(12) United States Patent
Zhou

(10) Patent No.: US 7,314,750 B2
(45) Date of Patent: Jan. 1, 2008

(54) ADDRESSABLE OLIGONUCLEOTIDE ARRAY OF THE RAT GENOME

(75) Inventor: Xue Mei Zhou, San Jose, CA (US)

(73) Assignee: Affymetrix, Inc., Santa Clara, CA (US)

( * ) Notice: Subject to any disclaimer, the term of this patent is extended or adjusted under 35 U.S.C. 154(b) by 217 days.

(21) Appl. No.: 10/719,956

(22) Filed: Nov. 20, 2003

(65) Prior Publication Data

US 2004/0146910 A1 Jul. 29, 2004

Related U.S. Application Data

(60) Provisional application No. 60/427,836, filed on Nov. 20, 2002.

(51) Int. Cl.
 C12M 1/34 (2006.01)
 C12M 3/00 (2006.01)
 C07H 21/04 (2006.01)
 C12Q 1/68 (2006.01)

(52) U.S. Cl. ............... 435/287.2; 435/91.1; 435/6; 536/23.1; 536/24.3

(58) Field of Classification Search ............... None
 See application file for complete search history.

(56) References Cited

U.S. PATENT DOCUMENTS

| | | | |
|---|---|---|---|
| 4,275,149 A | 6/1981 | Litman et al. | |
| 4,277,437 A | 7/1981 | Maggio | |
| 4,366,241 A | 12/1982 | Tom et al. | |
| 5,143,854 A | 9/1992 | Pirrung et al. | |
| 5,324,633 A | 6/1994 | Fodor et al. | |
| 5,474,796 A | * 12/1995 | Brennan | 427/2.13 |
| 5,679,523 A | 10/1997 | Li et al. | |
| 5,723,594 A | 3/1998 | Janjic et al. | |
| 5,800,992 A | 9/1998 | Fodor et al. | |
| 6,300,063 B1 | 10/2001 | Lipshutz et al. | |
| 6,309,822 B1 | 10/2001 | Fodor et al. | |

FOREIGN PATENT DOCUMENTS

| | | |
|---|---|---|
| WO | WO 90/15070 | 12/1990 |
| WO | WO 92/10092 | 6/1992 |
| WO | WO 92/10588 | 6/1992 |

OTHER PUBLICATIONS

Affymetrix Product Catalog, Jan. 2001, pp. 1-13.*
Gunther et al 'Analysis of the rat major histocompatibility system by Southern blot hybridization.' J Immunol. Feb. 1985;134(2):1257-61. □□*
Email (Apr. 11, 2006) from tao@ncib.nlm.nih.gov to Kapushoc, Stephen T. regarding the Rat UniGene Build 34 Release Date, pp. 1-2.*
Affymetrix DATA Sheet GeneChip Rat Genome 230 Array, pp. 1-4.*
Weaver I.C.G. et al 'Maternal care effects on the hippocampal transcriptome and anxiety-mediated behaviors in the offspring that are reversible in adulthood.' Proc Natl Acad Sci U S A. Feb. 28, 2006;103(9):3480-5.*
Stuart R.O. et al 'Changes in global gene expression patterns during development and maturation of the rat kidney.' Proc Natl Acad Sci U S A. May 8, 2001:98(10):5649-54.*
Fodor et al. "Light-directed, spatially addressable parallel chemical synthesis," Science. Feb. 15, 1991;251(4995):767-73.
Wodicka et al. "Genome-wide expression monitoring in *Saccharomyces cerevisiae*." Nat Biotechnol. Dec. 1997;15(13):1359-67.
Zhang et al. "Gene expression profiles in normal and cancer cells."Science. May 23, 1997;276(5316):1268-72.
Ramos-Nino et al. "Microarray analysis and RNA silencing link fra-1 to cd44 and c-met expression in mesothelioma." Cancer Res. Jul. 1, 2003;63(13):3539-45.
Qin et al. "Gene expression profiles and transcription factors involved in parathyroid hormone signaling in osteoblasts revealed by microarray and bioinformatics." J Biol Chem. May 30, 2003; 278(22):19723-31. Epub Mar. 18, 2003.
O'Connell et al. "A large scale genetic analysis of c-Myc-regulated gene expression patterns." J Biol Chem. Apr. 4, 2003;278(14)12563-73. Epub Jan. 14, 2003.
Naciff et al. "Gene expression profile induced by 17 alpha-ethynyl estradiol in the prepubertal female reproductive system of the rat." Toxicol Sci. Apr. 2003;72(2):314-30. Epub Mar. 7, 2003.
Warren et al. "The BMP antagonist noggin regulates cranial suture fusion." Nature. Apr. 10, 2003;422(6932):625-9.
Roberts and Szostak, "RNA-peptide fusions for the in vitro selection of peptides and proteins." Proc Natl Acad Sci U S A. Nov. 11, 1997;94(23):12297-302.
Cho et al. "Parallel analysis of genetic selections using whole genome oligonucleotide arrays." Proc Natl Acad Sci U S A. Mar. 31, 1998;95(7):3752-7.
Winkzeler et al. "Direct allelic variation scanning of the yeast genome." Science. Aug. 21, 1998;281(5380):1194-7.
Andersson et al. "Comparative genome organization of vertebrates. The First International Workshop on Comparative Genome Organization." Mamm Genome. Oct. 1996;7(10):717-34.
Shoemaker et al. "Quantitive phenotypic analysis of yeast deletion mutants using a highly parallel molecular bar-coding strategy." Nat Genet. Dec. 1996;14(4):450-6.

* cited by examiner

*Primary Examiner*—Ram R. Shukla
*Assistant Examiner*—Stephen Kapushoc
(74) *Attorney, Agent, or Firm*—Sandra E. Wells

(57) ABSTRACT

The invention provides nucleic acid sequences which are complementary, in one embodiment, to a wide variety of Rat genes. The invention provides the sequences in such a way as to make them available for a variety of analyses. In one embodiment the nucleic acid sequences provided are present as an array of probes that may be used to measure gene expression of at least 20,000 rat genes. As such, the invention relates to diverse fields impacted by the nature of molecular interaction, including chemistry, biology, medicine, and medical diagnostics.

10 Claims, No Drawings

ADDRESSABLE OLIGONUCLEOTIDE ARRAY OF THE RAT GENOME

RELATED APPLICATIONS

The present application claims priority to U.S. Provisional Application No. 60/427,836, filed Nov. 20, 2002, the disclosure of which is incorporated herein by reference in its entirety.

FIELD OF THE INVENTION

The present invention provides a unique pool of nucleic acid sequences useful for analyzing molecular interactions of biological interest. The invention therefore relates to diverse fields impacted by the nature of molecular interaction, including chemistry, biology, medicine, and medical diagnostics.

REFERENCE TO SEQUENCE LISTING

The Sequence Listing submitted on compact disk is hereby incorporated by reference. The file on the disk is named 3527.1seqlist.txt, the file is 101 MB and the date of creation is Nov. 20, 2003.

BACKGROUND OF THE INVENTION

Many biological functions are carried out by regulating the expression levels of various genes, either through changes in levels of transcription (e.g. through control of initiation, provision of RNA precursors, RNA processing, etc.) of particular genes, through changes in the copy number of the genetic DNA, through changes in RNA processing such as polyadenylation and splicing or RNA stability or through changes in protein synthesis. For example, control of the cell cycle and cell differentiation, as well as diseases, are characterized by the variations in the transcription levels of a group of genes. Gene expression is not only responsible for physiological functions, but also associated with pathogenesis. For example, the lack of sufficient functional tumor suppressor genes and/or the over expression of oncogene/protooncogenes leads to tumorgenesis. (See, e.g., Marshall, Cell, 64: 313-326 (1991) and Weinberg, Science, 254: 1138-1146 (1991)). Thus, changes in the expression levels of particular genes (e.g. oncogenes or tumor suppressors), serve as signposts for the presence and progression of various diseases.

As a consequence, novel techniques and apparatus are needed to study gene expression in specific biological systems.

SUMMARY OF THE INVENTION

The invention provides nucleic acid sequences which are complementary to particular rat genes and ESTs and makes them available for a variety of analyses, including, for example, gene expression analysis. In a preferred embodiment an array comprising nucleic acid probes where each probe is one of the sequences listed in SEQ ID Nos. 1-699,466 is disclosed. Each probe sequence may be present in a feature of known location that can be distinguished from other features that comprise probes of different sequence. For example, in one embodiment the invention comprises an array comprising any 10 or more, 100 or more, 1000, or more, 10,000 or more or 100,000 or more nucleic acid probes containing 9 or more consecutive nucleotides from the sequences listed in SEQ ID NOS: 1-699,466, or the perfect match, perfect mismatch, antisense match or antisense mismatch thereof. In a further embodiment, the invention comprises the use of any of the above arrays or fragments disclosed in SEQ ID Nos. 1-699,466 to: monitor gene expression levels by hybridization of the array to a DNA library; monitor gene expression levels by hybridization to an mRNA-protein fusion compound; identify polymorphisms; identify biallelic markers; produce genetic maps; analyze genetic variation; comparatively analyze gene expression between different species; analyze gene knockouts; or, to hybridize tag-labeled compounds. In a further embodiment the invention comprises a method of analysis comprising hybridizing one or more pools of nucleic acids to two or more of the fragments disclosed in SEQ ID Nos. 1-699,466 and detecting said hybridization. In a further embodiment the invention comprises the use of any one or more of the fragments disclosed in SEQ ID Nos. 1-699,466 as a primer for PCR. In a further embodiment the invention comprises the use of any one or more of the fragments disclosed in SEQ ID Nos. 1-699,466 as a ligand. In another embodiment each of the sequences in SEQ ID Nos. 1-699,466 is synthesized on an array as a probe and the array is used to monitor gene expression from a biological sample isolated from rat.

DETAILED DESCRIPTION OF THE INVENTION

The present invention has many preferred embodiments and relies on many patents, applications and other references for details known to those of the art. Therefore, when a patent, application, or other reference is cited or repeated below, it should be understood that it is incorporated by reference in its entirety for all purposes as well as for the proposition that is recited.

As used in this application, the singular form "a," "an," and "the" include plural references unless the context clearly dictates otherwise. For example, the term "an agent" includes a plurality of agents, including mixtures thereof.

An individual is not limited to a human being but may also be other organisms including but not limited to mammals, plants, bacteria, or cells derived from any of the above.

Throughout this disclosure, various aspects of this invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

The practice of the present invention may employ, unless otherwise indicated, conventional techniques and descriptions of organic chemistry, polymer technology, molecular biology (including recombinant techniques), cell biology, biochemistry, and immunology, which are within the skill of the art. Such conventional techniques include polymer array synthesis, hybridization, ligation, and detection of hybridization using a label. Specific illustrations of suitable techniques can be had by reference to the example herein below. However, other equivalent conventional procedures can, of course, also be used. Such conventional techniques and descriptions can be found in standard laboratory manuals such as *Genome Analysis: A Laboratory Manual Series (Vols. I-IV), Using Antibodies: A Laboratory Manual, Cells: A Laboratory Manual, PCR Primer: A Laboratory Manual,* and *Molecular Cloning: A Laboratory Manual* (all from Cold Spring Harbor Laboratory Press), Stryer, L. (1995) *Biochemistry* (4th Ed.) Freeman, N.Y., Gait, *"Oligonucleotide Synthesis: A Practical Approach"* 1984, *IRL Press, London*, Nelson and Cox (2000), *Lehninger, Principles of Biochemistry* 3$^{rd}$ Ed., W. H. Freeman Pub., New York, N.Y. and Berg et al. (2002) *Biochemistry*, 5$^{th}$ Ed., W. H. Freeman Pub., New York, N.Y., all of which are herein incorporated in their entirety by reference for all purposes.

The present invention can employ solid substrates, including arrays in some preferred embodiments. Methods and techniques applicable to polymer (including protein) array synthesis have been described in U.S. Ser. No. 09/536,841, WO 00/58516, U.S. Pat. Nos. 5,143,854, 5,242,974, 5,252, 743, 5,324,633, 5,384,261, 5,405,783, 5,424,186, 5,451,683, 5,482,867, 5,491,074, 5,527,681, 5,550,215, 5,571,639, 5,578,832, 5,593,839, 5,599,695, 5,624,711, 5,631,734, 5,795,716, 5,831,070, 5,837,832, 5,856,101, 5,858,659, 5,936,324, 5,968,740, 5,974,164, 5,981,185, 5,981,956, 6,025,601, 6,033,860, 6,040,193, 6,090,555, 6,136,269, 6,269,846 and 6,428,752, in PCT Applications Nos. PCT/US99/00730 (International Publication Number WO 99/36760) and PCT/US01/04285, which are all incorporated herein by reference in their entirety for all purposes.

Patents that describe synthesis techniques in specific embodiments include U.S. Pat. Nos. 5,412,087, 6,147,205, 6,262,216, 6,310,189, 5,889,165, and 5,959,098. Nucleic acid arrays are described in many of the above patents, but the same techniques are applied to polypeptide arrays.

Nucleic acid arrays that are useful in the present invention include those that are commercially available from Affymetrix (Santa Clara, Calif.) under the brand name GeneChip®. Example arrays are shown on the website at affymetrix.com.

The present invention also contemplates many uses for polymers attached to solid substrates. These uses include gene expression monitoring, profiling, library screening, genotyping and diagnostics. Gene expression monitoring, and profiling methods can be shown in U.S. Pat. Nos. 5,800,992, 6,013,449, 6,020,135, 6,033,860, 6,040,138, 6,177,248 and 6,309,822. Genotyping and uses therefore are shown in U.S. Ser. No. 60/319,253, Ser. No. 10/013,598, and U.S. Pat. Nos. 5,856,092, 6,300,063, 5,858,659, 6,284,460, 6,361,947, 6,368,799 and 6,333,179. Other uses are embodied in U.S. Pat. Nos. 5,871,928, 5,902,723, 6,045,996, 5,541,061, and 6,197,506. Genotyping arrays are described in U.S. patent application Ser. No. 10/681,773.

The present invention also contemplates sample preparation methods in certain preferred embodiments. Prior to or concurrent with genotyping, the genomic sample may be amplified by a variety of mechanisms, some of which may employ PCR. See, e.g., *PCR Technology: Principles and Applications for DNA Amplification* (Ed. H. A. Erlich, Freeman Press, NY, N.Y., 1992); *PCR Protocols: A Guide to Methods and Applications* (Eds. Innis, et al., Academic Press, San Diego, Calif., 1990); Mattila et al., *Nucleic Acids Res.* 19, 4967 (1991); Eckert et al., *PCR Methods and Applications* 1, 17 (1991); *PCR* (Eds. McPherson et al., IRL Press, Oxford); and U.S. Pat. Nos. 4,683,202, 4,683,195, 4,800,159 4,965,188, and 5,333,675, each of which is incorporated herein by reference in their entireties for all purposes. The sample may be amplified on the array. See, for example, U.S. Pat. No. 6,300,070 and U.S. patent application Ser. No. 09/513,300, which are incorporated herein by reference.

Other suitable amplification methods include the ligase chain reaction (LCR) (e.g., Wu and Wallace, *Genomics* 4, 560 (1989), Landegren et al., *Science* 241, 1077 (1988) and Barringer et al. *Gene* 89:117 (1990)), transcription amplification (Kwoh et al., *Proc. Natl. Acad. Sci. USA* 86, 1173 (1989) and WO88/10315), self-sustained sequence replication (Guatelli et al., *Proc. Nat. Acad. Sci. USA*, 87, 1874 (1990) and WO90/06995), selective amplification of target polynucleotide sequences (U.S. Pat. No. 6,410,276), consensus sequence primed polymerase chain reaction (CP-PCR) (U.S. Pat. No. 4,437,975), arbitrarily primed polymerase chain reaction (AP-PCR) (U.S. Pat. Nos. 5,413,909, 5,861,245) and nucleic acid based sequence amplification (NABSA). (See, U.S. Pat. Nos. 5,409,818, 5,554,517, and 6,063,603, each of which is incorporated herein by reference). Other amplification methods that may be used are described in, U.S. Pat. Nos. 5,242,794, 5,494,810, 4,988,617 and 6,582,938, each of which is incorporated herein by reference.

Additional methods of sample preparation and techniques for reducing the complexity of a nucleic sample are described in Dong et al., *Genome Research* 11, 1418 (2001), in U.S. Pat. Nos. 6,361,947, 6,391,592 and U.S. patent application Ser. No. 09/916,135, and U.S. patent Publication Nos. 20030096235, 20030082543, and 20030036069.

Methods for conducting polynucleotide hybridization assays have been well developed in the art. Hybridization assay procedures and conditions will vary depending on the application and are selected in accordance with the general binding methods known including those referred to in: Maniatis et al. *Molecular Cloning: A Laboratory Manual* (2$^{nd}$ Ed. Cold Spring Harbor, N.Y., 1989); Berger and Kimmel *Methods in Enzymology*, Vol. 152, *Guide to Molecular Cloning Techniques* (Academic Press, Inc., San Diego, Calif., 1987); Young and Davism, *P.N.A.S*, 80: 1194 (1983). Methods and apparatus for carrying out repeated and controlled hybridization reactions have been described in U.S. Pat. Nos. 5,871,928, 5,874,219, 6,045,996 and 6,386,749, 6,391,623 each of which are incorporated herein by reference The present invention also contemplates signal detection of hybridization between ligands in certain preferred embodiments. See U.S. Pat. Nos. 5,143,854, 5,578,832; 5,631,734; 5,834,758; 5,936,324; 5,981,956; 6,025,601; 6,141,096; 6,185,030; 6,201,639; 6,218,803; and 6,225,625, in U.S. Patent application 60/364,731 and in PCT Application PCT/US99/06097 (published as WO99/47964), each of which also is hereby incorporated by reference in its entirety for all purposes.

Methods and apparatus for signal detection and processing of intensity data are disclosed in, for example, U.S. Pat. Nos. 5,143,854, 5,547,839, 5,578,832, 5,631,734, 5,800, 992, 5,834,758; 5,856,092, 5,902,723, 5,936,324, 5,981, 956, 6,025,601, 6,090,555, 6,141,096, 6,185,030, 6,201, 639; 6,218,803; and 6,225,625, in U.S. Patent application 60/364,731 and in PCT Application PCT/US99/06097 (published as WO99/47964), each of which also is hereby incorporated by reference in its entirety for all purposes.

The practice of the present invention may also employ conventional biology methods, software and systems. Computer software products of the invention typically include computer readable medium having computer-executable instructions for performing the logic steps of the method of the invention. Suitable computer readable medium include floppy disk, CD-ROM/DVD/DVD-ROM, hard-disk drive, flash memory, ROM/RAM, magnetic tapes and etc. The computer executable instructions may be written in a suitable computer language or combination of several languages. Basic computational biology methods are described in, e.g. Setubal and Meidanis et al., *Introduction to Computational Biology Methods* (PWS Publishing Company, Boston, 1997); Salzberg, Searles, Kasif, (Ed.), *Computational Methods in Molecular Biology*, (Elsevier, Amsterdam, 1998); Rashidi and Buehler, *Bioinformatics Basics: Application in Biological Science and Medicine* (CRC Press, London, 2000) and Ouelette and Bzevanis *Bioinformatics: A Practical Guide for Analysis of Gene and Proteins* (Wiley & Sons, Inc., 2$^{nd}$ ed., 2001).

The present invention may also make use of various computer program products and software for a variety of purposes, such as probe design, management of data, analysis, and instrument operation. See, U.S. Pat. Nos. 5,593,839, 5,795,716, 5,733,729, 5,974,164, 6,066,454, 6,090,555, 6,185,561, 6,188,783, 6,223,127, 6,229,911 and 6,308,170.

Additionally, the present invention may have preferred embodiments that include methods for providing genetic information over networks such as the Internet as shown in U.S. patent application Ser. No. 10/063,559, 60/349,546, 60/376,003, 60/394,574, 60/403,381.

The present invention is related to U.S. patent application Ser. No. 10/607,108 which is herein incorporated by reference in its entirety.

I. Definitions

Massive Parallel Screening: The phrase "massively parallel screening" refers to the simultaneous screening of at least about 100, about 1000, about 10,000, about 100,000 or about 500,000 different nucleic acid hybridizations.

Nucleic Acid: The terms "nucleic acid" or "nucleic acid molecule" refer to a deoxyribonucleotide or ribonucleotide polymer in either single-or double-stranded form, and unless otherwise limited, would encompass analogs of natural nucleotides that can function in a similar manner as naturally occurring nucleotides. Nucleic acids may be derived from a variety or sources including, but not limited to, naturally occurring nucleic acids, clones, synthesis in solution or solid phase synthesis. A nucleic acid refers to a polymeric form of nucleotides of any length, either ribonucleotides, deoxyribonucleotides or peptide nucleic acids (PNAs), that comprise purine and pyrimidine bases, or other natural, chemically or biochemically modified, non-natural, or derivatized nucleotide bases. The backbone of the polynucleotide can comprise sugars and phosphate groups, as may typically be found in RNA or DNA, or modified or substituted sugar or phosphate groups. A polynucleotide may comprise modified nucleotides, such as methylated nucleotides, incorporation of phosphorothioate linkages, halogenated nucleosides and other nucleotide analogs. The sequence of nucleotides may be interrupted by non-nucleotide components. Thus the terms nucleoside, nucleotide, deoxynucleoside and deoxynucleotide generally include analogs such as those described herein. These analogs are those molecules having some structural features in common with a naturally occurring nucleoside or nucleotide such that when incorporated into a nucleic acid or oligonucleoside sequence, they allow hybridization with a naturally occurring nucleic acid sequence in solution. Typically, these analogs are derived from naturally occurring nucleosides and nucleotides by replacing and/or modifying the base, the ribose or the phosphodiester moiety. The changes can be tailor made to stabilize or destabilize hybrid formation or enhance the specificity of hybridization with a complementary nucleic acid sequence as desired.

Nucleic acids according to the present invention may include any polymer or oligomer of pyrimidine and purine bases, preferably cytosine, thymine, and uracil, and adenine and guanine, respectively. See Albert L. Lehninger, PRINCIPLES OF BIOCHEMISTRY, at 793-800 (Worth Pub. 1982). Indeed, the present invention contemplates any deoxyribonucleotide, ribonucleotide or peptide nucleic acid component, and any chemical variants thereof, such as methylated, hydroxymethylated or glucosylated forms of these bases, and the like. The polymers or oligomers may be heterogeneous or homogeneous in composition, and may be isolated from naturally-occurring sources or may be artificially or synthetically produced. In addition, the nucleic acids may be DNA or RNA, or a mixture thereof, and may exist permanently or transitionally in single-stranded or double-stranded form, including homoduplex, heteroduplex, and hybrid states.

An "oligonucleotide" or "polynucleotide" is a nucleic acid ranging from at least 2, preferably at least 8, 15 or 20 nucleotides in length, but may be up to 50, 100, 1000, or 5000 nucleotides long or a compound that specifically hybridizes to a polynucleotide. Polynucleotides of the present invention include sequences of deoxyribonucleic acid (DNA) or ribonucleic acid (RNA) or mimetics thereof which may be isolated from natural sources, recombinantly produced or artificially synthesized. A further example of a polynucleotide of the present invention may be a peptide nucleic acid (PNA). (See U.S. Pat. No. 6,156,501 which is hereby incorporated by reference in its entirety.) The invention also encompasses situations in which there is a nontraditional base pairing such as Hoogsteen base pairing which has been identified in certain tRNA molecules and postulated to exist in a triple helix. "Polynucleotide" and "oligonucleotide" are used interchangeably in this application.

Probe: As used herein a "probe" is defined as a nucleic acid capable of binding to a target nucleic acid of complementary sequence through one or more types of chemical bonds, usually through complementary base pairing, usually through hydrogen bond formation. As used herein, a probe may include natural (i.e. A, G, U, C, or T) or modified bases (7-deazaguanosine, inosine, etc.). In addition, a linkage other than a phosphodiester bond may join the bases in probes. Modifications in probes may be used to improve or alter hybridization properties. Thus, probes may be peptide nucleic acids in which the constituent bases are joined by peptide bonds rather than phosphodiester linkages. Other modifications may also be used, for example, methylation or inclusion of a label or dye.

The terms "mRNA or mRNA transcripts" as used herein, include, but not limited to pre-mRNA transcript(s), transcript processing intermediates, mature mRNA(s) ready for translation and transcripts of the gene or genes, or nucleic acids derived from the mRNA transcript(s). Transcript processing may include splicing, editing and degradation. As used herein, a nucleic acid derived from an mRNA transcript refers to a nucleic acid for whose synthesis the mRNA transcript or a subsequence thereof has ultimately served as a template. Thus, a cDNA reverse transcribed from an mRNA, an RNA transcribed from that cDNA, a DNA amplified from the cDNA, an RNA transcribed from the amplified DNA, etc., are all derived from the mRNA transcript and detection of such derived products is indicative of the presence and/or abundance of the original transcript in a sample. Thus, mRNA derived samples include, but are not limited to, mRNA transcripts of the gene or genes, cDNA reverse transcribed from the mRNA, cRNA transcribed from the cDNA, DNA amplified from the genes, RNA transcribed from amplified DNA, and the like.

Primer is a single-stranded oligonucleotide capable of acting as a point of initiation for template-directed DNA synthesis under suitable conditions e.g., buffer and temperature, in the presence of four different nucleoside triphosphates and an agent for polymerization, such as, for example, DNA or RNA polymerase or reverse transcriptase. The length of the primer, in any given case, depends on, for example, the intended use of the primer, and generally ranges from 15 to 30 nucleotides. Short primer molecules generally require cooler temperatures to form sufficiently stable hybrid complexes with the template. A primer need not reflect the exact sequence of the template but must be sufficiently complementary to hybridize with such template. The primer site is the area of the template to which a primer hybridizes. The primer pair is a set of primers including a 5' upstream primer that hybridizes with the 5' end of the sequence to be amplified and a 3' downstream primer that hybridizes with the complement of the 3' end of the sequence to be amplified.

Subsequence: "Subsequence" refers to a sequence of nucleic acids that comprise a part of a longer sequence of nucleic acids.

Perfect match: The term "match," "perfect match," "perfect match probe" or "perfect match control" refers to a nucleic acid that has a sequence that is designed to be perfectly complementary to a particular target sequence or portion thereof. For example, if the target sequence is 5'-GATTGCATA-3' the perfect complement is 5'-TATGCAATC-3'. Where the target sequence is longer than the probe the probe is typically perfectly complementary to a portion (subsequence) of the target sequence. For example, if the target sequence is a fragment that is 800 bases, the perfect match probe may be perfectly complementary to a 25 base region of the target. A perfect match (PM) probe can be a "test probe", a "normalization control" probe, an expression level control probe and the like. A perfect match control or perfect match is, however, distinguished from a "mismatch" or "mismatch probe."

Mismatch: The term "mismatch," "mismatch control" or "mismatch probe" refers to a nucleic acid whose sequence is deliberately designed not to be perfectly complementary to a particular target sequence. As a non-limiting example, for each mismatch (MM) control in a high-density probe array there typically exists a corresponding perfect match (PM) probe that is perfectly complementary to the same particular target sequence. The mismatch may comprise one or more bases. While the mismatch(es) may be located anywhere in the mismatch probe, terminal mismatches are less desirable because a terminal mismatch is less likely to prevent hybridization of the target sequence. In a particularly preferred embodiment, the mismatch is located at the center of the probe, for example if the probe is 25 bases the mismatch position is position 13, also termed the central position, such that the mismatch is most likely to destabilize the duplex with the target sequence under the test hybridization conditions. A homo-mismatch substitutes an adenine (A) for a thymine (T) and vice versa and a guanine (G) for a cytosine (C) and vice versa. For example, if the target sequence was: 5'-AGGTCCA-3', a probe designed with a single homo-mismatch at the central, or fourth position, would result in the following sequence: 3'-TCCTGGT-5', the PM probe would be 3'-TCCAGGT-5'.

Array: An "array" is a solid support with at least a first surface having a plurality of different nucleic acid sequences attached to the first surface. An array is an intentionally created collection of molecules which can be prepared either synthetically or biosynthetically. The molecules in the array can be identical or different from each other. The array can assume a variety of formats, e.g., libraries of soluble molecules; libraries of compounds tethered to resin beads, silica chips, or other solid supports. Additionally, the term "array" is meant to include those libraries of nucleic acids which can be prepared by spotting nucleic acids of essentially any length (e.g., from 1 to about 1000 nucleotide monomers in length) onto a substrate.

An array is an intentionally created collection of nucleic acids which can be prepared either synthetically or biosynthetically and screened for biological activity in a variety of different formats (e.g., libraries of soluble molecules; and libraries of oligos tethered to resin beads, silica chips, or other solid supports). Additionally, the term "array" is meant to include those libraries of nucleic acids which can be prepared by spotting nucleic acids of essentially any length (e.g., from 1 to about 1000 nucleotide monomers in length) onto a substrate.

"Solid support", "support", and "substrate" are used interchangeably and refer to a material or group of materials having a rigid or semi-rigid surface or surfaces. In many embodiments, at least one surface of the solid support will be substantially flat, although in some embodiments it may be desirable to physically separate synthesis regions for different compounds with, for example, wells, raised regions, pins, etched trenches, or the like. According to other embodiments, the solid support(s) will take the form of beads, resins, gels, microspheres, or other geometric configurations.

Gene Knockout: the term "gene knockout," as defined in Lodish et al. *Molecular Cell Biology* $3^{rd}$ *Edition*, Scientific American Books pub., which is hereby incorporated in its entirety for all purposes is, is a technique for selectively inactivating a gene by replacing it with a mutant allele in an otherwise normal organism.

DNA Library—as used herein the term "genomic library" or "genomic DNA library" refers to a collection of cloned DNA molecules consisting of fragments of the entire genome (genomic library) or of DNA copies of all the mRNA produced by a cell type (cDNA library) inserted into a suitable cloning vector.

A genome is all the genetic material of an organism. In some instances, the term genome may refer to the chromosomal DNA. Genome may be multichromosomal such that the DNA is cellularly distributed among a plurality of individual chromosomes. For example, in human there are 22 pairs of chromosomes plus a gender associated XX or XY pair. DNA derived from the genetic material in the chromosomes of a particular organism is genomic DNA. The term genome may also refer to genetic materials from organisms that do not have chromosomal structure. In addition, the term genome may refer to mitochondria DNA. A genomic library is a collection of DNA fragments representing the whole or a portion of a genome. Frequently, a genomic library is a collection of clones made from a set of randomly generated, sometimes overlapping DNA fragments representing the entire genome or a portion of the genome of an organism.

The term "chromosome" refers to the heredity-bearing gene carrier of a cell which is derived from chromatin and which comprises DNA and protein components (especially histones). The conventional internationally recognized individual human genome chromosome numbering system is employed herein. The size of an individual chromosome can vary from one type to another within a given multi-chromosomal genome and from one genome to another. In the case of the human genome, the entire DNA mass of a given chromosome is usually greater than about 100,000,000 bp. For example, the size of the entire human genome is about $3 \times 10^9$ bp. The largest chromosome, chromosome no. 1, contains about $2.4 \times 10^8$ bp while the smallest chromosome, chromosome no. 22, contains about $5.3 \times 10^7$ bp.

A "chromosomal region" is a portion of a chromosome. The actual physical size or extent of any individual chromosomal region can vary greatly. The term "region" is not necessarily definitive of a particular one or more genes because a region need not take into specific account the particular coding segments (exons) of an individual gene.

An allele refers to one specific form of a genetic sequence (such as a gene) within a cell, an individual or within a population, the specific form differing from other forms of the same gene in the sequence of at least one, and frequently more than one, variant sites within the sequence of the gene. The sequences at these variant sites that differ between different alleles are termed "variances", "polymorphisms", or "mutations". At each autosomal specific chromosomal location or "locus" an individual possesses two alleles, one inherited from one parent and one from the other parent, for example one from the mother and one from the father. An individual is "heterozygous" at a locus if it has two different alleles at that locus. An individual is "homozygous" at a locus if it has two identical alleles at that locus.

Polymorphism refers to the occurrence of two or more genetically determined alternative sequences or alleles in a population. A polymorphic marker or site is the locus at which divergence occurs. Preferred markers have at least two alleles, each occurring at frequency of greater than 1%, and more preferably greater than 10% or 20% of a selected population. A polymorphism may comprise one or more base changes, an insertion, a repeat, or a deletion. A polymorphic locus may be as small as one base pair. Polymorphic markers include restriction fragment length polymorphisms, variable number of tandem repeats (VNTR's), hypervariable regions, minisatellites, dinucleotide repeats, trinucleotide repeats, tetranucleotide repeats, simple sequence repeats, and insertion elements such as Alu. The first identified allelic form is arbitrarily designated as the reference form and other allelic forms are designated as alternative or variant alleles. The allelic form occurring most frequently in a selected population is sometimes referred to as the wildtype form. Diploid organisms may be homozygous or heterozygous for allelic forms. A diallelic polymorphism has two forms. A triallelic polymorphism has three forms. Single nucleotide polymorphisms (SNPs) are included in polymorphisms.

A genetic map is a map that presents the order of specific sequences on a chromosome. A genetic map expresses the positions of genes relative to each othere without a physical anchor on the chromosome. The distance between markers is typically determined by the frequency of recombination, which is related to the relative distance between markers. Genetic map distances are typically expressed as recombination units or centimorgans (cM). The physical map gives the position of a marker and its distance from other genes or markers on the same chromosome in base pairs and related to given positions along the chromosome. See, *Color Atlas of Genetics*, Ed. Passarge, Thieme, New York, N.Y. (2001), which is incorporated by reference. Genetic variation refers to variation in the sequence of the same region between two or more individuals.

Hybridization is the association of two complementary nucleic acid strands or their derivatives (such as PNA) to form double stranded molecules. Hybrids may contain, for example, two DNA strands, two RNA strands, or one DNA and one RNA strand.

Hybridization probes are oligonucleotides capable of binding in a base-specific manner to a complementary strand of nucleic acid. Such probes include peptide nucleic acids, as described in Nielsen et al., *Science* 254, 1497-1500 (1991), and other nucleic acid analogs and nucleic acid mimetics. See U.S. patent application Ser. No. 08/630,427.

Hybridizations are usually performed under stringent conditions, for example, at a salt concentration of no more than 1 M and a temperature of at least 25° C. For example, conditions of 5×SSPE (750 mM NaCl, 50 mM NaPhosphate, 5 mM EDTA, pH 7.4) and a temperature of 25-30° C. are suitable for allele-specific probe hybridizations. For stringent conditions, see, for example, Sambrook et al. which is hereby incorporated by reference in its entirety for all purposes above.

An mRNA-protein fusion is a compound whereby an mRNA is directly attached to the peptide or protein it encodes by a stable covalent linkage.

A ligand is any molecule, other than an enzyme substrate, that binds tightly and specifically to a macromolecule, for example, a protein, forming a macromolecule-ligand complex.

Complementary or substantially complementary: Refers to the hybridization or base pairing between nucleotides or nucleic acids, such as, for instance, between the two strands of a double stranded DNA molecule or between an oligonucleotide primer and a primer binding site on a single stranded nucleic acid to be sequenced or amplified. Complementary nucleotides are, generally, A and T (or A and U), or C and G. Two single stranded RNA or DNA molecules are said to be substantially complementary when the nucleotides of one strand, optimally aligned and compared and with appropriate nucleotide insertions or deletions, pair with at least about 80% of the nucleotides of the other strand, usually at least about 90% to 95%, and more preferably from about 98 to 100%. Alternatively, substantial complementary exists when an RNA or DNA strand will hybridize under selective hybridization conditions to its complement. Typically, selective hybridization will occur when there is at least about 65% complementary over a stretch of at least 14 to 25 nucleotides, preferably at least about 75%, more preferably at least about 90% complementary. S. ee, M. Kanehisa Nucleic Acids Res. 12:203 (1984), incorporated herein by reference.

Combinatorial Synthesis Strategy: A combinatorial synthesis strategy is an ordered strategy for parallel synthesis of diverse polymer sequences by sequential addition of reagents which may be represented by a reactant matrix and a switch matrix, the product of which is a product matrix. A reactant matrix is a l column by m row matrix of the building blocks to be added. The switch matrix is all or a subset of the binary numbers, preferably ordered, between 1 and m arranged in columns. A "binary strategy" is one in which at least two successive steps illuminate a portion, often half, of a region of interest on the substrate. In a binary synthesis strategy, all possible compounds which can be formed from an ordered set of reactants are formed. In most preferred embodiments, binary synthesis refers to a synthesis strategy which also factors a previous addition step. For example, a strategy in which a switch matrix for a masking strategy halves regions that were previously illuminated, illuminating about half of the previously illuminated region and protecting the remaining half (while also protecting about half of previously protected regions and illuminating about half of previously protected regions). It will be recognized that binary rounds may be interspersed with non-binary rounds and that only a portion of a substrate may be subjected to a binary scheme. A combinatorial "masking" strategy is a synthesis which uses light or other spatially selective deprotecting or activating agents to remove protecting groups from materials for addition of other materials such as amino acids.

Target nucleic acid: The term "target nucleic acid" or "target sequence" refers to a nucleic acid or nucleic acid sequence which is to be analyzed. A target can be a nucleic acid to which a probe will hybridize. The probe may or may not be specifically designed to hybridize to the target. It is either the presence or absence of the target nucleic acid that is to be detected, or the amount of the target nucleic acid that is to be quantified. The term target nucleic acid may refer to the specific subsequence of a larger nucleic acid to which the probe is directed or to the overall sequence (e.g., gene or mRNA) whose expression level it is desired to detect. The difference in usage will be apparent from context.

II. Rat Array

An array is disclosed that allows for simultaneous measurement of relative gene expression levels for at least 20,000 rat genes. Probes of the array are designed to be complementary to 25 contiguous bases of a selected gene. Mismatch probes may be included on the array for use as controls to measure discrimination and specificity. Antisense probes that are derived from the opposite strand of the gene may also be included. Other control sequence probes may also be included. Control probes may be included to assay for manufacturing defects, problems with sample preparation and problems with hybridization. In a preferred embodiment the array is a single solid support so that the expression levels for at least 20,000 rat genes may be simultaneously analyzed in a single experiment using a single hybridization. See, for example the U133 Plus 2.0 Array available from Affymetrix. This array allows analysis of over 47,000 human transcripts on a single chip. In another embodiment the probes are divided so that they are on two or more chips or solid supports. The arrays may also be attached to pegs for high throughput analysis.

SEQ ID Nos. 1-699,466, encompassed in the Sequence listing, presents target sequences included in the invention. Each target sequence corresponds to and represents at least four additional nucleic acid sequences included in the invention. For example, if the target to be hybridized to the array is 5'-gatgctacc-3' the probe sequences included in the invention which are represented by this nucleic acid sequence are, for example:

5'-ggtagcatc-3'=(perfect) sense match
5'-ggtaccatc-3'=sense mismatch
5'-gatgctacc-3'=(perfect) antisense match
5'-gatggtacc-3'=antisense mismatch Accordingly, for each nucleic acid sequence listed in SEQ ID Nos. 1-699,466, this disclosure includes the corresponding sense match, sense mismatch, antisense match and antisense mismatch. The position of the mismatch is not limited to the above example, it may be located anywhere in the nucleic acid sequence and may comprise one or more bases. In a preferred embodiment the mismatch is located at the central position of the probe, for example, position 13 of a 25 mer probe.

Consequently, the present invention includes: a) the target sequences listed in SEQ ID Nos. 1-699,466, or the sense-match, sense mismatch, antisense match or antisense mismatch thereof; b) clones which comprise the target nucleic acid sequences listed in SEQ ID Nos. 1-699,466, or the sense-match, sense mismatch, antisense match or antisense mismatch thereof; c) longer nucleotide sequences which include the nucleic acid sequences listed in SEQ ID Nos. 1-699,466, or the sense-match, sense mismatch, antisense match or antisense mismatch thereof and d) subsequences greater than 9 nucleotides in length of the target nucleic acid sequences listed in SEQ ID Nos. 1-699,466, or the sense match, sense mismatch, antisense match or antisense mismatch.

Target sequences were chosen to include more than 24,000 full-length rat genes and EST clusters. These sequences were chosen as predicted coding sequences from genomic BAC entries. The EST clusters share homology with the predicted coding sequences from BAC cones. Target sequences were selected using the computer based methods described in U.S. patent application No. 6,309,822 incorporated herein by reference for all purposes.

Each target sequence listed in SEQ ID NOS 1-699,466 corresponds to a GenBank database accession number. These accession numbers allow for the identification of sequences located in the GenBank sequence database through the use of computer programs such as BLAST. Access to BLAST is available to the public through the internet at, for example, the website hosted by the National Center for Biotechnology Information (NCBI). One of skill in the art will be familiar with the use of the BLAST program to obtain information about particular sequences in order to, for example, determine the GenBank accession number, determine the species from which the sequence is derived, determine the gene from which the sequence is derived, to determine other genes and species which contain similar sequences and to determine the degree of similarity between one sequence and another. All information relating to the target sequences available through the GenBank database is hereby incorporated by reference for all purposes.

When measuring expression one of skill in the art will recognize that the probes of the array should be designed to be complementary to the sequence to be detected. This may vary depending on which amplification method is used. For example, one method of amplification calls for reverse transcription of the mRNA using an oligo-dt-T7 primer. Double stranded cDNA with an RNA polymerase promoter is then generated and antisense RNA is transcribed and labeled. The antisense RNA is then hybridized to the array. The antisense RNA is complementary to the mRNA so the sense probe on the array that is designed to hybridize to the antisense RNA is identical in sequence to a portion of the starting mRNA. In another method the amplified RNA to be hybridized to the array is sense, meaning that it has the same sequence as the starting mRNA. In other embodiments the amplification product that is hybridized to the array may be cDNA that may be of the sense (same as) or antisense (complement of) orientation relative to the starting mRNA.

The present invention provides a pool of unique nucleotide sequences complementary to Rat sequences in particular embodiments which alone, or in combinations of 2 or more, 10 or more, 100 or more, 1,000 or more, 10,000 or more, or 100,000 or more, can be used for a variety of applications.

In one embodiment, the present invention provides for a pool of unique nucleotide sequences which are complementary to approximately 24,000 rat full-length genes and EST clusters from Unigene database (build 99) formed into a high density array of probes suitable for array based massive parallel gene expression. Array based methods for monitoring gene expression are disclosed and discussed in detail in U.S. Pat. No. 5,800,992, U.S. Pat. No. 6,309,822, and PCT Application WO 92/10588 (published on Jun. 25, 1992), all of which are incorporated herein by reference for all purposes. Generally those methods of monitoring gene expression involve (1) providing a pool of target nucleic acids comprising RNA transcript(s) of one or more target gene(s), or nucleic acids derived from the RNA transcript(s); (2) hybridizing the nucleic acid sample to a high density array of probes and (3) detecting the hybridized nucleic acids and calculating a relative expression (transcription, RNA processing or degradation) level.

The development of Very Large Scale Immobilized Polymer Synthesis or VLSIPS™ technology has provided methods for making very large arrays of nucleic acid probes in very small arrays. See U.S. Pat. No. 5,143,854 and PCT Patent Publication Nos. WO 90/15070 and WO 92/10092, and Fodor et al., *Science*, 251, 767-77 (1991), each of which is incorporated herein by reference. U.S. patent application Ser. No. 5,800,992, describes methods for making arrays of nucleic acid probes that can be used to detect the presence of a nucleic acid containing a specific nucleotide sequence. Methods of forming high density arrays of nucleic acids, peptides and other polymer sequences with a minimal number of synthetic steps are known. The nucleic acid array can be synthesized on a solid substrate by a variety of methods, including, but not limited to, light-directed chemical coupling, and mechanically directed coupling.

In a preferred detection method, the array of immobilized nucleic acids, or probes, is contacted with a sample containing target nucleic acids, to which a flourescent label is attached. Target nucleic acids hybridize to the probes on the array and any non-hybridized nucleic acids are removed. The array containing the hybridized target nucleic acids are exposed to light which excites the flourescent label. The resulting flourescent intensity, or brightness, is detected. Relative brightness is used to determine which probe is the best candidate for the perfect match to the hybridized target nucleic acid because flourescent intensity (brightness) corresponds to binding affinity. Once the position of the perfect match probe is known, the sequence of the hybridized target nucleic is known because the sequence and position of the probe is known.

In the array of the present invention the probes are presented in pairs, one probe in each pair being a perfect match to the target sequence and the other probe being identical to the perfect match probe except that the central base is a homo-mismatch. Mismatch probes provide a control for non-specific binding or cross-hybridization to a nucleic acid in the sample other than the target to which the probe is directed. Thus, mismatch probes indicate whether hybridization is or is not specific. For example, if the target is present, the perfect match probes should be consistently brighter than the mismatch probes because fluorescence intensity, or brightness, corresponds to binding affinity. (See, for example U.S. Pat. No. 5,324,633, which is incorporated herein for all purposes.) In addition, if all central mismatches are present, the mismatch probes can be used to detect a mutation. Finally the difference in intensity between the perfect match and the mismatch probe (I(PM)-I(MM)) provides a good measure of the concentration of the hybridized material. See pending PCT Application No. 98/11223, which is incorporated herein by reference for all purposes. The probe pairs are presented in both sense and antisense orientation, thereby eliciting a total of four probes per target sequence: sense match, sense mismatch, antisense match and antisense mismatch.

In another embodiment, the current invention provides a pool of sequences which may be used as probes for their complementary genes listed in the Genbank database. Methods for making probes are well known. See for example Sambrook, Fritsche and Maniatis. "Molecular Cloning A laboratory Manual" $2^{nd}$ Ed. Cold Spring Harbor Press (1989) ("Maniatis et al.") which is hereby incorporated in its entirety by reference for all purposes. Maniatis et al. describes a number of uses for nucleic acid probes of defined sequence. Some of the uses described by Maniatis et al. include: to screen cDNA or genomic DNA libraries, or subclones derived from them, for additional clones containing segments of DNA that have been isolated and previously sequenced; in Southern, northern, or dot-blot hybridization to identify or detect the sequences of specific genes; in Southern, or dot-blot hybridization of genomic DNA to detect specific mutations in genes of known sequence; to detect specific mutations generated by site-directed mutagenesis of cloned genes; and to map the 5' termini of mRNA molecules by primer extensions. Maniatis et al. describes other uses for probes throughout. See also Alberts et al. *Molecular Biology of the Cell* $3^{rd}$ edition, Garland Publishing Inc. (1994) p. 307 and Lodish et al. *Molecular Cell Biology*, $3^{rd}$ edition, Scientific American Books (1995) p. 285-286, each of which is hereby incorporated by reference in its entirety for all purposes, for a brief discussion of the use of nucleic acid probes in in situ hybridization. Other uses for probes derived from the sequences disclosed in this invention will be readily apparent to those of skill in the art. See, for example, Lodish et al. *Molecular Cell Biology*, $3^{rd}$ edition, Scientific American Books (1995) p.229-233, incorporated above, for a description of the construction of genomic libraries.

In another embodiment, the current invention may be combined with known methods to monitor expression levels of genes in a wide variety of contexts. For example, where the effects of a drug on gene expression are to be determined, the drug will be administered to an organism, a tissue sample, or a cell and the gene expression levels will be analyzed. For example, nucleic acids are isolated from the treated tissue sample, cell, or a biological sample from the organism and from an untreated organism tissue sample or cell, hybridized to a high density probe array containing probes directed to the gene of interest and the expression levels of that gene are determined. The types of drugs that may be used in these types of experiments include, but are not limited to, antibiotics, antivirals, narcotics, anti-cancer drugs, tumor suppressing drugs, and any chemical composition which may affect the expression of genes in vivo or in vitro. The current invention is particularly suited to be used in the types of analyses described by, for example, pending U.S. application No. 6,309,822 and PCT Application No. 98/11223, each of which is incorporated by reference in its entirety for all purposes. As described in Wodicka et al., Nature Biotechnology 15 (1997), hereby incorporated by reference in its entirety for all purposes, because mRNA hybridization correlates to gene expression level, hybridization patterns can be compared to determine differential gene expression. As non-limiting examples: hybridization patterns from samples treated with certain types of drugs may be compared to hybridization patterns from samples which have not been treated or which have been treated with a different drug; hybridization patterns for samples infected with a specific virus may be compared against hybridization patterns from non-infected samples; hybridization patterns for samples with cancer may be compared against hybridization patterns for samples without cancer; hybridization patterns of samples from cancerous cells which have been treated with a tumor suppressing drug may be compared against untreated cancerous cells, etc. Zhang et al., Science 276 1268-1272, hereby incorporated by reference in its entirety for all purposes, provides an example of how gene expression data can provide a great deal of insight into cancer research. One skilled in the art will appreciate that a wide range of applications will be available using 2 or more, 10 or more, 100 or more, 1000 or more, 10,000 or more or 100,000 or more of the SEQ ID Nos. 1-699,466 sequences as probes for gene expression analysis.

The combination of the nucleic array technology and the Rat specific probes in this disclosure is a powerful tool for studying gene expression. Rat arrays have been used by researchers in a variety of studies. See, for example, Ramos-Nino, M. E. et al. Cancer Research 63, 3539-45, 2003, Qin, L. et al. Journal of Biological Chemistry 278(22), 19723-31, 2003, O' Connell, B. C. et al. Journal of Biological Chemistry 278(14), 12563-73, 2003, Naciff, J. M. et al. Toxicological Sciences 72(2), 314-30, 2003, and Warren, S. M. et al. Nature 422(10), 625-9, 2003.

In another embodiment, the invention may be used in conjunction with the techniques which link specific proteins to the mRNA which encodes the protein. (See for example Roberts and Szostak Proc. Natl, Acad. Sci. 94 12297-12302 (1997), which is incorporated herein in its entirety for all purposes.) Hybridization of these mRNA-protein fusion compounds to arrays comprised of 2 or more, 10 or more, 100 or more, 1000 or more, 10,000 or more, or 100,000 or more the sequences disclosed in the present invention provides a powerful tool for monitoring expression levels.

In one embodiment, the current invention provides a pool of unique nucleic acid sequences which can be used for parallel analysis of gene expression under selective conditions. Without wishing to be limited, genetic selection under selective conditions could include: variation in the temperature of the organism's environment; variation in pH levels in the organism's environment; variation in an organism's food (type, texture, amount etc.); variation in an organism's surroundings; etc. Arrays, such as those in the present invention, can be used to determine whether gene expression is altered when an organism is exposed to selective conditions.

Methods for using nucleic acid arrays to analyze genetic selections under selective conditions are known. (See for example, R. Cho et al., Proc. Natl. Acad. Sci. 95 3752-3757 (1998), incorporated herein in its entirety for all purposes.) Cho et al. describes the use of a high-density array containing oligonucleotides complementary to every gene in the yeast *Saccharomyces cerevisiae* to perform two-hybrid protein-protein interaction screens for *S. cerevisiae* genes implicated in mRNA splicing and microtubule assembly. Cho et al. was able to characterize the results of a screen in a single experiment by hybridization of labeled DNA derived from positive clones. Briefly, as described by Cho et al., two proteins are expressed in yeast as fusions to either the DNA-binding domain or the activation domain of a transcription factor. Physical interaction of the two proteins reconstitutes transcriptional activity, turning on a gene essential for survival under selective conditions. In screening for novel protein-protein interactions, yeast cells are first transformed with a plasmid encoding a specific DNA-binding fusion protein. A plasmid library of activation domain fusions derived from genomic DNA is then introduced into these cells. Transcriptional activation fusions found in cells that survive selective conditions are considered to encode peptide domains that may interact with the DNA-binding domain fusion protein. Clones are then isolated from the two-hybrid screen and mixed into a single pool. Plasmid DNA is purified from the pooled clones and the gene inserts are amplified using PCR. The DNA products are then hybridized to yeast whole genome arrays for characterization. The methods employed by Cho et al. are applicable to the analysis of a range of genetic selections. High density arrays created using two or more, 10 or more, 100 or more, 1000 or more, 10,000 or more, or 100,000 or more of the sequences disclosed in the current invention can be used to analyze genetic selections in the rat system using the methods described in Cho et al.

In another embodiment, the current invention provides a pool of unique nucleic acid sequences which can be used to identify biallelic markers, providing a novel and efficient approach to the study of genetic variation. For example, methods for using high density arrays comprised of probes which are complementary to the genomic DNA of a particular species to interrogate polymorphisms are well known. (See for example, U.S. Pat. No. 6,300,063 which is hereby incorporated by reference herein for all purposes.) Pools of 2 or more, 10 or more, 100 or more, 1000 or more, 10,000 or more, or 100,000 or more of the sequences disclosed in this invention combined with the methods described in the above patent provides a tool for studying genetic variation in the Rat system.

In another embodiment genetic variation may be correlated with variation in gene expression pattern. Much of the genetic variation between individuals is the result of single nucleotide polymorphisms (SNPs). The presence of SNPs in or near a gene may result in differences in gene expression, which may result, for example, from changes in the rate of transcription, the stability of the mRNA, splicing of the mRNA, or translation of the mRNA. In one embodiment an array comprising SEQ ID Nos. 1-699,466 and probes to genotype selected SNPs in the rat genome may be used to monitor genotype and expression changes that correlate with differences in genotype.

In another embodiment of the invention, genetic variation can be used to produce genetic maps of various strains of Rat. Winzeler et al., "Direct Allelic Variation Scanning of the Yeast Genome" Science. 281(5380):1194-7. (1998), which is hereby incorporated for all purposes describes methods for conducting this type of screening with arrays containing probes complementary to the yeast genome. Briefly, genomic DNA from strains which are phenotypically different is isolated, fragmented, and labeled. Each strain is then hybridized to identical arrays comprised of the nucleic acid sequences complementary to the system being studied. Comparison of hybridization patterns between the various strains then serve as genetic markers. As described by Winzler et al, these markers can then be used for linkage analysis. High density arrays created from 2 or more, 10 or more, 100 or more, 1000 or more, 10,000 or more, or 100,000 or more of the sequences disclosed in this invention can be used to study genetic variation using the methods described by Winzler et al.

In another embodiment, the present invention may be used for cross-species comparisons. One skilled in the art will appreciate that it is often useful to determine whether a gene present in one species, for example rat, is present in a conserved format in another species, including, without limitation, Drosophila, human, chicken, zebrafish, *Escherichia coli*, mouse or yeast. See, for example, Andersson et al., Mamm. Genome 7(10):717-734 (1996), which is hereby incorporated by reference for all purposes, which describes the utility of cross-species comparisons. The use of 2 or more, 10 or more, 100 or more, 1000 or more, 10,000 or more or 100,000 or more of the sequences disclosed in this invention in an array can be used to determine whether any of the sequence from one or more of the rat genes represented by the sequences disclosed in this invention is conserved in another species by, for example, hybridizing genomic nucleic acid samples from another species to an array comprised of the sequences disclosed in this invention. Areas of hybridization will yield genomic regions where the nucleotide sequence is highly conserved between the interrogation species and the rat.

In another embodiment, the present invention may be used to characterize the genotype of knockouts. Methods for using gene knockouts to identify a gene are well known. See for example, Lodish et al. *Molecular Cell Biology*, 3$^{rd}$ *Edition*, Scientific American Books pub pp. 292-296 and U.S. Pat. No. 5,679,523, which are hereby incorporated by reference for all purposes. By isolating genomic nucleic acid samples from knockout species with a known phenotype and hybridizing the samples to an array comprised of 2 or more, 10 or more, 100 or more, 1000 or more, 10,000 or more, or 100,000 or more of the sequences disclosed in this invention, candidates genes which contribute to the phenotype will be identified and made accessible for further characterization.

In another embodiment, the present invention may be used to identify new gene family members. Methods of screening libraries with probes are well known. (See, for example, Maniatis et al, incorporated by reference above.) Because the present invention is comprised of nucleic acid sequences from specific known genes, 2 or more, 10 or more, 100 or more, 1000 or more, 10,000 or more, or 100,000 or more of sequences disclosed in this invention may be used as probes to screen genomic libraries to look for additional family members of those genes from which the target sequences are derived.

In another embodiment, the present invention may be used to provide nucleic acid sequences to be used as tag sequences. Tag sequences are a type of genetic "bar code" which can be used to label compounds of interest. The analysis of deletion mutants using tag sequences is described in, for example, Shoemaker et al., Nature Genetics 14 450-456 (1996), which is hereby incorporated by reference in its entirety for all purposes. Shoemaker et al. describes the use of PCR to generate large numbers of deletion strains. Each deletion strain is labeled with a unique 20-base tag sequence that can be hybridized to a high-density oligonucleotide array. The tags serve as unique identifiers (molecular bar codes) that allow analysis of large numbers of deletion strains simultaneously through selective growth conditions. The use of tag sequences need not be limited to this example however. The utility of using unique known short oligonucleotide sequences capable of hybridizing to a nucleic acid array to label various compounds will be apparent to one skilled in the art. One or more, 10 or more, 100 or more, 1000 or more, 10,000 or more, or 100,000 or more of the SEQ ID Nos. 1-699,466 sequences are excellent candidates to be used as tag sequences.

In another embodiment of the invention, the sequences of this invention may be used to generate primers directed to their corresponding genes as disclosed in the Genbank or any other public database. These primers may be used in such basic techniques as sequencing or PCR, see for example Maniatis et al., incorporated by reference above.

In another embodiment, the invention provides a pool of nucleic acid sequences to be used as ligands for specific genes. The sequences disclosed in this invention may be used as ligands to their corresponding genes as disclosed in the Genbank or any other public database. Compounds which specifically bind known genes are of interest for a variety of uses. One particular clinical use is to act as an antisense protein which specifically binds and disables a gene which has been, for example, linked to a disease. Methods and uses for ligands to specific genes are known. See for example, U.S. Pat. No. 5,723,594, which is hereby incorporated by reference in its entirety for all purposes.

In a preferred embodiment, the hybridized nucleic acids are detected by detecting one or more labels attached to the sample nucleic acids. The labels may be incorporated by any of a number of means well known to those of skill in the art. In one embodiment, the label is simultaneously incorporated during the amplification step in the preparation of the sample nucleic acids. Thus, for example, polymerase chain reaction (PCR) with labeled primers or labeled nucleotides will provide a labeled amplification product. In another embodiment, transcription amplification, as described above, using a labeled nucleotide (e.g. fluorescein-labeled UTP and/or CTP) incorporates a label into the transcribed nucleic acids.

Alternatively, a label may be added directly to the original nucleic acid sample (e.g., mRNA, polyA mRNA, cDNA, etc.) or to the amplification product after the amplification is completed. Means of attaching labels to nucleic acids are well known to those of skill in the art and include, for example nick translation or end-labeling (e.g. with a labeled RNA) by kinasing of the nucleic acid and subsequent attachment (ligation) of a nucleic acid linker joining the sample nucleic acid to a label (e.g., a fluorophore).

Detectable labels suitable for use in the present invention include any composition detectable by spectroscopic, photochemical, biochemical, immunochemical, electrical, optical or chemical means. Useful labels in the present invention include biotin for staining with labeled streptavidin conjugate, magnetic beads (e.g., Dynabeads™), fluorescent dyes (e.g., fluorescein, texas red, rhodamine, green fluorescent protein, and the like), radiolabels (e.g., $^3$H, $^{125}$I, $^{35}$S, $^{14}$C, or $^{32}$P), phosphorescent labels, enzymes (e.g., horse radish peroxidase, alkaline phosphatase and others commonly used in an ELISA), and colorimetric labels such as colloidal gold or colored glass or plastic (e.g., polystyrene, polypropylene, latex, etc.) beads. Patents teaching the use of such labels include U.S. Pat. Nos. 3,817,837; 3,850,752; 3,939,350; 3,996,345; 4,277,437; 4,275,149; and 4,366,241, each of which is hereby incorporated by reference in its entirety for all purposes.

Means of detecting such labels are well known to those of skill in the art. Thus, for example, radiolabels may be detected using photographic film or scintillation counters, fluorescent markers may be detected using a photodetector to detect emitted light. Enzymatic labels are typically detected by providing the enzyme with a substrate and detecting the reaction product produced by the action of the enzyme on the substrate, and colorimetric labels are detected by simply visualizing the colored label.

The label may be added to the target nucleic acid(s) prior to, or after the hybridization. So called "direct labels" are detectable labels that are directly attached to or incorporated into the target nucleic acid prior to hybridization. In contrast, so called "indirect labels" are joined to the hybrid duplex after hybridization. Often, the indirect label is attached to a binding moiety that has been attached to the target nucleic acid prior to the hybridization. Thus, for example, the target nucleic acid may be biotinylated before the hybridization. After hybridization, an aviden-conjugated fluorophore will bind the biotin bearing hybrid duplexes providing a label that is easily detected. For a detailed review of methods of labeling nucleic acids and detecting labeled hybridized nucleic acids see *Laboratory Techniques in Biochemistry and Molecular Biology*, Vol. 24: *Hybridization With Nucleic Acid Probes*, P. Tijssen, ed. Elsevier, N.Y., (1993), which is hereby incorporated by reference in its entirety for all purposes.

Fluorescent labels are preferred and easily added during an in vitro transcription reaction. In a preferred embodiment, fluorescein labeled UTP and CTP are incorporated into the RNA produced in an in vitro transcription reaction as described above.

EXAMPLE

The following example serves to illustrate the type of experiment that could be conducted using the invention.

Expression Monitoring by Hybridization to High Density Oligonucleotide Arrays

Arrays containing the desired number of probes can be synthesized using the method described in U.S. Pat. No. 5,143,854, incorporated by reference above. Extracted poly (A)$^+$RNA can then be coverted to cDNA using the methods described below. The cDNA is then transcribed in the presence of labeled ribonucleotide triphosphates. The label may be biotin or a dye such as fluorescein. RNA is then fragmented with heat in the presence of magnesium ions. Hybridizations are carried out in a flow cell that contains the two-dimensional DNA probe arrays. Following a brief washing step to remove unhybridized RNA, the arrays are scanned using a scanning confocal microscope.

1. A Method of RNA Preparation:

Labeled RNA is prepared from clones containing a T7 RNA polymerase promoter site by incorporating labeled ribonucleotides in an IVT reaction. Either biotin-labeled or fluorescein-labeled UTP and CTP (1:3 labeled to unlabeled) plus unlabeled ATP and GTP is used for the reaction with 2500 U of T7 RNA polymerase. Following the reaction unincorporated nucleotide triphosphates are removed using size-selective membrane such as Microcon-100, (Amicon, Beverly, Mass.). The total molar concentration of RNA is based on a measurement of the absorbance at 260 nm. Following quantitation of RNA amounts, RNA is fragmented randomly to an average length of approximately 50 bases by heating at 94° in 40 mM Tris-acetate pH 8.1, 100 mM potassium acetate, 30 mM magnesium acetate, for 30 to 40 min. Fragmentation reduces possible interference from RNA secondary structure, and minimizes the effects of multiple interactions with closely spaced probe molecules. For material made directly from cellular RNA, cytoplasmic RNA is extracted from cells by the method of Favaloro et al. Methods Enzymol. 65:718-749 (1980) hereby incorporated by reference for all purposes, and poly $(A)^+$ RNA is isolated with an oligo dT selection step using, for example, Poly Atract, (Promega, Madison, Wis.). RNA can be amplified using a modification of the procedure described by Eberwine et al. Proc. Natl. Acad. Sci. USA 89:3010-3014 (1992), hereby incorporated by reference for all purposes. Microgram amounts of poly $(A)^+$ RNA are converted into double stranded cDNA using a cDNA synthesis kit (kits may be obtained from Life Technologies, Gaithersburg, Md.) with an oligo dT primer incorporating a T7 RNA polymerase promoter site. After second-strand synthesis, the reaction mixture is extracted with phenol/chloroform, and the double-stranded DNA isolated using a membrane filtration step using, for example, Microcon-100, (Amicon). Labeled cRNA can be made directly from the cDNA pool with an IVT step as described above. The total molar concentration of labeled cRNA is determined from the absorbance at 260 nm and assuming an average RNA size of 1000 ribonucleotides. The commonly used convention is that 1 OD is equivalent to 40 ug of RNA, and that 1 ug of cellular mRNA consists of 3 pmol of RNA molecules. Cellular mRNA may also be labeled directly without any intermediate cDNA synthesis steps. In this case, Poly $(A)^+$ RNA is fragmented as described, and the 5' ends of the fragments are kinased and then incubated overnight with a biotinylated oligoribonucleotide (5'-biotin-AAAAAA-3') in the presence of T4 RNA ligase (available from Epicentre Technologies, Madison, Wis.). Alternatively, mRNA has been labeled directly by UV-induced cross-linking to a psoralen derivative linked to biotin (available from Schleicher & Schuell, Keene, N.H.).

2. Array Hybridization and Scanning:

Array hybridization solutions can be made containing 0.9 M NaCl, 60 mM EDTA, and 0.005% Triton X-100, adjusted to pH 7.6 (referred to as 6×SSPE-T). In addition, the solutions should contain 0.5 mg/ml unlabeled, degraded herring sperm DNA (available from Sigma, St. Louis, Mo.). Prior to hybridization, RNA samples are heated in the hybridization solution to 99° C. for 10 min, placed on ice for 5 min, and allowed to equilibrate at room temperature before being placed in the hybridization flow cell. Following hybridization, the solutions are removed, the arrays washed with 6×SSPE-T at 22 C for 7 min, and then washed with 0.5×SSPE-T at 40° C. for 15 min. When biotin labeled RNA is used the hybridized RNA should be stained with a streptavidin-phycoerythrin in 6×SSPE-T at 40° C. for 5 min. The arrays are read using a scanning confocal microscope made by Molecular Dynamics (commercially available through Affymetrix, Santa Clara, Calif.). The scanner uses an argon ion laser as the excitation source, with the emission detected by a photomultiplier tube through either a 530 nm bandpass filter (flourescein) or a 560 nm longpass filter (phycoerythrin). Nucleic acids of either sense or antisense orientations may be used in hybridization experiments. Arrays for probes with either orientation (reverse complements of each other) are made using the same set of photolithgraphic masks by reversing the order of the photochemical steps and incorporating the complementary nucleotide.

3. Quantitative Analysis of Hybridization Patterns and Intensities:

Following a quantitative scan of an array, a grid is aligned to the image using the known dimensions of the array and the corner control regions as markers. The image is then reduced to a simple text file containing position and intensity information using software developed at Affymetrix (available with the confocal scanner). This information is merged with another text file that contains information relating physical position on the array to probe sequence and the identity of the RNA (and the specific part of the RNA) for which the oligonucleotide probe is designed. The quantitative analysis of the hybridization results involves a simple form of pattern recognition based on the assumption that, in the presence of a specific RNA, the perfect match (PM) probes will hybridize more strongly on average than their mismatch (MM) partners. The number of instances in which the PM hybridization is larger than the MM signal is computed along with the average of the logarithm of the PM/MM ratios for each probe set. These values are used to make a decision (using a predefined decision matrix) concerning the presence or absence of an RNA. To determine the quantitative RNA abundance, the average of the difference (PM-MM) for each probe family is calculated. The advantage of the difference method is that signals from random cross-hybridization contribute equally, on average, to the PM and MM probes, while specific hybridization contributes more to the PM probes. By averaging the pairwise differences, the real signals add constructively while the contributions from cross-hybridization tend to cancel. When assessing the differences between two different RNA samples, the hybridization signals from side-by-side experiments on identically synthesized arrays are compared directly. The magnitude of the changes in the average of the difference (PM-MM) values is interpreted by comparison with the results of spiking experiments as well as the signals observed for the internal standard bacterial and phase RNAs spiked into each sample at a known amount. Data analysis programs, such as those described in U.S. Pat. No. 6,600,996 perform these operations automatically. For additional methods of expression analysis see the GeneChip® Expression Analysis Technical Manual (2003), available from Affymetrix, Inc. which is hereby incorporated by reference for all purposes.

CONCLUSION

The inventions herein provide a pool of unique nucleic acid sequences which are complementary to approximately 24,000 full-length rat genes and EST clusters from Unigene database (build 99). These sequences can be used for a variety of types of analyses.

The above description is illustrative and not restrictive. Many variations of the invention will become apparent to those of skill in the art upon review of this disclosure. The scope of the invention should, therefore, be determined not with reference to the above description, but instead be determined with reference to the appended claims along with their full scope of equivalents.

SEQUENCE LISTING (699466 sequences)

SEQ ID NO: 1 - DNA, 25 bp, Rattus norvegicus
aaaaaacaactgctcaaccctatca

SEQ ID NO: 2 - DNA, 25 bp, Rattus norvegicus
aaaaaacaactggtcaaccctatca

SEQ ID NO: 3 - DNA, 25 bp, Rattus norvegicus
aaaaaacacattcccctctttgctg

SEQ ID NO: 4 - DNA, 25 bp, Rattus norvegicus
aaaaaacacattgccctctttgctg

SEQ ID NO: 5 - DNA, 25 bp, Rattus norvegicus
aaaaaacaccccagtctgtcacctg

SEQ ID NO: 6 - DNA, 25 bp, Rattus norvegicus
aaaaaacacccctgtctgtcacctg

SEQ ID NO: 7 - DNA, 25 bp, Rattus norvegicus
aaaaaacactggctttcactcctat

SEQ ID NO: 8 - DNA, 25 bp, Rattus norvegicus
aaaaaacactgggtttcactcctat

SEQ ID NO: 9 - DNA, 25 bp, Rattus norvegicus
aaaaaacagaggctcctgcccatct

SEQ ID NO: 10 - DNA, 25 bp, Rattus norvegicus
aaaaaacagagggtcctgcccatct

SEQ ID NO: 11 - DNA, 25 bp, Rattus norvegicus
aaaaaaccctctaccagatgcagaa

SEQ ID NO: 12 - DNA, 25 bp, Rattus norvegicus
aaaaaaccctcttccagatgcagaa

SEQ ID NO: 13 - DNA, 25 bp, Rattus norvegicus
aaaaaaccctgcagccctctgaagt

SEQ ID NO: 14 - DNA, 25 bp, Rattus norvegicus
aaaaaaccctgctgccctctgaagt

SEQ ID NO: 15 - DNA, 25 bp, Rattus norvegicus
aaaaaacctgttccttgctgctcag

SEQ ID NO: 16 - DNA, 25 bp, Rattus norvegicus
aaaaaacctgttgcttgctgctcag

SEQ ID NO: 17 - DNA, 25 bp, Rattus norvegicus
aaaaaactccagagtatgcccactg

SEQ ID NO: 18 - DNA, 25 bp, Rattus norvegicus
aaaaaactccagtgtatgcccactg

SEQ ID NO: 19 - DNA, 25 bp, Rattus norvegicus
aaaaaactcgggactgccctgcagg

SEQ ID NO: 20 - DNA, 25 bp, Rattus norvegicus
aaaaaactcgggtctgccctgcagg

SEQ ID NO: 21 - DNA, 25 bp, Rattus norvegicus
aaaaaactctctataccacacacag

SEQ ID NO: 22 - DNA, 25 bp, Rattus norvegicus
aaaaaactctctcagcaatccctgt

SEQ ID NO: 23 - DNA, 25 bp, Rattus norvegicus
aaaaaactctctgagcaatccctgt

SEQ ID NO: 24 - DNA, 25 bp, Rattus norvegicus
aaaaaactctctttaccacacacag

SEQ ID NO: 25 - DNA, 25 bp, Rattus norvegicus
aaaaaactgcctccctatctatgtt

SEQ ID NO: 26 - DNA, 25 bp, Rattus norvegicus
aaaaaactgcctgcctatctatgtt

SEQ ID NO: 27 - DNA, 25 bp, Rattus norvegicus
aaaaaactgtgtcatctcccatctg

SEQ ID NO: 28 - DNA, 25 bp, Rattus norvegicus
aaaaaactgtgtgatctcccatctg

SEQ ID NO: 29 - DNA, 25 bp, Rattus norvegicus
aaaaaagcagagacccacaagtagg

SEQ ID NO: 30 - DNA, 25 bp, Rattus norvegicus
aaaaaagcagagtcccacaagtagg

SEQ ID NO: 31 - DNA, 25 bp, Rattus norvegicus
aaaaaagcagccatctatgccccta

SEQ ID NO: 32 - DNA, 25 bp, Rattus norvegicus
aaaaaagcagccttctatgccccta

SEQ ID NO: 33 - DNA, 25 bp, Rattus norvegicus
aaaaaagcatgtcatctctatcccc

SEQ ID NO: 34 - DNA, 25 bp, Rattus norvegicus
aaaaaagcatgtgatctctatcccc

SEQ ID NO: 35 - DNA, 25 bp, Rattus norvegicus
aaaaaagccacccagtacatccaca

SEQ ID NO: 36 - DNA, 25 bp, Rattus norvegicus
aaaaaagccaccgagtacatccaca

SEQ ID NO: 37 - DNA, 25 bp, Rattus norvegicus
aaaaaagccctaacatgccaccaac

SEQ ID NO: 38 - DNA, 25 bp, Rattus norvegicus
aaaaaagccctatcatgccaccaac

SEQ ID NO: 39 - DNA, 25 bp, Rattus norvegicus
aaaaaagccgctctggcactggcac

SEQ ID NO: 40 - DNA, 25 bp, Rattus norvegicus
aaaaaagccgctgtggcactggcac

SEQ ID NO: 41 - DNA, 25 bp, Rattus norvegicus
aaaaaagctagcacccagccagaat

SEQ ID NO: 42 - DNA, 25 bp, Rattus norvegicus
aaaaaagctagctcccagccagaat

SEQ ID NO: 43 - DNA, 25 bp, Rattus norvegicus
aaaaaagctgctcatcactggtaca

SEQ ID NO: 44 - DNA, 25 bp, Rattus norvegicus
aaaaaagctgctgatcactggtaca

SEQ ID NO: 45 - DNA, 25 bp, Rattus norvegicus
aaaaaagctggacgccctggctctc

SEQ ID NO: 46 - DNA, 25 bp, Rattus norvegicus
aaaaaagctggaggccctggctctc

SEQ ID NO: 47 - DNA, 25 bp, Rattus norvegicus
aaaaaaggacaaacttgaactcgat

SEQ ID NO: 48 - DNA, 25 bp, Rattus norvegicus
aaaaaaggacaatcttgaactcgat

SEQ ID NO: 49 - DNA, 25 bp, Rattus norvegicus
aaaaaaggcagtcgctcctaggtct

SEQ ID NO: 50 - DNA, 25 bp, Rattus norvegicus
aaaaaaggcagtggctcctaggtct

SEQ ID NO: 51 - DNA, 25 bp, Rattus norvegicus
aaaaaagtctctcccatcccttggg

SEQ ID NO: 52 - DNA, 25 bp, Rattus norvegicus
aaaaaagtctctgccatcccttggg

SEQ ID NO: 53 - DNA, 25 bp, Rattus norvegicus
aaaaaataccagacgctctcaccat

SEQ ID NO: 54 - DNA, 25 bp, Rattus norvegicus
aaaaaataccagtcgctctcaccat

SEQ ID NO: 55 - DNA, 25 bp, Rattus norvegicus
aaaaaatactccacctcctgtgact

SEQ ID NO: 56 - DNA, 25 bp, Rattus norvegicus
aaaaaatactcctcctcctgtgact

SEQ ID NO: 57 - DNA, 25 bp, Rattus norvegicus
aaaaaatattcacgcctggctttca

SEQ ID NO: 58 - DNA, 25 bp, Rattus norvegicus
aaaaaatattcaggcctggctttca

SEQ ID NO: 59 - DNA, 25 bp, Rattus norvegicus
aaaaaatcccggaatgctggcctgg

SEQ ID NO: 60 - DNA, 25 bp, Rattus norvegicus
aaaaaatcccggtatgctggcctgg

SEQ ID NO: 61 - DNA, 25 bp, Rattus norvegicus
aaaaaatcgacccatgccgcttgag

SEQ ID NO: 62 - DNA, 25 bp, Rattus norvegicus
aaaaaatcgaccgatgccgcttgag

SEQ ID NO: 63 - DNA, 25 bp, Rattus norvegicus
aaaaaatctagcactcgcctacaaa

SEQ ID NO: 64 - DNA, 25 bp, Rattus norvegicus
aaaaaatctagctctcgcctacaaa

SEQ ID NO: 65 - DNA, 25 bp, Rattus norvegicus
aaaaaatctggaactgccccaggct

SEQ ID NO: 66 - DNA, 25 bp, Rattus norvegicus
aaaaaatctggatctgccccaggct

SEQ ID NO: 67 - DNA, 25 bp, Rattus norvegicus
aaaaaatgcattctctctaactttg

SEQ ID NO: 68 - DNA, 25 bp, Rattus norvegicus
aaaaaatgcattgtctctaactttg

SEQ ID NO: 69 - DNA, 25 bp, Rattus norvegicus
aaaaaatgccttagagacagtttct

SEQ ID NO: 70 - DNA, 25 bp, Rattus norvegicus
aaaaaatgccttatggactgacagt

SEQ ID NO: 71 - DNA, 25 bp, Rattus norvegicus
aaaaaatgcctttgagacagtttct

SEQ ID NO: 72 - DNA, 25 bp, Rattus norvegicus
aaaaaatgccttttggactgacagt

SEQ ID NO: 73 - DNA, 25 bp, Rattus norvegicus
aaaaaatggccaccactcaggacta

SEQ ID NO: 74 - DNA, 25 bp, Rattus norvegicus
aaaaaatggccagcactcaggacta

SEQ ID NO: 75 - DNA, 25 bp, Rattus norvegicus
aaaaaatggtccactggccacactg

SEQ ID NO: 76 - DNA, 25 bp, Rattus norvegicus
aaaaaatggtcctctggccacactg

SEQ ID NO: 77 - DNA, 25 bp, Rattus norvegicus
aaaaaatggtggacctccggcagct

SEQ ID NO: 78 - DNA, 25 bp, Rattus norvegicus
aaaaaatggtggtcctccggcagct

SEQ ID NO: 79 - DNA, 25 bp, Rattus norvegicus
aaaaaatggtgtagccgcgccatct

SEQ ID NO: 80 - DNA, 25 bp, Rattus norvegicus
aaaaaatggtgttgccgcgccatct

SEQ ID NO: 81 - DNA, 25 bp, Rattus norvegicus
aaaaaattatccacagtcctgttct

SEQ ID NO: 82 - DNA, 25 bp, Rattus norvegicus
aaaaaattatcctcagtcctgttct

SEQ ID NO: 83 - DNA, 25 bp, Rattus norvegicus
aaaaaattcattaccatctgtggta

SEQ ID NO: 84 - DNA, 25 bp, Rattus norvegicus
aaaaaattcatttccatctgtggta

SEQ ID NO: 85 - DNA, 25 bp, Rattus norvegicus
aaaaaattccttagctctcctctct

SEQ ID NO: 86 - DNA, 25 bp, Rattus norvegicus
aaaaaattcctttgctctcctctct

SEQ ID NO: 87 - DNA, 25 bp, Rattus norvegicus
aaaaaattgagacagcatctcacta

SEQ ID NO: 88 - DNA, 25 bp, Rattus norvegicus
aaaaaattgagagagcatctcacta

SEQ ID NO: 89 - DNA, 25 bp, Rattus norvegicus
aaaaaattgcctcttgccagcgtct

SEQ ID NO: 90 - DNA, 25 bp, Rattus norvegicus
aaaaaattgcctgttgccagcgtct

SEQ ID NO: 91 - DNA, 25 bp, Rattus norvegicus
aaaaaattgctgacctgtgtgtaaa

SEQ ID NO: 92 - DNA, 25 bp, Rattus norvegicus
aaaaaattgctgtcctgtgtgtaaa

SEQ ID NO: 93 - DNA, 25 bp, Rattus norvegicus
aaaaaattgtcaatggcaccataaa

SEQ ID NO: 94 - DNA, 25 bp, Rattus norvegicus
aaaaaattgtcattggcaccataaa

SEQ ID NO: 95 - DNA, 25 bp, Rattus norvegicus
aaaaacaaacctagcttcatgccct

SEQ ID NO: 96 - DNA, 25 bp, Rattus norvegicus
aaaaacaaaccttgcttcatgccct

SEQ ID NO: 97 - DNA, 25 bp, Rattus norvegicus
aaaaacaacactcatccaccatttc

SEQ ID NO: 98 - DNA, 25 bp, Rattus norvegicus
aaaaacaacactgatccaccatttc

SEQ ID NO: 99 - DNA, 25 bp, Rattus norvegicus
aaaaacaaccctcctttctctgaag

SEQ ID NO: 100 - DNA, 25 bp, Rattus norvegicus
aaaaacaaccctgctttctctgaag

SEQ ID NO: 101 - DNA, 25 bp, Rattus norvegicus
aaaaacaactctcttcagctttctc

SEQ ID NO: 102 - DNA, 25 bp, Rattus norvegicus
aaaaacaactctgttcagctttctc

SEQ ID NO: 103 - DNA, 25 bp, Rattus norvegicus
aaaaacaagctccttcgagcctcag

SEQ ID NO: 104 - DNA, 25 bp, Rattus norvegicus
aaaaacaagctcgttcgagcctcag

SEQ ID NO: 105 - DNA, 25 bp, Rattus norvegicus
aaaaacaagtacacgcatgcacaca

SEQ ID NO: 106 - DNA, 25 bp, Rattus norvegicus
aaaaacaagtactcgcatgcacaca

SEQ ID NO: 107 - DNA, 25 bp, Rattus norvegicus
aaaaacaatgaaacagccactgcac

SEQ ID NO: 108 - DNA, 25 bp, Rattus norvegicus
aaaaacaatgaatcagccactgcac

SEQ ID NO: 109 - DNA, 25 bp, Rattus norvegicus
aaaaacaatgtgaggcggcaagcaa

SEQ ID NO: 110 - DNA, 25 bp, Rattus norvegicus
aaaaacaatgtgtggcggcaagcaa

SEQ ID NO: 111 - DNA, 25 bp, Rattus norvegicus
aaaaacaattacatctccctcatcg

SEQ ID NO: 112 - DNA, 25 bp, Rattus norvegicus
aaaaacaattacttctccctcatcg

SEQ ID NO: 113 - DNA, 25 bp, Rattus norvegicus
aaaaacacaggcactctttgggagc

SEQ ID NO: 114 - DNA, 25 bp, Rattus norvegicus
aaaaacacaggctctctttgggagc

SEQ ID NO: 115 - DNA, 25 bp, Rattus norvegicus
aaaaacaccccaccattgcagatgt

SEQ ID NO: 116 - DNA, 25 bp, Rattus norvegicus
aaaaacaccccagcattgcagatgt

SEQ ID NO: 117 - DNA, 25 bp, Rattus norvegicus
aaaaacactgagatgctttgggcaa

SEQ ID NO: 118 - DNA, 25 bp, Rattus norvegicus
aaaaacactgagttgctttgggcaa

SEQ ID NO: 119 - DNA, 25 bp, Rattus norvegicus
aaaaacagatccaggtccatgccct

SEQ ID NO: 120 - DNA, 25 bp, Rattus norvegicus
aaaaacagatcctggtccatgccct

SEQ ID NO: 121 - DNA, 25 bp, Rattus norvegicus
aaaaacagcaccagaaagttgtcct

SEQ ID NO: 122 - DNA, 25 bp, Rattus norvegicus
aaaaacagcacctgaaagttgtcct

SEQ ID NO: 123 - DNA, 25 bp, Rattus norvegicus
aaaaacagcttactgtctgtgccag

SEQ ID NO: 124 - DNA, 25 bp, Rattus norvegicus
aaaaacagcttagtgtctgtgccag

SEQ ID NO: 125 - DNA, 25 bp, Rattus norvegicus
aaaaacaggatccttgcccctggat

SEQ ID NO: 126 - DNA, 25 bp, Rattus norvegicus
aaaaacaggatcgttgcccctggat

SEQ ID NO: 127 - DNA, 25 bp, Rattus norvegicus
aaaaacagtttcacctctatgcctt

SEQ ID NO: 128 - DNA, 25 bp, Rattus norvegicus
aaaaacagtttctcctctatgcctt

SEQ ID NO: 129 - DNA, 25 bp, Rattus norvegicus
aaaaacatcacgctccttccgggag

SEQ ID NO: 130 - DNA, 25 bp, Rattus norvegicus
aaaaacatcacggtccttccgggag

SEQ ID NO: 131 - DNA, 25 bp, Rattus norvegicus
aaaaacatcctgagcagcggcgcgc

SEQ ID NO: 132 - DNA, 25 bp, Rattus norvegicus
aaaaacatcctgtgcagcggcgcgc

SEQ ID NO: 133 - DNA, 25 bp, Rattus norvegicus
aaaaacatctccatcttcaagcggg

SEQ ID NO: 134 - DNA, 25 bp, Rattus norvegicus
aaaaacatctccttcttcaagcggg

SEQ ID NO: 135 - DNA, 25 bp, Rattus norvegicus
aaaaacatcttcaatgctgctcgca

SEQ ID NO: 136 - DNA, 25 bp, Rattus norvegicus
aaaaacatcttctatgctgctcgca

SEQ ID NO: 137 - DNA, 25 bp, Rattus norvegicus
aaaaacatgagtccctccatcatag

SEQ ID NO: 138 - DNA, 25 bp, Rattus norvegicus
aaaaacatgagtgcctccatcatag

SEQ ID NO: 139 - DNA, 25 bp, Rattus norvegicus
aaaaacattgctcttggtgtcacat

SEQ ID NO: 140 - DNA, 25 bp, Rattus norvegicus
aaaaacattgctgttggtgtcacat

SEQ ID NO: 141 - DNA, 25 bp, Rattus norvegicus
aaaaacatttctcttgccaggcatc

SEQ ID NO: 142 - DNA, 25 bp, Rattus norvegicus
aaaaacatttctgttgccaggcatc

SEQ ID NO: 143 - DNA, 25 bp, Rattus norvegicus
aaaaacatttgtcccgtcattgaag

SEQ ID NO: 144 - DNA, 25 bp, Rattus norvegicus
aaaaacatttgtgccgtcattgaag

SEQ ID NO: 145 - DNA, 25 bp, Rattus norvegicus
aaaaaccaaactcttccatgtctcg

SEQ ID NO: 146 - DNA, 25 bp, Rattus norvegicus
aaaaaccaaactgttccatgtctcg

SEQ ID NO: 147 - DNA, 25 bp, Rattus norvegicus
aaaaaccaacacactccaggaggag

SEQ ID NO: 148 - DNA, 25 bp, Rattus norvegicus
aaaaaccaacacatcctgcgcttca

SEQ ID NO: 149 - DNA, 25 bp, Rattus norvegicus
aaaaaccaacactctccaggaggag

SEQ ID NO: 150 - DNA, 25 bp, Rattus norvegicus
aaaaaccaacacttcctgcgcttca

SEQ ID NO: 151 - DNA, 25 bp, Rattus norvegicus
aaaaaccaagcacacgtccaatcag

SEQ ID NO: 152 - DNA, 25 bp, Rattus norvegicus
aaaaaccaagcagacgtccaatcag

SEQ ID NO: 153 - DNA, 25 bp, Rattus norvegicus
aaaaaccagaacaccaagagcgctg

SEQ ID NO: 154 - DNA, 25 bp, Rattus norvegicus
aaaaaccagaactccaagagcgctg

SEQ ID NO: 155 - DNA, 25 bp, Rattus norvegicus
aaaaaccagactccggatccagcaa

SEQ ID NO: 156 - DNA, 25 bp, Rattus norvegicus
aaaaaccagactgcggatccagcaa

SEQ ID NO: 157 - DNA, 25 bp, Rattus norvegicus
aaaaaccagagactccacttctatc

SEQ ID NO: 158 - DNA, 25 bp, Rattus norvegicus
aaaaaccagagagtccacttctatc

SEQ ID NO: 159 - DNA, 25 bp, Rattus norvegicus
aaaaaccagcaactcctcctgtgtt

SEQ ID NO: 160 - DNA, 25 bp, Rattus norvegicus
aaaaaccagcaagtcctcctgtgtt

SEQ ID NO: 161 - DNA, 25 bp, Rattus norvegicus
aaaaaccatccgatgtgttctgctc

SEQ ID NO: 162 - DNA, 25 bp, Rattus norvegicus
aaaaaccatccgttgtgttctgctc

SEQ ID NO: 163 - DNA, 25 bp, Rattus norvegicus
aaaaaccatgtgatgtcatttcctg

SEQ ID NO: 164 - DNA, 25 bp, Rattus norvegicus
aaaaaccatgtgttgtcatttcctg

SEQ ID NO: 165 - DNA, 25 bp, Rattus norvegicus
aaaaacccattcagctcggccagtg

SEQ ID NO: 166 - DNA, 25 bp, Rattus norvegicus
aaaaacccattctgctcggccagtg

SEQ ID NO: 167 - DNA, 25 bp, Rattus norvegicus
aaaaaccctgcacggttagcagtgt

SEQ ID NO: 168 - DNA, 25 bp, Rattus norvegicus
aaaaaccctgcagggttagcagtgt

SEQ ID NO: 169 - DNA, 25 bp, Rattus norvegicus
aaaaaccctgtgacggctgtctctg

SEQ ID NO: 170 - DNA, 25 bp, Rattus norvegicus
aaaaaccctgtgtcggctgtctctg

SEQ ID NO: 171 - DNA, 25 bp, Rattus norvegicus
aaaaacccttgccactcacatagac

SEQ ID NO: 172 - DNA, 25 bp, Rattus norvegicus
aaaaacccttgcgactcacatagac

SEQ ID NO: 173 - DNA, 25 bp, Rattus norvegicus
aaaaacctcaccatgcttgtgttta

SEQ ID NO: 174 - DNA, 25 bp, Rattus norvegicus
aaaaacctcaccttgcttgtgttta

SEQ ID NO: 175 - DNA, 25 bp, Rattus norvegicus
aaaaacctctctatgagctgctaat

SEQ ID NO: 176 - DNA, 25 bp, Rattus norvegicus
aaaaacctctctttgagctgctaat

SEQ ID NO: 177 - DNA, 25 bp, Rattus norvegicus
aaaaacctcttcaaccatatccgag

SEQ ID NO: 178 - DNA, 25 bp, Rattus norvegicus
aaaaacctcttctaccatatccgag

SEQ ID NO: 179 - DNA, 25 bp, Rattus norvegicus
aaaaacctgactagtccctgcattt

SEQ ID NO: 180 - DNA, 25 bp, Rattus norvegicus
aaaaacctgacttgtccctgcattt

SEQ ID NO: 181 - DNA, 25 bp, Rattus norvegicus
aaaaacctggaccaagcctggcgct

SEQ ID NO: 182 - DNA, 25 bp, Rattus norvegicus
aaaaacctggacgaagcctggcgct

SEQ ID NO: 183 - DNA, 25 bp, Rattus norvegicus
aaaaacctgtctcacaacgggtgtg

SEQ ID NO: 184 - DNA, 25 bp, Rattus norvegicus
aaaaacctgtctctccactgggcct

SEQ ID NO: 185 - DNA, 25 bp, Rattus norvegicus
aaaaacctgtctgacaacgggtgtg

SEQ ID NO: 186 - DNA, 25 bp, Rattus norvegicus
aaaaacctgtctgtccactgggcct

SEQ ID NO: 187 - DNA, 25 bp, Rattus norvegicus
aaaaacctgtgtccactcctgtagg

SEQ ID NO: 188 - DNA, 25 bp, Rattus norvegicus
aaaaacctgtgtgcactcctgtagg

SEQ ID NO: 189 - DNA, 25 bp, Rattus norvegicus
aaaaacgactgcaggaagatcccaa

SEQ ID NO: 190 - DNA, 25 bp, Rattus norvegicus
aaaaacgactgctggaagatcccaa

SEQ ID NO: 191 - DNA, 25 bp, Rattus norvegicus
aaaaacgcctacaccaatactcctg

SEQ ID NO: 192 - DNA, 25 bp, Rattus norvegicus
aaaaacgcctactccaatactcctg

SEQ ID NO: 193 - DNA, 25 bp, Rattus norvegicus
aaaaacggcgacagcaccgagcgca

SEQ ID NO: 194 - DNA, 25 bp, Rattus norvegicus
aaaaacggcgactgcaccgagcgca

SEQ ID NO: 195 - DNA, 25 bp, Rattus norvegicus
aaaaacgggagcctgccaacctgca

SEQ ID NO: 196 - DNA, 25 bp, Rattus norvegicus
aaaaacgggagcgtgccaacctgca

SEQ ID NO: 197 - DNA, 25 bp, Rattus norvegicus
aaaaacgtgtgcaccacaggcttca

SEQ ID NO: 198 - DNA, 25 bp, Rattus norvegicus
aaaaacgtgtgctccacaggcttca

SEQ ID NO: 199 - DNA, 25 bp, Rattus norvegicus
aaaaacgttgacaactcagggctgg

SEQ ID NO: 200 - DNA, 25 bp, Rattus norvegicus
aaaaacgttgactactcagggctgg

SEQ ID NO: 201 - DNA, 25 bp, Rattus norvegicus
aaaaactcagacacacttttcctca

SEQ ID NO: 202 - DNA, 25 bp, Rattus norvegicus
aaaaactcagactcacttttcctca

SEQ ID NO: 203 - DNA, 25 bp, Rattus norvegicus
aaaaactcagtcaccatcttctatg

SEQ ID NO: 204 - DNA, 25 bp, Rattus norvegicus
aaaaactcagtctccatcttctatg

SEQ ID NO: 205 - DNA, 25 bp, Rattus norvegicus
aaaaactcctatatgttgccacttt

SEQ ID NO: 206 - DNA, 25 bp, Rattus norvegicus
aaaaactcctatttgttgccacttt

SEQ ID NO: 207 - DNA, 25 bp, Rattus norvegicus
aaaaactcttccagttgaccagctc

SEQ ID NO: 208 - DNA, 25 bp, Rattus norvegicus
aaaaactcttcctgttgaccagctc

SEQ ID NO: 209 - DNA, 25 bp, Rattus norvegicus
aaaaactgcctgaagttcaggctga

SEQ ID NO: 210 - DNA, 25 bp, Rattus norvegicus
aaaaactgcctgtagttcaggctga

SEQ ID NO: 211 - DNA, 25 bp, Rattus norvegicus
aaaaactgcggcaggaggctcacaa

SEQ ID NO: 212 - DNA, 25 bp, Rattus norvegicus
aaaaactgcggctggaggctcacaa

SEQ ID NO: 213 - DNA, 25 bp, Rattus norvegicus
aaaaactggtgtcgactgtggtctt

SEQ ID NO: 214 - DNA, 25 bp, Rattus norvegicus
aaaaactggtgtggactgtggtctt

SEQ ID NO: 215 - DNA, 25 bp, Rattus norvegicus
aaaaactgtaccagaggactgaggt

SEQ ID NO: 216 - DNA, 25 bp, Rattus norvegicus
aaaaactgtacctgaggactgaggt

SEQ ID NO: 217 - DNA, 25 bp, Rattus norvegicus
aaaaacttcacaccatggagcggca

SEQ ID NO: 218 - DNA, 25 bp, Rattus norvegicus
aaaaacttcacagcatggagcggca

SEQ ID NO: 219 - DNA, 25 bp, Rattus norvegicus
aaaaacttctctcttggcctggtct

SEQ ID NO: 220 - DNA, 25 bp, Rattus norvegicus
aaaaacttctctgttggcctggtct

SEQ ID NO: 221 - DNA, 25 bp, Rattus norvegicus
aaaaacttcttgctcatccttggct

SEQ ID NO: 222 - DNA, 25 bp, Rattus norvegicus
aaaaacttcttggtcatccttggct

SEQ ID NO: 223 - DNA, 25 bp, Rattus norvegicus
aaaaacttgcgcaggaagcctccgc

SEQ ID NO: 224 - DNA, 25 bp, Rattus norvegicus
aaaaacttgcgctggaagcctccgc

SEQ ID NO: 225 - DNA, 25 bp, Rattus norvegicus
aaaaacttgtcacagtgggcccgct

SEQ ID NO: 226 - DNA, 25 bp, Rattus norvegicus
aaaaacttgtcagagtgggcccgct

SEQ ID NO: 227 - DNA, 25 bp, Rattus norvegicus
aaaaactttattacagctgggctgg

SEQ ID NO: 228 - DNA, 25 bp, Rattus norvegicus
aaaaactttatttcagctgggctgg

SEQ ID NO: 229 - DNA, 25 bp, Rattus norvegicus
aaaaagaaacctatccagcctgctg

SEQ ID NO: 230 - DNA, 25 bp, Rattus norvegicus
aaaaagaaacctttccagcctgctg

SEQ ID NO: 231 - DNA, 25 bp, Rattus norvegicus
aaaaagaagaccagacctcaccctg

SEQ ID NO: 232 - DNA, 25 bp, Rattus norvegicus
aaaaagaagacctgacctcaccctg

SEQ ID NO: 233 - DNA, 25 bp, Rattus norvegicus
aaaaagaagggccagcgactgcctt

SEQ ID NO: 234 - DNA, 25 bp, Rattus norvegicus
aaaaagaagggcgagcgactgcctt

SEQ ID NO: 235 - DNA, 25 bp, Rattus norvegicus
aaaaagaatataagcttcacctggg

SEQ ID NO: 236 - DNA, 25 bp, Rattus norvegicus
aaaaagaatatatgcttcacctggg

SEQ ID NO: 237 - DNA, 25 bp, Rattus norvegicus
aaaaagaatccgagtgccgccaagt

SEQ ID NO: 238 - DNA, 25 bp, Rattus norvegicus
aaaaagaatccgtgtgccgccaagt

SEQ ID NO: 239 - DNA, 25 bp, Rattus norvegicus
aaaaagacacccacagccatcagat

SEQ ID NO: 240 - DNA, 25 bp, Rattus norvegicus
aaaaagacaccctcagccatcagat

SEQ ID NO: 241 - DNA, 25 bp, Rattus norvegicus
aaaaagaccagtctccttctctctt

SEQ ID NO: 242 - DNA, 25 bp, Rattus norvegicus
aaaaagaccagtgtccttctctctt

SEQ ID NO: 243 - DNA, 25 bp, Rattus norvegicus
aaaaagacctccctcttgctctatt

SEQ ID NO: 244 - DNA, 25 bp, Rattus norvegicus
aaaaagacctccgtcttgctctatt

SEQ ID NO: 245 - DNA, 25 bp, Rattus norvegicus
aaaaagacctttctctcgctaacag

SEQ ID NO: 246 - DNA, 25 bp, Rattus norvegicus
aaaaagacctttgtctcgctaacag

SEQ ID NO: 247 - DNA, 25 bp, Rattus norvegicus
aaaaagacttcaacattccccagat

SEQ ID NO: 248 - DNA, 25 bp, Rattus norvegicus
aaaaagacttcatcattccccagat

SEQ ID NO: 249 - DNA, 25 bp, Rattus norvegicus
aaaaagactttcaagatgcagttct

SEQ ID NO: 250 - DNA, 25 bp, Rattus norvegicus
aaaaagactttctagatgcagttct

SEQ ID NO: 251 - DNA, 25 bp, Rattus norvegicus
aaaaagagcaaccaggtcctgatta

SEQ ID NO: 252 - DNA, 25 bp, Rattus norvegicus
aaaaagagcaacgaggtcctgatta

SEQ ID NO: 253 - DNA, 25 bp, Rattus norvegicus
aaaaagaggcgccttgtctacagcc

SEQ ID NO: 254 - DNA, 25 bp, Rattus norvegicus
aaaaagaggcgcgttgtctacagcc

SEQ ID NO: 255 - DNA, 25 bp, Rattus norvegicus
aaaaagaggctgctctctctcggat

SEQ ID NO: 256 - DNA, 25 bp, Rattus norvegicus
aaaaagaggctggtctctctcggat

SEQ ID NO: 257 - DNA, 25 bp, Rattus norvegicus
aaaaagagttgtcccctgtccactt

SEQ ID NO: 258 - DNA, 25 bp, Rattus norvegicus
aaaaagagttgtgccctgtccactt

SEQ ID NO: 259 - DNA, 25 bp, Rattus norvegicus
aaaaagatgtcacaaagctgcagga

SEQ ID NO: 260 - DNA, 25 bp, Rattus norvegicus
aaaaagatgtcagaaagctgcagga

SEQ ID NO: 261 - DNA, 25 bp, Rattus norvegicus
aaaaagattcggatctcccaggctc

SEQ ID NO: 262 - DNA, 25 bp, Rattus norvegicus
aaaaagattcggttctcccaggctc

SEQ ID NO: 263 - DNA, 25 bp, Rattus norvegicus
aaaaagatttggaacacacagaggg

SEQ ID NO: 264 - DNA, 25 bp, Rattus norvegicus
aaaaagatttggtacacacagaggg

SEQ ID NO: 265 - DNA, 25 bp, Rattus norvegicus
aaaaagcaaatccagtcacatcaag

SEQ ID NO: 266 - DNA, 25 bp, Rattus norvegicus
aaaaagcaaatcgagtcacatcaag

SEQ ID NO: 267 - DNA, 25 bp, Rattus norvegicus
aaaaagcaaggaccggctgtctcac

SEQ ID NO: 268 - DNA, 25 bp, Rattus norvegicus
aaaaagcaaggagcggctgtctcac

SEQ ID NO: 269 - DNA, 25 bp, Rattus norvegicus
aaaaagcaatgccactctgcccttt

SEQ ID NO: 270 - DNA, 25 bp, Rattus norvegicus
aaaaagcaatgcgactctgcccttt

SEQ ID NO: 271 - DNA, 25 bp, Rattus norvegicus
aaaaagcaccctatacctgcaaatg

SEQ ID NO: 272 - DNA, 25 bp, Rattus norvegicus
aaaaagcaccctttacctgcaaatg

SEQ ID NO: 273 - DNA, 25 bp, Rattus norvegicus
aaaaagcacgcacaccttacggaca

SEQ ID NO: 274 - DNA, 25 bp, Rattus norvegicus
aaaaagcacgcagaccttacggaca

SEQ ID NO: 275 - DNA, 25 bp, Rattus norvegicus
aaaaagcagctcactgccccttgga

SEQ ID NO: 276 - DNA, 25 bp, Rattus norvegicus
aaaaagcagctctctgccccttgga

SEQ ID NO: 277 - DNA, 25 bp, Rattus norvegicus
aaaaagcagctgatcgaacccgttc

SEQ ID NO: 278 - DNA, 25 bp, Rattus norvegicus
aaaaagcagctgttcgaacccgttc

SEQ ID NO: 279 - DNA, 25 bp, Rattus norvegicus
aaaaagcatcctactccttgtagtt

SEQ ID NO: 280 - DNA, 25 bp, Rattus norvegicus
aaaaagcatccttctccttgtagtt

SEQ ID NO: 281 - DNA, 25 bp, Rattus norvegicus
aaaaagccagaaccggcctgcttgt

SEQ ID NO: 282 - DNA, 25 bp, Rattus norvegicus
aaaaagccagaagcggcctgcttgt

SEQ ID NO: 283 - DNA, 25 bp, Rattus norvegicus
aaaaagccagtaaaggaagccttga

SEQ ID NO: 284 - DNA, 25 bp, Rattus norvegicus
aaaaagccagtataggaagccttga

SEQ ID NO: 285 - DNA, 25 bp, Rattus norvegicus
aaaaagccagttctgtcccttcaag

SEQ ID NO: 286 - DNA, 25 bp, Rattus norvegicus
aaaaagccagttgtgtcccttcaag

SEQ ID NO: 287 - DNA, 25 bp, Rattus norvegicus
aaaaagccccagaatgatgctgtct

SEQ ID NO: 288 - DNA, 25 bp, Rattus norvegicus
aaaaagccccagtatgatgctgtct

SEQ ID NO: 289 - DNA, 25 bp, Rattus norvegicus
aaaaagccctggatctgtgacttca

SEQ ID NO: 290 - DNA, 25 bp, Rattus norvegicus
aaaaagccctggttctgtgacttca

SEQ ID NO: 291 - DNA, 25 bp, Rattus norvegicus
aaaaagccctgtctatagtctctgg

SEQ ID NO: 292 - DNA, 25 bp, Rattus norvegicus
aaaaagccctgtgtatagtctctgg

SEQ ID NO: 293 - DNA, 25 bp, Rattus norvegicus
aaaaagccgctgaaatggtgggaca

SEQ ID NO: 294 - DNA, 25 bp, Rattus norvegicus
aaaaagccgctgtaatggtgggaca

SEQ ID NO: 295 - DNA, 25 bp, Rattus norvegicus
aaaaagccgtcacggcaatggcagc

SEQ ID NO: 296 - DNA, 25 bp, Rattus norvegicus
aaaaagccgtcagggcaatggcagc

SEQ ID NO: 297 - DNA, 25 bp, Rattus norvegicus
aaaaagcctcctagtgcaatgtctt

SEQ ID NO: 298 - DNA, 25 bp, Rattus norvegicus
aaaaagcctccttgtgcaatgtctt

SEQ ID NO: 299 - DNA, 25 bp, Rattus norvegicus
aaaaagcctgaaatctgtctggtag

SEQ ID NO: 300 - DNA, 25 bp, Rattus norvegicus
aaaaagcctgaattctgtctggtag

SEQ ID NO: 301 - DNA, 25 bp, Rattus norvegicus
aaaaagccttccatggacatcacat

SEQ ID NO: 302 - DNA, 25 bp, Rattus norvegicus
aaaaagccttccttggacatcacat

SEQ ID NO: 303 - DNA, 25 bp, Rattus norvegicus
aaaaagccttgaaaatcctccctga

SEQ ID NO: 304 - DNA, 25 bp, Rattus norvegicus
aaaaagccttgataatcctccctga

SEQ ID NO: 305 - DNA, 25 bp, Rattus norvegicus
aaaaagcctttcagcctacactgta

SEQ ID NO: 306 - DNA, 25 bp, Rattus norvegicus
aaaaagcctttctgcctacactgta

SEQ ID NO: 307 - DNA, 25 bp, Rattus norvegicus
aaaaagctcaccagcattctgactt

SEQ ID NO: 308 - DNA, 25 bp, Rattus norvegicus
aaaaagctcacctgcattctgactt

SEQ ID NO: 309 - DNA, 25 bp, Rattus norvegicus
aaaaagctcatgagggctagtgaga

SEQ ID NO: 310 - DNA, 25 bp, Rattus norvegicus
aaaaagctcatgtgggctagtgaga

SEQ ID NO: 311 - DNA, 25 bp, Rattus norvegicus
aaaaagctcattctcgactgtgcca

SEQ ID NO: 312 - DNA, 25 bp, Rattus norvegicus
aaaaagctcattgtcgactgtgcca

SEQ ID NO: 313 - DNA, 25 bp, Rattus norvegicus
aaaaagctccacaagtttgctagtg

SEQ ID NO: 314 - DNA, 25 bp, Rattus norvegicus
aaaaagctccactagtttgctagtg

SEQ ID NO: 315 - DNA, 25 bp, Rattus norvegicus
aaaaagctctacacatggatgatat

SEQ ID NO: 316 - DNA, 25 bp, Rattus norvegicus
aaaaagctctactcatggatgatat

SEQ ID NO: 317 - DNA, 25 bp, Rattus norvegicus
aaaaagctcttaacgttcagtatga

SEQ ID NO: 318 - DNA, 25 bp, Rattus norvegicus
aaaaagctcttatcgttcagtatga

SEQ ID NO: 319 - DNA, 25 bp, Rattus norvegicus
aaaaagctgcatagcctgtcttttg

SEQ ID NO: 320 - DNA, 25 bp, Rattus norvegicus
aaaaagctgcattgcctgtcttttg

SEQ ID NO: 321 - DNA, 25 bp, Rattus norvegicus
aaaaagctgcctacttagctctaaa

SEQ ID NO: 322 - DNA, 25 bp, Rattus norvegicus
aaaaagctgcctcacatatctgatg

SEQ ID NO: 323 - DNA, 25 bp, Rattus norvegicus
aaaaagctgcctgacatatctgatg

SEQ ID NO: 324 - DNA, 25 bp, Rattus norvegicus
aaaaagctgccttcttagctctaaa

SEQ ID NO: 325 - DNA, 25 bp, Rattus norvegicus
aaaaagctgctaaccaatgatgttg

SEQ ID NO: 326 - DNA, 25 bp, Rattus norvegicus
aaaaagctgctatccaatgatgttg

SEQ ID NO: 327 - DNA, 25 bp, Rattus norvegicus
aaaaagctggacctggcctgagcac

SEQ ID NO: 328 - DNA, 25 bp, Rattus norvegicus
aaaaagctggacgtggcctgagcac

SEQ ID NO: 329 - DNA, 25 bp, Rattus norvegicus
aaaaagcttcctagggcatcttcag

SEQ ID NO: 330 - DNA, 25 bp, Rattus norvegicus
aaaaagcttccttgggcatcttcag

SEQ ID NO: 331 - DNA, 25 bp, Rattus norvegicus
aaaaagcttgcccagatccggcagc

SEQ ID NO: 332 - DNA, 25 bp, Rattus norvegicus
aaaaagcttgccgagatccggcagc

SEQ ID NO: 333 - DNA, 25 bp, Rattus norvegicus
aaaaagctttctcaccaactacaat

SEQ ID NO: 334 - DNA, 25 bp, Rattus norvegicus
aaaaagctttctgaccaactacaat

SEQ ID NO: 335 - DNA, 25 bp, Rattus norvegicus
aaaaagcttttcatctctccagagg

SEQ ID NO: 336 - DNA, 25 bp, Rattus norvegicus
aaaaagcttttcttctctccagagg

SEQ ID NO: 337 - DNA, 25 bp, Rattus norvegicus
aaaaaggaagcacccactgcccatc

SEQ ID NO: 338 - DNA, 25 bp, Rattus norvegicus
aaaaaggaagcagccactgcccatc

SEQ ID NO: 339 - DNA, 25 bp, Rattus norvegicus
aaaaaggaagcgatgcactcgggag

SEQ ID NO: 340 - DNA, 25 bp, Rattus norvegicus
aaaaaggaagcgttgcactcgggag

SEQ ID NO: 341 - DNA, 25 bp, Rattus norvegicus
aaaaaggacttcctgtccacaggat

SEQ ID NO: 342 - DNA, 25 bp, Rattus norvegicus
aaaaaggacttcgtgtccacaggat

SEQ ID NO: 343 - DNA, 25 bp, Rattus norvegicus
aaaaaggagcttattgctctccgtg

SEQ ID NO: 344 - DNA, 25 bp, Rattus norvegicus
aaaaaggagctttttgctctccgtg

SEQ ID NO: 345 - DNA, 25 bp, Rattus norvegicus
aaaaaggagggcacctgcactgctg

SEQ ID NO: 346 - DNA, 25 bp, Rattus norvegicus
aaaaaggagggctcctgcactgctg

SEQ ID NO: 347 - DNA, 25 bp, Rattus norvegicus
aaaaaggagtctcccaaaggccttg

SEQ ID NO: 348 - DNA, 25 bp, Rattus norvegicus
aaaaaggagtctgccaaaggccttg

SEQ ID NO: 349 - DNA, 25 bp, Rattus norvegicus
aaaaaggatagcattttcaagaaat

SEQ ID NO: 350 - DNA, 25 bp, Rattus norvegicus
aaaaaggatagctttttcaagaaat

SEQ ID NO: 351 - DNA, 25 bp, Rattus norvegicus
aaaaaggcagctatgctcatgttct

SEQ ID NO: 352 - DNA, 25 bp, Rattus norvegicus
aaaaaggcagctcctttgccatctc

SEQ ID NO: 353 - DNA, 25 bp, Rattus norvegicus
aaaaaggcagctgctttgccatctc

SEQ ID NO: 354 - DNA, 25 bp, Rattus norvegicus
aaaaaggcagctttgctcatgttct

SEQ ID NO: 355 - DNA, 25 bp, Rattus norvegicus
aaaaaggcagtgagctcctccaaga

SEQ ID NO: 356 - DNA, 25 bp, Rattus norvegicus
aaaaaggcagtgtgctcctccaaga

SEQ ID NO: 357 - DNA, 25 bp, Rattus norvegicus
aaaaaggccatgcacatgcgctccc

SEQ ID NO: 358 - DNA, 25 bp, Rattus norvegicus
aaaaaggccatggacatgcgctccc

SEQ ID NO: 359 - DNA, 25 bp, Rattus norvegicus
aaaaaggccgcaatcttcgatcagt

SEQ ID NO: 360 - DNA, 25 bp, Rattus norvegicus
aaaaaggccgcattcttcgatcagt

SEQ ID NO: 361 - DNA, 25 bp, Rattus norvegicus
aaaaaggcgaccactgaagaactgt

SEQ ID NO: 362 - DNA, 25 bp, Rattus norvegicus
aaaaaggcgacctctgaagaactgt

SEQ ID NO: 363 - DNA, 25 bp, Rattus norvegicus
aaaaaggctctgacctctatgggtg

SEQ ID NO: 364 - DNA, 25 bp, Rattus norvegicus
aaaaaggctctgtcctctatgggtg

SEQ ID NO: 365 - DNA, 25 bp, Rattus norvegicus
aaaaaggctttgcagctgtgcgtgt

SEQ ID NO: 366 - DNA, 25 bp, Rattus norvegicus
aaaaaggctttggagctgtgcgtgt

SEQ ID NO: 367 - DNA, 25 bp, Rattus norvegicus
aaaaaggtcgtacttcttcactcat

SEQ ID NO: 368 - DNA, 25 bp, Rattus norvegicus
aaaaaggtcgtagttcttcactcat

SEQ ID NO: 369 - DNA, 25 bp, Rattus norvegicus
aaaaaggtgaagctccagggacagt

SEQ ID NO: 370 - DNA, 25 bp, Rattus norvegicus
aaaaaggtgaaggtccagggacagt

SEQ ID NO: 371 - DNA, 25 bp, Rattus norvegicus
aaaaaggtggctcaggtcgctctgc

SEQ ID NO: 372 - DNA, 25 bp, Rattus norvegicus
aaaaaggtggctgaggtcgctctgc

SEQ ID NO: 373 - DNA, 25 bp, Rattus norvegicus
aaaaaggtgtgtcggctgcagctta

SEQ ID NO: 374 - DNA, 25 bp, Rattus norvegicus
aaaaaggtgtgtgggctgcagctta

SEQ ID NO: 375 - DNA, 25 bp, Rattus norvegicus
aaaaagtatctaattccagccctcg

SEQ ID NO: 376 - DNA, 25 bp, Rattus norvegicus
aaaaagtatctatttccagccctcg

SEQ ID NO: 377 - DNA, 25 bp, Rattus norvegicus
aaaaagtcagacctggtggcccaca

SEQ ID NO: 378 - DNA, 25 bp, Rattus norvegicus
aaaaagtcagacgtggtggcccaca

SEQ ID NO: 379 - DNA, 25 bp, Rattus norvegicus
aaaaagtcaggacgccattctccct

SEQ ID NO: 380 - DNA, 25 bp, Rattus norvegicus
aaaaagtcaggaggccattctccct

SEQ ID NO: 381 - DNA, 25 bp, Rattus norvegicus
aaaaagtccagcactagggctcctt

SEQ ID NO: 382 - DNA, 25 bp, Rattus norvegicus
aaaaagtccagctctagggctcctt

SEQ ID NO: 383 - DNA, 25 bp, Rattus norvegicus
aaaaagtcgcacatcgttccttgct

SEQ ID NO: 384 - DNA, 25 bp, Rattus norvegicus
aaaaagtcgcacttcgttccttgct

SEQ ID NO: 385 - DNA, 25 bp, Rattus norvegicus
aaaaagtctcatacccattctctat

SEQ ID NO: 386 - DNA, 25 bp, Rattus norvegicus
aaaaagtctcatagctggagagctg

SEQ ID NO: 387 - DNA, 25 bp, Rattus norvegicus
aaaaagtctcatatcctggagccct

SEQ ID NO: 388 - DNA, 25 bp, Rattus norvegicus
aaaaagtctcattcccattctctat

SEQ ID NO: 389 - DNA, 25 bp, Rattus norvegicus
aaaaagtctcattgctggagagctg

SEQ ID NO: 390 - DNA, 25 bp, Rattus norvegicus
aaaaagtctcatttcctggagccct

SEQ ID NO: 391 - DNA, 25 bp, Rattus norvegicus
aaaaagtctgctagggcttctgaag

SEQ ID NO: 392 - DNA, 25 bp, Rattus norvegicus
aaaaagtctgcttgggcttctgaag

SEQ ID NO: 393 - DNA, 25 bp, Rattus norvegicus
aaaaagtgaactcgctgttgagtac

SEQ ID NO: 394 - DNA, 25 bp, Rattus norvegicus
aaaaagtgaactggctgttgagtac

SEQ ID NO: 395 - DNA, 25 bp, Rattus norvegicus
aaaaagtgactgactttataggcag

SEQ ID NO: 396 - DNA, 25 bp, Rattus norvegicus
aaaaagtgactgtctttataggcag

SEQ ID NO: 397 - DNA, 25 bp, Rattus norvegicus
aaaaagtgagagctccaggctgagt

SEQ ID NO: 398 - DNA, 25 bp, Rattus norvegicus
aaaaagtgagaggtccaggctgagt

SEQ ID NO: 399 - DNA, 25 bp, Rattus norvegicus
aaaaagtgccataaaccctcgcttg

SEQ ID NO: 400 - DNA, 25 bp, Rattus norvegicus
aaaaagtgccattaaccctcgcttg

SEQ ID NO: 401 - DNA, 25 bp, Rattus norvegicus
aaaaagtgcctgcagccagatggcc

SEQ ID NO: 402 - DNA, 25 bp, Rattus norvegicus
aaaaagtgcctggagccagatggcc

SEQ ID NO: 403 - DNA, 25 bp, Rattus norvegicus
aaaaagtgctccagctgattcttct

SEQ ID NO: 404 - DNA, 25 bp, Rattus norvegicus
aaaaagtgctcctgctgattcttct

SEQ ID NO: 405 - DNA, 25 bp, Rattus norvegicus
aaaaagtgctctcggttccccagag

SEQ ID NO: 406 - DNA, 25 bp, Rattus norvegicus
aaaaagtgctctgggttccccagag

SEQ ID NO: 407 - DNA, 25 bp, Rattus norvegicus
aaaaagtggcgacctttcgactcat

SEQ ID NO: 408 - DNA, 25 bp, Rattus norvegicus
aaaaagtggcgagctttcgactcat

SEQ ID NO: 409 - DNA, 25 bp, Rattus norvegicus
aaaaagtgtgctctcactggccaga

SEQ ID NO: 410 - DNA, 25 bp, Rattus norvegicus
aaaaagtgtgctgtcactggccaga

SEQ ID NO: 411 - DNA, 25 bp, Rattus norvegicus
aaaaagtgttctacgtgtgtgcaca

SEQ ID NO: 412 - DNA, 25 bp, Rattus norvegicus
aaaaagtgttcttcgtgtgtgcaca

SEQ ID NO: 413 - DNA, 25 bp, Rattus norvegicus
aaaaagttcctcatctctggtgggc

SEQ ID NO: 414 - DNA, 25 bp, Rattus norvegicus
aaaaagttcctcttctctggtgggc

SEQ ID NO: 415 - DNA, 25 bp, Rattus norvegicus
aaaaagttcctgatgctggctgcag

SEQ ID NO: 416 - DNA, 25 bp, Rattus norvegicus
aaaaagttcctgttgctggctgcag

SEQ ID NO: 417 - DNA, 25 bp, Rattus norvegicus
aaaaagttgtcgcagtctgtggcag

SEQ ID NO: 418 - DNA, 25 bp, Rattus norvegicus
aaaaagttgtcggagtctgtggcag

SEQ ID NO: 419 - DNA, 25 bp, Rattus norvegicus
aaaaagtttcacactacctctgaca

SEQ ID NO: 420 - DNA, 25 bp, Rattus norvegicus
aaaaagtttcactctacctctgaca

SEQ ID NO: 421 - DNA, 25 bp, Rattus norvegicus
aaaaagtttctgattgcctggatag

SEQ ID NO: 422 - DNA, 25 bp, Rattus norvegicus
aaaaagtttctgtttgcctggatag

SEQ ID NO: 423 - DNA, 25 bp, Rattus norvegicus
aaaaataacctcatcatcatccagt

SEQ ID NO: 424 - DNA, 25 bp, Rattus norvegicus
aaaaataacctcttcatcatccagt

SEQ ID NO: 425 - DNA, 25 bp, Rattus norvegicus
aaaaataactacactgagacatgcc

SEQ ID NO: 426 - DNA, 25 bp, Rattus norvegicus
aaaaataactactctgagacatgcc

SEQ ID NO: 427 - DNA, 25 bp, Rattus norvegicus
aaaaataattccacacaggtctaag

SEQ ID NO: 428 - DNA, 25 bp, Rattus norvegicus
aaaaataattcctcacaggtctaag

SEQ ID NO: 429 - DNA, 25 bp, Rattus norvegicus
aaaaatacacttatctatgttgtga

SEQ ID NO: 430 - DNA, 25 bp, Rattus norvegicus
aaaaatacacttttctatgttgtga

SEQ ID NO: 431 - DNA, 25 bp, Rattus norvegicus
aaaaataccctccaaactctgctga

SEQ ID NO: 432 - DNA, 25 bp, Rattus norvegicus
aaaaataccctcgaaactctgctga

SEQ ID NO: 433 - DNA, 25 bp, Rattus norvegicus
aaaaatacctcaagccacgatccag

SEQ ID NO: 434 - DNA, 25 bp, Rattus norvegicus
aaaaatacctcatgccacgatccag

SEQ ID NO: 435 - DNA, 25 bp, Rattus norvegicus
aaaaatactatcatgcatgggctgg

SEQ ID NO: 436 - DNA, 25 bp, Rattus norvegicus
aaaaatactatcttgcatgggctgg

SEQ ID NO: 437 - DNA, 25 bp, Rattus norvegicus
aaaaatactcgcctcccgatattgg

SEQ ID NO: 438 - DNA, 25 bp, Rattus norvegicus
aaaaatactcgcgtcccgatattgg

SEQ ID NO: 439 - DNA, 25 bp, Rattus norvegicus
aaaaatactggcacatggcatgaca

SEQ ID NO: 440 - DNA, 25 bp, Rattus norvegicus
aaaaatactggctcatggcatgaca

SEQ ID NO: 441 - DNA, 25 bp, Rattus norvegicus
aaaaatagaaccacagaggcggcag

SEQ ID NO: 442 - DNA, 25 bp, Rattus norvegicus
aaaaatagaacctcagaggcggcag

SEQ ID NO: 443 - DNA, 25 bp, Rattus norvegicus
aaaaatagagccatctccactccta

SEQ ID NO: 444 - DNA, 25 bp, Rattus norvegicus
aaaaatagagccttctccactccta

SEQ ID NO: 445 - DNA, 25 bp, Rattus norvegicus
aaaaataggctgatctccctctact

SEQ ID NO: 446 - DNA, 25 bp, Rattus norvegicus
aaaaataggctgttctccctctact

SEQ ID NO: 447 - DNA, 25 bp, Rattus norvegicus
aaaaataggcttcccattgtcattt

SEQ ID NO: 448 - DNA, 25 bp, Rattus norvegicus
aaaaataggcttgccattgtcattt

SEQ ID NO: 449 - DNA, 25 bp, Rattus norvegicus
aaaaatatatttctccactgacaaa

SEQ ID NO: 450 - DNA, 25 bp, Rattus norvegicus
aaaaatatatttgtccactgacaaa

SEQ ID NO: 451 - DNA, 25 bp, Rattus norvegicus
aaaaatatcagaatgcacccctctc

SEQ ID NO: 452 - DNA, 25 bp, Rattus norvegicus
aaaaatatcagattgcacccctctc

SEQ ID NO: 453 - DNA, 25 bp, Rattus norvegicus
aaaaatatttaaactcagacccact

SEQ ID NO: 454 - DNA, 25 bp, Rattus norvegicus
aaaaatatttaatctcagacccact

SEQ ID NO: 455 - DNA, 25 bp, Rattus norvegicus
aaaaatcaaggacaccccactgctg

SEQ ID NO: 456 - DNA, 25 bp, Rattus norvegicus
aaaaatcaaggagaccccactgctg

SEQ ID NO: 457 - DNA, 25 bp, Rattus norvegicus
aaaaatcacactactggcctgtact

SEQ ID NO: 458 - DNA, 25 bp, Rattus norvegicus
aaaaatcacacttctggcctgtact

SEQ ID NO: 459 - DNA, 25 bp, Rattus norvegicus
aaaaatcagaacagctgccagtgcc

SEQ ID NO: 460 - DNA, 25 bp, Rattus norvegicus
aaaaatcagaactgctgccagtgcc

SEQ ID NO: 461 - DNA, 25 bp, Rattus norvegicus
aaaaatcagcccacgaggatccagg

SEQ ID NO: 462 - DNA, 25 bp, Rattus norvegicus
aaaaatcagccctcgaggatccagg

SEQ ID NO: 463 - DNA, 25 bp, Rattus norvegicus
aaaaatccaaagcatttgagtgcca

SEQ ID NO: 464 - DNA, 25 bp, Rattus norvegicus
aaaaatccaaaggatttgagtgcca

SEQ ID NO: 465 - DNA, 25 bp, Rattus norvegicus
aaaaatccacccctagcagagatcc

SEQ ID NO: 466 - DNA, 25 bp, Rattus norvegicus
aaaaatccacccgtagcagagatcc

SEQ ID NO: 467 - DNA, 25 bp, Rattus norvegicus
aaaaatccacctcaggttcatcaca

SEQ ID NO: 468 - DNA, 25 bp, Rattus norvegicus
aaaaatccacctgaggttcatcaca

SEQ ID NO: 469 - DNA, 25 bp, Rattus norvegicus
aaaaatccagggatcagcacaccac

SEQ ID NO: 470 - DNA, 25 bp, Rattus norvegicus
aaaaatccagggttcagcacaccac

SEQ ID NO: 471 - DNA, 25 bp, Rattus norvegicus
aaaaatccatagctggtagcacaca

SEQ ID NO: 472 - DNA, 25 bp, Rattus norvegicus
aaaaatccataggtggtagcacaca

SEQ ID NO: 473 - DNA, 25 bp, Rattus norvegicus
aaaaatccatctacgtctacctcct

SEQ ID NO: 474 - DNA, 25 bp, Rattus norvegicus
aaaaatccatcttcgtctacctcct

SEQ ID NO: 475 - DNA, 25 bp, Rattus norvegicus
aaaaatcccattctggctttcagcc

SEQ ID NO: 476 - DNA, 25 bp, Rattus norvegicus
aaaaatcccattgtggctttcagcc

SEQ ID NO: 477 - DNA, 25 bp, Rattus norvegicus
aaaaatccccttcagatgggcgctg

SEQ ID NO: 478 - DNA, 25 bp, Rattus norvegicus
aaaaatccccttgagatgggcgctg

SEQ ID NO: 479 - DNA, 25 bp, Rattus norvegicus
aaaaatcccgcaatgcccatagttc

SEQ ID NO: 480 - DNA, 25 bp, Rattus norvegicus
aaaaatcccgcattgcccatagttc

SEQ ID NO: 481 - DNA, 25 bp, Rattus norvegicus
aaaaatcctggcaactcctagacat

SEQ ID NO: 482 - DNA, 25 bp, Rattus norvegicus
aaaaatcctggctactcctagacat

SEQ ID NO: 483 - DNA, 25 bp, Rattus norvegicus
aaaaatcctgtaatagagtctagca

SEQ ID NO: 484 - DNA, 25 bp, Rattus norvegicus
aaaaatcctgtattagagtctagca

SEQ ID NO: 485 - DNA, 25 bp, Rattus norvegicus
aaaaatccttgccttgacagcttcc

SEQ ID NO: 486 - DNA, 25 bp, Rattus norvegicus
aaaaatccttgcgttgacagcttcc

SEQ ID NO: 487 - DNA, 25 bp, Rattus norvegicus
aaaaatcgcgttatccttccaatca

SEQ ID NO: 488 - DNA, 25 bp, Rattus norvegicus
aaaaatcgcgttttccttccaatca

SEQ ID NO: 489 - DNA, 25 bp, Rattus norvegicus
aaaaatcgctccattgtacctctct

SEQ ID NO: 490 - DNA, 25 bp, Rattus norvegicus
aaaaatcgctcctttgtacctctct

SEQ ID NO: 491 - DNA, 25 bp, Rattus norvegicus
aaaaatcgggcactctcattcagaa

SEQ ID NO: 492 - DNA, 25 bp, Rattus norvegicus
aaaaatcgggcagtctcattcagaa

SEQ ID NO: 493 - DNA, 25 bp, Rattus norvegicus
aaaaatctacctctttcagactgta

SEQ ID NO: 494 - DNA, 25 bp, Rattus norvegicus
aaaaatctacctgtttcagactgta

SEQ ID NO: 495 - DNA, 25 bp, Rattus norvegicus
aaaaatctacgtccaaccccaagct

SEQ ID NO: 496 - DNA, 25 bp, Rattus norvegicus
aaaaatctacgtgcaaccccaagct

SEQ ID NO: 497 - DNA, 25 bp, Rattus norvegicus
aaaaatctatgcactctttcccatg

SEQ ID NO: 498 - DNA, 25 bp, Rattus norvegicus
aaaaatctatgctctctttcccatg

SEQ ID NO: 499 - DNA, 25 bp, Rattus norvegicus
aaaaatctcgccattgtgactgact

SEQ ID NO: 500 - DNA, 25 bp, Rattus norvegicus
aaaaatctcgcctttgtgactgact

SEQ ID NO: 501 - DNA, 25 bp, Rattus norvegicus
aaaaatctctacatctgataccatt

SEQ ID NO: 502 - DNA, 25 bp, Rattus norvegicus
aaaaatctctacttctgataccatt

SEQ ID NO: 503 - DNA, 25 bp, Rattus norvegicus
aaaaatctctctactgcctgtagaa

SEQ ID NO: 504 - DNA, 25 bp, Rattus norvegicus
aaaaatctctcttctgcctgtagaa

SEQ ID NO: 505 - DNA, 25 bp, Rattus norvegicus
aaaaatctctgtccagtgaaccctc

SEQ ID NO: 506 - DNA, 25 bp, Rattus norvegicus
aaaaatctctgtgcagtgaaccctc

SEQ ID NO: 507 - DNA, 25 bp, Rattus norvegicus
aaaaatctcttcctgttcattcaaa

SEQ ID NO: 508 - DNA, 25 bp, Rattus norvegicus
aaaaatctcttcgtgttcattcaaa

SEQ ID NO: 509 - DNA, 25 bp, Rattus norvegicus
aaaaatctgaccagtacgagacaag

SEQ ID NO: 510 - DNA, 25 bp, Rattus norvegicus
aaaaatctgacctgtacgagacaag

SEQ ID NO: 511 - DNA, 25 bp, Rattus norvegicus
aaaaatctgatgatcccatttcctt

SEQ ID NO: 512 - DNA, 25 bp, Rattus norvegicus
aaaaatctgatgttcccatttcctt

SEQ ID NO: 513 - DNA, 25 bp, Rattus norvegicus
aaaaatctggtcacctgacccaggg

SEQ ID NO: 514 - DNA, 25 bp, Rattus norvegicus
aaaaatctggtctcctgacccaggg

SEQ ID NO: 515 - DNA, 25 bp, Rattus norvegicus
aaaaatcttggcaacctctgcattt

SEQ ID NO: 516 - DNA, 25 bp, Rattus norvegicus
aaaaatcttggctacctctgcattt

SEQ ID NO: 517 - DNA, 25 bp, Rattus norvegicus
aaaaatcttgtacagtccagtgtaa

SEQ ID NO: 518 - DNA, 25 bp, Rattus norvegicus
aaaaatcttgtagagtccagtgtaa

SEQ ID NO: 519 - DNA, 25 bp, Rattus norvegicus
aaaaatctttggagatgtctgagga

SEQ ID NO: 520 - DNA, 25 bp, Rattus norvegicus
aaaaatctttggtgatgtctgagga

SEQ ID NO: 521 - DNA, 25 bp, Rattus norvegicus
aaaaatgacttcagtaggcccatac

SEQ ID NO: 522 - DNA, 25 bp, Rattus norvegicus
aaaaatgacttctgtaggcccatac

SEQ ID NO: 523 - DNA, 25 bp, Rattus norvegicus
aaaaatgagcatacgccccttttca

SEQ ID NO: 524 - DNA, 25 bp, Rattus norvegicus
aaaaatgagcattcgccccttttca

SEQ ID NO: 525 - DNA, 25 bp, Rattus norvegicus
aaaaatgagctaccaggacccctac

SEQ ID NO: 526 - DNA, 25 bp, Rattus norvegicus
aaaaatgagctagcaggacccctac

SEQ ID NO: 527 - DNA, 25 bp, Rattus norvegicus
aaaaatgattcaaccactctcctac

SEQ ID NO: 528 - DNA, 25 bp, Rattus norvegicus
aaaaatgattcatccactctcctac

SEQ ID NO: 529 - DNA, 25 bp, Rattus norvegicus
aaaaatgattgcaccttctccagct

SEQ ID NO: 530 - DNA, 25 bp, Rattus norvegicus
aaaaatgattgctccttctccagct

SEQ ID NO: 531 - DNA, 25 bp, Rattus norvegicus
aaaaatgcaaatctccctccgcagt

SEQ ID NO: 532 - DNA, 25 bp, Rattus norvegicus
aaaaatgcaaatgtccctccgcagt

SEQ ID NO: 533 - DNA, 25 bp, Rattus norvegicus
aaaaatgcacatctatgcccatttt

SEQ ID NO: 534 - DNA, 25 bp, Rattus norvegicus
aaaaatgcacatgtatgcccatttt

SEQ ID NO: 535 - DNA, 25 bp, Rattus norvegicus
aaaaatgcagcaccgctgctgaggt

SEQ ID NO: 536 - DNA, 25 bp, Rattus norvegicus
aaaaatgcagcagcgctgctgaggt

SEQ ID NO: 537 - DNA, 25 bp, Rattus norvegicus
aaaaatgcagtgagccaggaagggc

SEQ ID NO: 538 - DNA, 25 bp, Rattus norvegicus
aaaaatgcagtgtgccaggaagggc

SEQ ID NO: 539 - DNA, 25 bp, Rattus norvegicus
aaaaatgccactctcctggtgattt

SEQ ID NO: 540 - DNA, 25 bp, Rattus norvegicus
aaaaatgccactgtcctggtgattt

SEQ ID NO: 541 - DNA, 25 bp, Rattus norvegicus
aaaaatgcctagagtacatctggtt

SEQ ID NO: 542 - DNA, 25 bp, Rattus norvegicus
aaaaatgcctagtgtacatctggtt

SEQ ID NO: 543 - DNA, 25 bp, Rattus norvegicus
aaaaatgcgggcactgtgtcagtgt

SEQ ID NO: 544 - DNA, 25 bp, Rattus norvegicus
aaaaatgcgggctctgtgtcagtgt

SEQ ID NO: 545 - DNA, 25 bp, Rattus norvegicus
aaaaatgctctgacgctgaattcgt

SEQ ID NO: 546 - DNA, 25 bp, Rattus norvegicus
aaaaatgctctgtcgctgaattcgt

SEQ ID NO: 547 - DNA, 25 bp, Rattus norvegicus
aaaaatgctcttcatgctgtcccgt

SEQ ID NO: 548 - DNA, 25 bp, Rattus norvegicus
aaaaatgctcttgatgctgtcccgt

SEQ ID NO: 549 - DNA, 25 bp, Rattus norvegicus
aaaaatgctgggcagcctgtgccat

SEQ ID NO: 550 - DNA, 25 bp, Rattus norvegicus
aaaaatgctggggagcctgtgccat

SEQ ID NO: 551 - DNA, 25 bp, Rattus norvegicus
aaaaatgctgttcctagggcccatt

SEQ ID NO: 552 - DNA, 25 bp, Rattus norvegicus
aaaaatgctgttgctagggcccatt

SEQ ID NO: 553 - DNA, 25 bp, Rattus norvegicus
aaaaatggatctacacaggtcaggg

SEQ ID NO: 554 - DNA, 25 bp, Rattus norvegicus
aaaaatggatcttcacaggtcaggg

SEQ ID NO: 555 - DNA, 25 bp, Rattus norvegicus
aaaaatggccttcagttattcactt

SEQ ID NO: 556 - DNA, 25 bp, Rattus norvegicus
aaaaatggccttgagttattcactt

SEQ ID NO: 557 - DNA, 25 bp, Rattus norvegicus
aaaaatggcgccagtggcaccttca

SEQ ID NO: 558 - DNA, 25 bp, Rattus norvegicus
aaaaatggcgcctgtggcaccttca

SEQ ID NO: 559 - DNA, 25 bp, Rattus norvegicus
aaaaatggtaccaggccacctcaga

SEQ ID NO: 560 - DNA, 25 bp, Rattus norvegicus
aaaaatggtaccattctcacacgca

SEQ ID NO: 561 - DNA, 25 bp, Rattus norvegicus
aaaaatggtacctggccacctcaga

SEQ ID NO: 562 - DNA, 25 bp, Rattus norvegicus
aaaaatggtacctttctcacacgca

SEQ ID NO: 563 - DNA, 25 bp, Rattus norvegicus
aaaaatggtatccacctctacctga

SEQ ID NO: 564 - DNA, 25 bp, Rattus norvegicus
aaaaatggtatcgacctctacctga

SEQ ID NO: 565 - DNA, 25 bp, Rattus norvegicus
aaaaatggtcaccactcccatgagg

SEQ ID NO: 566 - DNA, 25 bp, Rattus norvegicus
aaaaatggtcacgactcccatgagg

SEQ ID NO: 567 - DNA, 25 bp, Rattus norvegicus
aaaaatggtctcatagcagtgcccc

SEQ ID NO: 568 - DNA, 25 bp, Rattus norvegicus
aaaaatggtctcttagcagtgcccc

SEQ ID NO: 569 - DNA, 25 bp, Rattus norvegicus
aaaaatggttctcagctccgttgtg

SEQ ID NO: 570 - DNA, 25 bp, Rattus norvegicus
aaaaatggttctgagctccgttgtg

SEQ ID NO: 571 - DNA, 25 bp, Rattus norvegicus
aaaaatgtagatcccttctctgtcg

SEQ ID NO: 572 - DNA, 25 bp, Rattus norvegicus
aaaaatgtagatgccttctctgtcg

SEQ ID NO: 573 - DNA, 25 bp, Rattus norvegicus
aaaaatgtatctcgctcctgggaga

SEQ ID NO: 574 - DNA, 25 bp, Rattus norvegicus
aaaaatgtatctggctcctgggaga

SEQ ID NO: 575 - DNA, 25 bp, Rattus norvegicus
aaaaatgtcagcatttctctccacc

SEQ ID NO: 576 - DNA, 25 bp, Rattus norvegicus
aaaaatgtcagcttttctctccacc

SEQ ID NO: 577 - DNA, 25 bp, Rattus norvegicus
aaaaatgtccctacagtgtcatcag

SEQ ID NO: 578 - DNA, 25 bp, Rattus norvegicus
aaaaatgtcccttcagtgtcatcag

SEQ ID NO: 579 - DNA, 25 bp, Rattus norvegicus
aaaaatgtccgccaccttcattggc

SEQ ID NO: 580 - DNA, 25 bp, Rattus norvegicus
aaaaatgtccgcgaccttcattggc

SEQ ID NO: 581 - DNA, 25 bp, Rattus norvegicus
aaaaatgtgtccagccaccacgagg

SEQ ID NO: 582 - DNA, 25 bp, Rattus norvegicus
aaaaatgtgtcctgccaccacgagg

SEQ ID NO: 583 - DNA, 25 bp, Rattus norvegicus
aaaaatgttcctccctataatcccg

SEQ ID NO: 584 - DNA, 25 bp, Rattus norvegicus
aaaaatgttcctgcctataatcccg

SEQ ID NO: 585 - DNA, 25 bp, Rattus norvegicus
aaaaatgttgtactctgttccttga

SEQ ID NO: 586 - DNA, 25 bp, Rattus norvegicus
aaaaatgttgtagtctgttccttga

SEQ ID NO: 587 - DNA, 25 bp, Rattus norvegicus
aaaaatgttgtcaccttcctgttgg

SEQ ID NO: 588 - DNA, 25 bp, Rattus norvegicus
aaaaatgttgtctccttcctgttgg

SEQ ID NO: 589 - DNA, 25 bp, Rattus norvegicus
aaaaattaactcatatgctcgtttg

SEQ ID NO: 590 - DNA, 25 bp, Rattus norvegicus
aaaaattaactcttatgctcgtttg

SEQ ID NO: 591 - DNA, 25 bp, Rattus norvegicus
aaaaattacagcacctcaggtctaa

SEQ ID NO: 592 - DNA, 25 bp, Rattus norvegicus
aaaaattacagctcctcaggtctaa

SEQ ID NO: 593 - DNA, 25 bp, Rattus norvegicus
aaaaattacccgcacctgtcagtct

SEQ ID NO: 594 - DNA, 25 bp, Rattus norvegicus
aaaaattacccggacctgtcagtct

SEQ ID NO: 595 - DNA, 25 bp, Rattus norvegicus
aaaaattactctactgctcgctatg

SEQ ID NO: 596 - DNA, 25 bp, Rattus norvegicus
aaaaattactcttctgctcgctatg

SEQ ID NO: 597 - DNA, 25 bp, Rattus norvegicus
aaaaattcaaaaccaccagtgatag

SEQ ID NO: 598 - DNA, 25 bp, Rattus norvegicus
aaaaattcaaaagcaccagtgatag

SEQ ID NO: 599 - DNA, 25 bp, Rattus norvegicus
aaaaattcatcgctctaggcctctt

SEQ ID NO: 600 - DNA, 25 bp, Rattus norvegicus
aaaaattcatcggtctaggcctctt

SEQ ID NO: 601 - DNA, 25 bp, Rattus norvegicus
aaaaattccagaacgcttccctgag

SEQ ID NO: 602 - DNA, 25 bp, Rattus norvegicus
aaaaattccagatcgcttccctgag

SEQ ID NO: 603 - DNA, 25 bp, Rattus norvegicus
aaaaattcgaataccaccacactgg

SEQ ID NO: 604 - DNA, 25 bp, Rattus norvegicus
aaaaattcgaattccaccacactgg

SEQ ID NO: 605 - DNA, 25 bp, Rattus norvegicus
aaaaattctcctagtgctcagtgcc

SEQ ID NO: 606 - DNA, 25 bp, Rattus norvegicus
aaaaattctccttgtgctcagtgcc

SEQ ID NO: 607 - DNA, 25 bp, Rattus norvegicus
aaaaattgagacagcatctcactat

SEQ ID NO: 608 - DNA, 25 bp, Rattus norvegicus
aaaaattgagactgcatctcactat

SEQ ID NO: 609 - DNA, 25 bp, Rattus norvegicus
aaaaattgcattagagcacggagtc

SEQ ID NO: 610 - DNA, 25 bp, Rattus norvegicus
aaaaattgcatttgagcacggagtc

SEQ ID NO: 611 - DNA, 25 bp, Rattus norvegicus
aaaaattgctttcttctcgctgtgt

SEQ ID NO: 612 - DNA, 25 bp, Rattus norvegicus
aaaaattgctttgttctcgctgtgt

SEQ ID NO: 613 - DNA, 25 bp, Rattus norvegicus
aaaaattggcaaccagccgctattt

SEQ ID NO: 614 - DNA, 25 bp, Rattus norvegicus
aaaaattggcaagcagccgctattt

SEQ ID NO: 615 - DNA, 25 bp, Rattus norvegicus
aaaaattggtccaagcggcacacga

SEQ ID NO: 616 - DNA, 25 bp, Rattus norvegicus
aaaaattggtcctagcggcacacga

SEQ ID NO: 617 - DNA, 25 bp, Rattus norvegicus
aaaaattggtgcaccgaggtccctg

SEQ ID NO: 618 - DNA, 25 bp, Rattus norvegicus
aaaaattggtgctccgaggtccctg

SEQ ID NO: 619 - DNA, 25 bp, Rattus norvegicus
aaaacaaaaaccacgcactgtgcta

SEQ ID NO: 620 - DNA, 25 bp, Rattus norvegicus
aaaacaaaaacctcgcactgtgcta

SEQ ID NO: 621 - DNA, 25 bp, Rattus norvegicus
aaaacaaatatgctttgccctggag

SEQ ID NO: 622 - DNA, 25 bp, Rattus norvegicus
aaaacaaatatggtttgccctggag

SEQ ID NO: 623 - DNA, 25 bp, Rattus norvegicus
aaaacaacatatcgctggacttttt

SEQ ID NO: 624 - DNA, 25 bp, Rattus norvegicus
aaaacaacatatggctggacttttt

SEQ ID NO: 625 - DNA, 25 bp, Rattus norvegicus
aaaacaacatccatctctgtcactg

SEQ ID NO: 626 - DNA, 25 bp, Rattus norvegicus
aaaacaacatccttctctgtcactg

SEQ ID NO: 627 - DNA, 25 bp, Rattus norvegicus
aaaacaacatgcatttctccaccaa

SEQ ID NO: 628 - DNA, 25 bp, Rattus norvegicus
aaaacaacatgcttttctccaccaa

SEQ ID NO: 629 - DNA, 25 bp, Rattus norvegicus
aaaacaacgactacagcagggctgt

SEQ ID NO: 630 - DNA, 25 bp, Rattus norvegicus
aaaacaacgacttcagcagggctgt

SEQ ID NO: 631 - DNA, 25 bp, Rattus norvegicus
aaaacaactaggatcccactctcca

SEQ ID NO: 632 - DNA, 25 bp, Rattus norvegicus
aaaacaactaggttcccactctcca

SEQ ID NO: 633 - DNA, 25 bp, Rattus norvegicus
aaaacaactgctctgatccaggctg

SEQ ID NO: 634 - DNA, 25 bp, Rattus norvegicus
aaaacaactgctgtgatccaggctg

SEQ ID NO: 635 - DNA, 25 bp, Rattus norvegicus
aaaacaacttttacattctctggtg

SEQ ID NO: 636 - DNA, 25 bp, Rattus norvegicus
aaaacaactttttcattctctggtg

SEQ ID NO: 637 - DNA, 25 bp, Rattus norvegicus
aaaacaagccccaccccagaggatg

SEQ ID NO: 638 - DNA, 25 bp, Rattus norvegicus
aaaacaagcccctccccagaggatg

SEQ ID NO: 639 - DNA, 25 bp, Rattus norvegicus
aaaacaagccctaatagtcctccat

SEQ ID NO: 640 - DNA, 25 bp, Rattus norvegicus
aaaacaagcccttatagtcctccat

SEQ ID NO: 641 - DNA, 25 bp, Rattus norvegicus
aaaacaagcctgacgtgcctttagt

SEQ ID NO: 642 - DNA, 25 bp, Rattus norvegicus
aaaacaagcctgtcgtgcctttagt

SEQ ID NO: 643 - DNA, 25 bp, Rattus norvegicus
aaaacaagccttactcaggtggtat

SEQ ID NO: 644 - DNA, 25 bp, Rattus norvegicus
aaaacaagcctttctcaggtggtat

SEQ ID NO: 645 - DNA, 25 bp, Rattus norvegicus
aaaacaagggtcacctggctgtgga

SEQ ID NO: 646 - DNA, 25 bp, Rattus norvegicus
aaaacaagggtctcctggctgtgga

SEQ ID NO: 647 - DNA, 25 bp, Rattus norvegicus
aaaacaagtactcacccctgaggca

SEQ ID NO: 648 - DNA, 25 bp, Rattus norvegicus
aaaacaagtactgacccctgaggca

SEQ ID NO: 649 - DNA, 25 bp, Rattus norvegicus
aaaacaagtgaaccttggtgcaagc

SEQ ID NO: 650 - DNA, 25 bp, Rattus norvegicus
aaaacaagtgaagcttggtgcaagc

SEQ ID NO: 651 - DNA, 25 bp, Rattus norvegicus
aaaacaagtggccgcgaggtttcag

SEQ ID NO: 652 - DNA, 25 bp, Rattus norvegicus
aaaacaagtggcggcgaggtttcag

SEQ ID NO: 653 - DNA, 25 bp, Rattus norvegicus
aaaacaagtgtcagcatcttcaaaa

SEQ ID NO: 654 - DNA, 25 bp, Rattus norvegicus
aaaacaagtgtctgcatcttcaaaa

SEQ ID NO: 655 - DNA, 25 bp, Rattus norvegicus
aaaacaagttctctcattccacagc

SEQ ID NO: 656 - DNA, 25 bp, Rattus norvegicus
aaaacaagttctgtcattccacagc

SEQ ID NO: 657 - DNA, 25 bp, Rattus norvegicus
aaaacaagttgactggaagattcca

SEQ ID NO: 658 - DNA, 25 bp, Rattus norvegicus
aaaacaagttgagtggaagattcca

SEQ ID NO: 659 - DNA, 25 bp, Rattus norvegicus
aaaacaatattcaccattccctacg

SEQ ID NO: 660 - DNA, 25 bp, Rattus norvegicus
aaaacaatattctccattccctacg

SEQ ID NO: 661 - DNA, 25 bp, Rattus norvegicus
aaaacaatcttcactcctcctttga

SEQ ID NO: 662 - DNA, 25 bp, Rattus norvegicus
aaaacaatcttctctcctcctttga

SEQ ID NO: 663 - DNA, 25 bp, Rattus norvegicus
aaaacaatgatcagttctctgcctg

SEQ ID NO: 664 - DNA, 25 bp, Rattus norvegicus
aaaacaatgatctgttctctgcctg

SEQ ID NO: 665 - DNA, 25 bp, Rattus norvegicus
aaaacaatgcgcaggtggtcggact

SEQ ID NO: 666 - DNA, 25 bp, Rattus norvegicus
aaaacaatgcgctggtggtcggact

SEQ ID NO: 667 - DNA, 25 bp, Rattus norvegicus
aaaacaatgctcaggccttggtcta

SEQ ID NO: 668 - DNA, 25 bp, Rattus norvegicus
aaaacaatgctctggccttggtcta

SEQ ID NO: 669 - DNA, 25 bp, Rattus norvegicus
aaaacaatgtgacctggcccctacg

SEQ ID NO: 670 - DNA, 25 bp, Rattus norvegicus
aaaacaatgtgagctggcccctacg

SEQ ID NO: 671 - DNA, 25 bp, Rattus norvegicus
aaaacaattttaaggccagaggcag

SEQ ID NO: 672 - DNA, 25 bp, Rattus norvegicus
aaaacaattttatggccagaggcag

SEQ ID NO: 673 - DNA, 25 bp, Rattus norvegicus
aaaacacaaaccagctgggcacctt

SEQ ID NO: 674 - DNA, 25 bp, Rattus norvegicus
aaaacacaaacctgctgggcacctt

SEQ ID NO: 675 - DNA, 25 bp, Rattus norvegicus
aaaacacaaccccagcaggtgtatg

SEQ ID NO: 676 - DNA, 25 bp, Rattus norvegicus
aaaacacaacccgagcaggtgtatg

SEQ ID NO: 677 - DNA, 25 bp, Rattus norvegicus
aaaacacaagccaagctccagtttc

SEQ ID NO: 678 - DNA, 25 bp, Rattus norvegicus
aaaacacaagcctagctccagtttc

SEQ ID NO: 679 - DNA, 25 bp, Rattus norvegicus
aaaacacaatcgctcctgggctgag

SEQ ID NO: 680 - DNA, 25 bp, Rattus norvegicus
aaaacacaatcggtcctgggctgag

SEQ ID NO: 681 - DNA, 25 bp, Rattus norvegicus
aaaacacacagtaactccagtcaaa

SEQ ID NO: 682 - DNA, 25 bp, Rattus norvegicus
aaaacacacagttactccagtcaaa

SEQ ID NO: 683 - DNA, 25 bp, Rattus norvegicus
aaaacacaccacctctcttattctg

SEQ ID NO: 684 - DNA, 25 bp, Rattus norvegicus
aaaacacaccacgtctcttattctg

SEQ ID NO: 685 - DNA, 25 bp, Rattus norvegicus
aaaacacacgctctagtcacccaag

SEQ ID NO: 686 - DNA, 25 bp, Rattus norvegicus
aaaacacacgctgtagtcacccaag

SEQ ID NO: 687 - DNA, 25 bp, Rattus norvegicus
aaaacacagactattcagttcagta

SEQ ID NO: 688 - DNA, 25 bp, Rattus norvegicus
aaaacacagactcgcgttgcaaggc

SEQ ID NO: 689 - DNA, 25 bp, Rattus norvegicus
aaaacacagactggcgttgcaaggc

SEQ ID NO: 690 - DNA, 25 bp, Rattus norvegicus
aaaacacagacttttcagttcagta

SEQ ID NO: 691 - DNA, 25 bp, Rattus norvegicus
aaaacacagcatcctactcagcttt

SEQ ID NO: 692 - DNA, 25 bp, Rattus norvegicus
aaaacacagcatgctactcagcttt

SEQ ID NO: 693 - DNA, 25 bp, Rattus norvegicus
aaaacacaggcacctctctgaggga

SEQ ID NO: 694 - DNA, 25 bp, Rattus norvegicus
aaaacacaggcagctctctgaggga

SEQ ID NO: 695 - DNA, 25 bp, Rattus norvegicus
aaaacacatcttacctgtcactttc

SEQ ID NO: 696 - DNA, 25 bp, Rattus norvegicus
aaaacacatctttcctgtcactttc

SEQ ID NO: 697 - DNA, 25 bp, Rattus norvegicus
aaaacaccaccacagagcctacagt

SEQ ID NO: 698 - DNA, 25 bp, Rattus norvegicus
aaaacaccaccagagagcctacagt

SEQ ID NO: 699 - DNA, 25 bp, Rattus norvegicus
aaaacaccacctctaatgcacttgt

SEQ ID NO: 700 - DNA, 25 bp, Rattus norvegicus
aaaacaccacctgtaatgcacttgt

SEQ ID NO: 701 - DNA, 25 bp, Rattus norvegicus
aaaacaccagagacatccgcagtca

SEQ ID NO: 702 - DNA, 25 bp, Rattus norvegicus
aaaacaccagagtcatccgcagtca

SEQ ID NO: 703 - DNA, 25 bp, Rattus norvegicus
aaaacaccaggcatgacgacacaca

SEQ ID NO: 704 - DNA, 25 bp, Rattus norvegicus
aaaacaccaggcttgacgacacaca

SEQ ID NO: 705 - DNA, 25 bp, Rattus norvegicus
aaaacaccatctcagactagcccgt

SEQ ID NO: 706 - DNA, 25 bp, Rattus norvegicus
aaaacaccatctgagactagcccgt

SEQ ID NO: 707 - DNA, 25 bp, Rattus norvegicus
aaaacaccattgacaacttcctgca

SEQ ID NO: 708 - DNA, 25 bp, Rattus norvegicus
aaaacaccattgtcaacttcctgca

SEQ ID NO: 709 - DNA, 25 bp, Rattus norvegicus
aaaacacccagtcaatccctgtaag

SEQ ID NO: 710 - DNA, 25 bp, Rattus norvegicus
aaaacacccagtgaatccctgtaag

SEQ ID NO: 711 - DNA, 25 bp, Rattus norvegicus
aaaacacccatgcactctcgttact

SEQ ID NO: 712 - DNA, 25 bp, Rattus norvegicus
aaaacacccatggactctcgttact

SEQ ID NO: 713 - DNA, 25 bp, Rattus norvegicus
aaaacaccccagagaagcgggctga

SEQ ID NO: 714 - DNA, 25 bp, Rattus norvegicus
aaaacaccccagtgaagcgggctga

SEQ ID NO: 715 - DNA, 25 bp, Rattus norvegicus
aaaacaccgtagactcgtagtctcg

SEQ ID NO: 716 - DNA, 25 bp, Rattus norvegicus
aaaacaccgtagtctcgtagtctcg

SEQ ID NO: 717 - DNA, 25 bp, Rattus norvegicus
aaaacacctcgcaggagatgggcct

SEQ ID NO: 718 - DNA, 25 bp, Rattus norvegicus
aaaacacctcgctggagatgggcct

SEQ ID NO: 719 - DNA, 25 bp, Rattus norvegicus
aaaacacctctaaaacctgacaccg

SEQ ID NO: 720 - DNA, 25 bp, Rattus norvegicus
aaaacacctctataacctgacaccg

SEQ ID NO: 721 - DNA, 25 bp, Rattus norvegicus
aaaacaccttgtaatttcatggaat

SEQ ID NO: 722 - DNA, 25 bp, Rattus norvegicus
aaaacaccttgttatttcatggaat

SEQ ID NO: 723 - DNA, 25 bp, Rattus norvegicus
aaaacacctttgcagccagttagct

SEQ ID NO: 724 - DNA, 25 bp, Rattus norvegicus
aaaacacctttggagccagttagct

SEQ ID NO: 725 - DNA, 25 bp, Rattus norvegicus
aaaacacgctcaagtgcactttccg

SEQ ID NO: 726 - DNA, 25 bp, Rattus norvegicus
aaaacacgctcatgtgcactttccg

SEQ ID NO: 727 - DNA, 25 bp, Rattus norvegicus
aaaacacggcttcctcaggcttgac

SEQ ID NO: 728 - DNA, 25 bp, Rattus norvegicus
aaaacacggcttgctcaggcttgac

SEQ ID NO: 729 - DNA, 25 bp, Rattus norvegicus
aaaacacgtagactgcctggcaccg

SEQ ID NO: 730 - DNA, 25 bp, Rattus norvegicus
aaaacacgtagagtgcctggcaccg

SEQ ID NO: 731 - DNA, 25 bp, Rattus norvegicus
aaaacacgtgttcagggctatccca

SEQ ID NO: 732 - DNA, 25 bp, Rattus norvegicus
aaaacacgtgttgagggctatccca

SEQ ID NO: 733 - DNA, 25 bp, Rattus norvegicus
aaaacactacatcgcactagctggg

SEQ ID NO: 734 - DNA, 25 bp, Rattus norvegicus
aaaacactacatggcactagctggg

SEQ ID NO: 735 - DNA, 25 bp, Rattus norvegicus
aaaacactactgatgacctctcgga

SEQ ID NO: 736 - DNA, 25 bp, Rattus norvegicus
aaaacactactgttgacctctcgga

SEQ ID NO: 737 - DNA, 25 bp, Rattus norvegicus
aaaacactagtgaagcctgctgaac

SEQ ID NO: 738 - DNA, 25 bp, Rattus norvegicus
aaaacactagtgtagcctgctgaac

SEQ ID NO: 739 - DNA, 25 bp, Rattus norvegicus
aaaacactctctagcttactgcttc

SEQ ID NO: 740 - DNA, 25 bp, Rattus norvegicus
aaaacactctcttgcttactgcttc

SEQ ID NO: 741 - DNA, 25 bp, Rattus norvegicus
aaaacactggtaccaacttctcctt

SEQ ID NO: 742 - DNA, 25 bp, Rattus norvegicus
aaaacactggtagcaacttctcctt

SEQ ID NO: 743 - DNA, 25 bp, Rattus norvegicus
aaaacactgtcacgaggtccgcctg

SEQ ID NO: 744 - DNA, 25 bp, Rattus norvegicus
aaaacactgtcaggaggtccgcctg

SEQ ID NO: 745 - DNA, 25 bp, Rattus norvegicus
aaaacacttcagagccctttgaggc

SEQ ID NO: 746 - DNA, 25 bp, Rattus norvegicus
aaaacacttcagtgccctttgaggc

SEQ ID NO: 747 - DNA, 25 bp, Rattus norvegicus
aaaacacttggactcttcttgcagc

SEQ ID NO: 748 - DNA, 25 bp, Rattus norvegicus
aaaacacttggagtcttcttgcagc

SEQ ID NO: 749 - DNA, 25 bp, Rattus norvegicus
aaaacagaacatcaaagcccaggga

SEQ ID NO: 750 - DNA, 25 bp, Rattus norvegicus
aaaacagaacatgaaagcccaggga

SEQ ID NO: 751 - DNA, 25 bp, Rattus norvegicus
aaaacagaagctcgcctgtgcctgg

SEQ ID NO: 752 - DNA, 25 bp, Rattus norvegicus
aaaacagaagctggcctgtgcctgg

SEQ ID NO: 753 - DNA, 25 bp, Rattus norvegicus
aaaacagaataaccctcagcctcct

SEQ ID NO: 754 - DNA, 25 bp, Rattus norvegicus
aaaacagaataagcctcagcctcct

SEQ ID NO: 755 - DNA, 25 bp, Rattus norvegicus
aaaacagacaacatcttcttcgcca

SEQ ID NO: 756 - DNA, 25 bp, Rattus norvegicus
aaaacagacaacttcttcttcgcca

SEQ ID NO: 757 - DNA, 25 bp, Rattus norvegicus
aaaacagacactacattgccatatg

SEQ ID NO: 758 - DNA, 25 bp, Rattus norvegicus
aaaacagacacttcattgccatatg

SEQ ID NO: 759 - DNA, 25 bp, Rattus norvegicus
aaaacagactcgactctgcatggtt

SEQ ID NO: 760 - DNA, 25 bp, Rattus norvegicus
aaaacagactcgtctctgcatggtt

SEQ ID NO: 761 - DNA, 25 bp, Rattus norvegicus
aaaacagagccccaggtgctagcta

SEQ ID NO: 762 - DNA, 25 bp, Rattus norvegicus
aaaacagagcccgaggtgctagcta

SEQ ID NO: 763 - DNA, 25 bp, Rattus norvegicus
aaaacagatccaactgggccagtgg

SEQ ID NO: 764 - DNA, 25 bp, Rattus norvegicus
aaaacagatccatctgggccagtgg

SEQ ID NO: 765 - DNA, 25 bp, Rattus norvegicus
aaaacagatccgcagggctctgcat

SEQ ID NO: 766 - DNA, 25 bp, Rattus norvegicus
aaaacagatccggagggctctgcat

SEQ ID NO: 767 - DNA, 25 bp, Rattus norvegicus
aaaacagcacacctcacacttggag

SEQ ID NO: 768 - DNA, 25 bp, Rattus norvegicus
aaaacagcacacgtcacacttggag

SEQ ID NO: 769 - DNA, 25 bp, Rattus norvegicus
aaaacagcacatagggcctccggat

SEQ ID NO: 770 - DNA, 25 bp, Rattus norvegicus
aaaacagcacattgggcctccggat

SEQ ID NO: 771 - DNA, 25 bp, Rattus norvegicus
aaaacagccagccattggagcctat

SEQ ID NO: 772 - DNA, 25 bp, Rattus norvegicus
aaaacagccagcgattggagcctat

SEQ ID NO: 773 - DNA, 25 bp, Rattus norvegicus
aaaacagcccagatctagggcctat

SEQ ID NO: 774 - DNA, 25 bp, Rattus norvegicus
aaaacagcccagttctagggcctat

SEQ ID NO: 775 - DNA, 25 bp, Rattus norvegicus
aaaacagcccatcctggacgctgct

SEQ ID NO: 776 - DNA, 25 bp, Rattus norvegicus
aaaacagcccatgctggacgctgct

SEQ ID NO: 777 - DNA, 25 bp, Rattus norvegicus
aaaacagccctgaccgtcagaaagt

SEQ ID NO: 778 - DNA, 25 bp, Rattus norvegicus
aaaacagccctgtccgtcagaaagt

SEQ ID NO: 779 - DNA, 25 bp, Rattus norvegicus
aaaacagcctcacttcggtgtatcc

SEQ ID NO: 780 - DNA, 25 bp, Rattus norvegicus
aaaacagcctcagttcggtgtatcc

SEQ ID NO: 781 - DNA, 25 bp, Rattus norvegicus
aaaacagcctgcattctgtctggaa

SEQ ID NO: 782 - DNA, 25 bp, Rattus norvegicus
aaaacagcctgctttctgtctggaa

SEQ ID NO: 783 - DNA, 25 bp, Rattus norvegicus
aaaacagcctgtaagccttagccat

SEQ ID NO: 784 - DNA, 25 bp, Rattus norvegicus
aaaacagcctgttagccttagccat

SEQ ID NO: 785 - DNA, 25 bp, Rattus norvegicus
aaaacagcgactatctaggaagaag

SEQ ID NO: 786 - DNA, 25 bp, Rattus norvegicus
aaaacagcgactttctaggaagaag

SEQ ID NO: 787 - DNA, 25 bp, Rattus norvegicus
aaaacagcgtgcctgcttttgttct

SEQ ID NO: 788 - DNA, 25 bp, Rattus norvegicus
aaaacagcgtgcgtgcttttgttct

SEQ ID NO: 789 - DNA, 25 bp, Rattus norvegicus
aaaacagctactataacagtgtggg

SEQ ID NO: 790 - DNA, 25 bp, Rattus norvegicus
aaaacagctactttaacagtgtggg

SEQ ID NO: 791 - DNA, 25 bp, Rattus norvegicus
aaaacagctcttacttactacagaa

SEQ ID NO: 792 - DNA, 25 bp, Rattus norvegicus
aaaacagctctttcttactacagaa

SEQ ID NO: 793 - DNA, 25 bp, Rattus norvegicus
aaaacagctgaactgttcgtccctc

SEQ ID NO: 794 - DNA, 25 bp, Rattus norvegicus
aaaacagctgaagtgttcgtccctc

SEQ ID NO: 795 - DNA, 25 bp, Rattus norvegicus
aaaacagctggaaattacggcaatt

SEQ ID NO: 796 - DNA, 25 bp, Rattus norvegicus
aaaacagctggatattacggcaatt

SEQ ID NO: 797 - DNA, 25 bp, Rattus norvegicus
aaaacagctgttactgagaactgta

SEQ ID NO: 798 - DNA, 25 bp, Rattus norvegicus
aaaacagctgtttctgagaactgta

SEQ ID NO: 799 - DNA, 25 bp, Rattus norvegicus
aaaacagcttctacacagactccag

SEQ ID NO: 800 - DNA, 25 bp, Rattus norvegicus
aaaacagcttcttcacagactccag

SEQ ID NO: 801 - DNA, 25 bp, Rattus norvegicus
aaaacagcttggatctctgtgttgg

SEQ ID NO: 802 - DNA, 25 bp, Rattus norvegicus
aaaacagcttggttctctgtgttgg

SEQ ID NO: 803 - DNA, 25 bp, Rattus norvegicus
aaaacagcttttctccttcctagat

SEQ ID NO: 804 - DNA, 25 bp, Rattus norvegicus
aaaacagcttttgtccttcctagat

SEQ ID NO: 805 - DNA, 25 bp, Rattus norvegicus
aaaacaggaagtcgctgtcgctcca

SEQ ID NO: 806 - DNA, 25 bp, Rattus norvegicus
aaaacaggaagtggctgtcgctcca

SEQ ID NO: 807 - DNA, 25 bp, Rattus norvegicus
aaaacaggacttatgggcagatcac

SEQ ID NO: 808 - DNA, 25 bp, Rattus norvegicus
aaaacaggacttttgggcagatcac

SEQ ID NO: 809 - DNA, 25 bp, Rattus norvegicus
aaaacaggcagcacttctaacctct

SEQ ID NO: 810 - DNA, 25 bp, Rattus norvegicus
aaaacaggcagctcttctaacctct

SEQ ID NO: 811 - DNA, 25 bp, Rattus norvegicus
aaaacaggcctcaccttagtggtgt

SEQ ID NO: 812 - DNA, 25 bp, Rattus norvegicus
aaaacaggcctctccttagtggtgt

SEQ ID NO: 813 - DNA, 25 bp, Rattus norvegicus
aaaacaggcgggatttccagagcaa

SEQ ID NO: 814 - DNA, 25 bp, Rattus norvegicus
aaaacaggcgggttttccagagcaa

SEQ ID NO: 815 - DNA, 25 bp, Rattus norvegicus
aaaacaggctcacccataggtcagt

SEQ ID NO: 816 - DNA, 25 bp, Rattus norvegicus
aaaacaggctcagccataggtcagt

SEQ ID NO: 817 - DNA, 25 bp, Rattus norvegicus
aaaacaggctggagcagatcgcgga

SEQ ID NO: 818 - DNA, 25 bp, Rattus norvegicus
aaaacaggctggctcaacctatggg

SEQ ID NO: 819 - DNA, 25 bp, Rattus norvegicus
aaaacaggctgggtcaacctatggg

SEQ ID NO: 820 - DNA, 25 bp, Rattus norvegicus
aaaacaggctggtgcagatcgcgga

SEQ ID NO: 821 - DNA, 25 bp, Rattus norvegicus
aaaacagggatcctccagtcgtgtg

SEQ ID NO: 822 - DNA, 25 bp, Rattus norvegicus
aaaacagggatcgtccagtcgtgtg

SEQ ID NO: 823 - DNA, 25 bp, Rattus norvegicus
aaaacagggtttatctcattggctg

SEQ ID NO: 824 - DNA, 25 bp, Rattus norvegicus
aaaacagggtttttctcattggctg

SEQ ID NO: 825 - DNA, 25 bp, Rattus norvegicus
aaaacaggtacgactgcctcggatc

SEQ ID NO: 826 - DNA, 25 bp, Rattus norvegicus
aaaacaggtacgtctgcctcggatc

SEQ ID NO: 827 - DNA, 25 bp, Rattus norvegicus
aaaacaggtctcagccatgaaagct

SEQ ID NO: 828 - DNA, 25 bp, Rattus norvegicus
aaaacaggtctctgccatgaaagct

SEQ ID NO: 829 - DNA, 25 bp, Rattus norvegicus
aaaacaggtggcatcggtgctgctc

SEQ ID NO: 830 - DNA, 25 bp, Rattus norvegicus
aaaacaggtggcttcggtgctgctc

SEQ ID NO: 831 - DNA, 25 bp, Rattus norvegicus
aaaacagtcacgagtcatagtgcat

SEQ ID NO: 832 - DNA, 25 bp, Rattus norvegicus
aaaacagtcacgtgtcatagtgcat

SEQ ID NO: 833 - DNA, 25 bp, Rattus norvegicus
aaaacagtcactattgccaacaaga

SEQ ID NO: 834 - DNA, 25 bp, Rattus norvegicus
aaaacagtcacttttgccaacaaga

SEQ ID NO: 835 - DNA, 25 bp, Rattus norvegicus
aaaacagtcaggcagacggcggtct

SEQ ID NO: 836 - DNA, 25 bp, Rattus norvegicus
aaaacagtcagggagacggcggtct

SEQ ID NO: 837 - DNA, 25 bp, Rattus norvegicus
aaaacagtgccacgtcttaccaggg

SEQ ID NO: 838 - DNA, 25 bp, Rattus norvegicus
aaaacagtgccaggtcttaccaggg

SEQ ID NO: 839 - DNA, 25 bp, Rattus norvegicus
aaaacagtggacacctacacacaca

SEQ ID NO: 840 - DNA, 25 bp, Rattus norvegicus
aaaacagtggactcctacacacaca

SEQ ID NO: 841 - DNA, 25 bp, Rattus norvegicus
aaaacagtgggcagagctggtgtca

SEQ ID NO: 842 - DNA, 25 bp, Rattus norvegicus
aaaacagtgggctgagctggtgtca

SEQ ID NO: 843 - DNA, 25 bp, Rattus norvegicus
aaaacagtgtatcggcgtgtccacg

SEQ ID NO: 844 - DNA, 25 bp, Rattus norvegicus
aaaacagtgtatgggcgtgtccacg

SEQ ID NO: 845 - DNA, 25 bp, Rattus norvegicus
aaaacagtgtcccaagggcaacagc

SEQ ID NO: 846 - DNA, 25 bp, Rattus norvegicus
aaaacagtgtccgaagggcaacagc

SEQ ID NO: 847 - DNA, 25 bp, Rattus norvegicus
aaaacagtgtttactggcccagcct

SEQ ID NO: 848 - DNA, 25 bp, Rattus norvegicus
aaaacagtgttttctggcccagcct

SEQ ID NO: 849 - DNA, 25 bp, Rattus norvegicus
aaaacagttccgagctcgttttctg

SEQ ID NO: 850 - DNA, 25 bp, Rattus norvegicus
aaaacagttccgtgctcgttttctg

SEQ ID NO: 851 - DNA, 25 bp, Rattus norvegicus
aaaacagttcgcatgtcacaacgta

SEQ ID NO: 852 - DNA, 25 bp, Rattus norvegicus
aaaacagttcgcttgtcacaacgta

SEQ ID NO: 853 - DNA, 25 bp, Rattus norvegicus
aaaacagttctgctacgacagccac

SEQ ID NO: 854 - DNA, 25 bp, Rattus norvegicus
aaaacagttctggtacgacagccac

SEQ ID NO: 855 - DNA, 25 bp, Rattus norvegicus
aaaacagttgacagcgggcttcgct

SEQ ID NO: 856 - DNA, 25 bp, Rattus norvegicus
aaaacagttgactgcgggcttcgct

SEQ ID NO: 857 - DNA, 25 bp, Rattus norvegicus
aaaacagtttgcattgtactggcat

SEQ ID NO: 858 - DNA, 25 bp, Rattus norvegicus
aaaacagtttgctttgtactggcat

SEQ ID NO: 859 - DNA, 25 bp, Rattus norvegicus
aaaacatatcctcttaaatcacaaa

SEQ ID NO: 860 - DNA, 25 bp, Rattus norvegicus
aaaacatatcctgttaaatcacaaa

SEQ ID NO: 861 - DNA, 25 bp, Rattus norvegicus
aaaacatatgatcacccactctcat

SEQ ID NO: 862 - DNA, 25 bp, Rattus norvegicus
aaaacatatgatgacccactctcat

SEQ ID NO: 863 - DNA, 25 bp, Rattus norvegicus
aaaacatcagatataggccttacat

SEQ ID NO: 864 - DNA, 25 bp, Rattus norvegicus
aaaacatcagatttaggccttacat

SEQ ID NO: 865 - DNA, 25 bp, Rattus norvegicus
aaaacatcagctattcccttgagac

SEQ ID NO: 866 - DNA, 25 bp, Rattus norvegicus
aaaacatcagcttttcccttgagac

SEQ ID NO: 867 - DNA, 25 bp, Rattus norvegicus
aaaacatccagcctgtgagcgccaa

SEQ ID NO: 868 - DNA, 25 bp, Rattus norvegicus
aaaacatccagcgtgtgagcgccaa

SEQ ID NO: 869 - DNA, 25 bp, Rattus norvegicus
aaaacatccaggacacggtggacaa

SEQ ID NO: 870 - DNA, 25 bp, Rattus norvegicus
aaaacatccaggtcacggtggacaa

SEQ ID NO: 871 - DNA, 25 bp, Rattus norvegicus
aaaacatccggcattggttgtggaa

SEQ ID NO: 872 - DNA, 25 bp, Rattus norvegicus
aaaacatccggctttggttgtggaa

SEQ ID NO: 873 - DNA, 25 bp, Rattus norvegicus
aaaacatcggacatccaggctcgaa

SEQ ID NO: 874 - DNA, 25 bp, Rattus norvegicus
aaaacatcggacttccaggctcgaa

SEQ ID NO: 875 - DNA, 25 bp, Rattus norvegicus
aaaacatcgggtcgctcaacacaca

SEQ ID NO: 876 - DNA, 25 bp, Rattus norvegicus
aaaacatcgggtggctcaacacaca

SEQ ID NO: 877 - DNA, 25 bp, Rattus norvegicus
aaaacatcgtgtaatctgtccccag

SEQ ID NO: 878 - DNA, 25 bp, Rattus norvegicus
aaaacatcgtgttatctgtccccag

SEQ ID NO: 879 - DNA, 25 bp, Rattus norvegicus
aaaacatctcttactgtgggtacca

SEQ ID NO: 880 - DNA, 25 bp, Rattus norvegicus
aaaacatctcttagtctctctctat

SEQ ID NO: 881 - DNA, 25 bp, Rattus norvegicus
aaaacatctctttctgtgggtacca

SEQ ID NO: 882 - DNA, 25 bp, Rattus norvegicus
aaaacatctctttgtctctctctat

SEQ ID NO: 883 - DNA, 25 bp, Rattus norvegicus
aaaacatctgctatgctcttgtggc

SEQ ID NO: 884 - DNA, 25 bp, Rattus norvegicus
aaaacatctgctttgctcttgtggc

SEQ ID NO: 885 - DNA, 25 bp, Rattus norvegicus
aaaacatgagagctccaggtgtgcc

SEQ ID NO: 886 - DNA, 25 bp, Rattus norvegicus
aaaacatgagaggtccaggtgtgcc

SEQ ID NO: 887 - DNA, 25 bp, Rattus norvegicus
aaaacatgagtgaggccgcgctagt

SEQ ID NO: 888 - DNA, 25 bp, Rattus norvegicus
aaaacatgagtgtggccgcgctagt

SEQ ID NO: 889 - DNA, 25 bp, Rattus norvegicus
aaaacatgcaggactccgtttcctt

SEQ ID NO: 890 - DNA, 25 bp, Rattus norvegicus
aaaacatgcaggtctccgtttcctt

SEQ ID NO: 891 - DNA, 25 bp, Rattus norvegicus
aaaacatgccacactctgcggacag

SEQ ID NO: 892 - DNA, 25 bp, Rattus norvegicus
aaaacatgccactctctgcggacag

SEQ ID NO: 893 - DNA, 25 bp, Rattus norvegicus
aaaacatgccatctgcacttgcttt

SEQ ID NO: 894 - DNA, 25 bp, Rattus norvegicus
aaaacatgccatgtgcacttgcttt

SEQ ID NO: 895 - DNA, 25 bp, Rattus norvegicus
aaaacatgcctccactcaattactt

SEQ ID NO: 896 - DNA, 25 bp, Rattus norvegicus
aaaacatgcctcgactcaattactt

SEQ ID NO: 897 - DNA, 25 bp, Rattus norvegicus
aaaacatgctctcttagagccctct

SEQ ID NO: 898 - DNA, 25 bp, Rattus norvegicus
aaaacatgctctgttagagccctct

SEQ ID NO: 899 - DNA, 25 bp, Rattus norvegicus
aaaacatgctttagccacatacggc

SEQ ID NO: 900 - DNA, 25 bp, Rattus norvegicus
aaaacatgcttttgccacatacggc

SEQ ID NO: 901 - DNA, 25 bp, Rattus norvegicus
aaaacatgtctgactttgcaaagga

SEQ ID NO: 902 - DNA, 25 bp, Rattus norvegicus
aaaacatgtctgtctttgcaaagga

SEQ ID NO: 903 - DNA, 25 bp, Rattus norvegicus
aaaacatgtgctctgcactgcctgc

SEQ ID NO: 904 - DNA, 25 bp, Rattus norvegicus
aaaacatgtgctgtgcactgcctgc

SEQ ID NO: 905 - DNA, 25 bp, Rattus norvegicus
aaaacatgttcaagggtggcctgca

SEQ ID NO: 906 - DNA, 25 bp, Rattus norvegicus
aaaacatgttcatgggtggcctgca

SEQ ID NO: 907 - DNA, 25 bp, Rattus norvegicus
aaaacatgttctcaggtctactgag

SEQ ID NO: 908 - DNA, 25 bp, Rattus norvegicus
aaaacatgttctgaggtctactgag

SEQ ID NO: 909 - DNA, 25 bp, Rattus norvegicus
aaaacatgttttaggcaaagcttct

SEQ ID NO: 910 - DNA, 25 bp, Rattus norvegicus
aaaacatgttttcccatattctaga

SEQ ID NO: 911 - DNA, 25 bp, Rattus norvegicus
aaaacatgttttgccatattctaga

SEQ ID NO: 912 - DNA, 25 bp, Rattus norvegicus
aaaacatgtttttggcaaagcttct

SEQ ID NO: 913 - DNA, 25 bp, Rattus norvegicus
aaaacattatgtactcctctgcatc

SEQ ID NO: 914 - DNA, 25 bp, Rattus norvegicus
aaaacattatgttctcctctgcatc

SEQ ID NO: 915 - DNA, 25 bp, Rattus norvegicus
aaaacattattccacaccacctcat

SEQ ID NO: 916 - DNA, 25 bp, Rattus norvegicus
aaaacattattcgacaccacctcat

SEQ ID NO: 917 - DNA, 25 bp, Rattus norvegicus
aaaacattcacgacgcgggctggac

SEQ ID NO: 918 - DNA, 25 bp, Rattus norvegicus
aaaacattcacgtcgcgggctggac

SEQ ID NO: 919 - DNA, 25 bp, Rattus norvegicus
aaaacattcccgatgctggaggatg

SEQ ID NO: 920 - DNA, 25 bp, Rattus norvegicus
aaaacattcccgttgctggaggatg

SEQ ID NO: 921 - DNA, 25 bp, Rattus norvegicus
aaaacattcctcagtgttaggcacc

SEQ ID NO: 922 - DNA, 25 bp, Rattus norvegicus
aaaacattcctctgtgttaggcacc

SEQ ID NO: 923 - DNA, 25 bp, Rattus norvegicus
aaaacattctatctgcgatgcattt

SEQ ID NO: 924 - DNA, 25 bp, Rattus norvegicus
aaaacattctatgtgcgatgcattt

SEQ ID NO: 925 - DNA, 25 bp, Rattus norvegicus
aaaacattctctcgccatgatccac

SEQ ID NO: 926 - DNA, 25 bp, Rattus norvegicus
aaaacattctctggccatgatccac

SEQ ID NO: 927 - DNA, 25 bp, Rattus norvegicus
aaaacattctgtccccacggatgat

SEQ ID NO: 928 - DNA, 25 bp, Rattus norvegicus
aaaacattctgtgcccacggatgat

SEQ ID NO: 929 - DNA, 25 bp, Rattus norvegicus
aaaacattgatcaccctagctgcag

SEQ ID NO: 930 - DNA, 25 bp, Rattus norvegicus
aaaacattgatctccctagctgcag

SEQ ID NO: 931 - DNA, 25 bp, Rattus norvegicus
aaaacattgcccagattgctccttt

SEQ ID NO: 932 - DNA, 25 bp, Rattus norvegicus
aaaacattgccctgattgctccttt

SEQ ID NO: 933 - DNA, 25 bp, Rattus norvegicus
aaaacattggctccctacttcactg

SEQ ID NO: 934 - DNA, 25 bp, Rattus norvegicus
aaaacattggctgcctacttcactg

SEQ ID NO: 935 - DNA, 25 bp, Rattus norvegicus
aaaacattgtcacagctcagccaac

SEQ ID NO: 936 - DNA, 25 bp, Rattus norvegicus
aaaacattgtcagagctcagccaac

SEQ ID NO: 937 - DNA, 25 bp, Rattus norvegicus
aaaacatttgatacttaggacacat

SEQ ID NO: 938 - DNA, 25 bp, Rattus norvegicus
aaaacatttgattcttaggacacat

SEQ ID NO: 939 - DNA, 25 bp, Rattus norvegicus
aaaacatttgctctcctgggataga

SEQ ID NO: 940 - DNA, 25 bp, Rattus norvegicus
aaaacatttgctgtcctgggataga

SEQ ID NO: 941 - DNA, 25 bp, Rattus norvegicus
aaaacatttggcatggctctctatc

SEQ ID NO: 942 - DNA, 25 bp, Rattus norvegicus
aaaacatttggcttggctctctatc

SEQ ID NO: 943 - DNA, 25 bp, Rattus norvegicus
aaaacatttgtcagttcagtaaata

SEQ ID NO: 944 - DNA, 25 bp, Rattus norvegicus
aaaacatttgtctgttcagtaaata

SEQ ID NO: 945 - DNA, 25 bp, Rattus norvegicus
aaaacattttagacgtggaacagat

SEQ ID NO: 946 - DNA, 25 bp, Rattus norvegicus
aaaacattttagtcgtggaacagat

SEQ ID NO: 947 - DNA, 25 bp, Rattus norvegicus
aaaaccaaaatcactcaagctgtaa

SEQ ID NO: 948 - DNA, 25 bp, Rattus norvegicus
aaaaccaaaatctctcaagctgtaa

SEQ ID NO: 949 - DNA, 25 bp, Rattus norvegicus
aaaaccaaacgccttgccatatctc

SEQ ID NO: 950 - DNA, 25 bp, Rattus norvegicus
aaaaccaaacgcgttgccatatctc

SEQ ID NO: 951 - DNA, 25 bp, Rattus norvegicus
aaaaccaaaggcagtgatcttccca

SEQ ID NO: 952 - DNA, 25 bp, Rattus norvegicus
aaaaccaaaggctgtgatcttccca

SEQ ID NO: 953 - DNA, 25 bp, Rattus norvegicus
aaaaccaaatgtctctctctaccct

SEQ ID NO: 954 - DNA, 25 bp, Rattus norvegicus
aaaaccaaatgtgtctctctaccct

SEQ ID NO: 955 - DNA, 25 bp, Rattus norvegicus
aaaaccaaattgatccctcagcatc

SEQ ID NO: 956 - DNA, 25 bp, Rattus norvegicus
aaaaccaaattgttccctcagcatc

SEQ ID NO: 957 - DNA, 25 bp, Rattus norvegicus
aaaaccaacacacatgccaggcagt

SEQ ID NO: 958 - DNA, 25 bp, Rattus norvegicus
aaaaccaacacagatgccaggcagt

SEQ ID NO: 959 - DNA, 25 bp, Rattus norvegicus
aaaaccaacagaaggcgcttcctca

SEQ ID NO: 960 - DNA, 25 bp, Rattus norvegicus
aaaaccaacagatggcgcttcctca

SEQ ID NO: 961 - DNA, 25 bp, Rattus norvegicus
aaaaccaacatcaagaactgctggg

SEQ ID NO: 962 - DNA, 25 bp, Rattus norvegicus
aaaaccaacatctagaactgctggg

SEQ ID NO: 963 - DNA, 25 bp, Rattus norvegicus
aaaaccaacattacaggcagcagat

SEQ ID NO: 964 - DNA, 25 bp, Rattus norvegicus
aaaaccaacatttcaggcagcagat

SEQ ID NO: 965 - DNA, 25 bp, Rattus norvegicus
aaaaccaacgttcagcagtgctact

SEQ ID NO: 966 - DNA, 25 bp, Rattus norvegicus
aaaaccaacgttgagcagtgctact

SEQ ID NO: 967 - DNA, 25 bp, Rattus norvegicus
aaaaccaactagctccctgcattat

SEQ ID NO: 968 - DNA, 25 bp, Rattus norvegicus
aaaaccaactaggtccctgcattat

SEQ ID NO: 969 - DNA, 25 bp, Rattus norvegicus
aaaaccaagagcaaagctggacctc

SEQ ID NO: 970 - DNA, 25 bp, Rattus norvegicus
aaaaccaagagctaagctggacctc

SEQ ID NO: 971 - DNA, 25 bp, Rattus norvegicus
aaaaccaagccaactgttcctagtg

SEQ ID NO: 972 - DNA, 25 bp, Rattus norvegicus
aaaaccaagccatctgttcctagtg

SEQ ID NO: 973 - DNA, 25 bp, Rattus norvegicus
aaaaccaaggccagactttcacctg

SEQ ID NO: 974 - DNA, 25 bp, Rattus norvegicus
aaaaccaaggcctgactttcacctg

SEQ ID NO: 975 - DNA, 25 bp, Rattus norvegicus
aaaaccaagggcatctactgcctgc

SEQ ID NO: 976 - DNA, 25 bp, Rattus norvegicus
aaaaccaagggcttctactgcctgc

SEQ ID NO: 977 - DNA, 25 bp, Rattus norvegicus
aaaaccaagggtcctcctgtctgca

SEQ ID NO: 978 - DNA, 25 bp, Rattus norvegicus
aaaaccaagggtgctcctgtctgca

SEQ ID NO: 979 - DNA, 25 bp, Rattus norvegicus
aaaaccaatccccattgagcttgtc

SEQ ID NO: 980 - DNA, 25 bp, Rattus norvegicus
aaaaccaatcccgattgagcttgtc

SEQ ID NO: 981 - DNA, 25 bp, Rattus norvegicus
aaaaccaatgtcaccaagctggcca

SEQ ID NO: 982 - DNA, 25 bp, Rattus norvegicus
aaaaccaatgtctccaagctggcca

SEQ ID NO: 983 - DNA, 25 bp, Rattus norvegicus
aaaaccaattttcctgcccagctat

SEQ ID NO: 984 - DNA, 25 bp, Rattus norvegicus
aaaaccaattttgctgcccagctat

SEQ ID NO: 985 - DNA, 25 bp, Rattus norvegicus
aaaaccacaccacatgtcatctttg

SEQ ID NO: 986 - DNA, 25 bp, Rattus norvegicus
aaaaccacaccagatgtcatctttg

SEQ ID NO: 987 - DNA, 25 bp, Rattus norvegicus
aaaaccacattcagttcccacctgg

SEQ ID NO: 988 - DNA, 25 bp, Rattus norvegicus
aaaaccacattctgttcccacctgg

SEQ ID NO: 989 - DNA, 25 bp, Rattus norvegicus
aaaaccaccattagagtgccacaga

SEQ ID NO: 990 - DNA, 25 bp, Rattus norvegicus
aaaaccaccatttgagtgccacaga

SEQ ID NO: 991 - DNA, 25 bp, Rattus norvegicus
aaaaccacgtatccttccgatacag

SEQ ID NO: 992 - DNA, 25 bp, Rattus norvegicus
aaaaccacgtatgcttccgatacag

SEQ ID NO: 993 - DNA, 25 bp, Rattus norvegicus
aaaaccactgcgagtccaggcataa

SEQ ID NO: 994 - DNA, 25 bp, Rattus norvegicus
aaaaccactgcgtgtccaggcataa

SEQ ID NO: 995 - DNA, 25 bp, Rattus norvegicus
aaaaccactgtgactctgaagagct

SEQ ID NO: 996 - DNA, 25 bp, Rattus norvegicus
aaaaccactgtgtctctgaagagct

SEQ ID NO: 997 - DNA, 25 bp, Rattus norvegicus
aaaaccactgttaccatcgatgaca

SEQ ID NO: 998 - DNA, 25 bp, Rattus norvegicus
aaaaccactgtttccatcgatgaca

SEQ ID NO: 999 - DNA, 25 bp, Rattus norvegicus
aaaaccacttctaattgtctatatt

SEQ ID NO: 1000 - DNA, 25 bp, Rattus norvegicus
aaaaccacttctcccaacatagctg

SEQ ID NO: 1001 - DNA, 25 bp, Rattus norvegicus
aaaaccacttctgccaacatagctg

SEQ ID NO: 1002 - DNA, 25 bp, Rattus norvegicus
aaaaccacttcttattgtctatatt

SEQ ID NO: 1003 - DNA, 25 bp, Rattus norvegicus
aaaaccacttggaggctggaccaca

SEQ ID NO: 1004 - DNA, 25 bp, Rattus norvegicus
aaaaccacttggtggctggaccaca

SEQ ID NO: 1005 - DNA, 25 bp, Rattus norvegicus
aaaaccagaggtcgcttcagcggct

SEQ ID NO: 1006 - DNA, 25 bp, Rattus norvegicus
aaaaccagaggtggcttcagcggct

SEQ ID NO: 1007 - DNA, 25 bp, Rattus norvegicus
aaaaccagatagactgcacccttct

SEQ ID NO: 1008 - DNA, 25 bp, Rattus norvegicus
aaaaccagatagtctgcacccttct

SEQ ID NO: 1009 - DNA, 25 bp, Rattus norvegicus
aaaaccagatgcatcccacgtgaac

SEQ ID NO: 1010 - DNA, 25 bp, Rattus norvegicus
aaaaccagatgcttcccacgtgaac

SEQ ID NO: 1011 - DNA, 25 bp, Rattus norvegicus
aaaaccagcacactgtcagtcagct

SEQ ID NO: 1012 - DNA, 25 bp, Rattus norvegicus
aaaaccagcacagtgtcagtcagct

SEQ ID NO: 1013 - DNA, 25 bp, Rattus norvegicus
aaaaccagcagtaaagttgcctgaa

SEQ ID NO: 1014 - DNA, 25 bp, Rattus norvegicus
aaaaccagcagttaagttgcctgaa

SEQ ID NO: 1015 - DNA, 25 bp, Rattus norvegicus
aaaaccagggttctcatggcccaag

SEQ ID NO: 1016 - DNA, 25 bp, Rattus norvegicus
aaaaccagggttgtcatggcccaag

SEQ ID NO: 1017 - DNA, 25 bp, Rattus norvegicus
aaaaccagtattctatttcagcaat

SEQ ID NO: 1018 - DNA, 25 bp, Rattus norvegicus
aaaaccagtattgtatttcagcaat

SEQ ID NO: 1019 - DNA, 25 bp, Rattus norvegicus
aaaaccatactgctgaccctgacgt

SEQ ID NO: 1020 - DNA, 25 bp, Rattus norvegicus
aaaaccatactggtgaccctgacgt

SEQ ID NO: 1021 - DNA, 25 bp, Rattus norvegicus
aaaaccatagctaacctctgggcac

SEQ ID NO: 1022 - DNA, 25 bp, Rattus norvegicus
aaaaccatagcttacctctgggcac

SEQ ID NO: 1023 - DNA, 25 bp, Rattus norvegicus
aaaaccatattgactagggatgaga

SEQ ID NO: 1024 - DNA, 25 bp, Rattus norvegicus
aaaaccatattgtctagggatgaga

SEQ ID NO: 1025 - DNA, 25 bp, Rattus norvegicus
aaaaccatatttactaactgtgtag

SEQ ID NO: 1026 - DNA, 25 bp, Rattus norvegicus
aaaaccatatttcccttgttcaagg

SEQ ID NO: 1027 - DNA, 25 bp, Rattus norvegicus
aaaaccatatttgccttgttcaagg

SEQ ID NO: 1028 - DNA, 25 bp, Rattus norvegicus
aaaaccatattttctaactgtgtag

SEQ ID NO: 1029 - DNA, 25 bp, Rattus norvegicus
aaaaccatcaacaccaaggtcaaag

SEQ ID NO: 1030 - DNA, 25 bp, Rattus norvegicus
aaaaccatcaactccaaggtcaaag

SEQ ID NO: 1031 - DNA, 25 bp, Rattus norvegicus
aaaaccatcatgcatgctctccata

SEQ ID NO: 1032 - DNA, 25 bp, Rattus norvegicus
aaaaccatcatggatgctctccata

SEQ ID NO: 1033 - DNA, 25 bp, Rattus norvegicus
aaaaccatccttcagcatggcgcat

SEQ ID NO: 1034 - DNA, 25 bp, Rattus norvegicus
aaaaccatccttgagcatggcgcat

SEQ ID NO: 1035 - DNA, 25 bp, Rattus norvegicus
aaaaccatcttacctcttgcatgag

SEQ ID NO: 1036 - DNA, 25 bp, Rattus norvegicus
aaaaccatcttagctcttgcatgag

SEQ ID NO: 1037 - DNA, 25 bp, Rattus norvegicus
aaaaccatgagaagtttaagcctct

SEQ ID NO: 1038 - DNA, 25 bp, Rattus norvegicus
aaaaccatgagatgtttaagcctct

SEQ ID NO: 1039 - DNA, 25 bp, Rattus norvegicus
aaaaccatgcctacaatgttggccc

SEQ ID NO: 1040 - DNA, 25 bp, Rattus norvegicus
aaaaccatgccttcaatgttggccc

SEQ ID NO: 1041 - DNA, 25 bp, Rattus norvegicus
aaaaccatgtcgcatacttacaaca

SEQ ID NO: 1042 - DNA, 25 bp, Rattus norvegicus
aaaaccatgtcggatacttacaaca

SEQ ID NO: 1043 - DNA, 25 bp, Rattus norvegicus
aaaaccatgtgtagcccagtgacgt

SEQ ID NO: 1044 - DNA, 25 bp, Rattus norvegicus
aaaaccatgtgttgcccagtgacgt

SEQ ID NO: 1045 - DNA, 25 bp, Rattus norvegicus
aaaaccatgtttccccaagtggaat

SEQ ID NO: 1046 - DNA, 25 bp, Rattus norvegicus
aaaaccatgtttgcccaagtggaat

SEQ ID NO: 1047 - DNA, 25 bp, Rattus norvegicus
aaaaccattcccatgtgaggctcag

SEQ ID NO: 1048 - DNA, 25 bp, Rattus norvegicus
aaaaccattcccttgtgaggctcag

SEQ ID NO: 1049 - DNA, 25 bp, Rattus norvegicus
aaaaccattctaatcttccttcagt

SEQ ID NO: 1050 - DNA, 25 bp, Rattus norvegicus
aaaaccattctattcttccttcagt

SEQ ID NO: 1051 - DNA, 25 bp, Rattus norvegicus
aaaaccattctccttcaaacgtgct

SEQ ID NO: 1052 - DNA, 25 bp, Rattus norvegicus
aaaaccattctcgttcaaacgtgct

SEQ ID NO: 1053 - DNA, 25 bp, Rattus norvegicus
aaaaccattgcacctcttgttgctt

SEQ ID NO: 1054 - DNA, 25 bp, Rattus norvegicus
aaaaccattgcagctcttgttgctt

SEQ ID NO: 1055 - DNA, 25 bp, Rattus norvegicus
aaaaccattgccagcacaattgtat

SEQ ID NO: 1056 - DNA, 25 bp, Rattus norvegicus
aaaaccattgcctgcacaattgtat

SEQ ID NO: 1057 - DNA, 25 bp, Rattus norvegicus
aaaaccattgctcctttgccatgag

SEQ ID NO: 1058 - DNA, 25 bp, Rattus norvegicus
aaaaccattgctgctttgccatgag

SEQ ID NO: 1059 - DNA, 25 bp, Rattus norvegicus
aaaaccatttgcactttagcgatct

SEQ ID NO: 1060 - DNA, 25 bp, Rattus norvegicus
aaaaccatttgctctttagcgatct

SEQ ID NO: 1061 - DNA, 25 bp, Rattus norvegicus
aaaaccatttggacacatcttggag

SEQ ID NO: 1062 - DNA, 25 bp, Rattus norvegicus
aaaaccatttggtcacatcttggag

SEQ ID NO: 1063 - DNA, 25 bp, Rattus norvegicus
aaaaccatttgtcgcccatatgtgt

SEQ ID NO: 1064 - DNA, 25 bp, Rattus norvegicus
aaaaccatttgtggcccatatgtgt

SEQ ID NO: 1065 - DNA, 25 bp, Rattus norvegicus
aaaacccaaataacagaatgccact

SEQ ID NO: 1066 - DNA, 25 bp, Rattus norvegicus
aaaacccaaatatcagaatgccact

SEQ ID NO: 1067 - DNA, 25 bp, Rattus norvegicus
aaaacccaagaactagcgcctgagc

SEQ ID NO: 1068 - DNA, 25 bp, Rattus norvegicus
aaaacccaagaagtagcgcctgagc

SEQ ID NO: 1069 - DNA, 25 bp, Rattus norvegicus
aaaacccaagacaccaaagaacatg

SEQ ID NO: 1070 - DNA, 25 bp, Rattus norvegicus
aaaacccaagactccaaagaacatg

SEQ ID NO: 1071 - DNA, 25 bp, Rattus norvegicus
aaaacccaagcccagtatggcctag

SEQ ID NO: 1072 - DNA, 25 bp, Rattus norvegicus
aaaacccaagccgagtatggcctag

SEQ ID NO: 1073 - DNA, 25 bp, Rattus norvegicus
aaaacccaagtgagtctgtcctatt

SEQ ID NO: 1074 - DNA, 25 bp, Rattus norvegicus
aaaacccaagtgtgtctgtcctatt

SEQ ID NO: 1075 - DNA, 25 bp, Rattus norvegicus
aaaacccaccatatcattctgattc

SEQ ID NO: 1076 - DNA, 25 bp, Rattus norvegicus
aaaacccaccatttcattctgattc

SEQ ID NO: 1077 - DNA, 25 bp, Rattus norvegicus
aaaacccacgacagcttgcctgtat

SEQ ID NO: 1078 - DNA, 25 bp, Rattus norvegicus
aaaacccacgactgcttgcctgtat

SEQ ID NO: 1079 - DNA, 25 bp, Rattus norvegicus
aaaacccacttgacagcaggagccg

SEQ ID NO: 1080 - DNA, 25 bp, Rattus norvegicus
aaaacccacttgtcagcaggagccg

SEQ ID NO: 1081 - DNA, 25 bp, Rattus norvegicus
aaaacccagccccagtggagaactg

SEQ ID NO: 1082 - DNA, 25 bp, Rattus norvegicus
aaaacccagcccgagtggagaactg

SEQ ID NO: 1083 - DNA, 25 bp, Rattus norvegicus
aaaacccagctcactgtgcagattt

SEQ ID NO: 1084 - DNA, 25 bp, Rattus norvegicus
aaaacccagctctctgtgcagattt

SEQ ID NO: 1085 - DNA, 25 bp, Rattus norvegicus
aaaacccagggtactgtgagttgat

SEQ ID NO: 1086 - DNA, 25 bp, Rattus norvegicus
aaaacccagggttctgtgagttgat

SEQ ID NO: 1087 - DNA, 25 bp, Rattus norvegicus
aaaacccaggtcatcgctgttgtaa

SEQ ID NO: 1088 - DNA, 25 bp, Rattus norvegicus
aaaacccaggtcttcgctgttgtaa

SEQ ID NO: 1089 - DNA, 25 bp, Rattus norvegicus
aaaacccagtatcttgaatttatgt

SEQ ID NO: 1090 - DNA, 25 bp, Rattus norvegicus
aaaacccagtatgttgaatttatgt

SEQ ID NO: 1091 - DNA, 25 bp, Rattus norvegicus
aaaacccatcccagtgatacacttc

SEQ ID NO: 1092 - DNA, 25 bp, Rattus norvegicus
aaaacccatccctgtgatacacttc

SEQ ID NO: 1093 - DNA, 25 bp, Rattus norvegicus
aaaacccatgtgacgtttctgccac

SEQ ID NO: 1094 - DNA, 25 bp, Rattus norvegicus
aaaacccatgtgtcgtttctgccac

SEQ ID NO: 1095 - DNA, 25 bp, Rattus norvegicus
aaaacccattcacgctgggcgacag

SEQ ID NO: 1096 - DNA, 25 bp, Rattus norvegicus
aaaacccattcaggctgggcgacag

SEQ ID NO: 1097 - DNA, 25 bp, Rattus norvegicus
aaaacccattctagcccctgatgtt

SEQ ID NO: 1098 - DNA, 25 bp, Rattus norvegicus
aaaacccattcttgcccctgatgtt

SEQ ID NO: 1099 - DNA, 25 bp, Rattus norvegicus
aaaacccattgtatctgagctccac

SEQ ID NO: 1100 - DNA, 25 bp, Rattus norvegicus
aaaacccattgtttctgagctccac

SEQ ID NO: 1101 - DNA, 25 bp, Rattus norvegicus
aaaacccatttcatctgggcatggt

SEQ ID NO: 1102 - DNA, 25 bp, Rattus norvegicus
aaaacccatttcattgtcaatccct

SEQ ID NO: 1103 - DNA, 25 bp, Rattus norvegicus
aaaacccatttcttctgggcatggt

SEQ ID NO: 1104 - DNA, 25 bp, Rattus norvegicus
aaaacccatttctttgtcaatccct

SEQ ID NO: 1105 - DNA, 25 bp, Rattus norvegicus
aaaaccccaaggcagagtggtgaat

SEQ ID NO: 1106 - DNA, 25 bp, Rattus norvegicus
aaaaccccaagggagagtggtgaat

SEQ ID NO: 1107 - DNA, 25 bp, Rattus norvegicus
aaaaccccacaaactcagcaatgaa

SEQ ID NO: 1108 - DNA, 25 bp, Rattus norvegicus
aaaaccccacaatctcagcaatgaa

SEQ ID NO: 1109 - DNA, 25 bp, Rattus norvegicus
aaaaccccatccagaagaacatcac

SEQ ID NO: 1110 - DNA, 25 bp, Rattus norvegicus
aaaaccccatcctgaagaacatcac

SEQ ID NO: 1111 - DNA, 25 bp, Rattus norvegicus
aaaaccccatgtacatatgttctgt

SEQ ID NO: 1112 - DNA, 25 bp, Rattus norvegicus
aaaaccccatgttcatatgttctgt

SEQ ID NO: 1113 - DNA, 25 bp, Rattus norvegicus
aaaacccctatcatcactttacatg

SEQ ID NO: 1114 - DNA, 25 bp, Rattus norvegicus
aaaacccctatcttcactttacatg

SEQ ID NO: 1115 - DNA, 25 bp, Rattus norvegicus
aaaacccgtgcacttcatggatgat

SEQ ID NO: 1116 - DNA, 25 bp, Rattus norvegicus
aaaacccgtgcagttcatggatgat

SEQ ID NO: 1117 - DNA, 25 bp, Rattus norvegicus
aaaacccgtgttagcgcatcattta

SEQ ID NO: 1118 - DNA, 25 bp, Rattus norvegicus
aaaacccgtgtttgcgcatcattta

SEQ ID NO: 1119 - DNA, 25 bp, Rattus norvegicus
aaaaccctatcaaagctcctgagtc

SEQ ID NO: 1120 - DNA, 25 bp, Rattus norvegicus
aaaaccctatcatagctcctgagtc

SEQ ID NO: 1121 - DNA, 25 bp, Rattus norvegicus
aaaaccctattgcatctggtctctg

SEQ ID NO: 1122 - DNA, 25 bp, Rattus norvegicus
aaaaccctattggatctggtctctg

SEQ ID NO: 1123 - DNA, 25 bp, Rattus norvegicus
aaaaccctcactctgagtacgggct

SEQ ID NO: 1124 - DNA, 25 bp, Rattus norvegicus
aaaaccctcactgtgagtacgggct

SEQ ID NO: 1125 - DNA, 25 bp, Rattus norvegicus
aaaaccctcataccacttgactaag

SEQ ID NO: 1126 - DNA, 25 bp, Rattus norvegicus
aaaaccctcatagcacttgactaag

SEQ ID NO: 1127 - DNA, 25 bp, Rattus norvegicus
aaaaccctcatcaagaccattgtca

SEQ ID NO: 1128 - DNA, 25 bp, Rattus norvegicus
aaaaccctcatctagaccattgtca

SEQ ID NO: 1129 - DNA, 25 bp, Rattus norvegicus
aaaaccctctgacaaggccttctgg

SEQ ID NO: 1130 - DNA, 25 bp, Rattus norvegicus
aaaaccctctgagaaggccttctgg

SEQ ID NO: 1131 - DNA, 25 bp, Rattus norvegicus
aaaaccctcttcactcagttgactg

SEQ ID NO: 1132 - DNA, 25 bp, Rattus norvegicus
aaaaccctcttctctcagttgactg

SEQ ID NO: 1133 - DNA, 25 bp, Rattus norvegicus
aaaaccctgaagcatctgttacaat

SEQ ID NO: 1134 - DNA, 25 bp, Rattus norvegicus
aaaaccctgaaggatctgttacaat

SEQ ID NO: 1135 - DNA, 25 bp, Rattus norvegicus
aaaaccctgagacctcttggagtgc

SEQ ID NO: 1136 - DNA, 25 bp, Rattus norvegicus
aaaaccctgagagctcttggagtgc

SEQ ID NO: 1137 - DNA, 25 bp, Rattus norvegicus
aaaaccctgattattctggaatgta

SEQ ID NO: 1138 - DNA, 25 bp, Rattus norvegicus
aaaaccctgatttttctggaatgta

SEQ ID NO: 1139 - DNA, 25 bp, Rattus norvegicus
aaaaccctgcagaactacatccttt

SEQ ID NO: 1140 - DNA, 25 bp, Rattus norvegicus
aaaaccctgcagtactacatccttt

SEQ ID NO: 1141 - DNA, 25 bp, Rattus norvegicus
aaaaccctgggtacattcctcagca

SEQ ID NO: 1142 - DNA, 25 bp, Rattus norvegicus
aaaaccctgggttcattcctcagca

SEQ ID NO: 1143 - DNA, 25 bp, Rattus norvegicus
aaaaccctggttctgatcctggtgg

SEQ ID NO: 1144 - DNA, 25 bp, Rattus norvegicus
aaaaccctggttgtgatcctggtgg

SEQ ID NO: 1145 - DNA, 25 bp, Rattus norvegicus
aaaaccctgttgaagttgtcagagc

SEQ ID NO: 1146 - DNA, 25 bp, Rattus norvegicus
aaaaccctgttgtagttgtcagagc

SEQ ID NO: 1147 - DNA, 25 bp, Rattus norvegicus
aaaacccttcagagagtctggcttt

SEQ ID NO: 1148 - DNA, 25 bp, Rattus norvegicus
aaaacccttcagtgagtctggcttt

SEQ ID NO: 1149 - DNA, 25 bp, Rattus norvegicus
aaaacccttcgaaagcatccttgag

SEQ ID NO: 1150 - DNA, 25 bp, Rattus norvegicus
aaaacccttcgatagcatccttgag

SEQ ID NO: 1151 - DNA, 25 bp, Rattus norvegicus
aaaacccttgctatttggagagctc

SEQ ID NO: 1152 - DNA, 25 bp, Rattus norvegicus
aaaacccttgctttttggagagctc

SEQ ID NO: 1153 - DNA, 25 bp, Rattus norvegicus
aaaacccttgtgcataattgaatga

SEQ ID NO: 1154 - DNA, 25 bp, Rattus norvegicus
aaaacccttgtggataattgaatga

SEQ ID NO: 1155 - DNA, 25 bp, Rattus norvegicus
aaaaccgacccaatcatctttgcgg

SEQ ID NO: 1156 - DNA, 25 bp, Rattus norvegicus
aaaaccgacccattcatctttgcgg

SEQ ID NO: 1157 - DNA, 25 bp, Rattus norvegicus
aaaaccgagacaacagcgcgtcctg

SEQ ID NO: 1158 - DNA, 25 bp, Rattus norvegicus
aaaaccgagacatcagcgcgtcctg

SEQ ID NO: 1159 - DNA, 25 bp, Rattus norvegicus
aaaaccgaggcgaacagccccgcat

SEQ ID NO: 1160 - DNA, 25 bp, Rattus norvegicus
aaaaccgaggcgtacagccccgcat

SEQ ID NO: 1161 - DNA, 25 bp, Rattus norvegicus
aaaaccgatatccatgaacctcacc

SEQ ID NO: 1162 - DNA, 25 bp, Rattus norvegicus
aaaaccgatatcgatgaacctcacc

SEQ ID NO: 1163 - DNA, 25 bp, Rattus norvegicus
aaaaccgatgtgaacgccgtcatgg

SEQ ID NO: 1164 - DNA, 25 bp, Rattus norvegicus
aaaaccgatgtgtacgccgtcatgg

SEQ ID NO: 1165 - DNA, 25 bp, Rattus norvegicus
aaaaccgcactcacagatagggtga

SEQ ID NO: 1166 - DNA, 25 bp, Rattus norvegicus
aaaaccgcactctcagatagggtga

SEQ ID NO: 1167 - DNA, 25 bp, Rattus norvegicus
aaaaccgctataatcactttacaag

SEQ ID NO: 1168 - DNA, 25 bp, Rattus norvegicus
aaaaccgctatattcactttacaag

SEQ ID NO: 1169 - DNA, 25 bp, Rattus norvegicus
aaaaccgctgtgattctttctcact

SEQ ID NO: 1170 - DNA, 25 bp, Rattus norvegicus
aaaaccgctgtgtttctttctcact

SEQ ID NO: 1171 - DNA, 25 bp, Rattus norvegicus
aaaaccggcgatccaggaagcttag

SEQ ID NO: 1172 - DNA, 25 bp, Rattus norvegicus
aaaaccggcgatgcaggaagcttag

SEQ ID NO: 1173 - DNA, 25 bp, Rattus norvegicus
aaaaccgggctaacaaaggcatata

SEQ ID NO: 1174 - DNA, 25 bp, Rattus norvegicus
aaaaccgggctatcaaaggcatata

SEQ ID NO: 1175 - DNA, 25 bp, Rattus norvegicus
aaaaccggttttacaggatgcatag

SEQ ID NO: 1176 - DNA, 25 bp, Rattus norvegicus
aaaaccggtttttcaggatgcatag

SEQ ID NO: 1177 - DNA, 25 bp, Rattus norvegicus
aaaaccgtatgaacagatgctgtcc

SEQ ID NO: 1178 - DNA, 25 bp, Rattus norvegicus
aaaaccgtatgatcagatgctgtcc

SEQ ID NO: 1179 - DNA, 25 bp, Rattus norvegicus
aaaaccgtcagcaccatctttatat

SEQ ID NO: 1180 - DNA, 25 bp, Rattus norvegicus
aaaaccgtcagctccatctttatat

SEQ ID NO: 1181 - DNA, 25 bp, Rattus norvegicus
aaaaccgtctgtaccaggtatgtgt

SEQ ID NO: 1182 - DNA, 25 bp, Rattus norvegicus
aaaaccgtctgttccaggtatgtgt

SEQ ID NO: 1183 - DNA, 25 bp, Rattus norvegicus
aaaaccgttctgatatctgctcatg

SEQ ID NO: 1184 - DNA, 25 bp, Rattus norvegicus
aaaaccgttctgttatctgctcatg

SEQ ID NO: 1185 - DNA, 25 bp, Rattus norvegicus
aaaaccgtttatatcctctgctcag

SEQ ID NO: 1186 - DNA, 25 bp, Rattus norvegicus
aaaaccgtttatttcctctgctcag

SEQ ID NO: 1187 - DNA, 25 bp, Rattus norvegicus
aaaacctaaggactacagcaatgac

SEQ ID NO: 1188 - DNA, 25 bp, Rattus norvegicus
aaaacctaaggagtacagcaatgac

SEQ ID NO: 1189 - DNA, 25 bp, Rattus norvegicus
aaaacctactcgacatgatggctta

SEQ ID NO: 1190 - DNA, 25 bp, Rattus norvegicus
aaaacctactcgtcatgatggctta

SEQ ID NO: 1191 - DNA, 25 bp, Rattus norvegicus
aaaacctagcataagagccctcaaa

SEQ ID NO: 1192 - DNA, 25 bp, Rattus norvegicus
aaaacctagcattagagccctcaaa

SEQ ID NO: 1193 - DNA, 25 bp, Rattus norvegicus
aaaacctcaaggctcgagatcccat

SEQ ID NO: 1194 - DNA, 25 bp, Rattus norvegicus
aaaacctcaagggtcgagatcccat

SEQ ID NO: 1195 - DNA, 25 bp, Rattus norvegicus
aaaacctcactcatgtacttggcta

SEQ ID NO: 1196 - DNA, 25 bp, Rattus norvegicus
aaaacctcactcttgtacttggcta

SEQ ID NO: 1197 - DNA, 25 bp, Rattus norvegicus
aaaacctcaggcagctgcggagagt

SEQ ID NO: 1198 - DNA, 25 bp, Rattus norvegicus
aaaacctcaggctgctgcggagagt

SEQ ID NO: 1199 - DNA, 25 bp, Rattus norvegicus
aaaacctcatgtctgcttctagtgt

SEQ ID NO: 1200 - DNA, 25 bp, Rattus norvegicus
aaaacctcatgtgtgcttctagtgt

SEQ ID NO: 1201 - DNA, 25 bp, Rattus norvegicus
aaaacctcctacagagctgggtctg

SEQ ID NO: 1202 - DNA, 25 bp, Rattus norvegicus
aaaacctcctactgagctgggtctg

SEQ ID NO: 1203 - DNA, 25 bp, Rattus norvegicus
aaaacctcctttctgactggctcag

SEQ ID NO: 1204 - DNA, 25 bp, Rattus norvegicus
aaaacctcctttgtgactggctcag

SEQ ID NO: 1205 - DNA, 25 bp, Rattus norvegicus
aaaacctctacgctctcttaaatag

SEQ ID NO: 1206 - DNA, 25 bp, Rattus norvegicus
aaaacctctacggtctcttaaatag

SEQ ID NO: 1207 - DNA, 25 bp, Rattus norvegicus
aaaacctctcagaagttcgggcaat

SEQ ID NO: 1208 - DNA, 25 bp, Rattus norvegicus
aaaacctctcagtagttcgggcaat

SEQ ID NO: 1209 - DNA, 25 bp, Rattus norvegicus
aaaacctctgctattgattggtagc

SEQ ID NO: 1210 - DNA, 25 bp, Rattus norvegicus
aaaacctctgcttttgattggtagc

SEQ ID NO: 1211 - DNA, 25 bp, Rattus norvegicus
aaaacctcttatcctcttggttcgg

SEQ ID NO: 1212 - DNA, 25 bp, Rattus norvegicus
aaaacctcttatgctcttggttcgg

SEQ ID NO: 1213 - DNA, 25 bp, Rattus norvegicus
aaaacctgccatagatcatgtccac

SEQ ID NO: 1214 - DNA, 25 bp, Rattus norvegicus
aaaacctgccattgatcatgtccac

SEQ ID NO: 1215 - DNA, 25 bp, Rattus norvegicus
aaaacctggactcctcagtgccttt

SEQ ID NO: 1216 - DNA, 25 bp, Rattus norvegicus
aaaacctggactcggagactcttgt

SEQ ID NO: 1217 - DNA, 25 bp, Rattus norvegicus
aaaacctggactgctcagtgccttt

SEQ ID NO: 1218 - DNA, 25 bp, Rattus norvegicus
aaaacctggactgggagactcttgt

SEQ ID NO: 1219 - DNA, 25 bp, Rattus norvegicus
aaaacctggcacatcgctagagaga

SEQ ID NO: 1220 - DNA, 25 bp, Rattus norvegicus
aaaacctggcacttcgctagagaga

SEQ ID NO: 1221 - DNA, 25 bp, Rattus norvegicus
aaaacctggcgaagaccacagcaat

SEQ ID NO: 1222 - DNA, 25 bp, Rattus norvegicus
aaaacctggcgatgaccacagcaat

SEQ ID NO: 1223 - DNA, 25 bp, Rattus norvegicus
aaaacctggcgcagttaaatacaca

SEQ ID NO: 1224 - DNA, 25 bp, Rattus norvegicus
aaaacctggcgcctgagttcaactc

SEQ ID NO: 1225 - DNA, 25 bp, Rattus norvegicus
aaaacctggcgcgtgagttcaactc

SEQ ID NO: 1226 - DNA, 25 bp, Rattus norvegicus
aaaacctggcgctgttaaatacaca

SEQ ID NO: 1227 - DNA, 25 bp, Rattus norvegicus
aaaacctgtctcagtgtgcactgga

SEQ ID NO: 1228 - DNA, 25 bp, Rattus norvegicus
aaaacctgtctcatttgagggtgct

SEQ ID NO: 1229 - DNA, 25 bp, Rattus norvegicus
aaaacctgtctctgtgtgcactgga

SEQ ID NO: 1230 - DNA, 25 bp, Rattus norvegicus
aaaacctgtctcttttgagggtgct

SEQ ID NO: 1231 - DNA, 25 bp, Rattus norvegicus
aaaacctgtttgcttgggatagtgg

SEQ ID NO: 1232 - DNA, 25 bp, Rattus norvegicus
aaaacctgtttggttgggatagtgg

SEQ ID NO: 1233 - DNA, 25 bp, Rattus norvegicus
aaaaccttaagcactgcattcccat

SEQ ID NO: 1234 - DNA, 25 bp, Rattus norvegicus
aaaaccttaagctctgcattcccat

SEQ ID NO: 1235 - DNA, 25 bp, Rattus norvegicus
aaaaccttacagatgctactcgtgg

SEQ ID NO: 1236 - DNA, 25 bp, Rattus norvegicus
aaaaccttacagttgctactcgtgg

SEQ ID NO: 1237 - DNA, 25 bp, Rattus norvegicus
aaaaccttagcactgttcagctcag

SEQ ID NO: 1238 - DNA, 25 bp, Rattus norvegicus
aaaaccttagcagtgttcagctcag

SEQ ID NO: 1239 - DNA, 25 bp, Rattus norvegicus
aaaaccttagctactgttctgccat

SEQ ID NO: 1240 - DNA, 25 bp, Rattus norvegicus
aaaaccttagcttctgttctgccat

SEQ ID NO: 1241 - DNA, 25 bp, Rattus norvegicus
aaaaccttaggaaccaatctcaact

SEQ ID NO: 1242 - DNA, 25 bp, Rattus norvegicus
aaaaccttaggatccaatctcaact

SEQ ID NO: 1243 - DNA, 25 bp, Rattus norvegicus
aaaaccttagggaccagtgtggcag

SEQ ID NO: 1244 - DNA, 25 bp, Rattus norvegicus
aaaaccttagggtccagtgtggcag

SEQ ID NO: 1245 - DNA, 25 bp, Rattus norvegicus
aaaaccttaggtactcatggctcta

SEQ ID NO: 1246 - DNA, 25 bp, Rattus norvegicus
aaaaccttaggttctcatggctcta

SEQ ID NO: 1247 - DNA, 25 bp, Rattus norvegicus
aaaaccttatggataagcctcgcaa

SEQ ID NO: 1248 - DNA, 25 bp, Rattus norvegicus
aaaaccttatggttaagcctcgcaa

SEQ ID NO: 1249 - DNA, 25 bp, Rattus norvegicus
aaaaccttattgatgcagagctctg

SEQ ID NO: 1250 - DNA, 25 bp, Rattus norvegicus
aaaaccttattgttgcagagctctg

SEQ ID NO: 1251 - DNA, 25 bp, Rattus norvegicus
aaaaccttcaccagcccataaagag

SEQ ID NO: 1252 - DNA, 25 bp, Rattus norvegicus
aaaaccttcacctgcccataaagag

SEQ ID NO: 1253 - DNA, 25 bp, Rattus norvegicus
aaaaccttccaacattcaacagctt

SEQ ID NO: 1254 - DNA, 25 bp, Rattus norvegicus
aaaaccttccaagattcaacagctt

SEQ ID NO: 1255 - DNA, 25 bp, Rattus norvegicus
aaaaccttctctctactatcttgaa

SEQ ID NO: 1256 - DNA, 25 bp, Rattus norvegicus
aaaaccttctctgtactatcttgaa

SEQ ID NO: 1257 - DNA, 25 bp, Rattus norvegicus
aaaaccttcttaccatccttatgtg

SEQ ID NO: 1258 - DNA, 25 bp, Rattus norvegicus
aaaaccttcttagcatccttatgtg

SEQ ID NO: 1259 - DNA, 25 bp, Rattus norvegicus
aaaaccttgcctactgctgaggaca

SEQ ID NO: 1260 - DNA, 25 bp, Rattus norvegicus
aaaaccttgccttctgctgaggaca

SEQ ID NO: 1261 - DNA, 25 bp, Rattus norvegicus
aaaaccttggtcaatgggcatctgc

SEQ ID NO: 1262 - DNA, 25 bp, Rattus norvegicus
aaaaccttggtctatgggcatctgc

SEQ ID NO: 1263 - DNA, 25 bp, Rattus norvegicus
aaaacctttactcacttccattctg

SEQ ID NO: 1264 - DNA, 25 bp, Rattus norvegicus
aaaacctttactgacttccattctg

SEQ ID NO: 1265 - DNA, 25 bp, Rattus norvegicus
aaaacctttcccatatgtagatcat

SEQ ID NO: 1266 - DNA, 25 bp, Rattus norvegicus
aaaacctttcccttatgtagatcat

SEQ ID NO: 1267 - DNA, 25 bp, Rattus norvegicus
aaaacctttgccacgtgtagtgcct

SEQ ID NO: 1268 - DNA, 25 bp, Rattus norvegicus
aaaacctttgcctcgtgtagtgcct

SEQ ID NO: 1269 - DNA, 25 bp, Rattus norvegicus
aaaacgaaagccctgcatcccaagg

SEQ ID NO: 1270 - DNA, 25 bp, Rattus norvegicus
aaaacgaaagccgtgcatcccaagg

SEQ ID NO: 1271 - DNA, 25 bp, Rattus norvegicus
aaaacgaaccatatccagtgcagga

SEQ ID NO: 1272 - DNA, 25 bp, Rattus norvegicus
aaaacgaaccatttccagtgcagga

SEQ ID NO: 1273 - DNA, 25 bp, Rattus norvegicus
aaaacgacccgcagcaagtgaggct

SEQ ID NO: 1274 - DNA, 25 bp, Rattus norvegicus
aaaacgacccgctgcaagtgaggct

SEQ ID NO: 1275 - DNA, 25 bp, Rattus norvegicus
aaaacgacggtgagctgacatccag

SEQ ID NO: 1276 - DNA, 25 bp, Rattus norvegicus
aaaacgacggtgtgctgacatccag

SEQ ID NO: 1277 - DNA, 25 bp, Rattus norvegicus
aaaacgactcttcctgtccacatag

SEQ ID NO: 1278 - DNA, 25 bp, Rattus norvegicus
aaaacgactcttgctgtccacatag

SEQ ID NO: 1279 - DNA, 25 bp, Rattus norvegicus
aaaacgagacctcctgtgttccaga

SEQ ID NO: 1280 - DNA, 25 bp, Rattus norvegicus
aaaacgagacctgctgtgttccaga

SEQ ID NO: 1281 - DNA, 25 bp, Rattus norvegicus
aaaacgaggctcaggctatgcagaa

SEQ ID NO: 1282 - DNA, 25 bp, Rattus norvegicus
aaaacgaggctctggctatgcagaa

SEQ ID NO: 1283 - DNA, 25 bp, Rattus norvegicus
aaaacgagtcccattacttgccatg

SEQ ID NO: 1284 - DNA, 25 bp, Rattus norvegicus
aaaacgagtccctttacttgccatg

SEQ ID NO: 1285 - DNA, 25 bp, Rattus norvegicus
aaaacgagttccagacattgtcatg

SEQ ID NO: 1286 - DNA, 25 bp, Rattus norvegicus
aaaacgagttcctgacattgtcatg

SEQ ID NO: 1287 - DNA, 25 bp, Rattus norvegicus
aaaacgatcatcaacacggttgcat

SEQ ID NO: 1288 - DNA, 25 bp, Rattus norvegicus
aaaacgatcatctacacggttgcat

SEQ ID NO: 1289 - DNA, 25 bp, Rattus norvegicus
aaaacgcacagaaacaccaccatga

SEQ ID NO: 1290 - DNA, 25 bp, Rattus norvegicus
aaaacgcacagatacaccaccatga

SEQ ID NO: 1291 - DNA, 25 bp, Rattus norvegicus
aaaacgcctacacacgactggcagt

SEQ ID NO: 1292 - DNA, 25 bp, Rattus norvegicus
aaaacgcctacagacgactggcagt

SEQ ID NO: 1293 - DNA, 25 bp, Rattus norvegicus
aaaacgcctactaatctctggctgc

SEQ ID NO: 1294 - DNA, 25 bp, Rattus norvegicus
aaaacgcctacttatctctggctgc

SEQ ID NO: 1295 - DNA, 25 bp, Rattus norvegicus
aaaacgcgtcttctaacatggcaaa

SEQ ID NO: 1296 - DNA, 25 bp, Rattus norvegicus
aaaacgcgtcttgtaacatggcaaa

SEQ ID NO: 1297 - DNA, 25 bp, Rattus norvegicus
aaaacgctcgcgagctagactggat

SEQ ID NO: 1298 - DNA, 25 bp, Rattus norvegicus
aaaacgctcgcgtgctagactggat

SEQ ID NO: 1299 - DNA, 25 bp, Rattus norvegicus
aaaacgctctacagatctccttttc

SEQ ID NO: 1300 - DNA, 25 bp, Rattus norvegicus
aaaacgctctactgatctccttttc

SEQ ID NO: 1301 - DNA, 25 bp, Rattus norvegicus
aaaacgctgtcgactcgagaacctc

SEQ ID NO: 1302 - DNA, 25 bp, Rattus norvegicus
aaaacgctgtcgtctcgagaacctc

SEQ ID NO: 1303 - DNA, 25 bp, Rattus norvegicus
aaaacgctgtctaggcttacgtgca

SEQ ID NO: 1304 - DNA, 25 bp, Rattus norvegicus
aaaacgctgtcttggcttacgtgca

SEQ ID NO: 1305 - DNA, 25 bp, Rattus norvegicus
aaaacgctgtgcaaattctagcagt

SEQ ID NO: 1306 - DNA, 25 bp, Rattus norvegicus
aaaacgctgtgctaattctagcagt

SEQ ID NO: 1307 - DNA, 25 bp, Rattus norvegicus
aaaacggaatatccccatgctcttc

SEQ ID NO: 1308 - DNA, 25 bp, Rattus norvegicus
aaaacggaatatgcccatgctcttc

SEQ ID NO: 1309 - DNA, 25 bp, Rattus norvegicus
aaaacggacaacacagcaagggcac

SEQ ID NO: 1310 - DNA, 25 bp, Rattus norvegicus
aaaacggacaactcagcaagggcac

SEQ ID NO: 1311 - DNA, 25 bp, Rattus norvegicus
aaaacggacctcacctgtcttgtag

SEQ ID NO: 1312 - DNA, 25 bp, Rattus norvegicus
aaaacggacctctcctgtcttgtag

SEQ ID NO: 1313 - DNA, 25 bp, Rattus norvegicus
aaaacggcaggcaacctgagccttc

SEQ ID NO: 1314 - DNA, 25 bp, Rattus norvegicus
aaaacggcaggctacctgagccttc

SEQ ID NO: 1315 - DNA, 25 bp, Rattus norvegicus
aaaacggccaacaggctgccactgt

SEQ ID NO: 1316 - DNA, 25 bp, Rattus norvegicus
aaaacggccaactggctgccactgt

SEQ ID NO: 1317 - DNA, 25 bp, Rattus norvegicus
aaaacggcctgaactgtgacttcaa

SEQ ID NO: 1318 - DNA, 25 bp, Rattus norvegicus
aaaacggcctgatctgtgacttcaa

SEQ ID NO: 1319 - DNA, 25 bp, Rattus norvegicus
aaaacggctactagcaccaggactg

SEQ ID NO: 1320 - DNA, 25 bp, Rattus norvegicus
aaaacggctacttgcaccaggactg

SEQ ID NO: 1321 - DNA, 25 bp, Rattus norvegicus
aaaacggctagtacgctgggatggt

SEQ ID NO: 1322 - DNA, 25 bp, Rattus norvegicus
aaaacggctagttcgctgggatggt

SEQ ID NO: 1323 - DNA, 25 bp, Rattus norvegicus
aaaacgggacatccagtgtgtgcct

SEQ ID NO: 1324 - DNA, 25 bp, Rattus norvegicus
aaaacgggacatgcagtgtgtgcct

SEQ ID NO: 1325 - DNA, 25 bp, Rattus norvegicus
aaaacgggccagctcagcaggtgat

SEQ ID NO: 1326 - DNA, 25 bp, Rattus norvegicus
aaaacgggccaggtcagcaggtgat

SEQ ID NO: 1327 - DNA, 25 bp, Rattus norvegicus
aaaacgggtacgagtggctactgcg

SEQ ID NO: 1328 - DNA, 25 bp, Rattus norvegicus
aaaacgggtacgtgtggctactgcg

SEQ ID NO: 1329 - DNA, 25 bp, Rattus norvegicus
aaaacggtacaccaccatctcagag

SEQ ID NO: 1330 - DNA, 25 bp, Rattus norvegicus
aaaacggtacacgaccatctcagag

SEQ ID NO: 1331 - DNA, 25 bp, Rattus norvegicus
aaaacggtagacacgatcctgctgt

SEQ ID NO: 1332 - DNA, 25 bp, Rattus norvegicus
aaaacggtagactcgatcctgctgt

SEQ ID NO: 1333 - DNA, 25 bp, Rattus norvegicus
aaaacggtgcagagccagactgata

SEQ ID NO: 1334 - DNA, 25 bp, Rattus norvegicus
aaaacggtgcagtgccagactgata

SEQ ID NO: 1335 - DNA, 25 bp, Rattus norvegicus
aaaacggtttagcagcctcttcgca

SEQ ID NO: 1336 - DNA, 25 bp, Rattus norvegicus
aaaacggtttaggagcctcttcgca

SEQ ID NO: 1337 - DNA, 25 bp, Rattus norvegicus
aaaacgtacctcactgaagtcattt

SEQ ID NO: 1338 - DNA, 25 bp, Rattus norvegicus
aaaacgtacctctctgaagtcattt

SEQ ID NO: 1339 - DNA, 25 bp, Rattus norvegicus
aaaacgtattcgactcttcatccag

SEQ ID NO: 1340 - DNA, 25 bp, Rattus norvegicus
aaaacgtattcgtctcttcatccag

SEQ ID NO: 1341 - DNA, 25 bp, Rattus norvegicus
aaaacgtcctgcatttttctgtctt

SEQ ID NO: 1342 - DNA, 25 bp, Rattus norvegicus
aaaacgtcctgcttttttctgtctt

SEQ ID NO: 1343 - DNA, 25 bp, Rattus norvegicus
aaaacgtccttgctgcagcgctaca

SEQ ID NO: 1344 - DNA, 25 bp, Rattus norvegicus
aaaacgtccttggtgcagcgctaca

SEQ ID NO: 1345 - DNA, 25 bp, Rattus norvegicus
aaaacgtctcttctgaatactttga

SEQ ID NO: 1346 - DNA, 25 bp, Rattus norvegicus
aaaacgtctcttgtgaatactttga

SEQ ID NO: 1347 - DNA, 25 bp, Rattus norvegicus
aaaacgtgactgctgggctctccac

SEQ ID NO: 1348 - DNA, 25 bp, Rattus norvegicus
aaaacgtgactggtgggctctccac

SEQ ID NO: 1349 - DNA, 25 bp, Rattus norvegicus
aaaacgtgctttacaggtacagaga

SEQ ID NO: 1350 - DNA, 25 bp, Rattus norvegicus
aaaacgtgcttttcaggtacagaga

SEQ ID NO: 1351 - DNA, 25 bp, Rattus norvegicus
aaaacgtggtgaccggcagcatctg

SEQ ID NO: 1352 - DNA, 25 bp, Rattus norvegicus
aaaacgtggtgagcggcagcatctg

SEQ ID NO: 1353 - DNA, 25 bp, Rattus norvegicus
aaaacgtgtgtccttttcagtctgt

SEQ ID NO: 1354 - DNA, 25 bp, Rattus norvegicus
aaaacgtgtgtcgttttcagtctgt

SEQ ID NO: 1355 - DNA, 25 bp, Rattus norvegicus
aaaacgtgttgcatggactgactgt

SEQ ID NO: 1356 - DNA, 25 bp, Rattus norvegicus
aaaacgtgttgcttggactgactgt

SEQ ID NO: 1357 - DNA, 25 bp, Rattus norvegicus
aaaacgtgtttcattgcatcactct

SEQ ID NO: 1358 - DNA, 25 bp, Rattus norvegicus
aaaacgtgtttctttgcatcactct

SEQ ID NO: 1359 - DNA, 25 bp, Rattus norvegicus
aaaacgtgtttgctttgctgccatt

SEQ ID NO: 1360 - DNA, 25 bp, Rattus norvegicus
aaaacgtgtttggtttgctgccatt

SEQ ID NO: 1361 - DNA, 25 bp, Rattus norvegicus
aaaacgttcccaaggcagcaaccag

SEQ ID NO: 1362 - DNA, 25 bp, Rattus norvegicus
aaaacgttcccatggcagcaaccag

SEQ ID NO: 1363 - DNA, 25 bp, Rattus norvegicus
aaaacgttctgtacattgagagatg

SEQ ID NO: 1364 - DNA, 25 bp, Rattus norvegicus
aaaacgttctgttcattgagagatg

SEQ ID NO: 1365 - DNA, 25 bp, Rattus norvegicus
aaaactaacattcacccagcacgga

SEQ ID NO: 1366 - DNA, 25 bp, Rattus norvegicus
aaaactaacattgacccagcacgga

SEQ ID NO: 1367 - DNA, 25 bp, Rattus norvegicus
aaaactaacctcagggatacctctg

SEQ ID NO: 1368 - DNA, 25 bp, Rattus norvegicus
aaaactaacctctgggatacctctg

SEQ ID NO: 1369 - DNA, 25 bp, Rattus norvegicus
aaaactaaggttccagccactgtca

SEQ ID NO: 1370 - DNA, 25 bp, Rattus norvegicus
aaaactaaggttgcagccactgtca

SEQ ID NO: 1371 - DNA, 25 bp, Rattus norvegicus
aaaactaagtgtactctgtgcctct

SEQ ID NO: 1372 - DNA, 25 bp, Rattus norvegicus
aaaactaagtgttctctgtgcctct

SEQ ID NO: 1373 - DNA, 25 bp, Rattus norvegicus
aaaactacagtcctgggctctccta

SEQ ID NO: 1374 - DNA, 25 bp, Rattus norvegicus
aaaactacagtcgtgggctctccta

SEQ ID NO: 1375 - DNA, 25 bp, Rattus norvegicus
aaaactaccaacatgtcagccagca

SEQ ID NO: 1376 - DNA, 25 bp, Rattus norvegicus
aaaactaccaacttgtcagccagca

SEQ ID NO: 1377 - DNA, 25 bp, Rattus norvegicus
aaaactacgtaaaggccagcttcta

SEQ ID NO: 1378 - DNA, 25 bp, Rattus norvegicus
aaaactacgtaatggccagcttcta

SEQ ID NO: 1379 - DNA, 25 bp, Rattus norvegicus
aaaactacgtgaccccacatttgct

SEQ ID NO: 1380 - DNA, 25 bp, Rattus norvegicus
aaaactacgtgagcccacatttgct

SEQ ID NO: 1381 - DNA, 25 bp, Rattus norvegicus
aaaactactccaaaagcccaacatt

SEQ ID NO: 1382 - DNA, 25 bp, Rattus norvegicus
aaaactactccataagcccaacatt

SEQ ID NO: 1383 - DNA, 25 bp, Rattus norvegicus
aaaactacttatatattatctgtct

SEQ ID NO: 1384 - DNA, 25 bp, Rattus norvegicus
aaaactacttatttattatctgtct

SEQ ID NO: 1385 - DNA, 25 bp, Rattus norvegicus
aaaactaggcgaccccatggagagt

SEQ ID NO: 1386 - DNA, 25 bp, Rattus norvegicus
aaaactaggcgagcccatggagagt

SEQ ID NO: 1387 - DNA, 25 bp, Rattus norvegicus
aaaactaggctgactcgaacccctg

SEQ ID NO: 1388 - DNA, 25 bp, Rattus norvegicus
aaaactaggctgtctcgaacccctg

SEQ ID NO: 1389 - DNA, 25 bp, Rattus norvegicus
aaaactagggtcagatcactggaaa

SEQ ID NO: 1390 - DNA, 25 bp, Rattus norvegicus
aaaactagggtctgatcactggaaa

SEQ ID NO: 1391 - DNA, 25 bp, Rattus norvegicus
aaaactagtccgcatgcctttgagc

SEQ ID NO: 1392 - DNA, 25 bp, Rattus norvegicus
aaaactagtccggatgcctttgagc

SEQ ID NO: 1393 - DNA, 25 bp, Rattus norvegicus
aaaactatatacctcagtgtcccac

SEQ ID NO: 1394 - DNA, 25 bp, Rattus norvegicus
aaaactatatacgtcagtgtcccac

SEQ ID NO: 1395 - DNA, 25 bp, Rattus norvegicus
aaaactatcttgagatgcctgagtg

SEQ ID NO: 1396 - DNA, 25 bp, Rattus norvegicus
aaaactatcttgtgatgcctgagtg

SEQ ID NO: 1397 - DNA, 25 bp, Rattus norvegicus
aaaactattggcatatcactccccg

SEQ ID NO: 1398 - DNA, 25 bp, Rattus norvegicus
aaaactattggcttatcactccccg

SEQ ID NO: 1399 - DNA, 25 bp, Rattus norvegicus
aaaactattttcatctctacttcag

SEQ ID NO: 1400 - DNA, 25 bp, Rattus norvegicus
aaaactattttcttctctacttcag

SEQ ID NO: 1401 - DNA, 25 bp, Rattus norvegicus
aaaactcaaatcagcatctctgccc

SEQ ID NO: 1402 - DNA, 25 bp, Rattus norvegicus
aaaactcaaatctgcatctctgccc

SEQ ID NO: 1403 - DNA, 25 bp, Rattus norvegicus
aaaactcaacatcagcaatcccatt

SEQ ID NO: 1404 - DNA, 25 bp, Rattus norvegicus
aaaactcaacatgagcaatcccatt

SEQ ID NO: 1405 - DNA, 25 bp, Rattus norvegicus
aaaactcaacctaatcctgcagtat

SEQ ID NO: 1406 - DNA, 25 bp, Rattus norvegicus
aaaactcaaccttatcctgcagtat

SEQ ID NO: 1407 - DNA, 25 bp, Rattus norvegicus
aaaactcaagaacaccacagccttt

SEQ ID NO: 1408 - DNA, 25 bp, Rattus norvegicus
aaaactcaagaagaccacagccttt

SEQ ID NO: 1409 - DNA, 25 bp, Rattus norvegicus
aaaactcaagtgcagtaaggacaga

SEQ ID NO: 1410 - DNA, 25 bp, Rattus norvegicus
aaaactcaagtggagtaaggacaga

SEQ ID NO: 1411 - DNA, 25 bp, Rattus norvegicus
aaaactcacagcacagggcagaggt

SEQ ID NO: 1412 - DNA, 25 bp, Rattus norvegicus
aaaactcacagctcagggcagaggt

SEQ ID NO: 1413 - DNA, 25 bp, Rattus norvegicus
aaaactcacaggatggccagcactt

SEQ ID NO: 1414 - DNA, 25 bp, Rattus norvegicus
aaaactcacaggttggccagcactt

SEQ ID NO: 1415 - DNA, 25 bp, Rattus norvegicus
aaaactcaccagcatagtagctaga

SEQ ID NO: 1416 - DNA, 25 bp, Rattus norvegicus
aaaactcaccaggatagtagctaga

SEQ ID NO: 1417 - DNA, 25 bp, Rattus norvegicus
aaaactcacttcatatctactctgg

SEQ ID NO: 1418 - DNA, 25 bp, Rattus norvegicus
aaaactcacttcttatctactctgg

SEQ ID NO: 1419 - DNA, 25 bp, Rattus norvegicus
aaaactcagcgcagccaagggatat

SEQ ID NO: 1420 - DNA, 25 bp, Rattus norvegicus
aaaactcagcgctgccaagggatat

SEQ ID NO: 1421 - DNA, 25 bp, Rattus norvegicus
aaaactcaggagacaccactcgacg

SEQ ID NO: 1422 - DNA, 25 bp, Rattus norvegicus
aaaactcaggagtcaccactcgacg

SEQ ID NO: 1423 - DNA, 25 bp, Rattus norvegicus
aaaactcaggcccagtgtcacgacc

SEQ ID NO: 1424 - DNA, 25 bp, Rattus norvegicus
aaaactcaggccgagtgtcacgacc

SEQ ID NO: 1425 - DNA, 25 bp, Rattus norvegicus
aaaactcaggcgcacaaacttcacc

SEQ ID NO: 1426 - DNA, 25 bp, Rattus norvegicus
aaaactcaggcggacaaacttcacc

SEQ ID NO: 1427 - DNA, 25 bp, Rattus norvegicus
aaaactcagggactctcagagttgg

SEQ ID NO: 1428 - DNA, 25 bp, Rattus norvegicus
aaaactcagggagtctcagagttgg

SEQ ID NO: 1429 - DNA, 25 bp, Rattus norvegicus
aaaactcagggcattgtcctgtcgt

SEQ ID NO: 1430 - DNA, 25 bp, Rattus norvegicus
aaaactcagggctttgtcctgtcgt

SEQ ID NO: 1431 - DNA, 25 bp, Rattus norvegicus
aaaactcaggtgaggatgtgcagaa

SEQ ID NO: 1432 - DNA, 25 bp, Rattus norvegicus
aaaactcaggtgtggatgtgcagaa

SEQ ID NO: 1433 - DNA, 25 bp, Rattus norvegicus
aaaactcagttcagaggactattga

SEQ ID NO: 1434 - DNA, 25 bp, Rattus norvegicus
aaaactcagttctgaggactattga

SEQ ID NO: 1435 - DNA, 25 bp, Rattus norvegicus
aaaactcatcttccagaagcttctg

SEQ ID NO: 1436 - DNA, 25 bp, Rattus norvegicus
aaaactcatcttgcagaagcttctg

SEQ ID NO: 1437 - DNA, 25 bp, Rattus norvegicus
aaaactcatgcacaactcctatcgc

SEQ ID NO: 1438 - DNA, 25 bp, Rattus norvegicus
aaaactcatgcagaactcctatcgc

SEQ ID NO: 1439 - DNA, 25 bp, Rattus norvegicus
aaaactcatgtaagccacacagtgg

SEQ ID NO: 1440 - DNA, 25 bp, Rattus norvegicus
aaaactcatgtatgccacacagtgg

SEQ ID NO: 1441 - DNA, 25 bp, Rattus norvegicus
aaaactcattgtatcttccaccaca

SEQ ID NO: 1442 - DNA, 25 bp, Rattus norvegicus
aaaactcattgtttcttccaccaca

SEQ ID NO: 1443 - DNA, 25 bp, Rattus norvegicus
aaaactccaacgctgctatactctg

SEQ ID NO: 1444 - DNA, 25 bp, Rattus norvegicus
aaaactccaacggtgctatactctg

SEQ ID NO: 1445 - DNA, 25 bp, Rattus norvegicus
aaaactccaaggctcttcttgactt

SEQ ID NO: 1446 - DNA, 25 bp, Rattus norvegicus
aaaactccaagggtcttcttgactt

SEQ ID NO: 1447 - DNA, 25 bp, Rattus norvegicus
aaaactccaagtctttctgtagtca

SEQ ID NO: 1448 - DNA, 25 bp, Rattus norvegicus
aaaactccaagtgtttctgtagtca

SEQ ID NO: 1449 - DNA, 25 bp, Rattus norvegicus
aaaactccagagaatgcccactggg

SEQ ID NO: 1450 - DNA, 25 bp, Rattus norvegicus
aaaactccagagtatgcccactggg

SEQ ID NO: 1451 - DNA, 25 bp, Rattus norvegicus
aaaactccagtcaccattcattctg

SEQ ID NO: 1452 - DNA, 25 bp, Rattus norvegicus
aaaactccagtctccattcattctg

SEQ ID NO: 1453 - DNA, 25 bp, Rattus norvegicus
aaaactccattgagcagggctgaaa

SEQ ID NO: 1454 - DNA, 25 bp, Rattus norvegicus
aaaactccattgtgcagggctgaaa

SEQ ID NO: 1455 - DNA, 25 bp, Rattus norvegicus
aaaactccccacatgaggctgcact

SEQ ID NO: 1456 - DNA, 25 bp, Rattus norvegicus
aaaactccccacttgaggctgcact

SEQ ID NO: 1457 - DNA, 25 bp, Rattus norvegicus
aaaactcccctgctgacatgtggaa

SEQ ID NO: 1458 - DNA, 25 bp, Rattus norvegicus
aaaactcccctggtgacatgtggaa

SEQ ID NO: 1459 - DNA, 25 bp, Rattus norvegicus
aaaactcccgttatctatcctgtat

SEQ ID NO: 1460 - DNA, 25 bp, Rattus norvegicus
aaaactcccgttttctatcctgtat

SEQ ID NO: 1461 - DNA, 25 bp, Rattus norvegicus
aaaactccgataattgtatgcattt

SEQ ID NO: 1462 - DNA, 25 bp, Rattus norvegicus
aaaactccgatatttgtatgcattt

SEQ ID NO: 1463 - DNA, 25 bp, Rattus norvegicus
aaaactccgatcacagcttgctaaa

SEQ ID NO: 1464 - DNA, 25 bp, Rattus norvegicus
aaaactccgatctcagcttgctaaa

SEQ ID NO: 1465 - DNA, 25 bp, Rattus norvegicus
aaaactcctaccaatgctgatcaat

SEQ ID NO: 1466 - DNA, 25 bp, Rattus norvegicus
aaaactcctacctatgctgatcaat

SEQ ID NO: 1467 - DNA, 25 bp, Rattus norvegicus
aaaactcctgagacatgaacccgtc

SEQ ID NO: 1468 - DNA, 25 bp, Rattus norvegicus
aaaactcctgagtcatgaacccgtc

SEQ ID NO: 1469 - DNA, 25 bp, Rattus norvegicus
aaaactcctgctccaatgggtgtga

SEQ ID NO: 1470 - DNA, 25 bp, Rattus norvegicus
aaaactcctgctgcaatgggtgtga

SEQ ID NO: 1471 - DNA, 25 bp, Rattus norvegicus
aaaactcctggaatcttgcaaagat

SEQ ID NO: 1472 - DNA, 25 bp, Rattus norvegicus
aaaactcctggattcttgcaaagat

SEQ ID NO: 1473 - DNA, 25 bp, Rattus norvegicus
aaaactctagtgacagttcctgttg

SEQ ID NO: 1474 - DNA, 25 bp, Rattus norvegicus
aaaactctagtgtcagttcctgttg

SEQ ID NO: 1475 - DNA, 25 bp, Rattus norvegicus
aaaactctcagcacgagcttatgca

SEQ ID NO: 1476 - DNA, 25 bp, Rattus norvegicus
aaaactctcagctcgagcttatgca

SEQ ID NO: 1477 - DNA, 25 bp, Rattus norvegicus
aaaactctcatgacttcaattgtac

SEQ ID NO: 1478 - DNA, 25 bp, Rattus norvegicus
aaaactctcatgtcttcaattgtac

SEQ ID NO: 1479 - DNA, 25 bp, Rattus norvegicus
aaaactctccatataagcttccaga

SEQ ID NO: 1480 - DNA, 25 bp, Rattus norvegicus
aaaactctccatttaagcttccaga

SEQ ID NO: 1481 - DNA, 25 bp, Rattus norvegicus
aaaactctcgcacccagacgtgata

SEQ ID NO: 1482 - DNA, 25 bp, Rattus norvegicus
aaaactctcgcagccagacgtgata

SEQ ID NO: 1483 - DNA, 25 bp, Rattus norvegicus
aaaactctcttgctgaagacctttg

SEQ ID NO: 1484 - DNA, 25 bp, Rattus norvegicus
aaaactctcttggtgaagacctttg

SEQ ID NO: 1485 - DNA, 25 bp, Rattus norvegicus
aaaactctgactatggtattctctc

SEQ ID NO: 1486 - DNA, 25 bp, Rattus norvegicus
aaaactctgactttggtattctctc

SEQ ID NO: 1487 - DNA, 25 bp, Rattus norvegicus
aaaactctgcctaccagctttaaga

SEQ ID NO: 1488 - DNA, 25 bp, Rattus norvegicus
aaaactctgccttccagctttaaga

SEQ ID NO: 1489 - DNA, 25 bp, Rattus norvegicus
aaaactctgctgaagctcaatggct

SEQ ID NO: 1490 - DNA, 25 bp, Rattus norvegicus
aaaactctgctgtagctcaatggct

SEQ ID NO: 1491 - DNA, 25 bp, Rattus norvegicus
aaaactctgtacacacctagttcat

SEQ ID NO: 1492 - DNA, 25 bp, Rattus norvegicus
aaaactctgtactcacctagttcat

SEQ ID NO: 1493 - DNA, 25 bp, Rattus norvegicus
aaaactctgtgtcgtctcatgtcat

SEQ ID NO: 1494 - DNA, 25 bp, Rattus norvegicus
aaaactctgtgtggtctcatgtcat

SEQ ID NO: 1495 - DNA, 25 bp, Rattus norvegicus
aaaactcttagcaccataatggtgc

SEQ ID NO: 1496 - DNA, 25 bp, Rattus norvegicus
aaaactcttagctccataatggtgc

SEQ ID NO: 1497 - DNA, 25 bp, Rattus norvegicus
aaaactcttctgataaacggcaata

SEQ ID NO: 1498 - DNA, 25 bp, Rattus norvegicus
aaaactcttctgttaaacggcaata

SEQ ID NO: 1499 - DNA, 25 bp, Rattus norvegicus
aaaactcttgctagagcctcagctg

SEQ ID NO: 1500 - DNA, 25 bp, Rattus norvegicus
aaaactcttgcttgagcctcagctg

SEQ ID NO: 1501 - DNA, 25 bp, Rattus norvegicus
aaaactcttgttatctgaattgcta

SEQ ID NO: 1502 - DNA, 25 bp, Rattus norvegicus
aaaactcttgttttctgaattgcta

SEQ ID NO: 1503 - DNA, 25 bp, Rattus norvegicus
aaaactgaaactctaccatgccact

SEQ ID NO: 1504 - DNA, 25 bp, Rattus norvegicus
aaaactgaaactgtaccatgccact

SEQ ID NO: 1505 - DNA, 25 bp, Rattus norvegicus
aaaactgaaattaactctctagctt

SEQ ID NO: 1506 - DNA, 25 bp, Rattus norvegicus
aaaactgaaatttactctctagctt

SEQ ID NO: 1507 - DNA, 25 bp, Rattus norvegicus
aaaactgaagctcgagggtggccct

SEQ ID NO: 1508 - DNA, 25 bp, Rattus norvegicus
aaaactgaagctggagggtggccct

SEQ ID NO: 1509 - DNA, 25 bp, Rattus norvegicus
aaaactgaagttagtggcactgcat

SEQ ID NO: 1510 - DNA, 25 bp, Rattus norvegicus
aaaactgaagtttgtggcactgcat

SEQ ID NO: 1511 - DNA, 25 bp, Rattus norvegicus
aaaactgacactctacctgagtccc

SEQ ID NO: 1512 - DNA, 25 bp, Rattus norvegicus
aaaactgacactgtacctgagtccc

SEQ ID NO: 1513 - DNA, 25 bp, Rattus norvegicus
aaaactgacatcatgactctggccc

SEQ ID NO: 1514 - DNA, 25 bp, Rattus norvegicus
aaaactgacatcttgactctggccc

SEQ ID NO: 1515 - DNA, 25 bp, Rattus norvegicus
aaaactgactcaacactcactgctg

SEQ ID NO: 1516 - DNA, 25 bp, Rattus norvegicus
aaaactgactcatcactcactgctg

SEQ ID NO: 1517 - DNA, 25 bp, Rattus norvegicus
aaaactgagaagcatccttgacatg

SEQ ID NO: 1518 - DNA, 25 bp, Rattus norvegicus
aaaactgagaagcttgggagaccca

SEQ ID NO: 1519 - DNA, 25 bp, Rattus norvegicus
aaaactgagaaggatccttgacatg

SEQ ID NO: 1520 - DNA, 25 bp, Rattus norvegicus
aaaactgagaaggttgggagaccca

SEQ ID NO: 1521 - DNA, 25 bp, Rattus norvegicus
aaaactgagaccacgtgggtgcatg

SEQ ID NO: 1522 - DNA, 25 bp, Rattus norvegicus
aaaactgagacctcgtgggtgcatg

SEQ ID NO: 1523 - DNA, 25 bp, Rattus norvegicus
aaaactgagacgctctgcaccttca

SEQ ID NO: 1524 - DNA, 25 bp, Rattus norvegicus
aaaactgagacggtctgcaccttca

SEQ ID NO: 1525 - DNA, 25 bp, Rattus norvegicus
aaaactgagactatgctgggtgtgt

SEQ ID NO: 1526 - DNA, 25 bp, Rattus norvegicus
aaaactgagactttgctgggtgtgt

SEQ ID NO: 1527 - DNA, 25 bp, Rattus norvegicus
aaaactgaggcacgctcacgccgag

SEQ ID NO: 1528 - DNA, 25 bp, Rattus norvegicus
aaaactgaggcaggctcacgccgag

SEQ ID NO: 1529 - DNA, 25 bp, Rattus norvegicus
aaaactgagttcctttccttcatga

SEQ ID NO: 1530 - DNA, 25 bp, Rattus norvegicus
aaaactgagttcgtttccttcatga

SEQ ID NO: 1531 - DNA, 25 bp, Rattus norvegicus
aaaactgatcttcttgttctcttct

SEQ ID NO: 1532 - DNA, 25 bp, Rattus norvegicus
aaaactgatcttgttgttctcttct

SEQ ID NO: 1533 - DNA, 25 bp, Rattus norvegicus
aaaactgatgcgattccttgggagt

SEQ ID NO: 1534 - DNA, 25 bp, Rattus norvegicus
aaaactgatgcgtttccttgggagt

SEQ ID NO: 1535 - DNA, 25 bp, Rattus norvegicus
aaaactgatggtagttgtatggaca

SEQ ID NO: 1536 - DNA, 25 bp, Rattus norvegicus
aaaactgatggttgttgtatggaca

SEQ ID NO: 1537 - DNA, 25 bp, Rattus norvegicus
aaaactgattaccactactccgatc

SEQ ID NO: 1538 - DNA, 25 bp, Rattus norvegicus
aaaactgattacgactactccgatc

SEQ ID NO: 1539 - DNA, 25 bp, Rattus norvegicus
aaaactgcacatattctgggcattg

SEQ ID NO: 1540 - DNA, 25 bp, Rattus norvegicus
aaaactgcacattttctgggcattg

SEQ ID NO: 1541 - DNA, 25 bp, Rattus norvegicus
aaaactgcagcaccgatgcttgccc

SEQ ID NO: 1542 - DNA, 25 bp, Rattus norvegicus
aaaactgcagcagcgatgcttgccc

SEQ ID NO: 1543 - DNA, 25 bp, Rattus norvegicus
aaaactgcagttactgtgggtggct

SEQ ID NO: 1544 - DNA, 25 bp, Rattus norvegicus
aaaactgcagtttctgtgggtggct

SEQ ID NO: 1545 - DNA, 25 bp, Rattus norvegicus
aaaactgccgtacaagtgatagtgt

SEQ ID NO: 1546 - DNA, 25 bp, Rattus norvegicus
aaaactgccgtagaagtgatagtgt

SEQ ID NO: 1547 - DNA, 25 bp, Rattus norvegicus
aaaactgccttcacacacattttct

SEQ ID NO: 1548 - DNA, 25 bp, Rattus norvegicus
aaaactgccttcattttcctgtgtg

SEQ ID NO: 1549 - DNA, 25 bp, Rattus norvegicus
aaaactgccttctcacacattttct

SEQ ID NO: 1550 - DNA, 25 bp, Rattus norvegicus
aaaactgccttctttttcctgtgtg

SEQ ID NO: 1551 - DNA, 25 bp, Rattus norvegicus
aaaactgcctttaatggtgtggtct

SEQ ID NO: 1552 - DNA, 25 bp, Rattus norvegicus
aaaactgcctttcttctttgtagct

SEQ ID NO: 1553 - DNA, 25 bp, Rattus norvegicus
aaaactgcctttgttctttgtagct

SEQ ID NO: 1554 - DNA, 25 bp, Rattus norvegicus
aaaactgccttttatggtgtggtct

SEQ ID NO: 1555 - DNA, 25 bp, Rattus norvegicus
aaaactgctactacgccagatgcgc

SEQ ID NO: 1556 - DNA, 25 bp, Rattus norvegicus
aaaactgctacttcgccagatgcgc

SEQ ID NO: 1557 - DNA, 25 bp, Rattus norvegicus
aaaactgctaggaccttggcacttg

SEQ ID NO: 1558 - DNA, 25 bp, Rattus norvegicus
aaaactgctaggtccttggcacttg

SEQ ID NO: 1559 - DNA, 25 bp, Rattus norvegicus
aaaactgctctcagtggtaccatgt

SEQ ID NO: 1560 - DNA, 25 bp, Rattus norvegicus
aaaactgctctctgtggtaccatgt

SEQ ID NO: 1561 - DNA, 25 bp, Rattus norvegicus
aaaactgctctgctacaagcgcctc

SEQ ID NO: 1562 - DNA, 25 bp, Rattus norvegicus
aaaactgctctggtacaagcgcctc

SEQ ID NO: 1563 - DNA, 25 bp, Rattus norvegicus
aaaactgctgcaacctgcggaagga

SEQ ID NO: 1564 - DNA, 25 bp, Rattus norvegicus
aaaactgctgcatcctgcggaagga

SEQ ID NO: 1565 - DNA, 25 bp, Rattus norvegicus
aaaactgctgctacgtgtgtacaaa

SEQ ID NO: 1566 - DNA, 25 bp, Rattus norvegicus
aaaactgctgctactcatgtacaat

SEQ ID NO: 1567 - DNA, 25 bp, Rattus norvegicus
aaaactgctgcttcgtgtgtacaaa

SEQ ID NO: 1568 - DNA, 25 bp, Rattus norvegicus
aaaactgctgcttctcatgtacaat

SEQ ID NO: 1569 - DNA, 25 bp, Rattus norvegicus
aaaactgctggcctgtctcacccta

SEQ ID NO: 1570 - DNA, 25 bp, Rattus norvegicus
aaaactgctggcgtgtctcacccta

SEQ ID NO: 1571 - DNA, 25 bp, Rattus norvegicus
aaaactgctggtaccacagcgggtt

SEQ ID NO: 1572 - DNA, 25 bp, Rattus norvegicus
aaaactgctggttccacagcgggtt

SEQ ID NO: 1573 - DNA, 25 bp, Rattus norvegicus
aaaactgctgttcttaactgccctt

SEQ ID NO: 1574 - DNA, 25 bp, Rattus norvegicus
aaaactgctgttgttaactgccctt

SEQ ID NO: 1575 - DNA, 25 bp, Rattus norvegicus
aaaactgcttccacctttctgagca

SEQ ID NO: 1576 - DNA, 25 bp, Rattus norvegicus
aaaactgcttcctcctttctgagca

SEQ ID NO: 1577 - DNA, 25 bp, Rattus norvegicus
aaaactggacataccatggccctgg

SEQ ID NO: 1578 - DNA, 25 bp, Rattus norvegicus
aaaactggacattccatggccctgg

SEQ ID NO: 1579 - DNA, 25 bp, Rattus norvegicus
aaaactggactgacggtttgataca

SEQ ID NO: 1580 - DNA, 25 bp, Rattus norvegicus
aaaactggactgtcggtttgataca

SEQ ID NO: 1581 - DNA, 25 bp, Rattus norvegicus
aaaactggagagattctgctcgctc

SEQ ID NO: 1582 - DNA, 25 bp, Rattus norvegicus
aaaactggagagtttctgctcgctc

SEQ ID NO: 1583 - DNA, 25 bp, Rattus norvegicus
aaaactggatatcctgtctgctcaa

SEQ ID NO: 1584 - DNA, 25 bp, Rattus norvegicus
aaaactggatatgctgtctgctcaa

SEQ ID NO: 1585 - DNA, 25 bp, Rattus norvegicus
aaaactggatcaagacagggctttt

SEQ ID NO: 1586 - DNA, 25 bp, Rattus norvegicus
aaaactggatcatgacagggctttt

SEQ ID NO: 1587 - DNA, 25 bp, Rattus norvegicus
aaaactggccaaactagccttctgg

SEQ ID NO: 1588 - DNA, 25 bp, Rattus norvegicus
aaaactggccaatctagccttctgg

SEQ ID NO: 1589 - DNA, 25 bp, Rattus norvegicus
aaaactggctctactctctaagata

SEQ ID NO: 1590 - DNA, 25 bp, Rattus norvegicus
aaaactggctcttctctctaagata

SEQ ID NO: 1591 - DNA, 25 bp, Rattus norvegicus
aaaactggcttccaggctgtcacag

SEQ ID NO: 1592 - DNA, 25 bp, Rattus norvegicus
aaaactggcttcgaggctgtcacag

SEQ ID NO: 1593 - DNA, 25 bp, Rattus norvegicus
aaaactgggcttcgatctcgggcac

SEQ ID NO: 1594 - DNA, 25 bp, Rattus norvegicus
aaaactgggcttggatctcgggcac

SEQ ID NO: 1595 - DNA, 25 bp, Rattus norvegicus
aaaactgggtccatattgccctgat

SEQ ID NO: 1596 - DNA, 25 bp, Rattus norvegicus
aaaactgggtccttattgccctgat

SEQ ID NO: 1597 - DNA, 25 bp, Rattus norvegicus
aaaactggtcagagcgcttacctag

SEQ ID NO: 1598 - DNA, 25 bp, Rattus norvegicus
aaaactggtcagtgcgcttacctag

SEQ ID NO: 1599 - DNA, 25 bp, Rattus norvegicus
aaaactgtacccagctgcactggtg

SEQ ID NO: 1600 - DNA, 25 bp, Rattus norvegicus
aaaactgtaccctgctgcactggtg

SEQ ID NO: 1601 - DNA, 25 bp, Rattus norvegicus
aaaactgtacgaactgaatgcctga

SEQ ID NO: 1602 - DNA, 25 bp, Rattus norvegicus
aaaactgtacgatctgaatgcctga

SEQ ID NO: 1603 - DNA, 25 bp, Rattus norvegicus
aaaactgtactgagttatccaagaa

SEQ ID NO: 1604 - DNA, 25 bp, Rattus norvegicus
aaaactgtactgctcccctatgtgc

SEQ ID NO: 1605 - DNA, 25 bp, Rattus norvegicus
aaaactgtactggtcccctatgtgc

SEQ ID NO: 1606 - DNA, 25 bp, Rattus norvegicus
aaaactgtactgtgttatccaagaa

SEQ ID NO: 1607 - DNA, 25 bp, Rattus norvegicus
aaaactgtatgaacttggccgtgct

SEQ ID NO: 1608 - DNA, 25 bp, Rattus norvegicus
aaaactgtatgatcttggccgtgct

SEQ ID NO: 1609 - DNA, 25 bp, Rattus norvegicus
aaaactgtcagaagcttcaaagtag

SEQ ID NO: 1610 - DNA, 25 bp, Rattus norvegicus
aaaactgtcagaatttgcttactat

SEQ ID NO: 1611 - DNA, 25 bp, Rattus norvegicus
aaaactgtcagacgctctgctccaa

SEQ ID NO: 1612 - DNA, 25 bp, Rattus norvegicus
aaaactgtcagaggctctgctccaa

SEQ ID NO: 1613 - DNA, 25 bp, Rattus norvegicus
aaaactgtcagatgcttcaaagtag

SEQ ID NO: 1614 - DNA, 25 bp, Rattus norvegicus
aaaactgtcagattttgcttactat

SEQ ID NO: 1615 - DNA, 25 bp, Rattus norvegicus
aaaactgtcagcatttgggtaatct

SEQ ID NO: 1616 - DNA, 25 bp, Rattus norvegicus
aaaactgtcagcttttgggtaatct

SEQ ID NO: 1617 - DNA, 25 bp, Rattus norvegicus
aaaactgtcctgatgatcacagctt

SEQ ID NO: 1618 - DNA, 25 bp, Rattus norvegicus
aaaactgtcctgttgatcacagctt

SEQ ID NO: 1619 - DNA, 25 bp, Rattus norvegicus
aaaactgtccttcccggtgcaggag

SEQ ID NO: 1620 - DNA, 25 bp, Rattus norvegicus
aaaactgtccttgccggtgcaggag

SEQ ID NO: 1621 - DNA, 25 bp, Rattus norvegicus
aaaactgtcgcaatgtgggcttgga

SEQ ID NO: 1622 - DNA, 25 bp, Rattus norvegicus
aaaactgtcgcattgtgggcttgga

SEQ ID NO: 1623 - DNA, 25 bp, Rattus norvegicus
aaaactgtcttacctttggtgaact

SEQ ID NO: 1624 - DNA, 25 bp, Rattus norvegicus
aaaactgtcttagctttggtgaact

SEQ ID NO: 1625 - DNA, 25 bp, Rattus norvegicus
aaaactgtgactccagtgatcccac

SEQ ID NO: 1626 - DNA, 25 bp, Rattus norvegicus
aaaactgtgactgcagtgatcccac

SEQ ID NO: 1627 - DNA, 25 bp, Rattus norvegicus
aaaactgtgaggaatgccccgggct

SEQ ID NO: 1628 - DNA, 25 bp, Rattus norvegicus
aaaactgtgaggtatgccccgggct

SEQ ID NO: 1629 - DNA, 25 bp, Rattus norvegicus
aaaactgtgcacactcttaagcttt

SEQ ID NO: 1630 - DNA, 25 bp, Rattus norvegicus
aaaactgtgcactctcttaagcttt

SEQ ID NO: 1631 - DNA, 25 bp, Rattus norvegicus
aaaactgtgcagctgtctgatgtat

SEQ ID NO: 1632 - DNA, 25 bp, Rattus norvegicus
aaaactgtgcaggtgtctgatgtat

SEQ ID NO: 1633 - DNA, 25 bp, Rattus norvegicus
aaaactgtgcctaggtctaacttca

SEQ ID NO: 1634 - DNA, 25 bp, Rattus norvegicus
aaaactgtgccttggtctaacttca

SEQ ID NO: 1635 - DNA, 25 bp, Rattus norvegicus
aaaactgtgctgagactgtgcggta

SEQ ID NO: 1636 - DNA, 25 bp, Rattus norvegicus
aaaactgtgctgtgactgtgcggta

SEQ ID NO: 1637 - DNA, 25 bp, Rattus norvegicus
aaaactgtggaacctgggcagccaa

SEQ ID NO: 1638 - DNA, 25 bp, Rattus norvegicus
aaaactgtggaagctgggcagccaa

SEQ ID NO: 1639 - DNA, 25 bp, Rattus norvegicus
aaaactgtggagaccgtggatgcat

SEQ ID NO: 1640 - DNA, 25 bp, Rattus norvegicus
aaaactgtggagtccgtggatgcat

SEQ ID NO: 1641 - DNA, 25 bp, Rattus norvegicus
aaaactgtggtcaccttttgagtcg

SEQ ID NO: 1642 - DNA, 25 bp, Rattus norvegicus
aaaactgtggtctccttttgagtcg

SEQ ID NO: 1643 - DNA, 25 bp, Rattus norvegicus
aaaactgtgttcctgctttctgaga

SEQ ID NO: 1644 - DNA, 25 bp, Rattus norvegicus
aaaactgtgttcgtgctttctgaga

SEQ ID NO: 1645 - DNA, 25 bp, Rattus norvegicus
aaaactgttacaacagcacgcctca

SEQ ID NO: 1646 - DNA, 25 bp, Rattus norvegicus
aaaactgttacatcagcacgcctca

SEQ ID NO: 1647 - DNA, 25 bp, Rattus norvegicus
aaaactgttccaatcatatttacct

SEQ ID NO: 1648 - DNA, 25 bp, Rattus norvegicus
aaaactgttccattcatatttacct

SEQ ID NO: 1649 - DNA, 25 bp, Rattus norvegicus
aaaactgttgctctttgcctctaac

SEQ ID NO: 1650 - DNA, 25 bp, Rattus norvegicus
aaaactgttgctgtttgcctctaac

SEQ ID NO: 1651 - DNA, 25 bp, Rattus norvegicus
aaaactgttgtgacacctgaggaat

SEQ ID NO: 1652 - DNA, 25 bp, Rattus norvegicus
aaaactgttgtgtcacctgaggaat

SEQ ID NO: 1653 - DNA, 25 bp, Rattus norvegicus
aaaactgttgttagatactccgtag

SEQ ID NO: 1654 - DNA, 25 bp, Rattus norvegicus
aaaactgttgtttgatactccgtag

SEQ ID NO: 1655 - DNA, 25 bp, Rattus norvegicus
aaaacttacgccaatgaatgcattc

SEQ ID NO: 1656 - DNA, 25 bp, Rattus norvegicus
aaaacttacgcctatgaatgcattc

SEQ ID NO: 1657 - DNA, 25 bp, Rattus norvegicus
aaaacttagactactgcaccatcac

SEQ ID NO: 1658 - DNA, 25 bp, Rattus norvegicus
aaaacttagacttctgcaccatcac

SEQ ID NO: 1659 - DNA, 25 bp, Rattus norvegicus
aaaacttagttgatcttgaaccact

SEQ ID NO: 1660 - DNA, 25 bp, Rattus norvegicus
aaaacttagttgttcttgaaccact

SEQ ID NO: 1661 - DNA, 25 bp, Rattus norvegicus
aaaacttattccacatgatctttaa

SEQ ID NO: 1662 - DNA, 25 bp, Rattus norvegicus
aaaacttattcctcatgatctttaa

SEQ ID NO: 1663 - DNA, 25 bp, Rattus norvegicus
aaaacttcaactagtgtgccctggc

SEQ ID NO: 1664 - DNA, 25 bp, Rattus norvegicus
aaaacttcaacttgtgtgccctggc

SEQ ID NO: 1665 - DNA, 25 bp, Rattus norvegicus
aaaacttcagagacttgtcctgcct

SEQ ID NO: 1666 - DNA, 25 bp, Rattus norvegicus
aaaacttcagagtcttgtcctgcct

SEQ ID NO: 1667 - DNA, 25 bp, Rattus norvegicus
aaaacttcagcacccctggagtgag

SEQ ID NO: 1668 - DNA, 25 bp, Rattus norvegicus
aaaacttcagcacgagctcagccct

SEQ ID NO: 1669 - DNA, 25 bp, Rattus norvegicus
aaaacttcagcagccctggagtgag

SEQ ID NO: 1670 - DNA, 25 bp, Rattus norvegicus
aaaacttcagcaggagctcagccct

SEQ ID NO: 1671 - DNA, 25 bp, Rattus norvegicus
aaaacttcagcccaggaaccactgg

SEQ ID NO: 1672 - DNA, 25 bp, Rattus norvegicus
aaaacttcagccgaggaaccactgg

SEQ ID NO: 1673 - DNA, 25 bp, Rattus norvegicus
aaaacttcagtgcacacaccagtgg

SEQ ID NO: 1674 - DNA, 25 bp, Rattus norvegicus
aaaacttcagtggacacaccagtgg

SEQ ID NO: 1675 - DNA, 25 bp, Rattus norvegicus
aaaacttcatgtccccattttcatt

SEQ ID NO: 1676 - DNA, 25 bp, Rattus norvegicus
aaaacttcatgtgcccattttcatt

SEQ ID NO: 1677 - DNA, 25 bp, Rattus norvegicus
aaaacttcatttacacatcccttgt

SEQ ID NO: 1678 - DNA, 25 bp, Rattus norvegicus
aaaacttcattttcacatcccttgt

SEQ ID NO: 1679 - DNA, 25 bp, Rattus norvegicus
aaaacttcccaactgcagaggccct

SEQ ID NO: 1680 - DNA, 25 bp, Rattus norvegicus
aaaacttcccaagtgcagaggccct

SEQ ID NO: 1681 - DNA, 25 bp, Rattus norvegicus
aaaacttcccagagggctgtaccag

SEQ ID NO: 1682 - DNA, 25 bp, Rattus norvegicus
aaaacttcccagtgggctgtaccag

SEQ ID NO: 1683 - DNA, 25 bp, Rattus norvegicus
aaaacttcgggcacctctggctttg

SEQ ID NO: 1684 - DNA, 25 bp, Rattus norvegicus
aaaacttcgggctcctctggctttg

SEQ ID NO: 1685 - DNA, 25 bp, Rattus norvegicus
aaaacttctgtcacagtgacccctg

SEQ ID NO: 1686 - DNA, 25 bp, Rattus norvegicus
aaaacttctgtctcagtgacccctg

SEQ ID NO: 1687 - DNA, 25 bp, Rattus norvegicus
aaaacttcttcaactttccaatatg

SEQ ID NO: 1688 - DNA, 25 bp, Rattus norvegicus
aaaacttcttcatctttccaatatg

SEQ ID NO: 1689 - DNA, 25 bp, Rattus norvegicus
aaaacttcttctagatggcaggcat

SEQ ID NO: 1690 - DNA, 25 bp, Rattus norvegicus
aaaacttcttcttgatggcaggcat

SEQ ID NO: 1691 - DNA, 25 bp, Rattus norvegicus
aaaacttcttgacagcttgcatgat

SEQ ID NO: 1692 - DNA, 25 bp, Rattus norvegicus
aaaacttcttgagagcttgcatgat

SEQ ID NO: 1693 - DNA, 25 bp, Rattus norvegicus
aaaacttgaggacagcactttcgga

SEQ ID NO: 1694 - DNA, 25 bp, Rattus norvegicus
aaaacttgaggagagcactttcgga

SEQ ID NO: 1695 - DNA, 25 bp, Rattus norvegicus
aaaacttgctgaaccccatactgtg

SEQ ID NO: 1696 - DNA, 25 bp, Rattus norvegicus
aaaacttgctgatccccatactgtg

SEQ ID NO: 1697 - DNA, 25 bp, Rattus norvegicus
aaaacttgggtaatcttcaacagat

SEQ ID NO: 1698 - DNA, 25 bp, Rattus norvegicus
aaaacttgggtattcttcaacagat

SEQ ID NO: 1699 - DNA, 25 bp, Rattus norvegicus
aaaacttgggttccagctctagctg

SEQ ID NO: 1700 - DNA, 25 bp, Rattus norvegicus
aaaacttgggttgcagctctagctg

SEQ ID NO: 1701 - DNA, 25 bp, Rattus norvegicus
aaaacttggtgcacctatctctgtg

SEQ ID NO: 1702 - DNA, 25 bp, Rattus norvegicus
aaaacttggtgctcctatctctgtg

SEQ ID NO: 1703 - DNA, 25 bp, Rattus norvegicus
aaaacttgtccccaaagcacagtcg

SEQ ID NO: 1704 - DNA, 25 bp, Rattus norvegicus
aaaacttgtcccgaaagcacagtcg

SEQ ID NO: 1705 - DNA, 25 bp, Rattus norvegicus
aaaacttgtgctctacattcaggga

SEQ ID NO: 1706 - DNA, 25 bp, Rattus norvegicus
aaaacttgtgctgtacattcaggga

SEQ ID NO: 1707 - DNA, 25 bp, Rattus norvegicus
aaaactttagtcaacatccgtgtat

SEQ ID NO: 1708 - DNA, 25 bp, Rattus norvegicus
aaaactttagtctacatccgtgtat

SEQ ID NO: 1709 - DNA, 25 bp, Rattus norvegicus
aaaactttatgcacagtgtccctat

SEQ ID NO: 1710 - DNA, 25 bp, Rattus norvegicus
aaaactttatgctcagtgtccctat

SEQ ID NO: 1711 - DNA, 25 bp, Rattus norvegicus
aaaactttccaaccttatctgccac

SEQ ID NO: 1712 - DNA, 25 bp, Rattus norvegicus
aaaactttccaagcttatctgccac

SEQ ID NO: 1713 - DNA, 25 bp, Rattus norvegicus
aaaactttcgttctctgtcttctgt

SEQ ID NO: 1714 - DNA, 25 bp, Rattus norvegicus
aaaactttcgttgtctgtcttctgt

SEQ ID NO: 1715 - DNA, 25 bp, Rattus norvegicus
aaaactttctctcgtctctgttgtg

SEQ ID NO: 1716 - DNA, 25 bp, Rattus norvegicus
aaaactttctctggtctctgttgtg

SEQ ID NO: 1717 - DNA, 25 bp, Rattus norvegicus
aaaactttgaggctgcctctcgtgc

SEQ ID NO: 1718 - DNA, 25 bp, Rattus norvegicus
aaaactttgagggtgcctctcgtgc

SEQ ID NO: 1719 - DNA, 25 bp, Rattus norvegicus
aaaactttgcccaggccagaccatg

SEQ ID NO: 1720 - DNA, 25 bp, Rattus norvegicus
aaaactttgccctggccagaccatg

SEQ ID NO: 1721 - DNA, 25 bp, Rattus norvegicus
aaaactttgggtagtgccaggcaag

SEQ ID NO: 1722 - DNA, 25 bp, Rattus norvegicus
aaaactttgggttgtgccaggcaag

SEQ ID NO: 1723 - DNA, 25 bp, Rattus norvegicus
aaaacttttcatccgagttgcctct

SEQ ID NO: 1724 - DNA, 25 bp, Rattus norvegicus
aaaacttttcatgcgagttgcctct

SEQ ID NO: 1725 - DNA, 25 bp, Rattus norvegicus
aaaacttttccaccgtgttctctgc

SEQ ID NO: 1726 - DNA, 25 bp, Rattus norvegicus
aaaacttttccagcgtgttctctgc

SEQ ID NO: 1727 - DNA, 25 bp, Rattus norvegicus
aaaacttttcttctactgaagatga

SEQ ID NO: 1728 - DNA, 25 bp, Rattus norvegicus
aaaacttttcttctgccatcaataa

SEQ ID NO: 1729 - DNA, 25 bp, Rattus norvegicus
aaaacttttcttgtactgaagatga

SEQ ID NO: 1730 - DNA, 25 bp, Rattus norvegicus
aaaacttttcttgtgccatcaataa

SEQ ID NO: 1731 - DNA, 25 bp, Rattus norvegicus
aaaacttttggcattttgtcctcat

SEQ ID NO: 1732 - DNA, 25 bp, Rattus norvegicus
aaaacttttggctttttgtcctcat

SEQ ID NO: 1733 - DNA, 25 bp, Rattus norvegicus
aaaagaaacctcagcaatctctccc

SEQ ID NO: 1734 - DNA, 25 bp, Rattus norvegicus
aaaagaaacctctgcaatctctccc

SEQ ID NO: 1735 - DNA, 25 bp, Rattus norvegicus
aaaagaaagctgcacgcggaccccg

SEQ ID NO: 1736 - DNA, 25 bp, Rattus norvegicus
aaaagaaagctggacgcggaccccg

SEQ ID NO: 1737 - DNA, 25 bp, Rattus norvegicus
aaaagaaaggctcccacggctgctg

SEQ ID NO: 1738 - DNA, 25 bp, Rattus norvegicus
aaaagaaaggctgccacggctgctg

SEQ ID NO: 1739 - DNA, 25 bp, Rattus norvegicus
aaaagaaaggtgaccctggcagatg

SEQ ID NO: 1740 - DNA, 25 bp, Rattus norvegicus
aaaagaaaggtgtccctggcagatg

SEQ ID NO: 1741 - DNA, 25 bp, Rattus norvegicus
aaaagaaatcttcacccacctggca

SEQ ID NO: 1742 - DNA, 25 bp, Rattus norvegicus
aaaagaaatcttgacccacctggca

SEQ ID NO: 1743 - DNA, 25 bp, Rattus norvegicus
aaaagaacaagccaagccctgccct

SEQ ID NO: 1744 - DNA, 25 bp, Rattus norvegicus
aaaagaacaagcgaagccctgccct

SEQ ID NO: 1745 - DNA, 25 bp, Rattus norvegicus
aaaagaacagcacccggccagcagt

SEQ ID NO: 1746 - DNA, 25 bp, Rattus norvegicus
aaaagaacagcagccggccagcagt

SEQ ID NO: 1747 - DNA, 25 bp, Rattus norvegicus
aaaagaacccatctcgggctggaga

SEQ ID NO: 1748 - DNA, 25 bp, Rattus norvegicus
aaaagaacccatgtcgggctggaga

SEQ ID NO: 1749 - DNA, 25 bp, Rattus norvegicus
aaaagaacggcactctctgcacgat

SEQ ID NO: 1750 - DNA, 25 bp, Rattus norvegicus
aaaagaacggcagtctctgcacgat

SEQ ID NO: 1751 - DNA, 25 bp, Rattus norvegicus
aaaagaactggcagggagaacgtgt

SEQ ID NO: 1752 - DNA, 25 bp, Rattus norvegicus
aaaagaactggctgggagaacgtgt

SEQ ID NO: 1753 - DNA, 25 bp, Rattus norvegicus
aaaagaactgtcctgtgatcccaag

SEQ ID NO: 1754 - DNA, 25 bp, Rattus norvegicus
aaaagaactgtcgtgtgatcccaag

SEQ ID NO: 1755 - DNA, 25 bp, Rattus norvegicus
aaaagaacttctcaggtagccgacg

SEQ ID NO: 1756 - DNA, 25 bp, Rattus norvegicus
aaaagaacttctccgtcagtcacct

SEQ ID NO: 1757 - DNA, 25 bp, Rattus norvegicus
aaaagaacttctgaggtagccgacg

SEQ ID NO: 1758 - DNA, 25 bp, Rattus norvegicus
aaaagaacttctgcgtcagtcacct

SEQ ID NO: 1759 - DNA, 25 bp, Rattus norvegicus
aaaagaagactcagccacttgctac

SEQ ID NO: 1760 - DNA, 25 bp, Rattus norvegicus
aaaagaagactctgccacttgctac

SEQ ID NO: 1761 - DNA, 25 bp, Rattus norvegicus
aaaagaagcaccatgggtcccatgc

SEQ ID NO: 1762 - DNA, 25 bp, Rattus norvegicus
aaaagaagcaccttgggtcccatgc

SEQ ID NO: 1763 - DNA, 25 bp, Rattus norvegicus
aaaagaagccgcactgtttcccagg

SEQ ID NO: 1764 - DNA, 25 bp, Rattus norvegicus
aaaagaagccgctctgtttcccagg

SEQ ID NO: 1765 - DNA, 25 bp, Rattus norvegicus
aaaagaagcctcagcaatctctccc

SEQ ID NO: 1766 - DNA, 25 bp, Rattus norvegicus
aaaagaagcctctgcaatctctccc

SEQ ID NO: 1767 - DNA, 25 bp, Rattus norvegicus
aaaagaagcgacaggctgcactggc

SEQ ID NO: 1768 - DNA, 25 bp, Rattus norvegicus
aaaagaagcgactggctgcactggc

SEQ ID NO: 1769 - DNA, 25 bp, Rattus norvegicus
aaaagaagcgcccatgttttcctca

SEQ ID NO: 1770 - DNA, 25 bp, Rattus norvegicus
aaaagaagcgccgatgttttcctca

SEQ ID NO: 1771 - DNA, 25 bp, Rattus norvegicus
aaaagaagcgtcctggatccaccag

SEQ ID NO: 1772 - DNA, 25 bp, Rattus norvegicus
aaaagaagcgtcgtggatccaccag

SEQ ID NO: 1773 - DNA, 25 bp, Rattus norvegicus
aaaagaagtatgaagccctggccaa

SEQ ID NO: 1774 - DNA, 25 bp, Rattus norvegicus
aaaagaagtatgtagccctggccaa

SEQ ID NO: 1775 - DNA, 25 bp, Rattus norvegicus
aaaagaagtcatctgcctttggcag

SEQ ID NO: 1776 - DNA, 25 bp, Rattus norvegicus
aaaagaagtcatgtgcctttggcag

SEQ ID NO: 1777 - DNA, 25 bp, Rattus norvegicus
aaaagaagtcttccccagatccctg

SEQ ID NO: 1778 - DNA, 25 bp, Rattus norvegicus
aaaagaagtcttgcccagatccctg

SEQ ID NO: 1779 - DNA, 25 bp, Rattus norvegicus
aaaagaagttcccatcaatcgcagg

SEQ ID NO: 1780 - DNA, 25 bp, Rattus norvegicus
aaaagaagttccgatcaatcgcagg

SEQ ID NO: 1781 - DNA, 25 bp, Rattus norvegicus
aaaagaatcagcatcctacagaccc

SEQ ID NO: 1782 - DNA, 25 bp, Rattus norvegicus
aaaagaatcagcttcctacagaccc

SEQ ID NO: 1783 - DNA, 25 bp, Rattus norvegicus
aaaagaatcattctcagtggccaag

SEQ ID NO: 1784 - DNA, 25 bp, Rattus norvegicus
aaaagaatcattgtcagtggccaag

SEQ ID NO: 1785 - DNA, 25 bp, Rattus norvegicus
aaaagaatcggaagcccagcgggct

SEQ ID NO: 1786 - DNA, 25 bp, Rattus norvegicus
aaaagaatcggatgcccagcgggct

SEQ ID NO: 1787 - DNA, 25 bp, Rattus norvegicus
aaaagaatcggtacgcagggagctt

SEQ ID NO: 1788 - DNA, 25 bp, Rattus norvegicus
aaaagaatcggttcgcagggagctt

SEQ ID NO: 1789 - DNA, 25 bp, Rattus norvegicus
aaaagaatctgcagctgggcgtggc

SEQ ID NO: 1790 - DNA, 25 bp, Rattus norvegicus
aaaagaatctgctgctgggcgtggc

SEQ ID NO: 1791 - DNA, 25 bp, Rattus norvegicus
aaaagacacaatccctgcgagagcc

SEQ ID NO: 1792 - DNA, 25 bp, Rattus norvegicus
aaaagacacaatgcctgcgagagcc

SEQ ID NO: 1793 - DNA, 25 bp, Rattus norvegicus
aaaagacacactaagttcagaactt

SEQ ID NO: 1794 - DNA, 25 bp, Rattus norvegicus
aaaagacacacttagttcagaactt

SEQ ID NO: 1795 - DNA, 25 bp, Rattus norvegicus
aaaagacacatcagagaccacaaaa

SEQ ID NO: 1796 - DNA, 25 bp, Rattus norvegicus
aaaagacacatctgagaccacaaaa

SEQ ID NO: 1797 - DNA, 25 bp, Rattus norvegicus
aaaagacactgacccaggcaactga

SEQ ID NO: 1798 - DNA, 25 bp, Rattus norvegicus
aaaagacactgagccaggcaactga

SEQ ID NO: 1799 - DNA, 25 bp, Rattus norvegicus
aaaagacacttgagcgggtgactca

SEQ ID NO: 1800 - DNA, 25 bp, Rattus norvegicus
aaaagacacttgtgcgggtgactca

SEQ ID NO: 1801 - DNA, 25 bp, Rattus norvegicus
aaaagacagtcactcccatcactgg

SEQ ID NO: 1802 - DNA, 25 bp, Rattus norvegicus
aaaagacagtcagtcccatcactgg

SEQ ID NO: 1803 - DNA, 25 bp, Rattus norvegicus
aaaagacagtgtctcatccctgcac

SEQ ID NO: 1804 - DNA, 25 bp, Rattus norvegicus
aaaagacagtgtgtcatccctgcac

SEQ ID NO: 1805 - DNA, 25 bp, Rattus norvegicus
aaaagacatcttcaaagcccttggg

SEQ ID NO: 1806 - DNA, 25 bp, Rattus norvegicus
aaaagacatcttgaaagcccttggg

SEQ ID NO: 1807 - DNA, 25 bp, Rattus norvegicus
aaaagaccagctccttcctgtttgt

SEQ ID NO: 1808 - DNA, 25 bp, Rattus norvegicus
aaaagaccagctgcttcctgtttgt

SEQ ID NO: 1809 - DNA, 25 bp, Rattus norvegicus
aaaagaccggttcagatattttctg

SEQ ID NO: 1810 - DNA, 25 bp, Rattus norvegicus
aaaagaccggttgagatattttctg

SEQ ID NO: 1811 - DNA, 25 bp, Rattus norvegicus
aaaagacctcatacactagttgtat

SEQ ID NO: 1812 - DNA, 25 bp, Rattus norvegicus
aaaagacctcattcactagttgtat

SEQ ID NO: 1813 - DNA, 25 bp, Rattus norvegicus
aaaagacctgatctccaagcccact

SEQ ID NO: 1814 - DNA, 25 bp, Rattus norvegicus
aaaagacctgatgtccaagcccact

SEQ ID NO: 1815 - DNA, 25 bp, Rattus norvegicus
aaaagacctggtcgacatgccaaca

SEQ ID NO: 1816 - DNA, 25 bp, Rattus norvegicus
aaaagacctggtggacatgccaaca

SEQ ID NO: 1817 - DNA, 25 bp, Rattus norvegicus
aaaagaccttcacccagtgtctcag

SEQ ID NO: 1818 - DNA, 25 bp, Rattus norvegicus
aaaagaccttcagccagtgtctcag

SEQ ID NO: 1819 - DNA, 25 bp, Rattus norvegicus
aaaagacgaaacagccagcccagcg

SEQ ID NO: 1820 - DNA, 25 bp, Rattus norvegicus
aaaagacgaaactgccagcccagcg

SEQ ID NO: 1821 - DNA, 25 bp, Rattus norvegicus
aaaagacgatggctctgctgtcctt

SEQ ID NO: 1822 - DNA, 25 bp, Rattus norvegicus
aaaagacgatgggtctgctgtcctt

SEQ ID NO: 1823 - DNA, 25 bp, Rattus norvegicus
aaaagacggctcagtggttaaggca

SEQ ID NO: 1824 - DNA, 25 bp, Rattus norvegicus
aaaagacggctctgtggttaaggca

SEQ ID NO: 1825 - DNA, 25 bp, Rattus norvegicus
aaaagactaaccagagctatatctg

SEQ ID NO: 1826 - DNA, 25 bp, Rattus norvegicus
aaaagactaacctgagctatatctg

SEQ ID NO: 1827 - DNA, 25 bp, Rattus norvegicus
aaaagactacacagtgacccaggtg

SEQ ID NO: 1828 - DNA, 25 bp, Rattus norvegicus
aaaagactacactgtgacccaggtg

SEQ ID NO: 1829 - DNA, 25 bp, Rattus norvegicus
aaaagactcatcattcctggatccg

SEQ ID NO: 1830 - DNA, 25 bp, Rattus norvegicus
aaaagactcatctttcctggatccg

SEQ ID NO: 1831 - DNA, 25 bp, Rattus norvegicus
aaaagactcgcactgactgttacct

SEQ ID NO: 1832 - DNA, 25 bp, Rattus norvegicus
aaaagactcgcagtgactgttacct

SEQ ID NO: 1833 - DNA, 25 bp, Rattus norvegicus
aaaagactctttattctcattctgt

SEQ ID NO: 1834 - DNA, 25 bp, Rattus norvegicus
aaaagactcttttttctcattctgt

SEQ ID NO: 1835 - DNA, 25 bp, Rattus norvegicus
aaaagactgaggctcccgccgccgg

SEQ ID NO: 1836 - DNA, 25 bp, Rattus norvegicus
aaaagactgagggtcccgccgccgg

SEQ ID NO: 1837 - DNA, 25 bp, Rattus norvegicus
aaaagactgcttcccaggtgaatca

SEQ ID NO: 1838 - DNA, 25 bp, Rattus norvegicus
aaaagactgcttctgggtgcggcct

SEQ ID NO: 1839 - DNA, 25 bp, Rattus norvegicus
aaaagactgcttgccaggtgaatca

SEQ ID NO: 1840 - DNA, 25 bp, Rattus norvegicus
aaaagactgcttgtgggtgcggcct

SEQ ID NO: 1841 - DNA, 25 bp, Rattus norvegicus
aaaagactgtcaacaatccccttga

SEQ ID NO: 1842 - DNA, 25 bp, Rattus norvegicus
aaaagactgtcatcaatccccttga

SEQ ID NO: 1843 - DNA, 25 bp, Rattus norvegicus
aaaagactgtctagcttgctctcat

SEQ ID NO: 1844 - DNA, 25 bp, Rattus norvegicus
aaaagactgtcttgcttgctctcat

SEQ ID NO: 1845 - DNA, 25 bp, Rattus norvegicus
aaaagactgtttcgcctgctctgtt

SEQ ID NO: 1846 - DNA, 25 bp, Rattus norvegicus
aaaagactgtttggcctgctctgtt

SEQ ID NO: 1847 - DNA, 25 bp, Rattus norvegicus
aaaagacttaaaccggcaggcctca

SEQ ID NO: 1848 - DNA, 25 bp, Rattus norvegicus
aaaagacttaaagcggcaggcctca

SEQ ID NO: 1849 - DNA, 25 bp, Rattus norvegicus
aaaagactttataggatttcattca

SEQ ID NO: 1850 - DNA, 25 bp, Rattus norvegicus
aaaagactttattggatttcattca

SEQ ID NO: 1851 - DNA, 25 bp, Rattus norvegicus
aaaagactttctccagggcactcag

SEQ ID NO: 1852 - DNA, 25 bp, Rattus norvegicus
aaaagactttctgcagggcactcag

SEQ ID NO: 1853 - DNA, 25 bp, Rattus norvegicus
aaaagactttttcagccacgatagt

SEQ ID NO: 1854 - DNA, 25 bp, Rattus norvegicus
aaaagactttttgagccacgatagt

SEQ ID NO: 1855 - DNA, 25 bp, Rattus norvegicus
aaaagagaaagacccgctatagagt

SEQ ID NO: 1856 - DNA, 25 bp, Rattus norvegicus
aaaagagaaagagccgctatagagt

SEQ ID NO: 1857 - DNA, 25 bp, Rattus norvegicus
aaaagagaacacagtgccccaggaa

SEQ ID NO: 1858 - DNA, 25 bp, Rattus norvegicus
aaaagagaacactgtgccccaggaa

SEQ ID NO: 1859 - DNA, 25 bp, Rattus norvegicus
aaaagagaagccaagcccctagtct

SEQ ID NO: 1860 - DNA, 25 bp, Rattus norvegicus
aaaagagaagcctagcccctagtct

SEQ ID NO: 1861 - DNA, 25 bp, Rattus norvegicus
aaaagagactccagggtgctggaag

SEQ ID NO: 1862 - DNA, 25 bp, Rattus norvegicus
aaaagagactcctgggtgctggaag

SEQ ID NO: 1863 - DNA, 25 bp, Rattus norvegicus
aaaagagacttcaccgtcgaactct

SEQ ID NO: 1864 - DNA, 25 bp, Rattus norvegicus
aaaagagacttctccgtcgaactct

SEQ ID NO: 1865 - DNA, 25 bp, Rattus norvegicus
aaaagagagactctccttccgctac

SEQ ID NO: 1866 - DNA, 25 bp, Rattus norvegicus
aaaagagagactgtccttccgctac

SEQ ID NO: 1867 - DNA, 25 bp, Rattus norvegicus
aaaagagaggcgctgtccttgccgt

SEQ ID NO: 1868 - DNA, 25 bp, Rattus norvegicus
aaaagagaggcggtgtccttgccgt

SEQ ID NO: 1869 - DNA, 25 bp, Rattus norvegicus
aaaagagatgaactggccagccagc

SEQ ID NO: 1870 - DNA, 25 bp, Rattus norvegicus
aaaagagatgaagtggccagccagc

SEQ ID NO: 1871 - DNA, 25 bp, Rattus norvegicus
aaaagagatggcagtgtgtggctca

SEQ ID NO: 1872 - DNA, 25 bp, Rattus norvegicus
aaaagagatggctgtgtgtggctca

SEQ ID NO: 1873 - DNA, 25 bp, Rattus norvegicus
aaaagagcaggcctcagaccgcgcc

SEQ ID NO: 1874 - DNA, 25 bp, Rattus norvegicus
aaaagagcaggcgtcagaccgcgcc

SEQ ID NO: 1875 - DNA, 25 bp, Rattus norvegicus
aaaagagcatttaccaccgagaaat

SEQ ID NO: 1876 - DNA, 25 bp, Rattus norvegicus
aaaagagcattttccaccgagaaat

SEQ ID NO: 1877 - DNA, 25 bp, Rattus norvegicus
aaaagagccacaacatgattgccct

SEQ ID NO: 1878 - DNA, 25 bp, Rattus norvegicus
aaaagagccacatcatgattgccct

SEQ ID NO: 1879 - DNA, 25 bp, Rattus norvegicus
aaaagagccatgcacgtcctcacgt

SEQ ID NO: 1880 - DNA, 25 bp, Rattus norvegicus
aaaagagccatggacgtcctcacgt

SEQ ID NO: 1881 - DNA, 25 bp, Rattus norvegicus
aaaagagcctacagctggaggcacc

SEQ ID NO: 1882 - DNA, 25 bp, Rattus norvegicus
aaaagagcctactgctggaggcacc

SEQ ID NO: 1883 - DNA, 25 bp, Rattus norvegicus
aaaagagctctaaaggtcctacgtc

SEQ ID NO: 1884 - DNA, 25 bp, Rattus norvegicus
aaaagagctctataggtcctacgtc

SEQ ID NO: 1885 - DNA, 25 bp, Rattus norvegicus
aaaagagctgctcactgcagccctc

SEQ ID NO: 1886 - DNA, 25 bp, Rattus norvegicus
aaaagagctgctgactgcagccctc

SEQ ID NO: 1887 - DNA, 25 bp, Rattus norvegicus
aaaagagctgttcacttccaggaag

SEQ ID NO: 1888 - DNA, 25 bp, Rattus norvegicus
aaaagagctgttgacttccaggaag

SEQ ID NO: 1889 - DNA, 25 bp, Rattus norvegicus
aaaagaggaagaacgctccctccca

SEQ ID NO: 1890 - DNA, 25 bp, Rattus norvegicus
aaaagaggaagatcgctccctccca

SEQ ID NO: 1891 - DNA, 25 bp, Rattus norvegicus
aaaagaggagtcacgacttggcagt

SEQ ID NO: 1892 - DNA, 25 bp, Rattus norvegicus
aaaagaggagtctcgacttggcagt

SEQ ID NO: 1893 - DNA, 25 bp, Rattus norvegicus
aaaagaggcgccagtgtgcatacac

SEQ ID NO: 1894 - DNA, 25 bp, Rattus norvegicus
aaaagaggcgcctgtgtgcatacac

SEQ ID NO: 1895 - DNA, 25 bp, Rattus norvegicus
aaaagaggcgcgctcagtctccatc

SEQ ID NO: 1896 - DNA, 25 bp, Rattus norvegicus
aaaagaggcgcggtcagtctccatc

SEQ ID NO: 1897 - DNA, 25 bp, Rattus norvegicus
aaaagagggagcatcaactggagtt

SEQ ID NO: 1898 - DNA, 25 bp, Rattus norvegicus
aaaagagggagcttcaactggagtt

SEQ ID NO: 1899 - DNA, 25 bp, Rattus norvegicus
aaaagaggtggaactctccgctcct

SEQ ID NO: 1900 - DNA, 25 bp, Rattus norvegicus
aaaagaggtggatctctccgctcct

SEQ ID NO: 1901 - DNA, 25 bp, Rattus norvegicus
aaaagagtactgcaccttctctctg

SEQ ID NO: 1902 - DNA, 25 bp, Rattus norvegicus
aaaagagtactggaccttctctctg

SEQ ID NO: 1903 - DNA, 25 bp, Rattus norvegicus
aaaagagtcaccactgttgttcctg

SEQ ID NO: 1904 - DNA, 25 bp, Rattus norvegicus
aaaagagtcacctctgttgttcctg

SEQ ID NO: 1905 - DNA, 25 bp, Rattus norvegicus
aaaagagtcggtccatccccgagat

SEQ ID NO: 1906 - DNA, 25 bp, Rattus norvegicus
aaaagagtcggtgcatccccgagat

SEQ ID NO: 1907 - DNA, 25 bp, Rattus norvegicus
aaaagagtcgtcagcatctgccagg

SEQ ID NO: 1908 - DNA, 25 bp, Rattus norvegicus
aaaagagtcgtctgcatctgccagg

SEQ ID NO: 1909 - DNA, 25 bp, Rattus norvegicus
aaaagagtctagctgctccctggtg

SEQ ID NO: 1910 - DNA, 25 bp, Rattus norvegicus
aaaagagtctaggtgctccctggtg

SEQ ID NO: 1911 - DNA, 25 bp, Rattus norvegicus
aaaagagtctcacctgccagctctg

SEQ ID NO: 1912 - DNA, 25 bp, Rattus norvegicus
aaaagagtctcagctgccagctctg

SEQ ID NO: 1913 - DNA, 25 bp, Rattus norvegicus
aaaagagtcttacacaccaaccgca

SEQ ID NO: 1914 - DNA, 25 bp, Rattus norvegicus
aaaagagtcttagacaccaaccgca

SEQ ID NO: 1915 - DNA, 25 bp, Rattus norvegicus
aaaagagtgatgaccctttccttgc

SEQ ID NO: 1916 - DNA, 25 bp, Rattus norvegicus
aaaagagtgatgtccctttccttgc

SEQ ID NO: 1917 - DNA, 25 bp, Rattus norvegicus
aaaagagtgcttattcttaatcatc

SEQ ID NO: 1918 - DNA, 25 bp, Rattus norvegicus
aaaagagtgctttttcttaatcatc

SEQ ID NO: 1919 - DNA, 25 bp, Rattus norvegicus
aaaagatactgcatgcctgctatag

SEQ ID NO: 1920 - DNA, 25 bp, Rattus norvegicus
aaaagatactgcttgcctgctatag

SEQ ID NO: 1921 - DNA, 25 bp, Rattus norvegicus
aaaagatagcagaccctttgtgttg

SEQ ID NO: 1922 - DNA, 25 bp, Rattus norvegicus
aaaagatagcagtccctttgtgttg

SEQ ID NO: 1923 - DNA, 25 bp, Rattus norvegicus
aaaagataggccctccctcgatggt

SEQ ID NO: 1924 - DNA, 25 bp, Rattus norvegicus
aaaagataggccgtccctcgatggt

SEQ ID NO: 1925 - DNA, 25 bp, Rattus norvegicus
aaaagatattcacacgctagcccag

SEQ ID NO: 1926 - DNA, 25 bp, Rattus norvegicus
aaaagatattcagacgctagcccag

SEQ ID NO: 1927 - DNA, 25 bp, Rattus norvegicus
aaaagatcaagtccctcttctgccg

SEQ ID NO: 1928 - DNA, 25 bp, Rattus norvegicus
aaaagatcaagtgcctcttctgccg

SEQ ID NO: 1929 - DNA, 25 bp, Rattus norvegicus
aaaagatcagccctcagtttcaagg

SEQ ID NO: 1930 - DNA, 25 bp, Rattus norvegicus
aaaagatcagccgtcagtttcaagg

SEQ ID NO: 1931 - DNA, 25 bp, Rattus norvegicus
aaaagatcattcctagccagcccgg

SEQ ID NO: 1932 - DNA, 25 bp, Rattus norvegicus
aaaagatcattcgtagccagcccgg

SEQ ID NO: 1933 - DNA, 25 bp, Rattus norvegicus
aaaagatccaggctcgtcacgcagt

SEQ ID NO: 1934 - DNA, 25 bp, Rattus norvegicus
aaaagatccagggtcgtcacgcagt

SEQ ID NO: 1935 - DNA, 25 bp, Rattus norvegicus
aaaagatccctgcacacgggaactc

SEQ ID NO: 1936 - DNA, 25 bp, Rattus norvegicus
aaaagatccctggacacgggaactc

SEQ ID NO: 1937 - DNA, 25 bp, Rattus norvegicus
aaaagatccgtgagcgctgacccaa

SEQ ID NO: 1938 - DNA, 25 bp, Rattus norvegicus
aaaagatccgtgtgcgctgacccaa

SEQ ID NO: 1939 - DNA, 25 bp, Rattus norvegicus
aaaagatcgcgccggattattgctg

SEQ ID NO: 1940 - DNA, 25 bp, Rattus norvegicus
aaaagatcgcgcgggattattgctg

SEQ ID NO: 1941 - DNA, 25 bp, Rattus norvegicus
aaaagatcttcccagtacactctac

SEQ ID NO: 1942 - DNA, 25 bp, Rattus norvegicus
aaaagatcttccgagtacactctac

SEQ ID NO: 1943 - DNA, 25 bp, Rattus norvegicus
aaaagatcttcgaggtatccgctcc

SEQ ID NO: 1944 - DNA, 25 bp, Rattus norvegicus
aaaagatcttcgtggtatccgctcc

SEQ ID NO: 1945 - DNA, 25 bp, Rattus norvegicus
aaaagatcttttcccgtttatgctg

SEQ ID NO: 1946 - DNA, 25 bp, Rattus norvegicus
aaaagatcttttgccgtttatgctg

SEQ ID NO: 1947 - DNA, 25 bp, Rattus norvegicus
aaaagatgacatagccccgagagcc

SEQ ID NO: 1948 - DNA, 25 bp, Rattus norvegicus
aaaagatgacattgccccgagagcc

SEQ ID NO: 1949 - DNA, 25 bp, Rattus norvegicus
aaaagatgccctattgagtatttgc

SEQ ID NO: 1950 - DNA, 25 bp, Rattus norvegicus
aaaagatgcccttttgagtatttgc

SEQ ID NO: 1951 - DNA, 25 bp, Rattus norvegicus
aaaagatgccgcctgattatatttc

SEQ ID NO: 1952 - DNA, 25 bp, Rattus norvegicus
aaaagatgccgcgtgattatatttc

SEQ ID NO: 1953 - DNA, 25 bp, Rattus norvegicus
aaaagatgctcacacatcgcttctc

SEQ ID NO: 1954 - DNA, 25 bp, Rattus norvegicus
aaaagatgctcagacatcgcttctc

SEQ ID NO: 1955 - DNA, 25 bp, Rattus norvegicus
aaaagatgctccctcagaatttcca

SEQ ID NO: 1956 - DNA, 25 bp, Rattus norvegicus
aaaagatgctccgtcagaatttcca

SEQ ID NO: 1957 - DNA, 25 bp, Rattus norvegicus
aaaagatgcttgaacctgagaggaa

SEQ ID NO: 1958 - DNA, 25 bp, Rattus norvegicus
aaaagatgcttgtacctgagaggaa

SEQ ID NO: 1959 - DNA, 25 bp, Rattus norvegicus
aaaagatggataccctggccttgtc

SEQ ID NO: 1960 - DNA, 25 bp, Rattus norvegicus
aaaagatggatagcctggccttgtc

SEQ ID NO: 1961 - DNA, 25 bp, Rattus norvegicus
aaaagatggctcacttcatttttgt

SEQ ID NO: 1962 - DNA, 25 bp, Rattus norvegicus
aaaagatggctctcttcatttttgt

SEQ ID NO: 1963 - DNA, 25 bp, Rattus norvegicus
aaaagatggtctactcctaacctgg

SEQ ID NO: 1964 - DNA, 25 bp, Rattus norvegicus
aaaagatggtcttctcctaacctgg

SEQ ID NO: 1965 - DNA, 25 bp, Rattus norvegicus
aaaagatggtggatcgcctggcgaa

SEQ ID NO: 1966 - DNA, 25 bp, Rattus norvegicus
aaaagatggtggttcgcctggcgaa

SEQ ID NO: 1967 - DNA, 25 bp, Rattus norvegicus
aaaagatgtcggcttccacaggccc

SEQ ID NO: 1968 - DNA, 25 bp, Rattus norvegicus
aaaagatgtcgggttccacaggccc

SEQ ID NO: 1969 - DNA, 25 bp, Rattus norvegicus
aaaagattctacaacaacccagcca

SEQ ID NO: 1970 - DNA, 25 bp, Rattus norvegicus
aaaagattctactacaacccagcca

SEQ ID NO: 1971 - DNA, 25 bp, Rattus norvegicus
aaaagattgacgcagcggcttcaca

SEQ ID NO: 1972 - DNA, 25 bp, Rattus norvegicus
aaaagattgacggagcggcttcaca

SEQ ID NO: 1973 - DNA, 25 bp, Rattus norvegicus
aaaagattgcccctgcctgtcgttc

SEQ ID NO: 1974 - DNA, 25 bp, Rattus norvegicus
aaaagattgcccgtgcctgtcgttc

SEQ ID NO: 1975 - DNA, 25 bp, Rattus norvegicus
aaaagattgggcagcctcgccatga

SEQ ID NO: 1976 - DNA, 25 bp, Rattus norvegicus
aaaagattgggctgcctcgccatga

SEQ ID NO: 1977 - DNA, 25 bp, Rattus norvegicus
aaaagatttccacattctgtatttg

SEQ ID NO: 1978 - DNA, 25 bp, Rattus norvegicus
aaaagatttccagattctgtatttg

SEQ ID NO: 1979 - DNA, 25 bp, Rattus norvegicus
aaaagatttctgacaggatcctaca

SEQ ID NO: 1980 - DNA, 25 bp, Rattus norvegicus
aaaagatttctgagcagcggcctct

SEQ ID NO: 1981 - DNA, 25 bp, Rattus norvegicus
aaaagatttctgtcaggatcctaca

SEQ ID NO: 1982 - DNA, 25 bp, Rattus norvegicus
aaaagatttctgtgcagcggcctct

SEQ ID NO: 1983 - DNA, 25 bp, Rattus norvegicus
aaaagattttgcaccatatttacca

SEQ ID NO: 1984 - DNA, 25 bp, Rattus norvegicus
aaaagattttgctccatatttacca

SEQ ID NO: 1985 - DNA, 25 bp, Rattus norvegicus
aaaagcaaacaaacatccgtcctcc

SEQ ID NO: 1986 - DNA, 25 bp, Rattus norvegicus
aaaagcaaacaatcatccgtcctcc

SEQ ID NO: 1987 - DNA, 25 bp, Rattus norvegicus
aaaagcaaagcaaaggccgccaagg

SEQ ID NO: 1988 - DNA, 25 bp, Rattus norvegicus
aaaagcaaagcataggccgccaagg

SEQ ID NO: 1989 - DNA, 25 bp, Rattus norvegicus
aaaagcaaagcccaggtctcctctc

SEQ ID NO: 1990 - DNA, 25 bp, Rattus norvegicus
aaaagcaaagccgaggtctcctctc

SEQ ID NO: 1991 - DNA, 25 bp, Rattus norvegicus
aaaagcaaccctctgagtccctcag

SEQ ID NO: 1992 - DNA, 25 bp, Rattus norvegicus
aaaagcaaccctgtgagtccctcag

SEQ ID NO: 1993 - DNA, 25 bp, Rattus norvegicus
aaaagcaagccaactcttcagaagg

SEQ ID NO: 1994 - DNA, 25 bp, Rattus norvegicus
aaaagcaagccatctcttcagaagg

SEQ ID NO: 1995 - DNA, 25 bp, Rattus norvegicus
aaaagcaagcccagtcgtgtgtttc

SEQ ID NO: 1996 - DNA, 25 bp, Rattus norvegicus
aaaagcaagccctgtcgtgtgtttc

SEQ ID NO: 1997 - DNA, 25 bp, Rattus norvegicus
aaaagcaagcgaacactcttcccag

SEQ ID NO: 1998 - DNA, 25 bp, Rattus norvegicus
aaaagcaagcgatcactcttcccag

SEQ ID NO: 1999 - DNA, 25 bp, Rattus norvegicus
aaaagcaagttcatctgggaccctg

SEQ ID NO: 2000 - DNA, 25 bp, Rattus norvegicus
aaaagcaagttcttctgggaccctg

SEQ ID NO: 2001 - DNA, 25 bp, Rattus norvegicus
aaaagcaatacactctcatttcaga

SEQ ID NO: 2002 - DNA, 25 bp, Rattus norvegicus
aaaagcaatacagtctcatttcaga

SEQ ID NO: 2003 - DNA, 25 bp, Rattus norvegicus
aaaagcaatcctaacccagccggca

SEQ ID NO: 2004 - DNA, 25 bp, Rattus norvegicus
aaaagcaatccttacccagccggca

SEQ ID NO: 2005 - DNA, 25 bp, Rattus norvegicus
aaaagcacaacacaatcccagggat

SEQ ID NO: 2006 - DNA, 25 bp, Rattus norvegicus
aaaagcacaacagaatcccagggat

SEQ ID NO: 2007 - DNA, 25 bp, Rattus norvegicus
aaaagcacagggactgtcagcacaa

SEQ ID NO: 2008 - DNA, 25 bp, Rattus norvegicus
aaaagcacagggtctgtcagcacaa

SEQ ID NO: 2009 - DNA, 25 bp, Rattus norvegicus
aaaagcaccagccaagctctgctca

SEQ ID NO: 2010 - DNA, 25 bp, Rattus norvegicus
aaaagcaccagcgaagctctgctca

SEQ ID NO: 2011 - DNA, 25 bp, Rattus norvegicus
aaaagcaccctaaacctgcaaatgg

SEQ ID NO: 2012 - DNA, 25 bp, Rattus norvegicus
aaaagcaccctatacctgcaaatgg

SEQ ID NO: 2013 - DNA, 25 bp, Rattus norvegicus
aaaagcaccgagatgagacagcaca

SEQ ID NO: 2014 - DNA, 25 bp, Rattus norvegicus
aaaagcaccgagttgagacagcaca

SEQ ID NO: 2015 - DNA, 25 bp, Rattus norvegicus
aaaagcacctgtattatcccttcta

SEQ ID NO: 2016 - DNA, 25 bp, Rattus norvegicus
aaaagcacctgttttatcccttcta

SEQ ID NO: 2017 - DNA, 25 bp, Rattus norvegicus
aaaagcactacgcatctgtggagat

SEQ ID NO: 2018 - DNA, 25 bp, Rattus norvegicus
aaaagcactacggatctgtggagat

SEQ ID NO: 2019 - DNA, 25 bp, Rattus norvegicus
aaaagcactcagacggtcctcaagg

SEQ ID NO: 2020 - DNA, 25 bp, Rattus norvegicus
aaaagcactcagtcggtcctcaagg

SEQ ID NO: 2021 - DNA, 25 bp, Rattus norvegicus
aaaagcactgagcattctctccagc

SEQ ID NO: 2022 - DNA, 25 bp, Rattus norvegicus
aaaagcactgaggattctctccagc

SEQ ID NO: 2023 - DNA, 25 bp, Rattus norvegicus
aaaagcactggcacctagtaggtat

SEQ ID NO: 2024 - DNA, 25 bp, Rattus norvegicus
aaaagcactggctcctagtaggtat

SEQ ID NO: 2025 - DNA, 25 bp, Rattus norvegicus
aaaagcactggtctgggtccggtca

SEQ ID NO: 2026 - DNA, 25 bp, Rattus norvegicus
aaaagcactggtgtgggtccggtca

SEQ ID NO: 2027 - DNA, 25 bp, Rattus norvegicus
aaaagcacttttcacacagatcatc

SEQ ID NO: 2028 - DNA, 25 bp, Rattus norvegicus
aaaagcacttttgacacagatcatc

SEQ ID NO: 2029 - DNA, 25 bp, Rattus norvegicus
aaaagcagacgcaccatacctggcg

SEQ ID NO: 2030 - DNA, 25 bp, Rattus norvegicus
aaaagcagacgctccatacctggcg

SEQ ID NO: 2031 - DNA, 25 bp, Rattus norvegicus
aaaagcagacttctcagctctgacc

SEQ ID NO: 2032 - DNA, 25 bp, Rattus norvegicus
aaaagcagacttgtcagctctgacc

SEQ ID NO: 2033 - DNA, 25 bp, Rattus norvegicus
aaaagcagagtccaacccacatttt

SEQ ID NO: 2034 - DNA, 25 bp, Rattus norvegicus
aaaagcagagtcgaacccacatttt

SEQ ID NO: 2035 - DNA, 25 bp, Rattus norvegicus
aaaagcagccctctcttccaaattc

SEQ ID NO: 2036 - DNA, 25 bp, Rattus norvegicus
aaaagcagccctgtcttccaaattc

SEQ ID NO: 2037 - DNA, 25 bp, Rattus norvegicus
aaaagcagcctgactgctgtcctgt

SEQ ID NO: 2038 - DNA, 25 bp, Rattus norvegicus
aaaagcagcctgtctgctgtcctgt

SEQ ID NO: 2039 - DNA, 25 bp, Rattus norvegicus
aaaagcagcgcacacagcacttcag

SEQ ID NO: 2040 - DNA, 25 bp, Rattus norvegicus
aaaagcagcgcagacagcacttcag

SEQ ID NO: 2041 - DNA, 25 bp, Rattus norvegicus
aaaagcagctccagtttgccgagtt

SEQ ID NO: 2042 - DNA, 25 bp, Rattus norvegicus
aaaagcagctcctgtttgccgagtt

SEQ ID NO: 2043 - DNA, 25 bp, Rattus norvegicus
aaaagcagcttgacccatgcaggga

SEQ ID NO: 2044 - DNA, 25 bp, Rattus norvegicus
aaaagcagcttgtcccatgcaggga

SEQ ID NO: 2045 - DNA, 25 bp, Rattus norvegicus
aaaagcaggcacaccgttggaggag

SEQ ID NO: 2046 - DNA, 25 bp, Rattus norvegicus
aaaagcaggcactccgttggaggag

SEQ ID NO: 2047 - DNA, 25 bp, Rattus norvegicus
aaaagcaggccgaggctgctttcaa

SEQ ID NO: 2048 - DNA, 25 bp, Rattus norvegicus
aaaagcaggccgtggctgctttcaa

SEQ ID NO: 2049 - DNA, 25 bp, Rattus norvegicus
aaaagcaggcctcagccagacttga

SEQ ID NO: 2050 - DNA, 25 bp, Rattus norvegicus
aaaagcaggcctgagccagacttga

SEQ ID NO: 2051 - DNA, 25 bp, Rattus norvegicus
aaaagcaggctcagcacttgggcct

SEQ ID NO: 2052 - DNA, 25 bp, Rattus norvegicus
aaaagcaggctctgcacttgggcct

SEQ ID NO: 2053 - DNA, 25 bp, Rattus norvegicus
aaaagcagggccacctccatttgga

SEQ ID NO: 2054 - DNA, 25 bp, Rattus norvegicus
aaaagcagggcccacaactggatga

SEQ ID NO: 2055 - DNA, 25 bp, Rattus norvegicus
aaaagcagggccgacaactggatga

SEQ ID NO: 2056 - DNA, 25 bp, Rattus norvegicus
aaaagcagggcctcctccatttgga

SEQ ID NO: 2057 - DNA, 25 bp, Rattus norvegicus
aaaagcaggtgaacccaggtctgga

SEQ ID NO: 2058 - DNA, 25 bp, Rattus norvegicus
aaaagcaggtgatcccaggtctgga

SEQ ID NO: 2059 - DNA, 25 bp, Rattus norvegicus
aaaagcaggttcaggaatccttcca

SEQ ID NO: 2060 - DNA, 25 bp, Rattus norvegicus
aaaagcaggttctggaatccttcca

SEQ ID NO: 2061 - DNA, 25 bp, Rattus norvegicus
aaaagcagtcctcccgattgtagta

SEQ ID NO: 2062 - DNA, 25 bp, Rattus norvegicus
aaaagcagtcctgccgattgtagta

SEQ ID NO: 2063 - DNA, 25 bp, Rattus norvegicus
aaaagcagtgtaattgaccaaagca

SEQ ID NO: 2064 - DNA, 25 bp, Rattus norvegicus
aaaagcagtgtatttgaccaaagca

SEQ ID NO: 2065 - DNA, 25 bp, Rattus norvegicus
aaaagcagtttcaagtcaagtcact

SEQ ID NO: 2066 - DNA, 25 bp, Rattus norvegicus
aaaagcagtttctagtcaagtcact

SEQ ID NO: 2067 - DNA, 25 bp, Rattus norvegicus
aaaagcataactcggctgctgttct

SEQ ID NO: 2068 - DNA, 25 bp, Rattus norvegicus
aaaagcataactgggctgctgttct

SEQ ID NO: 2069 - DNA, 25 bp, Rattus norvegicus
aaaagcatccgaacaatcctgacct

SEQ ID NO: 2070 - DNA, 25 bp, Rattus norvegicus
aaaagcatccgatcaatcctgacct

SEQ ID NO: 2071 - DNA, 25 bp, Rattus norvegicus
aaaagcatctccaacgacctggatg

SEQ ID NO: 2072 - DNA, 25 bp, Rattus norvegicus
aaaagcatctccaggcatatgtgcc

SEQ ID NO: 2073 - DNA, 25 bp, Rattus norvegicus
aaaagcatctcctacgacctggatg

SEQ ID NO: 2074 - DNA, 25 bp, Rattus norvegicus
aaaagcatctcctggcatatgtgcc

SEQ ID NO: 2075 - DNA, 25 bp, Rattus norvegicus
aaaagcatgactattctcttgcctc

SEQ ID NO: 2076 - DNA, 25 bp, Rattus norvegicus
aaaagcatgacttttctcttgcctc

SEQ ID NO: 2077 - DNA, 25 bp, Rattus norvegicus
aaaagcatgcacagtcctgagctct

SEQ ID NO: 2078 - DNA, 25 bp, Rattus norvegicus
aaaagcatgcactgtcctgagctct

SEQ ID NO: 2079 - DNA, 25 bp, Rattus norvegicus
aaaagcatgcttaggcacttctctc

SEQ ID NO: 2080 - DNA, 25 bp, Rattus norvegicus
aaaagcatgctttggcacttctctc

SEQ ID NO: 2081 - DNA, 25 bp, Rattus norvegicus
aaaagcatgggtactcacgtgagtc

SEQ ID NO: 2082 - DNA, 25 bp, Rattus norvegicus
aaaagcatgggttctcacgtgagtc

SEQ ID NO: 2083 - DNA, 25 bp, Rattus norvegicus
aaaagcatgtacagacgcagacccc

SEQ ID NO: 2084 - DNA, 25 bp, Rattus norvegicus
aaaagcatgtactgacgcagacccc

SEQ ID NO: 2085 - DNA, 25 bp, Rattus norvegicus
aaaagcattcccaactctggtattc

SEQ ID NO: 2086 - DNA, 25 bp, Rattus norvegicus
aaaagcattccctactctggtattc

SEQ ID NO: 2087 - DNA, 25 bp, Rattus norvegicus
aaaagcattctaactggttcaacaa

SEQ ID NO: 2088 - DNA, 25 bp, Rattus norvegicus
aaaagcattctatctggttcaacaa

SEQ ID NO: 2089 - DNA, 25 bp, Rattus norvegicus
aaaagcattctcagtgtgacttaca

SEQ ID NO: 2090 - DNA, 25 bp, Rattus norvegicus
aaaagcattctcatatgtactagca

SEQ ID NO: 2091 - DNA, 25 bp, Rattus norvegicus
aaaagcattctctgtgtgacttaca

SEQ ID NO: 2092 - DNA, 25 bp, Rattus norvegicus
aaaagcattctcttatgtactagca

SEQ ID NO: 2093 - DNA, 25 bp, Rattus norvegicus
aaaagcattgctatccttcatgtgt

SEQ ID NO: 2094 - DNA, 25 bp, Rattus norvegicus
aaaagcattgctttccttcatgtgt

SEQ ID NO: 2095 - DNA, 25 bp, Rattus norvegicus
aaaagcattggactcaccctcctta

SEQ ID NO: 2096 - DNA, 25 bp, Rattus norvegicus
aaaagcattggacttgtctctcccc

SEQ ID NO: 2097 - DNA, 25 bp, Rattus norvegicus
aaaagcattggagtcaccctcctta

SEQ ID NO: 2098 - DNA, 25 bp, Rattus norvegicus
aaaagcattggagttgtctctcccc

SEQ ID NO: 2099 - DNA, 25 bp, Rattus norvegicus
aaaagccaaagacactgccacccac

SEQ ID NO: 2100 - DNA, 25 bp, Rattus norvegicus
aaaagccaaagagactgccacccac

SEQ ID NO: 2101 - DNA, 25 bp, Rattus norvegicus
aaaagccaaagccactgtctctaat

SEQ ID NO: 2102 - DNA, 25 bp, Rattus norvegicus
aaaagccaaagcgactgtctctaat

SEQ ID NO: 2103 - DNA, 25 bp, Rattus norvegicus
aaaagccaaccaaattgccttcctt

SEQ ID NO: 2104 - DNA, 25 bp, Rattus norvegicus
aaaagccaaccatattgccttcctt

SEQ ID NO: 2105 - DNA, 25 bp, Rattus norvegicus
aaaagccaactcagtagacaccttc

SEQ ID NO: 2106 - DNA, 25 bp, Rattus norvegicus
aaaagccaactctgtagacaccttc

SEQ ID NO: 2107 - DNA, 25 bp, Rattus norvegicus
aaaagccaagatctatacactgaaa

SEQ ID NO: 2108 - DNA, 25 bp, Rattus norvegicus
aaaagccaagatgtatacactgaaa

SEQ ID NO: 2109 - DNA, 25 bp, Rattus norvegicus
aaaagccaagctagcctcaactgct

SEQ ID NO: 2110 - DNA, 25 bp, Rattus norvegicus
aaaagccaagcttgcctcaactgct

SEQ ID NO: 2111 - DNA, 25 bp, Rattus norvegicus
aaaagccaatccaccagtagcatgt

SEQ ID NO: 2112 - DNA, 25 bp, Rattus norvegicus
aaaagccaatcctccagtagcatgt

SEQ ID NO: 2113 - DNA, 25 bp, Rattus norvegicus
aaaagccacaatcaggtgttttctg

SEQ ID NO: 2114 - DNA, 25 bp, Rattus norvegicus
aaaagccacaatgaggtgttttctg

SEQ ID NO: 2115 - DNA, 25 bp, Rattus norvegicus
aaaagccacatactgagacacgccc

SEQ ID NO: 2116 - DNA, 25 bp, Rattus norvegicus
aaaagccacatagtgagacacgccc

SEQ ID NO: 2117 - DNA, 25 bp, Rattus norvegicus
aaaagccacatccagtactacacag

SEQ ID NO: 2118 - DNA, 25 bp, Rattus norvegicus
aaaagccacatcgagtactacacag

SEQ ID NO: 2119 - DNA, 25 bp, Rattus norvegicus
aaaagccaccagatctgttgtaaat

SEQ ID NO: 2120 - DNA, 25 bp, Rattus norvegicus
aaaagccaccagttctgttgtaaat

SEQ ID NO: 2121 - DNA, 25 bp, Rattus norvegicus
aaaagccacctcctgtggtgacact

SEQ ID NO: 2122 - DNA, 25 bp, Rattus norvegicus
aaaagccacctcgtgtggtgacact

SEQ ID NO: 2123 - DNA, 25 bp, Rattus norvegicus
aaaagccaccttagcacagttcaaa

SEQ ID NO: 2124 - DNA, 25 bp, Rattus norvegicus
aaaagccaccttcgatgcagcctgt

SEQ ID NO: 2125 - DNA, 25 bp, Rattus norvegicus
aaaagccaccttggatgcagcctgt

SEQ ID NO: 2126 - DNA, 25 bp, Rattus norvegicus
aaaagccacctttgcacagttcaaa

SEQ ID NO: 2127 - DNA, 25 bp, Rattus norvegicus
aaaagccactagagacccttagctg

SEQ ID NO: 2128 - DNA, 25 bp, Rattus norvegicus
aaaagccactagtgacccttagctg

SEQ ID NO: 2129 - DNA, 25 bp, Rattus norvegicus
aaaagccactcacttgtctgtctgg

SEQ ID NO: 2130 - DNA, 25 bp, Rattus norvegicus
aaaagccactcagttgtctgtctgg

SEQ ID NO: 2131 - DNA, 25 bp, Rattus norvegicus
aaaagccagaccctaagtgcgtctt

SEQ ID NO: 2132 - DNA, 25 bp, Rattus norvegicus
aaaagccagaccgtaagtgcgtctt

SEQ ID NO: 2133 - DNA, 25 bp, Rattus norvegicus
aaaagccagatcatgacttccttct

SEQ ID NO: 2134 - DNA, 25 bp, Rattus norvegicus
aaaagccagatcttgacttccttct

SEQ ID NO: 2135 - DNA, 25 bp, Rattus norvegicus
aaaagccagcgactgggtccagcag

SEQ ID NO: 2136 - DNA, 25 bp, Rattus norvegicus
aaaagccagcgagtgggtccagcag

SEQ ID NO: 2137 - DNA, 25 bp, Rattus norvegicus
aaaagccaggcaagatccatgtgat

SEQ ID NO: 2138 - DNA, 25 bp, Rattus norvegicus
aaaagccaggcatgatccatgtgat

SEQ ID NO: 2139 - DNA, 25 bp, Rattus norvegicus
aaaagccaggctagtctctacactg

SEQ ID NO: 2140 - DNA, 25 bp, Rattus norvegicus
aaaagccaggcttgtctctacactg

SEQ ID NO: 2141 - DNA, 25 bp, Rattus norvegicus
aaaagccaggtgacactttgggcct

SEQ ID NO: 2142 - DNA, 25 bp, Rattus norvegicus
aaaagccaggtgtcactttgggcct

SEQ ID NO: 2143 - DNA, 25 bp, Rattus norvegicus
aaaagccagtttcctcagacctcct

SEQ ID NO: 2144 - DNA, 25 bp, Rattus norvegicus
aaaagccagtttgctcagacctcct

SEQ ID NO: 2145 - DNA, 25 bp, Rattus norvegicus
aaaagccatgacatgtccagaccct

SEQ ID NO: 2146 - DNA, 25 bp, Rattus norvegicus
aaaagccatgacttgtccagaccct

SEQ ID NO: 2147 - DNA, 25 bp, Rattus norvegicus
aaaagccatgccctgggtttgcgta

SEQ ID NO: 2148 - DNA, 25 bp, Rattus norvegicus
aaaagccatgccgtgggtttgcgta

SEQ ID NO: 2149 - DNA, 25 bp, Rattus norvegicus
aaaagccatggtcctgcagactgac

SEQ ID NO: 2150 - DNA, 25 bp, Rattus norvegicus
aaaagccatggtgctgcagactgac

SEQ ID NO: 2151 - DNA, 25 bp, Rattus norvegicus
aaaagcccagagatgtcaggtaaat

SEQ ID NO: 2152 - DNA, 25 bp, Rattus norvegicus
aaaagcccagagttgtcaggtaaat

SEQ ID NO: 2153 - DNA, 25 bp, Rattus norvegicus
aaaagcccatcaagtgttctgcacc

SEQ ID NO: 2154 - DNA, 25 bp, Rattus norvegicus
aaaagcccatcaccatgagatcctg

SEQ ID NO: 2155 - DNA, 25 bp, Rattus norvegicus
aaaagcccatcagcatgagatcctg

SEQ ID NO: 2156 - DNA, 25 bp, Rattus norvegicus
aaaagcccatcatgtgttctgcacc

SEQ ID NO: 2157 - DNA, 25 bp, Rattus norvegicus
aaaagccccaacaggatctctgtta

SEQ ID NO: 2158 - DNA, 25 bp, Rattus norvegicus
aaaagccccaactggatctctgtta

SEQ ID NO: 2159 - DNA, 25 bp, Rattus norvegicus
aaaagccccaggcacagtctggctg

SEQ ID NO: 2160 - DNA, 25 bp, Rattus norvegicus
aaaagccccagggacagtctggctg

SEQ ID NO: 2161 - DNA, 25 bp, Rattus norvegicus
aaaagccccgtaacaaactgccatt

SEQ ID NO: 2162 - DNA, 25 bp, Rattus norvegicus
aaaagccccgtatcaaactgccatt

SEQ ID NO: 2163 - DNA, 25 bp, Rattus norvegicus
aaaagcccggacattggcccattgg

SEQ ID NO: 2164 - DNA, 25 bp, Rattus norvegicus
aaaagcccggactttggcccattgg

SEQ ID NO: 2165 - DNA, 25 bp, Rattus norvegicus
aaaagcccggagcagagagccacag

SEQ ID NO: 2166 - DNA, 25 bp, Rattus norvegicus
aaaagcccggaggagagagccacag

SEQ ID NO: 2167 - DNA, 25 bp, Rattus norvegicus
aaaagcccgggacatccaggccaag

SEQ ID NO: 2168 - DNA, 25 bp, Rattus norvegicus
aaaagcccgggagatccaggccaag

SEQ ID NO: 2169 - DNA, 25 bp, Rattus norvegicus
aaaagccctagaactgtcttccaag

SEQ ID NO: 2170 - DNA, 25 bp, Rattus norvegicus
aaaagccctagatctgtcttccaag

SEQ ID NO: 2171 - DNA, 25 bp, Rattus norvegicus
aaaagccctctgcagcaatgtgcca

SEQ ID NO: 2172 - DNA, 25 bp, Rattus norvegicus
aaaagccctctggagcaatgtgcca

SEQ ID NO: 2173 - DNA, 25 bp, Rattus norvegicus
aaaagccctgggagtttctgcctgt

SEQ ID NO: 2174 - DNA, 25 bp, Rattus norvegicus
aaaagccctgggtgtttctgcctgt

SEQ ID NO: 2175 - DNA, 25 bp, Rattus norvegicus
aaaagcccttaaaatggcatttgct

SEQ ID NO: 2176 - DNA, 25 bp, Rattus norvegicus
aaaagcccttaatatggcatttgct

SEQ ID NO: 2177 - DNA, 25 bp, Rattus norvegicus
aaaagcccttgaacatcgactacat

SEQ ID NO: 2178 - DNA, 25 bp, Rattus norvegicus
aaaagcccttgatcatcgactacat

SEQ ID NO: 2179 - DNA, 25 bp, Rattus norvegicus
aaaagccgaacgacattcaccagta

SEQ ID NO: 2180 - DNA, 25 bp, Rattus norvegicus
aaaagccgaacgtcattcaccagta

SEQ ID NO: 2181 - DNA, 25 bp, Rattus norvegicus
aaaagccgaagacccagcggttctg

SEQ ID NO: 2182 - DNA, 25 bp, Rattus norvegicus
aaaagccgaagagccagcggttctg

SEQ ID NO: 2183 - DNA, 25 bp, Rattus norvegicus
aaaagccgcggaccgaactcgtgtt

SEQ ID NO: 2184 - DNA, 25 bp, Rattus norvegicus
aaaagccgcggagcgaactcgtgtt

SEQ ID NO: 2185 - DNA, 25 bp, Rattus norvegicus
aaaagccgctggatgcaacggtctt

SEQ ID NO: 2186 - DNA, 25 bp, Rattus norvegicus
aaaagccgctggttgcaacggtctt

SEQ ID NO: 2187 - DNA, 25 bp, Rattus norvegicus
aaaagccggcttcatttgctgtctt

SEQ ID NO: 2188 - DNA, 25 bp, Rattus norvegicus
aaaagccggcttgatttgctgtctt

SEQ ID NO: 2189 - DNA, 25 bp, Rattus norvegicus
aaaagccggtttagtatgcagatga

SEQ ID NO: 2190 - DNA, 25 bp, Rattus norvegicus
aaaagccggttttgtatgcagatga

SEQ ID NO: 2191 - DNA, 25 bp, Rattus norvegicus
aaaagccgtgccatggatggcggtc

SEQ ID NO: 2192 - DNA, 25 bp, Rattus norvegicus
aaaagccgtgccttggatggcggtc

SEQ ID NO: 2193 - DNA, 25 bp, Rattus norvegicus
aaaagcctatgccatgcgaagccca

SEQ ID NO: 2194 - DNA, 25 bp, Rattus norvegicus
aaaagcctatgcgatgcgaagccca

SEQ ID NO: 2195 - DNA, 25 bp, Rattus norvegicus
aaaagcctcaaaatgtatctctaat

SEQ ID NO: 2196 - DNA, 25 bp, Rattus norvegicus
aaaagcctcaaattgtatctctaat

SEQ ID NO: 2197 - DNA, 25 bp, Rattus norvegicus
aaaagcctcactccgtggtggtgtc

SEQ ID NO: 2198 - DNA, 25 bp, Rattus norvegicus
aaaagcctcactgcgtggtggtgtc

SEQ ID NO: 2199 - DNA, 25 bp, Rattus norvegicus
aaaagcctcatcagaatcattggat

SEQ ID NO: 2200 - DNA, 25 bp, Rattus norvegicus
aaaagcctcatcagtgggtcctcta

SEQ ID NO: 2201 - DNA, 25 bp, Rattus norvegicus
aaaagcctcatctgaatcattggat

SEQ ID NO: 2202 - DNA, 25 bp, Rattus norvegicus
aaaagcctcatctgtgggtcctcta

SEQ ID NO: 2203 - DNA, 25 bp, Rattus norvegicus
aaaagcctccagacttcttcagaga

SEQ ID NO: 2204 - DNA, 25 bp, Rattus norvegicus
aaaagcctccagcttgctgaagctc

SEQ ID NO: 2205 - DNA, 25 bp, Rattus norvegicus
aaaagcctccaggttgctgaagctc

SEQ ID NO: 2206 - DNA, 25 bp, Rattus norvegicus
aaaagcctccagtcttcttcagaga

SEQ ID NO: 2207 - DNA, 25 bp, Rattus norvegicus
aaaagcctccatacatctcaagtcg

SEQ ID NO: 2208 - DNA, 25 bp, Rattus norvegicus
aaaagcctccattcatctcaagtcg

SEQ ID NO: 2209 - DNA, 25 bp, Rattus norvegicus
aaaagcctcccacaagtgatccgac

SEQ ID NO: 2210 - DNA, 25 bp, Rattus norvegicus
aaaagcctcccagaagtgatccgac

SEQ ID NO: 2211 - DNA, 25 bp, Rattus norvegicus
aaaagcctccggagagccggctcag

SEQ ID NO: 2212 - DNA, 25 bp, Rattus norvegicus
aaaagcctccggtgagccggctcag

SEQ ID NO: 2213 - DNA, 25 bp, Rattus norvegicus
aaaagcctctccctgatattttcgg

SEQ ID NO: 2214 - DNA, 25 bp, Rattus norvegicus
aaaagcctctccgtgatattttcgg

SEQ ID NO: 2215 - DNA, 25 bp, Rattus norvegicus
aaaagcctctgaaactctgcgaaca

SEQ ID NO: 2216 - DNA, 25 bp, Rattus norvegicus
aaaagcctctgatactctgcgaaca

SEQ ID NO: 2217 - DNA, 25 bp, Rattus norvegicus
aaaagcctctgcacatttatccgat

SEQ ID NO: 2218 - DNA, 25 bp, Rattus norvegicus
aaaagcctctgctcatttatccgat

SEQ ID NO: 2219 - DNA, 25 bp, Rattus norvegicus
aaaagcctctgtagagcatcctgtc

SEQ ID NO: 2220 - DNA, 25 bp, Rattus norvegicus
aaaagcctctgttgagcatcctgtc

SEQ ID NO: 2221 - DNA, 25 bp, Rattus norvegicus
aaaagcctgaaacggtctcatcctt

SEQ ID NO: 2222 - DNA, 25 bp, Rattus norvegicus
aaaagcctgaaagggtctcatcctt

SEQ ID NO: 2223 - DNA, 25 bp, Rattus norvegicus
aaaagcctggagatggcgactcttt

SEQ ID NO: 2224 - DNA, 25 bp, Rattus norvegicus
aaaagcctggagttggcgactcttt

SEQ ID NO: 2225 - DNA, 25 bp, Rattus norvegicus
aaaagcctgtccagttggtggtgca

SEQ ID NO: 2226 - DNA, 25 bp, Rattus norvegicus
aaaagcctgtcctgttggtggtgca

SEQ ID NO: 2227 - DNA, 25 bp, Rattus norvegicus
aaaagcctgtggactgagctctctg

SEQ ID NO: 2228 - DNA, 25 bp, Rattus norvegicus
aaaagcctgtggtctgagctctctg

SEQ ID NO: 2229 - DNA, 25 bp, Rattus norvegicus
aaaagcctgtgtagacatgtcttga

SEQ ID NO: 2230 - DNA, 25 bp, Rattus norvegicus
aaaagcctgtgtcagactccaaaca

SEQ ID NO: 2231 - DNA, 25 bp, Rattus norvegicus
aaaagcctgtgtgagactccaaaca

SEQ ID NO: 2232 - DNA, 25 bp, Rattus norvegicus
aaaagcctgtgttgacatgtcttga

SEQ ID NO: 2233 - DNA, 25 bp, Rattus norvegicus
aaaagcctgtttcttgaggtcctgc

SEQ ID NO: 2234 - DNA, 25 bp, Rattus norvegicus
aaaagcctgtttgttgaggtcctgc

SEQ ID NO: 2235 - DNA, 25 bp, Rattus norvegicus
aaaagccttcatcacaagtactcgg

SEQ ID NO: 2236 - DNA, 25 bp, Rattus norvegicus
aaaagccttcatgacaagtactcgg

SEQ ID NO: 2237 - DNA, 25 bp, Rattus norvegicus
aaaagccttcctctgtcctagacag

SEQ ID NO: 2238 - DNA, 25 bp, Rattus norvegicus
aaaagccttcctgtgtcctagacag

SEQ ID NO: 2239 - DNA, 25 bp, Rattus norvegicus
aaaagccttcggagactgcagggag

SEQ ID NO: 2240 - DNA, 25 bp, Rattus norvegicus
aaaagccttcggtgactgcagggag

SEQ ID NO: 2241 - DNA, 25 bp, Rattus norvegicus
aaaagccttggcaacaggcgcccct

SEQ ID NO: 2242 - DNA, 25 bp, Rattus norvegicus
aaaagccttggctacaggcgcccct

SEQ ID NO: 2243 - DNA, 25 bp, Rattus norvegicus
aaaagcctttggacatggacagtaa

SEQ ID NO: 2244 - DNA, 25 bp, Rattus norvegicus
aaaagcctttggtcatggacagtaa

SEQ ID NO: 2245 - DNA, 25 bp, Rattus norvegicus
aaaagcgaaagcatcttccctgact

SEQ ID NO: 2246 - DNA, 25 bp, Rattus norvegicus
aaaagcgaaagcttcttccctgact

SEQ ID NO: 2247 - DNA, 25 bp, Rattus norvegicus
aaaagcgaccctacagactagacat

SEQ ID NO: 2248 - DNA, 25 bp, Rattus norvegicus
aaaagcgacccttcagactagacat

SEQ ID NO: 2249 - DNA, 25 bp, Rattus norvegicus
aaaagcgatttcatcttgctccagc

SEQ ID NO: 2250 - DNA, 25 bp, Rattus norvegicus
aaaagcgatttcttcttgctccagc

SEQ ID NO: 2251 - DNA, 25 bp, Rattus norvegicus
aaaagcgcagctcggaagttcacag

SEQ ID NO: 2252 - DNA, 25 bp, Rattus norvegicus
aaaagcgcagctgggaagttcacag

SEQ ID NO: 2253 - DNA, 25 bp, Rattus norvegicus
aaaagcgcctgcatcctacaagatg

SEQ ID NO: 2254 - DNA, 25 bp, Rattus norvegicus
aaaagcgcctgcttcctacaagatg

SEQ ID NO: 2255 - DNA, 25 bp, Rattus norvegicus
aaaagcgcctggagcagagccccaa

SEQ ID NO: 2256 - DNA, 25 bp, Rattus norvegicus
aaaagcgcctggtgcagagccccaa

SEQ ID NO: 2257 - DNA, 25 bp, Rattus norvegicus
aaaagcgcgagtccggccgcaccag

SEQ ID NO: 2258 - DNA, 25 bp, Rattus norvegicus
aaaagcgcgagtgcggccgcaccag

SEQ ID NO: 2259 - DNA, 25 bp, Rattus norvegicus
aaaagcgctccaaggccaagcagga

SEQ ID NO: 2260 - DNA, 25 bp, Rattus norvegicus
aaaagcgctccatggccaagcagga

SEQ ID NO: 2261 - DNA, 25 bp, Rattus norvegicus
aaaagcgctgctcttgtatgtctca

SEQ ID NO: 2262 - DNA, 25 bp, Rattus norvegicus
aaaagcgctgctgttgtatgtctca

SEQ ID NO: 2263 - DNA, 25 bp, Rattus norvegicus
aaaagcgctgttacatctgtggaag

SEQ ID NO: 2264 - DNA, 25 bp, Rattus norvegicus
aaaagcgctgtttcatctgtggaag

SEQ ID NO: 2265 - DNA, 25 bp, Rattus norvegicus
aaaagcgctttgatgacattcaaga

SEQ ID NO: 2266 - DNA, 25 bp, Rattus norvegicus
aaaagcgctttgttgacattcaaga

SEQ ID NO: 2267 - DNA, 25 bp, Rattus norvegicus
aaaagcggttttccaacacaacgtg

SEQ ID NO: 2268 - DNA, 25 bp, Rattus norvegicus
aaaagcggttttgcaacacaacgtg

SEQ ID NO: 2269 - DNA, 25 bp, Rattus norvegicus
aaaagcgtgagtcgcgacctccgtg

SEQ ID NO: 2270 - DNA, 25 bp, Rattus norvegicus
aaaagcgtgagtggcgacctccgtg

SEQ ID NO: 2271 - DNA, 25 bp, Rattus norvegicus
aaaagctaaaaacgccctgaagcat

SEQ ID NO: 2272 - DNA, 25 bp, Rattus norvegicus
aaaagctaaaaaggccctgaagcat

SEQ ID NO: 2273 - DNA, 25 bp, Rattus norvegicus
aaaagctaaccgctgcgacatcgca

SEQ ID NO: 2274 - DNA, 25 bp, Rattus norvegicus
aaaagctaaccggtgcgacatcgca

SEQ ID NO: 2275 - DNA, 25 bp, Rattus norvegicus
aaaagctaacctaggcctctgagtg

SEQ ID NO: 2276 - DNA, 25 bp, Rattus norvegicus
aaaagctaaccttggcctctgagtg

SEQ ID NO: 2277 - DNA, 25 bp, Rattus norvegicus
aaaagctaacttagtgggtgctcta

SEQ ID NO: 2278 - DNA, 25 bp, Rattus norvegicus
aaaagctaactttgtgggtgctcta

SEQ ID NO: 2279 - DNA, 25 bp, Rattus norvegicus
aaaagctaagagcacttgcacccct

SEQ ID NO: 2280 - DNA, 25 bp, Rattus norvegicus
aaaagctaagaggacttgcacccct

SEQ ID NO: 2281 - DNA, 25 bp, Rattus norvegicus
aaaagctaagcaatgccacccagca

SEQ ID NO: 2282 - DNA, 25 bp, Rattus norvegicus
aaaagctaagcattgccacccagca

SEQ ID NO: 2283 - DNA, 25 bp, Rattus norvegicus
aaaagctacagcacagccagacgct

SEQ ID NO: 2284 - DNA, 25 bp, Rattus norvegicus
aaaagctacagctcagccagacgct

SEQ ID NO: 2285 - DNA, 25 bp, Rattus norvegicus
aaaagctagcttcctatctcaggag

SEQ ID NO: 2286 - DNA, 25 bp, Rattus norvegicus
aaaagctagcttgctatctcaggag

SEQ ID NO: 2287 - DNA, 25 bp, Rattus norvegicus
aaaagctagtacagttgggtgcaca

SEQ ID NO: 2288 - DNA, 25 bp, Rattus norvegicus
aaaagctagtactgttgggtgcaca

SEQ ID NO: 2289 - DNA, 25 bp, Rattus norvegicus
aaaagctcaccccaggagttggctg

SEQ ID NO: 2290 - DNA, 25 bp, Rattus norvegicus
aaaagctcacccgaggagttggctg

SEQ ID NO: 2291 - DNA, 25 bp, Rattus norvegicus
aaaagctcacttcctttcatacagc

SEQ ID NO: 2292 - DNA, 25 bp, Rattus norvegicus
aaaagctcacttgctttcatacagc

SEQ ID NO: 2293 - DNA, 25 bp, Rattus norvegicus
aaaagctcagctcgagcctcggtgg

SEQ ID NO: 2294 - DNA, 25 bp, Rattus norvegicus
aaaagctcagctggagcctcggtgg

SEQ ID NO: 2295 - DNA, 25 bp, Rattus norvegicus
aaaagctccaggagtcatacggtga

SEQ ID NO: 2296 - DNA, 25 bp, Rattus norvegicus
aaaagctccaggtgtcatacggtga

SEQ ID NO: 2297 - DNA, 25 bp, Rattus norvegicus
aaaagctccattaccagaagtcgcc

SEQ ID NO: 2298 - DNA, 25 bp, Rattus norvegicus
aaaagctccatttccagaagtcgcc

SEQ ID NO: 2299 - DNA, 25 bp, Rattus norvegicus
aaaagctccccacgcaagtatacca

SEQ ID NO: 2300 - DNA, 25 bp, Rattus norvegicus
aaaagctccccactgagtgagcgtt

SEQ ID NO: 2301 - DNA, 25 bp, Rattus norvegicus
aaaagctccccaggcaagtatacca

SEQ ID NO: 2302 - DNA, 25 bp, Rattus norvegicus
aaaagctccccagtgagtgagcgtt

SEQ ID NO: 2303 - DNA, 25 bp, Rattus norvegicus
aaaagctcccttactgtgaagcatt

SEQ ID NO: 2304 - DNA, 25 bp, Rattus norvegicus
aaaagctcccttagtatccagtttg

SEQ ID NO: 2305 - DNA, 25 bp, Rattus norvegicus
aaaagctccctttctgtgaagcatt

SEQ ID NO: 2306 - DNA, 25 bp, Rattus norvegicus
aaaagctccctttgtatccagtttg

SEQ ID NO: 2307 - DNA, 25 bp, Rattus norvegicus
aaaagctcgaatacagtctcagatt

SEQ ID NO: 2308 - DNA, 25 bp, Rattus norvegicus
aaaagctcgaattcagtctcagatt

SEQ ID NO: 2309 - DNA, 25 bp, Rattus norvegicus
aaaagctcgtctcctatgtctctta

SEQ ID NO: 2310 - DNA, 25 bp, Rattus norvegicus
aaaagctcgtctgctatgtctctta

SEQ ID NO: 2311 - DNA, 25 bp, Rattus norvegicus
aaaagctctcttcaattctaggtag

SEQ ID NO: 2312 - DNA, 25 bp, Rattus norvegicus
aaaagctctcttcttccctgtgtta

SEQ ID NO: 2313 - DNA, 25 bp, Rattus norvegicus
aaaagctctcttgaattctaggtag

SEQ ID NO: 2314 - DNA, 25 bp, Rattus norvegicus
aaaagctctcttgttccctgtgtta

SEQ ID NO: 2315 - DNA, 25 bp, Rattus norvegicus
aaaagctctggcctaggtgactaga

SEQ ID NO: 2316 - DNA, 25 bp, Rattus norvegicus
aaaagctctggcgtaggtgactaga

SEQ ID NO: 2317 - DNA, 25 bp, Rattus norvegicus
aaaagctgactaccttccagctctg

SEQ ID NO: 2318 - DNA, 25 bp, Rattus norvegicus
aaaagctgactagcttccagctctg

SEQ ID NO: 2319 - DNA, 25 bp, Rattus norvegicus
aaaagctgactcacccagttaagga

SEQ ID NO: 2320 - DNA, 25 bp, Rattus norvegicus
aaaagctgactctcccagttaagga

SEQ ID NO: 2321 - DNA, 25 bp, Rattus norvegicus
aaaagctgactgatccttctggtcc

SEQ ID NO: 2322 - DNA, 25 bp, Rattus norvegicus
aaaagctgactgctcccaaggttgt

SEQ ID NO: 2323 - DNA, 25 bp, Rattus norvegicus
aaaagctgactggtcccaaggttgt

SEQ ID NO: 2324 - DNA, 25 bp, Rattus norvegicus
aaaagctgactgttccttctggtcc

SEQ ID NO: 2325 - DNA, 25 bp, Rattus norvegicus
aaaagctgagagacctgcttaagag

SEQ ID NO: 2326 - DNA, 25 bp, Rattus norvegicus
aaaagctgagagtcctgcttaagag

SEQ ID NO: 2327 - DNA, 25 bp, Rattus norvegicus
aaaagctgagatcgttgctgcctcc

SEQ ID NO: 2328 - DNA, 25 bp, Rattus norvegicus
aaaagctgagatggttgctgcctcc

SEQ ID NO: 2329 - DNA, 25 bp, Rattus norvegicus
aaaagctgagcgcacacccttgtaa

SEQ ID NO: 2330 - DNA, 25 bp, Rattus norvegicus
aaaagctgagcggacacccttgtaa

SEQ ID NO: 2331 - DNA, 25 bp, Rattus norvegicus
aaaagctgatacacacttggccctt

SEQ ID NO: 2332 - DNA, 25 bp, Rattus norvegicus
aaaagctgatactcacttggccctt

SEQ ID NO: 2333 - DNA, 25 bp, Rattus norvegicus
aaaagctgcttccttccttggcaga

SEQ ID NO: 2334 - DNA, 25 bp, Rattus norvegicus
aaaagctgcttcgttccttggcaga

SEQ ID NO: 2335 - DNA, 25 bp, Rattus norvegicus
aaaagctgcttgagggagccctggt

SEQ ID NO: 2336 - DNA, 25 bp, Rattus norvegicus
aaaagctgcttgtgggagccctggt

SEQ ID NO: 2337 - DNA, 25 bp, Rattus norvegicus
aaaagctggactcttcttgtcacgt

SEQ ID NO: 2338 - DNA, 25 bp, Rattus norvegicus
aaaagctggactgttcttgtcacgt

SEQ ID NO: 2339 - DNA, 25 bp, Rattus norvegicus
aaaagctggaggaccgccttgctgc

SEQ ID NO: 2340 - DNA, 25 bp, Rattus norvegicus
aaaagctggaggtccgccttgctgc

SEQ ID NO: 2341 - DNA, 25 bp, Rattus norvegicus
aaaagctggatcaggcacccttcca

SEQ ID NO: 2342 - DNA, 25 bp, Rattus norvegicus
aaaagctggatctggcacccttcca

SEQ ID NO: 2343 - DNA, 25 bp, Rattus norvegicus
aaaagctggcccaaatcatttcctc

SEQ ID NO: 2344 - DNA, 25 bp, Rattus norvegicus
aaaagctggccctaatcatttcctc

SEQ ID NO: 2345 - DNA, 25 bp, Rattus norvegicus
aaaagctggcgcagtgtcccagaat

SEQ ID NO: 2346 - DNA, 25 bp, Rattus norvegicus
aaaagctggcgctgtgtcccagaat

SEQ ID NO: 2347 - DNA, 25 bp, Rattus norvegicus
aaaagctggctgcagactgcaccca

SEQ ID NO: 2348 - DNA, 25 bp, Rattus norvegicus
aaaagctggctggagactgcaccca

SEQ ID NO: 2349 - DNA, 25 bp, Rattus norvegicus
aaaagctggcttatgttttgtgctt

SEQ ID NO: 2350 - DNA, 25 bp, Rattus norvegicus
aaaagctggcttttgttttgtgctt

SEQ ID NO: 2351 - DNA, 25 bp, Rattus norvegicus
aaaagctgggatagtgactgcacat

SEQ ID NO: 2352 - DNA, 25 bp, Rattus norvegicus
aaaagctgggattgtgactgcacat

SEQ ID NO: 2353 - DNA, 25 bp, Rattus norvegicus
aaaagctgggcaagcagtctactcc

SEQ ID NO: 2354 - DNA, 25 bp, Rattus norvegicus
aaaagctgggcatgcagtctactcc

SEQ ID NO: 2355 - DNA, 25 bp, Rattus norvegicus
aaaagctggtcacccaatgcctaca

SEQ ID NO: 2356 - DNA, 25 bp, Rattus norvegicus
aaaagctggtcagccaatgcctaca

SEQ ID NO: 2357 - DNA, 25 bp, Rattus norvegicus
aaaagctgtaggcatttctctgttg

SEQ ID NO: 2358 - DNA, 25 bp, Rattus norvegicus
aaaagctgtagggatttctctgttg

SEQ ID NO: 2359 - DNA, 25 bp, Rattus norvegicus
aaaagctgtcatacctttgccaagt

SEQ ID NO: 2360 - DNA, 25 bp, Rattus norvegicus
aaaagctgtcattcctttgccaagt

SEQ ID NO: 2361 - DNA, 25 bp, Rattus norvegicus
aaaagctgtgatctgttcctctaaa

SEQ ID NO: 2362 - DNA, 25 bp, Rattus norvegicus
aaaagctgtgatgtgttcctctaaa

SEQ ID NO: 2363 - DNA, 25 bp, Rattus norvegicus
aaaagctgttccagtctgttgcgca

SEQ ID NO: 2364 - DNA, 25 bp, Rattus norvegicus
aaaagctgttcctgtctgttgcgca

SEQ ID NO: 2365 - DNA, 25 bp, Rattus norvegicus
aaaagcttacaaagctcgggctcca

SEQ ID NO: 2366 - DNA, 25 bp, Rattus norvegicus
aaaagcttacaatgctcgggctcca

SEQ ID NO: 2367 - DNA, 25 bp, Rattus norvegicus
aaaagcttccagatctagcccaagg

SEQ ID NO: 2368 - DNA, 25 bp, Rattus norvegicus
aaaagcttccagttctagcccaagg

SEQ ID NO: 2369 - DNA, 25 bp, Rattus norvegicus
aaaagcttcccaaggcctgtgaaga

SEQ ID NO: 2370 - DNA, 25 bp, Rattus norvegicus
aaaagcttcccaatgtgtgtgaatg

SEQ ID NO: 2371 - DNA, 25 bp, Rattus norvegicus
aaaagcttcccatggcctgtgaaga

SEQ ID NO: 2372 - DNA, 25 bp, Rattus norvegicus
aaaagcttcccattgtgtgtgaatg

SEQ ID NO: 2373 - DNA, 25 bp, Rattus norvegicus
aaaagcttccttcaggctgaggtca

SEQ ID NO: 2374 - DNA, 25 bp, Rattus norvegicus
aaaagcttccttgaggctgaggtca

SEQ ID NO: 2375 - DNA, 25 bp, Rattus norvegicus
aaaagcttctctacgcatagtcacg

SEQ ID NO: 2376 - DNA, 25 bp, Rattus norvegicus
aaaagcttctcttcgcatagtcacg

SEQ ID NO: 2377 - DNA, 25 bp, Rattus norvegicus
aaaagcttctggaggatgtcaatac

SEQ ID NO: 2378 - DNA, 25 bp, Rattus norvegicus
aaaagcttctggtggatgtcaatac

SEQ ID NO: 2379 - DNA, 25 bp, Rattus norvegicus
aaaagcttgcagatactcacgccca

SEQ ID NO: 2380 - DNA, 25 bp, Rattus norvegicus
aaaagcttgcagttactcacgccca

SEQ ID NO: 2381 - DNA, 25 bp, Rattus norvegicus
aaaagcttgctcaatctacctgcag

SEQ ID NO: 2382 - DNA, 25 bp, Rattus norvegicus
aaaagcttgctctatctacctgcag

SEQ ID NO: 2383 - DNA, 25 bp, Rattus norvegicus
aaaagcttgctgaacttcacagaag

SEQ ID NO: 2384 - DNA, 25 bp, Rattus norvegicus
aaaagcttgctgtacttcacagaag

SEQ ID NO: 2385 - DNA, 25 bp, Rattus norvegicus
aaaagcttggtgagtgttacggaca

SEQ ID NO: 2386 - DNA, 25 bp, Rattus norvegicus
aaaagcttggtgtgtgttacggaca

SEQ ID NO: 2387 - DNA, 25 bp, Rattus norvegicus
aaaagcttgtcacttggtctccaga

SEQ ID NO: 2388 - DNA, 25 bp, Rattus norvegicus
aaaagcttgtcagttggtctccaga

SEQ ID NO: 2389 - DNA, 25 bp, Rattus norvegicus
aaaagcttgtcgcttcctttcagaa

SEQ ID NO: 2390 - DNA, 25 bp, Rattus norvegicus
aaaagcttgtcggttcctttcagaa

SEQ ID NO: 2391 - DNA, 25 bp, Rattus norvegicus
aaaagctttaatcccctgcgggcca

SEQ ID NO: 2392 - DNA, 25 bp, Rattus norvegicus
aaaagctttaatgccctgcgggcca

SEQ ID NO: 2393 - DNA, 25 bp, Rattus norvegicus
aaaagcttttctatagcctatcaaa

SEQ ID NO: 2394 - DNA, 25 bp, Rattus norvegicus
aaaagcttttctttagcctatcaaa

SEQ ID NO: 2395 - DNA, 25 bp, Rattus norvegicus
aaaaggaaaaggattcctcaatgct

SEQ ID NO: 2396 - DNA, 25 bp, Rattus norvegicus
aaaaggaaaaggtttcctcaatgct

SEQ ID NO: 2397 - DNA, 25 bp, Rattus norvegicus
aaaaggaaagtccatctggtagtct

SEQ ID NO: 2398 - DNA, 25 bp, Rattus norvegicus
aaaaggaaagtcgatctggtagtct

SEQ ID NO: 2399 - DNA, 25 bp, Rattus norvegicus
aaaaggaagcacaccgccaggatca

SEQ ID NO: 2400 - DNA, 25 bp, Rattus norvegicus
aaaaggaagcactccgccaggatca

SEQ ID NO: 2401 - DNA, 25 bp, Rattus norvegicus
aaaaggaagctacctccacggcatc

SEQ ID NO: 2402 - DNA, 25 bp, Rattus norvegicus
aaaaggaagctagctccacggcatc

SEQ ID NO: 2403 - DNA, 25 bp, Rattus norvegicus
aaaaggaagtcaactgcccctggga

SEQ ID NO: 2404 - DNA, 25 bp, Rattus norvegicus
aaaaggaagtcatctgcccctggga

SEQ ID NO: 2405 - DNA, 25 bp, Rattus norvegicus
aaaaggaagtggacagcagctgttc

SEQ ID NO: 2406 - DNA, 25 bp, Rattus norvegicus
aaaaggaagtggtcagcagctgttc

SEQ ID NO: 2407 - DNA, 25 bp, Rattus norvegicus
aaaaggaatactctccctgcgtctt

SEQ ID NO: 2408 - DNA, 25 bp, Rattus norvegicus
aaaaggaatactgtccctgcgtctt

SEQ ID NO: 2409 - DNA, 25 bp, Rattus norvegicus
aaaaggacaccaacataaccgctct

SEQ ID NO: 2410 - DNA, 25 bp, Rattus norvegicus
aaaaggacaccatcataaccgctct

SEQ ID NO: 2411 - DNA, 25 bp, Rattus norvegicus
aaaaggacaggcacccacagtgatg

SEQ ID NO: 2412 - DNA, 25 bp, Rattus norvegicus
aaaaggacaggctcccacagtgatg

SEQ ID NO: 2413 - DNA, 25 bp, Rattus norvegicus
aaaaggacctgaaaagtctctccag

SEQ ID NO: 2414 - DNA, 25 bp, Rattus norvegicus
aaaaggacctgataagtctctccag

SEQ ID NO: 2415 - DNA, 25 bp, Rattus norvegicus
aaaaggacctggagccagttcctct

SEQ ID NO: 2416 - DNA, 25 bp, Rattus norvegicus
aaaaggacctggtgccagttcctct

SEQ ID NO: 2417 - DNA, 25 bp, Rattus norvegicus
aaaaggacgcagactcggctgcagc

SEQ ID NO: 2418 - DNA, 25 bp, Rattus norvegicus
aaaaggacgcagtctcggctgcagc

SEQ ID NO: 2419 - DNA, 25 bp, Rattus norvegicus
aaaaggactacaccaaggaccccag

SEQ ID NO: 2420 - DNA, 25 bp, Rattus norvegicus
aaaaggactacagcaaggaccccag

SEQ ID NO: 2421 - DNA, 25 bp, Rattus norvegicus
aaaaggactccactatctgtgccct

SEQ ID NO: 2422 - DNA, 25 bp, Rattus norvegicus
aaaaggactccagtatctgtgccct

SEQ ID NO: 2423 - DNA, 25 bp, Rattus norvegicus
aaaaggactcgtcggcgtcagaatt

SEQ ID NO: 2424 - DNA, 25 bp, Rattus norvegicus
aaaaggactcgtgggcgtcagaatt

SEQ ID NO: 2425 - DNA, 25 bp, Rattus norvegicus
aaaaggactggcattttgcgcctca

SEQ ID NO: 2426 - DNA, 25 bp, Rattus norvegicus
aaaaggactggctttttgcgcctca

SEQ ID NO: 2427 - DNA, 25 bp, Rattus norvegicus
aaaaggacttctctgtgccgtttgt

SEQ ID NO: 2428 - DNA, 25 bp, Rattus norvegicus
aaaaggacttctgtgtgccgtttgt

SEQ ID NO: 2429 - DNA, 25 bp, Rattus norvegicus
aaaaggactttcatcctgcttccaa

SEQ ID NO: 2430 - DNA, 25 bp, Rattus norvegicus
aaaaggactttcttcctgcttccaa

SEQ ID NO: 2431 - DNA, 25 bp, Rattus norvegicus
aaaaggagaactcttgcgacgcatg

SEQ ID NO: 2432 - DNA, 25 bp, Rattus norvegicus
aaaaggagaactgttgcgacgcatg

SEQ ID NO: 2433 - DNA, 25 bp, Rattus norvegicus
aaaaggagacagctcgcgtttggct

SEQ ID NO: 2434 - DNA, 25 bp, Rattus norvegicus
aaaaggagacaggtcgcgtttggct

SEQ ID NO: 2435 - DNA, 25 bp, Rattus norvegicus
aaaaggagcctactcccaggctagc

SEQ ID NO: 2436 - DNA, 25 bp, Rattus norvegicus
aaaaggagcctagtcccaggctagc

SEQ ID NO: 2437 - DNA, 25 bp, Rattus norvegicus
aaaaggaggcatcccaagcctgcat

SEQ ID NO: 2438 - DNA, 25 bp, Rattus norvegicus
aaaaggaggcatgccaagcctgcat

SEQ ID NO: 2439 - DNA, 25 bp, Rattus norvegicus
aaaaggaggctgagctccgccgaat

SEQ ID NO: 2440 - DNA, 25 bp, Rattus norvegicus
aaaaggaggctgtgctccgccgaat

SEQ ID NO: 2441 - DNA, 25 bp, Rattus norvegicus
aaaaggatacatattgcaagccaaa

SEQ ID NO: 2442 - DNA, 25 bp, Rattus norvegicus
aaaaggatacattttgcaagccaaa

SEQ ID NO: 2443 - DNA, 25 bp, Rattus norvegicus
aaaaggatacgccacacaggccact

SEQ ID NO: 2444 - DNA, 25 bp, Rattus norvegicus
aaaaggatacgcgacacaggccact

SEQ ID NO: 2445 - DNA, 25 bp, Rattus norvegicus
aaaaggatatctaccaggcccagct

SEQ ID NO: 2446 - DNA, 25 bp, Rattus norvegicus
aaaaggatatcttccaggcccagct

SEQ ID NO: 2447 - DNA, 25 bp, Rattus norvegicus
aaaaggatgcctcttgtttcttgct

SEQ ID NO: 2448 - DNA, 25 bp, Rattus norvegicus
aaaaggatgcctgttgtttcttgct

SEQ ID NO: 2449 - DNA, 25 bp, Rattus norvegicus
aaaaggatgctaatggaccactagg

SEQ ID NO: 2450 - DNA, 25 bp, Rattus norvegicus
aaaaggatgctattggaccactagg

SEQ ID NO: 2451 - DNA, 25 bp, Rattus norvegicus
aaaaggatgcttctgaccccaactg

SEQ ID NO: 2452 - DNA, 25 bp, Rattus norvegicus
aaaaggatgcttgtgaccccaactg

SEQ ID NO: 2453 - DNA, 25 bp, Rattus norvegicus
aaaaggatggtcactctgtctttag

SEQ ID NO: 2454 - DNA, 25 bp, Rattus norvegicus
aaaaggatggtctctctgtctttag

SEQ ID NO: 2455 - DNA, 25 bp, Rattus norvegicus
aaaaggatgtcacatcacctggagc

SEQ ID NO: 2456 - DNA, 25 bp, Rattus norvegicus
aaaaggatgtcagatcacctggagc

SEQ ID NO: 2457 - DNA, 25 bp, Rattus norvegicus
aaaaggatgtccaggctggctgtgc

SEQ ID NO: 2458 - DNA, 25 bp, Rattus norvegicus
aaaaggatgtcctggctggctgtgc

SEQ ID NO: 2459 - DNA, 25 bp, Rattus norvegicus
aaaaggattttcacacttggattct

SEQ ID NO: 2460 - DNA, 25 bp, Rattus norvegicus
aaaaggattttctcacttggattct

SEQ ID NO: 2461 - DNA, 25 bp, Rattus norvegicus
aaaaggcaagaacctgctgcagggc

SEQ ID NO: 2462 - DNA, 25 bp, Rattus norvegicus
aaaaggcaagaagctgctgcagggc

SEQ ID NO: 2463 - DNA, 25 bp, Rattus norvegicus
aaaaggcacaatcgctacagcagaa

SEQ ID NO: 2464 - DNA, 25 bp, Rattus norvegicus
aaaaggcacaatggctacagcagaa

SEQ ID NO: 2465 - DNA, 25 bp, Rattus norvegicus
aaaaggcactgaatattccacccag

SEQ ID NO: 2466 - DNA, 25 bp, Rattus norvegicus
aaaaggcactgattattccacccag

SEQ ID NO: 2467 - DNA, 25 bp, Rattus norvegicus
aaaaggcagaccaccctgtaaacag

SEQ ID NO: 2468 - DNA, 25 bp, Rattus norvegicus
aaaaggcagacctccctgtaaacag

SEQ ID NO: 2469 - DNA, 25 bp, Rattus norvegicus
aaaaggcagcacactagctttgcac

SEQ ID NO: 2470 - DNA, 25 bp, Rattus norvegicus
aaaaggcagcactctagctttgcac

SEQ ID NO: 2471 - DNA, 25 bp, Rattus norvegicus
aaaaggcagcctccattgccgagca

SEQ ID NO: 2472 - DNA, 25 bp, Rattus norvegicus
aaaaggcagcctgcattgccgagca

SEQ ID NO: 2473 - DNA, 25 bp, Rattus norvegicus
aaaaggcaggcacccacattcagac

SEQ ID NO: 2474 - DNA, 25 bp, Rattus norvegicus
aaaaggcaggcagccacattcagac

SEQ ID NO: 2475 - DNA, 25 bp, Rattus norvegicus
aaaaggcatccaccttgcaggaggt

SEQ ID NO: 2476 - DNA, 25 bp, Rattus norvegicus
aaaaggcatccagcttgcaggaggt

SEQ ID NO: 2477 - DNA, 25 bp, Rattus norvegicus
aaaaggcatcccaaataatcccgct

SEQ ID NO: 2478 - DNA, 25 bp, Rattus norvegicus
aaaaggcatccctaataatcccgct

SEQ ID NO: 2479 - DNA, 25 bp, Rattus norvegicus
aaaaggcatcggctaaacctcccag

SEQ ID NO: 2480 - DNA, 25 bp, Rattus norvegicus
aaaaggcatcgggtaaacctcccag

SEQ ID NO: 2481 - DNA, 25 bp, Rattus norvegicus
aaaaggcatgtacgcacctgtgtcc

SEQ ID NO: 2482 - DNA, 25 bp, Rattus norvegicus
aaaaggcatgtaggcacctgtgtcc

SEQ ID NO: 2483 - DNA, 25 bp, Rattus norvegicus
aaaaggcattctatctttgctacct

SEQ ID NO: 2484 - DNA, 25 bp, Rattus norvegicus
aaaaggcattctttctttgctacct

SEQ ID NO: 2485 - DNA, 25 bp, Rattus norvegicus
aaaaggcattgtcctctccattgag

SEQ ID NO: 2486 - DNA, 25 bp, Rattus norvegicus
aaaaggcattgtgctctccattgag

SEQ ID NO: 2487 - DNA, 25 bp, Rattus norvegicus
aaaaggcatttacagccaggcccta

SEQ ID NO: 2488 - DNA, 25 bp, Rattus norvegicus
aaaaggcatttagagccaggcccta

SEQ ID NO: 2489 - DNA, 25 bp, Rattus norvegicus
aaaaggccaagacccacctggagct

SEQ ID NO: 2490 - DNA, 25 bp, Rattus norvegicus
aaaaggccaagagccacctggagct

SEQ ID NO: 2491 - DNA, 25 bp, Rattus norvegicus
aaaaggccacatcttgtccctgagc

SEQ ID NO: 2492 - DNA, 25 bp, Rattus norvegicus
aaaaggccacatgttgtccctgagc

SEQ ID NO: 2493 - DNA, 25 bp, Rattus norvegicus
aaaaggccagctagccgggagtgaa

SEQ ID NO: 2494 - DNA, 25 bp, Rattus norvegicus
aaaaggccagctatgtcttgcttcc

SEQ ID NO: 2495 - DNA, 25 bp, Rattus norvegicus
aaaaggccagcttgccgggagtgaa

SEQ ID NO: 2496 - DNA, 25 bp, Rattus norvegicus
aaaaggccagctttgtcttgcttcc

SEQ ID NO: 2497 - DNA, 25 bp, Rattus norvegicus
aaaaggccagtccatcgacgacatg

SEQ ID NO: 2498 - DNA, 25 bp, Rattus norvegicus
aaaaggccagtcgatcgacgacatg

SEQ ID NO: 2499 - DNA, 25 bp, Rattus norvegicus
aaaaggccatccctcagacggatga

SEQ ID NO: 2500 - DNA, 25 bp, Rattus norvegicus
aaaaggccatccgtcagacggatga

SEQ ID NO: 2501 - DNA, 25 bp, Rattus norvegicus
aaaaggcccaagctgcagagaacct

SEQ ID NO: 2502 - DNA, 25 bp, Rattus norvegicus
aaaaggcccaaggtgcagagaacct

SEQ ID NO: 2503 - DNA, 25 bp, Rattus norvegicus
aaaaggcccacacccgacaggagct

SEQ ID NO: 2504 - DNA, 25 bp, Rattus norvegicus
aaaaggcccacagccgacaggagct

SEQ ID NO: 2505 - DNA, 25 bp, Rattus norvegicus
aaaaggccccatatgctgcctctgt

SEQ ID NO: 2506 - DNA, 25 bp, Rattus norvegicus
aaaaggccccatttgctgcctctgt

SEQ ID NO: 2507 - DNA, 25 bp, Rattus norvegicus
aaaaggccgatgagaagcgatccga

SEQ ID NO: 2508 - DNA, 25 bp, Rattus norvegicus
aaaaggccgatgtgaagcgatccga

SEQ ID NO: 2509 - DNA, 25 bp, Rattus norvegicus
aaaaggcctcggatgtggcttccag

SEQ ID NO: 2510 - DNA, 25 bp, Rattus norvegicus
aaaaggcctcggttgtggcttccag

SEQ ID NO: 2511 - DNA, 25 bp, Rattus norvegicus
aaaaggcctggcaccacagcgtggc

SEQ ID NO: 2512 - DNA, 25 bp, Rattus norvegicus
aaaaggcctggctccacagcgtggc

SEQ ID NO: 2513 - DNA, 25 bp, Rattus norvegicus
aaaaggcgagctctagccccatgct

SEQ ID NO: 2514 - DNA, 25 bp, Rattus norvegicus
aaaaggcgagctgtagccccatgct

SEQ ID NO: 2515 - DNA, 25 bp, Rattus norvegicus
aaaaggcgcctcctggaagcgaact

SEQ ID NO: 2516 - DNA, 25 bp, Rattus norvegicus
aaaaggcgcctcgtggaagcgaact

SEQ ID NO: 2517 - DNA, 25 bp, Rattus norvegicus
aaaaggcggcagcaccaactagcaa

SEQ ID NO: 2518 - DNA, 25 bp, Rattus norvegicus
aaaaggcggcaggaccaactagcaa

SEQ ID NO: 2519 - DNA, 25 bp, Rattus norvegicus
aaaaggctcaacctcaagcagtaat

SEQ ID NO: 2520 - DNA, 25 bp, Rattus norvegicus
aaaaggctcaacgtcaagcagtaat

SEQ ID NO: 2521 - DNA, 25 bp, Rattus norvegicus
aaaaggctccgtcttgacaagtggt

SEQ ID NO: 2522 - DNA, 25 bp, Rattus norvegicus
aaaaggctccgtgttgacaagtggt

SEQ ID NO: 2523 - DNA, 25 bp, Rattus norvegicus
aaaaggctccttactgagaagcaat

SEQ ID NO: 2524 - DNA, 25 bp, Rattus norvegicus
aaaaggctcctttctgagaagcaat

SEQ ID NO: 2525 - DNA, 25 bp, Rattus norvegicus
aaaaggctctggctattctgtctct

SEQ ID NO: 2526 - DNA, 25 bp, Rattus norvegicus
aaaaggctctgggtattctgtctct

SEQ ID NO: 2527 - DNA, 25 bp, Rattus norvegicus
aaaaggctggccaagttgggactct

SEQ ID NO: 2528 - DNA, 25 bp, Rattus norvegicus
aaaaggctggcctagttgggactct

SEQ ID NO: 2529 - DNA, 25 bp, Rattus norvegicus
aaaaggctgggcaacacaatggcaa

SEQ ID NO: 2530 - DNA, 25 bp, Rattus norvegicus
aaaaggctgggctacacaatggcaa

SEQ ID NO: 2531 - DNA, 25 bp, Rattus norvegicus
aaaaggcttagaccaacctcatgca

SEQ ID NO: 2532 - DNA, 25 bp, Rattus norvegicus
aaaaggcttagagcaacctcatgca

SEQ ID NO: 2533 - DNA, 25 bp, Rattus norvegicus
aaaaggcttcgtcctgcttgcaggg

SEQ ID NO: 2534 - DNA, 25 bp, Rattus norvegicus
aaaaggcttcgtgctgcttgcaggg

SEQ ID NO: 2535 - DNA, 25 bp, Rattus norvegicus
aaaaggcttcttactgagcagattt

SEQ ID NO: 2536 - DNA, 25 bp, Rattus norvegicus
aaaaggcttctttctgagcagattt

SEQ ID NO: 2537 - DNA, 25 bp, Rattus norvegicus
aaaaggcttgcacaatccgcggcta

SEQ ID NO: 2538 - DNA, 25 bp, Rattus norvegicus
aaaaggcttgcagaatccgcggcta

SEQ ID NO: 2539 - DNA, 25 bp, Rattus norvegicus
aaaaggcttgcgactgtagttcatg

SEQ ID NO: 2540 - DNA, 25 bp, Rattus norvegicus
aaaaggcttgcgtctgtagttcatg

SEQ ID NO: 2541 - DNA, 25 bp, Rattus norvegicus
aaaaggcttgctccgtaaacaatga

SEQ ID NO: 2542 - DNA, 25 bp, Rattus norvegicus
aaaaggcttgctgcgtaaacaatga

SEQ ID NO: 2543 - DNA, 25 bp, Rattus norvegicus
aaaagggacttcagctgcctgggcc

SEQ ID NO: 2544 - DNA, 25 bp, Rattus norvegicus
aaaagggacttctgctgcctgggcc

SEQ ID NO: 2545 - DNA, 25 bp, Rattus norvegicus
aaaagggattgtcagctgccataaa

SEQ ID NO: 2546 - DNA, 25 bp, Rattus norvegicus
aaaagggattgtgagctgccataaa

SEQ ID NO: 2547 - DNA, 25 bp, Rattus norvegicus
aaaagggcaagaccgtcttcgttga

SEQ ID NO: 2548 - DNA, 25 bp, Rattus norvegicus
aaaagggcaagagcgtcttcgttga

SEQ ID NO: 2549 - DNA, 25 bp, Rattus norvegicus
aaaagggcacttagggtacagatgg

SEQ ID NO: 2550 - DNA, 25 bp, Rattus norvegicus
aaaagggcactttgggtacagatgg

SEQ ID NO: 2551 - DNA, 25 bp, Rattus norvegicus
aaaagggcagaactccaggaatgta

SEQ ID NO: 2552 - DNA, 25 bp, Rattus norvegicus
aaaagggcagaagtccaggaatgta

SEQ ID NO: 2553 - DNA, 25 bp, Rattus norvegicus
aaaagggcatcgatgtcaaatgtat

SEQ ID NO: 2554 - DNA, 25 bp, Rattus norvegicus
aaaagggcatcgttgtcaaatgtat

SEQ ID NO: 2555 - DNA, 25 bp, Rattus norvegicus
aaaagggcatgtccagctgcagtca

SEQ ID NO: 2556 - DNA, 25 bp, Rattus norvegicus
aaaagggcatgtgcagctgcagtca

SEQ ID NO: 2557 - DNA, 25 bp, Rattus norvegicus
aaaagggccacaattgggcttcctg

SEQ ID NO: 2558 - DNA, 25 bp, Rattus norvegicus
aaaagggccacatttgggcttcctg

SEQ ID NO: 2559 - DNA, 25 bp, Rattus norvegicus
aaaagggccaggagttctgttcttg

SEQ ID NO: 2560 - DNA, 25 bp, Rattus norvegicus
aaaagggccaggtgttctgttcttg

SEQ ID NO: 2561 - DNA, 25 bp, Rattus norvegicus
aaaagggcctttccttctgatgaaa

SEQ ID NO: 2562 - DNA, 25 bp, Rattus norvegicus
aaaagggcctttgcttctgatgaaa

SEQ ID NO: 2563 - DNA, 25 bp, Rattus norvegicus
aaaagggcgcggagagccagatgaa

SEQ ID NO: 2564 - DNA, 25 bp, Rattus norvegicus
aaaagggcgcggtgagccagatgaa

SEQ ID NO: 2565 - DNA, 25 bp, Rattus norvegicus
aaaagggcttggactgtgctcacat

SEQ ID NO: 2566 - DNA, 25 bp, Rattus norvegicus
aaaagggcttggtctgtgctcacat

SEQ ID NO: 2567 - DNA, 25 bp, Rattus norvegicus
aaaagggtccggagcttggccgcat

SEQ ID NO: 2568 - DNA, 25 bp, Rattus norvegicus
aaaagggtccggtgcttggccgcat

SEQ ID NO: 2569 - DNA, 25 bp, Rattus norvegicus
aaaagggtcttcactatgtctacaa

SEQ ID NO: 2570 - DNA, 25 bp, Rattus norvegicus
aaaagggtcttctctatgtctacaa

SEQ ID NO: 2571 - DNA, 25 bp, Rattus norvegicus
aaaagggtcttgagcgtgtctacat

SEQ ID NO: 2572 - DNA, 25 bp, Rattus norvegicus
aaaagggtcttgtgcgtgtctacat

SEQ ID NO: 2573 - DNA, 25 bp, Rattus norvegicus
aaaagggtgactacagtggccagat

SEQ ID NO: 2574 - DNA, 25 bp, Rattus norvegicus
aaaagggtgacttcagtggccagat

SEQ ID NO: 2575 - DNA, 25 bp, Rattus norvegicus
aaaagggtgatgactctccgccaga

SEQ ID NO: 2576 - DNA, 25 bp, Rattus norvegicus
aaaagggtgatgtctctccgccaga

SEQ ID NO: 2577 - DNA, 25 bp, Rattus norvegicus
aaaagggtgtgactctgatgttgaa

SEQ ID NO: 2578 - DNA, 25 bp, Rattus norvegicus
aaaagggtgtgagtctgatgttgaa

SEQ ID NO: 2579 - DNA, 25 bp, Rattus norvegicus
aaaagggtgttgacgctgacattac

SEQ ID NO: 2580 - DNA, 25 bp, Rattus norvegicus
aaaagggtgttgtcgctgacattac

SEQ ID NO: 2581 - DNA, 25 bp, Rattus norvegicus
aaaagggttccaacacgcatagaag

SEQ ID NO: 2582 - DNA, 25 bp, Rattus norvegicus
aaaagggttccatcacgcatagaag

SEQ ID NO: 2583 - DNA, 25 bp, Rattus norvegicus
aaaagggttctgctgttgcaggtct

SEQ ID NO: 2584 - DNA, 25 bp, Rattus norvegicus
aaaagggttctggtgttgcaggtct

SEQ ID NO: 2585 - DNA, 25 bp, Rattus norvegicus
aaaagggttgtaagctcgtggccgt

SEQ ID NO: 2586 - DNA, 25 bp, Rattus norvegicus
aaaagggttgtatgctcgtggccgt

SEQ ID NO: 2587 - DNA, 25 bp, Rattus norvegicus
aaaaggtaccacattctcactcaaa

SEQ ID NO: 2588 - DNA, 25 bp, Rattus norvegicus
aaaaggtaccactttctcactcaaa

SEQ ID NO: 2589 - DNA, 25 bp, Rattus norvegicus
aaaaggtcacggatcgcctacagtg

SEQ ID NO: 2590 - DNA, 25 bp, Rattus norvegicus
aaaaggtcacggttcgcctacagtg

SEQ ID NO: 2591 - DNA, 25 bp, Rattus norvegicus
aaaaggtcactgaaactcaagatta

SEQ ID NO: 2592 - DNA, 25 bp, Rattus norvegicus
aaaaggtcactgtaactcaagatta

SEQ ID NO: 2593 - DNA, 25 bp, Rattus norvegicus
aaaaggtcagaactgccaaggcatg

SEQ ID NO: 2594 - DNA, 25 bp, Rattus norvegicus
aaaaggtcagaagtgccaaggcatg

SEQ ID NO: 2595 - DNA, 25 bp, Rattus norvegicus
aaaaggtcagacatagtggcgccac

SEQ ID NO: 2596 - DNA, 25 bp, Rattus norvegicus
aaaaggtcagacttagtggcgccac

SEQ ID NO: 2597 - DNA, 25 bp, Rattus norvegicus
aaaaggtcagttcaagtcatctcaa

SEQ ID NO: 2598 - DNA, 25 bp, Rattus norvegicus
aaaaggtcagttgaagtcatctcaa

SEQ ID NO: 2599 - DNA, 25 bp, Rattus norvegicus
aaaaggtcatttctgtcttcacaca

SEQ ID NO: 2600 - DNA, 25 bp, Rattus norvegicus
aaaaggtcatttgtgtcttcacaca

SEQ ID NO: 2601 - DNA, 25 bp, Rattus norvegicus
aaaaggtccagcaggagcacctaga

SEQ ID NO: 2602 - DNA, 25 bp, Rattus norvegicus
aaaaggtccagctggagcacctaga

SEQ ID NO: 2603 - DNA, 25 bp, Rattus norvegicus
aaaaggtccattaccagcagtatca

SEQ ID NO: 2604 - DNA, 25 bp, Rattus norvegicus
aaaaggtccatttccagcagtatca

SEQ ID NO: 2605 - DNA, 25 bp, Rattus norvegicus
aaaaggtctcccactgtctctgagc

SEQ ID NO: 2606 - DNA, 25 bp, Rattus norvegicus
aaaaggtctccctctgtctctgagc

SEQ ID NO: 2607 - DNA, 25 bp, Rattus norvegicus
aaaaggtctctcattgaacctggag

SEQ ID NO: 2608 - DNA, 25 bp, Rattus norvegicus
aaaaggtctctctttgaacctggag

SEQ ID NO: 2609 - DNA, 25 bp, Rattus norvegicus
aaaaggtctgcaccgaacccacaag

SEQ ID NO: 2610 - DNA, 25 bp, Rattus norvegicus
aaaaggtctgcagcgaacccacaag

SEQ ID NO: 2611 - DNA, 25 bp, Rattus norvegicus
aaaaggtctggtctcataggtgaaa

SEQ ID NO: 2612 - DNA, 25 bp, Rattus norvegicus
aaaaggtctggtgtcataggtgaaa

SEQ ID NO: 2613 - DNA, 25 bp, Rattus norvegicus
aaaaggtgaccgcatcgcgcagctc

SEQ ID NO: 2614 - DNA, 25 bp, Rattus norvegicus
aaaaggtgaccggatcgcgcagctc

SEQ ID NO: 2615 - DNA, 25 bp, Rattus norvegicus
aaaaggtgatctaccggtgtcctga

SEQ ID NO: 2616 - DNA, 25 bp, Rattus norvegicus
aaaaggtgatcttccggtgtcctga

SEQ ID NO: 2617 - DNA, 25 bp, Rattus norvegicus
aaaaggtgcaacacgggaggcacac

SEQ ID NO: 2618 - DNA, 25 bp, Rattus norvegicus
aaaaggtgcaactcgggaggcacac

SEQ ID NO: 2619 - DNA, 25 bp, Rattus norvegicus
aaaaggtgcttcacagcatccttgc

SEQ ID NO: 2620 - DNA, 25 bp, Rattus norvegicus
aaaaggtgcttctcagcatccttgc

SEQ ID NO: 2621 - DNA, 25 bp, Rattus norvegicus
aaaaggtggctcatggctactcagt

SEQ ID NO: 2622 - DNA, 25 bp, Rattus norvegicus
aaaaggtggctcttggctactcagt

SEQ ID NO: 2623 - DNA, 25 bp, Rattus norvegicus
aaaaggtggctgctctgttctcctg

SEQ ID NO: 2624 - DNA, 25 bp, Rattus norvegicus
aaaaggtggctggtctgttctcctg

SEQ ID NO: 2625 - DNA, 25 bp, Rattus norvegicus
aaaaggtgtccactgcaagccaagt

SEQ ID NO: 2626 - DNA, 25 bp, Rattus norvegicus
aaaaggtgtccagtgcaagccaagt

SEQ ID NO: 2627 - DNA, 25 bp, Rattus norvegicus
aaaaggtgtcgtctgtgctatgaga

SEQ ID NO: 2628 - DNA, 25 bp, Rattus norvegicus
aaaaggtgtcgtgtgtgctatgaga

SEQ ID NO: 2629 - DNA, 25 bp, Rattus norvegicus
aaaaggtgtgcgcagaccaggtaca

SEQ ID NO: 2630 - DNA, 25 bp, Rattus norvegicus
aaaaggtgtgcggagaccaggtaca

SEQ ID NO: 2631 - DNA, 25 bp, Rattus norvegicus
aaaaggttattacttccaccatcat

SEQ ID NO: 2632 - DNA, 25 bp, Rattus norvegicus
aaaaggttattagttccaccatcat

SEQ ID NO: 2633 - DNA, 25 bp, Rattus norvegicus
aaaaggttctcaacaccccagaaag

SEQ ID NO: 2634 - DNA, 25 bp, Rattus norvegicus
aaaaggttctcatcaccccagaaag

SEQ ID NO: 2635 - DNA, 25 bp, Rattus norvegicus
aaaaggttgcaaatgtctgtccaga

SEQ ID NO: 2636 - DNA, 25 bp, Rattus norvegicus
aaaaggttgcaattgtctgtccaga

SEQ ID NO: 2637 - DNA, 25 bp, Rattus norvegicus
aaaaggtttcttactgcagccaatc

SEQ ID NO: 2638 - DNA, 25 bp, Rattus norvegicus
aaaaggtttctttctgcagccaatc

SEQ ID NO: 2639 - DNA, 25 bp, Rattus norvegicus
aaaagtaaactccatcaccgtcgat

SEQ ID NO: 2640 - DNA, 25 bp, Rattus norvegicus
aaaagtaaactcgatcaccgtcgat

SEQ ID NO: 2641 - DNA, 25 bp, Rattus norvegicus
aaaagtaaaggcagcgaccgcggcg

SEQ ID NO: 2642 - DNA, 25 bp, Rattus norvegicus
aaaagtaaaggctgcgaccgcggcg

SEQ ID NO: 2643 - DNA, 25 bp, Rattus norvegicus
aaaagtaagcgtcctctggcttctc

SEQ ID NO: 2644 - DNA, 25 bp, Rattus norvegicus
aaaagtaagcgtgctctggcttctc

SEQ ID NO: 2645 - DNA, 25 bp, Rattus norvegicus
aaaagtaatgagatcccctccacgg

SEQ ID NO: 2646 - DNA, 25 bp, Rattus norvegicus
aaaagtaatgagttcccctccacgg

SEQ ID NO: 2647 - DNA, 25 bp, Rattus norvegicus
aaaagtacagcgagttcagtgaagt

SEQ ID NO: 2648 - DNA, 25 bp, Rattus norvegicus
aaaagtacagcgtgttcagtgaagt

SEQ ID NO: 2649 - DNA, 25 bp, Rattus norvegicus
aaaagtacatgacttacctgcctcc

SEQ ID NO: 2650 - DNA, 25 bp, Rattus norvegicus
aaaagtacatgagttacctgcctcc

SEQ ID NO: 2651 - DNA, 25 bp, Rattus norvegicus
aaaagtacgtgcattctcgattcct

SEQ ID NO: 2652 - DNA, 25 bp, Rattus norvegicus
aaaagtacgtgctttctcgattcct

SEQ ID NO: 2653 - DNA, 25 bp, Rattus norvegicus
aaaagtactctcactttcattccta

SEQ ID NO: 2654 - DNA, 25 bp, Rattus norvegicus
aaaagtactctctctttcattccta

SEQ ID NO: 2655 - DNA, 25 bp, Rattus norvegicus
aaaagtactgtcattgcaacctgaa

SEQ ID NO: 2656 - DNA, 25 bp, Rattus norvegicus
aaaagtactgtctttgcaacctgaa

SEQ ID NO: 2657 - DNA, 25 bp, Rattus norvegicus
aaaagtagcattatcatgaggctgg

SEQ ID NO: 2658 - DNA, 25 bp, Rattus norvegicus
aaaagtagcattttcatgaggctgg

SEQ ID NO: 2659 - DNA, 25 bp, Rattus norvegicus
aaaagtagccacatgggcctcgatc

SEQ ID NO: 2660 - DNA, 25 bp, Rattus norvegicus
aaaagtagccacttgggcctcgatc

SEQ ID NO: 2661 - DNA, 25 bp, Rattus norvegicus
aaaagtagccttcgcaatctctccc

SEQ ID NO: 2662 - DNA, 25 bp, Rattus norvegicus
aaaagtagccttggcaatctctccc

SEQ ID NO: 2663 - DNA, 25 bp, Rattus norvegicus
aaaagtagctggctcttctgtgctc

SEQ ID NO: 2664 - DNA, 25 bp, Rattus norvegicus
aaaagtagctgggtcttctgtgctc

SEQ ID NO: 2665 - DNA, 25 bp, Rattus norvegicus
aaaagtagcttgcatgtgtttaatt

SEQ ID NO: 2666 - DNA, 25 bp, Rattus norvegicus
aaaagtagcttggatgtgtttaatt

SEQ ID NO: 2667 - DNA, 25 bp, Rattus norvegicus
aaaagtagggctctgttccacgtgt

SEQ ID NO: 2668 - DNA, 25 bp, Rattus norvegicus
aaaagtagggctgtgttccacgtgt

SEQ ID NO: 2669 - DNA, 25 bp, Rattus norvegicus
aaaagtagtcatactcctgtctcag

SEQ ID NO: 2670 - DNA, 25 bp, Rattus norvegicus
aaaagtagtcattctcctgtctcag

SEQ ID NO: 2671 - DNA, 25 bp, Rattus norvegicus
aaaagtatagtcctcctagctgcca

SEQ ID NO: 2672 - DNA, 25 bp, Rattus norvegicus
aaaagtatagtcgtcctagctgcca

SEQ ID NO: 2673 - DNA, 25 bp, Rattus norvegicus
aaaagtatcatcatatcctgggact

SEQ ID NO: 2674 - DNA, 25 bp, Rattus norvegicus
aaaagtatcatcttatcctgggact

SEQ ID NO: 2675 - DNA, 25 bp, Rattus norvegicus
aaaagtatcgccattcatgagaaag

SEQ ID NO: 2676 - DNA, 25 bp, Rattus norvegicus
aaaagtatcgcctttcatgagaaag

SEQ ID NO: 2677 - DNA, 25 bp, Rattus norvegicus
aaaagtatcgctaccttacacataa

SEQ ID NO: 2678 - DNA, 25 bp, Rattus norvegicus
aaaagtatcgcttccttacacataa

SEQ ID NO: 2679 - DNA, 25 bp, Rattus norvegicus
aaaagtatctcaagagcccagcctc

SEQ ID NO: 2680 - DNA, 25 bp, Rattus norvegicus
aaaagtatctcatgagcccagcctc

SEQ ID NO: 2681 - DNA, 25 bp, Rattus norvegicus
aaaagtatctgcatgcttgccgagc

SEQ ID NO: 2682 - DNA, 25 bp, Rattus norvegicus
aaaagtatctgcttgcttgccgagc

SEQ ID NO: 2683 - DNA, 25 bp, Rattus norvegicus
aaaagtattctccttgacccctgat

SEQ ID NO: 2684 - DNA, 25 bp, Rattus norvegicus
aaaagtattctcgttgacccctgat

SEQ ID NO: 2685 - DNA, 25 bp, Rattus norvegicus
aaaagtattctgatgtgtctgatgt

SEQ ID NO: 2686 - DNA, 25 bp, Rattus norvegicus
aaaagtattctgttgtgtctgatgt

SEQ ID NO: 2687 - DNA, 25 bp, Rattus norvegicus
aaaagtcaagcgactgtgaggccag

SEQ ID NO: 2688 - DNA, 25 bp, Rattus norvegicus
aaaagtcaagcgtctgtgaggccag

SEQ ID NO: 2689 - DNA, 25 bp, Rattus norvegicus
aaaagtcaatctaggctgtgtgtct

SEQ ID NO: 2690 - DNA, 25 bp, Rattus norvegicus
aaaagtcaatcttggctgtgtgtct

SEQ ID NO: 2691 - DNA, 25 bp, Rattus norvegicus
aaaagtcacaatctggatccagggc

SEQ ID NO: 2692 - DNA, 25 bp, Rattus norvegicus
aaaagtcacaatgtggatccagggc

SEQ ID NO: 2693 - DNA, 25 bp, Rattus norvegicus
aaaagtcaccagactcccatcaaag

SEQ ID NO: 2694 - DNA, 25 bp, Rattus norvegicus
aaaagtcaccagtctcccatcaaag

SEQ ID NO: 2695 - DNA, 25 bp, Rattus norvegicus
aaaagtcaccatcgcgtacctatga

SEQ ID NO: 2696 - DNA, 25 bp, Rattus norvegicus
aaaagtcaccatggcgtacctatga

SEQ ID NO: 2697 - DNA, 25 bp, Rattus norvegicus
aaaagtcacccgacgtcagaggcaa

SEQ ID NO: 2698 - DNA, 25 bp, Rattus norvegicus
aaaagtcacccgtcgtcagaggcaa

SEQ ID NO: 2699 - DNA, 25 bp, Rattus norvegicus
aaaagtcactctacagggccaagca

SEQ ID NO: 2700 - DNA, 25 bp, Rattus norvegicus
aaaagtcactcttcagggccaagca

SEQ ID NO: 2701 - DNA, 25 bp, Rattus norvegicus
aaaagtcactgtcccagagagccat

SEQ ID NO: 2702 - DNA, 25 bp, Rattus norvegicus
aaaagtcactgtgccagagagccat

SEQ ID NO: 2703 - DNA, 25 bp, Rattus norvegicus
aaaagtcagattcttcaagttgtga

SEQ ID NO: 2704 - DNA, 25 bp, Rattus norvegicus
aaaagtcagattgttcaagttgtga

SEQ ID NO: 2705 - DNA, 25 bp, Rattus norvegicus
aaaagtcaggttaaggcagtccgag

SEQ ID NO: 2706 - DNA, 25 bp, Rattus norvegicus
aaaagtcaggtttaggcagtccgag

SEQ ID NO: 2707 - DNA, 25 bp, Rattus norvegicus
aaaagtcatactctgtctccttgcc

SEQ ID NO: 2708 - DNA, 25 bp, Rattus norvegicus
aaaagtcatactgtgtctccttgcc

SEQ ID NO: 2709 - DNA, 25 bp, Rattus norvegicus
aaaagtccaagcagtatcaccaggg

SEQ ID NO: 2710 - DNA, 25 bp, Rattus norvegicus
aaaagtccaagctgtatcaccaggg

SEQ ID NO: 2711 - DNA, 25 bp, Rattus norvegicus
aaaagtccagctcactggtttctcc

SEQ ID NO: 2712 - DNA, 25 bp, Rattus norvegicus
aaaagtccagctgactggtttctcc

SEQ ID NO: 2713 - DNA, 25 bp, Rattus norvegicus
aaaagtccagttactacagctgtgg

SEQ ID NO: 2714 - DNA, 25 bp, Rattus norvegicus
aaaagtccagtttctacagctgtgg

SEQ ID NO: 2715 - DNA, 25 bp, Rattus norvegicus
aaaagtccattgaatttagcccaat

SEQ ID NO: 2716 - DNA, 25 bp, Rattus norvegicus
aaaagtccattgtatttagcccaat

SEQ ID NO: 2717 - DNA, 25 bp, Rattus norvegicus
aaaagtccatttcgcctcagtctgc

SEQ ID NO: 2718 - DNA, 25 bp, Rattus norvegicus
aaaagtccatttggcctcagtctgc

SEQ ID NO: 2719 - DNA, 25 bp, Rattus norvegicus
aaaagtcccagtaatgccgttctct

SEQ ID NO: 2720 - DNA, 25 bp, Rattus norvegicus
aaaagtcccagtctgctttggaaga

SEQ ID NO: 2721 - DNA, 25 bp, Rattus norvegicus
aaaagtcccagtgtgctttggaaga

SEQ ID NO: 2722 - DNA, 25 bp, Rattus norvegicus
aaaagtcccagttatgccgttctct

SEQ ID NO: 2723 - DNA, 25 bp, Rattus norvegicus
aaaagtccctggatatctcagtgtg

SEQ ID NO: 2724 - DNA, 25 bp, Rattus norvegicus
aaaagtccctggttatctcagtgtg

SEQ ID NO: 2725 - DNA, 25 bp, Rattus norvegicus
aaaagtcctgctcatttgcgctatt

SEQ ID NO: 2726 - DNA, 25 bp, Rattus norvegicus
aaaagtcctgctgatttgcgctatt

SEQ ID NO: 2727 - DNA, 25 bp, Rattus norvegicus
aaaagtcctgggatgagatgttaga

SEQ ID NO: 2728 - DNA, 25 bp, Rattus norvegicus
aaaagtcctgggttgagatgttaga

SEQ ID NO: 2729 - DNA, 25 bp, Rattus norvegicus
aaaagtccttttcctgctggagagt

SEQ ID NO: 2730 - DNA, 25 bp, Rattus norvegicus
aaaagtccttttgctgctggagagt

SEQ ID NO: 2731 - DNA, 25 bp, Rattus norvegicus
aaaagtctactgaggccatgaatac

SEQ ID NO: 2732 - DNA, 25 bp, Rattus norvegicus
aaaagtctactgtggccatgaatac

SEQ ID NO: 2733 - DNA, 25 bp, Rattus norvegicus
aaaagtctagttatggcattgccaa

SEQ ID NO: 2734 - DNA, 25 bp, Rattus norvegicus
aaaagtctagttttggcattgccaa

SEQ ID NO: 2735 - DNA, 25 bp, Rattus norvegicus
aaaagtctcagaatgcctctcagct

SEQ ID NO: 2736 - DNA, 25 bp, Rattus norvegicus
aaaagtctcagattgcctctcagct

SEQ ID NO: 2737 - DNA, 25 bp, Rattus norvegicus
aaaagtctcattccttgcagcttac

SEQ ID NO: 2738 - DNA, 25 bp, Rattus norvegicus
aaaagtctcattcttaatcgggcat

SEQ ID NO: 2739 - DNA, 25 bp, Rattus norvegicus
aaaagtctcattgcttgcagcttac

SEQ ID NO: 2740 - DNA, 25 bp, Rattus norvegicus
aaaagtctcattgttaatcgggcat

SEQ ID NO: 2741 - DNA, 25 bp, Rattus norvegicus
aaaagtctcgaccatggatcagcat

SEQ ID NO: 2742 - DNA, 25 bp, Rattus norvegicus
aaaagtctcgacgatggatcagcat

SEQ ID NO: 2743 - DNA, 25 bp, Rattus norvegicus
aaaagtctctgactctgggagctga

SEQ ID NO: 2744 - DNA, 25 bp, Rattus norvegicus
aaaagtctctgagtctgggagctga

SEQ ID NO: 2745 - DNA, 25 bp, Rattus norvegicus
aaaagtctctgtcttgtcaaatcct

SEQ ID NO: 2746 - DNA, 25 bp, Rattus norvegicus
aaaagtctctgtgttgtcaaatcct

SEQ ID NO: 2747 - DNA, 25 bp, Rattus norvegicus
aaaagtctctttaatgcctgtacag

SEQ ID NO: 2748 - DNA, 25 bp, Rattus norvegicus
aaaagtctctttaccacagcacttg

SEQ ID NO: 2749 - DNA, 25 bp, Rattus norvegicus
aaaagtctctttactctgtgatcca

SEQ ID NO: 2750 - DNA, 25 bp, Rattus norvegicus
aaaagtctcttttatgcctgtacag

SEQ ID NO: 2751 - DNA, 25 bp, Rattus norvegicus
aaaagtctcttttccacagcacttg

SEQ ID NO: 2752 - DNA, 25 bp, Rattus norvegicus
aaaagtctcttttctctgtgatcca

SEQ ID NO: 2753 - DNA, 25 bp, Rattus norvegicus
aaaagtctgaatcctgacctggtgt

SEQ ID NO: 2754 - DNA, 25 bp, Rattus norvegicus
aaaagtctgaatgctgacctggtgt

SEQ ID NO: 2755 - DNA, 25 bp, Rattus norvegicus
aaaagtctgcctacattgcagctcc

SEQ ID NO: 2756 - DNA, 25 bp, Rattus norvegicus
aaaagtctgccttcattgcagctcc

SEQ ID NO: 2757 - DNA, 25 bp, Rattus norvegicus
aaaagtctggtcaccaagtccatcg

SEQ ID NO: 2758 - DNA, 25 bp, Rattus norvegicus
aaaagtctggtctccaagtccatcg

SEQ ID NO: 2759 - DNA, 25 bp, Rattus norvegicus
aaaagtctgtataacacctactgta

SEQ ID NO: 2760 - DNA, 25 bp, Rattus norvegicus
aaaagtctgtattacacctactgta

SEQ ID NO: 2761 - DNA, 25 bp, Rattus norvegicus
aaaagtctgtcacctgcccagcgga

SEQ ID NO: 2762 - DNA, 25 bp, Rattus norvegicus
aaaagtctgtcagctgcccagcgga

SEQ ID NO: 2763 - DNA, 25 bp, Rattus norvegicus
aaaagtcttagtcgcctgtcgacac

SEQ ID NO: 2764 - DNA, 25 bp, Rattus norvegicus
aaaagtcttagtggcctgtcgacac

SEQ ID NO: 2765 - DNA, 25 bp, Rattus norvegicus
aaaagtcttcagagcccacatcaag

SEQ ID NO: 2766 - DNA, 25 bp, Rattus norvegicus
aaaagtcttcagtgcccacatcaag

SEQ ID NO: 2767 - DNA, 25 bp, Rattus norvegicus
aaaagtcttcctagagatctccctg

SEQ ID NO: 2768 - DNA, 25 bp, Rattus norvegicus
aaaagtcttccttgagatctccctg

SEQ ID NO: 2769 - DNA, 25 bp, Rattus norvegicus
aaaagtcttctccacactgtgttca

SEQ ID NO: 2770 - DNA, 25 bp, Rattus norvegicus
aaaagtcttctcgacactgtgttca

SEQ ID NO: 2771 - DNA, 25 bp, Rattus norvegicus
aaaagtcttgttctccatctgtaaa

SEQ ID NO: 2772 - DNA, 25 bp, Rattus norvegicus
aaaagtcttgttgtccatctgtaaa

SEQ ID NO: 2773 - DNA, 25 bp, Rattus norvegicus
aaaagtgacaccctctcatcctata

SEQ ID NO: 2774 - DNA, 25 bp, Rattus norvegicus
aaaagtgacaccgtctcatcctata

SEQ ID NO: 2775 - DNA, 25 bp, Rattus norvegicus
aaaagtgacagtacctgggcctctt

SEQ ID NO: 2776 - DNA, 25 bp, Rattus norvegicus
aaaagtgacagtcccaacagcccca

SEQ ID NO: 2777 - DNA, 25 bp, Rattus norvegicus
aaaagtgacagtgccaacagcccca

SEQ ID NO: 2778 - DNA, 25 bp, Rattus norvegicus
aaaagtgacagttcctgggcctctt

SEQ ID NO: 2779 - DNA, 25 bp, Rattus norvegicus
aaaagtgaccgcagtgggctcatag

SEQ ID NO: 2780 - DNA, 25 bp, Rattus norvegicus
aaaagtgaccgctgtgggctcatag

SEQ ID NO: 2781 - DNA, 25 bp, Rattus norvegicus
aaaagtgacctcacagcataactgg

SEQ ID NO: 2782 - DNA, 25 bp, Rattus norvegicus
aaaagtgacctctcagcataactgg

SEQ ID NO: 2783 - DNA, 25 bp, Rattus norvegicus
aaaagtgactgcattttaacgccag

SEQ ID NO: 2784 - DNA, 25 bp, Rattus norvegicus
aaaagtgactgctttttaacgccag

SEQ ID NO: 2785 - DNA, 25 bp, Rattus norvegicus
aaaagtgatgtgacacaggtcctgt

SEQ ID NO: 2786 - DNA, 25 bp, Rattus norvegicus
aaaagtgatgtgtcacaggtcctgt

SEQ ID NO: 2787 - DNA, 25 bp, Rattus norvegicus
aaaagtgcaaccctgtgcatcgcgg

SEQ ID NO: 2788 - DNA, 25 bp, Rattus norvegicus
aaaagtgcaaccgtgtgcatcgcgg

SEQ ID NO: 2789 - DNA, 25 bp, Rattus norvegicus
aaaagtgcaatcaaggttcctgttt

SEQ ID NO: 2790 - DNA, 25 bp, Rattus norvegicus
aaaagtgcaatctaggttcctgttt

SEQ ID NO: 2791 - DNA, 25 bp, Rattus norvegicus
aaaagtgcaggaaagctgggcagct

SEQ ID NO: 2792 - DNA, 25 bp, Rattus norvegicus
aaaagtgcaggatagctgggcagct

SEQ ID NO: 2793 - DNA, 25 bp, Rattus norvegicus
aaaagtgcaggtcctgtctctggag

SEQ ID NO: 2794 - DNA, 25 bp, Rattus norvegicus
aaaagtgcaggtgctgtctctggag

SEQ ID NO: 2795 - DNA, 25 bp, Rattus norvegicus
aaaagtgcatgccagcagtctcttc

SEQ ID NO: 2796 - DNA, 25 bp, Rattus norvegicus
aaaagtgcatgcgagcagtctcttc

SEQ ID NO: 2797 - DNA, 25 bp, Rattus norvegicus
aaaagtgcatttcaccaggataagt

SEQ ID NO: 2798 - DNA, 25 bp, Rattus norvegicus
aaaagtgcatttgaccaggataagt

SEQ ID NO: 2799 - DNA, 25 bp, Rattus norvegicus
aaaagtgccacaccagaggttcctc

SEQ ID NO: 2800 - DNA, 25 bp, Rattus norvegicus
aaaagtgccacagcagaggttcctc

SEQ ID NO: 2801 - DNA, 25 bp, Rattus norvegicus
aaaagtgcgagaacctgcaggccga

SEQ ID NO: 2802 - DNA, 25 bp, Rattus norvegicus
aaaagtgcgagatcctgcaggccga

SEQ ID NO: 2803 - DNA, 25 bp, Rattus norvegicus
aaaagtgctaacctgttctccccag

SEQ ID NO: 2804 - DNA, 25 bp, Rattus norvegicus
aaaagtgctaacgtgttctccccag

SEQ ID NO: 2805 - DNA, 25 bp, Rattus norvegicus
aaaagtgctaccaatgcctaccaaa

SEQ ID NO: 2806 - DNA, 25 bp, Rattus norvegicus
aaaagtgctacctatgcctaccaaa

SEQ ID NO: 2807 - DNA, 25 bp, Rattus norvegicus
aaaagtgctcggagtcttttctcca

SEQ ID NO: 2808 - DNA, 25 bp, Rattus norvegicus
aaaagtgctcggtgtcttttctcca

SEQ ID NO: 2809 - DNA, 25 bp, Rattus norvegicus
aaaagtgctcttcatatccgtgaca

SEQ ID NO: 2810 - DNA, 25 bp, Rattus norvegicus
aaaagtgctcttgatatccgtgaca

SEQ ID NO: 2811 - DNA, 25 bp, Rattus norvegicus
aaaagtgctggcataggtgattgac

SEQ ID NO: 2812 - DNA, 25 bp, Rattus norvegicus
aaaagtgctggcttaggtgattgac

SEQ ID NO: 2813 - DNA, 25 bp, Rattus norvegicus
aaaagtgctgtaagtcctcattccc

SEQ ID NO: 2814 - DNA, 25 bp, Rattus norvegicus
aaaagtgctgtatgtcctcattccc

SEQ ID NO: 2815 - DNA, 25 bp, Rattus norvegicus
aaaagtggaattcttgtgtcagcaa

SEQ ID NO: 2816 - DNA, 25 bp, Rattus norvegicus
aaaagtggaattgttgtgtcagcaa

SEQ ID NO: 2817 - DNA, 25 bp, Rattus norvegicus
aaaagtggacaacgtgcagctgcag

SEQ ID NO: 2818 - DNA, 25 bp, Rattus norvegicus
aaaagtggacaaggtgcagctgcag

SEQ ID NO: 2819 - DNA, 25 bp, Rattus norvegicus
aaaagtggacctccagagtgcccct

SEQ ID NO: 2820 - DNA, 25 bp, Rattus norvegicus
aaaagtggacctgcagagtgcccct

SEQ ID NO: 2821 - DNA, 25 bp, Rattus norvegicus
aaaagtggactcatctcccaggtaa

SEQ ID NO: 2822 - DNA, 25 bp, Rattus norvegicus
aaaagtggactcttctcccaggtaa

SEQ ID NO: 2823 - DNA, 25 bp, Rattus norvegicus
aaaagtggagccagacaccatctct

SEQ ID NO: 2824 - DNA, 25 bp, Rattus norvegicus
aaaagtggagcctgacaccatctct

SEQ ID NO: 2825 - DNA, 25 bp, Rattus norvegicus
aaaagtggatctctgctccttgctg

SEQ ID NO: 2826 - DNA, 25 bp, Rattus norvegicus
aaaagtggatctgtgctccttgctg

SEQ ID NO: 2827 - DNA, 25 bp, Rattus norvegicus
aaaagtggatgcagctgccggtcag

SEQ ID NO: 2828 - DNA, 25 bp, Rattus norvegicus
aaaagtggatgctgctgccggtcag

SEQ ID NO: 2829 - DNA, 25 bp, Rattus norvegicus
aaaagtggattcctccgtgatctct

SEQ ID NO: 2830 - DNA, 25 bp, Rattus norvegicus
aaaagtggattcgtccgtgatctct

SEQ ID NO: 2831 - DNA, 25 bp, Rattus norvegicus
aaaagtggcagtcggcaccaggcca

SEQ ID NO: 2832 - DNA, 25 bp, Rattus norvegicus
aaaagtggcagtgggcaccaggcca

SEQ ID NO: 2833 - DNA, 25 bp, Rattus norvegicus
aaaagtggccagacatgcaccatct

SEQ ID NO: 2834 - DNA, 25 bp, Rattus norvegicus
aaaagtggccagtcatgcaccatct

SEQ ID NO: 2835 - DNA, 25 bp, Rattus norvegicus
aaaagtggcccacaacagctaccct

SEQ ID NO: 2836 - DNA, 25 bp, Rattus norvegicus
aaaagtggcccagaacagctaccct

SEQ ID NO: 2837 - DNA, 25 bp, Rattus norvegicus
aaaagtggctgactccaagaagcta

SEQ ID NO: 2838 - DNA, 25 bp, Rattus norvegicus
aaaagtggctgagtccaagaagcta

SEQ ID NO: 2839 - DNA, 25 bp, Rattus norvegicus
aaaagtggcttgctcccaagactgg

SEQ ID NO: 2840 - DNA, 25 bp, Rattus norvegicus
aaaagtggcttggtcccaagactgg

SEQ ID NO: 2841 - DNA, 25 bp, Rattus norvegicus
aaaagtgggcatcaccttggctctc

SEQ ID NO: 2842 - DNA, 25 bp, Rattus norvegicus
aaaagtgggcatgaccttggctctc

SEQ ID NO: 2843 - DNA, 25 bp, Rattus norvegicus
aaaagtgggtgcctgagataactca

SEQ ID NO: 2844 - DNA, 25 bp, Rattus norvegicus
aaaagtgggtgcgtgagataactca

SEQ ID NO: 2845 - DNA, 25 bp, Rattus norvegicus
aaaagtggtcacaattcctccctat

SEQ ID NO: 2846 - DNA, 25 bp, Rattus norvegicus
aaaagtggtcactattcctccctat

SEQ ID NO: 2847 - DNA, 25 bp, Rattus norvegicus
aaaagtggtccacttcagccgtgtt

SEQ ID NO: 2848 - DNA, 25 bp, Rattus norvegicus
aaaagtggtccagttcagccgtgtt

SEQ ID NO: 2849 - DNA, 25 bp, Rattus norvegicus
aaaagtggttccacagatactcagt

SEQ ID NO: 2850 - DNA, 25 bp, Rattus norvegicus
aaaagtggttcctcagatactcagt

SEQ ID NO: 2851 - DNA, 25 bp, Rattus norvegicus
aaaagtggttgaacatcatggtggg

SEQ ID NO: 2852 - DNA, 25 bp, Rattus norvegicus
aaaagtggttgatcatcatggtggg

SEQ ID NO: 2853 - DNA, 25 bp, Rattus norvegicus
aaaagtgtaccccagacatcttctc

SEQ ID NO: 2854 - DNA, 25 bp, Rattus norvegicus
aaaagtgtacccgagacatcttctc

SEQ ID NO: 2855 - DNA, 25 bp, Rattus norvegicus
aaaagtgtactcctcacatactggc

SEQ ID NO: 2856 - DNA, 25 bp, Rattus norvegicus
aaaagtgtactcgtcacatactggc

SEQ ID NO: 2857 - DNA, 25 bp, Rattus norvegicus
aaaagtgtagcaagccttcattcaa

SEQ ID NO: 2858 - DNA, 25 bp, Rattus norvegicus
aaaagtgtagcatgccttcattcaa

SEQ ID NO: 2859 - DNA, 25 bp, Rattus norvegicus
aaaagtgtccgactactgaagccaa

SEQ ID NO: 2860 - DNA, 25 bp, Rattus norvegicus
aaaagtgtccgagtactgaagccaa

SEQ ID NO: 2861 - DNA, 25 bp, Rattus norvegicus
aaaagtgtcctgagtttcaagataa

SEQ ID NO: 2862 - DNA, 25 bp, Rattus norvegicus
aaaagtgtcctgtgtttcaagataa

SEQ ID NO: 2863 - DNA, 25 bp, Rattus norvegicus
aaaagtgtcgccatattctgccatt

SEQ ID NO: 2864 - DNA, 25 bp, Rattus norvegicus
aaaagtgtcgccttattctgccatt

SEQ ID NO: 2865 - DNA, 25 bp, Rattus norvegicus
aaaagtgtctggagtggtattctca

SEQ ID NO: 2866 - DNA, 25 bp, Rattus norvegicus
aaaagtgtctggtgtggtattctca

SEQ ID NO: 2867 - DNA, 25 bp, Rattus norvegicus
aaaagtgtgccgagctcggtcagct

SEQ ID NO: 2868 - DNA, 25 bp, Rattus norvegicus
aaaagtgtgccgtgctcggtcagct

SEQ ID NO: 2869 - DNA, 25 bp, Rattus norvegicus
aaaagtgtgctgaccccaaatatcc

SEQ ID NO: 2870 - DNA, 25 bp, Rattus norvegicus
aaaagtgtgctgtccccaaatatcc

SEQ ID NO: 2871 - DNA, 25 bp, Rattus norvegicus
aaaagtgtgcttacctggaggcccg

SEQ ID NO: 2872 - DNA, 25 bp, Rattus norvegicus
aaaagtgtgctttcctggaggcccg

SEQ ID NO: 2873 - DNA, 25 bp, Rattus norvegicus
aaaagtgtggcaagtccctttggct

SEQ ID NO: 2874 - DNA, 25 bp, Rattus norvegicus
aaaagtgtggcatgtccctttggct

SEQ ID NO: 2875 - DNA, 25 bp, Rattus norvegicus
aaaagtgtgtaccaggattcccagt

SEQ ID NO: 2876 - DNA, 25 bp, Rattus norvegicus
aaaagtgtgtacgaggattcccagt

SEQ ID NO: 2877 - DNA, 25 bp, Rattus norvegicus
aaaagtgttgcactgaacccaaaag

SEQ ID NO: 2878 - DNA, 25 bp, Rattus norvegicus
aaaagtgttgcagtgaacccaaaag

SEQ ID NO: 2879 - DNA, 25 bp, Rattus norvegicus
aaaagtgtttgtactgtgactgtag

SEQ ID NO: 2880 - DNA, 25 bp, Rattus norvegicus
aaaagtgtttgttctgtgactgtag

SEQ ID NO: 2881 - DNA, 25 bp, Rattus norvegicus
aaaagttacactctatcctgccacc

SEQ ID NO: 2882 - DNA, 25 bp, Rattus norvegicus
aaaagttacactgtatcctgccacc

SEQ ID NO: 2883 - DNA, 25 bp, Rattus norvegicus
aaaagttatattccgctgccaagtg

SEQ ID NO: 2884 - DNA, 25 bp, Rattus norvegicus
aaaagttatattgcgctgccaagtg

SEQ ID NO: 2885 - DNA, 25 bp, Rattus norvegicus
aaaagttcaccaccaagtcagacgt

SEQ ID NO: 2886 - DNA, 25 bp, Rattus norvegicus
aaaagttcaccagcaagtcagacgt

SEQ ID NO: 2887 - DNA, 25 bp, Rattus norvegicus
aaaagttcacccacccttgcttgtg

SEQ ID NO: 2888 - DNA, 25 bp, Rattus norvegicus
aaaagttcaccctcccttgcttgtg

SEQ ID NO: 2889 - DNA, 25 bp, Rattus norvegicus
aaaagttcacttctcatccaaatct

SEQ ID NO: 2890 - DNA, 25 bp, Rattus norvegicus
aaaagttcacttgtcatccaaatct

SEQ ID NO: 2891 - DNA, 25 bp, Rattus norvegicus
aaaagttccaaaccttcaagtcatg

SEQ ID NO: 2892 - DNA, 25 bp, Rattus norvegicus
aaaagttccaaagcttcaagtcatg

SEQ ID NO: 2893 - DNA, 25 bp, Rattus norvegicus
aaaagttccagtctgatcaggaaga

SEQ ID NO: 2894 - DNA, 25 bp, Rattus norvegicus
aaaagttccagtgtgatcaggaaga

SEQ ID NO: 2895 - DNA, 25 bp, Rattus norvegicus
aaaagttctccccactcagtgactg

SEQ ID NO: 2896 - DNA, 25 bp, Rattus norvegicus
aaaagttctcccgactcagtgactg

SEQ ID NO: 2897 - DNA, 25 bp, Rattus norvegicus
aaaagttctgaacgccctgtgattt

SEQ ID NO: 2898 - DNA, 25 bp, Rattus norvegicus
aaaagttctgaaggccctgtgattt

SEQ ID NO: 2899 - DNA, 25 bp, Rattus norvegicus
aaaagttcttccagacatcgggcct

SEQ ID NO: 2900 - DNA, 25 bp, Rattus norvegicus
aaaagttcttcctgacatcgggcct

SEQ ID NO: 2901 - DNA, 25 bp, Rattus norvegicus
aaaagttgagccattcttctgcctc

SEQ ID NO: 2902 - DNA, 25 bp, Rattus norvegicus
aaaagttgagcctttcttctgcctc

SEQ ID NO: 2903 - DNA, 25 bp, Rattus norvegicus
aaaagttgatgcaggccaccagtcc

SEQ ID NO: 2904 - DNA, 25 bp, Rattus norvegicus
aaaagttgatgctggccaccagtcc

SEQ ID NO: 2905 - DNA, 25 bp, Rattus norvegicus
aaaagttgcagtatgacgtcacagt

SEQ ID NO: 2906 - DNA, 25 bp, Rattus norvegicus
aaaagttgcagtttgacgtcacagt

SEQ ID NO: 2907 - DNA, 25 bp, Rattus norvegicus
aaaagttgcattctgctcttcctct

SEQ ID NO: 2908 - DNA, 25 bp, Rattus norvegicus
aaaagttgcattgtgctcttcctct

SEQ ID NO: 2909 - DNA, 25 bp, Rattus norvegicus
aaaagttgccttagacttcctcatg

SEQ ID NO: 2910 - DNA, 25 bp, Rattus norvegicus
aaaagttgcctttgacttcctcatg

SEQ ID NO: 2911 - DNA, 25 bp, Rattus norvegicus
aaaagttgctgtcctttactccagg

SEQ ID NO: 2912 - DNA, 25 bp, Rattus norvegicus
aaaagttgctgtgctttactccagg

SEQ ID NO: 2913 - DNA, 25 bp, Rattus norvegicus
aaaagttggacaagtgcttttcttc

SEQ ID NO: 2914 - DNA, 25 bp, Rattus norvegicus
aaaagttggacatgtgcttttcttc

SEQ ID NO: 2915 - DNA, 25 bp, Rattus norvegicus
aaaagttgggccacagatagggtct

SEQ ID NO: 2916 - DNA, 25 bp, Rattus norvegicus
aaaagttgggcctcagatagggtct

SEQ ID NO: 2917 - DNA, 25 bp, Rattus norvegicus
aaaagttgggtcatctctgttcttc

SEQ ID NO: 2918 - DNA, 25 bp, Rattus norvegicus
aaaagttgggtcttctctgttcttc

SEQ ID NO: 2919 - DNA, 25 bp, Rattus norvegicus
aaaagttggttcactgtctctcata

SEQ ID NO: 2920 - DNA, 25 bp, Rattus norvegicus
aaaagttggttctctgtctctcata

SEQ ID NO: 2921 - DNA, 25 bp, Rattus norvegicus
aaaagttgtctcatgggccagcaag

SEQ ID NO: 2922 - DNA, 25 bp, Rattus norvegicus
aaaagttgtctccattgctgcttca

SEQ ID NO: 2923 - DNA, 25 bp, Rattus norvegicus
aaaagttgtctcgattgctgcttca

SEQ ID NO: 2924 - DNA, 25 bp, Rattus norvegicus
aaaagttgtctcttgggccagcaag

SEQ ID NO: 2925 - DNA, 25 bp, Rattus norvegicus
aaaagttgtgccaatggctgccgga

SEQ ID NO: 2926 - DNA, 25 bp, Rattus norvegicus
aaaagttgtgcctatggctgccgga

SEQ ID NO: 2927 - DNA, 25 bp, Rattus norvegicus
aaaagtttactaatgcatggaccag

SEQ ID NO: 2928 - DNA, 25 bp, Rattus norvegicus
aaaagtttactattgcatggaccag

SEQ ID NO: 2929 - DNA, 25 bp, Rattus norvegicus
aaaagtttctttctcctgtggtctg

SEQ ID NO: 2930 - DNA, 25 bp, Rattus norvegicus
aaaagtttctttgtcctgtggtctg

SEQ ID NO: 2931 - DNA, 25 bp, Rattus norvegicus
aaaagtttgcgcctcggtatctggc

SEQ ID NO: 2932 - DNA, 25 bp, Rattus norvegicus
aaaagtttgcgcgtcggtatctggc

SEQ ID NO: 2933 - DNA, 25 bp, Rattus norvegicus
aaaagtttgctcattgtccacagtt

SEQ ID NO: 2934 - DNA, 25 bp, Rattus norvegicus
aaaagtttgctctttgtccacagtt

SEQ ID NO: 2935 - DNA, 25 bp, Rattus norvegicus
aaaagtttgtcccatcaccagaggc

SEQ ID NO: 2936 - DNA, 25 bp, Rattus norvegicus
aaaagtttgtccgatcaccagaggc

SEQ ID NO: 2937 - DNA, 25 bp, Rattus norvegicus
aaaataaacccaactctacaagagg

SEQ ID NO: 2938 - DNA, 25 bp, Rattus norvegicus
aaaataaacccatctctacaagagg

SEQ ID NO: 2939 - DNA, 25 bp, Rattus norvegicus
aaaataaagcaccatgttctcccca

SEQ ID NO: 2940 - DNA, 25 bp, Rattus norvegicus
aaaataaagcacgatgttctcccca

SEQ ID NO: 2941 - DNA, 25 bp, Rattus norvegicus
aaaataaatcctcttccttctcgat

SEQ ID NO: 2942 - DNA, 25 bp, Rattus norvegicus
aaaataaatcctgttccttctcgat

SEQ ID NO: 2943 - DNA, 25 bp, Rattus norvegicus
aaaataaatgaccactcgacctggg

SEQ ID NO: 2944 - DNA, 25 bp, Rattus norvegicus
aaaataaatgacgactcgacctggg

SEQ ID NO: 2945 - DNA, 25 bp, Rattus norvegicus
aaaataacaggacagcgaggaggac

SEQ ID NO: 2946 - DNA, 25 bp, Rattus norvegicus
aaaataacaggagagcgaggaggac

SEQ ID NO: 2947 - DNA, 25 bp, Rattus norvegicus
aaaataacccatctttgcctcagcc

SEQ ID NO: 2948 - DNA, 25 bp, Rattus norvegicus
aaaataacccatgtttgcctcagcc

SEQ ID NO: 2949 - DNA, 25 bp, Rattus norvegicus
aaaataacctcaacatctctcctga

SEQ ID NO: 2950 - DNA, 25 bp, Rattus norvegicus
aaaataacctcatcatctctcctga

SEQ ID NO: 2951 - DNA, 25 bp, Rattus norvegicus
aaaataacttcaaacttcctcacct

SEQ ID NO: 2952 - DNA, 25 bp, Rattus norvegicus
aaaataacttcatacttcctcacct

SEQ ID NO: 2953 - DNA, 25 bp, Rattus norvegicus
aaaataagactgaggcttcaaaaag

SEQ ID NO: 2954 - DNA, 25 bp, Rattus norvegicus
aaaataagactgtggcttcaaaaag

SEQ ID NO: 2955 - DNA, 25 bp, Rattus norvegicus
aaaataagtctgagatgttggctac

SEQ ID NO: 2956 - DNA, 25 bp, Rattus norvegicus
aaaataagtctgtgatgttggctac

SEQ ID NO: 2957 - DNA, 25 bp, Rattus norvegicus
aaaataagtttacactgcccctgct

SEQ ID NO: 2958 - DNA, 25 bp, Rattus norvegicus
aaaataagtttagactgcccctgct

SEQ ID NO: 2959 - DNA, 25 bp, Rattus norvegicus
aaaataatccttagcttgcggcgtt

SEQ ID NO: 2960 - DNA, 25 bp, Rattus norvegicus
aaaataatcctttgcttgcggcgtt

SEQ ID NO: 2961 - DNA, 25 bp, Rattus norvegicus
aaaataatgccacgcttttgccaag

SEQ ID NO: 2962 - DNA, 25 bp, Rattus norvegicus
aaaataatgccaggcttttgccaag

SEQ ID NO: 2963 - DNA, 25 bp, Rattus norvegicus
aaaataattgcaccaactcctcagc

SEQ ID NO: 2964 - DNA, 25 bp, Rattus norvegicus
aaaataattgcagcaactcctcagc

SEQ ID NO: 2965 - DNA, 25 bp, Rattus norvegicus
aaaataatttttcacctgcccattg

SEQ ID NO: 2966 - DNA, 25 bp, Rattus norvegicus
aaaataatttttgacctgcccattg

SEQ ID NO: 2967 - DNA, 25 bp, Rattus norvegicus
aaaatacaaactagccctcgtccag

SEQ ID NO: 2968 - DNA, 25 bp, Rattus norvegicus
aaaatacaaacttgccctcgtccag

SEQ ID NO: 2969 - DNA, 25 bp, Rattus norvegicus
aaaatacactgtacttgtgcctttt

SEQ ID NO: 2970 - DNA, 25 bp, Rattus norvegicus
aaaatacactgttcttgtgcctttt

SEQ ID NO: 2971 - DNA, 25 bp, Rattus norvegicus
aaaatacacttcagagtcccacctt

SEQ ID NO: 2972 - DNA, 25 bp, Rattus norvegicus
aaaatacacttctgagtcccacctt

SEQ ID NO: 2973 - DNA, 25 bp, Rattus norvegicus
aaaatacagagaatgcgacccgcag

SEQ ID NO: 2974 - DNA, 25 bp, Rattus norvegicus
aaaatacagagattgcgacccgcag

SEQ ID NO: 2975 - DNA, 25 bp, Rattus norvegicus
aaaatacaggtgcttgcatatgcct

SEQ ID NO: 2976 - DNA, 25 bp, Rattus norvegicus
aaaatacaggtggttgcatatgcct

SEQ ID NO: 2977 - DNA, 25 bp, Rattus norvegicus
aaaatacagtcacttgtggccagaa

SEQ ID NO: 2978 - DNA, 25 bp, Rattus norvegicus
aaaatacagtcagttgtggccagaa

SEQ ID NO: 2979 - DNA, 25 bp, Rattus norvegicus
aaaatacatcgacagggcctggagt

SEQ ID NO: 2980 - DNA, 25 bp, Rattus norvegicus
aaaatacatcgagagggcctggagt

SEQ ID NO: 2981 - DNA, 25 bp, Rattus norvegicus
aaaataccagctaatcctgtccgtc

SEQ ID NO: 2982 - DNA, 25 bp, Rattus norvegicus
aaaataccagcttatcctgtccgtc

SEQ ID NO: 2983 - DNA, 25 bp, Rattus norvegicus
aaaatacccactagagtgcctggtc

SEQ ID NO: 2984 - DNA, 25 bp, Rattus norvegicus
aaaatacccacttgagtgcctggtc

SEQ ID NO: 2985 - DNA, 25 bp, Rattus norvegicus
aaaataccctggaagtgtgccctgc

SEQ ID NO: 2986 - DNA, 25 bp, Rattus norvegicus
aaaataccctggtagtgtgccctgc

SEQ ID NO: 2987 - DNA, 25 bp, Rattus norvegicus
aaaatacctaaccttgaacacagag

SEQ ID NO: 2988 - DNA, 25 bp, Rattus norvegicus
aaaatacctaacgttgaacacagag

SEQ ID NO: 2989 - DNA, 25 bp, Rattus norvegicus
aaaatacctctacaaaacctgcctg

SEQ ID NO: 2990 - DNA, 25 bp, Rattus norvegicus
aaaatacctctagaaaacctgcctg

SEQ ID NO: 2991 - DNA, 25 bp, Rattus norvegicus
aaaatacctgatagcataatgcggg

SEQ ID NO: 2992 - DNA, 25 bp, Rattus norvegicus
aaaatacctgattgcataatgcggg

SEQ ID NO: 2993 - DNA, 25 bp, Rattus norvegicus
aaaatacctggcacttgacttcttc

SEQ ID NO: 2994 - DNA, 25 bp, Rattus norvegicus
aaaatacctggctcttgacttcttc

SEQ ID NO: 2995 - DNA, 25 bp, Rattus norvegicus
aaaatacgacatcataaagcccagt

SEQ ID NO: 2996 - DNA, 25 bp, Rattus norvegicus
aaaatacgacatgataaagcccagt

SEQ ID NO: 2997 - DNA, 25 bp, Rattus norvegicus
aaaatacgatgtatcgcccatccca

SEQ ID NO: 2998 - DNA, 25 bp, Rattus norvegicus
aaaatacgatgtttcgcccatccca

SEQ ID NO: 2999 - DNA, 25 bp, Rattus norvegicus
aaaatactccccattgggcacactg

SEQ ID NO: 3000 - DNA, 25 bp, Rattus norvegicus
aaaatactcccctttgggcacactg

SEQ ID NO: 3001 - DNA, 25 bp, Rattus norvegicus
aaaatactcgtacccattcagcaag

SEQ ID NO: 3002 - DNA, 25 bp, Rattus norvegicus
aaaatactcgtagccattcagcaag

SEQ ID NO: 3003 - DNA, 25 bp, Rattus norvegicus
aaaatactctggatgcaaggaaggc

SEQ ID NO: 3004 - DNA, 25 bp, Rattus norvegicus
aaaatactctggttgcaaggaaggc

SEQ ID NO: 3005 - DNA, 25 bp, Rattus norvegicus
aaaatactgcagcaggccagcctcg

SEQ ID NO: 3006 - DNA, 25 bp, Rattus norvegicus
aaaatactgcaggaggccagcctcg

SEQ ID NO: 3007 - DNA, 25 bp, Rattus norvegicus
aaaatactgtatagcctgcgtttca

SEQ ID NO: 3008 - DNA, 25 bp, Rattus norvegicus
aaaatactgtattgcctgcgtttca

SEQ ID NO: 3009 - DNA, 25 bp, Rattus norvegicus
aaaatactgtccaagagcttagtca

SEQ ID NO: 3010 - DNA, 25 bp, Rattus norvegicus
aaaatactgtcctagagcttagtca

SEQ ID NO: 3011 - DNA, 25 bp, Rattus norvegicus
aaaatactgtctacccacattccct

SEQ ID NO: 3012 - DNA, 25 bp, Rattus norvegicus
aaaatactgtcttcccacattccct

SEQ ID NO: 3013 - DNA, 25 bp, Rattus norvegicus
aaaatacttagtagctgctaatctg

SEQ ID NO: 3014 - DNA, 25 bp, Rattus norvegicus
aaaatacttagttgctgctaatctg

SEQ ID NO: 3015 - DNA, 25 bp, Rattus norvegicus
aaaatagaatgtcctccctgccttt

SEQ ID NO: 3016 - DNA, 25 bp, Rattus norvegicus
aaaatagaatgtgctccctgccttt

SEQ ID NO: 3017 - DNA, 25 bp, Rattus norvegicus
aaaatagacatcacatgtcccaccc

SEQ ID NO: 3018 - DNA, 25 bp, Rattus norvegicus
aaaatagacatctcatgtcccaccc

SEQ ID NO: 3019 - DNA, 25 bp, Rattus norvegicus
aaaatagaccatcttctctgggaac

SEQ ID NO: 3020 - DNA, 25 bp, Rattus norvegicus
aaaatagaccatgttctctgggaac

SEQ ID NO: 3021 - DNA, 25 bp, Rattus norvegicus
aaaatagattccctgattggcctca

SEQ ID NO: 3022 - DNA, 25 bp, Rattus norvegicus
aaaatagattccgtgattggcctca

SEQ ID NO: 3023 - DNA, 25 bp, Rattus norvegicus
aaaatagcatcacccctgtctttgc

SEQ ID NO: 3024 - DNA, 25 bp, Rattus norvegicus
aaaatagcatcagccctgtctttgc

SEQ ID NO: 3025 - DNA, 25 bp, Rattus norvegicus
aaaatagccaagctgcctcaatgtg

SEQ ID NO: 3026 - DNA, 25 bp, Rattus norvegicus
aaaatagccaaggtgcctcaatgtg

SEQ ID NO: 3027 - DNA, 25 bp, Rattus norvegicus
aaaatagccagtatgtcgtccctgt

SEQ ID NO: 3028 - DNA, 25 bp, Rattus norvegicus
aaaatagccagtttgtcgtccctgt

SEQ ID NO: 3029 - DNA, 25 bp, Rattus norvegicus
aaaatagctgcaaggtctggcctca

SEQ ID NO: 3030 - DNA, 25 bp, Rattus norvegicus
aaaatagctgcatggtctggcctca

SEQ ID NO: 3031 - DNA, 25 bp, Rattus norvegicus
aaaataggacttcggctagaacatt

SEQ ID NO: 3032 - DNA, 25 bp, Rattus norvegicus
aaaataggacttgggctagaacatt

SEQ ID NO: 3033 - DNA, 25 bp, Rattus norvegicus
aaaataggcttcaacataccccagg

SEQ ID NO: 3034 - DNA, 25 bp, Rattus norvegicus
aaaataggcttctacataccccagg

SEQ ID NO: 3035 - DNA, 25 bp, Rattus norvegicus
aaaatagggcacattcacatcagaa

SEQ ID NO: 3036 - DNA, 25 bp, Rattus norvegicus
aaaatagggcactttcacatcagaa

SEQ ID NO: 3037 - DNA, 25 bp, Rattus norvegicus
aaaatagtcataccgctgatgagaa

SEQ ID NO: 3038 - DNA, 25 bp, Rattus norvegicus
aaaatagtcatagcgctgatgagaa

SEQ ID NO: 3039 - DNA, 25 bp, Rattus norvegicus
aaaatagtgcctaacatactgttgt

SEQ ID NO: 3040 - DNA, 25 bp, Rattus norvegicus
aaaatagtgcctctcagccacggca

SEQ ID NO: 3041 - DNA, 25 bp, Rattus norvegicus
aaaatagtgcctgtcagccacggca

SEQ ID NO: 3042 - DNA, 25 bp, Rattus norvegicus
aaaatagtgccttacatactgttgt

SEQ ID NO: 3043 - DNA, 25 bp, Rattus norvegicus
aaaatagtttagctgtggcccctgt

SEQ ID NO: 3044 - DNA, 25 bp, Rattus norvegicus
aaaatagtttaggtgtggcccctgt

SEQ ID NO: 3045 - DNA, 25 bp, Rattus norvegicus
aaaatatatgccaatcctccccaat

SEQ ID NO: 3046 - DNA, 25 bp, Rattus norvegicus
aaaatatatgcctatcctccccaat

SEQ ID NO: 3047 - DNA, 25 bp, Rattus norvegicus
aaaatatccagtcacaaccatgttt

SEQ ID NO: 3048 - DNA, 25 bp, Rattus norvegicus
aaaatatccagtgacaaccatgttt

SEQ ID NO: 3049 - DNA, 25 bp, Rattus norvegicus
aaaatatccgcaaactcatcttgtg

SEQ ID NO: 3050 - DNA, 25 bp, Rattus norvegicus
aaaatatccgcatactcatcttgtg

SEQ ID NO: 3051 - DNA, 25 bp, Rattus norvegicus
aaaatatcgccgcaatcccttctgc

SEQ ID NO: 3052 - DNA, 25 bp, Rattus norvegicus
aaaatatcgccggaatcccttctgc

SEQ ID NO: 3053 - DNA, 25 bp, Rattus norvegicus
aaaatatctattccctttgactaag

SEQ ID NO: 3054 - DNA, 25 bp, Rattus norvegicus
aaaatatctattgcctttgactaag

SEQ ID NO: 3055 - DNA, 25 bp, Rattus norvegicus
aaaatatctcgcatcggtttcccca

SEQ ID NO: 3056 - DNA, 25 bp, Rattus norvegicus
aaaatatctcgcttcggtttcccca

SEQ ID NO: 3057 - DNA, 25 bp, Rattus norvegicus
aaaatatctcttactccttttatga

SEQ ID NO: 3058 - DNA, 25 bp, Rattus norvegicus
aaaatatctctttctccttttatga

SEQ ID NO: 3059 - DNA, 25 bp, Rattus norvegicus
aaaatatgccttagccattcctctt

SEQ ID NO: 3060 - DNA, 25 bp, Rattus norvegicus
aaaatatgcctttgccattcctctt

SEQ ID NO: 3061 - DNA, 25 bp, Rattus norvegicus
aaaatatgctgcacactctgtaaac

SEQ ID NO: 3062 - DNA, 25 bp, Rattus norvegicus
aaaatatgctgctcactctgtaaac

SEQ ID NO: 3063 - DNA, 25 bp, Rattus norvegicus
aaaatatgggagctgattcctaggt

SEQ ID NO: 3064 - DNA, 25 bp, Rattus norvegicus
aaaatatgggaggtgattcctaggt

SEQ ID NO: 3065 - DNA, 25 bp, Rattus norvegicus
aaaatatgtttgatggcgttcctgc

SEQ ID NO: 3066 - DNA, 25 bp, Rattus norvegicus
aaaatatgtttgttggcgttcctgc

SEQ ID NO: 3067 - DNA, 25 bp, Rattus norvegicus
aaaatattagacctgactccctcgt

SEQ ID NO: 3068 - DNA, 25 bp, Rattus norvegicus
aaaatattagacgtgactccctcgt

SEQ ID NO: 3069 - DNA, 25 bp, Rattus norvegicus
aaaatattcgccatcctttgctgtt

SEQ ID NO: 3070 - DNA, 25 bp, Rattus norvegicus
aaaatattcgccttcctttgctgtt

SEQ ID NO: 3071 - DNA, 25 bp, Rattus norvegicus
aaaatattctgtctgccacaggccc

SEQ ID NO: 3072 - DNA, 25 bp, Rattus norvegicus
aaaatattctgtgtgccacaggccc

SEQ ID NO: 3073 - DNA, 25 bp, Rattus norvegicus
aaaatattctttctagcaacccaga

SEQ ID NO: 3074 - DNA, 25 bp, Rattus norvegicus
aaaatattctttgtagcaacccaga

SEQ ID NO: 3075 - DNA, 25 bp, Rattus norvegicus
aaaatatttgtcacacacctgtttc

SEQ ID NO: 3076 - DNA, 25 bp, Rattus norvegicus
aaaatatttgtctcacacctgtttc

SEQ ID NO: 3077 - DNA, 25 bp, Rattus norvegicus
aaaatcaaactaacacatctcccac

SEQ ID NO: 3078 - DNA, 25 bp, Rattus norvegicus
aaaatcaaactatcacatctcccac

SEQ ID NO: 3079 - DNA, 25 bp, Rattus norvegicus
aaaatcaaagaccatcagcacccag

SEQ ID NO: 3080 - DNA, 25 bp, Rattus norvegicus
aaaatcaaagacgatcagcacccag

SEQ ID NO: 3081 - DNA, 25 bp, Rattus norvegicus
aaaatcaacgttagccaggtggtgg

SEQ ID NO: 3082 - DNA, 25 bp, Rattus norvegicus
aaaatcaacgtttgccaggtggtgg

SEQ ID NO: 3083 - DNA, 25 bp, Rattus norvegicus
aaaatcaagccgctcacccgagcag

SEQ ID NO: 3084 - DNA, 25 bp, Rattus norvegicus
aaaatcaagccggtcacccgagcag

SEQ ID NO: 3085 - DNA, 25 bp, Rattus norvegicus
aaaatcaataacagtctttgactta

SEQ ID NO: 3086 - DNA, 25 bp, Rattus norvegicus
aaaatcaataactgtctttgactta

SEQ ID NO: 3087 - DNA, 25 bp, Rattus norvegicus
aaaatcaatgcaccccactttagga

SEQ ID NO: 3088 - DNA, 25 bp, Rattus norvegicus
aaaatcaatgcagcccactttagga

SEQ ID NO: 3089 - DNA, 25 bp, Rattus norvegicus
aaaatcacacatacaggtggtaaat

SEQ ID NO: 3090 - DNA, 25 bp, Rattus norvegicus
aaaatcacacattcaggtggtaaat

SEQ ID NO: 3091 - DNA, 25 bp, Rattus norvegicus
aaaatcacagacaatgccctttcca

SEQ ID NO: 3092 - DNA, 25 bp, Rattus norvegicus
aaaatcacagactatgccctttcca

SEQ ID NO: 3093 - DNA, 25 bp, Rattus norvegicus
aaaatcacattcactgttcagctgt

SEQ ID NO: 3094 - DNA, 25 bp, Rattus norvegicus
aaaatcacattctctgttcagctgt

SEQ ID NO: 3095 - DNA, 25 bp, Rattus norvegicus
aaaatcacattgctggaactagaag

SEQ ID NO: 3096 - DNA, 25 bp, Rattus norvegicus
aaaatcacattggtggaactagaag

SEQ ID NO: 3097 - DNA, 25 bp, Rattus norvegicus
aaaatcaccacaccgttctaacaga

SEQ ID NO: 3098 - DNA, 25 bp, Rattus norvegicus
aaaatcaccacagcgttctaacaga

SEQ ID NO: 3099 - DNA, 25 bp, Rattus norvegicus
aaaatcaccacgctctttagccatg

SEQ ID NO: 3100 - DNA, 25 bp, Rattus norvegicus
aaaatcaccacggtctttagccatg

SEQ ID NO: 3101 - DNA, 25 bp, Rattus norvegicus
aaaatcaccatgactctcatcactg

SEQ ID NO: 3102 - DNA, 25 bp, Rattus norvegicus
aaaatcaccatgtctctcatcactg

SEQ ID NO: 3103 - DNA, 25 bp, Rattus norvegicus
aaaatcactgataagctcttcctgt

SEQ ID NO: 3104 - DNA, 25 bp, Rattus norvegicus
aaaatcactgattagctcttcctgt

SEQ ID NO: 3105 - DNA, 25 bp, Rattus norvegicus
aaaatcacttgtcccaacacttgag

SEQ ID NO: 3106 - DNA, 25 bp, Rattus norvegicus
aaaatcacttgtgccaacacttgag

SEQ ID NO: 3107 - DNA, 25 bp, Rattus norvegicus
aaaatcagacacagagtaggcccag

SEQ ID NO: 3108 - DNA, 25 bp, Rattus norvegicus
aaaatcagacactgagtaggcccag

SEQ ID NO: 3109 - DNA, 25 bp, Rattus norvegicus
aaaatcagactgatgtggacctgtt

SEQ ID NO: 3110 - DNA, 25 bp, Rattus norvegicus
aaaatcagactgttgtggacctgtt

SEQ ID NO: 3111 - DNA, 25 bp, Rattus norvegicus
aaaatcagcacacgagaccttttta

SEQ ID NO: 3112 - DNA, 25 bp, Rattus norvegicus
aaaatcagcacaggagaccttttta

SEQ ID NO: 3113 - DNA, 25 bp, Rattus norvegicus
aaaatcagccacatttatccctgtc

SEQ ID NO: 3114 - DNA, 25 bp, Rattus norvegicus
aaaatcagccacttttatccctgtc

SEQ ID NO: 3115 - DNA, 25 bp, Rattus norvegicus
aaaatcagcggccacggcctagata

SEQ ID NO: 3116 - DNA, 25 bp, Rattus norvegicus
aaaatcagcggcgacggcctagata

SEQ ID NO: 3117 - DNA, 25 bp, Rattus norvegicus
aaaatcagcgtcaacggcacgcttt

SEQ ID NO: 3118 - DNA, 25 bp, Rattus norvegicus
aaaatcagcgtctacggcacgcttt

SEQ ID NO: 3119 - DNA, 25 bp, Rattus norvegicus
aaaatcaggactatgccagcctggg

SEQ ID NO: 3120 - DNA, 25 bp, Rattus norvegicus
aaaatcaggactttgccagcctggg

SEQ ID NO: 3121 - DNA, 25 bp, Rattus norvegicus
aaaatcagggtgaggcatgctagca

SEQ ID NO: 3122 - DNA, 25 bp, Rattus norvegicus
aaaatcagggtgtggcatgctagca

SEQ ID NO: 3123 - DNA, 25 bp, Rattus norvegicus
aaaatcaggtgtaccacaaccccat

SEQ ID NO: 3124 - DNA, 25 bp, Rattus norvegicus
aaaatcaggtgttccacaaccccat

SEQ ID NO: 3125 - DNA, 25 bp, Rattus norvegicus
aaaatcagtagtatgttggcaacat

SEQ ID NO: 3126 - DNA, 25 bp, Rattus norvegicus
aaaatcagtagtttgttggcaacat

SEQ ID NO: 3127 - DNA, 25 bp, Rattus norvegicus
aaaatcagtgttcgcccttatagga

SEQ ID NO: 3128 - DNA, 25 bp, Rattus norvegicus
aaaatcagtgttggcccttatagga

SEQ ID NO: 3129 - DNA, 25 bp, Rattus norvegicus
aaaatcagttcacccggaggagctc

SEQ ID NO: 3130 - DNA, 25 bp, Rattus norvegicus
aaaatcagttcagccggaggagctc

SEQ ID NO: 3131 - DNA, 25 bp, Rattus norvegicus
aaaatcatatgcctgccttctcctc

SEQ ID NO: 3132 - DNA, 25 bp, Rattus norvegicus
aaaatcatatgcgtgccttctcctc

SEQ ID NO: 3133 - DNA, 25 bp, Rattus norvegicus
aaaatcatcaacctgcctgtagaag

SEQ ID NO: 3134 - DNA, 25 bp, Rattus norvegicus
aaaatcatcaacgtgcctgtagaag

SEQ ID NO: 3135 - DNA, 25 bp, Rattus norvegicus
aaaatcatcctcagctccatggtga

SEQ ID NO: 3136 - DNA, 25 bp, Rattus norvegicus
aaaatcatcctctgctccatggtga

SEQ ID NO: 3137 - DNA, 25 bp, Rattus norvegicus
aaaatcatgcttaagcagactgtgg

SEQ ID NO: 3138 - DNA, 25 bp, Rattus norvegicus
aaaatcatgcttaggtggctcttgt

SEQ ID NO: 3139 - DNA, 25 bp, Rattus norvegicus
aaaatcatgctttagcagactgtgg

SEQ ID NO: 3140 - DNA, 25 bp, Rattus norvegicus
aaaatcatgctttggtggctcttgt

SEQ ID NO: 3141 - DNA, 25 bp, Rattus norvegicus
aaaatcatgtgacttagaggtcatg

SEQ ID NO: 3142 - DNA, 25 bp, Rattus norvegicus
aaaatcatgtgagttagaggtcatg

SEQ ID NO: 3143 - DNA, 25 bp, Rattus norvegicus
aaaatcattctgcagccctactgag

SEQ ID NO: 3144 - DNA, 25 bp, Rattus norvegicus
aaaatcattctggagccctactgag

SEQ ID NO: 3145 - DNA, 25 bp, Rattus norvegicus
aaaatcattgatcctcccctcagga

SEQ ID NO: 3146 - DNA, 25 bp, Rattus norvegicus
aaaatcattgatgctcccctcagga

SEQ ID NO: 3147 - DNA, 25 bp, Rattus norvegicus
aaaatcattgcactttggtcagaaa

SEQ ID NO: 3148 - DNA, 25 bp, Rattus norvegicus
aaaatcattgcagtttggtcagaaa

SEQ ID NO: 3149 - DNA, 25 bp, Rattus norvegicus
aaaatcatttctagcactgtgaagc

SEQ ID NO: 3150 - DNA, 25 bp, Rattus norvegicus
aaaatcatttcttgcactgtgaagc

SEQ ID NO: 3151 - DNA, 25 bp, Rattus norvegicus
aaaatccaaagaatcgctcccaagc

SEQ ID NO: 3152 - DNA, 25 bp, Rattus norvegicus
aaaatccaaagattcgctcccaagc

SEQ ID NO: 3153 - DNA, 25 bp, Rattus norvegicus
aaaatccaaattcaccctccttatg

SEQ ID NO: 3154 - DNA, 25 bp, Rattus norvegicus
aaaatccaaattgaccctccttatg

SEQ ID NO: 3155 - DNA, 25 bp, Rattus norvegicus
aaaatccaagccaacagcactctga

SEQ ID NO: 3156 - DNA, 25 bp, Rattus norvegicus
aaaatccaagcctacagcactctga

SEQ ID NO: 3157 - DNA, 25 bp, Rattus norvegicus
aaaatccaagtgacaactgtggttg

SEQ ID NO: 3158 - DNA, 25 bp, Rattus norvegicus
aaaatccaagtgtcaactgtggttg

SEQ ID NO: 3159 - DNA, 25 bp, Rattus norvegicus
aaaatccaatgacctgtgtgccctg

SEQ ID NO: 3160 - DNA, 25 bp, Rattus norvegicus
aaaatccaatgagctgtgtgccctg

SEQ ID NO: 3161 - DNA, 25 bp, Rattus norvegicus
aaaatccacaatcaagatcccaagg

SEQ ID NO: 3162 - DNA, 25 bp, Rattus norvegicus
aaaatccacaatgaagatcccaagg

SEQ ID NO: 3163 - DNA, 25 bp, Rattus norvegicus
aaaatccacacacctgcttatctgc

SEQ ID NO: 3164 - DNA, 25 bp, Rattus norvegicus
aaaatccacacagctgcttatctgc

SEQ ID NO: 3165 - DNA, 25 bp, Rattus norvegicus
aaaatccaccgtctgcaagtagcat

SEQ ID NO: 3166 - DNA, 25 bp, Rattus norvegicus
aaaatccaccgtgtgcaagtagcat

SEQ ID NO: 3167 - DNA, 25 bp, Rattus norvegicus
aaaatccacgcgcaggaagctgttt

SEQ ID NO: 3168 - DNA, 25 bp, Rattus norvegicus
aaaatccacgcggaggaagctgttt

SEQ ID NO: 3169 - DNA, 25 bp, Rattus norvegicus
aaaatccacgttactgccgtaggtg

SEQ ID NO: 3170 - DNA, 25 bp, Rattus norvegicus
aaaatccacgtttctgccgtaggtg

SEQ ID NO: 3171 - DNA, 25 bp, Rattus norvegicus
aaaatccactttccctgttggttcg

SEQ ID NO: 3172 - DNA, 25 bp, Rattus norvegicus
aaaatccactttgcctgttggttcg

SEQ ID NO: 3173 - DNA, 25 bp, Rattus norvegicus
aaaatccagctgagacgggctatat

SEQ ID NO: 3174 - DNA, 25 bp, Rattus norvegicus
aaaatccagctgtgacgggctatat

SEQ ID NO: 3175 - DNA, 25 bp, Rattus norvegicus
aaaatccatgaaaacctttgcaggt

SEQ ID NO: 3176 - DNA, 25 bp, Rattus norvegicus
aaaatccatgaatacctttgcaggt

SEQ ID NO: 3177 - DNA, 25 bp, Rattus norvegicus
aaaatccattgtcgactttgtgctg

SEQ ID NO: 3178 - DNA, 25 bp, Rattus norvegicus
aaaatccattgtcgaggcccaaggc

SEQ ID NO: 3179 - DNA, 25 bp, Rattus norvegicus
aaaatccattgtggactttgtgctg

SEQ ID NO: 3180 - DNA, 25 bp, Rattus norvegicus
aaaatccattgtggaggcccaaggc

SEQ ID NO: 3181 - DNA, 25 bp, Rattus norvegicus
aaaatccatttccagcacacagcag

SEQ ID NO: 3182 - DNA, 25 bp, Rattus norvegicus
aaaatccatttcgagcacacagcag

SEQ ID NO: 3183 - DNA, 25 bp, Rattus norvegicus
aaaatcccagatagtctcttctcta

SEQ ID NO: 3184 - DNA, 25 bp, Rattus norvegicus
aaaatcccagattgtctcttctcta

SEQ ID NO: 3185 - DNA, 25 bp, Rattus norvegicus
aaaatcccagtcagaccttggtcaa

SEQ ID NO: 3186 - DNA, 25 bp, Rattus norvegicus
aaaatcccagtctgaccttggtcaa

SEQ ID NO: 3187 - DNA, 25 bp, Rattus norvegicus
aaaatcccggagaagctgagacatc

SEQ ID NO: 3188 - DNA, 25 bp, Rattus norvegicus
aaaatcccggagtagctgagacatc

SEQ ID NO: 3189 - DNA, 25 bp, Rattus norvegicus
aaaatccctccaactgtagccatag

SEQ ID NO: 3190 - DNA, 25 bp, Rattus norvegicus
aaaatccctccatctgtagccatag

SEQ ID NO: 3191 - DNA, 25 bp, Rattus norvegicus
aaaatccctggcaaatggctctgtt

SEQ ID NO: 3192 - DNA, 25 bp, Rattus norvegicus
aaaatccctggctaatggctctgtt

SEQ ID NO: 3193 - DNA, 25 bp, Rattus norvegicus
aaaatccgctcactggtgagcctgc

SEQ ID NO: 3194 - DNA, 25 bp, Rattus norvegicus
aaaatccgctcagtggtgagcctgc

SEQ ID NO: 3195 - DNA, 25 bp, Rattus norvegicus
aaaatccgtagtctctctctgactt

SEQ ID NO: 3196 - DNA, 25 bp, Rattus norvegicus
aaaatccgtagtgtctctctgactt

SEQ ID NO: 3197 - DNA, 25 bp, Rattus norvegicus
aaaatccgtgtcaagctgtgcaata

SEQ ID NO: 3198 - DNA, 25 bp, Rattus norvegicus
aaaatccgtgtctagctgtgcaata

SEQ ID NO: 3199 - DNA, 25 bp, Rattus norvegicus
aaaatcctattcatataatcagtgt

SEQ ID NO: 3200 - DNA, 25 bp, Rattus norvegicus
aaaatcctattcttataatcagtgt

SEQ ID NO: 3201 - DNA, 25 bp, Rattus norvegicus
aaaatcctcaacattgtcctgaatg

SEQ ID NO: 3202 - DNA, 25 bp, Rattus norvegicus
aaaatcctcaactttgtcctgaatg

SEQ ID NO: 3203 - DNA, 25 bp, Rattus norvegicus
aaaatcctcaatctggacccaaagg

SEQ ID NO: 3204 - DNA, 25 bp, Rattus norvegicus
aaaatcctcaatgtggacccaaagg

SEQ ID NO: 3205 - DNA, 25 bp, Rattus norvegicus
aaaatcctcccgagctgctgggttt

SEQ ID NO: 3206 - DNA, 25 bp, Rattus norvegicus
aaaatcctcccgtgctgctgggttt

SEQ ID NO: 3207 - DNA, 25 bp, Rattus norvegicus
aaaatcctccttctattctcaaggg

SEQ ID NO: 3208 - DNA, 25 bp, Rattus norvegicus
aaaatcctccttgtattctcaaggg

SEQ ID NO: 3209 - DNA, 25 bp, Rattus norvegicus
aaaatcctcgcaaaccttgttcgat

SEQ ID NO: 3210 - DNA, 25 bp, Rattus norvegicus
aaaatcctcgcataccttgttcgat

SEQ ID NO: 3211 - DNA, 25 bp, Rattus norvegicus
aaaatcctcggaagctcaagtagct

SEQ ID NO: 3212 - DNA, 25 bp, Rattus norvegicus
aaaatcctcggatgctcaagtagct

SEQ ID NO: 3213 - DNA, 25 bp, Rattus norvegicus
aaaatcctgcatattaactgctgtg

SEQ ID NO: 3214 - DNA, 25 bp, Rattus norvegicus
aaaatcctgcattttaactgctgtg

SEQ ID NO: 3215 - DNA, 25 bp, Rattus norvegicus
aaaatcctggaaatcctctcatgtt

SEQ ID NO: 3216 - DNA, 25 bp, Rattus norvegicus
aaaatcctggaattcctctcatgtt

SEQ ID NO: 3217 - DNA, 25 bp, Rattus norvegicus
aaaatcctgggtaagctgactgaaa

SEQ ID NO: 3218 - DNA, 25 bp, Rattus norvegicus
aaaatcctgggtatgtctttatgat

SEQ ID NO: 3219 - DNA, 25 bp, Rattus norvegicus
aaaatcctgggttagctgactgaaa

SEQ ID NO: 3220 - DNA, 25 bp, Rattus norvegicus
aaaatcctgggtttgtctttatgat

SEQ ID NO: 3221 - DNA, 25 bp, Rattus norvegicus
aaaatcctggtgagttgcgagctac

SEQ ID NO: 3222 - DNA, 25 bp, Rattus norvegicus
aaaatcctggtgtgttgcgagctac

SEQ ID NO: 3223 - DNA, 25 bp, Rattus norvegicus
aaaatcctgtctccagtcattggtg

SEQ ID NO: 3224 - DNA, 25 bp, Rattus norvegicus
aaaatcctgtctgcagtcattggtg

SEQ ID NO: 3225 - DNA, 25 bp, Rattus norvegicus
aaaatcctgtggagctaattcctcc

SEQ ID NO: 3226 - DNA, 25 bp, Rattus norvegicus
aaaatcctgtggtgctaattcctcc

SEQ ID NO: 3227 - DNA, 25 bp, Rattus norvegicus
aaaatccttcagagttaccgtcaga

SEQ ID NO: 3228 - DNA, 25 bp, Rattus norvegicus
aaaatccttcagtgttaccgtcaga

SEQ ID NO: 3229 - DNA, 25 bp, Rattus norvegicus
aaaatccttgtgcaagtcttctact

SEQ ID NO: 3230 - DNA, 25 bp, Rattus norvegicus
aaaatccttgtggaagtcttctact

SEQ ID NO: 3231 - DNA, 25 bp, Rattus norvegicus
aaaatcctttctcaggtagcatgaa

SEQ ID NO: 3232 - DNA, 25 bp, Rattus norvegicus
aaaatcctttctgaggtagcatgaa

SEQ ID NO: 3233 - DNA, 25 bp, Rattus norvegicus
aaaatccttttaccttgcctgagaa

SEQ ID NO: 3234 - DNA, 25 bp, Rattus norvegicus
aaaatccttttagcttgcctgagaa

SEQ ID NO: 3235 - DNA, 25 bp, Rattus norvegicus
aaaatccttttcaccaagcccacat

SEQ ID NO: 3236 - DNA, 25 bp, Rattus norvegicus
aaaatccttttctccaagcccacat

SEQ ID NO: 3237 - DNA, 25 bp, Rattus norvegicus
aaaatcgaacacatgcccccttggt

SEQ ID NO: 3238 - DNA, 25 bp, Rattus norvegicus
aaaatcgaacacttgcccccttggt

SEQ ID NO: 3239 - DNA, 25 bp, Rattus norvegicus
aaaatcgactccaactccaggatct

SEQ ID NO: 3240 - DNA, 25 bp, Rattus norvegicus
aaaatcgactcctactccaggatct

SEQ ID NO: 3241 - DNA, 25 bp, Rattus norvegicus
aaaatcgagagtcccgacagcagca

SEQ ID NO: 3242 - DNA, 25 bp, Rattus norvegicus
aaaatcgagagtgccgacagcagca

SEQ ID NO: 3243 - DNA, 25 bp, Rattus norvegicus
aaaatcgaggcgcagctctggcttg

SEQ ID NO: 3244 - DNA, 25 bp, Rattus norvegicus
aaaatcgaggcggagctctggcttg

SEQ ID NO: 3245 - DNA, 25 bp, Rattus norvegicus
aaaatcgatgtcaaccctggtgagc

SEQ ID NO: 3246 - DNA, 25 bp, Rattus norvegicus
aaaatcgatgtctaccctggtgagc

SEQ ID NO: 3247 - DNA, 25 bp, Rattus norvegicus
aaaatcgccaaaagtgtcccgtcta

SEQ ID NO: 3248 - DNA, 25 bp, Rattus norvegicus
aaaatcgccaaatgtgtcccgtcta

SEQ ID NO: 3249 - DNA, 25 bp, Rattus norvegicus
aaaatcgccaacatgctgaagccgg

SEQ ID NO: 3250 - DNA, 25 bp, Rattus norvegicus
aaaatcgccaacttgctgaagccgg

SEQ ID NO: 3251 - DNA, 25 bp, Rattus norvegicus
aaaatcgctactcctttctagcctg

SEQ ID NO: 3252 - DNA, 25 bp, Rattus norvegicus
aaaatcgctactgctttctagcctg

SEQ ID NO: 3253 - DNA, 25 bp, Rattus norvegicus
aaaatcgctcaacgactttgttcac

SEQ ID NO: 3254 - DNA, 25 bp, Rattus norvegicus
aaaatcgctcaaggactttgttcac

SEQ ID NO: 3255 - DNA, 25 bp, Rattus norvegicus
aaaatcggctccaactttacagtct

SEQ ID NO: 3256 - DNA, 25 bp, Rattus norvegicus
aaaatcggctcctactttacagtct

SEQ ID NO: 3257 - DNA, 25 bp, Rattus norvegicus
aaaatcgggtgtagtggctgttgtc

SEQ ID NO: 3258 - DNA, 25 bp, Rattus norvegicus
aaaatcgggtgttgtggctgttgtc

SEQ ID NO: 3259 - DNA, 25 bp, Rattus norvegicus
aaaatcggtggcatttttgccttca

SEQ ID NO: 3260 - DNA, 25 bp, Rattus norvegicus
aaaatcggtggcttttttgccttca

SEQ ID NO: 3261 - DNA, 25 bp, Rattus norvegicus
aaaatcggtgggagccctagattat

SEQ ID NO: 3262 - DNA, 25 bp, Rattus norvegicus
aaaatcggtgggtgccctagattat

SEQ ID NO: 3263 - DNA, 25 bp, Rattus norvegicus
aaaatcgtccagacctgatctcagt

SEQ ID NO: 3264 - DNA, 25 bp, Rattus norvegicus
aaaatcgtccagtcctgatctcagt

SEQ ID NO: 3265 - DNA, 25 bp, Rattus norvegicus
aaaatctacattactttaactggag

SEQ ID NO: 3266 - DNA, 25 bp, Rattus norvegicus
aaaatctacatttctttaactggag

SEQ ID NO: 3267 - DNA, 25 bp, Rattus norvegicus
aaaatctagagtccttcctgagtcc

SEQ ID NO: 3268 - DNA, 25 bp, Rattus norvegicus
aaaatctagagtgcttcctgagtcc

SEQ ID NO: 3269 - DNA, 25 bp, Rattus norvegicus
aaaatctagggcacccagtcatttc

SEQ ID NO: 3270 - DNA, 25 bp, Rattus norvegicus
aaaatctagggctcccagtcatttc

SEQ ID NO: 3271 - DNA, 25 bp, Rattus norvegicus
aaaatctagtcaccgtaatgccctc

SEQ ID NO: 3272 - DNA, 25 bp, Rattus norvegicus
aaaatctagtcagcgtaatgccctc

SEQ ID NO: 3273 - DNA, 25 bp, Rattus norvegicus
aaaatctagtccagcatggtggccc

SEQ ID NO: 3274 - DNA, 25 bp, Rattus norvegicus
aaaatctagtcctgcatggtggccc

SEQ ID NO: 3275 - DNA, 25 bp, Rattus norvegicus
aaaatctatcctaatttgtgttcag

SEQ ID NO: 3276 - DNA, 25 bp, Rattus norvegicus
aaaatctatccttatttgtgttcag

SEQ ID NO: 3277 - DNA, 25 bp, Rattus norvegicus
aaaatctatggcatagtacagacgc

SEQ ID NO: 3278 - DNA, 25 bp, Rattus norvegicus
aaaatctatggcttagtacagacgc

SEQ ID NO: 3279 - DNA, 25 bp, Rattus norvegicus
aaaatctcatgccatttcaagtttt

SEQ ID NO: 3280 - DNA, 25 bp, Rattus norvegicus
aaaatctcatgcgatttcaagtttt

SEQ ID NO: 3281 - DNA, 25 bp, Rattus norvegicus
aaaatctcattgaccactggcttct

SEQ ID NO: 3282 - DNA, 25 bp, Rattus norvegicus
aaaatctcattgtccactggcttct

SEQ ID NO: 3283 - DNA, 25 bp, Rattus norvegicus
aaaatctccccaaggaaccgctgag

SEQ ID NO: 3284 - DNA, 25 bp, Rattus norvegicus
aaaatctccccatggaaccgctgag

SEQ ID NO: 3285 - DNA, 25 bp, Rattus norvegicus
aaaatctcctgcagctttgtggatg

SEQ ID NO: 3286 - DNA, 25 bp, Rattus norvegicus
aaaatctcctgctgctttgtggatg

SEQ ID NO: 3287 - DNA, 25 bp, Rattus norvegicus
aaaatctcctttaaaccacacactg

SEQ ID NO: 3288 - DNA, 25 bp, Rattus norvegicus
aaaatctcctttcggtggtgccctg

SEQ ID NO: 3289 - DNA, 25 bp, Rattus norvegicus
aaaatctcctttgggtggtgccctg

SEQ ID NO: 3290 - DNA, 25 bp, Rattus norvegicus
aaaatctccttttaaccacacactg

SEQ ID NO: 3291 - DNA, 25 bp, Rattus norvegicus
aaaatctctaatatgttgttccttc

SEQ ID NO: 3292 - DNA, 25 bp, Rattus norvegicus
aaaatctctaatttgttgttccttc

SEQ ID NO: 3293 - DNA, 25 bp, Rattus norvegicus
aaaatctctctcatagccaactttc

SEQ ID NO: 3294 - DNA, 25 bp, Rattus norvegicus
aaaatctctctcttagccaactttc

SEQ ID NO: 3295 - DNA, 25 bp, Rattus norvegicus
aaaatctgacctagcacttgagcgc

SEQ ID NO: 3296 - DNA, 25 bp, Rattus norvegicus
aaaatctgaccttgcacttgagcgc

SEQ ID NO: 3297 - DNA, 25 bp, Rattus norvegicus
aaaatctgagatatctgaggcacag

SEQ ID NO: 3298 - DNA, 25 bp, Rattus norvegicus
aaaatctgagatttctgaggcacag

SEQ ID NO: 3299 - DNA, 25 bp, Rattus norvegicus
aaaatctgagcccatgacataatta

SEQ ID NO: 3300 - DNA, 25 bp, Rattus norvegicus
aaaatctgagccgatgacataatta

SEQ ID NO: 3301 - DNA, 25 bp, Rattus norvegicus
aaaatctgcttacttcactactgag

SEQ ID NO: 3302 - DNA, 25 bp, Rattus norvegicus
aaaatctgcttagttcactactgag

SEQ ID NO: 3303 - DNA, 25 bp, Rattus norvegicus
aaaatctggatcacttcattcccca

SEQ ID NO: 3304 - DNA, 25 bp, Rattus norvegicus
aaaatctggatctcttcattcccca

SEQ ID NO: 3305 - DNA, 25 bp, Rattus norvegicus
aaaatctggcctatgcagatgagta

SEQ ID NO: 3306 - DNA, 25 bp, Rattus norvegicus
aaaatctggcctttgcagatgagta

SEQ ID NO: 3307 - DNA, 25 bp, Rattus norvegicus
aaaatctggtacagactttctggtc

SEQ ID NO: 3308 - DNA, 25 bp, Rattus norvegicus
aaaatctggtactgactttctggtc

SEQ ID NO: 3309 - DNA, 25 bp, Rattus norvegicus
aaaatctgtacaccactgagggctt

SEQ ID NO: 3310 - DNA, 25 bp, Rattus norvegicus
aaaatctgtacagcactgagggctt

SEQ ID NO: 3311 - DNA, 25 bp, Rattus norvegicus
aaaatctgtctcatcagtatgtagt

SEQ ID NO: 3312 - DNA, 25 bp, Rattus norvegicus
aaaatctgtctcttcagtatgtagt

SEQ ID NO: 3313 - DNA, 25 bp, Rattus norvegicus
aaaatctgtgatccaggcctcactg

SEQ ID NO: 3314 - DNA, 25 bp, Rattus norvegicus
aaaatctgtgatgcaggcctcactg

SEQ ID NO: 3315 - DNA, 25 bp, Rattus norvegicus
aaaatctgtgttacagcacccctga

SEQ ID NO: 3316 - DNA, 25 bp, Rattus norvegicus
aaaatctgtgtttcagcacccctga

SEQ ID NO: 3317 - DNA, 25 bp, Rattus norvegicus
aaaatctgttatccatggtacctca

SEQ ID NO: 3318 - DNA, 25 bp, Rattus norvegicus
aaaatctgttatgcatggtacctca

SEQ ID NO: 3319 - DNA, 25 bp, Rattus norvegicus
aaaatctgttccatattgcctgata

SEQ ID NO: 3320 - DNA, 25 bp, Rattus norvegicus
aaaatctgttccttattgcctgata

SEQ ID NO: 3321 - DNA, 25 bp, Rattus norvegicus
aaaatcttagacaccttgcttacag

SEQ ID NO: 3322 - DNA, 25 bp, Rattus norvegicus
aaaatcttagactccttgcttacag

SEQ ID NO: 3323 - DNA, 25 bp, Rattus norvegicus
aaaatcttcaacagccggatggagt

SEQ ID NO: 3324 - DNA, 25 bp, Rattus norvegicus
aaaatcttcaactgccggatggagt

SEQ ID NO: 3325 - DNA, 25 bp, Rattus norvegicus
aaaatcttcagtctcttgtcaaagc

SEQ ID NO: 3326 - DNA, 25 bp, Rattus norvegicus
aaaatcttcagtgtcttgtcaaagc

SEQ ID NO: 3327 - DNA, 25 bp, Rattus norvegicus
aaaatcttccttagtgtaggacaag

SEQ ID NO: 3328 - DNA, 25 bp, Rattus norvegicus
aaaatcttcctttgtgtaggacaag

SEQ ID NO: 3329 - DNA, 25 bp, Rattus norvegicus
aaaatcttctcactatcacatctac

SEQ ID NO: 3330 - DNA, 25 bp, Rattus norvegicus
aaaatcttctcagtatcacatctac

SEQ ID NO: 3331 - DNA, 25 bp, Rattus norvegicus
aaaatcttggctaacctacgtggca

SEQ ID NO: 3332 - DNA, 25 bp, Rattus norvegicus
aaaatcttggcttacctacgtggca

SEQ ID NO: 3333 - DNA, 25 bp, Rattus norvegicus
aaaatctttgtaagtttattcctca

SEQ ID NO: 3334 - DNA, 25 bp, Rattus norvegicus
aaaatctttgtatgtttattcctca

SEQ ID NO: 3335 - DNA, 25 bp, Rattus norvegicus
aaaatcttttacaccaagggcatag

SEQ ID NO: 3336 - DNA, 25 bp, Rattus norvegicus
aaaatcttttactccaagggcatag

SEQ ID NO: 3337 - DNA, 25 bp, Rattus norvegicus
aaaatcttttggctgcggctgcaag

SEQ ID NO: 3338 - DNA, 25 bp, Rattus norvegicus
aaaatcttttgggtgcggctgcaag

SEQ ID NO: 3339 - DNA, 25 bp, Rattus norvegicus
aaaatcttttttctctcctggcagg

SEQ ID NO: 3340 - DNA, 25 bp, Rattus norvegicus
aaaatcttttttgtctcctggcagg

SEQ ID NO: 3341 - DNA, 25 bp, Rattus norvegicus
aaaatgaaaggcctctcctgccttc

SEQ ID NO: 3342 - DNA, 25 bp, Rattus norvegicus
aaaatgaaaggcgtctcctgccttc

SEQ ID NO: 3343 - DNA, 25 bp, Rattus norvegicus
aaaatgaacaggactaccagcccct

SEQ ID NO: 3344 - DNA, 25 bp, Rattus norvegicus
aaaatgaacaggtctaccagcccct

SEQ ID NO: 3345 - DNA, 25 bp, Rattus norvegicus
aaaatgaacattctttcctcccctg

SEQ ID NO: 3346 - DNA, 25 bp, Rattus norvegicus
aaaatgaacattgtttcctcccctg

SEQ ID NO: 3347 - DNA, 25 bp, Rattus norvegicus
aaaatgaagccgctctcacctctga

SEQ ID NO: 3348 - DNA, 25 bp, Rattus norvegicus
aaaatgaagccggtctcacctctga

SEQ ID NO: 3349 - DNA, 25 bp, Rattus norvegicus
aaaatgaatgctagcttggccctcc

SEQ ID NO: 3350 - DNA, 25 bp, Rattus norvegicus
aaaatgaatgcttgcttggccctcc

SEQ ID NO: 3351 - DNA, 25 bp, Rattus norvegicus
aaaatgaattcaacagatctggcag

SEQ ID NO: 3352 - DNA, 25 bp, Rattus norvegicus
aaaatgaattcatcagatctggcag

SEQ ID NO: 3353 - DNA, 25 bp, Rattus norvegicus
aaaatgacacaaatgactgggctaa

SEQ ID NO: 3354 - DNA, 25 bp, Rattus norvegicus
aaaatgacacaattgactgggctaa

SEQ ID NO: 3355 - DNA, 25 bp, Rattus norvegicus
aaaatgacatgcagccatccctgat

SEQ ID NO: 3356 - DNA, 25 bp, Rattus norvegicus
aaaatgacatgctgccatccctgat

SEQ ID NO: 3357 - DNA, 25 bp, Rattus norvegicus
aaaatgaccaggattataagccatc

SEQ ID NO: 3358 - DNA, 25 bp, Rattus norvegicus
aaaatgaccaggtttataagccatc

SEQ ID NO: 3359 - DNA, 25 bp, Rattus norvegicus
aaaatgaccagtcctgcttcaacag

SEQ ID NO: 3360 - DNA, 25 bp, Rattus norvegicus
aaaatgaccagtgctgcttcaacag

SEQ ID NO: 3361 - DNA, 25 bp, Rattus norvegicus
aaaatgacctctatgctttgtgctg

SEQ ID NO: 3362 - DNA, 25 bp, Rattus norvegicus
aaaatgacctctttgctttgtgctg

SEQ ID NO: 3363 - DNA, 25 bp, Rattus norvegicus
aaaatgactactaccttaacactag

SEQ ID NO: 3364 - DNA, 25 bp, Rattus norvegicus
aaaatgactacttccttaacactag

SEQ ID NO: 3365 - DNA, 25 bp, Rattus norvegicus
aaaatgactggacccggttctcgat

SEQ ID NO: 3366 - DNA, 25 bp, Rattus norvegicus
aaaatgactggagccggttctcgat

SEQ ID NO: 3367 - DNA, 25 bp, Rattus norvegicus
aaaatgactggtctgtgctagctgg

SEQ ID NO: 3368 - DNA, 25 bp, Rattus norvegicus
aaaatgactggtgtgtgctagctgg

SEQ ID NO: 3369 - DNA, 25 bp, Rattus norvegicus
aaaatgactgttactgattcctgag

SEQ ID NO: 3370 - DNA, 25 bp, Rattus norvegicus
aaaatgactgtttctgattcctgag

SEQ ID NO: 3371 - DNA, 25 bp, Rattus norvegicus
aaaatgacttatatctgctccagaa

SEQ ID NO: 3372 - DNA, 25 bp, Rattus norvegicus
aaaatgacttatttctgctccagaa

SEQ ID NO: 3373 - DNA, 25 bp, Rattus norvegicus
aaaatgactttactgtacctcctgc

SEQ ID NO: 3374 - DNA, 25 bp, Rattus norvegicus
aaaatgactttagtgtacctcctgc

SEQ ID NO: 3375 - DNA, 25 bp, Rattus norvegicus
aaaatgactttcaccttgcttcttc

SEQ ID NO: 3376 - DNA, 25 bp, Rattus norvegicus
aaaatgactttctccttgcttcttc

SEQ ID NO: 3377 - DNA, 25 bp, Rattus norvegicus
aaaatgagacaaccgggctgtgcct

SEQ ID NO: 3378 - DNA, 25 bp, Rattus norvegicus
aaaatgagacaagcgggctgtgcct

SEQ ID NO: 3379 - DNA, 25 bp, Rattus norvegicus
aaaatgagacatcacttctgttcag

SEQ ID NO: 3380 - DNA, 25 bp, Rattus norvegicus
aaaatgagacatgacttctgttcag

SEQ ID NO: 3381 - DNA, 25 bp, Rattus norvegicus
aaaatgagactcatcacgaacggcc

SEQ ID NO: 3382 - DNA, 25 bp, Rattus norvegicus
aaaatgagactcttcacgaacggcc

SEQ ID NO: 3383 - DNA, 25 bp, Rattus norvegicus
aaaatgagcaaaatccttccaaatc

SEQ ID NO: 3384 - DNA, 25 bp, Rattus norvegicus
aaaatgagcaaacctgagcagcccc

SEQ ID NO: 3385 - DNA, 25 bp, Rattus norvegicus
aaaatgagcaaagctgagcagcccc

SEQ ID NO: 3386 - DNA, 25 bp, Rattus norvegicus
aaaatgagcaaattccttccaaatc

SEQ ID NO: 3387 - DNA, 25 bp, Rattus norvegicus
aaaatgagcacgctttcttaccggc

SEQ ID NO: 3388 - DNA, 25 bp, Rattus norvegicus
aaaatgagcacggtttcttaccggc

SEQ ID NO: 3389 - DNA, 25 bp, Rattus norvegicus
aaaatgagcccaaggtactaagtct

SEQ ID NO: 3390 - DNA, 25 bp, Rattus norvegicus
aaaatgagcccatggtactaagtct

SEQ ID NO: 3391 - DNA, 25 bp, Rattus norvegicus
aaaatgagcgtcagcgcagccgcgt

SEQ ID NO: 3392 - DNA, 25 bp, Rattus norvegicus
aaaatgagcgtctgcgcagccgcgt

SEQ ID NO: 3393 - DNA, 25 bp, Rattus norvegicus
aaaatgaggagcagtgcccggagct

SEQ ID NO: 3394 - DNA, 25 bp, Rattus norvegicus
aaaatgaggagctgtgcccggagct

SEQ ID NO: 3395 - DNA, 25 bp, Rattus norvegicus
aaaatgaggaggaccgctggtgaac

SEQ ID NO: 3396 - DNA, 25 bp, Rattus norvegicus
aaaatgaggaggtccgctggtgaac

SEQ ID NO: 3397 - DNA, 25 bp, Rattus norvegicus
aaaatgagtctgctcttgccatggc

SEQ ID NO: 3398 - DNA, 25 bp, Rattus norvegicus
aaaatgagtctggtcttgccatggc

SEQ ID NO: 3399 - DNA, 25 bp, Rattus norvegicus
aaaatgagtcttctccctttgtggt

SEQ ID NO: 3400 - DNA, 25 bp, Rattus norvegicus
aaaatgagtcttgtccctttgtggt

SEQ ID NO: 3401 - DNA, 25 bp, Rattus norvegicus
aaaatgagttaaatccaccggatct

SEQ ID NO: 3402 - DNA, 25 bp, Rattus norvegicus
aaaatgagttaattccaccggatct

SEQ ID NO: 3403 - DNA, 25 bp, Rattus norvegicus
aaaatgagttcaacagtctgtttat

SEQ ID NO: 3404 - DNA, 25 bp, Rattus norvegicus
aaaatgagttcatcagtctgtttat

SEQ ID NO: 3405 - DNA, 25 bp, Rattus norvegicus
aaaatgagttccagtgacacgcccc

SEQ ID NO: 3406 - DNA, 25 bp, Rattus norvegicus
aaaatgagttcctgtgacacgcccc

SEQ ID NO: 3407 - DNA, 25 bp, Rattus norvegicus
aaaatgagttggcagcttgctgagt

SEQ ID NO: 3408 - DNA, 25 bp, Rattus norvegicus
aaaatgagttgggagcttgctgagt

SEQ ID NO: 3409 - DNA, 25 bp, Rattus norvegicus
aaaatgataaccaattgactccaat

SEQ ID NO: 3410 - DNA, 25 bp, Rattus norvegicus
aaaatgataacctattgactccaat

SEQ ID NO: 3411 - DNA, 25 bp, Rattus norvegicus
aaaatgatcaagacagctctcctgt

SEQ ID NO: 3412 - DNA, 25 bp, Rattus norvegicus
aaaatgatcaagtcagctctcctgt

SEQ ID NO: 3413 - DNA, 25 bp, Rattus norvegicus
aaaatgatccccaagctgtggtttt

SEQ ID NO: 3414 - DNA, 25 bp, Rattus norvegicus
aaaatgatcccctagctgtggtttt

SEQ ID NO: 3415 - DNA, 25 bp, Rattus norvegicus
aaaatgatccctccatttcctcaag

SEQ ID NO: 3416 - DNA, 25 bp, Rattus norvegicus
aaaatgatccctgcatttcctcaag

SEQ ID NO: 3417 - DNA, 25 bp, Rattus norvegicus
aaaatgatctgcagtctactgccta

SEQ ID NO: 3418 - DNA, 25 bp, Rattus norvegicus
aaaatgatctgctgtctactgccta

SEQ ID NO: 3419 - DNA, 25 bp, Rattus norvegicus
aaaatgatgctcacccttcttgtct

SEQ ID NO: 3420 - DNA, 25 bp, Rattus norvegicus
aaaatgatgctctcccttcttgtct

SEQ ID NO: 3421 - DNA, 25 bp, Rattus norvegicus
aaaatgatgcttccttcctcagttt

SEQ ID NO: 3422 - DNA, 25 bp, Rattus norvegicus
aaaatgatgcttgcttcctcagttt

SEQ ID NO: 3423 - DNA, 25 bp, Rattus norvegicus
aaaatgatggctaaggtcccctgag

SEQ ID NO: 3424 - DNA, 25 bp, Rattus norvegicus
aaaatgatggcttaggtcccctgag

SEQ ID NO: 3425 - DNA, 25 bp, Rattus norvegicus
aaaatgatgggcatgcgggacttca

SEQ ID NO: 3426 - DNA, 25 bp, Rattus norvegicus
aaaatgatgggcttgcgggacttca

SEQ ID NO: 3427 - DNA, 25 bp, Rattus norvegicus
aaaatgattcttcccttcaaccctg

SEQ ID NO: 3428 - DNA, 25 bp, Rattus norvegicus
aaaatgattcttgccttcaaccctg

SEQ ID NO: 3429 - DNA, 25 bp, Rattus norvegicus
aaaatgattgcccaggccatccctg

SEQ ID NO: 3430 - DNA, 25 bp, Rattus norvegicus
aaaatgattgccgaggccatccctg

SEQ ID NO: 3431 - DNA, 25 bp, Rattus norvegicus
aaaatgatttttaacgagcgtggca

SEQ ID NO: 3432 - DNA, 25 bp, Rattus norvegicus
aaaatgattttttacgagcgtggca

SEQ ID NO: 3433 - DNA, 25 bp, Rattus norvegicus
aaaatgcaaccaatttccctctgtg

SEQ ID NO: 3434 - DNA, 25 bp, Rattus norvegicus
aaaatgcaaccattttccctctgtg

SEQ ID NO: 3435 - DNA, 25 bp, Rattus norvegicus
aaaatgcaataaatcctgtggtgtt

SEQ ID NO: 3436 - DNA, 25 bp, Rattus norvegicus
aaaatgcaataattcctgtggtgtt

SEQ ID NO: 3437 - DNA, 25 bp, Rattus norvegicus
aaaatgcacattagggaccttagat

SEQ ID NO: 3438 - DNA, 25 bp, Rattus norvegicus
aaaatgcacatttgggaccttagat

SEQ ID NO: 3439 - DNA, 25 bp, Rattus norvegicus
aaaatgcacctgcagctgcatctga

SEQ ID NO: 3440 - DNA, 25 bp, Rattus norvegicus
aaaatgcacctggagctgcatctga

SEQ ID NO: 3441 - DNA, 25 bp, Rattus norvegicus
aaaatgcaccttaatcacagtctgg

SEQ ID NO: 3442 - DNA, 25 bp, Rattus norvegicus
aaaatgcacctttatcacagtctgg

SEQ ID NO: 3443 - DNA, 25 bp, Rattus norvegicus
aaaatgcacgcgaaagccatgccac

SEQ ID NO: 3444 - DNA, 25 bp, Rattus norvegicus
aaaatgcacgcgtaagccatgccac

SEQ ID NO: 3445 - DNA, 25 bp, Rattus norvegicus
aaaatgcactttcagttgaaaaatg

SEQ ID NO: 3446 - DNA, 25 bp, Rattus norvegicus
aaaatgcactttgagttgaaaaatg

SEQ ID NO: 3447 - DNA, 25 bp, Rattus norvegicus
aaaatgcagaggaccctgccggagt

SEQ ID NO: 3448 - DNA, 25 bp, Rattus norvegicus
aaaatgcagaggtccctgccggagt

SEQ ID NO: 3449 - DNA, 25 bp, Rattus norvegicus
aaaatgcaggcactgttttcacaaa

SEQ ID NO: 3450 - DNA, 25 bp, Rattus norvegicus
aaaatgcaggcagtgttttcacaaa

SEQ ID NO: 3451 - DNA, 25 bp, Rattus norvegicus
aaaatgcagtagacgcccctcggag

SEQ ID NO: 3452 - DNA, 25 bp, Rattus norvegicus
aaaatgcagtagtcgcccctcggag

SEQ ID NO: 3453 - DNA, 25 bp, Rattus norvegicus
aaaatgcagtcacgcgtgggcacat

SEQ ID NO: 3454 - DNA, 25 bp, Rattus norvegicus
aaaatgcagtcaggcgtgggcacat

SEQ ID NO: 3455 - DNA, 25 bp, Rattus norvegicus
aaaatgcagtctcccagtttgtttc

SEQ ID NO: 3456 - DNA, 25 bp, Rattus norvegicus
aaaatgcagtctgccagtttgtttc

SEQ ID NO: 3457 - DNA, 25 bp, Rattus norvegicus
aaaatgcatcctagtctacttcctg

SEQ ID NO: 3458 - DNA, 25 bp, Rattus norvegicus
aaaatgcatccttgtctacttcctg

SEQ ID NO: 3459 - DNA, 25 bp, Rattus norvegicus
aaaatgcatcttactcccataacca

SEQ ID NO: 3460 - DNA, 25 bp, Rattus norvegicus
aaaatgcatctttctcccataacca

SEQ ID NO: 3461 - DNA, 25 bp, Rattus norvegicus
aaaatgccagccctaaagtacctct

SEQ ID NO: 3462 - DNA, 25 bp, Rattus norvegicus
aaaatgccagccgtaaagtacctct

SEQ ID NO: 3463 - DNA, 25 bp, Rattus norvegicus
aaaatgccaggcctagcttcatact

SEQ ID NO: 3464 - DNA, 25 bp, Rattus norvegicus
aaaatgccaggcgtagcttcatact

SEQ ID NO: 3465 - DNA, 25 bp, Rattus norvegicus
aaaatgcccataatgttcaccatct

SEQ ID NO: 3466 - DNA, 25 bp, Rattus norvegicus
aaaatgcccatattgttcaccatct

SEQ ID NO: 3467 - DNA, 25 bp, Rattus norvegicus
aaaatgccccggctaactgcatgtt

SEQ ID NO: 3468 - DNA, 25 bp, Rattus norvegicus
aaaatgccccgggtaactgcatgtt

SEQ ID NO: 3469 - DNA, 25 bp, Rattus norvegicus
aaaatgccgcggagtttctgaagga

SEQ ID NO: 3470 - DNA, 25 bp, Rattus norvegicus
aaaatgccgcggtgtttctgaagga

SEQ ID NO: 3471 - DNA, 25 bp, Rattus norvegicus
aaaatgcctcctaaccacaataaag

SEQ ID NO: 3472 - DNA, 25 bp, Rattus norvegicus
aaaatgcctccttaccacaataaag

SEQ ID NO: 3473 - DNA, 25 bp, Rattus norvegicus
aaaatgcctctgagtgtctgaccca

SEQ ID NO: 3474 - DNA, 25 bp, Rattus norvegicus
aaaatgcctctgtgtgtctgaccca

SEQ ID NO: 3475 - DNA, 25 bp, Rattus norvegicus
aaaatgcctggcacaatcttcccag

SEQ ID NO: 3476 - DNA, 25 bp, Rattus norvegicus
aaaatgcctggctcaatcttcccag

SEQ ID NO: 3477 - DNA, 25 bp, Rattus norvegicus
aaaatgcctgggatagctgaagaaa

SEQ ID NO: 3478 - DNA, 25 bp, Rattus norvegicus
aaaatgcctgggttagctgaagaaa

SEQ ID NO: 3479 - DNA, 25 bp, Rattus norvegicus
aaaatgcctgtaagtctcaactaag

SEQ ID NO: 3480 - DNA, 25 bp, Rattus norvegicus
aaaatgcctgtatgtctcaactaag

SEQ ID NO: 3481 - DNA, 25 bp, Rattus norvegicus
aaaatgccttctaggtatcagttag

SEQ ID NO: 3482 - DNA, 25 bp, Rattus norvegicus
aaaatgccttctcctaatgtggtgc

SEQ ID NO: 3483 - DNA, 25 bp, Rattus norvegicus
aaaatgccttctgctaatgtggtgc

SEQ ID NO: 3484 - DNA, 25 bp, Rattus norvegicus
aaaatgccttcttggtatcagttag

SEQ ID NO: 3485 - DNA, 25 bp, Rattus norvegicus
aaaatgcgcgttagtactgtggatt

SEQ ID NO: 3486 - DNA, 25 bp, Rattus norvegicus
aaaatgcgcgtttgtactgtggatt

SEQ ID NO: 3487 - DNA, 25 bp, Rattus norvegicus
aaaatgctaaccacctgtgctcatg

SEQ ID NO: 3488 - DNA, 25 bp, Rattus norvegicus
aaaatgctaacctcctgtgctcatg

SEQ ID NO: 3489 - DNA, 25 bp, Rattus norvegicus
aaaatgctaagtctgaggcgaagac

SEQ ID NO: 3490 - DNA, 25 bp, Rattus norvegicus
aaaatgctaagtgtgaggcgaagac

SEQ ID NO: 3491 - DNA, 25 bp, Rattus norvegicus
aaaatgctactgatgctatgtcaca

SEQ ID NO: 3492 - DNA, 25 bp, Rattus norvegicus
aaaatgctactgttgctatgtcaca

SEQ ID NO: 3493 - DNA, 25 bp, Rattus norvegicus
aaaatgctcaggacggctgtggaca

SEQ ID NO: 3494 - DNA, 25 bp, Rattus norvegicus
aaaatgctcaggtcggctgtggaca

SEQ ID NO: 3495 - DNA, 25 bp, Rattus norvegicus
aaaatgctccaactccatatctctg

SEQ ID NO: 3496 - DNA, 25 bp, Rattus norvegicus
aaaatgctccaagtccatatctctg

SEQ ID NO: 3497 - DNA, 25 bp, Rattus norvegicus
aaaatgctccaccttagcctttcct

SEQ ID NO: 3498 - DNA, 25 bp, Rattus norvegicus
aaaatgctccacgttagcctttcct

SEQ ID NO: 3499 - DNA, 25 bp, Rattus norvegicus
aaaatgctccatacagtctgcttac

SEQ ID NO: 3500 - DNA, 25 bp, Rattus norvegicus
aaaatgctccattcagtctgcttac

SEQ ID NO: 3501 - DNA, 25 bp, Rattus norvegicus
aaaatgctccgtcaatctggccaac

SEQ ID NO: 3502 - DNA, 25 bp, Rattus norvegicus
aaaatgctccgtgaatctggccaac

SEQ ID NO: 3503 - DNA, 25 bp, Rattus norvegicus
aaaatgctccttaacaccagttaat

SEQ ID NO: 3504 - DNA, 25 bp, Rattus norvegicus
aaaatgctcctttacaccagttaat

SEQ ID NO: 3505 - DNA, 25 bp, Rattus norvegicus
aaaatgctctctagcactgtatcct

SEQ ID NO: 3506 - DNA, 25 bp, Rattus norvegicus
aaaatgctctcttgcactgtatcct

SEQ ID NO: 3507 - DNA, 25 bp, Rattus norvegicus
aaaatgctctgaaactgggcactct

SEQ ID NO: 3508 - DNA, 25 bp, Rattus norvegicus
aaaatgctctgactcctagtgccaa

SEQ ID NO: 3509 - DNA, 25 bp, Rattus norvegicus
aaaatgctctgagtcctagtgccaa

SEQ ID NO: 3510 - DNA, 25 bp, Rattus norvegicus
aaaatgctctgatactgggcactct

SEQ ID NO: 3511 - DNA, 25 bp, Rattus norvegicus
aaaatgctgcctacttttgtccgga

SEQ ID NO: 3512 - DNA, 25 bp, Rattus norvegicus
aaaatgctgccttcttttgtccgga

SEQ ID NO: 3513 - DNA, 25 bp, Rattus norvegicus
aaaatgctgcttacctccctttctc

SEQ ID NO: 3514 - DNA, 25 bp, Rattus norvegicus
aaaatgctgcttatctgtaatagcg

SEQ ID NO: 3515 - DNA, 25 bp, Rattus norvegicus
aaaatgctgctttcctccctttctc

SEQ ID NO: 3516 - DNA, 25 bp, Rattus norvegicus
aaaatgctgcttttctgtaatagcg

SEQ ID NO: 3517 - DNA, 25 bp, Rattus norvegicus
aaaatgctggccacgcagcagcggg

SEQ ID NO: 3518 - DNA, 25 bp, Rattus norvegicus
aaaatgctggcctcgcagcagcggg

SEQ ID NO: 3519 - DNA, 25 bp, Rattus norvegicus
aaaatgctgtccaggctgtgcaggc

SEQ ID NO: 3520 - DNA, 25 bp, Rattus norvegicus
aaaatgctgtcctggctgtgcaggc

SEQ ID NO: 3521 - DNA, 25 bp, Rattus norvegicus
aaaatgctgttgcacacacacacac

SEQ ID NO: 3522 - DNA, 25 bp, Rattus norvegicus
aaaatgctgttggacacacacacac

SEQ ID NO: 3523 - DNA, 25 bp, Rattus norvegicus
aaaatgcttcaaaactgctaggagt

SEQ ID NO: 3524 - DNA, 25 bp, Rattus norvegicus
aaaatgcttcaatactgctaggagt

SEQ ID NO: 3525 - DNA, 25 bp, Rattus norvegicus
aaaatgcttcacatcttaggattag

SEQ ID NO: 3526 - DNA, 25 bp, Rattus norvegicus
aaaatgcttcacttcttaggattag

SEQ ID NO: 3527 - DNA, 25 bp, Rattus norvegicus
aaaatgcttgggactgtcaccgtca

SEQ ID NO: 3528 - DNA, 25 bp, Rattus norvegicus
aaaatgcttgggtctgtcaccgtca

SEQ ID NO: 3529 - DNA, 25 bp, Rattus norvegicus
aaaatgctttgcatgtggctccatc

SEQ ID NO: 3530 - DNA, 25 bp, Rattus norvegicus
aaaatgctttgcttgtggctccatc

SEQ ID NO: 3531 - DNA, 25 bp, Rattus norvegicus
aaaatgcttttgctcctcttctgga

SEQ ID NO: 3532 - DNA, 25 bp, Rattus norvegicus
aaaatgcttttggtcctcttctgga

SEQ ID NO: 3533 - DNA, 25 bp, Rattus norvegicus
aaaatggaaatcaggaggctacaag

SEQ ID NO: 3534 - DNA, 25 bp, Rattus norvegicus
aaaatggaaatctggaggctacaag

SEQ ID NO: 3535 - DNA, 25 bp, Rattus norvegicus
aaaatggacagcagtctccttgggc

SEQ ID NO: 3536 - DNA, 25 bp, Rattus norvegicus
aaaatggacagctgtctccttgggc

SEQ ID NO: 3537 - DNA, 25 bp, Rattus norvegicus
aaaatggaccgcagttcctggtgac

SEQ ID NO: 3538 - DNA, 25 bp, Rattus norvegicus
aaaatggaccgctgttcctggtgac

SEQ ID NO: 3539 - DNA, 25 bp, Rattus norvegicus
aaaatggacgtgatctcccagaccc

SEQ ID NO: 3540 - DNA, 25 bp, Rattus norvegicus
aaaatggacgtgttctcccagaccc

SEQ ID NO: 3541 - DNA, 25 bp, Rattus norvegicus
aaaatggagcagaggttccccttca

SEQ ID NO: 3542 - DNA, 25 bp, Rattus norvegicus
aaaatggagcagtggttccccttca

SEQ ID NO: 3543 - DNA, 25 bp, Rattus norvegicus
aaaatggaggccctggtcactcagc

SEQ ID NO: 3544 - DNA, 25 bp, Rattus norvegicus
aaaatggaggccgtggtcactcagc

SEQ ID NO: 3545 - DNA, 25 bp, Rattus norvegicus
aaaatggatcaaagaaggtcaaccc

SEQ ID NO: 3546 - DNA, 25 bp, Rattus norvegicus
aaaatggatcaatgaaggtcaaccc

SEQ ID NO: 3547 - DNA, 25 bp, Rattus norvegicus
aaaatggatcccctgtgacgcgttt

SEQ ID NO: 3548 - DNA, 25 bp, Rattus norvegicus
aaaatggatcccgtgtgacgcgttt

SEQ ID NO: 3549 - DNA, 25 bp, Rattus norvegicus
aaaatggcagctctggtcaagttcc

SEQ ID NO: 3550 - DNA, 25 bp, Rattus norvegicus
aaaatggcagctgtggtcaagttcc

SEQ ID NO: 3551 - DNA, 25 bp, Rattus norvegicus
aaaatggcatcacagcagaccgcgt

SEQ ID NO: 3552 - DNA, 25 bp, Rattus norvegicus
aaaatggcatcagagcagaccgcgt

SEQ ID NO: 3553 - DNA, 25 bp, Rattus norvegicus
aaaatggccaccaggaaatcccctg

SEQ ID NO: 3554 - DNA, 25 bp, Rattus norvegicus
aaaatggccacctggaaatcccctg

SEQ ID NO: 3555 - DNA, 25 bp, Rattus norvegicus
aaaatggccaggacttccagtacgc

SEQ ID NO: 3556 - DNA, 25 bp, Rattus norvegicus
aaaatggccaggtcttccagtacgc

SEQ ID NO: 3557 - DNA, 25 bp, Rattus norvegicus
aaaatggccgcacacagtaatactg

SEQ ID NO: 3558 - DNA, 25 bp, Rattus norvegicus
aaaatggccgcagacagtaatactg

SEQ ID NO: 3559 - DNA, 25 bp, Rattus norvegicus
aaaatggcctctagacatctgatgc

SEQ ID NO: 3560 - DNA, 25 bp, Rattus norvegicus
aaaatggcctcttgacatctgatgc

SEQ ID NO: 3561 - DNA, 25 bp, Rattus norvegicus
aaaatggcctgaagcttcccatgaa

SEQ ID NO: 3562 - DNA, 25 bp, Rattus norvegicus
aaaatggcctgatgcttcccatgaa

SEQ ID NO: 3563 - DNA, 25 bp, Rattus norvegicus
aaaatggcggagacttcgcgtctga

SEQ ID NO: 3564 - DNA, 25 bp, Rattus norvegicus
aaaatggcggagtcttcgcgtctga

SEQ ID NO: 3565 - DNA, 25 bp, Rattus norvegicus
aaaatggctactcgtttctaatata

SEQ ID NO: 3566 - DNA, 25 bp, Rattus norvegicus
aaaatggctactggtttctaatata

SEQ ID NO: 3567 - DNA, 25 bp, Rattus norvegicus
aaaatggctcaccaatggcttaacc

SEQ ID NO: 3568 - DNA, 25 bp, Rattus norvegicus
aaaatggctcacgaatggcttaacc

SEQ ID NO: 3569 - DNA, 25 bp, Rattus norvegicus
aaaatggctcctacatgtctcttgg

SEQ ID NO: 3570 - DNA, 25 bp, Rattus norvegicus
aaaatggctccttcatgtctcttgg

SEQ ID NO: 3571 - DNA, 25 bp, Rattus norvegicus
aaaatggctgaacgccagggccctg

SEQ ID NO: 3572 - DNA, 25 bp, Rattus norvegicus
aaaatggctgaaggccagggccctg

SEQ ID NO: 3573 - DNA, 25 bp, Rattus norvegicus
aaaatggctgccaaacctatgctgc

SEQ ID NO: 3574 - DNA, 25 bp, Rattus norvegicus
aaaatggctgcctaacctatgctgc

SEQ ID NO: 3575 - DNA, 25 bp, Rattus norvegicus
aaaatggctggcattcccagaactc

SEQ ID NO: 3576 - DNA, 25 bp, Rattus norvegicus
aaaatggctggctttcccagaactc

SEQ ID NO: 3577 - DNA, 25 bp, Rattus norvegicus
aaaatggctggtacacacctccaaa

SEQ ID NO: 3578 - DNA, 25 bp, Rattus norvegicus
aaaatggctggttcacacctccaaa

SEQ ID NO: 3579 - DNA, 25 bp, Rattus norvegicus
aaaatggcttgaccgctacagacag

SEQ ID NO: 3580 - DNA, 25 bp, Rattus norvegicus
aaaatggcttgagcgctacagacag

SEQ ID NO: 3581 - DNA, 25 bp, Rattus norvegicus
aaaatggctttgacgtatagtgata

SEQ ID NO: 3582 - DNA, 25 bp, Rattus norvegicus
aaaatggctttgtcgtatagtgata

SEQ ID NO: 3583 - DNA, 25 bp, Rattus norvegicus
aaaatggcttttcccattcacagat

SEQ ID NO: 3584 - DNA, 25 bp, Rattus norvegicus
aaaatggcttttgccattcacagat

SEQ ID NO: 3585 - DNA, 25 bp, Rattus norvegicus
aaaatgggacaaactcttcaggagt

SEQ ID NO: 3586 - DNA, 25 bp, Rattus norvegicus
aaaatgggacaatctcttcaggagt

SEQ ID NO: 3587 - DNA, 25 bp, Rattus norvegicus
aaaatgggcgctcggatgaagcaaa

SEQ ID NO: 3588 - DNA, 25 bp, Rattus norvegicus
aaaatgggcgctgggatgaagcaaa

SEQ ID NO: 3589 - DNA, 25 bp, Rattus norvegicus
aaaatgggctccacaccacaagtgg

SEQ ID NO: 3590 - DNA, 25 bp, Rattus norvegicus
aaaatgggctcctcaccacaagtgg

SEQ ID NO: 3591 - DNA, 25 bp, Rattus norvegicus
aaaatgggtcaaccagttcctgctc

SEQ ID NO: 3592 - DNA, 25 bp, Rattus norvegicus
aaaatgggtcaagcagttcctgctc

SEQ ID NO: 3593 - DNA, 25 bp, Rattus norvegicus
aaaatgggttctaccaccatcgcaa

SEQ ID NO: 3594 - DNA, 25 bp, Rattus norvegicus
aaaatgggttcttccaccatcgcaa

SEQ ID NO: 3595 - DNA, 25 bp, Rattus norvegicus
aaaatggtacacattctcctcagaa

SEQ ID NO: 3596 - DNA, 25 bp, Rattus norvegicus
aaaatggtacactttctcctcagaa

SEQ ID NO: 3597 - DNA, 25 bp, Rattus norvegicus
aaaatggtccatcctacatcaacag

SEQ ID NO: 3598 - DNA, 25 bp, Rattus norvegicus
aaaatggtccatgctacatcaacag

SEQ ID NO: 3599 - DNA, 25 bp, Rattus norvegicus
aaaatggtcgctatgtccaccagag

SEQ ID NO: 3600 - DNA, 25 bp, Rattus norvegicus
aaaatggtcgctttgtccaccagag

SEQ ID NO: 3601 - DNA, 25 bp, Rattus norvegicus
aaaatggtcgtgaccatccacagtc

SEQ ID NO: 3602 - DNA, 25 bp, Rattus norvegicus
aaaatggtcgtgtccatccacagtc

SEQ ID NO: 3603 - DNA, 25 bp, Rattus norvegicus
aaaatggtcgttcccagcgctttgg

SEQ ID NO: 3604 - DNA, 25 bp, Rattus norvegicus
aaaatggtcgttgccagcgctttgg

SEQ ID NO: 3605 - DNA, 25 bp, Rattus norvegicus
aaaatggtggcacgcttggcgaaca

SEQ ID NO: 3606 - DNA, 25 bp, Rattus norvegicus
aaaatggtggcaggcttggcgaaca

SEQ ID NO: 3607 - DNA, 25 bp, Rattus norvegicus
aaaatggtgggaccacacaaggcaa

SEQ ID NO: 3608 - DNA, 25 bp, Rattus norvegicus
aaaatggtgggagcacacaaggcaa

SEQ ID NO: 3609 - DNA, 25 bp, Rattus norvegicus
aaaatggtggtgagaataatgtaac

SEQ ID NO: 3610 - DNA, 25 bp, Rattus norvegicus
aaaatggtggtgtgaataatgtaac

SEQ ID NO: 3611 - DNA, 25 bp, Rattus norvegicus
aaaatggtgtttcctttctatatgc

SEQ ID NO: 3612 - DNA, 25 bp, Rattus norvegicus
aaaatggtgtttgctttctatatgc

SEQ ID NO: 3613 - DNA, 25 bp, Rattus norvegicus
aaaatggttcctctactgcccatac

SEQ ID NO: 3614 - DNA, 25 bp, Rattus norvegicus
aaaatggttcctgtactgcccatac

SEQ ID NO: 3615 - DNA, 25 bp, Rattus norvegicus
aaaatgtaactgctgcagctctcag

SEQ ID NO: 3616 - DNA, 25 bp, Rattus norvegicus
aaaatgtaactggtgcagctctcag

SEQ ID NO: 3617 - DNA, 25 bp, Rattus norvegicus
aaaatgtacacacttcgcctacaca

SEQ ID NO: 3618 - DNA, 25 bp, Rattus norvegicus
aaaatgtacacagttcgcctacaca

SEQ ID NO: 3619 - DNA, 25 bp, Rattus norvegicus
aaaatgtacagtcgaccctgccgtc

SEQ ID NO: 3620 - DNA, 25 bp, Rattus norvegicus
aaaatgtacagtggaccctgccgtc

SEQ ID NO: 3621 - DNA, 25 bp, Rattus norvegicus
aaaatgtaccacatcctgtagctca

SEQ ID NO: 3622 - DNA, 25 bp, Rattus norvegicus
aaaatgtaccacttcctgtagctca

SEQ ID NO: 3623 - DNA, 25 bp, Rattus norvegicus
aaaatgtatggcctacttccaccat

SEQ ID NO: 3624 - DNA, 25 bp, Rattus norvegicus
aaaatgtatggcgtacttccaccat

SEQ ID NO: 3625 - DNA, 25 bp, Rattus norvegicus
aaaatgtatttgagccttctgtgag

SEQ ID NO: 3626 - DNA, 25 bp, Rattus norvegicus
aaaatgtatttgtgccttctgtgag

SEQ ID NO: 3627 - DNA, 25 bp, Rattus norvegicus
aaaatgtcagatacactgcccagga

SEQ ID NO: 3628 - DNA, 25 bp, Rattus norvegicus
aaaatgtcagattcactgcccagga

SEQ ID NO: 3629 - DNA, 25 bp, Rattus norvegicus
aaaatgtcatcccatgccaagtgtc

SEQ ID NO: 3630 - DNA, 25 bp, Rattus norvegicus
aaaatgtcatccgatgccaagtgtc

SEQ ID NO: 3631 - DNA, 25 bp, Rattus norvegicus
aaaatgtcatctcgccaggtgccat

SEQ ID NO: 3632 - DNA, 25 bp, Rattus norvegicus
aaaatgtcatctggccaggtgccat

SEQ ID NO: 3633 - DNA, 25 bp, Rattus norvegicus
aaaatgtcatgtatgtgctgcctct

SEQ ID NO: 3634 - DNA, 25 bp, Rattus norvegicus
aaaatgtcatgtttgtgctgcctct

SEQ ID NO: 3635 - DNA, 25 bp, Rattus norvegicus
aaaatgtcccagacctgggtgccaa

SEQ ID NO: 3636 - DNA, 25 bp, Rattus norvegicus
aaaatgtcccagtcctgggtgccaa

SEQ ID NO: 3637 - DNA, 25 bp, Rattus norvegicus
aaaatgtccgtgatctgcgtataaa

SEQ ID NO: 3638 - DNA, 25 bp, Rattus norvegicus
aaaatgtccgtgttctgcgtataaa

SEQ ID NO: 3639 - DNA, 25 bp, Rattus norvegicus
aaaatgtcctatcctttacctgtgg

SEQ ID NO: 3640 - DNA, 25 bp, Rattus norvegicus
aaaatgtcctatgctttacctgtgg

SEQ ID NO: 3641 - DNA, 25 bp, Rattus norvegicus
aaaatgtcctccaaaggcttctgcc

SEQ ID NO: 3642 - DNA, 25 bp, Rattus norvegicus
aaaatgtcctcctaaggcttctgcc

SEQ ID NO: 3643 - DNA, 25 bp, Rattus norvegicus
aaaatgtctaataacctgcattatt

SEQ ID NO: 3644 - DNA, 25 bp, Rattus norvegicus
aaaatgtctaattacctgcattatt

SEQ ID NO: 3645 - DNA, 25 bp, Rattus norvegicus
aaaatgtctccgattttactctgag

SEQ ID NO: 3646 - DNA, 25 bp, Rattus norvegicus
aaaatgtctccgtttttactctgag

SEQ ID NO: 3647 - DNA, 25 bp, Rattus norvegicus
aaaatgtctctacccaaaacttcag

SEQ ID NO: 3648 - DNA, 25 bp, Rattus norvegicus
aaaatgtctctagccaaaacttcag

SEQ ID NO: 3649 - DNA, 25 bp, Rattus norvegicus
aaaatgtctctgactctaagattaa

SEQ ID NO: 3650 - DNA, 25 bp, Rattus norvegicus
aaaatgtctctgtctctaagattaa

SEQ ID NO: 3651 - DNA, 25 bp, Rattus norvegicus
aaaatgtctgatccttaaccctccc

SEQ ID NO: 3652 - DNA, 25 bp, Rattus norvegicus
aaaatgtctgatgcttaaccctccc

SEQ ID NO: 3653 - DNA, 25 bp, Rattus norvegicus
aaaatgtctgccatttgtgctcaca

SEQ ID NO: 3654 - DNA, 25 bp, Rattus norvegicus
aaaatgtctgcccaacattccttcc

SEQ ID NO: 3655 - DNA, 25 bp, Rattus norvegicus
aaaatgtctgccgaacattccttcc

SEQ ID NO: 3656 - DNA, 25 bp, Rattus norvegicus
aaaatgtctgccttttgtgctcaca

SEQ ID NO: 3657 - DNA, 25 bp, Rattus norvegicus
aaaatgtctgggactgctctgcact

SEQ ID NO: 3658 - DNA, 25 bp, Rattus norvegicus
aaaatgtctgggtctgctctgcact

SEQ ID NO: 3659 - DNA, 25 bp, Rattus norvegicus
aaaatgtctgtcaacgtcaaccgca

SEQ ID NO: 3660 - DNA, 25 bp, Rattus norvegicus
aaaatgtctgtctacgtcaaccgca

SEQ ID NO: 3661 - DNA, 25 bp, Rattus norvegicus
aaaatgtcttgtatgattggtttag

SEQ ID NO: 3662 - DNA, 25 bp, Rattus norvegicus
aaaatgtcttgtttgattggtttag

SEQ ID NO: 3663 - DNA, 25 bp, Rattus norvegicus
aaaatgtgaacccatcacctgcaac

SEQ ID NO: 3664 - DNA, 25 bp, Rattus norvegicus
aaaatgtgaaccgatcacctgcaac

SEQ ID NO: 3665 - DNA, 25 bp, Rattus norvegicus
aaaatgtgaccaagttcgcttctgt

SEQ ID NO: 3666 - DNA, 25 bp, Rattus norvegicus
aaaatgtgaccatgttcgcttctgt

SEQ ID NO: 3667 - DNA, 25 bp, Rattus norvegicus
aaaatgtgccctccccaaattggag

SEQ ID NO: 3668 - DNA, 25 bp, Rattus norvegicus
aaaatgtgccctgcccaaattggag

SEQ ID NO: 3669 - DNA, 25 bp, Rattus norvegicus
aaaatgtgccgtagattacgcctaa

SEQ ID NO: 3670 - DNA, 25 bp, Rattus norvegicus
aaaatgtgccgttgattacgcctaa

SEQ ID NO: 3671 - DNA, 25 bp, Rattus norvegicus
aaaatgtgcctgactttatcctgac

SEQ ID NO: 3672 - DNA, 25 bp, Rattus norvegicus
aaaatgtgcctgtctttatcctgac

SEQ ID NO: 3673 - DNA, 25 bp, Rattus norvegicus
aaaatgtgctcccatgcttaacttg

SEQ ID NO: 3674 - DNA, 25 bp, Rattus norvegicus
aaaatgtgctccgatgcttaacttg

SEQ ID NO: 3675 - DNA, 25 bp, Rattus norvegicus
aaaatgtggatcaaggcctcagttt

SEQ ID NO: 3676 - DNA, 25 bp, Rattus norvegicus
aaaatgtggatcaccacctcagtgt

SEQ ID NO: 3677 - DNA, 25 bp, Rattus norvegicus
aaaatgtggatctaggcctcagttt

SEQ ID NO: 3678 - DNA, 25 bp, Rattus norvegicus
aaaatgtggatctccacctcagtgt

SEQ ID NO: 3679 - DNA, 25 bp, Rattus norvegicus
aaaatgtggcatccgttttacccaa

SEQ ID NO: 3680 - DNA, 25 bp, Rattus norvegicus
aaaatgtggcatgcgttttacccaa

SEQ ID NO: 3681 - DNA, 25 bp, Rattus norvegicus
aaaatgtggctaaacctccgtgctg

SEQ ID NO: 3682 - DNA, 25 bp, Rattus norvegicus
aaaatgtggctatacctccgtgctg

SEQ ID NO: 3683 - DNA, 25 bp, Rattus norvegicus
aaaatgtggctgaactgctcttcac

SEQ ID NO: 3684 - DNA, 25 bp, Rattus norvegicus
aaaatgtggctgtactgctcttcac

SEQ ID NO: 3685 - DNA, 25 bp, Rattus norvegicus
aaaatgtgtcaaccactgttggagg

SEQ ID NO: 3686 - DNA, 25 bp, Rattus norvegicus
aaaatgtgtcaagcactgttggagg

SEQ ID NO: 3687 - DNA, 25 bp, Rattus norvegicus
aaaatgtgtcccaagcttcgattct

SEQ ID NO: 3688 - DNA, 25 bp, Rattus norvegicus
aaaatgtgtccctagcttcgattct

SEQ ID NO: 3689 - DNA, 25 bp, Rattus norvegicus
aaaatgtgtcctcacctggctacaa

SEQ ID NO: 3690 - DNA, 25 bp, Rattus norvegicus
aaaatgtgtcctgacctggctacaa

SEQ ID NO: 3691 - DNA, 25 bp, Rattus norvegicus
aaaatgtgtcgacgctttggtgtga

SEQ ID NO: 3692 - DNA, 25 bp, Rattus norvegicus
aaaatgtgtcgaggctttggtgtga

SEQ ID NO: 3693 - DNA, 25 bp, Rattus norvegicus
aaaatgtgtgctagccttgggcttc

SEQ ID NO: 3694 - DNA, 25 bp, Rattus norvegicus
aaaatgtgtgcttgccttgggcttc

SEQ ID NO: 3695 - DNA, 25 bp, Rattus norvegicus
aaaatgttcacaaggtcaccgcctg

SEQ ID NO: 3696 - DNA, 25 bp, Rattus norvegicus
aaaatgttcacatggtcaccgcctg

SEQ ID NO: 3697 - DNA, 25 bp, Rattus norvegicus
aaaatgttccatagctggcctgtca

SEQ ID NO: 3698 - DNA, 25 bp, Rattus norvegicus
aaaatgttccatctagagttcaggg

SEQ ID NO: 3699 - DNA, 25 bp, Rattus norvegicus
aaaatgttccatgtagagttcaggg

SEQ ID NO: 3700 - DNA, 25 bp, Rattus norvegicus
aaaatgttccattgctggcctgtca

SEQ ID NO: 3701 - DNA, 25 bp, Rattus norvegicus
aaaatgttcccgagatgtccacagt

SEQ ID NO: 3702 - DNA, 25 bp, Rattus norvegicus
aaaatgttcccgtgatgtccacagt

SEQ ID NO: 3703 - DNA, 25 bp, Rattus norvegicus
aaaatgttccctagaccattggctg

SEQ ID NO: 3704 - DNA, 25 bp, Rattus norvegicus
aaaatgttcccttgaccattggctg

SEQ ID NO: 3705 - DNA, 25 bp, Rattus norvegicus
aaaatgttcctcctggtggtgctca

SEQ ID NO: 3706 - DNA, 25 bp, Rattus norvegicus
aaaatgttcctcgtggtggtgctca

SEQ ID NO: 3707 - DNA, 25 bp, Rattus norvegicus
aaaatgttctttacatgccatcaga

SEQ ID NO: 3708 - DNA, 25 bp, Rattus norvegicus
aaaatgttcttttcatgccatcaga

SEQ ID NO: 3709 - DNA, 25 bp, Rattus norvegicus
aaaatgttggacaatggtctggcga

SEQ ID NO: 3710 - DNA, 25 bp, Rattus norvegicus
aaaatgttggactatggtctggcga

SEQ ID NO: 3711 - DNA, 25 bp, Rattus norvegicus
aaaatgttggcaagaagtcatccat

SEQ ID NO: 3712 - DNA, 25 bp, Rattus norvegicus
aaaatgttggcatgaagtcatccat

SEQ ID NO: 3713 - DNA, 25 bp, Rattus norvegicus
aaaatgttggccactcttcctttag

SEQ ID NO: 3714 - DNA, 25 bp, Rattus norvegicus
aaaatgttggcctctcttcctttag

SEQ ID NO: 3715 - DNA, 25 bp, Rattus norvegicus
aaaatgttgtgtcttaccctctgtg

SEQ ID NO: 3716 - DNA, 25 bp, Rattus norvegicus
aaaatgttgtgtgttaccctctgtg

SEQ ID NO: 3717 - DNA, 25 bp, Rattus norvegicus
aaaatgtttaaaatgcctcagctgc

SEQ ID NO: 3718 - DNA, 25 bp, Rattus norvegicus
aaaatgtttaaattgcctcagctgc

SEQ ID NO: 3719 - DNA, 25 bp, Rattus norvegicus
aaaatgtttataatctcctcagtac

SEQ ID NO: 3720 - DNA, 25 bp, Rattus norvegicus
aaaatgtttatattctcctcagtac

SEQ ID NO: 3721 - DNA, 25 bp, Rattus norvegicus
aaaatgtttcccaacgtgttctctg

SEQ ID NO: 3722 - DNA, 25 bp, Rattus norvegicus
aaaatgtttcccacttagctatcag

SEQ ID NO: 3723 - DNA, 25 bp, Rattus norvegicus
aaaatgtttccctacgtgttctctg

SEQ ID NO: 3724 - DNA, 25 bp, Rattus norvegicus
aaaatgtttccctcttagctatcag

SEQ ID NO: 3725 - DNA, 25 bp, Rattus norvegicus
aaaatgtttcctagactcacccgtg

SEQ ID NO: 3726 - DNA, 25 bp, Rattus norvegicus
aaaatgtttccttgactcacccgtg

SEQ ID NO: 3727 - DNA, 25 bp, Rattus norvegicus
aaaatgtttctactccatcttaaag

SEQ ID NO: 3728 - DNA, 25 bp, Rattus norvegicus
aaaatgtttctagtccatcttaaag

SEQ ID NO: 3729 - DNA, 25 bp, Rattus norvegicus
aaaatgtttcttcctggtgaaaaat

SEQ ID NO: 3730 - DNA, 25 bp, Rattus norvegicus
aaaatgtttcttgctggtgaaaaat

SEQ ID NO: 3731 - DNA, 25 bp, Rattus norvegicus
aaaattaaagttacacatacagtgg

SEQ ID NO: 3732 - DNA, 25 bp, Rattus norvegicus
aaaattaaagtttcacatacagtgg

SEQ ID NO: 3733 - DNA, 25 bp, Rattus norvegicus
aaaattacaagccttctgcctcaac

SEQ ID NO: 3734 - DNA, 25 bp, Rattus norvegicus
aaaattacaagcgttctgcctcaac

SEQ ID NO: 3735 - DNA, 25 bp, Rattus norvegicus
aaaattaccataccttccagcagtt

SEQ ID NO: 3736 - DNA, 25 bp, Rattus norvegicus
aaaattaccatagcttccagcagtt

SEQ ID NO: 3737 - DNA, 25 bp, Rattus norvegicus
aaaattacctatcaggtccctgagg

SEQ ID NO: 3738 - DNA, 25 bp, Rattus norvegicus
aaaattacctatgaggtccctgagg

SEQ ID NO: 3739 - DNA, 25 bp, Rattus norvegicus
aaaattacctgcatttggagccaga

SEQ ID NO: 3740 - DNA, 25 bp, Rattus norvegicus
aaaattacctgcttttggagccaga

SEQ ID NO: 3741 - DNA, 25 bp, Rattus norvegicus
aaaattactcttacatggtacacag

SEQ ID NO: 3742 - DNA, 25 bp, Rattus norvegicus
aaaattactctttcatggtacacag

SEQ ID NO: 3743 - DNA, 25 bp, Rattus norvegicus
aaaattagctgaccagcccactttc

SEQ ID NO: 3744 - DNA, 25 bp, Rattus norvegicus
aaaattagctgagcagcccactttc

SEQ ID NO: 3745 - DNA, 25 bp, Rattus norvegicus
aaaattagtttcatcttctgtgtgc

SEQ ID NO: 3746 - DNA, 25 bp, Rattus norvegicus
aaaattagtttcttcttctgtgtgc

SEQ ID NO: 3747 - DNA, 25 bp, Rattus norvegicus
aaaattatctcccagtcgctcagct

SEQ ID NO: 3748 - DNA, 25 bp, Rattus norvegicus
aaaattatctccgagtcgctcagct

SEQ ID NO: 3749 - DNA, 25 bp, Rattus norvegicus
aaaattatcttcacatgggcagagt

SEQ ID NO: 3750 - DNA, 25 bp, Rattus norvegicus
aaaattatcttctcatgggcagagt

SEQ ID NO: 3751 - DNA, 25 bp, Rattus norvegicus
aaaattatctttcgctactcaacag

SEQ ID NO: 3752 - DNA, 25 bp, Rattus norvegicus
aaaattatctttggctactcaacag

SEQ ID NO: 3753 - DNA, 25 bp, Rattus norvegicus
aaaattatgggtaagatctctttag

SEQ ID NO: 3754 - DNA, 25 bp, Rattus norvegicus
aaaattatgggttagatctctttag

SEQ ID NO: 3755 - DNA, 25 bp, Rattus norvegicus
aaaattatgtgcagggctcctttcc

SEQ ID NO: 3756 - DNA, 25 bp, Rattus norvegicus
aaaattatgtgctgggctcctttcc

SEQ ID NO: 3757 - DNA, 25 bp, Rattus norvegicus
aaaattattttacagctgtccacat

SEQ ID NO: 3758 - DNA, 25 bp, Rattus norvegicus
aaaattattttagagctgtccacat

SEQ ID NO: 3759 - DNA, 25 bp, Rattus norvegicus
aaaattcaatctagccaagggccgt

SEQ ID NO: 3760 - DNA, 25 bp, Rattus norvegicus
aaaattcaatcttgccaagggccgt

SEQ ID NO: 3761 - DNA, 25 bp, Rattus norvegicus
aaaattcacatccttgccggagcaa

SEQ ID NO: 3762 - DNA, 25 bp, Rattus norvegicus
aaaattcacatcgttgccggagcaa

SEQ ID NO: 3763 - DNA, 25 bp, Rattus norvegicus
aaaattcagcaaaccctttcctaag

SEQ ID NO: 3764 - DNA, 25 bp, Rattus norvegicus
aaaattcagcaatccctttcctaag

SEQ ID NO: 3765 - DNA, 25 bp, Rattus norvegicus
aaaattcagccgctcctgtcttaga

SEQ ID NO: 3766 - DNA, 25 bp, Rattus norvegicus
aaaattcagccggtcctgtcttaga

SEQ ID NO: 3767 - DNA, 25 bp, Rattus norvegicus
aaaattcagctaccccttcaacatg

SEQ ID NO: 3768 - DNA, 25 bp, Rattus norvegicus
aaaattcagctagcccttcaacatg

SEQ ID NO: 3769 - DNA, 25 bp, Rattus norvegicus
aaaattccacttacttcatcttgtt

SEQ ID NO: 3770 - DNA, 25 bp, Rattus norvegicus
aaaattccactttcttcatcttgtt

SEQ ID NO: 3771 - DNA, 25 bp, Rattus norvegicus
aaaattccagctcaatgctcaccct

SEQ ID NO: 3772 - DNA, 25 bp, Rattus norvegicus
aaaattccagctcccgataagacgg

SEQ ID NO: 3773 - DNA, 25 bp, Rattus norvegicus
aaaattccagctgaatgctcaccct

SEQ ID NO: 3774 - DNA, 25 bp, Rattus norvegicus
aaaattccagctgccgataagacgg

SEQ ID NO: 3775 - DNA, 25 bp, Rattus norvegicus
aaaattccctggatattctgctact

SEQ ID NO: 3776 - DNA, 25 bp, Rattus norvegicus
aaaattccctggttattctgctact

SEQ ID NO: 3777 - DNA, 25 bp, Rattus norvegicus
aaaattcctaccagaatcctcttct

SEQ ID NO: 3778 - DNA, 25 bp, Rattus norvegicus
aaaattcctacctgaatcctcttct

SEQ ID NO: 3779 - DNA, 25 bp, Rattus norvegicus
aaaattcctcagactgctggcctcg

SEQ ID NO: 3780 - DNA, 25 bp, Rattus norvegicus
aaaattcctcagtctgctggcctcg

SEQ ID NO: 3781 - DNA, 25 bp, Rattus norvegicus
aaaattcctcccctcatctaatagt

SEQ ID NO: 3782 - DNA, 25 bp, Rattus norvegicus
aaaattcctcccgtcatctaatagt

SEQ ID NO: 3783 - DNA, 25 bp, Rattus norvegicus
aaaattcctcttattcttcatgcca

SEQ ID NO: 3784 - DNA, 25 bp, Rattus norvegicus
aaaattcctctttttcttcatgcca

SEQ ID NO: 3785 - DNA, 25 bp, Rattus norvegicus
aaaattcctgacactgactcactgt

SEQ ID NO: 3786 - DNA, 25 bp, Rattus norvegicus
aaaattcctgactctgactcactgt

SEQ ID NO: 3787 - DNA, 25 bp, Rattus norvegicus
aaaattcctgtcacttttagttcag

SEQ ID NO: 3788 - DNA, 25 bp, Rattus norvegicus
aaaattcctgtctcttttagttcag

SEQ ID NO: 3789 - DNA, 25 bp, Rattus norvegicus
aaaattcggtttcagccggctgaca

SEQ ID NO: 3790 - DNA, 25 bp, Rattus norvegicus
aaaattcggtttgagccggctgaca

SEQ ID NO: 3791 - DNA, 25 bp, Rattus norvegicus
aaaattctccaaactggtcctgctg

SEQ ID NO: 3792 - DNA, 25 bp, Rattus norvegicus
aaaattctccaatctggtcctgctg

SEQ ID NO: 3793 - DNA, 25 bp, Rattus norvegicus
aaaattctctctccattgtgtcaga

SEQ ID NO: 3794 - DNA, 25 bp, Rattus norvegicus
aaaattctctctgcattgtgtcaga

SEQ ID NO: 3795 - DNA, 25 bp, Rattus norvegicus
aaaattctgcaactttttcctgaga

SEQ ID NO: 3796 - DNA, 25 bp, Rattus norvegicus
aaaattctgcaagtttttcctgaga

SEQ ID NO: 3797 - DNA, 25 bp, Rattus norvegicus
aaaattctgcacaagctctgagctt

SEQ ID NO: 3798 - DNA, 25 bp, Rattus norvegicus
aaaattctgcactagctctgagctt

SEQ ID NO: 3799 - DNA, 25 bp, Rattus norvegicus
aaaattctggccctcttagaagctc

SEQ ID NO: 3800 - DNA, 25 bp, Rattus norvegicus
aaaattctggccgtcttagaagctc

SEQ ID NO: 3801 - DNA, 25 bp, Rattus norvegicus
aaaattctggtactgacacttcaca

SEQ ID NO: 3802 - DNA, 25 bp, Rattus norvegicus
aaaattctggtagtgacacttcaca

SEQ ID NO: 3803 - DNA, 25 bp, Rattus norvegicus
aaaattcttctcagctaatttgaat

SEQ ID NO: 3804 - DNA, 25 bp, Rattus norvegicus
aaaattcttctctgctaatttgaat

SEQ ID NO: 3805 - DNA, 25 bp, Rattus norvegicus
aaaattcttgtaacaccttctgtga

SEQ ID NO: 3806 - DNA, 25 bp, Rattus norvegicus
aaaattcttgtatcaccttctgtga

SEQ ID NO: 3807 - DNA, 25 bp, Rattus norvegicus
aaaattctttcaatcctggctgttt

SEQ ID NO: 3808 - DNA, 25 bp, Rattus norvegicus
aaaattctttcattcctggctgttt

SEQ ID NO: 3809 - DNA, 25 bp, Rattus norvegicus
aaaattgaacctcgactccctgctt

SEQ ID NO: 3810 - DNA, 25 bp, Rattus norvegicus
aaaattgaacctggactccctgctt

SEQ ID NO: 3811 - DNA, 25 bp, Rattus norvegicus
aaaattgaagcgatgctccctctta

SEQ ID NO: 3812 - DNA, 25 bp, Rattus norvegicus
aaaattgaagcgttgctccctctta

SEQ ID NO: 3813 - DNA, 25 bp, Rattus norvegicus
aaaattgacaagagaccccatccca

SEQ ID NO: 3814 - DNA, 25 bp, Rattus norvegicus
aaaattgacaagtgaccccatccca

SEQ ID NO: 3815 - DNA, 25 bp, Rattus norvegicus
aaaattgagacaccatctcactatg

SEQ ID NO: 3816 - DNA, 25 bp, Rattus norvegicus
aaaattgagacagcatctcactatg

SEQ ID NO: 3817 - DNA, 25 bp, Rattus norvegicus
aaaattgagagactccagcatccac

SEQ ID NO: 3818 - DNA, 25 bp, Rattus norvegicus
aaaattgagagagtccagcatccac

SEQ ID NO: 3819 - DNA, 25 bp, Rattus norvegicus
aaaattgcaaccagggctgttcatt

SEQ ID NO: 3820 - DNA, 25 bp, Rattus norvegicus
aaaattgcaacctgggctgttcatt

SEQ ID NO: 3821 - DNA, 25 bp, Rattus norvegicus
aaaattgcaccaaatttcctgcaaa

SEQ ID NO: 3822 - DNA, 25 bp, Rattus norvegicus
aaaattgcaccatatttcctgcaaa

SEQ ID NO: 3823 - DNA, 25 bp, Rattus norvegicus
aaaattgcatctatgtgacctgaca

SEQ ID NO: 3824 - DNA, 25 bp, Rattus norvegicus
aaaattgcatctttgtgacctgaca

SEQ ID NO: 3825 - DNA, 25 bp, Rattus norvegicus
aaaattgcattccttctccttataa

SEQ ID NO: 3826 - DNA, 25 bp, Rattus norvegicus
aaaattgcattcgttctccttataa

SEQ ID NO: 3827 - DNA, 25 bp, Rattus norvegicus
aaaattgcatttccagaagcttctg

SEQ ID NO: 3828 - DNA, 25 bp, Rattus norvegicus
aaaattgcatttgcagaagcttctg

SEQ ID NO: 3829 - DNA, 25 bp, Rattus norvegicus
aaaattgcccttatctagttctaga

SEQ ID NO: 3830 - DNA, 25 bp, Rattus norvegicus
aaaattgcccttttctagttctaga

SEQ ID NO: 3831 - DNA, 25 bp, Rattus norvegicus
aaaattgcctggcacctgcccaagt

SEQ ID NO: 3832 - DNA, 25 bp, Rattus norvegicus
aaaattgcctgggacctgcccaagt

SEQ ID NO: 3833 - DNA, 25 bp, Rattus norvegicus
aaaattgcctttccattcagtctct

SEQ ID NO: 3834 - DNA, 25 bp, Rattus norvegicus
aaaattgcctttgcattcagtctct

SEQ ID NO: 3835 - DNA, 25 bp, Rattus norvegicus
aaaattgctcacagatttaggtaaa

SEQ ID NO: 3836 - DNA, 25 bp, Rattus norvegicus
aaaattgctcactgatttaggtaaa

SEQ ID NO: 3837 - DNA, 25 bp, Rattus norvegicus
aaaattgctgtcactcttattctag

SEQ ID NO: 3838 - DNA, 25 bp, Rattus norvegicus
aaaattgctgtctctcttattctag

SEQ ID NO: 3839 - DNA, 25 bp, Rattus norvegicus
aaaattggctttcagatttctgaaa

SEQ ID NO: 3840 - DNA, 25 bp, Rattus norvegicus
aaaattggctttgagatttctgaaa

SEQ ID NO: 3841 - DNA, 25 bp, Rattus norvegicus
aaaattgggctgaccgccgcggacg

SEQ ID NO: 3842 - DNA, 25 bp, Rattus norvegicus
aaaattgggctgtccgccgcggacg

SEQ ID NO: 3843 - DNA, 25 bp, Rattus norvegicus
aaaattgggtcacccttgaattctg

SEQ ID NO: 3844 - DNA, 25 bp, Rattus norvegicus
aaaattgggtcagccttgaattctg

SEQ ID NO: 3845 - DNA, 25 bp, Rattus norvegicus
aaaattggtgctatggcgttgtaga

SEQ ID NO: 3846 - DNA, 25 bp, Rattus norvegicus
aaaattggtgctttggcgttgtaga

SEQ ID NO: 3847 - DNA, 25 bp, Rattus norvegicus
aaaattgtatgcagagggcctctct

SEQ ID NO: 3848 - DNA, 25 bp, Rattus norvegicus
aaaattgtatgctgagggcctctct

SEQ ID NO: 3849 - DNA, 25 bp, Rattus norvegicus
aaaattgtccagattgtagagacta

SEQ ID NO: 3850 - DNA, 25 bp, Rattus norvegicus
aaaattgtccagtttgtagagacta

SEQ ID NO: 3851 - DNA, 25 bp, Rattus norvegicus
aaaattgtccttaccaaatggctga

SEQ ID NO: 3852 - DNA, 25 bp, Rattus norvegicus
aaaattgtcctttccaaatggctga

SEQ ID NO: 3853 - DNA, 25 bp, Rattus norvegicus
aaaattgtgcctatatgtactggta

SEQ ID NO: 3854 - DNA, 25 bp, Rattus norvegicus
aaaattgtgcctttatgtactggta

SEQ ID NO: 3855 - DNA, 25 bp, Rattus norvegicus
aaaattgtgctgcttggtgaatcca

SEQ ID NO: 3856 - DNA, 25 bp, Rattus norvegicus
aaaattgtgctggttggtgaatcca

SEQ ID NO: 3857 - DNA, 25 bp, Rattus norvegicus
aaaattgtgtttcgcagtttgcggc

SEQ ID NO: 3858 - DNA, 25 bp, Rattus norvegicus
aaaattgtgtttggcagtttgcggc

SEQ ID NO: 3859 - DNA, 25 bp, Rattus norvegicus
aaaattgttcacaactgtactgatg

SEQ ID NO: 3860 - DNA, 25 bp, Rattus norvegicus
aaaattgttcactactgtactgatg

SEQ ID NO: 3861 - DNA, 25 bp, Rattus norvegicus
aaaattgttctaccctgtgttgctt

SEQ ID NO: 3862 - DNA, 25 bp, Rattus norvegicus
aaaattgttctagcctgtgttgctt

SEQ ID NO: 3863 - DNA, 25 bp, Rattus norvegicus
aaaattgtttctagagtggtggcca

SEQ ID NO: 3864 - DNA, 25 bp, Rattus norvegicus
aaaattgtttctatgccagagtgaa

SEQ ID NO: 3865 - DNA, 25 bp, Rattus norvegicus
aaaattgtttcttgagtggtggcca

SEQ ID NO: 3866 - DNA, 25 bp, Rattus norvegicus
aaaattgtttctttgccagagtgaa

SEQ ID NO: 3867 - DNA, 25 bp, Rattus norvegicus
aaaattgttttcagtgttcacttga

SEQ ID NO: 3868 - DNA, 25 bp, Rattus norvegicus
aaaattgttttctgtgttcacttga

SEQ ID NO: 3869 - DNA, 25 bp, Rattus norvegicus
aaaatttagttcatcccaggtgcca

SEQ ID NO: 3870 - DNA, 25 bp, Rattus norvegicus
aaaatttagttcttcccaggtgcca

SEQ ID NO: 3871 - DNA, 25 bp, Rattus norvegicus
aaaatttatactcccacatgattgt

SEQ ID NO: 3872 - DNA, 25 bp, Rattus norvegicus
aaaatttatactgccacatgattgt

SEQ ID NO: 3873 - DNA, 25 bp, Rattus norvegicus
aaaatttcagaaatgcccctgcctc

SEQ ID NO: 3874 - DNA, 25 bp, Rattus norvegicus
aaaatttcagaattgcccctgcctc

SEQ ID NO: 3875 - DNA, 25 bp, Rattus norvegicus
aaaatttcagtaccatccacatgtg

SEQ ID NO: 3876 - DNA, 25 bp, Rattus norvegicus
aaaatttcagtagcatccacatgtg

SEQ ID NO: 3877 - DNA, 25 bp, Rattus norvegicus
aaaatttcatcgagcccttgagcac

SEQ ID NO: 3878 - DNA, 25 bp, Rattus norvegicus
aaaatttcatcgtgcccttgagcac

SEQ ID NO: 3879 - DNA, 25 bp, Rattus norvegicus
aaaatttcatctactacacacgctc

SEQ ID NO: 3880 - DNA, 25 bp, Rattus norvegicus
aaaatttcatcttctacacacgctc

SEQ ID NO: 3881 - DNA, 25 bp, Rattus norvegicus
aaaatttcatgtacagttctggctt

SEQ ID NO: 3882 - DNA, 25 bp, Rattus norvegicus
aaaatttcatgtcttggtgccagac

SEQ ID NO: 3883 - DNA, 25 bp, Rattus norvegicus
aaaatttcatgtgttggtgccagac

SEQ ID NO: 3884 - DNA, 25 bp, Rattus norvegicus
aaaatttcatgttcagttctggctt

SEQ ID NO: 3885 - DNA, 25 bp, Rattus norvegicus
aaaatttccacaacaatgcagcaat

SEQ ID NO: 3886 - DNA, 25 bp, Rattus norvegicus
aaaatttccacatcaatgcagcaat

SEQ ID NO: 3887 - DNA, 25 bp, Rattus norvegicus
aaaatttccccaattgctctctgta

SEQ ID NO: 3888 - DNA, 25 bp, Rattus norvegicus
aaaatttccccatttgctctctgta

SEQ ID NO: 3889 - DNA, 25 bp, Rattus norvegicus
aaaatttcctggattcccttcatgc

SEQ ID NO: 3890 - DNA, 25 bp, Rattus norvegicus
aaaatttcctggtttcccttcatgc

SEQ ID NO: 3891 - DNA, 25 bp, Rattus norvegicus
aaaatttcgcagaagtactcagctg

SEQ ID NO: 3892 - DNA, 25 bp, Rattus norvegicus
aaaatttcgcagtagtactcagctg

SEQ ID NO: 3893 - DNA, 25 bp, Rattus norvegicus
aaaatttctcccaaatgtcaagtga

SEQ ID NO: 3894 - DNA, 25 bp, Rattus norvegicus
aaaatttctccctaatgtcaagtga

SEQ ID NO: 3895 - DNA, 25 bp, Rattus norvegicus
aaaatttctgacatcgtggacactg

SEQ ID NO: 3896 - DNA, 25 bp, Rattus norvegicus
aaaatttctgacttcgtggacactg

SEQ ID NO: 3897 - DNA, 25 bp, Rattus norvegicus
aaaatttctgtcagtgccagcctgc

SEQ ID NO: 3898 - DNA, 25 bp, Rattus norvegicus
aaaatttctgtctgtgccagcctgc

SEQ ID NO: 3899 - DNA, 25 bp, Rattus norvegicus
aaaatttgaggcagcgctttggagg

SEQ ID NO: 3900 - DNA, 25 bp, Rattus norvegicus
aaaatttgaggctgcgctttggagg

SEQ ID NO: 3901 - DNA, 25 bp, Rattus norvegicus
aaaatttgcagcagcttttcatcgt

SEQ ID NO: 3902 - DNA, 25 bp, Rattus norvegicus
aaaatttgcagctgcttttcatcgt

SEQ ID NO: 3903 - DNA, 25 bp, Rattus norvegicus
aaaatttgccacagtcctcatttct

SEQ ID NO: 3904 - DNA, 25 bp, Rattus norvegicus
aaaatttgccactgtcctcatttct

SEQ ID NO: 3905 - DNA, 25 bp, Rattus norvegicus
aaaatttgccctctttcattagaag

SEQ ID NO: 3906 - DNA, 25 bp, Rattus norvegicus
aaaatttgccctgtttcattagaag

SEQ ID NO: 3907 - DNA, 25 bp, Rattus norvegicus
aaaatttgcgaacttctgaatcctc

SEQ ID NO: 3908 - DNA, 25 bp, Rattus norvegicus
aaaatttgcgaagttctgaatcctc

SEQ ID NO: 3909 - DNA, 25 bp, Rattus norvegicus
aaaatttgctacaccaggatgctgg

SEQ ID NO: 3910 - DNA, 25 bp, Rattus norvegicus
aaaatttgctactccaggatgctgg

SEQ ID NO: 3911 - DNA, 25 bp, Rattus norvegicus
aaaatttggcagcttccgccagtgc

SEQ ID NO: 3912 - DNA, 25 bp, Rattus norvegicus
aaaatttggcaggttccgccagtgc

SEQ ID NO: 3913 - DNA, 25 bp, Rattus norvegicus
aaaatttgtcgaaagcccacacagc

SEQ ID NO: 3914 - DNA, 25 bp, Rattus norvegicus
aaaatttgtcgatagcccacacagc

SEQ ID NO: 3915 - DNA, 25 bp, Rattus norvegicus
aaaatttgtctcaaaatcatgtaca

SEQ ID NO: 3916 - DNA, 25 bp, Rattus norvegicus
aaaatttgtctctaaatcatgtaca

SEQ ID NO: 3917 - DNA, 25 bp, Rattus norvegicus
aaaatttgtgccagtgtcccaagag

SEQ ID NO: 3918 - DNA, 25 bp, Rattus norvegicus
aaaatttgtgcctgtgtcccaagag

SEQ ID NO: 3919 - DNA, 25 bp, Rattus norvegicus
aaaatttgttgtatggtgccctgtg

SEQ ID NO: 3920 - DNA, 25 bp, Rattus norvegicus
aaaatttgttgtttggtgccctgtg

SEQ ID NO: 3921 - DNA, 25 bp, Rattus norvegicus
aaaattttccttatcacactgatag

SEQ ID NO: 3922 - DNA, 25 bp, Rattus norvegicus
aaaattttccttttcacactgatag

SEQ ID NO: 3923 - DNA, 25 bp, Rattus norvegicus
aaaattttctcactacctgtacatt

SEQ ID NO: 3924 - DNA, 25 bp, Rattus norvegicus
aaaattttctcagtacctgtacatt

SEQ ID NO: 3925 - DNA, 25 bp, Rattus norvegicus
aaaattttgctaccatggacctaat

SEQ ID NO: 3926 - DNA, 25 bp, Rattus norvegicus
aaaattttgctagcatggacctaat

SEQ ID NO: 3927 - DNA, 25 bp, Rattus norvegicus
aaaatttttcaactcaatagtgtct

SEQ ID NO: 3928 - DNA, 25 bp, Rattus norvegicus
aaaatttttcaagtcaatagtgtct

SEQ ID NO: 3929 - DNA, 25 bp, Rattus norvegicus
aaaatttttccaatagattgcctat

SEQ ID NO: 3930 - DNA, 25 bp, Rattus norvegicus
aaaatttttccattagattgcctat

SEQ ID NO: 3931 - DNA, 25 bp, Rattus norvegicus
aaacaaaaacaactgcgtgtggcat

SEQ ID NO: 3932 - DNA, 25 bp, Rattus norvegicus
aaacaaaaacaagtgcgtgtggcat

SEQ ID NO: 3933 - DNA, 25 bp, Rattus norvegicus
aaacaaaaacatcctgagcagcggc

SEQ ID NO: 3934 - DNA, 25 bp, Rattus norvegicus
aaacaaaaacatgctgagcagcggc

SEQ ID NO: 3935 - DNA, 25 bp, Rattus norvegicus
aaacaaaacagcctggcactgcggc

SEQ ID NO: 3936 - DNA, 25 bp, Rattus norvegicus
aaacaaaacagcgtggcactgcggc

SEQ ID NO: 3937 - DNA, 25 bp, Rattus norvegicus
aaacaaaacgaccactgccctgaag

SEQ ID NO: 3938 - DNA, 25 bp, Rattus norvegicus
aaacaaaacgacgactgccctgaag

SEQ ID NO: 3939 - DNA, 25 bp, Rattus norvegicus
aaacaaaatcatcctcaaacaactg

SEQ ID NO: 3940 - DNA, 25 bp, Rattus norvegicus
aaacaaaatcatgctcaaacaactg

SEQ ID NO: 3941 - DNA, 25 bp, Rattus norvegicus
aaacaaacaaatctagttcaggaga

SEQ ID NO: 3942 - DNA, 25 bp, Rattus norvegicus
aaacaaacaaatgtagttcaggaga

SEQ ID NO: 3943 - DNA, 25 bp, Rattus norvegicus
aaacaaacagcacacctctggtggc

SEQ ID NO: 3944 - DNA, 25 bp, Rattus norvegicus
aaacaaacagcagacctctggtggc

SEQ ID NO: 3945 - DNA, 25 bp, Rattus norvegicus
aaacaaacaggcaatggatggatat

SEQ ID NO: 3946 - DNA, 25 bp, Rattus norvegicus
aaacaaacaggctatggatggatat

SEQ ID NO: 3947 - DNA, 25 bp, Rattus norvegicus
aaacaaaccatgagtgccaacccgg

SEQ ID NO: 3948 - DNA, 25 bp, Rattus norvegicus
aaacaaaccatgatcctttcctgac

SEQ ID NO: 3949 - DNA, 25 bp, Rattus norvegicus
aaacaaaccatgtgtgccaacccgg

SEQ ID NO: 3950 - DNA, 25 bp, Rattus norvegicus
aaacaaaccatgttcctttcctgac

SEQ ID NO: 3951 - DNA, 25 bp, Rattus norvegicus
aaacaaaccctgacctcagtgagat

SEQ ID NO: 3952 - DNA, 25 bp, Rattus norvegicus
aaacaaaccctgtcctcagtgagat

SEQ ID NO: 3953 - DNA, 25 bp, Rattus norvegicus
aaacaaacgtggctcatcaccctag

SEQ ID NO: 3954 - DNA, 25 bp, Rattus norvegicus
aaacaaacgtgggtcatcaccctag

SEQ ID NO: 3955 - DNA, 25 bp, Rattus norvegicus
aaacaaactgttcggctactggaca

SEQ ID NO: 3956 - DNA, 25 bp, Rattus norvegicus
aaacaaactgttgggctactggaca

SEQ ID NO: 3957 - DNA, 25 bp, Rattus norvegicus
aaacaaacttaaatctcacatctag

SEQ ID NO: 3958 - DNA, 25 bp, Rattus norvegicus
aaacaaacttaattctcacatctag

SEQ ID NO: 3959 - DNA, 25 bp, Rattus norvegicus
aaacaaacttctatgagaagcgagt

SEQ ID NO: 3960 - DNA, 25 bp, Rattus norvegicus
aaacaaacttctttgagaagcgagt

SEQ ID NO: 3961 - DNA, 25 bp, Rattus norvegicus
aaacaaagacctcatccatccaaga

SEQ ID NO: 3962 - DNA, 25 bp, Rattus norvegicus
aaacaaagacctgatccatccaaga

SEQ ID NO: 3963 - DNA, 25 bp, Rattus norvegicus
aaacaaagcatgagagcccacccag

SEQ ID NO: 3964 - DNA, 25 bp, Rattus norvegicus
aaacaaagcatgtgagcccacccag

SEQ ID NO: 3965 - DNA, 25 bp, Rattus norvegicus
aaacaaagcattatctgtcctcctg

SEQ ID NO: 3966 - DNA, 25 bp, Rattus norvegicus
aaacaaagcattttctgtcctcctg

SEQ ID NO: 3967 - DNA, 25 bp, Rattus norvegicus
aaacaaagcttccaatcactagtga

SEQ ID NO: 3968 - DNA, 25 bp, Rattus norvegicus
aaacaaagcttcgaatcactagtga

SEQ ID NO: 3969 - DNA, 25 bp, Rattus norvegicus
aaacaaaggcctccacttctgactg

SEQ ID NO: 3970 - DNA, 25 bp, Rattus norvegicus
aaacaaaggcctgcacttctgactg

SEQ ID NO: 3971 - DNA, 25 bp, Rattus norvegicus
aaacaaagggtgacgcggacagccg

SEQ ID NO: 3972 - DNA, 25 bp, Rattus norvegicus
aaacaaagggtgtcgcggacagccg

SEQ ID NO: 3973 - DNA, 25 bp, Rattus norvegicus
aaacaaagtctgagcaaactaccat

SEQ ID NO: 3974 - DNA, 25 bp, Rattus norvegicus
aaacaaagtctgtgcaaactaccat

SEQ ID NO: 3975 - DNA, 25 bp, Rattus norvegicus
aaacaaagtgctcgtgggtgcgact

SEQ ID NO: 3976 - DNA, 25 bp, Rattus norvegicus
aaacaaagtgctggtgggtgcgact

SEQ ID NO: 3977 - DNA, 25 bp, Rattus norvegicus
aaacaaatacctcgcctttatggag

SEQ ID NO: 3978 - DNA, 25 bp, Rattus norvegicus
aaacaaatacctggcctttatggag

SEQ ID NO: 3979 - DNA, 25 bp, Rattus norvegicus
aaacaaatgcctacagccgtaggaa

SEQ ID NO: 3980 - DNA, 25 bp, Rattus norvegicus
aaacaaatgccttcagccgtaggaa

SEQ ID NO: 3981 - DNA, 25 bp, Rattus norvegicus
aaacaaatggccatctgtgacctgg

SEQ ID NO: 3982 - DNA, 25 bp, Rattus norvegicus
aaacaaatggccttctgtgacctgg

SEQ ID NO: 3983 - DNA, 25 bp, Rattus norvegicus
aaacaaattcaacccaagcctgcaa

SEQ ID NO: 3984 - DNA, 25 bp, Rattus norvegicus
aaacaaattcaagccaagcctgcaa

SEQ ID NO: 3985 - DNA, 25 bp, Rattus norvegicus
aaacaaattggtctacctgcttggg

SEQ ID NO: 3986 - DNA, 25 bp, Rattus norvegicus
aaacaaattggtgtacctgcttggg

SEQ ID NO: 3987 - DNA, 25 bp, Rattus norvegicus
aaacaacacaaaatggtctccttga

SEQ ID NO: 3988 - DNA, 25 bp, Rattus norvegicus
aaacaacacaaattggtctccttga

SEQ ID NO: 3989 - DNA, 25 bp, Rattus norvegicus
aaacaacaccataagtctcaccaac

SEQ ID NO: 3990 - DNA, 25 bp, Rattus norvegicus
aaacaacaccattagtctcaccaac

SEQ ID NO: 3991 - DNA, 25 bp, Rattus norvegicus
aaacaacagcatagagcgagctctt

SEQ ID NO: 3992 - DNA, 25 bp, Rattus norvegicus
aaacaacagcattgagcgagctctt

SEQ ID NO: 3993 - DNA, 25 bp, Rattus norvegicus
aaacaacattgccacatttcccaaa

SEQ ID NO: 3994 - DNA, 25 bp, Rattus norvegicus
aaacaacattgcgacatttcccaaa

SEQ ID NO: 3995 - DNA, 25 bp, Rattus norvegicus
aaacaaccaccaatctaggcagtga

SEQ ID NO: 3996 - DNA, 25 bp, Rattus norvegicus
aaacaaccaccattctaggcagtga

SEQ ID NO: 3997 - DNA, 25 bp, Rattus norvegicus
aaacaacccatgagctttggtcctg

SEQ ID NO: 3998 - DNA, 25 bp, Rattus norvegicus
aaacaacccatgtgctttggtcctg

SEQ ID NO: 3999 - DNA, 25 bp, Rattus norvegicus
aaacaaccctatatgcaatggatgc

SEQ ID NO: 4000 - DNA, 25 bp, Rattus norvegicus
aaacaaccctatttgcaatggatgc

SEQ ID NO: 4001 - DNA, 25 bp, Rattus norvegicus
aaacaaccctcactagggcatggta

SEQ ID NO: 4002 - DNA, 25 bp, Rattus norvegicus
aaacaaccctcagtagggcatggta

SEQ ID NO: 4003 - DNA, 25 bp, Rattus norvegicus
aaacaaccctttcctgcacaatgtt

SEQ ID NO: 4004 - DNA, 25 bp, Rattus norvegicus
aaacaaccctttgctgcacaatgtt

SEQ ID NO: 4005 - DNA, 25 bp, Rattus norvegicus
aaacaacgatggagactgcctcttc

SEQ ID NO: 4006 - DNA, 25 bp, Rattus norvegicus
aaacaacgatggtgactgcctcttc

SEQ ID NO: 4007 - DNA, 25 bp, Rattus norvegicus
aaacaacggcccagagagccacctt

SEQ ID NO: 4008 - DNA, 25 bp, Rattus norvegicus
aaacaacggccctgagagccacctt

SEQ ID NO: 4009 - DNA, 25 bp, Rattus norvegicus
aaacaacggctgcatttcaacaagg

SEQ ID NO: 4010 - DNA, 25 bp, Rattus norvegicus
aaacaacggctggatttcaacaagg

SEQ ID NO: 4011 - DNA, 25 bp, Rattus norvegicus
aaacaacgtgcccagctagctagtc

SEQ ID NO: 4012 - DNA, 25 bp, Rattus norvegicus
aaacaacgtgccgagctagctagtc

SEQ ID NO: 4013 - DNA, 25 bp, Rattus norvegicus
aaacaactaagacagctggctcgca

SEQ ID NO: 4014 - DNA, 25 bp, Rattus norvegicus
aaacaactaagagagctggctcgca

SEQ ID NO: 4015 - DNA, 25 bp, Rattus norvegicus
aaacaactaccaaggttccgtgcgc

SEQ ID NO: 4016 - DNA, 25 bp, Rattus norvegicus
aaacaactaccatggttccgtgcgc

SEQ ID NO: 4017 - DNA, 25 bp, Rattus norvegicus
aaacaactatctaggtttccactgt

SEQ ID NO: 4018 - DNA, 25 bp, Rattus norvegicus
aaacaactatcttggtttccactgt

SEQ ID NO: 4019 - DNA, 25 bp, Rattus norvegicus
aaacaactcagtaattcccagctca

SEQ ID NO: 4020 - DNA, 25 bp, Rattus norvegicus
aaacaactcagttattcccagctca

SEQ ID NO: 4021 - DNA, 25 bp, Rattus norvegicus
aaacaactcctgcacaccttcaaga

SEQ ID NO: 4022 - DNA, 25 bp, Rattus norvegicus
aaacaactcctggacaccttcaaga

SEQ ID NO: 4023 - DNA, 25 bp, Rattus norvegicus
aaacaactctagaggcgtcagcagt

SEQ ID NO: 4024 - DNA, 25 bp, Rattus norvegicus
aaacaactctagtggcgtcagcagt

SEQ ID NO: 4025 - DNA, 25 bp, Rattus norvegicus
aaacaactgcaaagccggttctctc

SEQ ID NO: 4026 - DNA, 25 bp, Rattus norvegicus
aaacaactgcaatgccggttctctc

SEQ ID NO: 4027 - DNA, 25 bp, Rattus norvegicus
aaacaactgcagagcggcctgtaca

SEQ ID NO: 4028 - DNA, 25 bp, Rattus norvegicus
aaacaactgcagatattgccttaga

SEQ ID NO: 4029 - DNA, 25 bp, Rattus norvegicus
aaacaactgcagtgcggcctgtaca

SEQ ID NO: 4030 - DNA, 25 bp, Rattus norvegicus
aaacaactgcagttattgccttaga

SEQ ID NO: 4031 - DNA, 25 bp, Rattus norvegicus
aaacaactgcatacaagggctctgt

SEQ ID NO: 4032 - DNA, 25 bp, Rattus norvegicus
aaacaactgcattcaagggctctgt

SEQ ID NO: 4033 - DNA, 25 bp, Rattus norvegicus
aaacaactgccgcaggatactgagg

SEQ ID NO: 4034 - DNA, 25 bp, Rattus norvegicus
aaacaactgccggaggatactgagg

SEQ ID NO: 4035 - DNA, 25 bp, Rattus norvegicus
aaacaactgcgtctggcatcgcacg

SEQ ID NO: 4036 - DNA, 25 bp, Rattus norvegicus
aaacaactgcgtgtggcatcgcacg

SEQ ID NO: 4037 - DNA, 25 bp, Rattus norvegicus
aaacaactgctgagtgaacatgcac

SEQ ID NO: 4038 - DNA, 25 bp, Rattus norvegicus
aaacaactgctgtgtgaacatgcac

SEQ ID NO: 4039 - DNA, 25 bp, Rattus norvegicus
aaacaactgtctaagcatccctgat

SEQ ID NO: 4040 - DNA, 25 bp, Rattus norvegicus
aaacaactgtcttagcatccctgat

SEQ ID NO: 4041 - DNA, 25 bp, Rattus norvegicus
aaacaacttagcacaacccaggaat

SEQ ID NO: 4042 - DNA, 25 bp, Rattus norvegicus
aaacaacttagctcaacccaggaat

SEQ ID NO: 4043 - DNA, 25 bp, Rattus norvegicus
aaacaacttgcgacttgggattgat

SEQ ID NO: 4044 - DNA, 25 bp, Rattus norvegicus
aaacaacttgcgtcttgggattgat

SEQ ID NO: 4045 - DNA, 25 bp, Rattus norvegicus
aaacaacttttacttcatgcccatt

SEQ ID NO: 4046 - DNA, 25 bp, Rattus norvegicus
aaacaacttttagttcatgcccatt

SEQ ID NO: 4047 - DNA, 25 bp, Rattus norvegicus
aaacaagaacacacacacgctgctg

SEQ ID NO: 4048 - DNA, 25 bp, Rattus norvegicus
aaacaagaacactcacacgctgctg

SEQ ID NO: 4049 - DNA, 25 bp, Rattus norvegicus
aaacaagacaatctgcccgcgagca

SEQ ID NO: 4050 - DNA, 25 bp, Rattus norvegicus
aaacaagacaatgtgcccgcgagca

SEQ ID NO: 4051 - DNA, 25 bp, Rattus norvegicus
aaacaagagtttaccgcctgctagg

SEQ ID NO: 4052 - DNA, 25 bp, Rattus norvegicus
aaacaagagttttccgcctgctagg

SEQ ID NO: 4053 - DNA, 25 bp, Rattus norvegicus
aaacaagatttcattttcccacagt

SEQ ID NO: 4054 - DNA, 25 bp, Rattus norvegicus
aaacaagatttctttttcccacagt

SEQ ID NO: 4055 - DNA, 25 bp, Rattus norvegicus
aaacaagcatcaaggtggccaccca

SEQ ID NO: 4056 - DNA, 25 bp, Rattus norvegicus
aaacaagcatcatggtggccaccca

SEQ ID NO: 4057 - DNA, 25 bp, Rattus norvegicus
aaacaagcatgtctcatctctctcc

SEQ ID NO: 4058 - DNA, 25 bp, Rattus norvegicus
aaacaagcatgtgtcatctctctcc

SEQ ID NO: 4059 - DNA, 25 bp, Rattus norvegicus
aaacaagccattatcttcttgctcc

SEQ ID NO: 4060 - DNA, 25 bp, Rattus norvegicus
aaacaagccattccagtcatgatga

SEQ ID NO: 4061 - DNA, 25 bp, Rattus norvegicus
aaacaagccattgcagtcatgatga

SEQ ID NO: 4062 - DNA, 25 bp, Rattus norvegicus
aaacaagccattttcttcttgctcc

SEQ ID NO: 4063 - DNA, 25 bp, Rattus norvegicus
aaacaagcccagcatggtagccagc

SEQ ID NO: 4064 - DNA, 25 bp, Rattus norvegicus
aaacaagcccaggatggtagccagc

SEQ ID NO: 4065 - DNA, 25 bp, Rattus norvegicus
aaacaagccctcactgtggtatgac

SEQ ID NO: 4066 - DNA, 25 bp, Rattus norvegicus
aaacaagccctctctgtggtatgac

SEQ ID NO: 4067 - DNA, 25 bp, Rattus norvegicus
aaacaagcctcgagattgcagagct

SEQ ID NO: 4068 - DNA, 25 bp, Rattus norvegicus
aaacaagcctcgtgattgcagagct

SEQ ID NO: 4069 - DNA, 25 bp, Rattus norvegicus
aaacaagcctgcatctcatgtggct

SEQ ID NO: 4070 - DNA, 25 bp, Rattus norvegicus
aaacaagcctgcttctcatgtggct

SEQ ID NO: 4071 - DNA, 25 bp, Rattus norvegicus
aaacaagcctgtcactaccattctg

SEQ ID NO: 4072 - DNA, 25 bp, Rattus norvegicus
aaacaagcctgtgactaccattctg

SEQ ID NO: 4073 - DNA, 25 bp, Rattus norvegicus
aaacaagcggatactcatggagcac

SEQ ID NO: 4074 - DNA, 25 bp, Rattus norvegicus
aaacaagcggattctcatggagcac

SEQ ID NO: 4075 - DNA, 25 bp, Rattus norvegicus
aaacaagctagccatgcatcatctc

SEQ ID NO: 4076 - DNA, 25 bp, Rattus norvegicus
aaacaagctagcgatgcatcatctc

SEQ ID NO: 4077 - DNA, 25 bp, Rattus norvegicus
aaacaagctttgcagtagctccatc

SEQ ID NO: 4078 - DNA, 25 bp, Rattus norvegicus
aaacaagctttggagtagctccatc

SEQ ID NO: 4079 - DNA, 25 bp, Rattus norvegicus
aaacaagcttttactagtgcgtcct

SEQ ID NO: 4080 - DNA, 25 bp, Rattus norvegicus
aaacaagctttttctagtgcgtcct

SEQ ID NO: 4081 - DNA, 25 bp, Rattus norvegicus
aaacaaggaacccatcctgtgcgtg

SEQ ID NO: 4082 - DNA, 25 bp, Rattus norvegicus
aaacaaggaaccgatcctgtgcgtg

SEQ ID NO: 4083 - DNA, 25 bp, Rattus norvegicus
aaacaaggactgctctgtgtcctca

SEQ ID NO: 4084 - DNA, 25 bp, Rattus norvegicus
aaacaaggactggtctgtgtcctca

SEQ ID NO: 4085 - DNA, 25 bp, Rattus norvegicus
aaacaaggagctccgtcctgacgga

SEQ ID NO: 4086 - DNA, 25 bp, Rattus norvegicus
aaacaaggagctgcgtcctgacgga

SEQ ID NO: 4087 - DNA, 25 bp, Rattus norvegicus
aaacaaggaggcactctcctgggac

SEQ ID NO: 4088 - DNA, 25 bp, Rattus norvegicus
aaacaaggaggctctctcctgggac

SEQ ID NO: 4089 - DNA, 25 bp, Rattus norvegicus
aaacaaggcactatacacttccggg

SEQ ID NO: 4090 - DNA, 25 bp, Rattus norvegicus
aaacaaggcactttacacttccggg

SEQ ID NO: 4091 - DNA, 25 bp, Rattus norvegicus
aaacaagggagcaatctgtattttg

SEQ ID NO: 4092 - DNA, 25 bp, Rattus norvegicus
aaacaagggagctatctgtattttg

SEQ ID NO: 4093 - DNA, 25 bp, Rattus norvegicus
aaacaaggtaccctgatctgcttcc

SEQ ID NO: 4094 - DNA, 25 bp, Rattus norvegicus
aaacaaggtaccgtgatctgcttcc

SEQ ID NO: 4095 - DNA, 25 bp, Rattus norvegicus
aaacaaggtcctactcaggcgtcta

SEQ ID NO: 4096 - DNA, 25 bp, Rattus norvegicus
aaacaaggtccttctcaggcgtcta

SEQ ID NO: 4097 - DNA, 25 bp, Rattus norvegicus
aaacaaggtcggcagcaggagcatt

SEQ ID NO: 4098 - DNA, 25 bp, Rattus norvegicus
aaacaaggtcgggagcaggagcatt

SEQ ID NO: 4099 - DNA, 25 bp, Rattus norvegicus
aaacaagtaagactgtgccctctga

SEQ ID NO: 4100 - DNA, 25 bp, Rattus norvegicus
aaacaagtaagagtgtgccctctga

SEQ ID NO: 4101 - DNA, 25 bp, Rattus norvegicus
aaacaagtcaatcccctacatggtg

SEQ ID NO: 4102 - DNA, 25 bp, Rattus norvegicus
aaacaagtcaatgccctacatggtg

SEQ ID NO: 4103 - DNA, 25 bp, Rattus norvegicus
aaacaagtcactagagccccaagct

SEQ ID NO: 4104 - DNA, 25 bp, Rattus norvegicus
aaacaagtcacttgagccccaagct

SEQ ID NO: 4105 - DNA, 25 bp, Rattus norvegicus
aaacaagtccttatctccattcttc

SEQ ID NO: 4106 - DNA, 25 bp, Rattus norvegicus
aaacaagtccttttctccattcttc

SEQ ID NO: 4107 - DNA, 25 bp, Rattus norvegicus
aaacaagtctaacgagtgctgcgtg

SEQ ID NO: 4108 - DNA, 25 bp, Rattus norvegicus
aaacaagtctaaggagtgctgcgtg

SEQ ID NO: 4109 - DNA, 25 bp, Rattus norvegicus
aaacaagtctgtcgctgtcttaccc

SEQ ID NO: 4110 - DNA, 25 bp, Rattus norvegicus
aaacaagtctgtggctgtcttaccc

SEQ ID NO: 4111 - DNA, 25 bp, Rattus norvegicus
aaacaagtgcgtccttcaagagtgc

SEQ ID NO: 4112 - DNA, 25 bp, Rattus norvegicus
aaacaagtgcgtgcttcaagagtgc

SEQ ID NO: 4113 - DNA, 25 bp, Rattus norvegicus
aaacaagtgtttatggaggcggcgt

SEQ ID NO: 4114 - DNA, 25 bp, Rattus norvegicus
aaacaagtgtttttggaggcggcgt

SEQ ID NO: 4115 - DNA, 25 bp, Rattus norvegicus
aaacaagtttccatgaagtcggcgg

SEQ ID NO: 4116 - DNA, 25 bp, Rattus norvegicus
aaacaagtttccttgaagtcggcgg

SEQ ID NO: 4117 - DNA, 25 bp, Rattus norvegicus
aaacaataacctactccttgctgac

SEQ ID NO: 4118 - DNA, 25 bp, Rattus norvegicus
aaacaataaccttctccttgctgac

SEQ ID NO: 4119 - DNA, 25 bp, Rattus norvegicus
aaacaatcactcctcttcacaaagc

SEQ ID NO: 4120 - DNA, 25 bp, Rattus norvegicus
aaacaatcactcgtcttcacaaagc

SEQ ID NO: 4121 - DNA, 25 bp, Rattus norvegicus
aaacaatcaggtcgcttttgcagtt

SEQ ID NO: 4122 - DNA, 25 bp, Rattus norvegicus
aaacaatcaggtggcttttgcagtt

SEQ ID NO: 4123 - DNA, 25 bp, Rattus norvegicus
aaacaatcatgcagcttctctaaga

SEQ ID NO: 4124 - DNA, 25 bp, Rattus norvegicus
aaacaatcatgctgcttctctaaga

SEQ ID NO: 4125 - DNA, 25 bp, Rattus norvegicus
aaacaatccagaacttcccagagcc

SEQ ID NO: 4126 - DNA, 25 bp, Rattus norvegicus
aaacaatccagatcttcccagagcc

SEQ ID NO: 4127 - DNA, 25 bp, Rattus norvegicus
aaacaatccttccatagcacatgct

SEQ ID NO: 4128 - DNA, 25 bp, Rattus norvegicus
aaacaatccttcgatagcacatgct

SEQ ID NO: 4129 - DNA, 25 bp, Rattus norvegicus
aaacaatctgaaccctgagcgtgca

SEQ ID NO: 4130 - DNA, 25 bp, Rattus norvegicus
aaacaatctgaagcctgagcgtgca

SEQ ID NO: 4131 - DNA, 25 bp, Rattus norvegicus
aaacaatgacacctttgcaccagag

SEQ ID NO: 4132 - DNA, 25 bp, Rattus norvegicus
aaacaatgacacgtttgcaccagag

SEQ ID NO: 4133 - DNA, 25 bp, Rattus norvegicus
aaacaatgagttcttcttctctggg

SEQ ID NO: 4134 - DNA, 25 bp, Rattus norvegicus
aaacaatgagttgttcttctctggg

SEQ ID NO: 4135 - DNA, 25 bp, Rattus norvegicus
aaacaatgctccagtagccggttat

SEQ ID NO: 4136 - DNA, 25 bp, Rattus norvegicus
aaacaatgctcctgtagccggttat

SEQ ID NO: 4137 - DNA, 25 bp, Rattus norvegicus
aaacaatggcatacgagcgcttcag

SEQ ID NO: 4138 - DNA, 25 bp, Rattus norvegicus
aaacaatggcattcgagcgcttcag

SEQ ID NO: 4139 - DNA, 25 bp, Rattus norvegicus
aaacaatgtctgatgaaccaaaggg

SEQ ID NO: 4140 - DNA, 25 bp, Rattus norvegicus
aaacaatgtctgttgaaccaaaggg

SEQ ID NO: 4141 - DNA, 25 bp, Rattus norvegicus
aaacaattcagacggatggagtgat

SEQ ID NO: 4142 - DNA, 25 bp, Rattus norvegicus
aaacaattcagagggatggagtgat

SEQ ID NO: 4143 - DNA, 25 bp, Rattus norvegicus
aaacaattcattatctgtcacagca

SEQ ID NO: 4144 - DNA, 25 bp, Rattus norvegicus
aaacaattcattcactcccaagtaa

SEQ ID NO: 4145 - DNA, 25 bp, Rattus norvegicus
aaacaattcattgactcccaagtaa

SEQ ID NO: 4146 - DNA, 25 bp, Rattus norvegicus
aaacaattcattttctgtcacagca

SEQ ID NO: 4147 - DNA, 25 bp, Rattus norvegicus
aaacaattcctcatgatgcagatgt

SEQ ID NO: 4148 - DNA, 25 bp, Rattus norvegicus
aaacaattcctcttgatgcagatgt

SEQ ID NO: 4149 - DNA, 25 bp, Rattus norvegicus
aaacaattctataccaaaacctcat

SEQ ID NO: 4150 - DNA, 25 bp, Rattus norvegicus
aaacaattctattccaaaacctcat

SEQ ID NO: 4151 - DNA, 25 bp, Rattus norvegicus
aaacaattgacacgcaaggtctcaa

SEQ ID NO: 4152 - DNA, 25 bp, Rattus norvegicus
aaacaattgacaggcaaggtctcaa

SEQ ID NO: 4153 - DNA, 25 bp, Rattus norvegicus
aaacaattggccattctgagctgat

SEQ ID NO: 4154 - DNA, 25 bp, Rattus norvegicus
aaacaattggcctttctgagctgat

SEQ ID NO: 4155 - DNA, 25 bp, Rattus norvegicus
aaacaatttcacctgtagctggcag

SEQ ID NO: 4156 - DNA, 25 bp, Rattus norvegicus
aaacaatttcacgtgtagctggcag

SEQ ID NO: 4157 - DNA, 25 bp, Rattus norvegicus
aaacaatttctgacattgctctttt

SEQ ID NO: 4158 - DNA, 25 bp, Rattus norvegicus
aaacaatttctgtcattgctctttt

SEQ ID NO: 4159 - DNA, 25 bp, Rattus norvegicus
aaacaattttctatcattgagacaa

SEQ ID NO: 4160 - DNA, 25 bp, Rattus norvegicus
aaacaattttctttcattgagacaa

SEQ ID NO: 4161 - DNA, 25 bp, Rattus norvegicus
aaacacaaagtcaacggcagctcct

SEQ ID NO: 4162 - DNA, 25 bp, Rattus norvegicus
aaacacaaagtctacggcagctcct

SEQ ID NO: 4163 - DNA, 25 bp, Rattus norvegicus
aaacacaaatgcatgtacccctcat

SEQ ID NO: 4164 - DNA, 25 bp, Rattus norvegicus
aaacacaaatgcttgtacccctcat

SEQ ID NO: 4165 - DNA, 25 bp, Rattus norvegicus
aaacacaactaactcagagagcact

SEQ ID NO: 4166 - DNA, 25 bp, Rattus norvegicus
aaacacaactaagtcagagagcact

SEQ ID NO: 4167 - DNA, 25 bp, Rattus norvegicus
aaacacaactgcatccttgttgctc

SEQ ID NO: 4168 - DNA, 25 bp, Rattus norvegicus
aaacacaactgcttccttgttgctc

SEQ ID NO: 4169 - DNA, 25 bp, Rattus norvegicus
aaacacaagaatagagggcctcagt

SEQ ID NO: 4170 - DNA, 25 bp, Rattus norvegicus
aaacacaagaattgagggcctcagt

SEQ ID NO: 4171 - DNA, 25 bp, Rattus norvegicus
aaacacaagcccctgatgtcgatat

SEQ ID NO: 4172 - DNA, 25 bp, Rattus norvegicus
aaacacaagcccgtgatgtcgatat

SEQ ID NO: 4173 - DNA, 25 bp, Rattus norvegicus
aaacacaagcgtctgggttctgcat

SEQ ID NO: 4174 - DNA, 25 bp, Rattus norvegicus
aaacacaagcgtgtgggttctgcat

SEQ ID NO: 4175 - DNA, 25 bp, Rattus norvegicus
aaacacaagtgtaacccaccgcagg

SEQ ID NO: 4176 - DNA, 25 bp, Rattus norvegicus
aaacacaagtgttacccaccgcagg

SEQ ID NO: 4177 - DNA, 25 bp, Rattus norvegicus
aaacacaatgcaacatttcctttgt

SEQ ID NO: 4178 - DNA, 25 bp, Rattus norvegicus
aaacacaatgcatcatttcctttgt

SEQ ID NO: 4179 - DNA, 25 bp, Rattus norvegicus
aaacacacaattcgtcacagtgcag

SEQ ID NO: 4180 - DNA, 25 bp, Rattus norvegicus
aaacacacaattggtcacagtgcag

SEQ ID NO: 4181 - DNA, 25 bp, Rattus norvegicus
aaacacacacttctggtcaatcaac

SEQ ID NO: 4182 - DNA, 25 bp, Rattus norvegicus
aaacacacacttgtggtcaatcaac

SEQ ID NO: 4183 - DNA, 25 bp, Rattus norvegicus
aaacacacagacctgagacgccaga

SEQ ID NO: 4184 - DNA, 25 bp, Rattus norvegicus
aaacacacagacgtgagacgccaga

SEQ ID NO: 4185 - DNA, 25 bp, Rattus norvegicus
aaacacacagagatctgtctacctc

SEQ ID NO: 4186 - DNA, 25 bp, Rattus norvegicus
aaacacacagagttctgtctacctc

SEQ ID NO: 4187 - DNA, 25 bp, Rattus norvegicus
aaacacacctaaaccatgcaatcac

SEQ ID NO: 4188 - DNA, 25 bp, Rattus norvegicus
aaacacacctaatccatgcaatcac

SEQ ID NO: 4189 - DNA, 25 bp, Rattus norvegicus
aaacacacggtccatttcctagagg

SEQ ID NO: 4190 - DNA, 25 bp, Rattus norvegicus
aaacacacggtcgatttcctagagg

SEQ ID NO: 4191 - DNA, 25 bp, Rattus norvegicus
aaacacacggtgattcggatgattt

SEQ ID NO: 4192 - DNA, 25 bp, Rattus norvegicus
aaacacacggtgtttcggatgattt

SEQ ID NO: 4193 - DNA, 25 bp, Rattus norvegicus
aaacacacgtgccatgctttgggtt

SEQ ID NO: 4194 - DNA, 25 bp, Rattus norvegicus
aaacacacgtgcgatgctttgggtt

SEQ ID NO: 4195 - DNA, 25 bp, Rattus norvegicus
aaacacactagtctgaggccttcaa

SEQ ID NO: 4196 - DNA, 25 bp, Rattus norvegicus
aaacacactagtgtgaggccttcaa

SEQ ID NO: 4197 - DNA, 25 bp, Rattus norvegicus
aaacacactggaccctcttgagcta

SEQ ID NO: 4198 - DNA, 25 bp, Rattus norvegicus
aaacacactggagcctcttgagcta

SEQ ID NO: 4199 - DNA, 25 bp, Rattus norvegicus
aaacacacttctcgcaaggttatag

SEQ ID NO: 4200 - DNA, 25 bp, Rattus norvegicus
aaacacacttctggcaaggttatag

SEQ ID NO: 4201 - DNA, 25 bp, Rattus norvegicus
aaacacagaaagagaggctctcctc

SEQ ID NO: 4202 - DNA, 25 bp, Rattus norvegicus
aaacacagaaagtgaggctctcctc

SEQ ID NO: 4203 - DNA, 25 bp, Rattus norvegicus
aaacacagaacgctcaggacagaag

SEQ ID NO: 4204 - DNA, 25 bp, Rattus norvegicus
aaacacagaacggtcaggacagaag

SEQ ID NO: 4205 - DNA, 25 bp, Rattus norvegicus
aaacacagacccagttctgagcaat

SEQ ID NO: 4206 - DNA, 25 bp, Rattus norvegicus
aaacacagaccctgttctgagcaat

SEQ ID NO: 4207 - DNA, 25 bp, Rattus norvegicus
aaacacagaggtcttctgccctgca

SEQ ID NO: 4208 - DNA, 25 bp, Rattus norvegicus
aaacacagaggtgttctgccctgca

SEQ ID NO: 4209 - DNA, 25 bp, Rattus norvegicus
aaacacagattcatccgatcctcat

SEQ ID NO: 4210 - DNA, 25 bp, Rattus norvegicus
aaacacagattcttccgatcctcat

SEQ ID NO: 4211 - DNA, 25 bp, Rattus norvegicus
aaacacagccctacttggtgacaga

SEQ ID NO: 4212 - DNA, 25 bp, Rattus norvegicus
aaacacagcccttcttggtgacaga

SEQ ID NO: 4213 - DNA, 25 bp, Rattus norvegicus
aaacacagcctaatttcttgaacat

SEQ ID NO: 4214 - DNA, 25 bp, Rattus norvegicus
aaacacagcctattttcttgaacat

SEQ ID NO: 4215 - DNA, 25 bp, Rattus norvegicus
aaacacagcctgacggtactagaat

SEQ ID NO: 4216 - DNA, 25 bp, Rattus norvegicus
aaacacagcctgtcggtactagaat

SEQ ID NO: 4217 - DNA, 25 bp, Rattus norvegicus
aaacacagctgtcctatgtcttggg

SEQ ID NO: 4218 - DNA, 25 bp, Rattus norvegicus
aaacacagctgtgctatgtcttggg

SEQ ID NO: 4219 - DNA, 25 bp, Rattus norvegicus
aaacacagcttaagttggctccgca

SEQ ID NO: 4220 - DNA, 25 bp, Rattus norvegicus
aaacacagcttatgttggctccgca

SEQ ID NO: 4221 - DNA, 25 bp, Rattus norvegicus
aaacacaggtcgatggtcatctcac

SEQ ID NO: 4222 - DNA, 25 bp, Rattus norvegicus
aaacacaggtcgttggtcatctcac

SEQ ID NO: 4223 - DNA, 25 bp, Rattus norvegicus
aaacacagtctgctgacctctaccg

SEQ ID NO: 4224 - DNA, 25 bp, Rattus norvegicus
aaacacagtctggtgacctctaccg

SEQ ID NO: 4225 - DNA, 25 bp, Rattus norvegicus
aaacacagtgtgatccttcacctac

SEQ ID NO: 4226 - DNA, 25 bp, Rattus norvegicus
aaacacagtgtgttccttcacctac

SEQ ID NO: 4227 - DNA, 25 bp, Rattus norvegicus
aaacacatagagcaatacatactgg

SEQ ID NO: 4228 - DNA, 25 bp, Rattus norvegicus
aaacacatagaggaatacatactgg

SEQ ID NO: 4229 - DNA, 25 bp, Rattus norvegicus
aaacacatcaggctgcggccgaggc

SEQ ID NO: 4230 - DNA, 25 bp, Rattus norvegicus
aaacacatcagggtgcggccgaggc

SEQ ID NO: 4231 - DNA, 25 bp, Rattus norvegicus
aaacacatccctagtgcgtgatata

SEQ ID NO: 4232 - DNA, 25 bp, Rattus norvegicus
aaacacatcccttgtgcgtgatata

SEQ ID NO: 4233 - DNA, 25 bp, Rattus norvegicus
aaacacatctgactttcgacctaat

SEQ ID NO: 4234 - DNA, 25 bp, Rattus norvegicus
aaacacatctgagtttcgacctaat

SEQ ID NO: 4235 - DNA, 25 bp, Rattus norvegicus
aaacacatgagactcctccagcgct

SEQ ID NO: 4236 - DNA, 25 bp, Rattus norvegicus
aaacacatgagagtcctccagcgct

SEQ ID NO: 4237 - DNA, 25 bp, Rattus norvegicus
aaacacatgtgccataccgggacag

SEQ ID NO: 4238 - DNA, 25 bp, Rattus norvegicus
aaacacatgtgcgataccgggacag

SEQ ID NO: 4239 - DNA, 25 bp, Rattus norvegicus
aaacacatgttccagacaatcctcc

SEQ ID NO: 4240 - DNA, 25 bp, Rattus norvegicus
aaacacatgttcgagacaatcctcc

SEQ ID NO: 4241 - DNA, 25 bp, Rattus norvegicus
aaacacattgtcatctttgccttgc

SEQ ID NO: 4242 - DNA, 25 bp, Rattus norvegicus
aaacacattgtcttctttgccttgc

SEQ ID NO: 4243 - DNA, 25 bp, Rattus norvegicus
aaacacatttagactgtctctgggt

SEQ ID NO: 4244 - DNA, 25 bp, Rattus norvegicus
aaacacatttagtctgtctctgggt

SEQ ID NO: 4245 - DNA, 25 bp, Rattus norvegicus
aaacacatttctcctgtggctgcag

SEQ ID NO: 4246 - DNA, 25 bp, Rattus norvegicus
aaacacatttctctggccttagccg

SEQ ID NO: 4247 - DNA, 25 bp, Rattus norvegicus
aaacacatttctgctgtggctgcag

SEQ ID NO: 4248 - DNA, 25 bp, Rattus norvegicus
aaacacatttctgtggccttagccg

SEQ ID NO: 4249 - DNA, 25 bp, Rattus norvegicus
aaacacatttttcctgctagtcgct

SEQ ID NO: 4250 - DNA, 25 bp, Rattus norvegicus
aaacacatttttgctgctagtcgct

SEQ ID NO: 4251 - DNA, 25 bp, Rattus norvegicus
aaacaccaacatactgctgtcttgt

SEQ ID NO: 4252 - DNA, 25 bp, Rattus norvegicus
aaacaccaacatcaagtgtggctac

SEQ ID NO: 4253 - DNA, 25 bp, Rattus norvegicus
aaacaccaacatgaagtgtggctac

SEQ ID NO: 4254 - DNA, 25 bp, Rattus norvegicus
aaacaccaacattctgctgtcttgt

SEQ ID NO: 4255 - DNA, 25 bp, Rattus norvegicus
aaacaccaaccaaggctgtcctttt

SEQ ID NO: 4256 - DNA, 25 bp, Rattus norvegicus
aaacaccaaccatggctgtcctttt

SEQ ID NO: 4257 - DNA, 25 bp, Rattus norvegicus
aaacaccaactgctggcgctaacaa

SEQ ID NO: 4258 - DNA, 25 bp, Rattus norvegicus
aaacaccaactggtggcgctaacaa

SEQ ID NO: 4259 - DNA, 25 bp, Rattus norvegicus
aaacaccaagtgaatccaggatcaa

SEQ ID NO: 4260 - DNA, 25 bp, Rattus norvegicus
aaacaccaagtgctattgctcacaa

SEQ ID NO: 4261 - DNA, 25 bp, Rattus norvegicus
aaacaccaagtggtattgctcacaa

SEQ ID NO: 4262 - DNA, 25 bp, Rattus norvegicus
aaacaccaagtgtatccaggatcaa

SEQ ID NO: 4263 - DNA, 25 bp, Rattus norvegicus
aaacaccactcacgtcgacagcagt

SEQ ID NO: 4264 - DNA, 25 bp, Rattus norvegicus
aaacaccactcaggtcgacagcagt

SEQ ID NO: 4265 - DNA, 25 bp, Rattus norvegicus
aaacaccacttgatttcctatcact

SEQ ID NO: 4266 - DNA, 25 bp, Rattus norvegicus
aaacaccacttgttttcctatcact

SEQ ID NO: 4267 - DNA, 25 bp, Rattus norvegicus
aaacaccagattataggctttgaat

SEQ ID NO: 4268 - DNA, 25 bp, Rattus norvegicus
aaacaccagattttaggctttgaat

SEQ ID NO: 4269 - DNA, 25 bp, Rattus norvegicus
aaacaccagcgtcaatagggccagt

SEQ ID NO: 4270 - DNA, 25 bp, Rattus norvegicus
aaacaccagcgtgaatagggccagt

SEQ ID NO: 4271 - DNA, 25 bp, Rattus norvegicus
aaacaccagggtacctgatatcctg

SEQ ID NO: 4272 - DNA, 25 bp, Rattus norvegicus
aaacaccagggttcctgatatcctg

SEQ ID NO: 4273 - DNA, 25 bp, Rattus norvegicus
aaacaccaggtgatgatggctccaa

SEQ ID NO: 4274 - DNA, 25 bp, Rattus norvegicus
aaacaccaggtgttgatggctccaa

SEQ ID NO: 4275 - DNA, 25 bp, Rattus norvegicus
aaacaccaggttcctttggtacata

SEQ ID NO: 4276 - DNA, 25 bp, Rattus norvegicus
aaacaccaggttgctttggtacata

SEQ ID NO: 4277 - DNA, 25 bp, Rattus norvegicus
aaacaccatgatcgcaagccctttg

SEQ ID NO: 4278 - DNA, 25 bp, Rattus norvegicus
aaacaccatgatggcaagccctttg

SEQ ID NO: 4279 - DNA, 25 bp, Rattus norvegicus
aaacaccatggcagacgggcaattg

SEQ ID NO: 4280 - DNA, 25 bp, Rattus norvegicus
aaacaccatggctgacgggcaattg

SEQ ID NO: 4281 - DNA, 25 bp, Rattus norvegicus
aaacaccattggataaagctcgaga

SEQ ID NO: 4282 - DNA, 25 bp, Rattus norvegicus
aaacaccattggttaaagctcgaga

SEQ ID NO: 4283 - DNA, 25 bp, Rattus norvegicus
aaacacccagctatgaactggcgga

SEQ ID NO: 4284 - DNA, 25 bp, Rattus norvegicus
aaacacccagctttgaactggcgga

SEQ ID NO: 4285 - DNA, 25 bp, Rattus norvegicus
aaacacccagggattcctgtcagtt

SEQ ID NO: 4286 - DNA, 25 bp, Rattus norvegicus
aaacacccagggatttatactcatt

SEQ ID NO: 4287 - DNA, 25 bp, Rattus norvegicus
aaacacccagggtttcctgtcagtt

SEQ ID NO: 4288 - DNA, 25 bp, Rattus norvegicus
aaacacccagggttttatactcatt

SEQ ID NO: 4289 - DNA, 25 bp, Rattus norvegicus
aaacaccccgagctggcagacaaga

SEQ ID NO: 4290 - DNA, 25 bp, Rattus norvegicus
aaacaccccgaggtggcagacaaga

SEQ ID NO: 4291 - DNA, 25 bp, Rattus norvegicus
aaacacccgggcaggcatgtcaatc

SEQ ID NO: 4292 - DNA, 25 bp, Rattus norvegicus
aaacacccgggctggcatgtcaatc

SEQ ID NO: 4293 - DNA, 25 bp, Rattus norvegicus
aaacaccctgcacaagcactggaac

SEQ ID NO: 4294 - DNA, 25 bp, Rattus norvegicus
aaacaccctgcagaagcactggaac

SEQ ID NO: 4295 - DNA, 25 bp, Rattus norvegicus
aaacaccgaggcaagttttcgagca

SEQ ID NO: 4296 - DNA, 25 bp, Rattus norvegicus
aaacaccgaggctagttttcgagca

SEQ ID NO: 4297 - DNA, 25 bp, Rattus norvegicus
aaacaccgagtgacatcttttctcc

SEQ ID NO: 4298 - DNA, 25 bp, Rattus norvegicus
aaacaccgagtgtcatcttttctcc

SEQ ID NO: 4299 - DNA, 25 bp, Rattus norvegicus
aaacaccggctgacttggaggatat

SEQ ID NO: 4300 - DNA, 25 bp, Rattus norvegicus
aaacaccggctgtcttggaggatat

SEQ ID NO: 4301 - DNA, 25 bp, Rattus norvegicus
aaacaccgtgccagtgagtggactg

SEQ ID NO: 4302 - DNA, 25 bp, Rattus norvegicus
aaacaccgtgcctgtgagtggactg

SEQ ID NO: 4303 - DNA, 25 bp, Rattus norvegicus
aaacacctcgatcctggaaatgggt

SEQ ID NO: 4304 - DNA, 25 bp, Rattus norvegicus
aaacacctcgatgctggaaatgggt

SEQ ID NO: 4305 - DNA, 25 bp, Rattus norvegicus
aaacacctctctcgcatttgcagac

SEQ ID NO: 4306 - DNA, 25 bp, Rattus norvegicus
aaacacctctctggcatttgcagac

SEQ ID NO: 4307 - DNA, 25 bp, Rattus norvegicus
aaacacctctggcaaggctgaagca

SEQ ID NO: 4308 - DNA, 25 bp, Rattus norvegicus
aaacacctctgggaaggctgaagca

SEQ ID NO: 4309 - DNA, 25 bp, Rattus norvegicus
aaacacctgataatacccgaagaca

SEQ ID NO: 4310 - DNA, 25 bp, Rattus norvegicus
aaacacctgatattacccgaagaca

SEQ ID NO: 4311 - DNA, 25 bp, Rattus norvegicus
aaacacctgcggatcctggcaaggg

SEQ ID NO: 4312 - DNA, 25 bp, Rattus norvegicus
aaacacctgcggttcctggcaaggg

SEQ ID NO: 4313 - DNA, 25 bp, Rattus norvegicus
aaacacctgctgctgcttgaatgaa

SEQ ID NO: 4314 - DNA, 25 bp, Rattus norvegicus
aaacacctgctggtgcttgaatgaa

SEQ ID NO: 4315 - DNA, 25 bp, Rattus norvegicus
aaacacctgggcaaggtccttcatc

SEQ ID NO: 4316 - DNA, 25 bp, Rattus norvegicus
aaacacctgggctaggtccttcatc

SEQ ID NO: 4317 - DNA, 25 bp, Rattus norvegicus
aaacacctgtatattgtgcctcagc

SEQ ID NO: 4318 - DNA, 25 bp, Rattus norvegicus
aaacacctgtattttgtgcctcagc

SEQ ID NO: 4319 - DNA, 25 bp, Rattus norvegicus
aaacacctgtcaattgccaaatatt

SEQ ID NO: 4320 - DNA, 25 bp, Rattus norvegicus
aaacacctgtcatttgccaaatatt

SEQ ID NO: 4321 - DNA, 25 bp, Rattus norvegicus
aaacaccttagccacctgtgatggt

SEQ ID NO: 4322 - DNA, 25 bp, Rattus norvegicus
aaacaccttagcgacctgtgatggt

SEQ ID NO: 4323 - DNA, 25 bp, Rattus norvegicus
aaacaccttcgtactctgacagtaa

SEQ ID NO: 4324 - DNA, 25 bp, Rattus norvegicus
aaacaccttcgttctctgacagtaa

SEQ ID NO: 4325 - DNA, 25 bp, Rattus norvegicus
aaacaccttgatccccaagcatgaa

SEQ ID NO: 4326 - DNA, 25 bp, Rattus norvegicus
aaacaccttgatgcccaagcatgaa

SEQ ID NO: 4327 - DNA, 25 bp, Rattus norvegicus
aaacaccttgttcacattctgccac

SEQ ID NO: 4328 - DNA, 25 bp, Rattus norvegicus
aaacaccttgttgacattctgccac

SEQ ID NO: 4329 - DNA, 25 bp, Rattus norvegicus
aaacacctttaaagaaacatctaat

SEQ ID NO: 4330 - DNA, 25 bp, Rattus norvegicus
aaacacctttaatgaaacatctaat

SEQ ID NO: 4331 - DNA, 25 bp, Rattus norvegicus
aaacacctttttcggactggcagtg

SEQ ID NO: 4332 - DNA, 25 bp, Rattus norvegicus
aaacacctttttgggactggcagtg

SEQ ID NO: 4333 - DNA, 25 bp, Rattus norvegicus
aaacacgaagtgactgttccctacg

SEQ ID NO: 4334 - DNA, 25 bp, Rattus norvegicus
aaacacgaagtgtctgttccctacg

SEQ ID NO: 4335 - DNA, 25 bp, Rattus norvegicus
aaacacgaagttatgcagctatata

SEQ ID NO: 4336 - DNA, 25 bp, Rattus norvegicus
aaacacgaagttttgcagctatata

SEQ ID NO: 4337 - DNA, 25 bp, Rattus norvegicus
aaacacgaatgacacccaggacacc

SEQ ID NO: 4338 - DNA, 25 bp, Rattus norvegicus
aaacacgaatgagacccaggacacc

SEQ ID NO: 4339 - DNA, 25 bp, Rattus norvegicus
aaacacgagctacgccagcttcgag

SEQ ID NO: 4340 - DNA, 25 bp, Rattus norvegicus
aaacacgagctaggccagcttcgag

SEQ ID NO: 4341 - DNA, 25 bp, Rattus norvegicus
aaacacgatgtgctactttcccctt

SEQ ID NO: 4342 - DNA, 25 bp, Rattus norvegicus
aaacacgatgtggtactttcccctt

SEQ ID NO: 4343 - DNA, 25 bp, Rattus norvegicus
aaacacgcaccgcacactgcgcggc

SEQ ID NO: 4344 - DNA, 25 bp, Rattus norvegicus
aaacacgcaccggacactgcgcggc

SEQ ID NO: 4345 - DNA, 25 bp, Rattus norvegicus
aaacacgcccagctcgtgagggaga

SEQ ID NO: 4346 - DNA, 25 bp, Rattus norvegicus
aaacacgcccaggtcgtgagggaga

SEQ ID NO: 4347 - DNA, 25 bp, Rattus norvegicus
aaacacgccctcatgattatcaaga

SEQ ID NO: 4348 - DNA, 25 bp, Rattus norvegicus
aaacacgccctcttgattatcaaga

SEQ ID NO: 4349 - DNA, 25 bp, Rattus norvegicus
aaacacggagacacaggtcgcaggt

SEQ ID NO: 4350 - DNA, 25 bp, Rattus norvegicus
aaacacggagactcaggtcgcaggt

SEQ ID NO: 4351 - DNA, 25 bp, Rattus norvegicus
aaacacggaggcaggccaatgccgg

SEQ ID NO: 4352 - DNA, 25 bp, Rattus norvegicus
aaacacggaggctggccaatgccgg

SEQ ID NO: 4353 - DNA, 25 bp, Rattus norvegicus
aaacacggcactcggcgtagcatgc

SEQ ID NO: 4354 - DNA, 25 bp, Rattus norvegicus
aaacacggcactgggcgtagcatgc

SEQ ID NO: 4355 - DNA, 25 bp, Rattus norvegicus
aaacacggctcaattctggtcttaa

SEQ ID NO: 4356 - DNA, 25 bp, Rattus norvegicus
aaacacggctcatttctggtcttaa

SEQ ID NO: 4357 - DNA, 25 bp, Rattus norvegicus
aaacacggctcgagcagaaggctcc

SEQ ID NO: 4358 - DNA, 25 bp, Rattus norvegicus
aaacacggctcgtgcagaaggctcc

SEQ ID NO: 4359 - DNA, 25 bp, Rattus norvegicus
aaacacgggctcagtcaaattgaca

SEQ ID NO: 4360 - DNA, 25 bp, Rattus norvegicus
aaacacgggctctgtcaaattgaca

SEQ ID NO: 4361 - DNA, 25 bp, Rattus norvegicus
aaacacgggtgcatgtggctgcttt

SEQ ID NO: 4362 - DNA, 25 bp, Rattus norvegicus
aaacacgggtgcttgtggctgcttt

SEQ ID NO: 4363 - DNA, 25 bp, Rattus norvegicus
aaacacggtcccatcccacaggatg

SEQ ID NO: 4364 - DNA, 25 bp, Rattus norvegicus
aaacacggtcccttcccacaggatg

SEQ ID NO: 4365 - DNA, 25 bp, Rattus norvegicus
aaacacgtacctcgtgcactgcgag

SEQ ID NO: 4366 - DNA, 25 bp, Rattus norvegicus
aaacacgtacctggtgcactgcgag

SEQ ID NO: 4367 - DNA, 25 bp, Rattus norvegicus
aaacacgtagtcatcattgctcaga

SEQ ID NO: 4368 - DNA, 25 bp, Rattus norvegicus
aaacacgtagtcttcattgctcaga

SEQ ID NO: 4369 - DNA, 25 bp, Rattus norvegicus
aaacacgtcaccatgagggattcct

SEQ ID NO: 4370 - DNA, 25 bp, Rattus norvegicus
aaacacgtcaccttgagggattcct

SEQ ID NO: 4371 - DNA, 25 bp, Rattus norvegicus
aaacacgtcggcatctgagatgtgc

SEQ ID NO: 4372 - DNA, 25 bp, Rattus norvegicus
aaacacgtcggcttctgagatgtgc

SEQ ID NO: 4373 - DNA, 25 bp, Rattus norvegicus
aaacacgtctagcaggtgaatccat

SEQ ID NO: 4374 - DNA, 25 bp, Rattus norvegicus
aaacacgtctaggaggtgaatccat

SEQ ID NO: 4375 - DNA, 25 bp, Rattus norvegicus
aaacacgtctgcatttttatttgag

SEQ ID NO: 4376 - DNA, 25 bp, Rattus norvegicus
aaacacgtctgcttttttatttgag

SEQ ID NO: 4377 - DNA, 25 bp, Rattus norvegicus
aaacacgtgacgatctgcctttggt

SEQ ID NO: 4378 - DNA, 25 bp, Rattus norvegicus
aaacacgtgacgttctgcctttggt

SEQ ID NO: 4379 - DNA, 25 bp, Rattus norvegicus
aaacacgtgtatcctagcatagctg

SEQ ID NO: 4380 - DNA, 25 bp, Rattus norvegicus
aaacacgtgtatgctagcatagctg

SEQ ID NO: 4381 - DNA, 25 bp, Rattus norvegicus
aaacacgtgttccaggttctggcct

SEQ ID NO: 4382 - DNA, 25 bp, Rattus norvegicus
aaacacgtgttcgaggttctggcct

SEQ ID NO: 4383 - DNA, 25 bp, Rattus norvegicus
aaacacgttcagaaccatgctattg

SEQ ID NO: 4384 - DNA, 25 bp, Rattus norvegicus
aaacacgttcagtaccatgctattg

SEQ ID NO: 4385 - DNA, 25 bp, Rattus norvegicus
aaacacgttgcaaatggcccggcca

SEQ ID NO: 4386 - DNA, 25 bp, Rattus norvegicus
aaacacgttgcatatggcccggcca

SEQ ID NO: 4387 - DNA, 25 bp, Rattus norvegicus
aaacacgtttgcaccatggattgag

SEQ ID NO: 4388 - DNA, 25 bp, Rattus norvegicus
aaacacgtttgctccatggattgag

SEQ ID NO: 4389 - DNA, 25 bp, Rattus norvegicus
aaacactaaaacctcattctctctt

SEQ ID NO: 4390 - DNA, 25 bp, Rattus norvegicus
aaacactaaaacgtcattctctctt

SEQ ID NO: 4391 - DNA, 25 bp, Rattus norvegicus
aaacactaaataatgcacctgccta

SEQ ID NO: 4392 - DNA, 25 bp, Rattus norvegicus
aaacactaaatattgcacctgccta

SEQ ID NO: 4393 - DNA, 25 bp, Rattus norvegicus
aaacactaagccatacatcagaaag

SEQ ID NO: 4394 - DNA, 25 bp, Rattus norvegicus
aaacactaagccttacatcagaaag

SEQ ID NO: 4395 - DNA, 25 bp, Rattus norvegicus
aaacactaagtccaggtcctgttgg

SEQ ID NO: 4396 - DNA, 25 bp, Rattus norvegicus
aaacactaagtcgaggtcctgttgg

SEQ ID NO: 4397 - DNA, 25 bp, Rattus norvegicus
aaacactacactcactttctgggcg

SEQ ID NO: 4398 - DNA, 25 bp, Rattus norvegicus
aaacactacactgactttctgggcg

SEQ ID NO: 4399 - DNA, 25 bp, Rattus norvegicus
aaacactacgtcagccaatgtctgc

SEQ ID NO: 4400 - DNA, 25 bp, Rattus norvegicus
aaacactacgtctgccaatgtctgc

SEQ ID NO: 4401 - DNA, 25 bp, Rattus norvegicus
aaacactactgtagtacccagcgac

SEQ ID NO: 4402 - DNA, 25 bp, Rattus norvegicus
aaacactactgttgtacccagcgac

SEQ ID NO: 4403 - DNA, 25 bp, Rattus norvegicus
aaacactacttcaatccacaacttt

SEQ ID NO: 4404 - DNA, 25 bp, Rattus norvegicus
aaacactacttctatccacaacttt

SEQ ID NO: 4405 - DNA, 25 bp, Rattus norvegicus
aaacactagattcaacactggttgc

SEQ ID NO: 4406 - DNA, 25 bp, Rattus norvegicus
aaacactagattgaacactggttgc

SEQ ID NO: 4407 - DNA, 25 bp, Rattus norvegicus
aaacactatgctatgttggagggaa

SEQ ID NO: 4408 - DNA, 25 bp, Rattus norvegicus
aaacactatgctttgttggagggaa

SEQ ID NO: 4409 - DNA, 25 bp, Rattus norvegicus
aaacactattggcatacctcccctg

SEQ ID NO: 4410 - DNA, 25 bp, Rattus norvegicus
aaacactattgggatacctcccctg

SEQ ID NO: 4411 - DNA, 25 bp, Rattus norvegicus
aaacactatttcattctgttgaact

SEQ ID NO: 4412 - DNA, 25 bp, Rattus norvegicus
aaacactatttctttctgttgaact

SEQ ID NO: 4413 - DNA, 25 bp, Rattus norvegicus
aaacactcagaacacctaggctaaa

SEQ ID NO: 4414 - DNA, 25 bp, Rattus norvegicus
aaacactcagaagacctaggctaaa

SEQ ID NO: 4415 - DNA, 25 bp, Rattus norvegicus
aaacactcagggaccagggacagac

SEQ ID NO: 4416 - DNA, 25 bp, Rattus norvegicus
aaacactcagggtccagggacagac

SEQ ID NO: 4417 - DNA, 25 bp, Rattus norvegicus
aaacactcatacatgcacacactgt

SEQ ID NO: 4418 - DNA, 25 bp, Rattus norvegicus
aaacactcatacttgcacacactgt

SEQ ID NO: 4419 - DNA, 25 bp, Rattus norvegicus
aaacactcattgaggtcccagcatt

SEQ ID NO: 4420 - DNA, 25 bp, Rattus norvegicus
aaacactcattgtggtcccagcatt

SEQ ID NO: 4421 - DNA, 25 bp, Rattus norvegicus
aaacactccgcacttcttaagagag

SEQ ID NO: 4422 - DNA, 25 bp, Rattus norvegicus
aaacactccgcagttcttaagagag

SEQ ID NO: 4423 - DNA, 25 bp, Rattus norvegicus
aaacactcctgaaagcagctctttc

SEQ ID NO: 4424 - DNA, 25 bp, Rattus norvegicus
aaacactcctgaccacatggttctc

SEQ ID NO: 4425 - DNA, 25 bp, Rattus norvegicus
aaacactcctgagcacatggttctc

SEQ ID NO: 4426 - DNA, 25 bp, Rattus norvegicus
aaacactcctgatagcagctctttc

SEQ ID NO: 4427 - DNA, 25 bp, Rattus norvegicus
aaacactcggacacggagagacagt

SEQ ID NO: 4428 - DNA, 25 bp, Rattus norvegicus
aaacactcggactcggagagacagt

SEQ ID NO: 4429 - DNA, 25 bp, Rattus norvegicus
aaacactcggatcttatgtcctatt

SEQ ID NO: 4430 - DNA, 25 bp, Rattus norvegicus
aaacactcggatgttatgtcctatt

SEQ ID NO: 4431 - DNA, 25 bp, Rattus norvegicus
aaacactctaggctgctctaactat

SEQ ID NO: 4432 - DNA, 25 bp, Rattus norvegicus
aaacactctagggtgctctaactat

SEQ ID NO: 4433 - DNA, 25 bp, Rattus norvegicus
aaacactctccaaacaggcatccag

SEQ ID NO: 4434 - DNA, 25 bp, Rattus norvegicus
aaacactctccatacaggcatccag

SEQ ID NO: 4435 - DNA, 25 bp, Rattus norvegicus
aaacactctgaccaattgccagcat

SEQ ID NO: 4436 - DNA, 25 bp, Rattus norvegicus
aaacactctgacgaattgccagcat

SEQ ID NO: 4437 - DNA, 25 bp, Rattus norvegicus
aaacactctgtactgtgtgcggacc

SEQ ID NO: 4438 - DNA, 25 bp, Rattus norvegicus
aaacactctgtagtgtgtgcggacc

SEQ ID NO: 4439 - DNA, 25 bp, Rattus norvegicus
aaacactctgtgcagggctagggat

SEQ ID NO: 4440 - DNA, 25 bp, Rattus norvegicus
aaacactctgtggagggctagggat

SEQ ID NO: 4441 - DNA, 25 bp, Rattus norvegicus
aaacactgacgcactgagctgctac

SEQ ID NO: 4442 - DNA, 25 bp, Rattus norvegicus
aaacactgacgctctgagctgctac

SEQ ID NO: 4443 - DNA, 25 bp, Rattus norvegicus
aaacactgactactacctctctctg

SEQ ID NO: 4444 - DNA, 25 bp, Rattus norvegicus
aaacactgactagtacctctctctg

SEQ ID NO: 4445 - DNA, 25 bp, Rattus norvegicus
aaacactgatgtatactctccctga

SEQ ID NO: 4446 - DNA, 25 bp, Rattus norvegicus
aaacactgatgtttactctccctga

SEQ ID NO: 4447 - DNA, 25 bp, Rattus norvegicus
aaacactgattaataggccatgcca

SEQ ID NO: 4448 - DNA, 25 bp, Rattus norvegicus
aaacactgattattaggccatgcca

SEQ ID NO: 4449 - DNA, 25 bp, Rattus norvegicus
aaacactgcaaacctatttagaatc

SEQ ID NO: 4450 - DNA, 25 bp, Rattus norvegicus
aaacactgcaaagctatttagaatc

SEQ ID NO: 4451 - DNA, 25 bp, Rattus norvegicus
aaacactgcaataatcaaggataga

SEQ ID NO: 4452 - DNA, 25 bp, Rattus norvegicus
aaacactgcaattatcaaggataga

SEQ ID NO: 4453 - DNA, 25 bp, Rattus norvegicus
aaacactgctggacacacatacctg

SEQ ID NO: 4454 - DNA, 25 bp, Rattus norvegicus
aaacactgctggtcacacatacctg

SEQ ID NO: 4455 - DNA, 25 bp, Rattus norvegicus
aaacactgctgtccgcagggccttg

SEQ ID NO: 4456 - DNA, 25 bp, Rattus norvegicus
aaacactgctgtgcgcagggccttg

SEQ ID NO: 4457 - DNA, 25 bp, Rattus norvegicus
aaacactggagtccactttcgctcg

SEQ ID NO: 4458 - DNA, 25 bp, Rattus norvegicus
aaacactggagtgcactttcgctcg

SEQ ID NO: 4459 - DNA, 25 bp, Rattus norvegicus
aaacactggcacaactgtgacagct

SEQ ID NO: 4460 - DNA, 25 bp, Rattus norvegicus
aaacactggcacattgacccggtaa

SEQ ID NO: 4461 - DNA, 25 bp, Rattus norvegicus
aaacactggcactactgtgacagct

SEQ ID NO: 4462 - DNA, 25 bp, Rattus norvegicus
aaacactggcactttgacccggtaa

SEQ ID NO: 4463 - DNA, 25 bp, Rattus norvegicus
aaacactggctgcagcggcagccta

SEQ ID NO: 4464 - DNA, 25 bp, Rattus norvegicus
aaacactggctgcatctggtgaggt

SEQ ID NO: 4465 - DNA, 25 bp, Rattus norvegicus
aaacactggctggagcggcagccta

SEQ ID NO: 4466 - DNA, 25 bp, Rattus norvegicus
aaacactggctggatctggtgaggt

SEQ ID NO: 4467 - DNA, 25 bp, Rattus norvegicus
aaacactgggcgattgccaatgtga

SEQ ID NO: 4468 - DNA, 25 bp, Rattus norvegicus
aaacactgggcgtttgccaatgtga

SEQ ID NO: 4469 - DNA, 25 bp, Rattus norvegicus
aaacactgggttagccatccagccc

SEQ ID NO: 4470 - DNA, 25 bp, Rattus norvegicus
aaacactgggtttgccatccagccc

SEQ ID NO: 4471 - DNA, 25 bp, Rattus norvegicus
aaacactggtggcactcttcactga

SEQ ID NO: 4472 - DNA, 25 bp, Rattus norvegicus
aaacactggtgggactcttcactga

SEQ ID NO: 4473 - DNA, 25 bp, Rattus norvegicus
aaacactgttgtagcaatgtataac

SEQ ID NO: 4474 - DNA, 25 bp, Rattus norvegicus
aaacactgttgttgcaatgtataac

SEQ ID NO: 4475 - DNA, 25 bp, Rattus norvegicus
aaacacttactaatgccctctgact

SEQ ID NO: 4476 - DNA, 25 bp, Rattus norvegicus
aaacacttactattgccctctgact

SEQ ID NO: 4477 - DNA, 25 bp, Rattus norvegicus
aaacacttagcaccctgttgtggtt

SEQ ID NO: 4478 - DNA, 25 bp, Rattus norvegicus
aaacacttagcagcctgttgtggtt

SEQ ID NO: 4479 - DNA, 25 bp, Rattus norvegicus
aaacacttcatcatgcatagctgca

SEQ ID NO: 4480 - DNA, 25 bp, Rattus norvegicus
aaacacttcatcttgcatagctgca

SEQ ID NO: 4481 - DNA, 25 bp, Rattus norvegicus
aaacacttcattccgtgagcctgga

SEQ ID NO: 4482 - DNA, 25 bp, Rattus norvegicus
aaacacttcattgcgtgagcctgga

SEQ ID NO: 4483 - DNA, 25 bp, Rattus norvegicus
aaacacttcccgagtgtgcagataa

SEQ ID NO: 4484 - DNA, 25 bp, Rattus norvegicus
aaacacttcccgtgtgtgcagataa

SEQ ID NO: 4485 - DNA, 25 bp, Rattus norvegicus
aaacacttgcggcttgggcctctca

SEQ ID NO: 4486 - DNA, 25 bp, Rattus norvegicus
aaacacttgcgggttgggcctctca

SEQ ID NO: 4487 - DNA, 25 bp, Rattus norvegicus
aaacacttgtgtatgcatgatggca

SEQ ID NO: 4488 - DNA, 25 bp, Rattus norvegicus
aaacacttgtgtttgcatgatggca

SEQ ID NO: 4489 - DNA, 25 bp, Rattus norvegicus
aaacactttaccatgttcactggag

SEQ ID NO: 4490 - DNA, 25 bp, Rattus norvegicus
aaacactttaccttgttcactggag

SEQ ID NO: 4491 - DNA, 25 bp, Rattus norvegicus
aaacactttagaatttctgtggacg

SEQ ID NO: 4492 - DNA, 25 bp, Rattus norvegicus
aaacactttagattttctgtggacg

SEQ ID NO: 4493 - DNA, 25 bp, Rattus norvegicus
aaacactttcatatgcattcatttg

SEQ ID NO: 4494 - DNA, 25 bp, Rattus norvegicus
aaacactttcatttgcattcatttg

SEQ ID NO: 4495 - DNA, 25 bp, Rattus norvegicus
aaacactttccacatcatacacatt

SEQ ID NO: 4496 - DNA, 25 bp, Rattus norvegicus
aaacactttccagatcatacacatt

SEQ ID NO: 4497 - DNA, 25 bp, Rattus norvegicus
aaacactttcggacgctgagctaaa

SEQ ID NO: 4498 - DNA, 25 bp, Rattus norvegicus
aaacactttcggtcgctgagctaaa

SEQ ID NO: 4499 - DNA, 25 bp, Rattus norvegicus
aaacactttcttacctgtgtctcac

SEQ ID NO: 4500 - DNA, 25 bp, Rattus norvegicus
aaacactttctttcctgtgtctcac

SEQ ID NO: 4501 - DNA, 25 bp, Rattus norvegicus
aaacactttgacctgaccttatctt

SEQ ID NO: 4502 - DNA, 25 bp, Rattus norvegicus
aaacactttgacgtgaccttatctt

SEQ ID NO: 4503 - DNA, 25 bp, Rattus norvegicus
aaacagaaagttcaccttgccacgc

SEQ ID NO: 4504 - DNA, 25 bp, Rattus norvegicus
aaacagaaagttgaccttgccacgc

SEQ ID NO: 4505 - DNA, 25 bp, Rattus norvegicus
aaacagaaatctcaaccatcccatt

SEQ ID NO: 4506 - DNA, 25 bp, Rattus norvegicus
aaacagaaatctgaaccatcccatt

SEQ ID NO: 4507 - DNA, 25 bp, Rattus norvegicus
aaacagaagcaactctcccatttac

SEQ ID NO: 4508 - DNA, 25 bp, Rattus norvegicus
aaacagaagcaagtctcccatttac

SEQ ID NO: 4509 - DNA, 25 bp, Rattus norvegicus
aaacagaatgaaacctgttgggtct

SEQ ID NO: 4510 - DNA, 25 bp, Rattus norvegicus
aaacagaatgaatcctgttgggtct

SEQ ID NO: 4511 - DNA, 25 bp, Rattus norvegicus
aaacagacactgctgaccatccact

SEQ ID NO: 4512 - DNA, 25 bp, Rattus norvegicus
aaacagacactggtgaccatccact

SEQ ID NO: 4513 - DNA, 25 bp, Rattus norvegicus
aaacagacagcactctttcttctgg

SEQ ID NO: 4514 - DNA, 25 bp, Rattus norvegicus
aaacagacagcagtctttcttctgg

SEQ ID NO: 4515 - DNA, 25 bp, Rattus norvegicus
aaacagacagccatgctgtggcaca

SEQ ID NO: 4516 - DNA, 25 bp, Rattus norvegicus
aaacagacagccttgctgtggcaca

SEQ ID NO: 4517 - DNA, 25 bp, Rattus norvegicus
aaacagacagtgatcagcaagacat

SEQ ID NO: 4518 - DNA, 25 bp, Rattus norvegicus
aaacagacagtgttcagcaagacat

SEQ ID NO: 4519 - DNA, 25 bp, Rattus norvegicus
aaacagacatcaactctaggacggg

SEQ ID NO: 4520 - DNA, 25 bp, Rattus norvegicus
aaacagacatcatctctaggacggg

SEQ ID NO: 4521 - DNA, 25 bp, Rattus norvegicus
aaacagaccatgagcaattcccagg

SEQ ID NO: 4522 - DNA, 25 bp, Rattus norvegicus
aaacagaccatgtgcaattcccagg

SEQ ID NO: 4523 - DNA, 25 bp, Rattus norvegicus
aaacagacccaaatgaccgtctagt

SEQ ID NO: 4524 - DNA, 25 bp, Rattus norvegicus
aaacagacccaattgaccgtctagt

SEQ ID NO: 4525 - DNA, 25 bp, Rattus norvegicus
aaacagaccctgcactaactgctca

SEQ ID NO: 4526 - DNA, 25 bp, Rattus norvegicus
aaacagaccctggactaactgctca

SEQ ID NO: 4527 - DNA, 25 bp, Rattus norvegicus
aaacagacctgccagaattccagtt

SEQ ID NO: 4528 - DNA, 25 bp, Rattus norvegicus
aaacagacctgcgagaattccagtt

SEQ ID NO: 4529 - DNA, 25 bp, Rattus norvegicus
aaacagactactccctgttgctggc

SEQ ID NO: 4530 - DNA, 25 bp, Rattus norvegicus
aaacagactactgcctgttgctggc

SEQ ID NO: 4531 - DNA, 25 bp, Rattus norvegicus
aaacagactgctaaacacatcctag

SEQ ID NO: 4532 - DNA, 25 bp, Rattus norvegicus
aaacagactgcttaacacatcctag

SEQ ID NO: 4533 - DNA, 25 bp, Rattus norvegicus
aaacagactttgaagccttgacccg

SEQ ID NO: 4534 - DNA, 25 bp, Rattus norvegicus
aaacagactttgtagccttgacccg

SEQ ID NO: 4535 - DNA, 25 bp, Rattus norvegicus
aaacagagagggagagatccacaaa

SEQ ID NO: 4536 - DNA, 25 bp, Rattus norvegicus
aaacagagagggtgagatccacaaa

SEQ ID NO: 4537 - DNA, 25 bp, Rattus norvegicus
aaacagagcgttaagtcacccattc

SEQ ID NO: 4538 - DNA, 25 bp, Rattus norvegicus
aaacagagcgtttagtcacccattc

SEQ ID NO: 4539 - DNA, 25 bp, Rattus norvegicus
aaacagagctataacagctttaggc

SEQ ID NO: 4540 - DNA, 25 bp, Rattus norvegicus
aaacagagctattacagctttaggc

SEQ ID NO: 4541 - DNA, 25 bp, Rattus norvegicus
aaacagagctgacgaagcggccatt

SEQ ID NO: 4542 - DNA, 25 bp, Rattus norvegicus
aaacagagctgaggaagcggccatt

SEQ ID NO: 4543 - DNA, 25 bp, Rattus norvegicus
aaacagagcttcctggttggtctcc

SEQ ID NO: 4544 - DNA, 25 bp, Rattus norvegicus
aaacagagcttcgtggttggtctcc

SEQ ID NO: 4545 - DNA, 25 bp, Rattus norvegicus
aaacagaggctgaccgacatgtggt

SEQ ID NO: 4546 - DNA, 25 bp, Rattus norvegicus
aaacagaggctgtccgacatgtggt

SEQ ID NO: 4547 - DNA, 25 bp, Rattus norvegicus
aaacagagggccctaggcacctagg

SEQ ID NO: 4548 - DNA, 25 bp, Rattus norvegicus
aaacagagggccgtaggcacctagg

SEQ ID NO: 4549 - DNA, 25 bp, Rattus norvegicus
aaacagagtcccaaaccatgaggat

SEQ ID NO: 4550 - DNA, 25 bp, Rattus norvegicus
aaacagagtccctaaccatgaggat

SEQ ID NO: 4551 - DNA, 25 bp, Rattus norvegicus
aaacagatagtgaatattccgtgga

SEQ ID NO: 4552 - DNA, 25 bp, Rattus norvegicus
aaacagatagtgtatattccgtgga

SEQ ID NO: 4553 - DNA, 25 bp, Rattus norvegicus
aaacagatcatcagaaactcccact

SEQ ID NO: 4554 - DNA, 25 bp, Rattus norvegicus
aaacagatcatctgaaactcccact

SEQ ID NO: 4555 - DNA, 25 bp, Rattus norvegicus
aaacagatctacagcgcaagttcta

SEQ ID NO: 4556 - DNA, 25 bp, Rattus norvegicus
aaacagatctactgcgcaagttcta

SEQ ID NO: 4557 - DNA, 25 bp, Rattus norvegicus
aaacagatctccagggtcagcagca

SEQ ID NO: 4558 - DNA, 25 bp, Rattus norvegicus
aaacagatctcctgggtcagcagca

SEQ ID NO: 4559 - DNA, 25 bp, Rattus norvegicus
aaacagatctggctgcagtcaggat

SEQ ID NO: 4560 - DNA, 25 bp, Rattus norvegicus
aaacagatctgggtgcagtcaggat

SEQ ID NO: 4561 - DNA, 25 bp, Rattus norvegicus
aaacagatctgtccagctgtcctgt

SEQ ID NO: 4562 - DNA, 25 bp, Rattus norvegicus
aaacagatctgtgcagctgtcctgt

SEQ ID NO: 4563 - DNA, 25 bp, Rattus norvegicus
aaacagatcttccatctccaagagg

SEQ ID NO: 4564 - DNA, 25 bp, Rattus norvegicus
aaacagatcttcgatctccaagagg

SEQ ID NO: 4565 - DNA, 25 bp, Rattus norvegicus
aaacagatgaaacagtggcggtcct

SEQ ID NO: 4566 - DNA, 25 bp, Rattus norvegicus
aaacagatgaaagagtggcggtcct

SEQ ID NO: 4567 - DNA, 25 bp, Rattus norvegicus
aaacagatgcaacacagcccggtgc

SEQ ID NO: 4568 - DNA, 25 bp, Rattus norvegicus
aaacagatgcaagacagcccggtgc

SEQ ID NO: 4569 - DNA, 25 bp, Rattus norvegicus
aaacagatggtcatcctctgcctta

SEQ ID NO: 4570 - DNA, 25 bp, Rattus norvegicus
aaacagatggtcttcctctgcctta

SEQ ID NO: 4571 - DNA, 25 bp, Rattus norvegicus
aaacagatgttcagggtgcgagccc

SEQ ID NO: 4572 - DNA, 25 bp, Rattus norvegicus
aaacagatgttctgggtgcgagccc

SEQ ID NO: 4573 - DNA, 25 bp, Rattus norvegicus
aaacagattagtcagccccaggacc

SEQ ID NO: 4574 - DNA, 25 bp, Rattus norvegicus
aaacagattagtgagccccaggacc

SEQ ID NO: 4575 - DNA, 25 bp, Rattus norvegicus
aaacagattcgtccagttcacatcc

SEQ ID NO: 4576 - DNA, 25 bp, Rattus norvegicus
aaacagattcgtgcagttcacatcc

SEQ ID NO: 4577 - DNA, 25 bp, Rattus norvegicus
aaacagcaatgacagctctgccagt

SEQ ID NO: 4578 - DNA, 25 bp, Rattus norvegicus
aaacagcaatgagagctctgccagt

SEQ ID NO: 4579 - DNA, 25 bp, Rattus norvegicus
aaacagcaatgcaccacgggagtgg

SEQ ID NO: 4580 - DNA, 25 bp, Rattus norvegicus
aaacagcaatgctccacgggagtgg

SEQ ID NO: 4581 - DNA, 25 bp, Rattus norvegicus
aaacagcacaagctaacctgtcctg

SEQ ID NO: 4582 - DNA, 25 bp, Rattus norvegicus
aaacagcacaaggtaacctgtcctg

SEQ ID NO: 4583 - DNA, 25 bp, Rattus norvegicus
aaacagcactccaccatgtttctgc

SEQ ID NO: 4584 - DNA, 25 bp, Rattus norvegicus
aaacagcactcctccatgtttctgc

SEQ ID NO: 4585 - DNA, 25 bp, Rattus norvegicus
aaacagcacttcaacagttcacttc

SEQ ID NO: 4586 - DNA, 25 bp, Rattus norvegicus
aaacagcacttctacagttcacttc

SEQ ID NO: 4587 - DNA, 25 bp, Rattus norvegicus
aaacagcagcgcacgtccaagaggg

SEQ ID NO: 4588 - DNA, 25 bp, Rattus norvegicus
aaacagcagcgctcgtccaagaggg

SEQ ID NO: 4589 - DNA, 25 bp, Rattus norvegicus
aaacagcagcttcgatccttgtgag

SEQ ID NO: 4590 - DNA, 25 bp, Rattus norvegicus
aaacagcagcttggatccttgtgag

SEQ ID NO: 4591 - DNA, 25 bp, Rattus norvegicus
aaacagcagtaccagatttcatttg

SEQ ID NO: 4592 - DNA, 25 bp, Rattus norvegicus
aaacagcagtacgagatttcatttg

SEQ ID NO: 4593 - DNA, 25 bp, Rattus norvegicus
aaacagcagtgcaactcagactata

SEQ ID NO: 4594 - DNA, 25 bp, Rattus norvegicus
aaacagcagtgctactcagactata

SEQ ID NO: 4595 - DNA, 25 bp, Rattus norvegicus
aaacagcagtggatctccatttctc

SEQ ID NO: 4596 - DNA, 25 bp, Rattus norvegicus
aaacagcagtggttctccatttctc

SEQ ID NO: 4597 - DNA, 25 bp, Rattus norvegicus
aaacagcagtttacacggttctcct

SEQ ID NO: 4598 - DNA, 25 bp, Rattus norvegicus
aaacagcagttttcacggttctcct

SEQ ID NO: 4599 - DNA, 25 bp, Rattus norvegicus
aaacagcattagaaacctccgtggt

SEQ ID NO: 4600 - DNA, 25 bp, Rattus norvegicus
aaacagcattagtaacctccgtggt

SEQ ID NO: 4601 - DNA, 25 bp, Rattus norvegicus
aaacagcattataccagcagcatcc

SEQ ID NO: 4602 - DNA, 25 bp, Rattus norvegicus
aaacagcattattccagcagcatcc

SEQ ID NO: 4603 - DNA, 25 bp, Rattus norvegicus
aaacagcattgcctacatggatcag

SEQ ID NO: 4604 - DNA, 25 bp, Rattus norvegicus
aaacagcattgcgtacatggatcag

SEQ ID NO: 4605 - DNA, 25 bp, Rattus norvegicus
aaacagccaaggagaagtcaagatt

SEQ ID NO: 4606 - DNA, 25 bp, Rattus norvegicus
aaacagccaaggtgaagtcaagatt

SEQ ID NO: 4607 - DNA, 25 bp, Rattus norvegicus
aaacagccactgagccattgtctaa

SEQ ID NO: 4608 - DNA, 25 bp, Rattus norvegicus
aaacagccactgtgccattgtctaa

SEQ ID NO: 4609 - DNA, 25 bp, Rattus norvegicus
aaacagccagtcacggatgagcacc

SEQ ID NO: 4610 - DNA, 25 bp, Rattus norvegicus
aaacagccagtctcggatgagcacc

SEQ ID NO: 4611 - DNA, 25 bp, Rattus norvegicus
aaacagccagtgaggcctgcttctc

SEQ ID NO: 4612 - DNA, 25 bp, Rattus norvegicus
aaacagccagtgtggcctgcttctc

SEQ ID NO: 4613 - DNA, 25 bp, Rattus norvegicus
aaacagccatggacaattctgagat

SEQ ID NO: 4614 - DNA, 25 bp, Rattus norvegicus
aaacagccatggtcaattctgagat

SEQ ID NO: 4615 - DNA, 25 bp, Rattus norvegicus
aaacagcccttgaaggcaggtctct

SEQ ID NO: 4616 - DNA, 25 bp, Rattus norvegicus
aaacagcccttgtaggcaggtctct

SEQ ID NO: 4617 - DNA, 25 bp, Rattus norvegicus
aaacagccctttagtgtcttagaca

SEQ ID NO: 4618 - DNA, 25 bp, Rattus norvegicus
aaacagcccttttgtgtcttagaca

SEQ ID NO: 4619 - DNA, 25 bp, Rattus norvegicus
aaacagccgaagaagcctgcttgct

SEQ ID NO: 4620 - DNA, 25 bp, Rattus norvegicus
aaacagccgaagtagcctgcttgct

SEQ ID NO: 4621 - DNA, 25 bp, Rattus norvegicus
aaacagccggctagaacttttccag

SEQ ID NO: 4622 - DNA, 25 bp, Rattus norvegicus
aaacagccggcttgaacttttccag

SEQ ID NO: 4623 - DNA, 25 bp, Rattus norvegicus
aaacagcctatacactctggatgtg

SEQ ID NO: 4624 - DNA, 25 bp, Rattus norvegicus
aaacagcctatagactctggatgtg

SEQ ID NO: 4625 - DNA, 25 bp, Rattus norvegicus
aaacagcctgtcatttctaggcatt

SEQ ID NO: 4626 - DNA, 25 bp, Rattus norvegicus
aaacagcctgtcttttctaggcatt

SEQ ID NO: 4627 - DNA, 25 bp, Rattus norvegicus
aaacagcctttcacaagggagctcc

SEQ ID NO: 4628 - DNA, 25 bp, Rattus norvegicus
aaacagcctttctcaagggagctcc

SEQ ID NO: 4629 - DNA, 25 bp, Rattus norvegicus
aaacagcctttgatactgagcgagg

SEQ ID NO: 4630 - DNA, 25 bp, Rattus norvegicus
aaacagcctttgttactgagcgagg

SEQ ID NO: 4631 - DNA, 25 bp, Rattus norvegicus
aaacagcgcagtctgggccaatgtc

SEQ ID NO: 4632 - DNA, 25 bp, Rattus norvegicus
aaacagcgcagtgtgggccaatgtc

SEQ ID NO: 4633 - DNA, 25 bp, Rattus norvegicus
aaacagcgcatgactatggattcat

SEQ ID NO: 4634 - DNA, 25 bp, Rattus norvegicus
aaacagcgcatgtctatggattcat

SEQ ID NO: 4635 - DNA, 25 bp, Rattus norvegicus
aaacagcgccctacattgctttgtg

SEQ ID NO: 4636 - DNA, 25 bp, Rattus norvegicus
aaacagcgcccttcattgctttgtg

SEQ ID NO: 4637 - DNA, 25 bp, Rattus norvegicus
aaacagcgcgcgctatttaaggatg

SEQ ID NO: 4638 - DNA, 25 bp, Rattus norvegicus
aaacagcgcgcggtatttaaggatg

SEQ ID NO: 4639 - DNA, 25 bp, Rattus norvegicus
aaacagcgctgactgcagggtcttt

SEQ ID NO: 4640 - DNA, 25 bp, Rattus norvegicus
aaacagcgctgagtgcagggtcttt

SEQ ID NO: 4641 - DNA, 25 bp, Rattus norvegicus
aaacagcggctcagccagctggaga

SEQ ID NO: 4642 - DNA, 25 bp, Rattus norvegicus
aaacagcggctctgccagctggaga

SEQ ID NO: 4643 - DNA, 25 bp, Rattus norvegicus
aaacagcgggagatggttaacatgt

SEQ ID NO: 4644 - DNA, 25 bp, Rattus norvegicus
aaacagcgggagttggttaacatgt

SEQ ID NO: 4645 - DNA, 25 bp, Rattus norvegicus
aaacagctaggcagtgtcctctctg

SEQ ID NO: 4646 - DNA, 25 bp, Rattus norvegicus
aaacagctaggctgtgtcctctctg

SEQ ID NO: 4647 - DNA, 25 bp, Rattus norvegicus
aaacagctatctcctgggtgcagag

SEQ ID NO: 4648 - DNA, 25 bp, Rattus norvegicus
aaacagctatctgctgggtgcagag

SEQ ID NO: 4649 - DNA, 25 bp, Rattus norvegicus
aaacagctattcatatgcccaaatt

SEQ ID NO: 4650 - DNA, 25 bp, Rattus norvegicus
aaacagctattcttatgcccaaatt

SEQ ID NO: 4651 - DNA, 25 bp, Rattus norvegicus
aaacagctatttaccatgcaggtga

SEQ ID NO: 4652 - DNA, 25 bp, Rattus norvegicus
aaacagctattttccatgcaggtga

SEQ ID NO: 4653 - DNA, 25 bp, Rattus norvegicus
aaacagctccttcttgcctggcaag

SEQ ID NO: 4654 - DNA, 25 bp, Rattus norvegicus
aaacagctccttgttgcctggcaag

SEQ ID NO: 4655 - DNA, 25 bp, Rattus norvegicus
aaacagctctgaaccttctgagttc

SEQ ID NO: 4656 - DNA, 25 bp, Rattus norvegicus
aaacagctctgatccttctgagttc

SEQ ID NO: 4657 - DNA, 25 bp, Rattus norvegicus
aaacagctctgcacatgcctggaag

SEQ ID NO: 4658 - DNA, 25 bp, Rattus norvegicus
aaacagctctgctcatgcctggaag

SEQ ID NO: 4659 - DNA, 25 bp, Rattus norvegicus
aaacagctcttcaagaatttttcta

SEQ ID NO: 4660 - DNA, 25 bp, Rattus norvegicus
aaacagctcttcattactttatgca

SEQ ID NO: 4661 - DNA, 25 bp, Rattus norvegicus
aaacagctcttccacaggctcagga

SEQ ID NO: 4662 - DNA, 25 bp, Rattus norvegicus
aaacagctcttcgacaggctcagga

SEQ ID NO: 4663 - DNA, 25 bp, Rattus norvegicus
aaacagctcttctagaatttttcta

SEQ ID NO: 4664 - DNA, 25 bp, Rattus norvegicus
aaacagctcttctttactttatgca

SEQ ID NO: 4665 - DNA, 25 bp, Rattus norvegicus
aaacagctgccccagaggagacaaa

SEQ ID NO: 4666 - DNA, 25 bp, Rattus norvegicus
aaacagctgcccgagaggagacaaa

SEQ ID NO: 4667 - DNA, 25 bp, Rattus norvegicus
aaacagctgcctaagcttcaggaac

SEQ ID NO: 4668 - DNA, 25 bp, Rattus norvegicus
aaacagctgccttagcttcaggaac

SEQ ID NO: 4669 - DNA, 25 bp, Rattus norvegicus
aaacagctgcttaacttggagaaat

SEQ ID NO: 4670 - DNA, 25 bp, Rattus norvegicus
aaacagctgcttctgagtccttgga

SEQ ID NO: 4671 - DNA, 25 bp, Rattus norvegicus
aaacagctgcttgtgagtccttgga

SEQ ID NO: 4672 - DNA, 25 bp, Rattus norvegicus
aaacagctgctttacttggagaaat

SEQ ID NO: 4673 - DNA, 25 bp, Rattus norvegicus
aaacagctggacagtcaggctgctt

SEQ ID NO: 4674 - DNA, 25 bp, Rattus norvegicus
aaacagctggactgtcaggctgctt

SEQ ID NO: 4675 - DNA, 25 bp, Rattus norvegicus
aaacagctgggcctgtgcactgggc

SEQ ID NO: 4676 - DNA, 25 bp, Rattus norvegicus
aaacagctgggcgtgtgcactgggc

SEQ ID NO: 4677 - DNA, 25 bp, Rattus norvegicus
aaacagctggtgcacgagactttat

SEQ ID NO: 4678 - DNA, 25 bp, Rattus norvegicus
aaacagctggtggacgagactttat

SEQ ID NO: 4679 - DNA, 25 bp, Rattus norvegicus
aaacagctgtctctgacattccacc

SEQ ID NO: 4680 - DNA, 25 bp, Rattus norvegicus
aaacagctgtctgtgacattccacc

SEQ ID NO: 4681 - DNA, 25 bp, Rattus norvegicus
aaacagctgtgtatatgaccagtga

SEQ ID NO: 4682 - DNA, 25 bp, Rattus norvegicus
aaacagctgtgtttatgaccagtga

SEQ ID NO: 4683 - DNA, 25 bp, Rattus norvegicus
aaacagcttgtactagtgcacagga

SEQ ID NO: 4684 - DNA, 25 bp, Rattus norvegicus
aaacagcttgtagtagtgcacagga

SEQ ID NO: 4685 - DNA, 25 bp, Rattus norvegicus
aaacagcttgtcaggtgcagtccta

SEQ ID NO: 4686 - DNA, 25 bp, Rattus norvegicus
aaacagcttgtctggtgcagtccta

SEQ ID NO: 4687 - DNA, 25 bp, Rattus norvegicus
aaacagcttttcctgggaggcccat

SEQ ID NO: 4688 - DNA, 25 bp, Rattus norvegicus
aaacagcttttcgtgggaggcccat

SEQ ID NO: 4689 - DNA, 25 bp, Rattus norvegicus
aaacaggaaggactgccccctgagt

SEQ ID NO: 4690 - DNA, 25 bp, Rattus norvegicus
aaacaggaaggagtgccccctgagt

SEQ ID NO: 4691 - DNA, 25 bp, Rattus norvegicus
aaacaggacatactgcccagcgcag

SEQ ID NO: 4692 - DNA, 25 bp, Rattus norvegicus
aaacaggacatagtgcccagcgcag

SEQ ID NO: 4693 - DNA, 25 bp, Rattus norvegicus
aaacaggaccagcaaatgtgttctg

SEQ ID NO: 4694 - DNA, 25 bp, Rattus norvegicus
aaacaggaccaggaaatgtgttctg

SEQ ID NO: 4695 - DNA, 25 bp, Rattus norvegicus
aaacaggagctcagagccatccgct

SEQ ID NO: 4696 - DNA, 25 bp, Rattus norvegicus
aaacaggagctctgagccatccgct

SEQ ID NO: 4697 - DNA, 25 bp, Rattus norvegicus
aaacaggaggctagctgggactcca

SEQ ID NO: 4698 - DNA, 25 bp, Rattus norvegicus
aaacaggaggcttgctgggactcca

SEQ ID NO: 4699 - DNA, 25 bp, Rattus norvegicus
aaacaggatcttatgaggccgggtg

SEQ ID NO: 4700 - DNA, 25 bp, Rattus norvegicus
aaacaggatcttttgaggccgggtg

SEQ ID NO: 4701 - DNA, 25 bp, Rattus norvegicus
aaacaggatgcacgctttgggtccc

SEQ ID NO: 4702 - DNA, 25 bp, Rattus norvegicus
aaacaggatgcaggctttgggtccc

SEQ ID NO: 4703 - DNA, 25 bp, Rattus norvegicus
aaacaggcacagcattttcttgaat

SEQ ID NO: 4704 - DNA, 25 bp, Rattus norvegicus
aaacaggcacaggattttcttgaat

SEQ ID NO: 4705 - DNA, 25 bp, Rattus norvegicus
aaacaggcatccaccacattgtgta

SEQ ID NO: 4706 - DNA, 25 bp, Rattus norvegicus
aaacaggcatcctccacattgtgta

SEQ ID NO: 4707 - DNA, 25 bp, Rattus norvegicus
aaacaggcattgcaggtggtgcttt

SEQ ID NO: 4708 - DNA, 25 bp, Rattus norvegicus
aaacaggcattggaggtggtgcttt

SEQ ID NO: 4709 - DNA, 25 bp, Rattus norvegicus
aaacaggccgaccacaaagtccgtg

SEQ ID NO: 4710 - DNA, 25 bp, Rattus norvegicus
aaacaggccgacgacaaagtccgtg

SEQ ID NO: 4711 - DNA, 25 bp, Rattus norvegicus
aaacaggccgttctatgttgctaga

SEQ ID NO: 4712 - DNA, 25 bp, Rattus norvegicus
aaacaggccgttgtatgttgctaga

SEQ ID NO: 4713 - DNA, 25 bp, Rattus norvegicus
aaacaggcctcaccttaggttgcat

SEQ ID NO: 4714 - DNA, 25 bp, Rattus norvegicus
aaacaggcctcagcttaggttgcat

SEQ ID NO: 4715 - DNA, 25 bp, Rattus norvegicus
aaacaggcctctcttggcttggaaa

SEQ ID NO: 4716 - DNA, 25 bp, Rattus norvegicus
aaacaggcctctgttggcttggaaa

SEQ ID NO: 4717 - DNA, 25 bp, Rattus norvegicus
aaacaggcctgcaaatctctggaat

SEQ ID NO: 4718 - DNA, 25 bp, Rattus norvegicus
aaacaggcctgctaatctctggaat

SEQ ID NO: 4719 - DNA, 25 bp, Rattus norvegicus
aaacaggcctgtatcacatcccgtt

SEQ ID NO: 4720 - DNA, 25 bp, Rattus norvegicus
aaacaggcctgtttcacatcccgtt

SEQ ID NO: 4721 - DNA, 25 bp, Rattus norvegicus
aaacaggcggccagccagcagagag

SEQ ID NO: 4722 - DNA, 25 bp, Rattus norvegicus
aaacaggcggcctgccagcagagag

SEQ ID NO: 4723 - DNA, 25 bp, Rattus norvegicus
aaacaggcggctattggccattctg

SEQ ID NO: 4724 - DNA, 25 bp, Rattus norvegicus
aaacaggcggcttttggccattctg

SEQ ID NO: 4725 - DNA, 25 bp, Rattus norvegicus
aaacaggcgttactgcatttccaca

SEQ ID NO: 4726 - DNA, 25 bp, Rattus norvegicus
aaacaggcgttagtgcatttccaca

SEQ ID NO: 4727 - DNA, 25 bp, Rattus norvegicus
aaacaggctagtatttatgcttcta

SEQ ID NO: 4728 - DNA, 25 bp, Rattus norvegicus
aaacaggctagtttttatgcttcta

SEQ ID NO: 4729 - DNA, 25 bp, Rattus norvegicus
aaacaggctgctccatttgcagggc

SEQ ID NO: 4730 - DNA, 25 bp, Rattus norvegicus
aaacaggctgctgcatttgcagggc

SEQ ID NO: 4731 - DNA, 25 bp, Rattus norvegicus
aaacaggctgttcatgcaccctttt

SEQ ID NO: 4732 - DNA, 25 bp, Rattus norvegicus
aaacaggctgttgatgcaccctttt

SEQ ID NO: 4733 - DNA, 25 bp, Rattus norvegicus
aaacaggcttggaggtagacaccct

SEQ ID NO: 4734 - DNA, 25 bp, Rattus norvegicus
aaacaggcttggtggtagacaccct

SEQ ID NO: 4735 - DNA, 25 bp, Rattus norvegicus
aaacaggctttcaacaacacgggcg

SEQ ID NO: 4736 - DNA, 25 bp, Rattus norvegicus
aaacaggctttctacaacacgggcg

SEQ ID NO: 4737 - DNA, 25 bp, Rattus norvegicus
aaacagggacccattatgcttctct

SEQ ID NO: 4738 - DNA, 25 bp, Rattus norvegicus
aaacagggaccctttatgcttctct

SEQ ID NO: 4739 - DNA, 25 bp, Rattus norvegicus
aaacagggcactctgaattactcgc

SEQ ID NO: 4740 - DNA, 25 bp, Rattus norvegicus
aaacagggcactgtgaattactcgc

SEQ ID NO: 4741 - DNA, 25 bp, Rattus norvegicus
aaacagggtccgagacatctgcaat

SEQ ID NO: 4742 - DNA, 25 bp, Rattus norvegicus
aaacagggtccgtgacatctgcaat

SEQ ID NO: 4743 - DNA, 25 bp, Rattus norvegicus
aaacagggtgggagctcagtccgcc

SEQ ID NO: 4744 - DNA, 25 bp, Rattus norvegicus
aaacagggtgggtgctcagtccgcc

SEQ ID NO: 4745 - DNA, 25 bp, Rattus norvegicus
aaacaggtcaagcttctggcatcaa

SEQ ID NO: 4746 - DNA, 25 bp, Rattus norvegicus
aaacaggtcaaggttctggcatcaa

SEQ ID NO: 4747 - DNA, 25 bp, Rattus norvegicus
aaacaggtcgtgacaaagctcttct

SEQ ID NO: 4748 - DNA, 25 bp, Rattus norvegicus
aaacaggtcgtgtcaaagctcttct

SEQ ID NO: 4749 - DNA, 25 bp, Rattus norvegicus
aaacaggtctacatcatagctcaga

SEQ ID NO: 4750 - DNA, 25 bp, Rattus norvegicus
aaacaggtctacttcatagctcaga

SEQ ID NO: 4751 - DNA, 25 bp, Rattus norvegicus
aaacaggtctcaattcctagccaca

SEQ ID NO: 4752 - DNA, 25 bp, Rattus norvegicus
aaacaggtctcatttcctagccaca

SEQ ID NO: 4753 - DNA, 25 bp, Rattus norvegicus
aaacaggtctggcttactcgtgctt

SEQ ID NO: 4754 - DNA, 25 bp, Rattus norvegicus
aaacaggtctgggttactcgtgctt

SEQ ID NO: 4755 - DNA, 25 bp, Rattus norvegicus
aaacaggtggctagttgtcttacat

SEQ ID NO: 4756 - DNA, 25 bp, Rattus norvegicus
aaacaggtggcttgttgtcttacat

SEQ ID NO: 4757 - DNA, 25 bp, Rattus norvegicus
aaacaggtgtgcagtgtccacgatt

SEQ ID NO: 4758 - DNA, 25 bp, Rattus norvegicus
aaacaggtgtgctgtgtccacgatt

SEQ ID NO: 4759 - DNA, 25 bp, Rattus norvegicus
aaacaggttccccatgaggcacctc

SEQ ID NO: 4760 - DNA, 25 bp, Rattus norvegicus
aaacaggttcccgatgaggcacctc

SEQ ID NO: 4761 - DNA, 25 bp, Rattus norvegicus
aaacaggttctgagctataagtctt

SEQ ID NO: 4762 - DNA, 25 bp, Rattus norvegicus
aaacaggttctgcagcacccgtgga

SEQ ID NO: 4763 - DNA, 25 bp, Rattus norvegicus
aaacaggttctggagcacccgtgga

SEQ ID NO: 4764 - DNA, 25 bp, Rattus norvegicus
aaacaggttctgtgctataagtctt

SEQ ID NO: 4765 - DNA, 25 bp, Rattus norvegicus
aaacaggttgctatgcttactattt

SEQ ID NO: 4766 - DNA, 25 bp, Rattus norvegicus
aaacaggttgctttgcttactattt

SEQ ID NO: 4767 - DNA, 25 bp, Rattus norvegicus
aaacaggttggactaatgggcgctt

SEQ ID NO: 4768 - DNA, 25 bp, Rattus norvegicus
aaacaggttggagtaatgggcgctt

SEQ ID NO: 4769 - DNA, 25 bp, Rattus norvegicus
aaacaggttgtcacatggtctcaga

SEQ ID NO: 4770 - DNA, 25 bp, Rattus norvegicus
aaacaggttgtctcatggtctcaga

SEQ ID NO: 4771 - DNA, 25 bp, Rattus norvegicus
aaacaggttgttagccacaggataa

SEQ ID NO: 4772 - DNA, 25 bp, Rattus norvegicus
aaacaggttgtttgccacaggataa

SEQ ID NO: 4773 - DNA, 25 bp, Rattus norvegicus
aaacaggtttgacacagttggagtt

SEQ ID NO: 4774 - DNA, 25 bp, Rattus norvegicus
aaacaggtttgagacagttggagtt

SEQ ID NO: 4775 - DNA, 25 bp, Rattus norvegicus
aaacagtacatcactgttctcatga

SEQ ID NO: 4776 - DNA, 25 bp, Rattus norvegicus
aaacagtacatctctgttctcatga

SEQ ID NO: 4777 - DNA, 25 bp, Rattus norvegicus
aaacagtactgcagttactacccct

SEQ ID NO: 4778 - DNA, 25 bp, Rattus norvegicus
aaacagtactgctgttactacccct

SEQ ID NO: 4779 - DNA, 25 bp, Rattus norvegicus
aaacagtagcttccatgatcatgat

SEQ ID NO: 4780 - DNA, 25 bp, Rattus norvegicus
aaacagtagcttgcatgatcatgat

SEQ ID NO: 4781 - DNA, 25 bp, Rattus norvegicus
aaacagtagtgcagttcactcccca

SEQ ID NO: 4782 - DNA, 25 bp, Rattus norvegicus
aaacagtagtgctgttcactcccca

SEQ ID NO: 4783 - DNA, 25 bp, Rattus norvegicus
aaacagtatttcagcctggttctct

SEQ ID NO: 4784 - DNA, 25 bp, Rattus norvegicus
aaacagtatttctgcctggttctct

SEQ ID NO: 4785 - DNA, 25 bp, Rattus norvegicus
aaacagtcactgaccacttaagaaa

SEQ ID NO: 4786 - DNA, 25 bp, Rattus norvegicus
aaacagtcactgtccacttaagaaa

SEQ ID NO: 4787 - DNA, 25 bp, Rattus norvegicus
aaacagtcagctcacgctgcttttc

SEQ ID NO: 4788 - DNA, 25 bp, Rattus norvegicus
aaacagtcagctgacgctgcttttc

SEQ ID NO: 4789 - DNA, 25 bp, Rattus norvegicus
aaacagtccctaagtagttgtggaa

SEQ ID NO: 4790 - DNA, 25 bp, Rattus norvegicus
aaacagtccctatgtagttgtggaa

SEQ ID NO: 4791 - DNA, 25 bp, Rattus norvegicus
aaacagtcctatctgcgggcgttga

SEQ ID NO: 4792 - DNA, 25 bp, Rattus norvegicus
aaacagtcctatgtgcgggcgttga

SEQ ID NO: 4793 - DNA, 25 bp, Rattus norvegicus
aaacagtcctgtattgctttgccac

SEQ ID NO: 4794 - DNA, 25 bp, Rattus norvegicus
aaacagtcctgtcctttatgggcta

SEQ ID NO: 4795 - DNA, 25 bp, Rattus norvegicus
aaacagtcctgtgctttatgggcta

SEQ ID NO: 4796 - DNA, 25 bp, Rattus norvegicus
aaacagtcctgttttgctttgccac

SEQ ID NO: 4797 - DNA, 25 bp, Rattus norvegicus
aaacagtcgctgctctctgtgttgg

SEQ ID NO: 4798 - DNA, 25 bp, Rattus norvegicus
aaacagtcgctggtctctgtgttgg

SEQ ID NO: 4799 - DNA, 25 bp, Rattus norvegicus
aaacagtctcatatgggcttctcat

SEQ ID NO: 4800 - DNA, 25 bp, Rattus norvegicus
aaacagtctcatttgggcttctcat

SEQ ID NO: 4801 - DNA, 25 bp, Rattus norvegicus
aaacagtctccaaaacatgatgaag

SEQ ID NO: 4802 - DNA, 25 bp, Rattus norvegicus
aaacagtctccataacatgatgaag

SEQ ID NO: 4803 - DNA, 25 bp, Rattus norvegicus
aaacagtctcccaattctacagaag

SEQ ID NO: 4804 - DNA, 25 bp, Rattus norvegicus
aaacagtctccctattctacagaag

SEQ ID NO: 4805 - DNA, 25 bp, Rattus norvegicus
aaacagtctcctaggctgtggactc

SEQ ID NO: 4806 - DNA, 25 bp, Rattus norvegicus
aaacagtctcctatggcgtcttgct

SEQ ID NO: 4807 - DNA, 25 bp, Rattus norvegicus
aaacagtctccttggctgtggactc

SEQ ID NO: 4808 - DNA, 25 bp, Rattus norvegicus
aaacagtctcctttggcgtcttgct

SEQ ID NO: 4809 - DNA, 25 bp, Rattus norvegicus
aaacagtctctaaccttgcaaatga

SEQ ID NO: 4810 - DNA, 25 bp, Rattus norvegicus
aaacagtctctatccttgcaaatga

SEQ ID NO: 4811 - DNA, 25 bp, Rattus norvegicus
aaacagtctctcaacgggtcctaca

SEQ ID NO: 4812 - DNA, 25 bp, Rattus norvegicus
aaacagtctctctacgggtcctaca

SEQ ID NO: 4813 - DNA, 25 bp, Rattus norvegicus
aaacagtcttccagctgctgagagt

SEQ ID NO: 4814 - DNA, 25 bp, Rattus norvegicus
aaacagtcttcctgctgctgagagt

SEQ ID NO: 4815 - DNA, 25 bp, Rattus norvegicus
aaacagtctttgatcttccaagcct

SEQ ID NO: 4816 - DNA, 25 bp, Rattus norvegicus
aaacagtctttgttcttccaagcct

SEQ ID NO: 4817 - DNA, 25 bp, Rattus norvegicus
aaacagtgattacctagcgtcccag

SEQ ID NO: 4818 - DNA, 25 bp, Rattus norvegicus
aaacagtgattagctagcgtcccag

SEQ ID NO: 4819 - DNA, 25 bp, Rattus norvegicus
aaacagtgctttactttagcatcat

SEQ ID NO: 4820 - DNA, 25 bp, Rattus norvegicus
aaacagtgcttttctttagcatcat

SEQ ID NO: 4821 - DNA, 25 bp, Rattus norvegicus
aaacagtggataccgctgctgtgct

SEQ ID NO: 4822 - DNA, 25 bp, Rattus norvegicus
aaacagtggatagcgctgctgtgct

SEQ ID NO: 4823 - DNA, 25 bp, Rattus norvegicus
aaacagtggcatcgtgtccacccta

SEQ ID NO: 4824 - DNA, 25 bp, Rattus norvegicus
aaacagtggcatggtgtccacccta

SEQ ID NO: 4825 - DNA, 25 bp, Rattus norvegicus
aaacagtggtgaataggctttcaga

SEQ ID NO: 4826 - DNA, 25 bp, Rattus norvegicus
aaacagtggtgattaggctttcaga

SEQ ID NO: 4827 - DNA, 25 bp, Rattus norvegicus
aaacagtggttccttctgcattctc

SEQ ID NO: 4828 - DNA, 25 bp, Rattus norvegicus
aaacagtggttcgttctgcattctc

SEQ ID NO: 4829 - DNA, 25 bp, Rattus norvegicus
aaacagtgtacccatctgtgacccc

SEQ ID NO: 4830 - DNA, 25 bp, Rattus norvegicus
aaacagtgtaccgatctgtgacccc

SEQ ID NO: 4831 - DNA, 25 bp, Rattus norvegicus
aaacagtgtccacttgtaggtgaac

SEQ ID NO: 4832 - DNA, 25 bp, Rattus norvegicus
aaacagtgtccagttgtaggtgaac

SEQ ID NO: 4833 - DNA, 25 bp, Rattus norvegicus
aaacagtgtcccacttcctggaagt

SEQ ID NO: 4834 - DNA, 25 bp, Rattus norvegicus
aaacagtgtccctcttcctggaagt

SEQ ID NO: 4835 - DNA, 25 bp, Rattus norvegicus
aaacagtgtcgccaagcctcagatt

SEQ ID NO: 4836 - DNA, 25 bp, Rattus norvegicus
aaacagtgtcgcgaagcctcagatt

SEQ ID NO: 4837 - DNA, 25 bp, Rattus norvegicus
aaacagtgtggacagttgcttgcct

SEQ ID NO: 4838 - DNA, 25 bp, Rattus norvegicus
aaacagtgtggagagttgcttgcct

SEQ ID NO: 4839 - DNA, 25 bp, Rattus norvegicus
aaacagttagctcctggcatcctgg

SEQ ID NO: 4840 - DNA, 25 bp, Rattus norvegicus
aaacagttagctgctggcatcctgg

SEQ ID NO: 4841 - DNA, 25 bp, Rattus norvegicus
aaacagttatcacattcccacaaca

SEQ ID NO: 4842 - DNA, 25 bp, Rattus norvegicus
aaacagttatcagattcccacaaca

SEQ ID NO: 4843 - DNA, 25 bp, Rattus norvegicus
aaacagttccttctgagcaatcccc

SEQ ID NO: 4844 - DNA, 25 bp, Rattus norvegicus
aaacagttccttgtgagcaatcccc

SEQ ID NO: 4845 - DNA, 25 bp, Rattus norvegicus
aaacagttcgaaaccatcttgaaga

SEQ ID NO: 4846 - DNA, 25 bp, Rattus norvegicus
aaacagttcgaatccatcttgaaga

SEQ ID NO: 4847 - DNA, 25 bp, Rattus norvegicus
aaacagttcgtgcacgtgttgctaa

SEQ ID NO: 4848 - DNA, 25 bp, Rattus norvegicus
aaacagttcgtggacgtgttgctaa

SEQ ID NO: 4849 - DNA, 25 bp, Rattus norvegicus
aaacagttctacagctttccagtga

SEQ ID NO: 4850 - DNA, 25 bp, Rattus norvegicus
aaacagttctactgctttccagtga

SEQ ID NO: 4851 - DNA, 25 bp, Rattus norvegicus
aaacagttctagctcagggttcctc

SEQ ID NO: 4852 - DNA, 25 bp, Rattus norvegicus
aaacagttctaggtcagggttcctc

SEQ ID NO: 4853 - DNA, 25 bp, Rattus norvegicus
aaacagttgcttattcttctcctgt

SEQ ID NO: 4854 - DNA, 25 bp, Rattus norvegicus
aaacagttgctttttcttctcctgt

SEQ ID NO: 4855 - DNA, 25 bp, Rattus norvegicus
aaacagttggttaacgtgaggtctg

SEQ ID NO: 4856 - DNA, 25 bp, Rattus norvegicus
aaacagttggtttacgtgaggtctg

SEQ ID NO: 4857 - DNA, 25 bp, Rattus norvegicus
aaacagtttaatctctccccttgct

SEQ ID NO: 4858 - DNA, 25 bp, Rattus norvegicus
aaacagtttaatgtctccccttgct

SEQ ID NO: 4859 - DNA, 25 bp, Rattus norvegicus
aaacagtttccactgtggaattatg

SEQ ID NO: 4860 - DNA, 25 bp, Rattus norvegicus
aaacagtttccagtgtggaattatg

SEQ ID NO: 4861 - DNA, 25 bp, Rattus norvegicus
aaacagtttcctcctggcgttaggc

SEQ ID NO: 4862 - DNA, 25 bp, Rattus norvegicus
aaacagtttcctgctggcgttaggc

SEQ ID NO: 4863 - DNA, 25 bp, Rattus norvegicus
aaacagtttgtacgagcaggctcag

SEQ ID NO: 4864 - DNA, 25 bp, Rattus norvegicus
aaacagtttgtaggagcaggctcag

SEQ ID NO: 4865 - DNA, 25 bp, Rattus norvegicus
aaacagtttgtgctcctgctgctga

SEQ ID NO: 4866 - DNA, 25 bp, Rattus norvegicus
aaacagtttgtggtcctgctgctga

SEQ ID NO: 4867 - DNA, 25 bp, Rattus norvegicus
aaacagtttgttcttcgatggatga

SEQ ID NO: 4868 - DNA, 25 bp, Rattus norvegicus
aaacagtttgttgttcgatggatga

SEQ ID NO: 4869 - DNA, 25 bp, Rattus norvegicus
aaacataagcctcaggagccagtca

SEQ ID NO: 4870 - DNA, 25 bp, Rattus norvegicus
aaacataagcctgaggagccagtca

SEQ ID NO: 4871 - DNA, 25 bp, Rattus norvegicus
aaacataagtggctccctttctctt

SEQ ID NO: 4872 - DNA, 25 bp, Rattus norvegicus
aaacataagtgggtccctttctctt

SEQ ID NO: 4873 - DNA, 25 bp, Rattus norvegicus
aaacataatcttcccacataccagg

SEQ ID NO: 4874 - DNA, 25 bp, Rattus norvegicus
aaacataatcttgccacataccagg

SEQ ID NO: 4875 - DNA, 25 bp, Rattus norvegicus
aaacataatgcgctccatgcagctc

SEQ ID NO: 4876 - DNA, 25 bp, Rattus norvegicus
aaacataatgcggtccatgcagctc

SEQ ID NO: 4877 - DNA, 25 bp, Rattus norvegicus
aaacatacagtcatctcagtccgta

SEQ ID NO: 4878 - DNA, 25 bp, Rattus norvegicus
aaacatacagtcttctcagtccgta

SEQ ID NO: 4879 - DNA, 25 bp, Rattus norvegicus
aaacataccaggagctgggcatggt

SEQ ID NO: 4880 - DNA, 25 bp, Rattus norvegicus
aaacataccaggtgctgggcatggt

SEQ ID NO: 4881 - DNA, 25 bp, Rattus norvegicus
aaacatacccctagtgtgcacttga

SEQ ID NO: 4882 - DNA, 25 bp, Rattus norvegicus
aaacataccccttgtgtgcacttga

SEQ ID NO: 4883 - DNA, 25 bp, Rattus norvegicus
aaacatagagatccccgcagtgctc

SEQ ID NO: 4884 - DNA, 25 bp, Rattus norvegicus
aaacatagagatgcccgcagtgctc

SEQ ID NO: 4885 - DNA, 25 bp, Rattus norvegicus
aaacatagccaaagtccattcagaa

SEQ ID NO: 4886 - DNA, 25 bp, Rattus norvegicus
aaacatagccaatgtccattcagaa

SEQ ID NO: 4887 - DNA, 25 bp, Rattus norvegicus
aaacatagccctctggtagtaattt

SEQ ID NO: 4888 - DNA, 25 bp, Rattus norvegicus
aaacatagccctgtggtagtaattt

SEQ ID NO: 4889 - DNA, 25 bp, Rattus norvegicus
aaacatagtcttaggatgactgcgt

SEQ ID NO: 4890 - DNA, 25 bp, Rattus norvegicus
aaacatagtctttggatgactgcgt

SEQ ID NO: 4891 - DNA, 25 bp, Rattus norvegicus
aaacatagtgacctctgacctgctg

SEQ ID NO: 4892 - DNA, 25 bp, Rattus norvegicus
aaacatagtgacgtctgacctgctg

SEQ ID NO: 4893 - DNA, 25 bp, Rattus norvegicus
aaacatatacccattgcgatcaaac

SEQ ID NO: 4894 - DNA, 25 bp, Rattus norvegicus
aaacatataccctttgcgatcaaac

SEQ ID NO: 4895 - DNA, 25 bp, Rattus norvegicus
aaacatatcaaaccaccatcccatt

SEQ ID NO: 4896 - DNA, 25 bp, Rattus norvegicus
aaacatatcaaagcaccatcccatt

SEQ ID NO: 4897 - DNA, 25 bp, Rattus norvegicus
aaacatatcagcatgccattttgga

SEQ ID NO: 4898 - DNA, 25 bp, Rattus norvegicus
aaacatatcagcttgccattttgga

SEQ ID NO: 4899 - DNA, 25 bp, Rattus norvegicus
aaacatatccacagtctccaaagac

SEQ ID NO: 4900 - DNA, 25 bp, Rattus norvegicus
aaacatatccactgtctccaaagac

SEQ ID NO: 4901 - DNA, 25 bp, Rattus norvegicus
aaacatatccttcagccagtacagt

SEQ ID NO: 4902 - DNA, 25 bp, Rattus norvegicus
aaacatatccttgagccagtacagt

SEQ ID NO: 4903 - DNA, 25 bp, Rattus norvegicus
aaacatatcgttactcctccaactt

SEQ ID NO: 4904 - DNA, 25 bp, Rattus norvegicus
aaacatatcgtttctcctccaactt

SEQ ID NO: 4905 - DNA, 25 bp, Rattus norvegicus
aaacatatgagcctgtgtgggtcat

SEQ ID NO: 4906 - DNA, 25 bp, Rattus norvegicus
aaacatatgagcgtgtgtgggtcat

SEQ ID NO: 4907 - DNA, 25 bp, Rattus norvegicus
aaacatatgttcaagcacaaagctt

SEQ ID NO: 4908 - DNA, 25 bp, Rattus norvegicus
aaacatatgttctagcacaaagctt

SEQ ID NO: 4909 - DNA, 25 bp, Rattus norvegicus
aaacatatgttgagctcctcagtgc

SEQ ID NO: 4910 - DNA, 25 bp, Rattus norvegicus
aaacatatgttgtgctcctcagtgc

SEQ ID NO: 4911 - DNA, 25 bp, Rattus norvegicus
aaacatattttcatgccttagcctc

SEQ ID NO: 4912 - DNA, 25 bp, Rattus norvegicus
aaacatattttcttgccttagcctc

SEQ ID NO: 4913 - DNA, 25 bp, Rattus norvegicus
aaacatcaacttcttaacttaatca

SEQ ID NO: 4914 - DNA, 25 bp, Rattus norvegicus
aaacatcaacttgttaacttaatca

SEQ ID NO: 4915 - DNA, 25 bp, Rattus norvegicus
aaacatcaagtcaccattttccctg

SEQ ID NO: 4916 - DNA, 25 bp, Rattus norvegicus
aaacatcaagtctccattttccctg

SEQ ID NO: 4917 - DNA, 25 bp, Rattus norvegicus
aaacatcaatgaccccaaagccgcg

SEQ ID NO: 4918 - DNA, 25 bp, Rattus norvegicus
aaacatcaatgagcccaaagccgcg

SEQ ID NO: 4919 - DNA, 25 bp, Rattus norvegicus
aaacatcacaacattcacacgggcg

SEQ ID NO: 4920 - DNA, 25 bp, Rattus norvegicus
aaacatcacaactttcacacgggcg

SEQ ID NO: 4921 - DNA, 25 bp, Rattus norvegicus
aaacatcacataaacatagggcagg

SEQ ID NO: 4922 - DNA, 25 bp, Rattus norvegicus
aaacatcacatatacatagggcagg

SEQ ID NO: 4923 - DNA, 25 bp, Rattus norvegicus
aaacatcacctcagtactctatagc

SEQ ID NO: 4924 - DNA, 25 bp, Rattus norvegicus
aaacatcacctctgtactctatagc

SEQ ID NO: 4925 - DNA, 25 bp, Rattus norvegicus
aaacatcactgcatctcaagtcttc

SEQ ID NO: 4926 - DNA, 25 bp, Rattus norvegicus
aaacatcactgcttctcaagtcttc

SEQ ID NO: 4927 - DNA, 25 bp, Rattus norvegicus
aaacatcactgtccttgtgacacca

SEQ ID NO: 4928 - DNA, 25 bp, Rattus norvegicus
aaacatcactgtgcttgtgacacca

SEQ ID NO: 4929 - DNA, 25 bp, Rattus norvegicus
aaacatcagccacttccagagtcat

SEQ ID NO: 4930 - DNA, 25 bp, Rattus norvegicus
aaacatcagccagttccagagtcat

SEQ ID NO: 4931 - DNA, 25 bp, Rattus norvegicus
aaacatcagtccagaagccttccag

SEQ ID NO: 4932 - DNA, 25 bp, Rattus norvegicus
aaacatcagtcctgaagccttccag

SEQ ID NO: 4933 - DNA, 25 bp, Rattus norvegicus
aaacatcagtctaagctcagggcca

SEQ ID NO: 4934 - DNA, 25 bp, Rattus norvegicus
aaacatcagtcttagctcagggcca

SEQ ID NO: 4935 - DNA, 25 bp, Rattus norvegicus
aaacatcatgctaacggccttctct

SEQ ID NO: 4936 - DNA, 25 bp, Rattus norvegicus
aaacatcatgcttacggccttctct

SEQ ID NO: 4937 - DNA, 25 bp, Rattus norvegicus
aaacatcatggactagcatccccag

SEQ ID NO: 4938 - DNA, 25 bp, Rattus norvegicus
aaacatcatggagtagcatccccag

SEQ ID NO: 4939 - DNA, 25 bp, Rattus norvegicus
aaacatcatgggaacttccaggctt

SEQ ID NO: 4940 - DNA, 25 bp, Rattus norvegicus
aaacatcatgggtacttccaggctt

SEQ ID NO: 4941 - DNA, 25 bp, Rattus norvegicus
aaacatcatgtcagaggccaagcca

SEQ ID NO: 4942 - DNA, 25 bp, Rattus norvegicus
aaacatcatgtctgaggccaagcca

SEQ ID NO: 4943 - DNA, 25 bp, Rattus norvegicus
aaacatcatttgcacctttttcaag

SEQ ID NO: 4944 - DNA, 25 bp, Rattus norvegicus
aaacatcatttggacctttttcaag

SEQ ID NO: 4945 - DNA, 25 bp, Rattus norvegicus
aaacatccatccaggacctgtttta

SEQ ID NO: 4946 - DNA, 25 bp, Rattus norvegicus
aaacatccatcctggacctgtttta

SEQ ID NO: 4947 - DNA, 25 bp, Rattus norvegicus
aaacatccatttccttgtaatatgc

SEQ ID NO: 4948 - DNA, 25 bp, Rattus norvegicus
aaacatccatttgcttgtaatatgc

SEQ ID NO: 4949 - DNA, 25 bp, Rattus norvegicus
aaacatcccatacacagtccagtcg

SEQ ID NO: 4950 - DNA, 25 bp, Rattus norvegicus
aaacatcccatagacagtccagtcg

SEQ ID NO: 4951 - DNA, 25 bp, Rattus norvegicus
aaacatccctgcattctgagaatct

SEQ ID NO: 4952 - DNA, 25 bp, Rattus norvegicus
aaacatccctgctttctgagaatct

SEQ ID NO: 4953 - DNA, 25 bp, Rattus norvegicus
aaacatccgactaccttaaggtgct

SEQ ID NO: 4954 - DNA, 25 bp, Rattus norvegicus
aaacatccgacttccttaaggtgct

SEQ ID NO: 4955 - DNA, 25 bp, Rattus norvegicus
aaacatcctgagcagcggcgcgccg

SEQ ID NO: 4956 - DNA, 25 bp, Rattus norvegicus
aaacatcctgaggagcggcgcgccg

SEQ ID NO: 4957 - DNA, 25 bp, Rattus norvegicus
aaacatcctgcgcaggccattccag

SEQ ID NO: 4958 - DNA, 25 bp, Rattus norvegicus
aaacatcctgcggaggccattccag

SEQ ID NO: 4959 - DNA, 25 bp, Rattus norvegicus
aaacatcctgttccttgctatttat

SEQ ID NO: 4960 - DNA, 25 bp, Rattus norvegicus
aaacatcctgttgcttgctatttat

SEQ ID NO: 4961 - DNA, 25 bp, Rattus norvegicus
aaacatcgagtcactggcacatgct

SEQ ID NO: 4962 - DNA, 25 bp, Rattus norvegicus
aaacatcgagtctctggcacatgct

SEQ ID NO: 4963 - DNA, 25 bp, Rattus norvegicus
aaacatcgctaaccagcacacaggc

SEQ ID NO: 4964 - DNA, 25 bp, Rattus norvegicus
aaacatcgctaagcagcacacaggc

SEQ ID NO: 4965 - DNA, 25 bp, Rattus norvegicus
aaacatcgctctagtaaactgtggt

SEQ ID NO: 4966 - DNA, 25 bp, Rattus norvegicus
aaacatcgctcttgtaaactgtggt

SEQ ID NO: 4967 - DNA, 25 bp, Rattus norvegicus
aaacatctagacatagggtttcaga

SEQ ID NO: 4968 - DNA, 25 bp, Rattus norvegicus
aaacatctagacttagggtttcaga

SEQ ID NO: 4969 - DNA, 25 bp, Rattus norvegicus
aaacatctaggaaacgccctcttct

SEQ ID NO: 4970 - DNA, 25 bp, Rattus norvegicus
aaacatctaggatacgccctcttct

SEQ ID NO: 4971 - DNA, 25 bp, Rattus norvegicus
aaacatctatgacctccaagtgctg

SEQ ID NO: 4972 - DNA, 25 bp, Rattus norvegicus
aaacatctatgagctccaagtgctg

SEQ ID NO: 4973 - DNA, 25 bp, Rattus norvegicus
aaacatctcaatatctcatacccat

SEQ ID NO: 4974 - DNA, 25 bp, Rattus norvegicus
aaacatctcaatttctcatacccat

SEQ ID NO: 4975 - DNA, 25 bp, Rattus norvegicus
aaacatctcagccaagcatttacct

SEQ ID NO: 4976 - DNA, 25 bp, Rattus norvegicus
aaacatctcagcgaagcatttacct

SEQ ID NO: 4977 - DNA, 25 bp, Rattus norvegicus
aaacatctcattcccctggtataat

SEQ ID NO: 4978 - DNA, 25 bp, Rattus norvegicus
aaacatctcattgccctggtataat

SEQ ID NO: 4979 - DNA, 25 bp, Rattus norvegicus
aaacatctccacattcaaccaggtt

SEQ ID NO: 4980 - DNA, 25 bp, Rattus norvegicus
aaacatctccactttcaaccaggtt

SEQ ID NO: 4981 - DNA, 25 bp, Rattus norvegicus
aaacatctcgttattgcctttagca

SEQ ID NO: 4982 - DNA, 25 bp, Rattus norvegicus
aaacatctcgtttttgcctttagca

SEQ ID NO: 4983 - DNA, 25 bp, Rattus norvegicus
aaacatctctgcaagctcacagtta

SEQ ID NO: 4984 - DNA, 25 bp, Rattus norvegicus
aaacatctctgctagctcacagtta

SEQ ID NO: 4985 - DNA, 25 bp, Rattus norvegicus
aaacatctctggctgccaggcaatt

SEQ ID NO: 4986 - DNA, 25 bp, Rattus norvegicus
aaacatctctgggtgccaggcaatt

SEQ ID NO: 4987 - DNA, 25 bp, Rattus norvegicus
aaacatctctgtccttaaaatcctc

SEQ ID NO: 4988 - DNA, 25 bp, Rattus norvegicus
aaacatctctgtgcttaaaatcctc

SEQ ID NO: 4989 - DNA, 25 bp, Rattus norvegicus
aaacatctcttcatattgtgtggta

SEQ ID NO: 4990 - DNA, 25 bp, Rattus norvegicus
aaacatctcttcttattgtgtggta

SEQ ID NO: 4991 - DNA, 25 bp, Rattus norvegicus
aaacatctgcctaccatctgaggaa

SEQ ID NO: 4992 - DNA, 25 bp, Rattus norvegicus
aaacatctgccttccatctgaggaa

SEQ ID NO: 4993 - DNA, 25 bp, Rattus norvegicus
aaacatctgctgatacattagcata

SEQ ID NO: 4994 - DNA, 25 bp, Rattus norvegicus
aaacatctgctgttacattagcata

SEQ ID NO: 4995 - DNA, 25 bp, Rattus norvegicus
aaacatctggctctggttatcttca

SEQ ID NO: 4996 - DNA, 25 bp, Rattus norvegicus
aaacatctggctgtggttatcttca

SEQ ID NO: 4997 - DNA, 25 bp, Rattus norvegicus
aaacatctggtcctggtgtgaccta

SEQ ID NO: 4998 - DNA, 25 bp, Rattus norvegicus
aaacatctggtcgtggtgtgaccta

SEQ ID NO: 4999 - DNA, 25 bp, Rattus norvegicus
aaacatctgtgaaatctgcactgat

SEQ ID NO: 5000 - DNA, 25 bp, Rattus norvegicus
aaacatctgtgatatctgcactgat

SEQ ID NO: 5001 - DNA, 25 bp, Rattus norvegicus
aaacatctgttcattttcgtccatt

SEQ ID NO: 5002 - DNA, 25 bp, Rattus norvegicus
aaacatctgttctttttcgtccatt

SEQ ID NO: 5003 - DNA, 25 bp, Rattus norvegicus
aaacatctgttgctttggacttcgt

SEQ ID NO: 5004 - DNA, 25 bp, Rattus norvegicus
aaacatctgttggtttggacttcgt

SEQ ID NO: 5005 - DNA, 25 bp, Rattus norvegicus
aaacatctgtttccccatgatagac

SEQ ID NO: 5006 - DNA, 25 bp, Rattus norvegicus
aaacatctgtttgcccatgatagac

SEQ ID NO: 5007 - DNA, 25 bp, Rattus norvegicus
aaacatcttagcctgctgggaagac

SEQ ID NO: 5008 - DNA, 25 bp, Rattus norvegicus
aaacatcttagcgtgctgggaagac

SEQ ID NO: 5009 - DNA, 25 bp, Rattus norvegicus
aaacatcttcagagcagaggtacat

SEQ ID NO: 5010 - DNA, 25 bp, Rattus norvegicus
aaacatcttcagtgcagaggtacat

SEQ ID NO: 5011 - DNA, 25 bp, Rattus norvegicus
aaacatcttccccatgattggctaa

SEQ ID NO: 5012 - DNA, 25 bp, Rattus norvegicus
aaacatcttcccgatgattggctaa

SEQ ID NO: 5013 - DNA, 25 bp, Rattus norvegicus
aaacatctttatatccgtagtatga

SEQ ID NO: 5014 - DNA, 25 bp, Rattus norvegicus
aaacatctttatttccgtagtatga

SEQ ID NO: 5015 - DNA, 25 bp, Rattus norvegicus
aaacatctttggacttttgtggaat

SEQ ID NO: 5016 - DNA, 25 bp, Rattus norvegicus
aaacatctttggtcttttgtggaat

SEQ ID NO: 5017 - DNA, 25 bp, Rattus norvegicus
aaacatgaaccaccagtggcggctc

SEQ ID NO: 5018 - DNA, 25 bp, Rattus norvegicus
aaacatgaaccagcagtggcggctc

SEQ ID NO: 5019 - DNA, 25 bp, Rattus norvegicus
aaacatgaagatcctcagaggcctg

SEQ ID NO: 5020 - DNA, 25 bp, Rattus norvegicus
aaacatgaagatgctcagaggcctg

SEQ ID NO: 5021 - DNA, 25 bp, Rattus norvegicus
aaacatgaattgagtggctggcagt

SEQ ID NO: 5022 - DNA, 25 bp, Rattus norvegicus
aaacatgaattgtgtggctggcagt

SEQ ID NO: 5023 - DNA, 25 bp, Rattus norvegicus
aaacatgaccacactgggctataga

SEQ ID NO: 5024 - DNA, 25 bp, Rattus norvegicus
aaacatgaccacattagccaacttg

SEQ ID NO: 5025 - DNA, 25 bp, Rattus norvegicus
aaacatgaccactctgggctataga

SEQ ID NO: 5026 - DNA, 25 bp, Rattus norvegicus
aaacatgaccactttagccaacttg

SEQ ID NO: 5027 - DNA, 25 bp, Rattus norvegicus
aaacatgacgccagtcattggcttc

SEQ ID NO: 5028 - DNA, 25 bp, Rattus norvegicus
aaacatgacgcctgtcattggcttc

SEQ ID NO: 5029 - DNA, 25 bp, Rattus norvegicus
aaacatgacgctcgaggccgcgcaa

SEQ ID NO: 5030 - DNA, 25 bp, Rattus norvegicus
aaacatgacgctggaggccgcgcaa

SEQ ID NO: 5031 - DNA, 25 bp, Rattus norvegicus
aaacatgagaatccggagctccctc

SEQ ID NO: 5032 - DNA, 25 bp, Rattus norvegicus
aaacatgagaatgcggagctccctc

SEQ ID NO: 5033 - DNA, 25 bp, Rattus norvegicus
aaacatgagcatcgctggagccgga

SEQ ID NO: 5034 - DNA, 25 bp, Rattus norvegicus
aaacatgagcatggctggagccgga

SEQ ID NO: 5035 - DNA, 25 bp, Rattus norvegicus
aaacatgagcctcttgccacagagc

SEQ ID NO: 5036 - DNA, 25 bp, Rattus norvegicus
aaacatgagcctgttgccacagagc

SEQ ID NO: 5037 - DNA, 25 bp, Rattus norvegicus
aaacatgagtgcagttttccagcca

SEQ ID NO: 5038 - DNA, 25 bp, Rattus norvegicus
aaacatgagtgctgttttccagcca

SEQ ID NO: 5039 - DNA, 25 bp, Rattus norvegicus
aaacatgatctcctctaattctgga

SEQ ID NO: 5040 - DNA, 25 bp, Rattus norvegicus
aaacatgatctcgtctaattctgga

SEQ ID NO: 5041 - DNA, 25 bp, Rattus norvegicus
aaacatgatgtgcacttaggccata

SEQ ID NO: 5042 - DNA, 25 bp, Rattus norvegicus
aaacatgatgtggacttaggccata

SEQ ID NO: 5043 - DNA, 25 bp, Rattus norvegicus
aaacatgatgttcctgcttgtcaaa

SEQ ID NO: 5044 - DNA, 25 bp, Rattus norvegicus
aaacatgatgttgctgcttgtcaaa

SEQ ID NO: 5045 - DNA, 25 bp, Rattus norvegicus
aaacatgcaagcacagctgattggt

SEQ ID NO: 5046 - DNA, 25 bp, Rattus norvegicus
aaacatgcaagctcagctgattggt

SEQ ID NO: 5047 - DNA, 25 bp, Rattus norvegicus
aaacatgcacatctctgaaagccaa

SEQ ID NO: 5048 - DNA, 25 bp, Rattus norvegicus
aaacatgcacatgtctgaaagccaa

SEQ ID NO: 5049 - DNA, 25 bp, Rattus norvegicus
aaacatgcacttagaggtctgcccc

SEQ ID NO: 5050 - DNA, 25 bp, Rattus norvegicus
aaacatgcactttgaggtctgcccc

SEQ ID NO: 5051 - DNA, 25 bp, Rattus norvegicus
aaacatgcagagacgcttgcctcag

SEQ ID NO: 5052 - DNA, 25 bp, Rattus norvegicus
aaacatgcagagtcgcttgcctcag

SEQ ID NO: 5053 - DNA, 25 bp, Rattus norvegicus
aaacatgcatagaggccagcccata

SEQ ID NO: 5054 - DNA, 25 bp, Rattus norvegicus
aaacatgcatagtggccagcccata

SEQ ID NO: 5055 - DNA, 25 bp, Rattus norvegicus
aaacatgcatgccttgatcttgcag

SEQ ID NO: 5056 - DNA, 25 bp, Rattus norvegicus
aaacatgcatgcgttgatcttgcag

SEQ ID NO: 5057 - DNA, 25 bp, Rattus norvegicus
aaacatgccggacgatctacaacat

SEQ ID NO: 5058 - DNA, 25 bp, Rattus norvegicus
aaacatgccggaggatctacaacat

SEQ ID NO: 5059 - DNA, 25 bp, Rattus norvegicus
aaacatgcctgcacaggtggaccag

SEQ ID NO: 5060 - DNA, 25 bp, Rattus norvegicus
aaacatgcctgctcaggtggaccag

SEQ ID NO: 5061 - DNA, 25 bp, Rattus norvegicus
aaacatgcctttctttacatctgag

SEQ ID NO: 5062 - DNA, 25 bp, Rattus norvegicus
aaacatgcctttgtttacatctgag

SEQ ID NO: 5063 - DNA, 25 bp, Rattus norvegicus
aaacatgcgtttaatcagtttcttt

SEQ ID NO: 5064 - DNA, 25 bp, Rattus norvegicus
aaacatgcgttttatcagtttcttt

SEQ ID NO: 5065 - DNA, 25 bp, Rattus norvegicus
aaacatgctaagactgaccataaaa

SEQ ID NO: 5066 - DNA, 25 bp, Rattus norvegicus
aaacatgctaagtctgaccataaaa

SEQ ID NO: 5067 - DNA, 25 bp, Rattus norvegicus
aaacatgctacaagtaaagccaaaa

SEQ ID NO: 5068 - DNA, 25 bp, Rattus norvegicus
aaacatgctacatgtaaagccaaaa

SEQ ID NO: 5069 - DNA, 25 bp, Rattus norvegicus
aaacatgctcagcaaactgcaccag

SEQ ID NO: 5070 - DNA, 25 bp, Rattus norvegicus
aaacatgctcaggaaactgcaccag

SEQ ID NO: 5071 - DNA, 25 bp, Rattus norvegicus
aaacatgctcctaccagcaaatttc

SEQ ID NO: 5072 - DNA, 25 bp, Rattus norvegicus
aaacatgctccttccagcaaatttc

SEQ ID NO: 5073 - DNA, 25 bp, Rattus norvegicus
aaacatgctcgcagctgtgagtctg

SEQ ID NO: 5074 - DNA, 25 bp, Rattus norvegicus
aaacatgctcgctgctgtgagtctg

SEQ ID NO: 5075 - DNA, 25 bp, Rattus norvegicus
aaacatgcttgcctccttaaagata

SEQ ID NO: 5076 - DNA, 25 bp, Rattus norvegicus
aaacatgcttgcgtccttaaagata

SEQ ID NO: 5077 - DNA, 25 bp, Rattus norvegicus
aaacatgcttggagtcaactgcggt

SEQ ID NO: 5078 - DNA, 25 bp, Rattus norvegicus
aaacatgcttggtgtcaactgcggt

SEQ ID NO: 5079 - DNA, 25 bp, Rattus norvegicus
aaacatgcttgtcactccagtatgc

SEQ ID NO: 5080 - DNA, 25 bp, Rattus norvegicus
aaacatgcttgtgactccagtatgc

SEQ ID NO: 5081 - DNA, 25 bp, Rattus norvegicus
aaacatgctttcacagcagacttcc

SEQ ID NO: 5082 - DNA, 25 bp, Rattus norvegicus
aaacatgctttctcagcagacttcc

SEQ ID NO: 5083 - DNA, 25 bp, Rattus norvegicus
aaacatggaagtagtgcccctgact

SEQ ID NO: 5084 - DNA, 25 bp, Rattus norvegicus
aaacatggaagttgtgcccctgact

SEQ ID NO: 5085 - DNA, 25 bp, Rattus norvegicus
aaacatggactgcaggaaattccaa

SEQ ID NO: 5086 - DNA, 25 bp, Rattus norvegicus
aaacatggactggaggaaattccaa

SEQ ID NO: 5087 - DNA, 25 bp, Rattus norvegicus
aaacatggcaggagtgtgccttcaa

SEQ ID NO: 5088 - DNA, 25 bp, Rattus norvegicus
aaacatggcaggtgtgtgccttcaa

SEQ ID NO: 5089 - DNA, 25 bp, Rattus norvegicus
aaacatggcattccactgtatgaag

SEQ ID NO: 5090 - DNA, 25 bp, Rattus norvegicus
aaacatggcattgcactgtatgaag

SEQ ID NO: 5091 - DNA, 25 bp, Rattus norvegicus
aaacatggcgtgagtcttttcctac

SEQ ID NO: 5092 - DNA, 25 bp, Rattus norvegicus
aaacatggcgtgtgtcttttcctac

SEQ ID NO: 5093 - DNA, 25 bp, Rattus norvegicus
aaacatggctccagtgctatggttc

SEQ ID NO: 5094 - DNA, 25 bp, Rattus norvegicus
aaacatggctcctgtgctatggttc

SEQ ID NO: 5095 - DNA, 25 bp, Rattus norvegicus
aaacatggctctatattttaactag

SEQ ID NO: 5096 - DNA, 25 bp, Rattus norvegicus
aaacatggctctttattttaactag

SEQ ID NO: 5097 - DNA, 25 bp, Rattus norvegicus
aaacatggctgacagtgctgatgac

SEQ ID NO: 5098 - DNA, 25 bp, Rattus norvegicus
aaacatggctgagagtgctgatgac

SEQ ID NO: 5099 - DNA, 25 bp, Rattus norvegicus
aaacatggctgcatatatctataaa

SEQ ID NO: 5100 - DNA, 25 bp, Rattus norvegicus
aaacatggctgcttatatctataaa

SEQ ID NO: 5101 - DNA, 25 bp, Rattus norvegicus
aaacatggctgtattgtcacgccac

SEQ ID NO: 5102 - DNA, 25 bp, Rattus norvegicus
aaacatggctgttttgtcacgccac

SEQ ID NO: 5103 - DNA, 25 bp, Rattus norvegicus
aaacatggcttcagcaggttcagta

SEQ ID NO: 5104 - DNA, 25 bp, Rattus norvegicus
aaacatggcttctgcaggttcagta

SEQ ID NO: 5105 - DNA, 25 bp, Rattus norvegicus
aaacatgggaccatcatgcttgcct

SEQ ID NO: 5106 - DNA, 25 bp, Rattus norvegicus
aaacatgggaccttcatgcttgcct

SEQ ID NO: 5107 - DNA, 25 bp, Rattus norvegicus
aaacatgggcaacctcggcatgccg

SEQ ID NO: 5108 - DNA, 25 bp, Rattus norvegicus
aaacatgggcaagctcggcatgccg

SEQ ID NO: 5109 - DNA, 25 bp, Rattus norvegicus
aaacatgggcacattggctggcctg

SEQ ID NO: 5110 - DNA, 25 bp, Rattus norvegicus
aaacatgggcactttggctggcctg

SEQ ID NO: 5111 - DNA, 25 bp, Rattus norvegicus
aaacatgggctaacctgggcctgac

SEQ ID NO: 5112 - DNA, 25 bp, Rattus norvegicus
aaacatgggctatcctgggcctgac

SEQ ID NO: 5113 - DNA, 25 bp, Rattus norvegicus
aaacatggtcttaactgcgtgctca

SEQ ID NO: 5114 - DNA, 25 bp, Rattus norvegicus
aaacatggtctttactgcgtgctca

SEQ ID NO: 5115 - DNA, 25 bp, Rattus norvegicus
aaacatggtgccctttactctgaaa

SEQ ID NO: 5116 - DNA, 25 bp, Rattus norvegicus
aaacatggtgccgtttactctgaaa

SEQ ID NO: 5117 - DNA, 25 bp, Rattus norvegicus
aaacatgtactgctgtgatcttgta

SEQ ID NO: 5118 - DNA, 25 bp, Rattus norvegicus
aaacatgtactggtgtgatcttgta

SEQ ID NO: 5119 - DNA, 25 bp, Rattus norvegicus
aaacatgtatcgacactgggtggta

SEQ ID NO: 5120 - DNA, 25 bp, Rattus norvegicus
aaacatgtatcgtcactgggtggta

SEQ ID NO: 5121 - DNA, 25 bp, Rattus norvegicus
aaacatgtatgcattctccattcaa

SEQ ID NO: 5122 - DNA, 25 bp, Rattus norvegicus
aaacatgtatgctttctccattcaa

SEQ ID NO: 5123 - DNA, 25 bp, Rattus norvegicus
aaacatgtcactccgatggctcagt

SEQ ID NO: 5124 - DNA, 25 bp, Rattus norvegicus
aaacatgtcactgcgatggctcagt

SEQ ID NO: 5125 - DNA, 25 bp, Rattus norvegicus
aaacatgtcggcactagactgacct

SEQ ID NO: 5126 - DNA, 25 bp, Rattus norvegicus
aaacatgtcggctctagactgacct

SEQ ID NO: 5127 - DNA, 25 bp, Rattus norvegicus
aaacatgtctctcagtacttgggcc

SEQ ID NO: 5128 - DNA, 25 bp, Rattus norvegicus
aaacatgtctctgagtacttgggcc

SEQ ID NO: 5129 - DNA, 25 bp, Rattus norvegicus
aaacatgtgactactgttgtaatgt

SEQ ID NO: 5130 - DNA, 25 bp, Rattus norvegicus
aaacatgtgacttctgttgtaatgt

SEQ ID NO: 5131 - DNA, 25 bp, Rattus norvegicus
aaacatgtggaacctcttgcagaaa

SEQ ID NO: 5132 - DNA, 25 bp, Rattus norvegicus
aaacatgtggaagctcttgcagaaa

SEQ ID NO: 5133 - DNA, 25 bp, Rattus norvegicus
aaacatgtgtctcgcatctgtgcaa

SEQ ID NO: 5134 - DNA, 25 bp, Rattus norvegicus
aaacatgtgtctggcatctgtgcaa

SEQ ID NO: 5135 - DNA, 25 bp, Rattus norvegicus
aaacatgttcctcaagcagccagct

SEQ ID NO: 5136 - DNA, 25 bp, Rattus norvegicus
aaacatgttcctgaagcagccagct

SEQ ID NO: 5137 - DNA, 25 bp, Rattus norvegicus
aaacatgttctcagtctccaaaact

SEQ ID NO: 5138 - DNA, 25 bp, Rattus norvegicus
aaacatgttctctgtctccaaaact

SEQ ID NO: 5139 - DNA, 25 bp, Rattus norvegicus
aaacatgttggtccaagccagctct

SEQ ID NO: 5140 - DNA, 25 bp, Rattus norvegicus
aaacatgttggtgcaagccagctct

SEQ ID NO: 5141 - DNA, 25 bp, Rattus norvegicus
aaacatgttgtccttagttctcaag

SEQ ID NO: 5142 - DNA, 25 bp, Rattus norvegicus
aaacatgttgtcgttagttctcaag

SEQ ID NO: 5143 - DNA, 25 bp, Rattus norvegicus
aaacatgtttttcagtccacaccgt

SEQ ID NO: 5144 - DNA, 25 bp, Rattus norvegicus
aaacatgtttttgagtccacaccgt

SEQ ID NO: 5145 - DNA, 25 bp, Rattus norvegicus
aaacattaaccacctcaatcagcaa

SEQ ID NO: 5146 - DNA, 25 bp, Rattus norvegicus
aaacattaaccagctcaatcagcaa

SEQ ID NO: 5147 - DNA, 25 bp, Rattus norvegicus
aaacattaagctcgcccaatggtaa

SEQ ID NO: 5148 - DNA, 25 bp, Rattus norvegicus
aaacattaagctggcccaatggtaa

SEQ ID NO: 5149 - DNA, 25 bp, Rattus norvegicus
aaacattaatacattgtgctagagt

SEQ ID NO: 5150 - DNA, 25 bp, Rattus norvegicus
aaacattaatactttgtgctagagt

SEQ ID NO: 5151 - DNA, 25 bp, Rattus norvegicus
aaacattacattcgctccttcatcc

SEQ ID NO: 5152 - DNA, 25 bp, Rattus norvegicus
aaacattacattggctccttcatcc

SEQ ID NO: 5153 - DNA, 25 bp, Rattus norvegicus
aaacattacctgcttcccatttagt

SEQ ID NO: 5154 - DNA, 25 bp, Rattus norvegicus
aaacattacctggttcccatttagt

SEQ ID NO: 5155 - DNA, 25 bp, Rattus norvegicus
aaacattactgaatccagcccttcg

SEQ ID NO: 5156 - DNA, 25 bp, Rattus norvegicus
aaacattactgattccagcccttcg

SEQ ID NO: 5157 - DNA, 25 bp, Rattus norvegicus
aaacattactgcaaagctccctttc

SEQ ID NO: 5158 - DNA, 25 bp, Rattus norvegicus
aaacattactgctaagctccctttc

SEQ ID NO: 5159 - DNA, 25 bp, Rattus norvegicus
aaacattacttgaccacaactgagt

SEQ ID NO: 5160 - DNA, 25 bp, Rattus norvegicus
aaacattacttgtccacaactgagt

SEQ ID NO: 5161 - DNA, 25 bp, Rattus norvegicus
aaacattaggcacgcggcatcttcc

SEQ ID NO: 5162 - DNA, 25 bp, Rattus norvegicus
aaacattaggcaggcggcatcttcc

SEQ ID NO: 5163 - DNA, 25 bp, Rattus norvegicus
aaacattatgtcctcaggcatgcat

SEQ ID NO: 5164 - DNA, 25 bp, Rattus norvegicus
aaacattatgtcgtcaggcatgcat

SEQ ID NO: 5165 - DNA, 25 bp, Rattus norvegicus
aaacattcacaactaacccacaaag

SEQ ID NO: 5166 - DNA, 25 bp, Rattus norvegicus
aaacattcacaagtaacccacaaag

SEQ ID NO: 5167 - DNA, 25 bp, Rattus norvegicus
aaacattcacttactcttggtagcc

SEQ ID NO: 5168 - DNA, 25 bp, Rattus norvegicus
aaacattcactttctcttggtagcc

SEQ ID NO: 5169 - DNA, 25 bp, Rattus norvegicus
aaacattcagggacctctcatttct

SEQ ID NO: 5170 - DNA, 25 bp, Rattus norvegicus
aaacattcagggtcctctcatttct

SEQ ID NO: 5171 - DNA, 25 bp, Rattus norvegicus
aaacattcataaccccagagacacc

SEQ ID NO: 5172 - DNA, 25 bp, Rattus norvegicus
aaacattcataagcccagagacacc

SEQ ID NO: 5173 - DNA, 25 bp, Rattus norvegicus
aaacattcatgtaactgcccagtca

SEQ ID NO: 5174 - DNA, 25 bp, Rattus norvegicus
aaacattcatgttactgcccagtca

SEQ ID NO: 5175 - DNA, 25 bp, Rattus norvegicus
aaacattcattccttctcatatatt

SEQ ID NO: 5176 - DNA, 25 bp, Rattus norvegicus
aaacattcattcgttctcatatatt

SEQ ID NO: 5177 - DNA, 25 bp, Rattus norvegicus
aaacattccacaaaggtctcacctc

SEQ ID NO: 5178 - DNA, 25 bp, Rattus norvegicus
aaacattccacataggtctcacctc

SEQ ID NO: 5179 - DNA, 25 bp, Rattus norvegicus
aaacattcccatcagtcctgagaga

SEQ ID NO: 5180 - DNA, 25 bp, Rattus norvegicus
aaacattcccatgagtcctgagaga

SEQ ID NO: 5181 - DNA, 25 bp, Rattus norvegicus
aaacattccccaagagtgtcctaat

SEQ ID NO: 5182 - DNA, 25 bp, Rattus norvegicus
aaacattccccatgagtgtcctaat

SEQ ID NO: 5183 - DNA, 25 bp, Rattus norvegicus
aaacattcccgcagagagctatacc

SEQ ID NO: 5184 - DNA, 25 bp, Rattus norvegicus
aaacattcccgctgagagctatacc

SEQ ID NO: 5185 - DNA, 25 bp, Rattus norvegicus
aaacattcctcacatttttacctga

SEQ ID NO: 5186 - DNA, 25 bp, Rattus norvegicus
aaacattcctcagatttttacctga

SEQ ID NO: 5187 - DNA, 25 bp, Rattus norvegicus
aaacattccttcactggtcatgcat

SEQ ID NO: 5188 - DNA, 25 bp, Rattus norvegicus
aaacattccttctctggtcatgcat

SEQ ID NO: 5189 - DNA, 25 bp, Rattus norvegicus
aaacattctacacttcctttccatc

SEQ ID NO: 5190 - DNA, 25 bp, Rattus norvegicus
aaacattctacagttcctttccatc

SEQ ID NO: 5191 - DNA, 25 bp, Rattus norvegicus
aaacattctccccttcacagggctg

SEQ ID NO: 5192 - DNA, 25 bp, Rattus norvegicus
aaacattctcccgttcacagggctg

SEQ ID NO: 5193 - DNA, 25 bp, Rattus norvegicus
aaacattctgccctatacatcaatc

SEQ ID NO: 5194 - DNA, 25 bp, Rattus norvegicus
aaacattctgccgtatacatcaatc

SEQ ID NO: 5195 - DNA, 25 bp, Rattus norvegicus
aaacattcttttcgcactaactata

SEQ ID NO: 5196 - DNA, 25 bp, Rattus norvegicus
aaacattcttttctgtgctggacat

SEQ ID NO: 5197 - DNA, 25 bp, Rattus norvegicus
aaacattcttttggcactaactata

SEQ ID NO: 5198 - DNA, 25 bp, Rattus norvegicus
aaacattcttttgtgtgctggacat

SEQ ID NO: 5199 - DNA, 25 bp, Rattus norvegicus
aaacattgacacatgaaaccgctca

SEQ ID NO: 5200 - DNA, 25 bp, Rattus norvegicus
aaacattgacacttgaaaccgctca

SEQ ID NO: 5201 - DNA, 25 bp, Rattus norvegicus
aaacattgcacacccagcagcatag

SEQ ID NO: 5202 - DNA, 25 bp, Rattus norvegicus
aaacattgcacagccagcagcatag

SEQ ID NO: 5203 - DNA, 25 bp, Rattus norvegicus
aaacattgctttaccttcttgctat

SEQ ID NO: 5204 - DNA, 25 bp, Rattus norvegicus
aaacattgcttttccttcttgctat

SEQ ID NO: 5205 - DNA, 25 bp, Rattus norvegicus
aaacattggcaaacattcatgctta

SEQ ID NO: 5206 - DNA, 25 bp, Rattus norvegicus
aaacattggcaatcattcatgctta

SEQ ID NO: 5207 - DNA, 25 bp, Rattus norvegicus
aaacattgtaggactcctctcaaaa

SEQ ID NO: 5208 - DNA, 25 bp, Rattus norvegicus
aaacattgtaggtctcctctcaaaa

SEQ ID NO: 5209 - DNA, 25 bp, Rattus norvegicus
aaacattgttgacccagtgaccaaa

SEQ ID NO: 5210 - DNA, 25 bp, Rattus norvegicus
aaacattgttgagccagtgaccaaa

SEQ ID NO: 5211 - DNA, 25 bp, Rattus norvegicus
aaacatttaactcctttgggaatca

SEQ ID NO: 5212 - DNA, 25 bp, Rattus norvegicus
aaacatttaactgctttgggaatca

SEQ ID NO: 5213 - DNA, 25 bp, Rattus norvegicus
aaacatttatccatctcagtgcttt

SEQ ID NO: 5214 - DNA, 25 bp, Rattus norvegicus
aaacatttatccttctcagtgcttt

SEQ ID NO: 5215 - DNA, 25 bp, Rattus norvegicus
aaacatttatgtcggaccatgtcaa

SEQ ID NO: 5216 - DNA, 25 bp, Rattus norvegicus
aaacatttatgtgggaccatgtcaa

SEQ ID NO: 5217 - DNA, 25 bp, Rattus norvegicus
aaacatttcagtatccaactcaaga

SEQ ID NO: 5218 - DNA, 25 bp, Rattus norvegicus
aaacatttcagtttccaactcaaga

SEQ ID NO: 5219 - DNA, 25 bp, Rattus norvegicus
aaacatttgctccttggccgacaat

SEQ ID NO: 5220 - DNA, 25 bp, Rattus norvegicus
aaacatttgctcgttggccgacaat

SEQ ID NO: 5221 - DNA, 25 bp, Rattus norvegicus
aaacatttggacagagacttgggaa

SEQ ID NO: 5222 - DNA, 25 bp, Rattus norvegicus
aaacatttggactgagacttgggaa

SEQ ID NO: 5223 - DNA, 25 bp, Rattus norvegicus
aaacatttgggtctgccctgtgtct

SEQ ID NO: 5224 - DNA, 25 bp, Rattus norvegicus
aaacatttgggtgtgccctgtgtct

SEQ ID NO: 5225 - DNA, 25 bp, Rattus norvegicus
aaacatttggtacgtgggcttgcac

SEQ ID NO: 5226 - DNA, 25 bp, Rattus norvegicus
aaacatttggtaggtgggcttgcac

SEQ ID NO: 5227 - DNA, 25 bp, Rattus norvegicus
aaacatttgtcactcatcccacagc

SEQ ID NO: 5228 - DNA, 25 bp, Rattus norvegicus
aaacatttgtcagtcatcccacagc

SEQ ID NO: 5229 - DNA, 25 bp, Rattus norvegicus
aaacattttaagacagttccccatg

SEQ ID NO: 5230 - DNA, 25 bp, Rattus norvegicus
aaacattttaagtcagttccccatg

SEQ ID NO: 5231 - DNA, 25 bp, Rattus norvegicus
aaacattttctgagacgctgaccat

SEQ ID NO: 5232 - DNA, 25 bp, Rattus norvegicus
aaacattttctgtgacgctgaccat

SEQ ID NO: 5233 - DNA, 25 bp, Rattus norvegicus
aaacatttttatcgaggccggagag

SEQ ID NO: 5234 - DNA, 25 bp, Rattus norvegicus
aaacatttttatggaggccggagag

SEQ ID NO: 5235 - DNA, 25 bp, Rattus norvegicus
aaacatttttgccacctatcttcct

SEQ ID NO: 5236 - DNA, 25 bp, Rattus norvegicus
aaacatttttgcgacctatcttcct

SEQ ID NO: 5237 - DNA, 25 bp, Rattus norvegicus
aaaccaaaacctcagtctggcccag

SEQ ID NO: 5238 - DNA, 25 bp, Rattus norvegicus
aaaccaaaacctgagtctggcccag

SEQ ID NO: 5239 - DNA, 25 bp, Rattus norvegicus
aaaccaaaactccaattccatgcct

SEQ ID NO: 5240 - DNA, 25 bp, Rattus norvegicus
aaaccaaaactcgaattccatgcct

SEQ ID NO: 5241 - DNA, 25 bp, Rattus norvegicus
aaaccaaaagtccaaccagctgtgt

SEQ ID NO: 5242 - DNA, 25 bp, Rattus norvegicus
aaaccaaaagtcgaaccagctgtgt

SEQ ID NO: 5243 - DNA, 25 bp, Rattus norvegicus
aaaccaaacatcacttctggataaa

SEQ ID NO: 5244 - DNA, 25 bp, Rattus norvegicus
aaaccaaacatctcttctggataaa

SEQ ID NO: 5245 - DNA, 25 bp, Rattus norvegicus
aaaccaaactttccctctctgatgt

SEQ ID NO: 5246 - DNA, 25 bp, Rattus norvegicus
aaaccaaactttgcctctctgatgt

SEQ ID NO: 5247 - DNA, 25 bp, Rattus norvegicus
aaaccaaagcacaaccaggtacttg

SEQ ID NO: 5248 - DNA, 25 bp, Rattus norvegicus
aaaccaaagcactaccaggtacttg

SEQ ID NO: 5249 - DNA, 25 bp, Rattus norvegicus
aaaccaacacctaggcagtgacggg

SEQ ID NO: 5250 - DNA, 25 bp, Rattus norvegicus
aaaccaacaccttggcagtgacggg

SEQ ID NO: 5251 - DNA, 25 bp, Rattus norvegicus
aaaccaaccaggcaacagctcaggt

SEQ ID NO: 5252 - DNA, 25 bp, Rattus norvegicus
aaaccaaccagggaacagctcaggt

SEQ ID NO: 5253 - DNA, 25 bp, Rattus norvegicus
aaaccaaccctgcagttatggctct

SEQ ID NO: 5254 - DNA, 25 bp, Rattus norvegicus
aaaccaaccctggagttatggctct

SEQ ID NO: 5255 - DNA, 25 bp, Rattus norvegicus
aaaccaaccggcacaaattgcagta

SEQ ID NO: 5256 - DNA, 25 bp, Rattus norvegicus
aaaccaaccggctcaaattgcagta

SEQ ID NO: 5257 - DNA, 25 bp, Rattus norvegicus
aaaccaacctagaaactgctgtctg

SEQ ID NO: 5258 - DNA, 25 bp, Rattus norvegicus
aaaccaacctagtaactgctgtctg

SEQ ID NO: 5259 - DNA, 25 bp, Rattus norvegicus
aaaccaacctcgaagggcgagctat

SEQ ID NO: 5260 - DNA, 25 bp, Rattus norvegicus
aaaccaacctcgtagggcgagctat

SEQ ID NO: 5261 - DNA, 25 bp, Rattus norvegicus
aaaccaacctgtcactgatttgata

SEQ ID NO: 5262 - DNA, 25 bp, Rattus norvegicus
aaaccaacctgtctaagctccggag

SEQ ID NO: 5263 - DNA, 25 bp, Rattus norvegicus
aaaccaacctgtgactgatttgata

SEQ ID NO: 5264 - DNA, 25 bp, Rattus norvegicus
aaaccaacctgtgtaagctccggag

SEQ ID NO: 5265 - DNA, 25 bp, Rattus norvegicus
aaaccaacgctacatgatgctctaa

SEQ ID NO: 5266 - DNA, 25 bp, Rattus norvegicus
aaaccaacgctagatgatgctctaa

SEQ ID NO: 5267 - DNA, 25 bp, Rattus norvegicus
aaaccaacgtggcactatgcttacg

SEQ ID NO: 5268 - DNA, 25 bp, Rattus norvegicus
aaaccaacgtgggactatgcttacg

SEQ ID NO: 5269 - DNA, 25 bp, Rattus norvegicus
aaaccaactctacgcggatcagggc

SEQ ID NO: 5270 - DNA, 25 bp, Rattus norvegicus
aaaccaactctaggcggatcagggc

SEQ ID NO: 5271 - DNA, 25 bp, Rattus norvegicus
aaaccaacttcaagggaccactctg

SEQ ID NO: 5272 - DNA, 25 bp, Rattus norvegicus
aaaccaacttcatgggaccactctg

SEQ ID NO: 5273 - DNA, 25 bp, Rattus norvegicus
aaaccaacttgaaacttcagacctt

SEQ ID NO: 5274 - DNA, 25 bp, Rattus norvegicus
aaaccaacttgatacttcagacctt

SEQ ID NO: 5275 - DNA, 25 bp, Rattus norvegicus
aaaccaagagggaggcgtgcacacc

SEQ ID NO: 5276 - DNA, 25 bp, Rattus norvegicus
aaaccaagagggtggcgtgcacacc

SEQ ID NO: 5277 - DNA, 25 bp, Rattus norvegicus
aaaccaagcaacactgtgccttcta

SEQ ID NO: 5278 - DNA, 25 bp, Rattus norvegicus
aaaccaagcaactctgtgccttcta

SEQ ID NO: 5279 - DNA, 25 bp, Rattus norvegicus
aaaccaagcacaagctgcctagcgg

SEQ ID NO: 5280 - DNA, 25 bp, Rattus norvegicus
aaaccaagcacatgctgcctagcgg

SEQ ID NO: 5281 - DNA, 25 bp, Rattus norvegicus
aaaccaagcagtccaacctgtaatt

SEQ ID NO: 5282 - DNA, 25 bp, Rattus norvegicus
aaaccaagcagtgcaacctgtaatt

SEQ ID NO: 5283 - DNA, 25 bp, Rattus norvegicus
aaaccaagcatcctttgtatgtata

SEQ ID NO: 5284 - DNA, 25 bp, Rattus norvegicus
aaaccaagcatcgtttgtatgtata

SEQ ID NO: 5285 - DNA, 25 bp, Rattus norvegicus
aaaccaagcggtatcagaggcagaa

SEQ ID NO: 5286 - DNA, 25 bp, Rattus norvegicus
aaaccaagcggtttcagaggcagaa

SEQ ID NO: 5287 - DNA, 25 bp, Rattus norvegicus
aaaccaaggaggagagctcgctagg

SEQ ID NO: 5288 - DNA, 25 bp, Rattus norvegicus
aaaccaaggaggtgagctcgctagg

SEQ ID NO: 5289 - DNA, 25 bp, Rattus norvegicus
aaaccaaggcgaccagagctgtcct

SEQ ID NO: 5290 - DNA, 25 bp, Rattus norvegicus
aaaccaaggcgagcagagctgtcct

SEQ ID NO: 5291 - DNA, 25 bp, Rattus norvegicus
aaaccaagggcacttgagtctcagc

SEQ ID NO: 5292 - DNA, 25 bp, Rattus norvegicus
aaaccaagggcagttgagtctcagc

SEQ ID NO: 5293 - DNA, 25 bp, Rattus norvegicus
aaaccaaggtcacgtgacctctcct

SEQ ID NO: 5294 - DNA, 25 bp, Rattus norvegicus
aaaccaaggtcaggtgacctctcct

SEQ ID NO: 5295 - DNA, 25 bp, Rattus norvegicus
aaaccaagtcagcaagtcccctgct

SEQ ID NO: 5296 - DNA, 25 bp, Rattus norvegicus
aaaccaagtcaggaagtcccctgct

SEQ ID NO: 5297 - DNA, 25 bp, Rattus norvegicus
aaaccaagtctcatctagtcttaga

SEQ ID NO: 5298 - DNA, 25 bp, Rattus norvegicus
aaaccaagtctcttctagtcttaga

SEQ ID NO: 5299 - DNA, 25 bp, Rattus norvegicus
aaaccaagtgtgagctgtcaccttc

SEQ ID NO: 5300 - DNA, 25 bp, Rattus norvegicus
aaaccaagtgtgtgctgtcaccttc

SEQ ID NO: 5301 - DNA, 25 bp, Rattus norvegicus
aaaccaatccagctctcctttctga

SEQ ID NO: 5302 - DNA, 25 bp, Rattus norvegicus
aaaccaatccaggtctcctttctga

SEQ ID NO: 5303 - DNA, 25 bp, Rattus norvegicus
aaaccaatcgggagcatctctcggt

SEQ ID NO: 5304 - DNA, 25 bp, Rattus norvegicus
aaaccaatcgggtgcatctctcggt

SEQ ID NO: 5305 - DNA, 25 bp, Rattus norvegicus
aaaccaatcttactctgctaagtga

SEQ ID NO: 5306 - DNA, 25 bp, Rattus norvegicus
aaaccaatcttagtctgctaagtga

SEQ ID NO: 5307 - DNA, 25 bp, Rattus norvegicus
aaaccaattagtcccttctagaaga

SEQ ID NO: 5308 - DNA, 25 bp, Rattus norvegicus
aaaccaattagtgccttctagaaga

SEQ ID NO: 5309 - DNA, 25 bp, Rattus norvegicus
aaaccaattcagagtggccacccca

SEQ ID NO: 5310 - DNA, 25 bp, Rattus norvegicus
aaaccaattcagtgtggccacccca

SEQ ID NO: 5311 - DNA, 25 bp, Rattus norvegicus
aaaccaattgcaccagccttattag

SEQ ID NO: 5312 - DNA, 25 bp, Rattus norvegicus
aaaccaattgcagcagccttattag

SEQ ID NO: 5313 - DNA, 25 bp, Rattus norvegicus
aaaccacacaggactcaggagtaga

SEQ ID NO: 5314 - DNA, 25 bp, Rattus norvegicus
aaaccacacaggtctcaggagtaga

SEQ ID NO: 5315 - DNA, 25 bp, Rattus norvegicus
aaaccacactttaaatactgagcaa

SEQ ID NO: 5316 - DNA, 25 bp, Rattus norvegicus
aaaccacacttttaatactgagcaa

SEQ ID NO: 5317 - DNA, 25 bp, Rattus norvegicus
aaaccacagatgactgcctctctgg

SEQ ID NO: 5318 - DNA, 25 bp, Rattus norvegicus
aaaccacagatgtctgcctctctgg

SEQ ID NO: 5319 - DNA, 25 bp, Rattus norvegicus
aaaccacagccaatgaaccggaaat

SEQ ID NO: 5320 - DNA, 25 bp, Rattus norvegicus
aaaccacagccattgaaccggaaat

SEQ ID NO: 5321 - DNA, 25 bp, Rattus norvegicus
aaaccacagctcagctagtacacgg

SEQ ID NO: 5322 - DNA, 25 bp, Rattus norvegicus
aaaccacagctctgctagtacacgg

SEQ ID NO: 5323 - DNA, 25 bp, Rattus norvegicus
aaaccacaggagaccattgcttcac

SEQ ID NO: 5324 - DNA, 25 bp, Rattus norvegicus
aaaccacaggagtccattgcttcac

SEQ ID NO: 5325 - DNA, 25 bp, Rattus norvegicus
aaaccacaggatagcattttgccag

SEQ ID NO: 5326 - DNA, 25 bp, Rattus norvegicus
aaaccacaggattgcattttgccag

SEQ ID NO: 5327 - DNA, 25 bp, Rattus norvegicus
aaaccacaggcacggatagatccac

SEQ ID NO: 5328 - DNA, 25 bp, Rattus norvegicus
aaaccacaggcagggatagatccac

SEQ ID NO: 5329 - DNA, 25 bp, Rattus norvegicus
aaaccacagtagaaggcacccagat

SEQ ID NO: 5330 - DNA, 25 bp, Rattus norvegicus
aaaccacagtagtaggcacccagat

SEQ ID NO: 5331 - DNA, 25 bp, Rattus norvegicus
aaaccacagtccacctgagcgatat

SEQ ID NO: 5332 - DNA, 25 bp, Rattus norvegicus
aaaccacagtcctcctgagcgatat

SEQ ID NO: 5333 - DNA, 25 bp, Rattus norvegicus
aaaccacatcaaatcaaactccact

SEQ ID NO: 5334 - DNA, 25 bp, Rattus norvegicus
aaaccacatcaattcaaactccact

SEQ ID NO: 5335 - DNA, 25 bp, Rattus norvegicus
aaaccacatctcatttcaccttgaa

SEQ ID NO: 5336 - DNA, 25 bp, Rattus norvegicus
aaaccacatctcttttcaccttgaa

SEQ ID NO: 5337 - DNA, 25 bp, Rattus norvegicus
aaaccacatgctatggttcctggaa

SEQ ID NO: 5338 - DNA, 25 bp, Rattus norvegicus
aaaccacatgctttggttcctggaa

SEQ ID NO: 5339 - DNA, 25 bp, Rattus norvegicus
aaaccacattgactatcgtcacggg

SEQ ID NO: 5340 - DNA, 25 bp, Rattus norvegicus
aaaccacattgagtatcgtcacggg

SEQ ID NO: 5341 - DNA, 25 bp, Rattus norvegicus
aaaccaccacagcatcgctgatctg

SEQ ID NO: 5342 - DNA, 25 bp, Rattus norvegicus
aaaccaccacaggatcgctgatctg

SEQ ID NO: 5343 - DNA, 25 bp, Rattus norvegicus
aaaccaccagcaatctaggcagagg

SEQ ID NO: 5344 - DNA, 25 bp, Rattus norvegicus
aaaccaccagcattctaggcagagg

SEQ ID NO: 5345 - DNA, 25 bp, Rattus norvegicus
aaaccaccagtgatagcacagatag

SEQ ID NO: 5346 - DNA, 25 bp, Rattus norvegicus
aaaccaccagtgttagcacagatag

SEQ ID NO: 5347 - DNA, 25 bp, Rattus norvegicus
aaaccaccatgaatcaggctcactc

SEQ ID NO: 5348 - DNA, 25 bp, Rattus norvegicus
aaaccaccatgattcaggctcactc

SEQ ID NO: 5349 - DNA, 25 bp, Rattus norvegicus
aaaccaccctgtaagctacactgga

SEQ ID NO: 5350 - DNA, 25 bp, Rattus norvegicus
aaaccaccctgttagctacactgga

SEQ ID NO: 5351 - DNA, 25 bp, Rattus norvegicus
aaaccaccggagcagatatctttag

SEQ ID NO: 5352 - DNA, 25 bp, Rattus norvegicus
aaaccaccggaggagatatctttag

SEQ ID NO: 5353 - DNA, 25 bp, Rattus norvegicus
aaaccacctatgatcttacagcaca

SEQ ID NO: 5354 - DNA, 25 bp, Rattus norvegicus
aaaccacctatgttcttacagcaca

SEQ ID NO: 5355 - DNA, 25 bp, Rattus norvegicus
aaaccacctggtaagaggatactct

SEQ ID NO: 5356 - DNA, 25 bp, Rattus norvegicus
aaaccacctggttagaggatactct

SEQ ID NO: 5357 - DNA, 25 bp, Rattus norvegicus
aaaccaccttacagtagcatgcaca

SEQ ID NO: 5358 - DNA, 25 bp, Rattus norvegicus
aaaccaccttactgtagcatgcaca

SEQ ID NO: 5359 - DNA, 25 bp, Rattus norvegicus
aaaccaccttgtctcatagtacaat

SEQ ID NO: 5360 - DNA, 25 bp, Rattus norvegicus
aaaccaccttgtgtcatagtacaat

SEQ ID NO: 5361 - DNA, 25 bp, Rattus norvegicus
aaaccacgacgactcttctgaggaa

SEQ ID NO: 5362 - DNA, 25 bp, Rattus norvegicus
aaaccacgacgagtcttctgaggaa

SEQ ID NO: 5363 - DNA, 25 bp, Rattus norvegicus
aaaccacgcctgattcgggcagcat

SEQ ID NO: 5364 - DNA, 25 bp, Rattus norvegicus
aaaccacgcctgtttcgggcagcat

SEQ ID NO: 5365 - DNA, 25 bp, Rattus norvegicus
aaaccacgctcaagccttcttgatc

SEQ ID NO: 5366 - DNA, 25 bp, Rattus norvegicus
aaaccacgctcatgccttcttgatc

SEQ ID NO: 5367 - DNA, 25 bp, Rattus norvegicus
aaaccacggcatacgttgtgacaat

SEQ ID NO: 5368 - DNA, 25 bp, Rattus norvegicus
aaaccacggcattcgttgtgacaat

SEQ ID NO: 5369 - DNA, 25 bp, Rattus norvegicus
aaaccacggttgcatttcaacaatt

SEQ ID NO: 5370 - DNA, 25 bp, Rattus norvegicus
aaaccacggttggatttcaacaatt

SEQ ID NO: 5371 - DNA, 25 bp, Rattus norvegicus
aaaccacgtagtaatgtcaaaccat

SEQ ID NO: 5372 - DNA, 25 bp, Rattus norvegicus
aaaccacgtagttatgtcaaaccat

SEQ ID NO: 5373 - DNA, 25 bp, Rattus norvegicus
aaaccacgtatgatgtcttcctgga

SEQ ID NO: 5374 - DNA, 25 bp, Rattus norvegicus
aaaccacgtatgttgtcttcctgga

SEQ ID NO: 5375 - DNA, 25 bp, Rattus norvegicus
aaaccacgtcgaagtcggtgactca

SEQ ID NO: 5376 - DNA, 25 bp, Rattus norvegicus
aaaccacgtcgatgtcggtgactca

SEQ ID NO: 5377 - DNA, 25 bp, Rattus norvegicus
aaaccacgtcttcgtagctcaaata

SEQ ID NO: 5378 - DNA, 25 bp, Rattus norvegicus
aaaccacgtcttggtagctcaaata

SEQ ID NO: 5379 - DNA, 25 bp, Rattus norvegicus
aaaccactaacgctaattcataact

SEQ ID NO: 5380 - DNA, 25 bp, Rattus norvegicus
aaaccactaacggtaattcataact

SEQ ID NO: 5381 - DNA, 25 bp, Rattus norvegicus
aaaccactacacagaagcgaaggct

SEQ ID NO: 5382 - DNA, 25 bp, Rattus norvegicus
aaaccactacactgaagcgaaggct

SEQ ID NO: 5383 - DNA, 25 bp, Rattus norvegicus
aaaccactatgacttctttcatgat

SEQ ID NO: 5384 - DNA, 25 bp, Rattus norvegicus
aaaccactatgagttctttcatgat

SEQ ID NO: 5385 - DNA, 25 bp, Rattus norvegicus
aaaccactattgagaccactgcaga

SEQ ID NO: 5386 - DNA, 25 bp, Rattus norvegicus
aaaccactattgtgaccactgcaga

SEQ ID NO: 5387 - DNA, 25 bp, Rattus norvegicus
aaaccactcttcactgggctagtga

SEQ ID NO: 5388 - DNA, 25 bp, Rattus norvegicus
aaaccactcttcatttgctgttgta

SEQ ID NO: 5389 - DNA, 25 bp, Rattus norvegicus
aaaccactcttctctgggctagtga

SEQ ID NO: 5390 - DNA, 25 bp, Rattus norvegicus
aaaccactcttcttttgctgttgta

SEQ ID NO: 5391 - DNA, 25 bp, Rattus norvegicus
aaaccactgaatctacagcccaggt

SEQ ID NO: 5392 - DNA, 25 bp, Rattus norvegicus
aaaccactgaatgtacagcccaggt

SEQ ID NO: 5393 - DNA, 25 bp, Rattus norvegicus
aaaccactgagtcatgcactcggca

SEQ ID NO: 5394 - DNA, 25 bp, Rattus norvegicus
aaaccactgagtgatgcactcggca

SEQ ID NO: 5395 - DNA, 25 bp, Rattus norvegicus
aaaccactgcctcttggtcttctgg

SEQ ID NO: 5396 - DNA, 25 bp, Rattus norvegicus
aaaccactgcctgttggtcttctgg

SEQ ID NO: 5397 - DNA, 25 bp, Rattus norvegicus
aaaccactggccacaagagtgtctg

SEQ ID NO: 5398 - DNA, 25 bp, Rattus norvegicus
aaaccactggcctcaagagtgtctg

SEQ ID NO: 5399 - DNA, 25 bp, Rattus norvegicus
aaaccactgtctcttgagctgtcaa

SEQ ID NO: 5400 - DNA, 25 bp, Rattus norvegicus
aaaccactgtctgttgagctgtcaa

SEQ ID NO: 5401 - DNA, 25 bp, Rattus norvegicus
aaaccactgtttatcagccaccaag

SEQ ID NO: 5402 - DNA, 25 bp, Rattus norvegicus
aaaccactgtttcattgagacccgc

SEQ ID NO: 5403 - DNA, 25 bp, Rattus norvegicus
aaaccactgtttgattgagacccgc

SEQ ID NO: 5404 - DNA, 25 bp, Rattus norvegicus
aaaccactgtttttcagccaccaag

SEQ ID NO: 5405 - DNA, 25 bp, Rattus norvegicus
aaaccacttgacaagcagctccggt

SEQ ID NO: 5406 - DNA, 25 bp, Rattus norvegicus
aaaccacttgactagcagctccggt

SEQ ID NO: 5407 - DNA, 25 bp, Rattus norvegicus
aaaccactttgtagcctgcagttgt

SEQ ID NO: 5408 - DNA, 25 bp, Rattus norvegicus
aaaccactttgttgcctgcagttgt

SEQ ID NO: 5409 - DNA, 25 bp, Rattus norvegicus
aaaccagaactcatggcagttaggg

SEQ ID NO: 5410 - DNA, 25 bp, Rattus norvegicus
aaaccagaactcttggcagttaggg

SEQ ID NO: 5411 - DNA, 25 bp, Rattus norvegicus
aaaccagaagcactggtccgtgact

SEQ ID NO: 5412 - DNA, 25 bp, Rattus norvegicus
aaaccagaagcagtggtccgtgact

SEQ ID NO: 5413 - DNA, 25 bp, Rattus norvegicus
aaaccagaagccactgttttcactc

SEQ ID NO: 5414 - DNA, 25 bp, Rattus norvegicus
aaaccagaagcctctgttttcactc

SEQ ID NO: 5415 - DNA, 25 bp, Rattus norvegicus
aaaccagaatggaagaacagaagct

SEQ ID NO: 5416 - DNA, 25 bp, Rattus norvegicus
aaaccagaatggtagaacagaagct

SEQ ID NO: 5417 - DNA, 25 bp, Rattus norvegicus
aaaccagacgctcagactcggactt

SEQ ID NO: 5418 - DNA, 25 bp, Rattus norvegicus
aaaccagacgctgagactcggactt

SEQ ID NO: 5419 - DNA, 25 bp, Rattus norvegicus
aaaccagactgaagatccctggtat

SEQ ID NO: 5420 - DNA, 25 bp, Rattus norvegicus
aaaccagactgatgatccctggtat

SEQ ID NO: 5421 - DNA, 25 bp, Rattus norvegicus
aaaccagagaacacttttcaggagt

SEQ ID NO: 5422 - DNA, 25 bp, Rattus norvegicus
aaaccagagaactcttttcaggagt

SEQ ID NO: 5423 - DNA, 25 bp, Rattus norvegicus
aaaccagagattctcctcctgtgtt

SEQ ID NO: 5424 - DNA, 25 bp, Rattus norvegicus
aaaccagagattgtcctcctgtgtt

SEQ ID NO: 5425 - DNA, 25 bp, Rattus norvegicus
aaaccagagcacagggtctcgggcg

SEQ ID NO: 5426 - DNA, 25 bp, Rattus norvegicus
aaaccagagcactgggtctcgggcg

SEQ ID NO: 5427 - DNA, 25 bp, Rattus norvegicus
aaaccagagcagctgtctcttcaga

SEQ ID NO: 5428 - DNA, 25 bp, Rattus norvegicus
aaaccagagcaggtgtctcttcaga

SEQ ID NO: 5429 - DNA, 25 bp, Rattus norvegicus
aaaccagagcataagctgcagcccg

SEQ ID NO: 5430 - DNA, 25 bp, Rattus norvegicus
aaaccagagcattagctgcagcccg

SEQ ID NO: 5431 - DNA, 25 bp, Rattus norvegicus
aaaccagagcgtcccagatgtgaag

SEQ ID NO: 5432 - DNA, 25 bp, Rattus norvegicus
aaaccagagcgtctgtctccaggaa

SEQ ID NO: 5433 - DNA, 25 bp, Rattus norvegicus
aaaccagagcgtgccagatgtgaag

SEQ ID NO: 5434 - DNA, 25 bp, Rattus norvegicus
aaaccagagcgtgtgtctccaggaa

SEQ ID NO: 5435 - DNA, 25 bp, Rattus norvegicus
aaaccagaggtaacttccaaggcat

SEQ ID NO: 5436 - DNA, 25 bp, Rattus norvegicus
aaaccagaggtatcttccaaggcat

SEQ ID NO: 5437 - DNA, 25 bp, Rattus norvegicus
aaaccagagtccacagctgtgggaa

SEQ ID NO: 5438 - DNA, 25 bp, Rattus norvegicus
aaaccagagtcctcagctgtgggaa

SEQ ID NO: 5439 - DNA, 25 bp, Rattus norvegicus
aaaccagagtctcctgacaggctac

SEQ ID NO: 5440 - DNA, 25 bp, Rattus norvegicus
aaaccagagtctgctgacaggctac

SEQ ID NO: 5441 - DNA, 25 bp, Rattus norvegicus
aaaccagatagaatcttttgcagat

SEQ ID NO: 5442 - DNA, 25 bp, Rattus norvegicus
aaaccagatagattcttttgcagat

SEQ ID NO: 5443 - DNA, 25 bp, Rattus norvegicus
aaaccagatctacgagccacttcgg

SEQ ID NO: 5444 - DNA, 25 bp, Rattus norvegicus
aaaccagatctaggagccacttcgg

SEQ ID NO: 5445 - DNA, 25 bp, Rattus norvegicus
aaaccagatctgcaggtcaccatca

SEQ ID NO: 5446 - DNA, 25 bp, Rattus norvegicus
aaaccagatctggaggtcaccatca

SEQ ID NO: 5447 - DNA, 25 bp, Rattus norvegicus
aaaccagatggcagttccgccttta

SEQ ID NO: 5448 - DNA, 25 bp, Rattus norvegicus
aaaccagatggctgttccgccttta

SEQ ID NO: 5449 - DNA, 25 bp, Rattus norvegicus
aaaccagatgttatcctctgaacta

SEQ ID NO: 5450 - DNA, 25 bp, Rattus norvegicus
aaaccagatgttttcctctgaacta

SEQ ID NO: 5451 - DNA, 25 bp, Rattus norvegicus
aaaccagcaacccatcctaaagcta

SEQ ID NO: 5452 - DNA, 25 bp, Rattus norvegicus
aaaccagcaaccgatcctaaagcta

SEQ ID NO: 5453 - DNA, 25 bp, Rattus norvegicus
aaaccagcacttccgagattgcaac

SEQ ID NO: 5454 - DNA, 25 bp, Rattus norvegicus
aaaccagcacttgcgagattgcaac

SEQ ID NO: 5455 - DNA, 25 bp, Rattus norvegicus
aaaccagcagataggatgccttaac

SEQ ID NO: 5456 - DNA, 25 bp, Rattus norvegicus
aaaccagcagattggatgccttaac

SEQ ID NO: 5457 - DNA, 25 bp, Rattus norvegicus
aaaccagcagtgagagtgttcatgt

SEQ ID NO: 5458 - DNA, 25 bp, Rattus norvegicus
aaaccagcagtgcaagctcctatca

SEQ ID NO: 5459 - DNA, 25 bp, Rattus norvegicus
aaaccagcagtggaagctcctatca

SEQ ID NO: 5460 - DNA, 25 bp, Rattus norvegicus
aaaccagcagtgtgagtgttcatgt

SEQ ID NO: 5461 - DNA, 25 bp, Rattus norvegicus
aaaccagcagttactccgaggtatt

SEQ ID NO: 5462 - DNA, 25 bp, Rattus norvegicus
aaaccagcagttcactcaggaggtc

SEQ ID NO: 5463 - DNA, 25 bp, Rattus norvegicus
aaaccagcagttccaatcgtgacat

SEQ ID NO: 5464 - DNA, 25 bp, Rattus norvegicus
aaaccagcagttgactcaggaggtc

SEQ ID NO: 5465 - DNA, 25 bp, Rattus norvegicus
aaaccagcagttgcaatcgtgacat

SEQ ID NO: 5466 - DNA, 25 bp, Rattus norvegicus
aaaccagcagtttctccgaggtatt

SEQ ID NO: 5467 - DNA, 25 bp, Rattus norvegicus
aaaccagcattgatccagcctgtga

SEQ ID NO: 5468 - DNA, 25 bp, Rattus norvegicus
aaaccagcattgttccagcctgtga

SEQ ID NO: 5469 - DNA, 25 bp, Rattus norvegicus
aaaccagccagtccctccatgtggg

SEQ ID NO: 5470 - DNA, 25 bp, Rattus norvegicus
aaaccagccagtctttgggtcttgg

SEQ ID NO: 5471 - DNA, 25 bp, Rattus norvegicus
aaaccagccagtgcctccatgtggg

SEQ ID NO: 5472 - DNA, 25 bp, Rattus norvegicus
aaaccagccagtgtttgggtcttgg

SEQ ID NO: 5473 - DNA, 25 bp, Rattus norvegicus
aaaccagccattaagtgtgcctatg

SEQ ID NO: 5474 - DNA, 25 bp, Rattus norvegicus
aaaccagccattacccaatatagtg

SEQ ID NO: 5475 - DNA, 25 bp, Rattus norvegicus
aaaccagccattacgttgtactttg

SEQ ID NO: 5476 - DNA, 25 bp, Rattus norvegicus
aaaccagccatttagtgtgcctatg

SEQ ID NO: 5477 - DNA, 25 bp, Rattus norvegicus
aaaccagccatttcccaatatagtg

SEQ ID NO: 5478 - DNA, 25 bp, Rattus norvegicus
aaaccagccatttcgttgtactttg

SEQ ID NO: 5479 - DNA, 25 bp, Rattus norvegicus
aaaccagcctccagatgacttgaat

SEQ ID NO: 5480 - DNA, 25 bp, Rattus norvegicus
aaaccagcctcctgatgacttgaat

SEQ ID NO: 5481 - DNA, 25 bp, Rattus norvegicus
aaaccagcctggctctgagactttc

SEQ ID NO: 5482 - DNA, 25 bp, Rattus norvegicus
aaaccagcctgggtctgagactttc

SEQ ID NO: 5483 - DNA, 25 bp, Rattus norvegicus
aaaccagcctgtatttcatttccag

SEQ ID NO: 5484 - DNA, 25 bp, Rattus norvegicus
aaaccagcctgtttttcatttccag

SEQ ID NO: 5485 - DNA, 25 bp, Rattus norvegicus
aaaccagccttcattgctacaagtg

SEQ ID NO: 5486 - DNA, 25 bp, Rattus norvegicus
aaaccagccttctttgctacaagtg

SEQ ID NO: 5487 - DNA, 25 bp, Rattus norvegicus
aaaccagcgcatcagtgggttcttg

SEQ ID NO: 5488 - DNA, 25 bp, Rattus norvegicus
aaaccagcgcatgagtgggttcttg

SEQ ID NO: 5489 - DNA, 25 bp, Rattus norvegicus
aaaccagcgccaattcaagggacat

SEQ ID NO: 5490 - DNA, 25 bp, Rattus norvegicus
aaaccagcgccatttcaagggacat

SEQ ID NO: 5491 - DNA, 25 bp, Rattus norvegicus
aaaccagcggtgaatatacagtcaa

SEQ ID NO: 5492 - DNA, 25 bp, Rattus norvegicus
aaaccagcggtgtatatacagtcaa

SEQ ID NO: 5493 - DNA, 25 bp, Rattus norvegicus
aaaccagctaacaatggctacaggc

SEQ ID NO: 5494 - DNA, 25 bp, Rattus norvegicus
aaaccagctaactatggctacaggc

SEQ ID NO: 5495 - DNA, 25 bp, Rattus norvegicus
aaaccagctatcagccccaaggaca

SEQ ID NO: 5496 - DNA, 25 bp, Rattus norvegicus
aaaccagctatctgccccaaggaca

SEQ ID NO: 5497 - DNA, 25 bp, Rattus norvegicus
aaaccagctcagcaattggccccag

SEQ ID NO: 5498 - DNA, 25 bp, Rattus norvegicus
aaaccagctcaggaattggccccag

SEQ ID NO: 5499 - DNA, 25 bp, Rattus norvegicus
aaaccagctcctcccgctaagtgag

SEQ ID NO: 5500 - DNA, 25 bp, Rattus norvegicus
aaaccagctcctcggagtcggacca

SEQ ID NO: 5501 - DNA, 25 bp, Rattus norvegicus
aaaccagctcctgccgctaagtgag

SEQ ID NO: 5502 - DNA, 25 bp, Rattus norvegicus
aaaccagctcctgggagtcggacca

SEQ ID NO: 5503 - DNA, 25 bp, Rattus norvegicus
aaaccaggagccaggtcgtgccatg

SEQ ID NO: 5504 - DNA, 25 bp, Rattus norvegicus
aaaccaggagcctggtcgtgccatg

SEQ ID NO: 5505 - DNA, 25 bp, Rattus norvegicus
aaaccaggcaagacactagccacag

SEQ ID NO: 5506 - DNA, 25 bp, Rattus norvegicus
aaaccaggcaagtcactagccacag

SEQ ID NO: 5507 - DNA, 25 bp, Rattus norvegicus
aaaccaggcacacgcttctgttgtg

SEQ ID NO: 5508 - DNA, 25 bp, Rattus norvegicus
aaaccaggcacaggcttctgttgtg

SEQ ID NO: 5509 - DNA, 25 bp, Rattus norvegicus
aaaccaggccatacgcttcgaaaag

SEQ ID NO: 5510 - DNA, 25 bp, Rattus norvegicus
aaaccaggccattcgcttcgaaaag

SEQ ID NO: 5511 - DNA, 25 bp, Rattus norvegicus
aaaccaggcctgctagcaaccactg

SEQ ID NO: 5512 - DNA, 25 bp, Rattus norvegicus
aaaccaggcctggtagcaaccactg

SEQ ID NO: 5513 - DNA, 25 bp, Rattus norvegicus
aaaccagggaagagatctagtgcta

SEQ ID NO: 5514 - DNA, 25 bp, Rattus norvegicus
aaaccagggaagtgatctagtgcta

SEQ ID NO: 5515 - DNA, 25 bp, Rattus norvegicus
aaaccagggcctagcacacactaga

SEQ ID NO: 5516 - DNA, 25 bp, Rattus norvegicus
aaaccagggccttgcacacactaga

SEQ ID NO: 5517 - DNA, 25 bp, Rattus norvegicus
aaaccagggtgtctatcttttgctt

SEQ ID NO: 5518 - DNA, 25 bp, Rattus norvegicus
aaaccagggtgtgtatcttttgctt

SEQ ID NO: 5519 - DNA, 25 bp, Rattus norvegicus
aaaccaggtcatacactgtcactgt

SEQ ID NO: 5520 - DNA, 25 bp, Rattus norvegicus
aaaccaggtcatccacttggacaga

SEQ ID NO: 5521 - DNA, 25 bp, Rattus norvegicus
aaaccaggtcatgcacttggacaga

SEQ ID NO: 5522 - DNA, 25 bp, Rattus norvegicus
aaaccaggtcattcactgtcactgt

SEQ ID NO: 5523 - DNA, 25 bp, Rattus norvegicus
aaaccaggtccaatgagctttctga

SEQ ID NO: 5524 - DNA, 25 bp, Rattus norvegicus
aaaccaggtccattgagctttctga

SEQ ID NO: 5525 - DNA, 25 bp, Rattus norvegicus
aaaccaggtctgagatctgcagcta

SEQ ID NO: 5526 - DNA, 25 bp, Rattus norvegicus
aaaccaggtctgtgatctgcagcta

SEQ ID NO: 5527 - DNA, 25 bp, Rattus norvegicus
aaaccaggtgacatagggacattct

SEQ ID NO: 5528 - DNA, 25 bp, Rattus norvegicus
aaaccaggtgacttagggacattct

SEQ ID NO: 5529 - DNA, 25 bp, Rattus norvegicus
aaaccaggtggactcaaactcaggc

SEQ ID NO: 5530 - DNA, 25 bp, Rattus norvegicus
aaaccaggtggagtcaaactcaggc

SEQ ID NO: 5531 - DNA, 25 bp, Rattus norvegicus
aaaccagtaactctcaatcaatccc

SEQ ID NO: 5532 - DNA, 25 bp, Rattus norvegicus
aaaccagtaactgtcaatcaatccc

SEQ ID NO: 5533 - DNA, 25 bp, Rattus norvegicus
aaaccagtagatcagcctgactgaa

SEQ ID NO: 5534 - DNA, 25 bp, Rattus norvegicus
aaaccagtagatgagcctgactgaa

SEQ ID NO: 5535 - DNA, 25 bp, Rattus norvegicus
aaaccagtagttatcaggaagccag

SEQ ID NO: 5536 - DNA, 25 bp, Rattus norvegicus
aaaccagtagttttcaggaagccag

SEQ ID NO: 5537 - DNA, 25 bp, Rattus norvegicus
aaaccagtcacgatcacagggagaa

SEQ ID NO: 5538 - DNA, 25 bp, Rattus norvegicus
aaaccagtcacgttcacagggagaa

SEQ ID NO: 5539 - DNA, 25 bp, Rattus norvegicus
aaaccagtcagtattggtaccactg

SEQ ID NO: 5540 - DNA, 25 bp, Rattus norvegicus
aaaccagtcagttttggtaccactg

SEQ ID NO: 5541 - DNA, 25 bp, Rattus norvegicus
aaaccagtccagaacttcagaaaca

SEQ ID NO: 5542 - DNA, 25 bp, Rattus norvegicus
aaaccagtccagtacttcagaaaca

SEQ ID NO: 5543 - DNA, 25 bp, Rattus norvegicus
aaaccagtccgcaacgtggtgatct

SEQ ID NO: 5544 - DNA, 25 bp, Rattus norvegicus
aaaccagtccgctacgtggtgatct

SEQ ID NO: 5545 - DNA, 25 bp, Rattus norvegicus
aaaccagtccttctactgcatgagt

SEQ ID NO: 5546 - DNA, 25 bp, Rattus norvegicus
aaaccagtccttgtactgcatgagt

SEQ ID NO: 5547 - DNA, 25 bp, Rattus norvegicus
aaaccagtctcgctagctttcgtga

SEQ ID NO: 5548 - DNA, 25 bp, Rattus norvegicus
aaaccagtctcggtagctttcgtga

SEQ ID NO: 5549 - DNA, 25 bp, Rattus norvegicus
aaaccagtgactactcattagtgat

SEQ ID NO: 5550 - DNA, 25 bp, Rattus norvegicus
aaaccagtgacttctcattagtgat

SEQ ID NO: 5551 - DNA, 25 bp, Rattus norvegicus
aaaccagtgcagcttcaccctggag

SEQ ID NO: 5552 - DNA, 25 bp, Rattus norvegicus
aaaccagtgcaggttcaccctggag

SEQ ID NO: 5553 - DNA, 25 bp, Rattus norvegicus
aaaccagtgcttatctgattctaat

SEQ ID NO: 5554 - DNA, 25 bp, Rattus norvegicus
aaaccagtgcttttctgattctaat

SEQ ID NO: 5555 - DNA, 25 bp, Rattus norvegicus
aaaccagtggctatgtgtgcactta

SEQ ID NO: 5556 - DNA, 25 bp, Rattus norvegicus
aaaccagtggctttgtgtgcactta

SEQ ID NO: 5557 - DNA, 25 bp, Rattus norvegicus
aaaccagtgttacctttgaattatg

SEQ ID NO: 5558 - DNA, 25 bp, Rattus norvegicus
aaaccagtgttagctttgaattatg

SEQ ID NO: 5559 - DNA, 25 bp, Rattus norvegicus
aaaccagttattcagtatgcaggaa

SEQ ID NO: 5560 - DNA, 25 bp, Rattus norvegicus
aaaccagttattgagtatgcaggaa

SEQ ID NO: 5561 - DNA, 25 bp, Rattus norvegicus
aaaccagttctgcttccttgccaga

SEQ ID NO: 5562 - DNA, 25 bp, Rattus norvegicus
aaaccagttctggttccttgccaga

SEQ ID NO: 5563 - DNA, 25 bp, Rattus norvegicus
aaaccagttgatcaagattctcctc

SEQ ID NO: 5564 - DNA, 25 bp, Rattus norvegicus
aaaccagttgatgaagattctcctc

SEQ ID NO: 5565 - DNA, 25 bp, Rattus norvegicus
aaaccagttttgaacgtctagacat

SEQ ID NO: 5566 - DNA, 25 bp, Rattus norvegicus
aaaccagttttgtacgtctagacat

SEQ ID NO: 5567 - DNA, 25 bp, Rattus norvegicus
aaaccatacagtcttgttcgagaga

SEQ ID NO: 5568 - DNA, 25 bp, Rattus norvegicus
aaaccatacagtgttgttcgagaga

SEQ ID NO: 5569 - DNA, 25 bp, Rattus norvegicus
aaaccataccacattttgttgccat

SEQ ID NO: 5570 - DNA, 25 bp, Rattus norvegicus
aaaccataccactttttgttgccat

SEQ ID NO: 5571 - DNA, 25 bp, Rattus norvegicus
aaaccataccctaaattgggcagtg

SEQ ID NO: 5572 - DNA, 25 bp, Rattus norvegicus
aaaccatacccttaattgggcagtg

SEQ ID NO: 5573 - DNA, 25 bp, Rattus norvegicus
aaaccatagtgtagttgaacagtat

SEQ ID NO: 5574 - DNA, 25 bp, Rattus norvegicus
aaaccatagtgttgttgaacagtat

SEQ ID NO: 5575 - DNA, 25 bp, Rattus norvegicus
aaaccatatactagacattgctgag

SEQ ID NO: 5576 - DNA, 25 bp, Rattus norvegicus
aaaccatatacttgacattgctgag

SEQ ID NO: 5577 - DNA, 25 bp, Rattus norvegicus
aaaccatcaactatctttatcaaat

SEQ ID NO: 5578 - DNA, 25 bp, Rattus norvegicus
aaaccatcaactttctttatcaaat

SEQ ID NO: 5579 - DNA, 25 bp, Rattus norvegicus
aaaccatcacacaatttatcttttt

SEQ ID NO: 5580 - DNA, 25 bp, Rattus norvegicus
aaaccatcacactatttatcttttt

SEQ ID NO: 5581 - DNA, 25 bp, Rattus norvegicus
aaaccatcacagctagcctttgctc

SEQ ID NO: 5582 - DNA, 25 bp, Rattus norvegicus
aaaccatcacaggtagcctttgctc

SEQ ID NO: 5583 - DNA, 25 bp, Rattus norvegicus
aaaccatcagatcgccttaaagctg

SEQ ID NO: 5584 - DNA, 25 bp, Rattus norvegicus
aaaccatcagatggccttaaagctg

SEQ ID NO: 5585 - DNA, 25 bp, Rattus norvegicus
aaaccatcagcactgatacctagta

SEQ ID NO: 5586 - DNA, 25 bp, Rattus norvegicus
aaaccatcagcagtgatacctagta

SEQ ID NO: 5587 - DNA, 25 bp, Rattus norvegicus
aaaccatccaaaagaggcctccatt

SEQ ID NO: 5588 - DNA, 25 bp, Rattus norvegicus
aaaccatccaaatgaggcctccatt

SEQ ID NO: 5589 - DNA, 25 bp, Rattus norvegicus
aaaccatccagcattcattaaacca

SEQ ID NO: 5590 - DNA, 25 bp, Rattus norvegicus
aaaccatccagctttcattaaacca

SEQ ID NO: 5591 - DNA, 25 bp, Rattus norvegicus
aaaccatctaatcttacgtcctcct

SEQ ID NO: 5592 - DNA, 25 bp, Rattus norvegicus
aaaccatctaatgttacgtcctcct

SEQ ID NO: 5593 - DNA, 25 bp, Rattus norvegicus
aaaccatctgagagcagtgccttaa

SEQ ID NO: 5594 - DNA, 25 bp, Rattus norvegicus
aaaccatctgagcaactcgagtcaa

SEQ ID NO: 5595 - DNA, 25 bp, Rattus norvegicus
aaaccatctgaggaactcgagtcaa

SEQ ID NO: 5596 - DNA, 25 bp, Rattus norvegicus
aaaccatctgagtgcagtgccttaa

SEQ ID NO: 5597 - DNA, 25 bp, Rattus norvegicus
aaaccatctgtaattccgcttcttg

SEQ ID NO: 5598 - DNA, 25 bp, Rattus norvegicus
aaaccatctgtatttccgcttcttg

SEQ ID NO: 5599 - DNA, 25 bp, Rattus norvegicus
aaaccatctgtgcactgactgctgc

SEQ ID NO: 5600 - DNA, 25 bp, Rattus norvegicus
aaaccatctgtggactgactgctgc

SEQ ID NO: 5601 - DNA, 25 bp, Rattus norvegicus
aaaccatcttgccaaaagcctgctc

SEQ ID NO: 5602 - DNA, 25 bp, Rattus norvegicus
aaaccatcttgcgaaaagcctgctc

SEQ ID NO: 5603 - DNA, 25 bp, Rattus norvegicus
aaaccatgacggagggaagcacaca

SEQ ID NO: 5604 - DNA, 25 bp, Rattus norvegicus
aaaccatgacggtgggaagcacaca

SEQ ID NO: 5605 - DNA, 25 bp, Rattus norvegicus
aaaccatgatgcctttgtacttgct

SEQ ID NO: 5606 - DNA, 25 bp, Rattus norvegicus
aaaccatgatgcgtttgtacttgct

SEQ ID NO: 5607 - DNA, 25 bp, Rattus norvegicus
aaaccatgatttagctgtctgtaca

SEQ ID NO: 5608 - DNA, 25 bp, Rattus norvegicus
aaaccatgattttgctgtctgtaca

SEQ ID NO: 5609 - DNA, 25 bp, Rattus norvegicus
aaaccatgcagcatcatcaattttt

SEQ ID NO: 5610 - DNA, 25 bp, Rattus norvegicus
aaaccatgcagcttcatcaattttt

SEQ ID NO: 5611 - DNA, 25 bp, Rattus norvegicus
aaaccatgcaggctagccacaggca

SEQ ID NO: 5612 - DNA, 25 bp, Rattus norvegicus
aaaccatgcagggtagccacaggca

SEQ ID NO: 5613 - DNA, 25 bp, Rattus norvegicus
aaaccatgcagtaccacccgaaagg

SEQ ID NO: 5614 - DNA, 25 bp, Rattus norvegicus
aaaccatgcagttccacccgaaagg

SEQ ID NO: 5615 - DNA, 25 bp, Rattus norvegicus
aaaccatgccggactcttgggacaa

SEQ ID NO: 5616 - DNA, 25 bp, Rattus norvegicus
aaaccatgccggtctcttgggacaa

SEQ ID NO: 5617 - DNA, 25 bp, Rattus norvegicus
aaaccatgctagagactacttcccc

SEQ ID NO: 5618 - DNA, 25 bp, Rattus norvegicus
aaaccatgctagtgactacttcccc

SEQ ID NO: 5619 - DNA, 25 bp, Rattus norvegicus
aaaccatgctgtcttctccaggaaa

SEQ ID NO: 5620 - DNA, 25 bp, Rattus norvegicus
aaaccatgctgtgttctccaggaaa

SEQ ID NO: 5621 - DNA, 25 bp, Rattus norvegicus
aaaccatggatgaagtgctctgtga

SEQ ID NO: 5622 - DNA, 25 bp, Rattus norvegicus
aaaccatggatgtagtgctctgtga

SEQ ID NO: 5623 - DNA, 25 bp, Rattus norvegicus
aaaccatggcatatggtgtcccatt

SEQ ID NO: 5624 - DNA, 25 bp, Rattus norvegicus
aaaccatggcatttggtgtcccatt

SEQ ID NO: 5625 - DNA, 25 bp, Rattus norvegicus
aaaccatggctcaaaagttcttcga

SEQ ID NO: 5626 - DNA, 25 bp, Rattus norvegicus
aaaccatggctctaaagttcttcga

SEQ ID NO: 5627 - DNA, 25 bp, Rattus norvegicus
aaaccatgtcaaaggcattccgcaa

SEQ ID NO: 5628 - DNA, 25 bp, Rattus norvegicus
aaaccatgtcaatggcattccgcaa

SEQ ID NO: 5629 - DNA, 25 bp, Rattus norvegicus
aaaccattataaccgcctggccaag

SEQ ID NO: 5630 - DNA, 25 bp, Rattus norvegicus
aaaccattataagcgcctggccaag

SEQ ID NO: 5631 - DNA, 25 bp, Rattus norvegicus
aaaccattatgacgtctgcctgcaa

SEQ ID NO: 5632 - DNA, 25 bp, Rattus norvegicus
aaaccattatgaggtctgcctgcaa

SEQ ID NO: 5633 - DNA, 25 bp, Rattus norvegicus
aaaccattatttccatccaccaaat

SEQ ID NO: 5634 - DNA, 25 bp, Rattus norvegicus
aaaccattatttgcatccaccaaat

SEQ ID NO: 5635 - DNA, 25 bp, Rattus norvegicus
aaaccattccctaggcttcagaatg

SEQ ID NO: 5636 - DNA, 25 bp, Rattus norvegicus
aaaccattcccttggcttcagaatg

SEQ ID NO: 5637 - DNA, 25 bp, Rattus norvegicus
aaaccattcgttccatttgcttcgt

SEQ ID NO: 5638 - DNA, 25 bp, Rattus norvegicus
aaaccattcgttgcatttgcttcgt

SEQ ID NO: 5639 - DNA, 25 bp, Rattus norvegicus
aaaccattctcgactaggtagaaat

SEQ ID NO: 5640 - DNA, 25 bp, Rattus norvegicus
aaaccattctcgtctaggtagaaat

SEQ ID NO: 5641 - DNA, 25 bp, Rattus norvegicus
aaaccattgatacttcacggaaaca

SEQ ID NO: 5642 - DNA, 25 bp, Rattus norvegicus
aaaccattgatagttcacggaaaca

SEQ ID NO: 5643 - DNA, 25 bp, Rattus norvegicus
aaaccattgattacttcttgagtag

SEQ ID NO: 5644 - DNA, 25 bp, Rattus norvegicus
aaaccattgatttcttcttgagtag

SEQ ID NO: 5645 - DNA, 25 bp, Rattus norvegicus
aaaccattgcttctttctcaaacca

SEQ ID NO: 5646 - DNA, 25 bp, Rattus norvegicus
aaaccattgcttgtttctcaaacca

SEQ ID NO: 5647 - DNA, 25 bp, Rattus norvegicus
aaaccattgtgtctcttgtgtccta

SEQ ID NO: 5648 - DNA, 25 bp, Rattus norvegicus
aaaccattgtgtgtcttgtgtccta

SEQ ID NO: 5649 - DNA, 25 bp, Rattus norvegicus
aaaccatttatgatctgtgaggcga

SEQ ID NO: 5650 - DNA, 25 bp, Rattus norvegicus
aaaccatttatgttctgtgaggcga

SEQ ID NO: 5651 - DNA, 25 bp, Rattus norvegicus
aaaccatttgcacttggagttgctt

SEQ ID NO: 5652 - DNA, 25 bp, Rattus norvegicus
aaaccatttgcagttggagttgctt

SEQ ID NO: 5653 - DNA, 25 bp, Rattus norvegicus
aaaccattttcacaggtggcaaatt

SEQ ID NO: 5654 - DNA, 25 bp, Rattus norvegicus
aaaccattttcagaggtggcaaatt

SEQ ID NO: 5655 - DNA, 25 bp, Rattus norvegicus
aaacccaacaacagagactgcctag

SEQ ID NO: 5656 - DNA, 25 bp, Rattus norvegicus
aaacccaacaactgagactgcctag

SEQ ID NO: 5657 - DNA, 25 bp, Rattus norvegicus
aaacccaacatcattgccacagagg

SEQ ID NO: 5658 - DNA, 25 bp, Rattus norvegicus
aaacccaacatctttgccacagagg

SEQ ID NO: 5659 - DNA, 25 bp, Rattus norvegicus
aaacccaacattaggtagcctgaag

SEQ ID NO: 5660 - DNA, 25 bp, Rattus norvegicus
aaacccaacatttggtagcctgaag

SEQ ID NO: 5661 - DNA, 25 bp, Rattus norvegicus
aaacccaacctgatgtcgcacagta

SEQ ID NO: 5662 - DNA, 25 bp, Rattus norvegicus
aaacccaacctgttgtcgcacagta

SEQ ID NO: 5663 - DNA, 25 bp, Rattus norvegicus
aaacccaagccacgccaaattctgt

SEQ ID NO: 5664 - DNA, 25 bp, Rattus norvegicus
aaacccaagccaggccaaattctgt

SEQ ID NO: 5665 - DNA, 25 bp, Rattus norvegicus
aaacccaagtgcatggtcctccaag

SEQ ID NO: 5666 - DNA, 25 bp, Rattus norvegicus
aaacccaagtgcttggtcctccaag

SEQ ID NO: 5667 - DNA, 25 bp, Rattus norvegicus
aaacccaagttgacataatgccatg

SEQ ID NO: 5668 - DNA, 25 bp, Rattus norvegicus
aaacccaagttgtcataatgccatg

SEQ ID NO: 5669 - DNA, 25 bp, Rattus norvegicus
aaacccaatgctacctgtcagggag

SEQ ID NO: 5670 - DNA, 25 bp, Rattus norvegicus
aaacccaatgcttcctgtcagggag

SEQ ID NO: 5671 - DNA, 25 bp, Rattus norvegicus
aaacccacagggattctggatgcca

SEQ ID NO: 5672 - DNA, 25 bp, Rattus norvegicus
aaacccacagggtttctggatgcca

SEQ ID NO: 5673 - DNA, 25 bp, Rattus norvegicus
aaacccaccactacatggacctgaa

SEQ ID NO: 5674 - DNA, 25 bp, Rattus norvegicus
aaacccaccacttcatggacctgaa

SEQ ID NO: 5675 - DNA, 25 bp, Rattus norvegicus
aaacccacccagaccaggtgtggtg

SEQ ID NO: 5676 - DNA, 25 bp, Rattus norvegicus
aaacccacccagtccaggtgtggtg

SEQ ID NO: 5677 - DNA, 25 bp, Rattus norvegicus
aaacccactctcagagccggttgag

SEQ ID NO: 5678 - DNA, 25 bp, Rattus norvegicus
aaacccactctctgagccggttgag

SEQ ID NO: 5679 - DNA, 25 bp, Rattus norvegicus
aaacccactctgaactctatttata

SEQ ID NO: 5680 - DNA, 25 bp, Rattus norvegicus
aaacccactctgtactctatttata

SEQ ID NO: 5681 - DNA, 25 bp, Rattus norvegicus
aaacccactgcacgtttgtggcaaa

SEQ ID NO: 5682 - DNA, 25 bp, Rattus norvegicus
aaacccactgcaggtttgtggcaaa

SEQ ID NO: 5683 - DNA, 25 bp, Rattus norvegicus
aaacccactgctatgcaatgtgttt

SEQ ID NO: 5684 - DNA, 25 bp, Rattus norvegicus
aaacccactgctttgcaatgtgttt

SEQ ID NO: 5685 - DNA, 25 bp, Rattus norvegicus
aaacccactttgagtgccagacagt

SEQ ID NO: 5686 - DNA, 25 bp, Rattus norvegicus
aaacccactttgtgtgccagacagt

SEQ ID NO: 5687 - DNA, 25 bp, Rattus norvegicus
aaacccagagcaactgtggactcag

SEQ ID NO: 5688 - DNA, 25 bp, Rattus norvegicus
aaacccagagcatctgtggactcag

SEQ ID NO: 5689 - DNA, 25 bp, Rattus norvegicus
aaacccagagtaaacatccgatgct

SEQ ID NO: 5690 - DNA, 25 bp, Rattus norvegicus
aaacccagagtatacatccgatgct

SEQ ID NO: 5691 - DNA, 25 bp, Rattus norvegicus
aaacccagattcagactgtgcctaa

SEQ ID NO: 5692 - DNA, 25 bp, Rattus norvegicus
aaacccagattctgactgtgcctaa

SEQ ID NO: 5693 - DNA, 25 bp, Rattus norvegicus
aaacccagcaggagatgggtttgtt

SEQ ID NO: 5694 - DNA, 25 bp, Rattus norvegicus
aaacccagcaggtgatgggtttgtt

SEQ ID NO: 5695 - DNA, 25 bp, Rattus norvegicus
aaacccagcctgagaagccagaagg

SEQ ID NO: 5696 - DNA, 25 bp, Rattus norvegicus
aaacccagcctgtgaagccagaagg

SEQ ID NO: 5697 - DNA, 25 bp, Rattus norvegicus
aaacccaggaatacaatgcaccagg

SEQ ID NO: 5698 - DNA, 25 bp, Rattus norvegicus
aaacccaggaattcaatgcaccagg

SEQ ID NO: 5699 - DNA, 25 bp, Rattus norvegicus
aaacccaggactagaaatcacttga

SEQ ID NO: 5700 - DNA, 25 bp, Rattus norvegicus
aaacccaggacttgaaatcacttga

SEQ ID NO: 5701 - DNA, 25 bp, Rattus norvegicus
aaacccaggcttccttctcgattaa

SEQ ID NO: 5702 - DNA, 25 bp, Rattus norvegicus
aaacccaggcttgcttctcgattaa

SEQ ID NO: 5703 - DNA, 25 bp, Rattus norvegicus
aaacccagggtgattctcagtggag

SEQ ID NO: 5704 - DNA, 25 bp, Rattus norvegicus
aaacccagggtgtttctcagtggag

SEQ ID NO: 5705 - DNA, 25 bp, Rattus norvegicus
aaacccagtgccaattcatacaaag

SEQ ID NO: 5706 - DNA, 25 bp, Rattus norvegicus
aaacccagtgcctattcatacaaag

SEQ ID NO: 5707 - DNA, 25 bp, Rattus norvegicus
aaacccagttctccgtacagtgtta

SEQ ID NO: 5708 - DNA, 25 bp, Rattus norvegicus
aaacccagttctgcgtacagtgtta

SEQ ID NO: 5709 - DNA, 25 bp, Rattus norvegicus
aaacccagttgcaacttcatttgct

SEQ ID NO: 5710 - DNA, 25 bp, Rattus norvegicus
aaacccagttgctacttcatttgct

SEQ ID NO: 5711 - DNA, 25 bp, Rattus norvegicus
aaacccatcctgacatcgcaggaat

SEQ ID NO: 5712 - DNA, 25 bp, Rattus norvegicus
aaacccatcctgtcatcgcaggaat

SEQ ID NO: 5713 - DNA, 25 bp, Rattus norvegicus
aaacccatccttatatgtagcgcca

SEQ ID NO: 5714 - DNA, 25 bp, Rattus norvegicus
aaacccatccttttatgtagcgcca

SEQ ID NO: 5715 - DNA, 25 bp, Rattus norvegicus
aaacccatctggatttctggtgaaa

SEQ ID NO: 5716 - DNA, 25 bp, Rattus norvegicus
aaacccatctggttttctggtgaaa

SEQ ID NO: 5717 - DNA, 25 bp, Rattus norvegicus
aaacccatgactatagctggatgtg

SEQ ID NO: 5718 - DNA, 25 bp, Rattus norvegicus
aaacccatgactctaaaggagctgt

SEQ ID NO: 5719 - DNA, 25 bp, Rattus norvegicus
aaacccatgactgtaaaggagctgt

SEQ ID NO: 5720 - DNA, 25 bp, Rattus norvegicus
aaacccatgactttagctggatgtg

SEQ ID NO: 5721 - DNA, 25 bp, Rattus norvegicus
aaacccatgatgatggcatactaac

SEQ ID NO: 5722 - DNA, 25 bp, Rattus norvegicus
aaacccatgatgttggcatactaac

SEQ ID NO: 5723 - DNA, 25 bp, Rattus norvegicus
aaacccatggctacaaagggccgtg

SEQ ID NO: 5724 - DNA, 25 bp, Rattus norvegicus
aaacccatggcttcaaagggccgtg

SEQ ID NO: 5725 - DNA, 25 bp, Rattus norvegicus
aaacccatgggtctgtttgtaccat

SEQ ID NO: 5726 - DNA, 25 bp, Rattus norvegicus
aaacccatgggtgtgtttgtaccat

SEQ ID NO: 5727 - DNA, 25 bp, Rattus norvegicus
aaacccatgtagcatctgctgcaag

SEQ ID NO: 5728 - DNA, 25 bp, Rattus norvegicus
aaacccatgtaggatctgctgcaag

SEQ ID NO: 5729 - DNA, 25 bp, Rattus norvegicus
aaacccatgttaaaaatctcatatc

SEQ ID NO: 5730 - DNA, 25 bp, Rattus norvegicus
aaacccatgttataaatctcatatc

SEQ ID NO: 5731 - DNA, 25 bp, Rattus norvegicus
aaacccattgacagacggctccaag

SEQ ID NO: 5732 - DNA, 25 bp, Rattus norvegicus
aaacccattgactgacggctccaag

SEQ ID NO: 5733 - DNA, 25 bp, Rattus norvegicus
aaacccattgcgaagttgatccaga

SEQ ID NO: 5734 - DNA, 25 bp, Rattus norvegicus
aaacccattgcgtagttgatccaga

SEQ ID NO: 5735 - DNA, 25 bp, Rattus norvegicus
aaacccattggaatgcactctttat

SEQ ID NO: 5736 - DNA, 25 bp, Rattus norvegicus
aaacccattggattgcactctttat

SEQ ID NO: 5737 - DNA, 25 bp, Rattus norvegicus
aaaccccaaataacaggatgaactg

SEQ ID NO: 5738 - DNA, 25 bp, Rattus norvegicus
aaaccccaaatatcaggatgaactg

SEQ ID NO: 5739 - DNA, 25 bp, Rattus norvegicus
aaaccccacactcaggttctatggt

SEQ ID NO: 5740 - DNA, 25 bp, Rattus norvegicus
aaaccccacactgaggttctatggt

SEQ ID NO: 5741 - DNA, 25 bp, Rattus norvegicus
aaaccccacagtactaatgcagctc

SEQ ID NO: 5742 - DNA, 25 bp, Rattus norvegicus
aaaccccacagttctaatgcagctc

SEQ ID NO: 5743 - DNA, 25 bp, Rattus norvegicus
aaaccccaccatagagttcaggcaa

SEQ ID NO: 5744 - DNA, 25 bp, Rattus norvegicus
aaaccccaccattgagttcaggcaa

SEQ ID NO: 5745 - DNA, 25 bp, Rattus norvegicus
aaaccccacttcatggtggctgatg

SEQ ID NO: 5746 - DNA, 25 bp, Rattus norvegicus
aaaccccacttcttggtggctgatg

SEQ ID NO: 5747 - DNA, 25 bp, Rattus norvegicus
aaaccccactttcctgatgacactt

SEQ ID NO: 5748 - DNA, 25 bp, Rattus norvegicus
aaaccccactttgctgatgacactt

SEQ ID NO: 5749 - DNA, 25 bp, Rattus norvegicus
aaaccccagatcaaaagcctcattt

SEQ ID NO: 5750 - DNA, 25 bp, Rattus norvegicus
aaaccccagatctaaagcctcattt

SEQ ID NO: 5751 - DNA, 25 bp, Rattus norvegicus
aaaccccagattatcctcgtcaacg

SEQ ID NO: 5752 - DNA, 25 bp, Rattus norvegicus
aaaccccagattttcctcgtcaacg

SEQ ID NO: 5753 - DNA, 25 bp, Rattus norvegicus
aaaccccagcacatgtctagagaat

SEQ ID NO: 5754 - DNA, 25 bp, Rattus norvegicus
aaaccccagcacttgtctagagaat

SEQ ID NO: 5755 - DNA, 25 bp, Rattus norvegicus
aaaccccagcataattcttaagact

SEQ ID NO: 5756 - DNA, 25 bp, Rattus norvegicus
aaaccccagcattattcttaagact

SEQ ID NO: 5757 - DNA, 25 bp, Rattus norvegicus
aaaccccagccacgataggatattt

SEQ ID NO: 5758 - DNA, 25 bp, Rattus norvegicus
aaaccccagccaggataggatattt

SEQ ID NO: 5759 - DNA, 25 bp, Rattus norvegicus
aaaccccagcggaggagaggacaca

SEQ ID NO: 5760 - DNA, 25 bp, Rattus norvegicus
aaaccccagcggtggagaggacaca

SEQ ID NO: 5761 - DNA, 25 bp, Rattus norvegicus
aaaccccagctcacgaactcttatt

SEQ ID NO: 5762 - DNA, 25 bp, Rattus norvegicus
aaaccccagctctcgaactcttatt

SEQ ID NO: 5763 - DNA, 25 bp, Rattus norvegicus
aaaccccatctcaaattcagtagaa

SEQ ID NO: 5764 - DNA, 25 bp, Rattus norvegicus
aaaccccatctctaattcagtagaa

SEQ ID NO: 5765 - DNA, 25 bp, Rattus norvegicus
aaaccccatggtcttctctacatga

SEQ ID NO: 5766 - DNA, 25 bp, Rattus norvegicus
aaaccccatggtgttctctacatga

SEQ ID NO: 5767 - DNA, 25 bp, Rattus norvegicus
aaaccccatgttactctgggcattt

SEQ ID NO: 5768 - DNA, 25 bp, Rattus norvegicus
aaaccccatgtttctctgggcattt

SEQ ID NO: 5769 - DNA, 25 bp, Rattus norvegicus
aaaccccattccattgtggactctg

SEQ ID NO: 5770 - DNA, 25 bp, Rattus norvegicus
aaaccccattcctttgtggactctg

SEQ ID NO: 5771 - DNA, 25 bp, Rattus norvegicus
aaaccccgagctacatacatgcata

SEQ ID NO: 5772 - DNA, 25 bp, Rattus norvegicus
aaaccccgagcttcatacatgcata

SEQ ID NO: 5773 - DNA, 25 bp, Rattus norvegicus
aaacccctcagaaaggccaactgtg

SEQ ID NO: 5774 - DNA, 25 bp, Rattus norvegicus
aaacccctcagataggccaactgtg

SEQ ID NO: 5775 - DNA, 25 bp, Rattus norvegicus
aaacccctcagcatgaacatacagg

SEQ ID NO: 5776 - DNA, 25 bp, Rattus norvegicus
aaacccctcagcattatatcgagaa

SEQ ID NO: 5777 - DNA, 25 bp, Rattus norvegicus
aaacccctcagcttgaacatacagg

SEQ ID NO: 5778 - DNA, 25 bp, Rattus norvegicus
aaacccctcagctttatatcgagaa

SEQ ID NO: 5779 - DNA, 25 bp, Rattus norvegicus
aaacccctcttcagttcagccagat

SEQ ID NO: 5780 - DNA, 25 bp, Rattus norvegicus
aaacccctcttctgttcagccagat

SEQ ID NO: 5781 - DNA, 25 bp, Rattus norvegicus
aaacccctgcatagtgaagtgctac

SEQ ID NO: 5782 - DNA, 25 bp, Rattus norvegicus
aaacccctgcatataatataatcta

SEQ ID NO: 5783 - DNA, 25 bp, Rattus norvegicus
aaacccctgcattgtgaagtgctac

SEQ ID NO: 5784 - DNA, 25 bp, Rattus norvegicus
aaacccctgcatttaatataatcta

SEQ ID NO: 5785 - DNA, 25 bp, Rattus norvegicus
aaacccctgggcactgagtaagtcg

SEQ ID NO: 5786 - DNA, 25 bp, Rattus norvegicus
aaacccctgggctctgagtaagtcg

SEQ ID NO: 5787 - DNA, 25 bp, Rattus norvegicus
aaacccctgttcactgtaaaagcag

SEQ ID NO: 5788 - DNA, 25 bp, Rattus norvegicus
aaacccctgttctctgtaaaagcag

SEQ ID NO: 5789 - DNA, 25 bp, Rattus norvegicus
aaaccccttataacagaattaccag

SEQ ID NO: 5790 - DNA, 25 bp, Rattus norvegicus
aaaccccttatatcagaattaccag

SEQ ID NO: 5791 - DNA, 25 bp, Rattus norvegicus
aaaccccttcacatgctaattgcaa

SEQ ID NO: 5792 - DNA, 25 bp, Rattus norvegicus
aaaccccttcacttgctaattgcaa

SEQ ID NO: 5793 - DNA, 25 bp, Rattus norvegicus
aaacccgaaggcagaggcgctgtac

SEQ ID NO: 5794 - DNA, 25 bp, Rattus norvegicus
aaacccgaaggctgaggcgctgtac

SEQ ID NO: 5795 - DNA, 25 bp, Rattus norvegicus
aaacccgaattgaggccctgaatgc

SEQ ID NO: 5796 - DNA, 25 bp, Rattus norvegicus
aaacccgaattgtggccctgaatgc

SEQ ID NO: 5797 - DNA, 25 bp, Rattus norvegicus
aaacccgaccctaatcagactgatg

SEQ ID NO: 5798 - DNA, 25 bp, Rattus norvegicus
aaacccgacccttatcagactgatg

SEQ ID NO: 5799 - DNA, 25 bp, Rattus norvegicus
aaacccgaccgcagcatttgcagct

SEQ ID NO: 5800 - DNA, 25 bp, Rattus norvegicus
aaacccgaccgctgcatttgcagct

SEQ ID NO: 5801 - DNA, 25 bp, Rattus norvegicus
aaacccgacttcaggatgacaaaga

SEQ ID NO: 5802 - DNA, 25 bp, Rattus norvegicus
aaacccgacttctggatgacaaaga

SEQ ID NO: 5803 - DNA, 25 bp, Rattus norvegicus
aaacccgagagcagtgagccggcgc

SEQ ID NO: 5804 - DNA, 25 bp, Rattus norvegicus
aaacccgagagctgtgagccggcgc

SEQ ID NO: 5805 - DNA, 25 bp, Rattus norvegicus
aaacccgagcagcatagttctccct

SEQ ID NO: 5806 - DNA, 25 bp, Rattus norvegicus
aaacccgagcaggatagttctccct

SEQ ID NO: 5807 - DNA, 25 bp, Rattus norvegicus
aaacccgaggttcgtgagcctgcgc

SEQ ID NO: 5808 - DNA, 25 bp, Rattus norvegicus
aaacccgaggttggtgagcctgcgc

SEQ ID NO: 5809 - DNA, 25 bp, Rattus norvegicus
aaacccgattatattctccatctgg

SEQ ID NO: 5810 - DNA, 25 bp, Rattus norvegicus
aaacccgattattttctccatctgg

SEQ ID NO: 5811 - DNA, 25 bp, Rattus norvegicus
aaacccgattggcatctcaagagag

SEQ ID NO: 5812 - DNA, 25 bp, Rattus norvegicus
aaacccgattgggatctcaagagag

SEQ ID NO: 5813 - DNA, 25 bp, Rattus norvegicus
aaacccgcagagaaggctgccatga

SEQ ID NO: 5814 - DNA, 25 bp, Rattus norvegicus
aaacccgcagagtaggctgccatga

SEQ ID NO: 5815 - DNA, 25 bp, Rattus norvegicus
aaacccgcataaagctatcgagtga

SEQ ID NO: 5816 - DNA, 25 bp, Rattus norvegicus
aaacccgcataatgctatcgagtga

SEQ ID NO: 5817 - DNA, 25 bp, Rattus norvegicus
aaacccgcctgaatctaaagtcgag

SEQ ID NO: 5818 - DNA, 25 bp, Rattus norvegicus
aaacccgcctgattctaaagtcgag

SEQ ID NO: 5819 - DNA, 25 bp, Rattus norvegicus
aaacccggatttccaggccatcaga

SEQ ID NO: 5820 - DNA, 25 bp, Rattus norvegicus
aaacccggatttgcaggccatcaga

SEQ ID NO: 5821 - DNA, 25 bp, Rattus norvegicus
aaacccgggcttagtgtgaactgca

SEQ ID NO: 5822 - DNA, 25 bp, Rattus norvegicus
aaacccgggctttgtgtgaactgca

SEQ ID NO: 5823 - DNA, 25 bp, Rattus norvegicus
aaacccggtgagaatgcccagagtc

SEQ ID NO: 5824 - DNA, 25 bp, Rattus norvegicus
aaacccggtgagtatgcccagagtc

SEQ ID NO: 5825 - DNA, 25 bp, Rattus norvegicus
aaacccgtatccaaactgaagtgcg

SEQ ID NO: 5826 - DNA, 25 bp, Rattus norvegicus
aaacccgtatcctaactgaagtgcg

SEQ ID NO: 5827 - DNA, 25 bp, Rattus norvegicus
aaacccgtcgataacatttactgtg

SEQ ID NO: 5828 - DNA, 25 bp, Rattus norvegicus
aaacccgtcgattacatttactgtg

SEQ ID NO: 5829 - DNA, 25 bp, Rattus norvegicus
aaacccgtctggctgcactgcagat

SEQ ID NO: 5830 - DNA, 25 bp, Rattus norvegicus
aaacccgtctgggtgcactgcagat

SEQ ID NO: 5831 - DNA, 25 bp, Rattus norvegicus
aaacccgtgttgctccattgcctca

SEQ ID NO: 5832 - DNA, 25 bp, Rattus norvegicus
aaacccgtgttggtccattgcctca

SEQ ID NO: 5833 - DNA, 25 bp, Rattus norvegicus
aaacccgttacccttgcgatgacag

SEQ ID NO: 5834 - DNA, 25 bp, Rattus norvegicus
aaacccgttaccgttgcgatgacag

SEQ ID NO: 5835 - DNA, 25 bp, Rattus norvegicus
aaacccgttcagagatttccacagt

SEQ ID NO: 5836 - DNA, 25 bp, Rattus norvegicus
aaacccgttcagtgatttccacagt

SEQ ID NO: 5837 - DNA, 25 bp, Rattus norvegicus
aaacccgttggtccatccatgtata

SEQ ID NO: 5838 - DNA, 25 bp, Rattus norvegicus
aaacccgttggtgcatccatgtata

SEQ ID NO: 5839 - DNA, 25 bp, Rattus norvegicus
aaaccctaatcacttatctcgtgtg

SEQ ID NO: 5840 - DNA, 25 bp, Rattus norvegicus
aaaccctaatcagttatctcgtgtg

SEQ ID NO: 5841 - DNA, 25 bp, Rattus norvegicus
aaaccctaatgcacactctggattt

SEQ ID NO: 5842 - DNA, 25 bp, Rattus norvegicus
aaaccctaatgctcactctggattt

SEQ ID NO: 5843 - DNA, 25 bp, Rattus norvegicus
aaaccctaccagacactatggcggt

SEQ ID NO: 5844 - DNA, 25 bp, Rattus norvegicus
aaaccctaccagtcactatggcggt

SEQ ID NO: 5845 - DNA, 25 bp, Rattus norvegicus
aaaccctacgaaagtgccatttgcc

SEQ ID NO: 5846 - DNA, 25 bp, Rattus norvegicus
aaaccctacgaatgtgccatttgcc

SEQ ID NO: 5847 - DNA, 25 bp, Rattus norvegicus
aaaccctactagacattgagatgct

SEQ ID NO: 5848 - DNA, 25 bp, Rattus norvegicus
aaaccctactagtcattgagatgct

SEQ ID NO: 5849 - DNA, 25 bp, Rattus norvegicus
aaaccctagaatccctaaatgtgct

SEQ ID NO: 5850 - DNA, 25 bp, Rattus norvegicus
aaaccctagaatgcctaaatgtgct

SEQ ID NO: 5851 - DNA, 25 bp, Rattus norvegicus
aaaccctatgtgagccaactgtgtg

SEQ ID NO: 5852 - DNA, 25 bp, Rattus norvegicus
aaaccctatgtgtgccaactgtgtg

SEQ ID NO: 5853 - DNA, 25 bp, Rattus norvegicus
aaaccctattggatgatttgcctgc

SEQ ID NO: 5854 - DNA, 25 bp, Rattus norvegicus
aaaccctattggttgatttgcctgc

SEQ ID NO: 5855 - DNA, 25 bp, Rattus norvegicus
aaaccctcaatgactctgcattttg

SEQ ID NO: 5856 - DNA, 25 bp, Rattus norvegicus
aaaccctcaatgtctctgcattttg

SEQ ID NO: 5857 - DNA, 25 bp, Rattus norvegicus
aaaccctcaggaagtcttagtgcag

SEQ ID NO: 5858 - DNA, 25 bp, Rattus norvegicus
aaaccctcaggacttctctgtggct

SEQ ID NO: 5859 - DNA, 25 bp, Rattus norvegicus
aaaccctcaggagttctctgtggct

SEQ ID NO: 5860 - DNA, 25 bp, Rattus norvegicus
aaaccctcaggatgtcttagtgcag

SEQ ID NO: 5861 - DNA, 25 bp, Rattus norvegicus
aaaccctcagggaacatgatgcatg

SEQ ID NO: 5862 - DNA, 25 bp, Rattus norvegicus
aaaccctcagggtacatgatgcatg

SEQ ID NO: 5863 - DNA, 25 bp, Rattus norvegicus
aaaccctcagtacaagttctggctt

SEQ ID NO: 5864 - DNA, 25 bp, Rattus norvegicus
aaaccctcagtagaagttctggctt

SEQ ID NO: 5865 - DNA, 25 bp, Rattus norvegicus
aaaccctcagttatattatgtcaag

SEQ ID NO: 5866 - DNA, 25 bp, Rattus norvegicus
aaaccctcagttttattatgtcaag

SEQ ID NO: 5867 - DNA, 25 bp, Rattus norvegicus
aaaccctcatttcctggcatgtgtt

SEQ ID NO: 5868 - DNA, 25 bp, Rattus norvegicus
aaaccctcatttgctggcatgtgtt

SEQ ID NO: 5869 - DNA, 25 bp, Rattus norvegicus
aaaccctccctaagcaagttgatgg

SEQ ID NO: 5870 - DNA, 25 bp, Rattus norvegicus
aaaccctccctatgcaagttgatgg

SEQ ID NO: 5871 - DNA, 25 bp, Rattus norvegicus
aaaccctccgacattgaagctgaag

SEQ ID NO: 5872 - DNA, 25 bp, Rattus norvegicus
aaaccctccgactttgaagctgaag

SEQ ID NO: 5873 - DNA, 25 bp, Rattus norvegicus
aaaccctcctgaagggtcaagcgcg

SEQ ID NO: 5874 - DNA, 25 bp, Rattus norvegicus
aaaccctcctgatgggtcaagcgcg

SEQ ID NO: 5875 - DNA, 25 bp, Rattus norvegicus
aaaccctctatacagttaccagaga

SEQ ID NO: 5876 - DNA, 25 bp, Rattus norvegicus
aaaccctctatagagttaccagaga

SEQ ID NO: 5877 - DNA, 25 bp, Rattus norvegicus
aaaccctctattagacaccttacag

SEQ ID NO: 5878 - DNA, 25 bp, Rattus norvegicus
aaaccctctatttgacaccttacag

SEQ ID NO: 5879 - DNA, 25 bp, Rattus norvegicus
aaaccctctgaaaaccattaccatg

SEQ ID NO: 5880 - DNA, 25 bp, Rattus norvegicus
aaaccctctgaataccattaccatg

SEQ ID NO: 5881 - DNA, 25 bp, Rattus norvegicus
aaaccctgactaagtgtcctgtgga

SEQ ID NO: 5882 - DNA, 25 bp, Rattus norvegicus
aaaccctgactatgtgtcctgtgga

SEQ ID NO: 5883 - DNA, 25 bp, Rattus norvegicus
aaaccctgagtccttgcaccgtagt

SEQ ID NO: 5884 - DNA, 25 bp, Rattus norvegicus
aaaccctgagtcgttgcaccgtagt

SEQ ID NO: 5885 - DNA, 25 bp, Rattus norvegicus
aaaccctgagtgagcttggatctcc

SEQ ID NO: 5886 - DNA, 25 bp, Rattus norvegicus
aaaccctgagtgtgcttggatctcc

SEQ ID NO: 5887 - DNA, 25 bp, Rattus norvegicus
aaaccctgcattaagctggagttct

SEQ ID NO: 5888 - DNA, 25 bp, Rattus norvegicus
aaaccctgcatttagctggagttct

SEQ ID NO: 5889 - DNA, 25 bp, Rattus norvegicus
aaaccctgccatagatgccttgaga

SEQ ID NO: 5890 - DNA, 25 bp, Rattus norvegicus
aaaccctgccattgatgccttgaga

SEQ ID NO: 5891 - DNA, 25 bp, Rattus norvegicus
aaaccctgcgctctttgggtgtgga

SEQ ID NO: 5892 - DNA, 25 bp, Rattus norvegicus
aaaccctgcgctgtttgggtgtgga

SEQ ID NO: 5893 - DNA, 25 bp, Rattus norvegicus
aaaccctgctgtctaatgtatcctg

SEQ ID NO: 5894 - DNA, 25 bp, Rattus norvegicus
aaaccctgctgtgtaatgtatcctg

SEQ ID NO: 5895 - DNA, 25 bp, Rattus norvegicus
aaaccctggagtcacggcttggatt

SEQ ID NO: 5896 - DNA, 25 bp, Rattus norvegicus
aaaccctggagtgacggcttggatt

SEQ ID NO: 5897 - DNA, 25 bp, Rattus norvegicus
aaaccctggattctgatctgaattg

SEQ ID NO: 5898 - DNA, 25 bp, Rattus norvegicus
aaaccctggattgtgatctgaattg

SEQ ID NO: 5899 - DNA, 25 bp, Rattus norvegicus
aaaccctggctcactgagaaagcaa

SEQ ID NO: 5900 - DNA, 25 bp, Rattus norvegicus
aaaccctggctctctgagaaagcaa

SEQ ID NO: 5901 - DNA, 25 bp, Rattus norvegicus
aaaccctggttacagtggctccttg

SEQ ID NO: 5902 - DNA, 25 bp, Rattus norvegicus
aaaccctggttagagtggctccttg

SEQ ID NO: 5903 - DNA, 25 bp, Rattus norvegicus
aaaccctgtctacatgctggcaagt

SEQ ID NO: 5904 - DNA, 25 bp, Rattus norvegicus
aaaccctgtctagatgctggcaagt

SEQ ID NO: 5905 - DNA, 25 bp, Rattus norvegicus
aaaccctgtgatctgatcgtctgac

SEQ ID NO: 5906 - DNA, 25 bp, Rattus norvegicus
aaaccctgtgatgtgatcgtctgac

SEQ ID NO: 5907 - DNA, 25 bp, Rattus norvegicus
aaaccctgtggcatgagagggccct

SEQ ID NO: 5908 - DNA, 25 bp, Rattus norvegicus
aaaccctgtggcttgagagggccct

SEQ ID NO: 5909 - DNA, 25 bp, Rattus norvegicus
aaacccttatagagcagatcacatg

SEQ ID NO: 5910 - DNA, 25 bp, Rattus norvegicus
aaacccttatagtgcagatcacatg

SEQ ID NO: 5911 - DNA, 25 bp, Rattus norvegicus
aaacccttcaagatcagaattggca

SEQ ID NO: 5912 - DNA, 25 bp, Rattus norvegicus
aaacccttcaagttcagaattggca

SEQ ID NO: 5913 - DNA, 25 bp, Rattus norvegicus
aaacccttgcataccggtacaagag

SEQ ID NO: 5914 - DNA, 25 bp, Rattus norvegicus
aaacccttgcattccggtacaagag

SEQ ID NO: 5915 - DNA, 25 bp, Rattus norvegicus
aaacccttgctcagtggctctgggt

SEQ ID NO: 5916 - DNA, 25 bp, Rattus norvegicus
aaacccttgctctgtggctctgggt

SEQ ID NO: 5917 - DNA, 25 bp, Rattus norvegicus
aaacccttgggcagtcgcaggtctg

SEQ ID NO: 5918 - DNA, 25 bp, Rattus norvegicus
aaacccttgggctgtcgcaggtctg

SEQ ID NO: 5919 - DNA, 25 bp, Rattus norvegicus
aaacccttggtgactgtcataccgg

SEQ ID NO: 5920 - DNA, 25 bp, Rattus norvegicus
aaacccttggtgtctgtcataccgg

SEQ ID NO: 5921 - DNA, 25 bp, Rattus norvegicus
aaacccttgtgcagttgaggccgaa

SEQ ID NO: 5922 - DNA, 25 bp, Rattus norvegicus
aaacccttgtgctgttgaggccgaa

SEQ ID NO: 5923 - DNA, 25 bp, Rattus norvegicus
aaaccctttcagagagctgcatgta

SEQ ID NO: 5924 - DNA, 25 bp, Rattus norvegicus
aaaccctttcagtgagctgcatgta

SEQ ID NO: 5925 - DNA, 25 bp, Rattus norvegicus
aaaccctttgaaatccatgtgccca

SEQ ID NO: 5926 - DNA, 25 bp, Rattus norvegicus
aaaccctttgaattccatgtgccca

SEQ ID NO: 5927 - DNA, 25 bp, Rattus norvegicus
aaaccctttgcacttgttggcgttg

SEQ ID NO: 5928 - DNA, 25 bp, Rattus norvegicus
aaaccctttgcagttgttggcgttg

SEQ ID NO: 5929 - DNA, 25 bp, Rattus norvegicus
aaaccctttttaaggctcacacagc

SEQ ID NO: 5930 - DNA, 25 bp, Rattus norvegicus
aaaccctttttatggctcacacagc

SEQ ID NO: 5931 - DNA, 25 bp, Rattus norvegicus
aaaccgaagacacttcttctgcggg

SEQ ID NO: 5932 - DNA, 25 bp, Rattus norvegicus
aaaccgaagacagttcttctgcggg

SEQ ID NO: 5933 - DNA, 25 bp, Rattus norvegicus
aaaccgaagcccagacgctctaggt

SEQ ID NO: 5934 - DNA, 25 bp, Rattus norvegicus
aaaccgaagccctgacgctctaggt

SEQ ID NO: 5935 - DNA, 25 bp, Rattus norvegicus
aaaccgaatcacagtgcgggagaac

SEQ ID NO: 5936 - DNA, 25 bp, Rattus norvegicus
aaaccgaatcactgtgcgggagaac

SEQ ID NO: 5937 - DNA, 25 bp, Rattus norvegicus
aaaccgacatctaagaggccctgga

SEQ ID NO: 5938 - DNA, 25 bp, Rattus norvegicus
aaaccgacatcttagaggccctgga

SEQ ID NO: 5939 - DNA, 25 bp, Rattus norvegicus
aaaccgactctaagaagcctacctt

SEQ ID NO: 5940 - DNA, 25 bp, Rattus norvegicus
aaaccgactctatgaagcctacctt

SEQ ID NO: 5941 - DNA, 25 bp, Rattus norvegicus
aaaccgactttcactattcccaatg

SEQ ID NO: 5942 - DNA, 25 bp, Rattus norvegicus
aaaccgactttctctattcccaatg

SEQ ID NO: 5943 - DNA, 25 bp, Rattus norvegicus
aaaccgagacaccacgaggttgtga

SEQ ID NO: 5944 - DNA, 25 bp, Rattus norvegicus
aaaccgagacacgacgaggttgtga

SEQ ID NO: 5945 - DNA, 25 bp, Rattus norvegicus
aaaccgagatgtcaggcaatggcct

SEQ ID NO: 5946 - DNA, 25 bp, Rattus norvegicus
aaaccgagatgtgaggcaatggcct

SEQ ID NO: 5947 - DNA, 25 bp, Rattus norvegicus
aaaccgagcgacactaatccagtct

SEQ ID NO: 5948 - DNA, 25 bp, Rattus norvegicus
aaaccgagcgactctaatccagtct

SEQ ID NO: 5949 - DNA, 25 bp, Rattus norvegicus
aaaccgaggcagcagctcttgttgc

SEQ ID NO: 5950 - DNA, 25 bp, Rattus norvegicus
aaaccgaggcaggagctcttgttgc

SEQ ID NO: 5951 - DNA, 25 bp, Rattus norvegicus
aaaccgatacttctcacagctgaag

SEQ ID NO: 5952 - DNA, 25 bp, Rattus norvegicus
aaaccgatacttgtcacagctgaag

SEQ ID NO: 5953 - DNA, 25 bp, Rattus norvegicus
aaaccgatgtatcctgggtcattat

SEQ ID NO: 5954 - DNA, 25 bp, Rattus norvegicus
aaaccgatgtatcctttctctgtgt

SEQ ID NO: 5955 - DNA, 25 bp, Rattus norvegicus
aaaccgatgtatgctgggtcattat

SEQ ID NO: 5956 - DNA, 25 bp, Rattus norvegicus
aaaccgatgtatgctttctctgtgt

SEQ ID NO: 5957 - DNA, 25 bp, Rattus norvegicus
aaaccgatttgccacaagctcacaa

SEQ ID NO: 5958 - DNA, 25 bp, Rattus norvegicus
aaaccgatttgcgacaagctcacaa

SEQ ID NO: 5959 - DNA, 25 bp, Rattus norvegicus
aaaccgcactctaccttgtgaagtt

SEQ ID NO: 5960 - DNA, 25 bp, Rattus norvegicus
aaaccgcactcttccttgtgaagtt

SEQ ID NO: 5961 - DNA, 25 bp, Rattus norvegicus
aaaccgcatgtgaaggatgtctgct

SEQ ID NO: 5962 - DNA, 25 bp, Rattus norvegicus
aaaccgcatgtgtaggatgtctgct

SEQ ID NO: 5963 - DNA, 25 bp, Rattus norvegicus
aaaccgccagcgaacttgacaatta

SEQ ID NO: 5964 - DNA, 25 bp, Rattus norvegicus
aaaccgccagcgtacttgacaatta

SEQ ID NO: 5965 - DNA, 25 bp, Rattus norvegicus
aaaccgccatctattttgtgaactt

SEQ ID NO: 5966 - DNA, 25 bp, Rattus norvegicus
aaaccgccatcttttttgtgaactt

SEQ ID NO: 5967 - DNA, 25 bp, Rattus norvegicus
aaaccgccattgctgagttgtgaat

SEQ ID NO: 5968 - DNA, 25 bp, Rattus norvegicus
aaaccgccattggtgagttgtgaat

SEQ ID NO: 5969 - DNA, 25 bp, Rattus norvegicus
aaaccgcctctgagacttgaagtat

SEQ ID NO: 5970 - DNA, 25 bp, Rattus norvegicus
aaaccgcctctgtgacttgaagtat

SEQ ID NO: 5971 - DNA, 25 bp, Rattus norvegicus
aaaccgcgttatagctgagccttac

SEQ ID NO: 5972 - DNA, 25 bp, Rattus norvegicus
aaaccgcgttattgctgagccttac

SEQ ID NO: 5973 - DNA, 25 bp, Rattus norvegicus
aaaccgctgctccttttctgttagc

SEQ ID NO: 5974 - DNA, 25 bp, Rattus norvegicus
aaaccgctgctcgttttctgttagc

SEQ ID NO: 5975 - DNA, 25 bp, Rattus norvegicus
aaaccgctgggtctactatgcagat

SEQ ID NO: 5976 - DNA, 25 bp, Rattus norvegicus
aaaccgctgggtgtactatgcagat

SEQ ID NO: 5977 - DNA, 25 bp, Rattus norvegicus
aaaccggacttcatgtgtgggcgtg

SEQ ID NO: 5978 - DNA, 25 bp, Rattus norvegicus
aaaccggacttcttgtgtgggcgtg

SEQ ID NO: 5979 - DNA, 25 bp, Rattus norvegicus
aaaccggaggccaatgagcagtcta

SEQ ID NO: 5980 - DNA, 25 bp, Rattus norvegicus
aaaccggaggcctatgagcagtcta

SEQ ID NO: 5981 - DNA, 25 bp, Rattus norvegicus
aaaccggagtcaaggagtcagcaat

SEQ ID NO: 5982 - DNA, 25 bp, Rattus norvegicus
aaaccggagtcatggagtcagcaat

SEQ ID NO: 5983 - DNA, 25 bp, Rattus norvegicus
aaaccggcacagagcatgagatgga

SEQ ID NO: 5984 - DNA, 25 bp, Rattus norvegicus
aaaccggcacagtgcatgagatgga

SEQ ID NO: 5985 - DNA, 25 bp, Rattus norvegicus
aaaccggcagcacgctcacaggtga

SEQ ID NO: 5986 - DNA, 25 bp, Rattus norvegicus
aaaccggcagcaggctcacaggtga

SEQ ID NO: 5987 - DNA, 25 bp, Rattus norvegicus
aaaccgggaggacatactgaatgct

SEQ ID NO: 5988 - DNA, 25 bp, Rattus norvegicus
aaaccgggaggagatactgaatgct

SEQ ID NO: 5989 - DNA, 25 bp, Rattus norvegicus
aaaccgggttgcagctcagaggagc

SEQ ID NO: 5990 - DNA, 25 bp, Rattus norvegicus
aaaccgggttgctgctcagaggagc

SEQ ID NO: 5991 - DNA, 25 bp, Rattus norvegicus
aaaccggtaagcaagatatttgcat

SEQ ID NO: 5992 - DNA, 25 bp, Rattus norvegicus
aaaccggtaagctagatatttgcat

SEQ ID NO: 5993 - DNA, 25 bp, Rattus norvegicus
aaaccggtagccaggagtcgccaag

SEQ ID NO: 5994 - DNA, 25 bp, Rattus norvegicus
aaaccggtagcctggagtcgccaag

SEQ ID NO: 5995 - DNA, 25 bp, Rattus norvegicus
aaaccggtccctctatgctgggctt

SEQ ID NO: 5996 - DNA, 25 bp, Rattus norvegicus
aaaccggtccctgtatgctgggctt

SEQ ID NO: 5997 - DNA, 25 bp, Rattus norvegicus
aaaccggtggtcagaggaaagcaca

SEQ ID NO: 5998 - DNA, 25 bp, Rattus norvegicus
aaaccggtggtctgaggaaagcaca

SEQ ID NO: 5999 - DNA, 25 bp, Rattus norvegicus
aaaccggtgtacatgtttatgcccg

SEQ ID NO: 6000 - DNA, 25 bp, Rattus norvegicus
aaaccggtgtacttgtttatgcccg

SEQ ID NO: 6001 - DNA, 25 bp, Rattus norvegicus
aaaccgtaacgcacagctcaagctc

SEQ ID NO: 6002 - DNA, 25 bp, Rattus norvegicus
aaaccgtaacgctcagctcaagctc

SEQ ID NO: 6003 - DNA, 25 bp, Rattus norvegicus
aaaccgtaagatagcttcagcctca

SEQ ID NO: 6004 - DNA, 25 bp, Rattus norvegicus
aaaccgtaagattgcttcagcctca

SEQ ID NO: 6005 - DNA, 25 bp, Rattus norvegicus
aaaccgtaattcagctcattttttg

SEQ ID NO: 6006 - DNA, 25 bp, Rattus norvegicus
aaaccgtaattctgctcattttttg

SEQ ID NO: 6007 - DNA, 25 bp, Rattus norvegicus
aaaccgtagatgcatcgttatcccc

SEQ ID NO: 6008 - DNA, 25 bp, Rattus norvegicus
aaaccgtagatggatcgttatcccc

SEQ ID NO: 6009 - DNA, 25 bp, Rattus norvegicus
aaaccgtagcatacacgggtctgaa

SEQ ID NO: 6010 - DNA, 25 bp, Rattus norvegicus
aaaccgtagcattcacgggtctgaa

SEQ ID NO: 6011 - DNA, 25 bp, Rattus norvegicus
aaaccgtatgtcagcctccgagtgc

SEQ ID NO: 6012 - DNA, 25 bp, Rattus norvegicus
aaaccgtatgtctgcctccgagtgc

SEQ ID NO: 6013 - DNA, 25 bp, Rattus norvegicus
aaaccgtatgttagtgcccagccct

SEQ ID NO: 6014 - DNA, 25 bp, Rattus norvegicus
aaaccgtatgtttgtgcccagccct

SEQ ID NO: 6015 - DNA, 25 bp, Rattus norvegicus
aaaccgtcacggataatctctgaag

SEQ ID NO: 6016 - DNA, 25 bp, Rattus norvegicus
aaaccgtcacggttaatctctgaag

SEQ ID NO: 6017 - DNA, 25 bp, Rattus norvegicus
aaaccgtccgcaaaggaggcctgat

SEQ ID NO: 6018 - DNA, 25 bp, Rattus norvegicus
aaaccgtccgcataggaggcctgat

SEQ ID NO: 6019 - DNA, 25 bp, Rattus norvegicus
aaaccgtctaccacgagtgctcttc

SEQ ID NO: 6020 - DNA, 25 bp, Rattus norvegicus
aaaccgtctacctcgagtgctcttc

SEQ ID NO: 6021 - DNA, 25 bp, Rattus norvegicus
aaaccgtctgtgaacgcacttctat

SEQ ID NO: 6022 - DNA, 25 bp, Rattus norvegicus
aaaccgtctgtgtacgcacttctat

SEQ ID NO: 6023 - DNA, 25 bp, Rattus norvegicus
aaaccgtcttccaatggttctgcct

SEQ ID NO: 6024 - DNA, 25 bp, Rattus norvegicus
aaaccgtcttcctatggttctgcct

SEQ ID NO: 6025 - DNA, 25 bp, Rattus norvegicus
aaaccgtgagacacatcctaggacc

SEQ ID NO: 6026 - DNA, 25 bp, Rattus norvegicus
aaaccgtgagactcatcctaggacc

SEQ ID NO: 6027 - DNA, 25 bp, Rattus norvegicus
aaaccgtgaggcagcagcggacctg

SEQ ID NO: 6028 - DNA, 25 bp, Rattus norvegicus
aaaccgtgaggccttcattcttcaa

SEQ ID NO: 6029 - DNA, 25 bp, Rattus norvegicus
aaaccgtgaggcgttcattcttcaa

SEQ ID NO: 6030 - DNA, 25 bp, Rattus norvegicus
aaaccgtgaggctgcagcggacctg

SEQ ID NO: 6031 - DNA, 25 bp, Rattus norvegicus
aaaccgtgccgccaaagaggagctg

SEQ ID NO: 6032 - DNA, 25 bp, Rattus norvegicus
aaaccgtgccgcgaaagaggagctg

SEQ ID NO: 6033 - DNA, 25 bp, Rattus norvegicus
aaaccgtgcctgaagctgtttgagt

SEQ ID NO: 6034 - DNA, 25 bp, Rattus norvegicus
aaaccgtgcctgtagctgtttgagt

SEQ ID NO: 6035 - DNA, 25 bp, Rattus norvegicus
aaaccgtggcttcacccgtggctga

SEQ ID NO: 6036 - DNA, 25 bp, Rattus norvegicus
aaaccgtggcttgacccgtggctga

SEQ ID NO: 6037 - DNA, 25 bp, Rattus norvegicus
aaaccgtggtgcatgagccgtggac

SEQ ID NO: 6038 - DNA, 25 bp, Rattus norvegicus
aaaccgtggtgcttgagccgtggac

SEQ ID NO: 6039 - DNA, 25 bp, Rattus norvegicus
aaaccgtgtgtcaatgatctgatgt

SEQ ID NO: 6040 - DNA, 25 bp, Rattus norvegicus
aaaccgtgtgtctatgatctgatgt

SEQ ID NO: 6041 - DNA, 25 bp, Rattus norvegicus
aaaccgttcaaaccagagtccagac

SEQ ID NO: 6042 - DNA, 25 bp, Rattus norvegicus
aaaccgttcaaagcagagtccagac

SEQ ID NO: 6043 - DNA, 25 bp, Rattus norvegicus
aaaccgttgagaacttctgggaact

SEQ ID NO: 6044 - DNA, 25 bp, Rattus norvegicus
aaaccgttgagatcttctgggaact

SEQ ID NO: 6045 - DNA, 25 bp, Rattus norvegicus
aaaccgtttcttcaactcatctagt

SEQ ID NO: 6046 - DNA, 25 bp, Rattus norvegicus
aaaccgtttcttgaactcatctagt

SEQ ID NO: 6047 - DNA, 25 bp, Rattus norvegicus
aaacctaacagaatcccgcatttat

SEQ ID NO: 6048 - DNA, 25 bp, Rattus norvegicus
aaacctaacagattcccgcatttat

SEQ ID NO: 6049 - DNA, 25 bp, Rattus norvegicus
aaacctaacatcatgttatgacttg

SEQ ID NO: 6050 - DNA, 25 bp, Rattus norvegicus
aaacctaacatcttgttatgacttg

SEQ ID NO: 6051 - DNA, 25 bp, Rattus norvegicus
aaacctaagagcagcgcggcagcac

SEQ ID NO: 6052 - DNA, 25 bp, Rattus norvegicus
aaacctaagagctgcgcggcagcac

SEQ ID NO: 6053 - DNA, 25 bp, Rattus norvegicus
aaacctaagctgaatgtatgtgtgt

SEQ ID NO: 6054 - DNA, 25 bp, Rattus norvegicus
aaacctaagctgtatgtatgtgtgt

SEQ ID NO: 6055 - DNA, 25 bp, Rattus norvegicus
aaacctaagcttctgtgacctccag

SEQ ID NO: 6056 - DNA, 25 bp, Rattus norvegicus
aaacctaagcttgtgtgacctccag

SEQ ID NO: 6057 - DNA, 25 bp, Rattus norvegicus
aaacctaatcttcgcattcctactg

SEQ ID NO: 6058 - DNA, 25 bp, Rattus norvegicus
aaacctaatcttggcattcctactg

SEQ ID NO: 6059 - DNA, 25 bp, Rattus norvegicus
aaacctaatgagagcttgctgtggc

SEQ ID NO: 6060 - DNA, 25 bp, Rattus norvegicus
aaacctaatgagtgcttgctgtggc

SEQ ID NO: 6061 - DNA, 25 bp, Rattus norvegicus
aaacctaatgcccaggacgctccag

SEQ ID NO: 6062 - DNA, 25 bp, Rattus norvegicus
aaacctaatgccgaggacgctccag

SEQ ID NO: 6063 - DNA, 25 bp, Rattus norvegicus
aaacctacagtgagtctggccttgc

SEQ ID NO: 6064 - DNA, 25 bp, Rattus norvegicus
aaacctacagtgtgtctggccttgc

SEQ ID NO: 6065 - DNA, 25 bp, Rattus norvegicus
aaacctacatctcactccagggaag

SEQ ID NO: 6066 - DNA, 25 bp, Rattus norvegicus
aaacctacatctgactccagggaag

SEQ ID NO: 6067 - DNA, 25 bp, Rattus norvegicus
aaacctacctaacgatgctgctttc

SEQ ID NO: 6068 - DNA, 25 bp, Rattus norvegicus
aaacctacctaaggatgctgctttc

SEQ ID NO: 6069 - DNA, 25 bp, Rattus norvegicus
aaacctacgaagaagcatgggcagt

SEQ ID NO: 6070 - DNA, 25 bp, Rattus norvegicus
aaacctacgaagtagcatgggcagt

SEQ ID NO: 6071 - DNA, 25 bp, Rattus norvegicus
aaacctacgtctaggtctactgtca

SEQ ID NO: 6072 - DNA, 25 bp, Rattus norvegicus
aaacctacgtcttggtctactgtca

SEQ ID NO: 6073 - DNA, 25 bp, Rattus norvegicus
aaacctactcagacctttatgtgaa

SEQ ID NO: 6074 - DNA, 25 bp, Rattus norvegicus
aaacctactcagtcctttatgtgaa

SEQ ID NO: 6075 - DNA, 25 bp, Rattus norvegicus
aaacctactcgtctgtgagaacaga

SEQ ID NO: 6076 - DNA, 25 bp, Rattus norvegicus
aaacctactcgtgtgtgagaacaga

SEQ ID NO: 6077 - DNA, 25 bp, Rattus norvegicus
aaacctactgatactggtcatggta

SEQ ID NO: 6078 - DNA, 25 bp, Rattus norvegicus
aaacctactgattctggtcatggta

SEQ ID NO: 6079 - DNA, 25 bp, Rattus norvegicus
aaacctactgtcatttgctttgtgc

SEQ ID NO: 6080 - DNA, 25 bp, Rattus norvegicus
aaacctactgtcttttgctttgtgc

SEQ ID NO: 6081 - DNA, 25 bp, Rattus norvegicus
aaacctacttgtcgaccctatgtgc

SEQ ID NO: 6082 - DNA, 25 bp, Rattus norvegicus
aaacctacttgtggaccctatgtgc

SEQ ID NO: 6083 - DNA, 25 bp, Rattus norvegicus
aaacctagaggacctgtacttgaat

SEQ ID NO: 6084 - DNA, 25 bp, Rattus norvegicus
aaacctagaggagctgtacttgaat

SEQ ID NO: 6085 - DNA, 25 bp, Rattus norvegicus
aaacctagccgccactcaagggttg

SEQ ID NO: 6086 - DNA, 25 bp, Rattus norvegicus
aaacctagccgcgactcaagggttg

SEQ ID NO: 6087 - DNA, 25 bp, Rattus norvegicus
aaacctagctagctggttcttccca

SEQ ID NO: 6088 - DNA, 25 bp, Rattus norvegicus
aaacctagctaggtggttcttccca

SEQ ID NO: 6089 - DNA, 25 bp, Rattus norvegicus
aaacctaggccgacagagagcaact

SEQ ID NO: 6090 - DNA, 25 bp, Rattus norvegicus
aaacctaggccgtcagagagcaact

SEQ ID NO: 6091 - DNA, 25 bp, Rattus norvegicus
aaacctagggctctatgcacgctaa

SEQ ID NO: 6092 - DNA, 25 bp, Rattus norvegicus
aaacctagggctgtatgcacgctaa

SEQ ID NO: 6093 - DNA, 25 bp, Rattus norvegicus
aaacctaggtcactttacttcagag

SEQ ID NO: 6094 - DNA, 25 bp, Rattus norvegicus
aaacctaggtcagtttacttcagag

SEQ ID NO: 6095 - DNA, 25 bp, Rattus norvegicus
aaacctagtgcaaaggaaacgcaga

SEQ ID NO: 6096 - DNA, 25 bp, Rattus norvegicus
aaacctagtgcataggaaacgcaga

SEQ ID NO: 6097 - DNA, 25 bp, Rattus norvegicus
aaacctagttgcatctcttccacat

SEQ ID NO: 6098 - DNA, 25 bp, Rattus norvegicus
aaacctagttgcttctcttccacat

SEQ ID NO: 6099 - DNA, 25 bp, Rattus norvegicus
aaacctatatgcatacagtgcacct

SEQ ID NO: 6100 - DNA, 25 bp, Rattus norvegicus
aaacctatatgcttacagtgcacct

SEQ ID NO: 6101 - DNA, 25 bp, Rattus norvegicus
aaacctatatttacataattctatg

SEQ ID NO: 6102 - DNA, 25 bp, Rattus norvegicus
aaacctatattttcataattctatg

SEQ ID NO: 6103 - DNA, 25 bp, Rattus norvegicus
aaacctatgaggagtgtacgtacat

SEQ ID NO: 6104 - DNA, 25 bp, Rattus norvegicus
aaacctatgaggtgtgtacgtacat

SEQ ID NO: 6105 - DNA, 25 bp, Rattus norvegicus
aaacctatgctgacttccagagcac

SEQ ID NO: 6106 - DNA, 25 bp, Rattus norvegicus
aaacctatgctgtcttccagagcac

SEQ ID NO: 6107 - DNA, 25 bp, Rattus norvegicus
aaacctatgcttcttatcactgtca

SEQ ID NO: 6108 - DNA, 25 bp, Rattus norvegicus
aaacctatgcttgttatcactgtca

SEQ ID NO: 6109 - DNA, 25 bp, Rattus norvegicus
aaacctattcctaacttatcacact

SEQ ID NO: 6110 - DNA, 25 bp, Rattus norvegicus
aaacctattccttacttatcacact

SEQ ID NO: 6111 - DNA, 25 bp, Rattus norvegicus
aaacctcaaatgactgcttcctaag

SEQ ID NO: 6112 - DNA, 25 bp, Rattus norvegicus
aaacctcaaatgtctgcttcctaag

SEQ ID NO: 6113 - DNA, 25 bp, Rattus norvegicus
aaacctcaacacacgggactctggg

SEQ ID NO: 6114 - DNA, 25 bp, Rattus norvegicus
aaacctcaacactcgggactctggg

SEQ ID NO: 6115 - DNA, 25 bp, Rattus norvegicus
aaacctcaactcacagaactttggg

SEQ ID NO: 6116 - DNA, 25 bp, Rattus norvegicus
aaacctcaactctcagaactttggg

SEQ ID NO: 6117 - DNA, 25 bp, Rattus norvegicus
aaacctcaagacaagtcccagttgt

SEQ ID NO: 6118 - DNA, 25 bp, Rattus norvegicus
aaacctcaagactagtcccagttgt

SEQ ID NO: 6119 - DNA, 25 bp, Rattus norvegicus
aaacctcaagctcgccttctgttcg

SEQ ID NO: 6120 - DNA, 25 bp, Rattus norvegicus
aaacctcaagctggccttctgttcg

SEQ ID NO: 6121 - DNA, 25 bp, Rattus norvegicus
aaacctcaagtcctgtaagcctcaa

SEQ ID NO: 6122 - DNA, 25 bp, Rattus norvegicus
aaacctcaagtcgtgtaagcctcaa

SEQ ID NO: 6123 - DNA, 25 bp, Rattus norvegicus
aaacctcaatggcaagaattactcc

SEQ ID NO: 6124 - DNA, 25 bp, Rattus norvegicus
aaacctcaatgggaagaattactcc

SEQ ID NO: 6125 - DNA, 25 bp, Rattus norvegicus
aaacctcacataagtggctcttcct

SEQ ID NO: 6126 - DNA, 25 bp, Rattus norvegicus
aaacctcacatatgtggctcttcct

SEQ ID NO: 6127 - DNA, 25 bp, Rattus norvegicus
aaacctcacattctggcctggtgtg

SEQ ID NO: 6128 - DNA, 25 bp, Rattus norvegicus
aaacctcacattgtggcctggtgtg

SEQ ID NO: 6129 - DNA, 25 bp, Rattus norvegicus
aaacctcacggacctatagcagaga

SEQ ID NO: 6130 - DNA, 25 bp, Rattus norvegicus
aaacctcacggagctatagcagaga

SEQ ID NO: 6131 - DNA, 25 bp, Rattus norvegicus
aaacctcacggtaaccacagccaga

SEQ ID NO: 6132 - DNA, 25 bp, Rattus norvegicus
aaacctcacggttaccacagccaga

SEQ ID NO: 6133 - DNA, 25 bp, Rattus norvegicus
aaacctcagactaggagtgtgtaga

SEQ ID NO: 6134 - DNA, 25 bp, Rattus norvegicus
aaacctcagacttggagtgtgtaga

SEQ ID NO: 6135 - DNA, 25 bp, Rattus norvegicus
aaacctcagctacttgctgctacca

SEQ ID NO: 6136 - DNA, 25 bp, Rattus norvegicus
aaacctcagctagttgctgctacca

SEQ ID NO: 6137 - DNA, 25 bp, Rattus norvegicus
aaacctcaggaaaactgtccctctg

SEQ ID NO: 6138 - DNA, 25 bp, Rattus norvegicus
aaacctcaggaatactgtccctctg

SEQ ID NO: 6139 - DNA, 25 bp, Rattus norvegicus
aaacctcagtgaacttctgcagtcg

SEQ ID NO: 6140 - DNA, 25 bp, Rattus norvegicus
aaacctcagtgatcttctgcagtcg

SEQ ID NO: 6141 - DNA, 25 bp, Rattus norvegicus
aaacctcatcgtaacaggcctggta

SEQ ID NO: 6142 - DNA, 25 bp, Rattus norvegicus
aaacctcatcgttacaggcctggta

SEQ ID NO: 6143 - DNA, 25 bp, Rattus norvegicus
aaacctcatgaaatcttcactgcct

SEQ ID NO: 6144 - DNA, 25 bp, Rattus norvegicus
aaacctcatgaattcttcactgcct

SEQ ID NO: 6145 - DNA, 25 bp, Rattus norvegicus
aaacctcatgacataatttcagttt

SEQ ID NO: 6146 - DNA, 25 bp, Rattus norvegicus
aaacctcatgacttaatttcagttt

SEQ ID NO: 6147 - DNA, 25 bp, Rattus norvegicus
aaacctcatttcaaagctgccaaac

SEQ ID NO: 6148 - DNA, 25 bp, Rattus norvegicus
aaacctcatttctaagctgccaaac

SEQ ID NO: 6149 - DNA, 25 bp, Rattus norvegicus
aaacctccaaaactgacagttcctg

SEQ ID NO: 6150 - DNA, 25 bp, Rattus norvegicus
aaacctccaaaagtgacagttcctg

SEQ ID NO: 6151 - DNA, 25 bp, Rattus norvegicus
aaacctccaagcctaaagcagctaa

SEQ ID NO: 6152 - DNA, 25 bp, Rattus norvegicus
aaacctccaagcgtaaagcagctaa

SEQ ID NO: 6153 - DNA, 25 bp, Rattus norvegicus
aaacctccactacccagaattctgt

SEQ ID NO: 6154 - DNA, 25 bp, Rattus norvegicus
aaacctccactagccagaattctgt

SEQ ID NO: 6155 - DNA, 25 bp, Rattus norvegicus
aaacctccagaaccctagggctctt

SEQ ID NO: 6156 - DNA, 25 bp, Rattus norvegicus
aaacctccagaagcctagggctctt

SEQ ID NO: 6157 - DNA, 25 bp, Rattus norvegicus
aaacctccagctagtgaaatcaccg

SEQ ID NO: 6158 - DNA, 25 bp, Rattus norvegicus
aaacctccagcttgtgaaatcaccg

SEQ ID NO: 6159 - DNA, 25 bp, Rattus norvegicus
aaacctccaggacgtgctgtccttt

SEQ ID NO: 6160 - DNA, 25 bp, Rattus norvegicus
aaacctccaggaggtgctgtccttt

SEQ ID NO: 6161 - DNA, 25 bp, Rattus norvegicus
aaacctccagtaagatatgcagtgt

SEQ ID NO: 6162 - DNA, 25 bp, Rattus norvegicus
aaacctccagtatgatatgcagtgt

SEQ ID NO: 6163 - DNA, 25 bp, Rattus norvegicus
aaacctccagtcacaaccagttaag

SEQ ID NO: 6164 - DNA, 25 bp, Rattus norvegicus
aaacctccagtctcaaccagttaag

SEQ ID NO: 6165 - DNA, 25 bp, Rattus norvegicus
aaacctcccattactgggtcagtgg

SEQ ID NO: 6166 - DNA, 25 bp, Rattus norvegicus
aaacctcccatttctgggtcagtgg

SEQ ID NO: 6167 - DNA, 25 bp, Rattus norvegicus
aaacctcccctgctggacacgggat

SEQ ID NO: 6168 - DNA, 25 bp, Rattus norvegicus
aaacctcccctggtggacacgggat

SEQ ID NO: 6169 - DNA, 25 bp, Rattus norvegicus
aaacctcctggacccgagaactgac

SEQ ID NO: 6170 - DNA, 25 bp, Rattus norvegicus
aaacctcctggagccgagaactgac

SEQ ID NO: 6171 - DNA, 25 bp, Rattus norvegicus
aaacctcctgtcagtttctggatgt

SEQ ID NO: 6172 - DNA, 25 bp, Rattus norvegicus
aaacctcctgtctgtttctggatgt

SEQ ID NO: 6173 - DNA, 25 bp, Rattus norvegicus
aaacctccttgacagtttcaacagc

SEQ ID NO: 6174 - DNA, 25 bp, Rattus norvegicus
aaacctccttgagagtttcaacagc

SEQ ID NO: 6175 - DNA, 25 bp, Rattus norvegicus
aaacctcgcgggagacctagaagtg

SEQ ID NO: 6176 - DNA, 25 bp, Rattus norvegicus
aaacctcgcgggtgacctagaagtg

SEQ ID NO: 6177 - DNA, 25 bp, Rattus norvegicus
aaacctcgctgcatttcactgggag

SEQ ID NO: 6178 - DNA, 25 bp, Rattus norvegicus
aaacctcgctgcttttcactgggag

SEQ ID NO: 6179 - DNA, 25 bp, Rattus norvegicus
aaacctcggagacagttttgcaccg

SEQ ID NO: 6180 - DNA, 25 bp, Rattus norvegicus
aaacctcggagagagttttgcaccg

SEQ ID NO: 6181 - DNA, 25 bp, Rattus norvegicus
aaacctcggtcaaacttgcgacgga

SEQ ID NO: 6182 - DNA, 25 bp, Rattus norvegicus
aaacctcggtcatacttgcgacgga

SEQ ID NO: 6183 - DNA, 25 bp, Rattus norvegicus
aaacctcgtaggatctgcagcagac

SEQ ID NO: 6184 - DNA, 25 bp, Rattus norvegicus
aaacctcgtaggttctgcagcagac

SEQ ID NO: 6185 - DNA, 25 bp, Rattus norvegicus
aaacctcgtggacatggcggcacag

SEQ ID NO: 6186 - DNA, 25 bp, Rattus norvegicus
aaacctcgtggagatggcggcacag

SEQ ID NO: 6187 - DNA, 25 bp, Rattus norvegicus
aaacctctacccaggacagtggact

SEQ ID NO: 6188 - DNA, 25 bp, Rattus norvegicus
aaacctctaccctggacagtggact

SEQ ID NO: 6189 - DNA, 25 bp, Rattus norvegicus
aaacctctcaccagcttagagcttg

SEQ ID NO: 6190 - DNA, 25 bp, Rattus norvegicus
aaacctctcacctgcttagagcttg

SEQ ID NO: 6191 - DNA, 25 bp, Rattus norvegicus
aaacctctcctgctaggtagaagct

SEQ ID NO: 6192 - DNA, 25 bp, Rattus norvegicus
aaacctctcctggtaggtagaagct

SEQ ID NO: 6193 - DNA, 25 bp, Rattus norvegicus
aaacctctcgagagtatttctggaa

SEQ ID NO: 6194 - DNA, 25 bp, Rattus norvegicus
aaacctctcgagtgtatttctggaa

SEQ ID NO: 6195 - DNA, 25 bp, Rattus norvegicus
aaacctctctccagccagaaggtgg

SEQ ID NO: 6196 - DNA, 25 bp, Rattus norvegicus
aaacctctctcctgccagaaggtgg

SEQ ID NO: 6197 - DNA, 25 bp, Rattus norvegicus
aaacctctctggctgcccaggtggg

SEQ ID NO: 6198 - DNA, 25 bp, Rattus norvegicus
aaacctctctgggtgcccaggtggg

SEQ ID NO: 6199 - DNA, 25 bp, Rattus norvegicus
aaacctctcttgctgtcattgtgta

SEQ ID NO: 6200 - DNA, 25 bp, Rattus norvegicus
aaacctctcttggtgtcattgtgta

SEQ ID NO: 6201 - DNA, 25 bp, Rattus norvegicus
aaacctctgaagaatcttgtactgt

SEQ ID NO: 6202 - DNA, 25 bp, Rattus norvegicus
aaacctctgaagtatcttgtactgt

SEQ ID NO: 6203 - DNA, 25 bp, Rattus norvegicus
aaacctctgatcacttacattcgaa

SEQ ID NO: 6204 - DNA, 25 bp, Rattus norvegicus
aaacctctgatctcttacattcgaa

SEQ ID NO: 6205 - DNA, 25 bp, Rattus norvegicus
aaacctctgccactccagagctggg

SEQ ID NO: 6206 - DNA, 25 bp, Rattus norvegicus
aaacctctgccagtccagagctggg

SEQ ID NO: 6207 - DNA, 25 bp, Rattus norvegicus
aaacctctggctctctgtggtggaa

SEQ ID NO: 6208 - DNA, 25 bp, Rattus norvegicus
aaacctctggctgtctgtggtggaa

SEQ ID NO: 6209 - DNA, 25 bp, Rattus norvegicus
aaacctctgggaatgcttgcagtga

SEQ ID NO: 6210 - DNA, 25 bp, Rattus norvegicus
aaacctctgggattgcttgcagtga

SEQ ID NO: 6211 - DNA, 25 bp, Rattus norvegicus
aaacctctgggcaggtccatggact

SEQ ID NO: 6212 - DNA, 25 bp, Rattus norvegicus
aaacctctgggctggtccatggact

SEQ ID NO: 6213 - DNA, 25 bp, Rattus norvegicus
aaacctctggttcaatttgtgctta

SEQ ID NO: 6214 - DNA, 25 bp, Rattus norvegicus
aaacctctggttgaatttgtgctta

SEQ ID NO: 6215 - DNA, 25 bp, Rattus norvegicus
aaacctctgtttctgcgccatagaa

SEQ ID NO: 6216 - DNA, 25 bp, Rattus norvegicus
aaacctctgtttgtgcgccatagaa

SEQ ID NO: 6217 - DNA, 25 bp, Rattus norvegicus
aaacctctttgaaggaattctcttt

SEQ ID NO: 6218 - DNA, 25 bp, Rattus norvegicus
aaacctctttgaccctgtagcacat

SEQ ID NO: 6219 - DNA, 25 bp, Rattus norvegicus
aaacctctttgagcctgtagcacat

SEQ ID NO: 6220 - DNA, 25 bp, Rattus norvegicus
aaacctctttgatggaattctcttt

SEQ ID NO: 6221 - DNA, 25 bp, Rattus norvegicus
aaacctgaaagtccacacgcgcggc

SEQ ID NO: 6222 - DNA, 25 bp, Rattus norvegicus
aaacctgaaagtgcacacgcgcggc

SEQ ID NO: 6223 - DNA, 25 bp, Rattus norvegicus
aaacctgaaccaacagtaacctcat

SEQ ID NO: 6224 - DNA, 25 bp, Rattus norvegicus
aaacctgaaccatcagtaacctcat

SEQ ID NO: 6225 - DNA, 25 bp, Rattus norvegicus
aaacctgaatcaatgcttgctgtgc

SEQ ID NO: 6226 - DNA, 25 bp, Rattus norvegicus
aaacctgaatcattgcttgctgtgc

SEQ ID NO: 6227 - DNA, 25 bp, Rattus norvegicus
aaacctgacactactttctgccagg

SEQ ID NO: 6228 - DNA, 25 bp, Rattus norvegicus
aaacctgacacttctttctgccagg

SEQ ID NO: 6229 - DNA, 25 bp, Rattus norvegicus
aaacctgacatcattgtgtggcccc

SEQ ID NO: 6230 - DNA, 25 bp, Rattus norvegicus
aaacctgacatctttgtgtggcccc

SEQ ID NO: 6231 - DNA, 25 bp, Rattus norvegicus
aaacctgaccagactttgcagtgac

SEQ ID NO: 6232 - DNA, 25 bp, Rattus norvegicus
aaacctgaccagtctttgcagtgac

SEQ ID NO: 6233 - DNA, 25 bp, Rattus norvegicus
aaacctgaccgccatccacaggaga

SEQ ID NO: 6234 - DNA, 25 bp, Rattus norvegicus
aaacctgaccgcgatccacaggaga

SEQ ID NO: 6235 - DNA, 25 bp, Rattus norvegicus
aaacctgaccgtcatgactgggaga

SEQ ID NO: 6236 - DNA, 25 bp, Rattus norvegicus
aaacctgaccgtgatgactgggaga

SEQ ID NO: 6237 - DNA, 25 bp, Rattus norvegicus
aaacctgacctgcttggagatgacg

SEQ ID NO: 6238 - DNA, 25 bp, Rattus norvegicus
aaacctgacctggttggagatgacg

SEQ ID NO: 6239 - DNA, 25 bp, Rattus norvegicus
aaacctgactccaatcttctgagga

SEQ ID NO: 6240 - DNA, 25 bp, Rattus norvegicus
aaacctgactcctatcttctgagga

SEQ ID NO: 6241 - DNA, 25 bp, Rattus norvegicus
aaacctgactgcaagcttgggctca

SEQ ID NO: 6242 - DNA, 25 bp, Rattus norvegicus
aaacctgactgctagcttgggctca

SEQ ID NO: 6243 - DNA, 25 bp, Rattus norvegicus
aaacctgactggacgaacccctgtg

SEQ ID NO: 6244 - DNA, 25 bp, Rattus norvegicus
aaacctgactggtcgaacccctgtg

SEQ ID NO: 6245 - DNA, 25 bp, Rattus norvegicus
aaacctgacttccacttcatgacag

SEQ ID NO: 6246 - DNA, 25 bp, Rattus norvegicus
aaacctgacttcgacttcatgacag

SEQ ID NO: 6247 - DNA, 25 bp, Rattus norvegicus
aaacctgactttcagcctgtacaag

SEQ ID NO: 6248 - DNA, 25 bp, Rattus norvegicus
aaacctgactttcgctactggtgac

SEQ ID NO: 6249 - DNA, 25 bp, Rattus norvegicus
aaacctgactttgagcctgtacaag

SEQ ID NO: 6250 - DNA, 25 bp, Rattus norvegicus
aaacctgactttggctactggtgac

SEQ ID NO: 6251 - DNA, 25 bp, Rattus norvegicus
aaacctgagatccacaaatgtcgct

SEQ ID NO: 6252 - DNA, 25 bp, Rattus norvegicus
aaacctgagatcgacaaatgtcgct

SEQ ID NO: 6253 - DNA, 25 bp, Rattus norvegicus
aaacctgagattatcacattcatca

SEQ ID NO: 6254 - DNA, 25 bp, Rattus norvegicus
aaacctgagattcggctgctgatcg

SEQ ID NO: 6255 - DNA, 25 bp, Rattus norvegicus
aaacctgagattgggctgctgatcg

SEQ ID NO: 6256 - DNA, 25 bp, Rattus norvegicus
aaacctgagattttcacattcatca

SEQ ID NO: 6257 - DNA, 25 bp, Rattus norvegicus
aaacctgagcgaagtccctctctga

SEQ ID NO: 6258 - DNA, 25 bp, Rattus norvegicus
aaacctgagcgatgtccctctctga

SEQ ID NO: 6259 - DNA, 25 bp, Rattus norvegicus
aaacctgagtcgaaggagctgcctt

SEQ ID NO: 6260 - DNA, 25 bp, Rattus norvegicus
aaacctgagtcgtaggagctgcctt

SEQ ID NO: 6261 - DNA, 25 bp, Rattus norvegicus
aaacctgatcataagtcgggcttac

SEQ ID NO: 6262 - DNA, 25 bp, Rattus norvegicus
aaacctgatcattagtcgggcttac

SEQ ID NO: 6263 - DNA, 25 bp, Rattus norvegicus
aaacctgatgttcttgtggacactg

SEQ ID NO: 6264 - DNA, 25 bp, Rattus norvegicus
aaacctgatgttgttgtggacactg

SEQ ID NO: 6265 - DNA, 25 bp, Rattus norvegicus
aaacctgcaattaaattctaccaat

SEQ ID NO: 6266 - DNA, 25 bp, Rattus norvegicus
aaacctgcaatttaattctaccaat

SEQ ID NO: 6267 - DNA, 25 bp, Rattus norvegicus
aaacctgcacttagatttgctaata

SEQ ID NO: 6268 - DNA, 25 bp, Rattus norvegicus
aaacctgcactttgatttgctaata

SEQ ID NO: 6269 - DNA, 25 bp, Rattus norvegicus
aaacctgcaggtagtggccggccat

SEQ ID NO: 6270 - DNA, 25 bp, Rattus norvegicus
aaacctgcaggtcccttcaccttgg

SEQ ID NO: 6271 - DNA, 25 bp, Rattus norvegicus
aaacctgcaggtgccttcaccttgg

SEQ ID NO: 6272 - DNA, 25 bp, Rattus norvegicus
aaacctgcaggttgtggccggccat

SEQ ID NO: 6273 - DNA, 25 bp, Rattus norvegicus
aaacctgcatcccaagggccttcgt

SEQ ID NO: 6274 - DNA, 25 bp, Rattus norvegicus
aaacctgcatccgaagggccttcgt

SEQ ID NO: 6275 - DNA, 25 bp, Rattus norvegicus
aaacctgcatggcaaagggtaccat

SEQ ID NO: 6276 - DNA, 25 bp, Rattus norvegicus
aaacctgcatgggaaagggtaccat

SEQ ID NO: 6277 - DNA, 25 bp, Rattus norvegicus
aaacctgcattcatgtcttgttcta

SEQ ID NO: 6278 - DNA, 25 bp, Rattus norvegicus
aaacctgcattcttgtcttgttcta

SEQ ID NO: 6279 - DNA, 25 bp, Rattus norvegicus
aaacctgcattgagacatccgatct

SEQ ID NO: 6280 - DNA, 25 bp, Rattus norvegicus
aaacctgcattgtgacatccgatct

SEQ ID NO: 6281 - DNA, 25 bp, Rattus norvegicus
aaacctgccaacaatgttacctagc

SEQ ID NO: 6282 - DNA, 25 bp, Rattus norvegicus
aaacctgccaactatgttacctagc

SEQ ID NO: 6283 - DNA, 25 bp, Rattus norvegicus
aaacctgccaagaatgatgacatca

SEQ ID NO: 6284 - DNA, 25 bp, Rattus norvegicus
aaacctgccaagctgagctcaagcc

SEQ ID NO: 6285 - DNA, 25 bp, Rattus norvegicus
aaacctgccaaggtgagctcaagcc

SEQ ID NO: 6286 - DNA, 25 bp, Rattus norvegicus
aaacctgccaagtatgatgacatca

SEQ ID NO: 6287 - DNA, 25 bp, Rattus norvegicus
aaacctgccactacctacgtgagga

SEQ ID NO: 6288 - DNA, 25 bp, Rattus norvegicus
aaacctgccacttcctacgtgagga

SEQ ID NO: 6289 - DNA, 25 bp, Rattus norvegicus
aaacctgcccagagaaaatttcgca

SEQ ID NO: 6290 - DNA, 25 bp, Rattus norvegicus
aaacctgcccagtgaaaatttcgca

SEQ ID NO: 6291 - DNA, 25 bp, Rattus norvegicus
aaacctgcctgtaagggtagttcag

SEQ ID NO: 6292 - DNA, 25 bp, Rattus norvegicus
aaacctgcctgtagtcaagtcttta

SEQ ID NO: 6293 - DNA, 25 bp, Rattus norvegicus
aaacctgcctgttagggtagttcag

SEQ ID NO: 6294 - DNA, 25 bp, Rattus norvegicus
aaacctgcctgttgtcaagtcttta

SEQ ID NO: 6295 - DNA, 25 bp, Rattus norvegicus
aaacctgcgggcaggagatctcgga

SEQ ID NO: 6296 - DNA, 25 bp, Rattus norvegicus
aaacctgcgggctggagatctcgga

SEQ ID NO: 6297 - DNA, 25 bp, Rattus norvegicus
aaacctgcgtttctgaacacttgtt

SEQ ID NO: 6298 - DNA, 25 bp, Rattus norvegicus
aaacctgcgtttgtgaacacttgtt

SEQ ID NO: 6299 - DNA, 25 bp, Rattus norvegicus
aaacctgctataatcatcccagtca

SEQ ID NO: 6300 - DNA, 25 bp, Rattus norvegicus
aaacctgctatattcatcccagtca

SEQ ID NO: 6301 - DNA, 25 bp, Rattus norvegicus
aaacctgctcacctgtagagaggct

SEQ ID NO: 6302 - DNA, 25 bp, Rattus norvegicus
aaacctgctcacgtgtagagaggct

SEQ ID NO: 6303 - DNA, 25 bp, Rattus norvegicus
aaacctgctgcacgtgtagatgaca

SEQ ID NO: 6304 - DNA, 25 bp, Rattus norvegicus
aaacctgctgcaggtgtagatgaca

SEQ ID NO: 6305 - DNA, 25 bp, Rattus norvegicus
aaacctggaaggatccacgtgcact

SEQ ID NO: 6306 - DNA, 25 bp, Rattus norvegicus
aaacctggaaggttccacgtgcact

SEQ ID NO: 6307 - DNA, 25 bp, Rattus norvegicus
aaacctggattcatatgtgtaatta

SEQ ID NO: 6308 - DNA, 25 bp, Rattus norvegicus
aaacctggattcttatgtgtaatta

SEQ ID NO: 6309 - DNA, 25 bp, Rattus norvegicus
aaacctggcaacatgagtccaatcc

SEQ ID NO: 6310 - DNA, 25 bp, Rattus norvegicus
aaacctggcaacttgagtccaatcc

SEQ ID NO: 6311 - DNA, 25 bp, Rattus norvegicus
aaacctggcagcaatagaatacact

SEQ ID NO: 6312 - DNA, 25 bp, Rattus norvegicus
aaacctggcagctatagaatacact

SEQ ID NO: 6313 - DNA, 25 bp, Rattus norvegicus
aaacctggcgatcaccacagcaatg

SEQ ID NO: 6314 - DNA, 25 bp, Rattus norvegicus
aaacctggcgatgaccacagcaatg

SEQ ID NO: 6315 - DNA, 25 bp, Rattus norvegicus
aaacctggcttgacttagtgagtga

SEQ ID NO: 6316 - DNA, 25 bp, Rattus norvegicus
aaacctggcttgtcttagtgagtga

SEQ ID NO: 6317 - DNA, 25 bp, Rattus norvegicus
aaacctgggacacatgctggtggca

SEQ ID NO: 6318 - DNA, 25 bp, Rattus norvegicus
aaacctgggacagatgctggtggca

SEQ ID NO: 6319 - DNA, 25 bp, Rattus norvegicus
aaacctgggcaacaagccaactgag

SEQ ID NO: 6320 - DNA, 25 bp, Rattus norvegicus
aaacctgggcaagaagccaactgag

SEQ ID NO: 6321 - DNA, 25 bp, Rattus norvegicus
aaacctgggccacagagtgaacatt

SEQ ID NO: 6322 - DNA, 25 bp, Rattus norvegicus
aaacctgggccagagagtgaacatt

SEQ ID NO: 6323 - DNA, 25 bp, Rattus norvegicus
aaacctgggctgcagtgattaagag

SEQ ID NO: 6324 - DNA, 25 bp, Rattus norvegicus
aaacctgggctggagtgattaagag

SEQ ID NO: 6325 - DNA, 25 bp, Rattus norvegicus
aaacctgggtaaaggtggcgcctgc

SEQ ID NO: 6326 - DNA, 25 bp, Rattus norvegicus
aaacctgggtaacagctgccttcac

SEQ ID NO: 6327 - DNA, 25 bp, Rattus norvegicus
aaacctgggtaagagctgccttcac

SEQ ID NO: 6328 - DNA, 25 bp, Rattus norvegicus
aaacctgggtaatggtggcgcctgc

SEQ ID NO: 6329 - DNA, 25 bp, Rattus norvegicus
aaacctgtacaaattgccctgggag

SEQ ID NO: 6330 - DNA, 25 bp, Rattus norvegicus
aaacctgtacaatttgccctgggag

SEQ ID NO: 6331 - DNA, 25 bp, Rattus norvegicus
aaacctgtacagaggtgactactac

SEQ ID NO: 6332 - DNA, 25 bp, Rattus norvegicus
aaacctgtacagtggtgactactac

SEQ ID NO: 6333 - DNA, 25 bp, Rattus norvegicus
aaacctgtatatcatctctgtgaag

SEQ ID NO: 6334 - DNA, 25 bp, Rattus norvegicus
aaacctgtatatgatctctgtgaag

SEQ ID NO: 6335 - DNA, 25 bp, Rattus norvegicus
aaacctgtatgtcggtgtgcaagcc

SEQ ID NO: 6336 - DNA, 25 bp, Rattus norvegicus
aaacctgtatgtgggtgtgcaagcc

SEQ ID NO: 6337 - DNA, 25 bp, Rattus norvegicus
aaacctgtcactactgcatttacta

SEQ ID NO: 6338 - DNA, 25 bp, Rattus norvegicus
aaacctgtcacttctgcatttacta

SEQ ID NO: 6339 - DNA, 25 bp, Rattus norvegicus
aaacctgtcagtcatgggactccga

SEQ ID NO: 6340 - DNA, 25 bp, Rattus norvegicus
aaacctgtcagtgatgggactccga

SEQ ID NO: 6341 - DNA, 25 bp, Rattus norvegicus
aaacctgtccctcagaatggcccag

SEQ ID NO: 6342 - DNA, 25 bp, Rattus norvegicus
aaacctgtccctgagaatggcccag

SEQ ID NO: 6343 - DNA, 25 bp, Rattus norvegicus
aaacctgtcctcaacaagctgactg

SEQ ID NO: 6344 - DNA, 25 bp, Rattus norvegicus
aaacctgtcctctacaagctgactg

SEQ ID NO: 6345 - DNA, 25 bp, Rattus norvegicus
aaacctgtccttcggcatgaaatca

SEQ ID NO: 6346 - DNA, 25 bp, Rattus norvegicus
aaacctgtccttgggcatgaaatca

SEQ ID NO: 6347 - DNA, 25 bp, Rattus norvegicus
aaacctgtcgtaaaagctgctgccc

SEQ ID NO: 6348 - DNA, 25 bp, Rattus norvegicus
aaacctgtcgtataagctgctgccc

SEQ ID NO: 6349 - DNA, 25 bp, Rattus norvegicus
aaacctgtctccatcattcaagtgg

SEQ ID NO: 6350 - DNA, 25 bp, Rattus norvegicus
aaacctgtctccttcattcaagtgg

SEQ ID NO: 6351 - DNA, 25 bp, Rattus norvegicus
aaacctgtctgcaatgtttgggcat

SEQ ID NO: 6352 - DNA, 25 bp, Rattus norvegicus
aaacctgtctgctatgtttgggcat

SEQ ID NO: 6353 - DNA, 25 bp, Rattus norvegicus
aaacctgtcttgaaaagccaagcca

SEQ ID NO: 6354 - DNA, 25 bp, Rattus norvegicus
aaacctgtcttgtaaagccaagcca

SEQ ID NO: 6355 - DNA, 25 bp, Rattus norvegicus
aaacctgtgagcaactgttggctgc

SEQ ID NO: 6356 - DNA, 25 bp, Rattus norvegicus
aaacctgtgagctactgttggctgc

SEQ ID NO: 6357 - DNA, 25 bp, Rattus norvegicus
aaacctgtgcacagcgggttctgac

SEQ ID NO: 6358 - DNA, 25 bp, Rattus norvegicus
aaacctgtgcactgcgggttctgac

SEQ ID NO: 6359 - DNA, 25 bp, Rattus norvegicus
aaacctgtgcatccaaagaccttta

SEQ ID NO: 6360 - DNA, 25 bp, Rattus norvegicus
aaacctgtgcatgcaaagaccttta

SEQ ID NO: 6361 - DNA, 25 bp, Rattus norvegicus
aaacctgtgcgactaactgtgctca

SEQ ID NO: 6362 - DNA, 25 bp, Rattus norvegicus
aaacctgtgcgagtaactgtgctca

SEQ ID NO: 6363 - DNA, 25 bp, Rattus norvegicus
aaacctgtggcccaaagtcagccta

SEQ ID NO: 6364 - DNA, 25 bp, Rattus norvegicus
aaacctgtggccgaaagtcagccta

SEQ ID NO: 6365 - DNA, 25 bp, Rattus norvegicus
aaacctgtggtaatattctctatgg

SEQ ID NO: 6366 - DNA, 25 bp, Rattus norvegicus
aaacctgtggtattattctctatgg

SEQ ID NO: 6367 - DNA, 25 bp, Rattus norvegicus
aaacctgtgttcctggctactaaga

SEQ ID NO: 6368 - DNA, 25 bp, Rattus norvegicus
aaacctgtgttcgtggctactaaga

SEQ ID NO: 6369 - DNA, 25 bp, Rattus norvegicus
aaacctgttataattgtgtttcttg

SEQ ID NO: 6370 - DNA, 25 bp, Rattus norvegicus
aaacctgttatatttgtgtttcttg

SEQ ID NO: 6371 - DNA, 25 bp, Rattus norvegicus
aaacctgttattactctggagctga

SEQ ID NO: 6372 - DNA, 25 bp, Rattus norvegicus
aaacctgttattcaaggcttgtgta

SEQ ID NO: 6373 - DNA, 25 bp, Rattus norvegicus
aaacctgttattgaaggcttgtgta

SEQ ID NO: 6374 - DNA, 25 bp, Rattus norvegicus
aaacctgttatttctctggagctga

SEQ ID NO: 6375 - DNA, 25 bp, Rattus norvegicus
aaacctgttctcaaagctcctgtga

SEQ ID NO: 6376 - DNA, 25 bp, Rattus norvegicus
aaacctgttctctaagctcctgtga

SEQ ID NO: 6377 - DNA, 25 bp, Rattus norvegicus
aaacctgttcttaatgatgtctgac

SEQ ID NO: 6378 - DNA, 25 bp, Rattus norvegicus
aaacctgttctttatgatgtctgac

SEQ ID NO: 6379 - DNA, 25 bp, Rattus norvegicus
aaacctgttgaaactgatgcgtgac

SEQ ID NO: 6380 - DNA, 25 bp, Rattus norvegicus
aaacctgttgaatctgatgcgtgac

SEQ ID NO: 6381 - DNA, 25 bp, Rattus norvegicus
aaacctgtttgacccattttgaatg

SEQ ID NO: 6382 - DNA, 25 bp, Rattus norvegicus
aaacctgtttgagccattttgaatg

SEQ ID NO: 6383 - DNA, 25 bp, Rattus norvegicus
aaacctgtttgtacttctgcaccag

SEQ ID NO: 6384 - DNA, 25 bp, Rattus norvegicus
aaacctgtttgttcttctgcaccag

SEQ ID NO: 6385 - DNA, 25 bp, Rattus norvegicus
aaacctgttttacgccctatgcaca

SEQ ID NO: 6386 - DNA, 25 bp, Rattus norvegicus
aaacctgttttaggccctatgcaca

SEQ ID NO: 6387 - DNA, 25 bp, Rattus norvegicus
aaaccttacaggacactgccagaga

SEQ ID NO: 6388 - DNA, 25 bp, Rattus norvegicus
aaaccttacaggtcactgccagaga

SEQ ID NO: 6389 - DNA, 25 bp, Rattus norvegicus
aaaccttacgacagcagcgaatgtg

SEQ ID NO: 6390 - DNA, 25 bp, Rattus norvegicus
aaaccttacgactgcagcgaatgtg

SEQ ID NO: 6391 - DNA, 25 bp, Rattus norvegicus
aaaccttactccatagatgttcggg

SEQ ID NO: 6392 - DNA, 25 bp, Rattus norvegicus
aaaccttactccattgactttgcca

SEQ ID NO: 6393 - DNA, 25 bp, Rattus norvegicus
aaaccttactccttagatgttcggg

SEQ ID NO: 6394 - DNA, 25 bp, Rattus norvegicus
aaaccttactcctttgactttgcca

SEQ ID NO: 6395 - DNA, 25 bp, Rattus norvegicus
aaaccttagttacactcacacccag

SEQ ID NO: 6396 - DNA, 25 bp, Rattus norvegicus
aaaccttagttagactcacacccag

SEQ ID NO: 6397 - DNA, 25 bp, Rattus norvegicus
aaaccttatttcctgtgatacgtgc

SEQ ID NO: 6398 - DNA, 25 bp, Rattus norvegicus
aaaccttatttcgtgtgatacgtgc

SEQ ID NO: 6399 - DNA, 25 bp, Rattus norvegicus
aaaccttcaggtattgttgcttgag

SEQ ID NO: 6400 - DNA, 25 bp, Rattus norvegicus
aaaccttcaggttttgttgcttgag

SEQ ID NO: 6401 - DNA, 25 bp, Rattus norvegicus
aaaccttcatacagacacaactgag

SEQ ID NO: 6402 - DNA, 25 bp, Rattus norvegicus
aaaccttcatactgacacaactgag

SEQ ID NO: 6403 - DNA, 25 bp, Rattus norvegicus
aaaccttcatatcgttgaactaatg

SEQ ID NO: 6404 - DNA, 25 bp, Rattus norvegicus
aaaccttcatatggttgaactaatg

SEQ ID NO: 6405 - DNA, 25 bp, Rattus norvegicus
aaaccttcatgtctcagtggctaat

SEQ ID NO: 6406 - DNA, 25 bp, Rattus norvegicus
aaaccttcatgtgtcagtggctaat

SEQ ID NO: 6407 - DNA, 25 bp, Rattus norvegicus
aaaccttccacacagtcacttaaat

SEQ ID NO: 6408 - DNA, 25 bp, Rattus norvegicus
aaaccttccacagagtcacttaaat

SEQ ID NO: 6409 - DNA, 25 bp, Rattus norvegicus
aaaccttccagtcacctatcttggt

SEQ ID NO: 6410 - DNA, 25 bp, Rattus norvegicus
aaaccttccagtgacctatcttggt

SEQ ID NO: 6411 - DNA, 25 bp, Rattus norvegicus
aaaccttccggactctgatgccaga

SEQ ID NO: 6412 - DNA, 25 bp, Rattus norvegicus
aaaccttccggagtctgatgccaga

SEQ ID NO: 6413 - DNA, 25 bp, Rattus norvegicus
aaaccttcgtgcacggctcgggaga

SEQ ID NO: 6414 - DNA, 25 bp, Rattus norvegicus
aaaccttcgtgctcggctcgggaga

SEQ ID NO: 6415 - DNA, 25 bp, Rattus norvegicus
aaaccttctgacacttattagctaa

SEQ ID NO: 6416 - DNA, 25 bp, Rattus norvegicus
aaaccttctgactcttattagctaa

SEQ ID NO: 6417 - DNA, 25 bp, Rattus norvegicus
aaaccttctgcacgctgtggaaacc

SEQ ID NO: 6418 - DNA, 25 bp, Rattus norvegicus
aaaccttctgcaggctgtggaaacc

SEQ ID NO: 6419 - DNA, 25 bp, Rattus norvegicus
aaaccttctgccaatggcctgggaa

SEQ ID NO: 6420 - DNA, 25 bp, Rattus norvegicus
aaaccttctgcctatggcctgggaa

SEQ ID NO: 6421 - DNA, 25 bp, Rattus norvegicus
aaaccttcttttctctaagtgccag

SEQ ID NO: 6422 - DNA, 25 bp, Rattus norvegicus
aaaccttcttttgtctaagtgccag

SEQ ID NO: 6423 - DNA, 25 bp, Rattus norvegicus
aaaccttgaagccatcaggaggcat

SEQ ID NO: 6424 - DNA, 25 bp, Rattus norvegicus
aaaccttgaagcgatcaggaggcat

SEQ ID NO: 6425 - DNA, 25 bp, Rattus norvegicus
aaaccttgaccacgacatcaacaag

SEQ ID NO: 6426 - DNA, 25 bp, Rattus norvegicus
aaaccttgaccaggacatcaacaag

SEQ ID NO: 6427 - DNA, 25 bp, Rattus norvegicus
aaaccttgacccagatgtggcccag

SEQ ID NO: 6428 - DNA, 25 bp, Rattus norvegicus
aaaccttgaccctgatgtggcccag

SEQ ID NO: 6429 - DNA, 25 bp, Rattus norvegicus
aaaccttgagaaaaattctgcaggg

SEQ ID NO: 6430 - DNA, 25 bp, Rattus norvegicus
aaaccttgagaataattctgcaggg

SEQ ID NO: 6431 - DNA, 25 bp, Rattus norvegicus
aaaccttgagttctgggttgcctgt

SEQ ID NO: 6432 - DNA, 25 bp, Rattus norvegicus
aaaccttgagttgtgggttgcctgt

SEQ ID NO: 6433 - DNA, 25 bp, Rattus norvegicus
aaaccttgatttctgctgtgctttg

SEQ ID NO: 6434 - DNA, 25 bp, Rattus norvegicus
aaaccttgatttgtgctgtgctttg

SEQ ID NO: 6435 - DNA, 25 bp, Rattus norvegicus
aaaccttgcacacattttttcagaa

SEQ ID NO: 6436 - DNA, 25 bp, Rattus norvegicus
aaaccttgcacagattttttcagaa

SEQ ID NO: 6437 - DNA, 25 bp, Rattus norvegicus
aaaccttgcagccttatcttcagat

SEQ ID NO: 6438 - DNA, 25 bp, Rattus norvegicus
aaaccttgcagcgttatcttcagat

SEQ ID NO: 6439 - DNA, 25 bp, Rattus norvegicus
aaaccttgcagtatgagagctggca

SEQ ID NO: 6440 - DNA, 25 bp, Rattus norvegicus
aaaccttgcagtttgagagctggca

SEQ ID NO: 6441 - DNA, 25 bp, Rattus norvegicus
aaaccttgcatgcaagcctagtgta

SEQ ID NO: 6442 - DNA, 25 bp, Rattus norvegicus
aaaccttgcatggaagcctagtgta

SEQ ID NO: 6443 - DNA, 25 bp, Rattus norvegicus
aaaccttgctttcgccatagggtct

SEQ ID NO: 6444 - DNA, 25 bp, Rattus norvegicus
aaaccttgctttggccatagggtct

SEQ ID NO: 6445 - DNA, 25 bp, Rattus norvegicus
aaaccttggccacgctaagtggtca

SEQ ID NO: 6446 - DNA, 25 bp, Rattus norvegicus
aaaccttggccaggctaagtggtca

SEQ ID NO: 6447 - DNA, 25 bp, Rattus norvegicus
aaaccttggcgtagactatgtgacc

SEQ ID NO: 6448 - DNA, 25 bp, Rattus norvegicus
aaaccttggcgttgactatgtgacc

SEQ ID NO: 6449 - DNA, 25 bp, Rattus norvegicus
aaaccttggctgcaagtggcacagt

SEQ ID NO: 6450 - DNA, 25 bp, Rattus norvegicus
aaaccttggctggaagtggcacagt

SEQ ID NO: 6451 - DNA, 25 bp, Rattus norvegicus
aaaccttggcttaatcttctgtgaa

SEQ ID NO: 6452 - DNA, 25 bp, Rattus norvegicus
aaaccttggctttatcttctgtgaa

SEQ ID NO: 6453 - DNA, 25 bp, Rattus norvegicus
aaaccttgtaagcaagccatgtagc

SEQ ID NO: 6454 - DNA, 25 bp, Rattus norvegicus
aaaccttgtaaggaagccatgtagc

SEQ ID NO: 6455 - DNA, 25 bp, Rattus norvegicus
aaaccttgtatgattgtcacctgtg

SEQ ID NO: 6456 - DNA, 25 bp, Rattus norvegicus
aaaccttgtatgtttgtcacctgtg

SEQ ID NO: 6457 - DNA, 25 bp, Rattus norvegicus
aaaccttgtctcatgaaataatcga

SEQ ID NO: 6458 - DNA, 25 bp, Rattus norvegicus
aaaccttgtctcttgaaataatcga

SEQ ID NO: 6459 - DNA, 25 bp, Rattus norvegicus
aaaccttgtcttaatgcatactctg

SEQ ID NO: 6460 - DNA, 25 bp, Rattus norvegicus
aaaccttgtctttatgcatactctg

SEQ ID NO: 6461 - DNA, 25 bp, Rattus norvegicus
aaaccttgtgaacaatccagggtca

SEQ ID NO: 6462 - DNA, 25 bp, Rattus norvegicus
aaaccttgtgaagaatccagggtca

SEQ ID NO: 6463 - DNA, 25 bp, Rattus norvegicus
aaaccttgtgcaacaatttaaatgt

SEQ ID NO: 6464 - DNA, 25 bp, Rattus norvegicus
aaaccttgtgcatcaatttaaatgt

SEQ ID NO: 6465 - DNA, 25 bp, Rattus norvegicus
aaaccttgtgccagtagctttgtgc

SEQ ID NO: 6466 - DNA, 25 bp, Rattus norvegicus
aaaccttgtgcctgtagctttgtgc

SEQ ID NO: 6467 - DNA, 25 bp, Rattus norvegicus
aaaccttgttccctaccattgtcat

SEQ ID NO: 6468 - DNA, 25 bp, Rattus norvegicus
aaaccttgttccgtaccattgtcat

SEQ ID NO: 6469 - DNA, 25 bp, Rattus norvegicus
aaaccttgtttgagagcacgctggg

SEQ ID NO: 6470 - DNA, 25 bp, Rattus norvegicus
aaaccttgtttgtgagcacgctggg

SEQ ID NO: 6471 - DNA, 25 bp, Rattus norvegicus
aaacctttaaatccctgagtgcaga

SEQ ID NO: 6472 - DNA, 25 bp, Rattus norvegicus
aaacctttaaatgcctgagtgcaga

SEQ ID NO: 6473 - DNA, 25 bp, Rattus norvegicus
aaacctttatgaagtctctacccac

SEQ ID NO: 6474 - DNA, 25 bp, Rattus norvegicus
aaacctttatgatgtctctacccac

SEQ ID NO: 6475 - DNA, 25 bp, Rattus norvegicus
aaacctttcactcttagggctccag

SEQ ID NO: 6476 - DNA, 25 bp, Rattus norvegicus
aaacctttcactgttagggctccag

SEQ ID NO: 6477 - DNA, 25 bp, Rattus norvegicus
aaacctttctcaataagcatttcag

SEQ ID NO: 6478 - DNA, 25 bp, Rattus norvegicus
aaacctttctcattaagcatttcag

SEQ ID NO: 6479 - DNA, 25 bp, Rattus norvegicus
aaacctttgaccagtgtcttccaag

SEQ ID NO: 6480 - DNA, 25 bp, Rattus norvegicus
aaacctttgacctgtgtcttccaag

SEQ ID NO: 6481 - DNA, 25 bp, Rattus norvegicus
aaacctttgacgatcgcttctgaga

SEQ ID NO: 6482 - DNA, 25 bp, Rattus norvegicus
aaacctttgacgttcgcttctgaga

SEQ ID NO: 6483 - DNA, 25 bp, Rattus norvegicus
aaacctttgagtactgtgcccttca

SEQ ID NO: 6484 - DNA, 25 bp, Rattus norvegicus
aaacctttgagttctgtgcccttca

SEQ ID NO: 6485 - DNA, 25 bp, Rattus norvegicus
aaacctttgattagtactccgcctg

SEQ ID NO: 6486 - DNA, 25 bp, Rattus norvegicus
aaacctttgatttgtactccgcctg

SEQ ID NO: 6487 - DNA, 25 bp, Rattus norvegicus
aaacctttgcacatctcatttagac

SEQ ID NO: 6488 - DNA, 25 bp, Rattus norvegicus
aaacctttgcacttctcatttagac

SEQ ID NO: 6489 - DNA, 25 bp, Rattus norvegicus
aaacctttggttcccactcagaagc

SEQ ID NO: 6490 - DNA, 25 bp, Rattus norvegicus
aaacctttggttgccactcagaagc

SEQ ID NO: 6491 - DNA, 25 bp, Rattus norvegicus
aaacctttgtgcctaaatacaactg

SEQ ID NO: 6492 - DNA, 25 bp, Rattus norvegicus
aaacctttgtgcgtaaatacaactg

SEQ ID NO: 6493 - DNA, 25 bp, Rattus norvegicus
aaaccttttcctcgcctgaatgaga

SEQ ID NO: 6494 - DNA, 25 bp, Rattus norvegicus
aaaccttttcctggcctgaatgaga

SEQ ID NO: 6495 - DNA, 25 bp, Rattus norvegicus
aaaccttttctcctctatgtggatg

SEQ ID NO: 6496 - DNA, 25 bp, Rattus norvegicus
aaaccttttctcgtctatgtggatg

SEQ ID NO: 6497 - DNA, 25 bp, Rattus norvegicus
aaaccttttcttactgcagcctgta

SEQ ID NO: 6498 - DNA, 25 bp, Rattus norvegicus
aaaccttttcttcgctggctttcat

SEQ ID NO: 6499 - DNA, 25 bp, Rattus norvegicus
aaaccttttcttggctggctttcat

SEQ ID NO: 6500 - DNA, 25 bp, Rattus norvegicus
aaaccttttctttctgcagcctgta

SEQ ID NO: 6501 - DNA, 25 bp, Rattus norvegicus
aaaccttttttcactgtcattgaag

SEQ ID NO: 6502 - DNA, 25 bp, Rattus norvegicus
aaaccttttttctctgtcattgaag

SEQ ID NO: 6503 - DNA, 25 bp, Rattus norvegicus
aaacgaaacctcatgactccatgga

SEQ ID NO: 6504 - DNA, 25 bp, Rattus norvegicus
aaacgaaacctcttgactccatgga

SEQ ID NO: 6505 - DNA, 25 bp, Rattus norvegicus
aaacgaaacttcagtctctaccctg

SEQ ID NO: 6506 - DNA, 25 bp, Rattus norvegicus
aaacgaaacttctgtctctaccctg

SEQ ID NO: 6507 - DNA, 25 bp, Rattus norvegicus
aaacgaacatttatcctggagtgga

SEQ ID NO: 6508 - DNA, 25 bp, Rattus norvegicus
aaacgaacatttttcctggagtgga

SEQ ID NO: 6509 - DNA, 25 bp, Rattus norvegicus
aaacgaaccctgctgtaggcattta

SEQ ID NO: 6510 - DNA, 25 bp, Rattus norvegicus
aaacgaaccctggtgtaggcattta

SEQ ID NO: 6511 - DNA, 25 bp, Rattus norvegicus
aaacgaactccactgctcctgagga

SEQ ID NO: 6512 - DNA, 25 bp, Rattus norvegicus
aaacgaactccagtgctcctgagga

SEQ ID NO: 6513 - DNA, 25 bp, Rattus norvegicus
aaacgaactctgaaagcgtgttgga

SEQ ID NO: 6514 - DNA, 25 bp, Rattus norvegicus
aaacgaactctgtaagcgtgttgga

SEQ ID NO: 6515 - DNA, 25 bp, Rattus norvegicus
aaacgaagttctaagctcacaagtg

SEQ ID NO: 6516 - DNA, 25 bp, Rattus norvegicus
aaacgaagttcttagctcacaagtg

SEQ ID NO: 6517 - DNA, 25 bp, Rattus norvegicus
aaacgaatatctattggtcaggaag

SEQ ID NO: 6518 - DNA, 25 bp, Rattus norvegicus
aaacgaatatcttttggtcaggaag

SEQ ID NO: 6519 - DNA, 25 bp, Rattus norvegicus
aaacgacaacccagactcgaggaga

SEQ ID NO: 6520 - DNA, 25 bp, Rattus norvegicus
aaacgacaaccctgactcgaggaga

SEQ ID NO: 6521 - DNA, 25 bp, Rattus norvegicus
aaacgacacaccacatagccaaaga

SEQ ID NO: 6522 - DNA, 25 bp, Rattus norvegicus
aaacgacacacctcatagccaaaga

SEQ ID NO: 6523 - DNA, 25 bp, Rattus norvegicus
aaacgacactgaatggtgctagaga

SEQ ID NO: 6524 - DNA, 25 bp, Rattus norvegicus
aaacgacactgattggtgctagaga

SEQ ID NO: 6525 - DNA, 25 bp, Rattus norvegicus
aaacgacagctgagggaccgtacac

SEQ ID NO: 6526 - DNA, 25 bp, Rattus norvegicus
aaacgacagctgtgggaccgtacac

SEQ ID NO: 6527 - DNA, 25 bp, Rattus norvegicus
aaacgacctgttctgtcacttgtag

SEQ ID NO: 6528 - DNA, 25 bp, Rattus norvegicus
aaacgacctgttgtgtcacttgtag

SEQ ID NO: 6529 - DNA, 25 bp, Rattus norvegicus
aaacgacgtaaacacgcctgtccag

SEQ ID NO: 6530 - DNA, 25 bp, Rattus norvegicus
aaacgacgtaaagacgcctgtccag

SEQ ID NO: 6531 - DNA, 25 bp, Rattus norvegicus
aaacgactaaagcacatacagagaa

SEQ ID NO: 6532 - DNA, 25 bp, Rattus norvegicus
aaacgactaaaggacatacagagaa

SEQ ID NO: 6533 - DNA, 25 bp, Rattus norvegicus
aaacgactcatgatttgcccatacc

SEQ ID NO: 6534 - DNA, 25 bp, Rattus norvegicus
aaacgactcatgttttgcccatacc

SEQ ID NO: 6535 - DNA, 25 bp, Rattus norvegicus
aaacgactctggcttgagcgtggaa

SEQ ID NO: 6536 - DNA, 25 bp, Rattus norvegicus
aaacgactctgggttgagcgtggaa

SEQ ID NO: 6537 - DNA, 25 bp, Rattus norvegicus
aaacgactctgtagagctctctgca

SEQ ID NO: 6538 - DNA, 25 bp, Rattus norvegicus
aaacgactctgttgagctctctgca

SEQ ID NO: 6539 - DNA, 25 bp, Rattus norvegicus
aaacgactgcagaacatccagcgca

SEQ ID NO: 6540 - DNA, 25 bp, Rattus norvegicus
aaacgactgcagtacatccagcgca

SEQ ID NO: 6541 - DNA, 25 bp, Rattus norvegicus
aaacgagaagagactgttcctccct

SEQ ID NO: 6542 - DNA, 25 bp, Rattus norvegicus
aaacgagaagagtctgttcctccct

SEQ ID NO: 6543 - DNA, 25 bp, Rattus norvegicus
aaacgagaatgaccgctgtgtcccc

SEQ ID NO: 6544 - DNA, 25 bp, Rattus norvegicus
aaacgagaatgagcgctgtgtcccc

SEQ ID NO: 6545 - DNA, 25 bp, Rattus norvegicus
aaacgagacaatcagggtatggctt

SEQ ID NO: 6546 - DNA, 25 bp, Rattus norvegicus
aaacgagacaatgagggtatggctt

SEQ ID NO: 6547 - DNA, 25 bp, Rattus norvegicus
aaacgagacatcatgctagtataaa

SEQ ID NO: 6548 - DNA, 25 bp, Rattus norvegicus
aaacgagacatcttgctagtataaa

SEQ ID NO: 6549 - DNA, 25 bp, Rattus norvegicus
aaacgagagggcctggcctccctag

SEQ ID NO: 6550 - DNA, 25 bp, Rattus norvegicus
aaacgagagggcgtggcctccctag

SEQ ID NO: 6551 - DNA, 25 bp, Rattus norvegicus
aaacgagatggcaaggctccggcag

SEQ ID NO: 6552 - DNA, 25 bp, Rattus norvegicus
aaacgagatggcactttcctggtcc

SEQ ID NO: 6553 - DNA, 25 bp, Rattus norvegicus
aaacgagatggctaggctccggcag

SEQ ID NO: 6554 - DNA, 25 bp, Rattus norvegicus
aaacgagatggctctttcctggtcc

SEQ ID NO: 6555 - DNA, 25 bp, Rattus norvegicus
aaacgagcactgaggcaagcaccca

SEQ ID NO: 6556 - DNA, 25 bp, Rattus norvegicus
aaacgagcactgtggcaagcaccca

SEQ ID NO: 6557 - DNA, 25 bp, Rattus norvegicus
aaacgagctgtgcttgcaaggactt

SEQ ID NO: 6558 - DNA, 25 bp, Rattus norvegicus
aaacgagctgtggttgcaaggactt

SEQ ID NO: 6559 - DNA, 25 bp, Rattus norvegicus
aaacgagcttgtaagtacatggata

SEQ ID NO: 6560 - DNA, 25 bp, Rattus norvegicus
aaacgagcttgttagtacatggata

SEQ ID NO: 6561 - DNA, 25 bp, Rattus norvegicus
aaacgaggacatcgagtgaaccctt

SEQ ID NO: 6562 - DNA, 25 bp, Rattus norvegicus
aaacgaggacatggagtgaaccctt

SEQ ID NO: 6563 - DNA, 25 bp, Rattus norvegicus
aaacgaggcctcattctgtgtactg

SEQ ID NO: 6564 - DNA, 25 bp, Rattus norvegicus
aaacgaggcctctttctgtgtactg

SEQ ID NO: 6565 - DNA, 25 bp, Rattus norvegicus
aaacgaggctggctttcagcaccca

SEQ ID NO: 6566 - DNA, 25 bp, Rattus norvegicus
aaacgaggctgggtttcagcaccca

SEQ ID NO: 6567 - DNA, 25 bp, Rattus norvegicus
aaacgaggtcctaaatgtcttctga

SEQ ID NO: 6568 - DNA, 25 bp, Rattus norvegicus
aaacgaggtccttaatgtcttctga

SEQ ID NO: 6569 - DNA, 25 bp, Rattus norvegicus
aaacgaggtggccacttctgtgaaa

SEQ ID NO: 6570 - DNA, 25 bp, Rattus norvegicus
aaacgaggtggcgacttctgtgaaa

SEQ ID NO: 6571 - DNA, 25 bp, Rattus norvegicus
aaacgagtagggatcatggagcagc

SEQ ID NO: 6572 - DNA, 25 bp, Rattus norvegicus
aaacgagtagggttcatggagcagc

SEQ ID NO: 6573 - DNA, 25 bp, Rattus norvegicus
aaacgagtctgccaaacattaggtg

SEQ ID NO: 6574 - DNA, 25 bp, Rattus norvegicus
aaacgagtctgcgaaacattaggtg

SEQ ID NO: 6575 - DNA, 25 bp, Rattus norvegicus
aaacgatacattacctgtggtcatt

SEQ ID NO: 6576 - DNA, 25 bp, Rattus norvegicus
aaacgatacatttcctgtggtcatt

SEQ ID NO: 6577 - DNA, 25 bp, Rattus norvegicus
aaacgatcttgtcctggaactgaac

SEQ ID NO: 6578 - DNA, 25 bp, Rattus norvegicus
aaacgatcttgtgctggaactgaac

SEQ ID NO: 6579 - DNA, 25 bp, Rattus norvegicus
aaacgatgacttcggtctgcacacc

SEQ ID NO: 6580 - DNA, 25 bp, Rattus norvegicus
aaacgatgacttgggtctgcacacc

SEQ ID NO: 6581 - DNA, 25 bp, Rattus norvegicus
aaacgatggtgccagtactgtccaa

SEQ ID NO: 6582 - DNA, 25 bp, Rattus norvegicus
aaacgatggtgcgagtactgtccaa

SEQ ID NO: 6583 - DNA, 25 bp, Rattus norvegicus
aaacgattccctcgctatgactctg

SEQ ID NO: 6584 - DNA, 25 bp, Rattus norvegicus
aaacgattccctggctatgactctg

SEQ ID NO: 6585 - DNA, 25 bp, Rattus norvegicus
aaacgattctccaatgacggcaggt

SEQ ID NO: 6586 - DNA, 25 bp, Rattus norvegicus
aaacgattctcctatgacggcaggt

SEQ ID NO: 6587 - DNA, 25 bp, Rattus norvegicus
aaacgattttcacctgggccaggct

SEQ ID NO: 6588 - DNA, 25 bp, Rattus norvegicus
aaacgattttcagctgggccaggct

SEQ ID NO: 6589 - DNA, 25 bp, Rattus norvegicus
aaacgcaagattctcccacgagcgc

SEQ ID NO: 6590 - DNA, 25 bp, Rattus norvegicus
aaacgcaagattgtcccacgagcgc

SEQ ID NO: 6591 - DNA, 25 bp, Rattus norvegicus
aaacgcaagcagagagccgccatct

SEQ ID NO: 6592 - DNA, 25 bp, Rattus norvegicus
aaacgcaagcagtgagccgccatct

SEQ ID NO: 6593 - DNA, 25 bp, Rattus norvegicus
aaacgcaagcgtctcagatgaggta

SEQ ID NO: 6594 - DNA, 25 bp, Rattus norvegicus
aaacgcaagcgtgtcagatgaggta

SEQ ID NO: 6595 - DNA, 25 bp, Rattus norvegicus
aaacgcaagcttacattttgatcaa

SEQ ID NO: 6596 - DNA, 25 bp, Rattus norvegicus
aaacgcaagctttcattttgatcaa

SEQ ID NO: 6597 - DNA, 25 bp, Rattus norvegicus
aaacgcacagatctctggtcagtct

SEQ ID NO: 6598 - DNA, 25 bp, Rattus norvegicus
aaacgcacagatgtctggtcagtct

SEQ ID NO: 6599 - DNA, 25 bp, Rattus norvegicus
aaacgcacagtcagttctgcagcag

SEQ ID NO: 6600 - DNA, 25 bp, Rattus norvegicus
aaacgcacagtctgttctgcagcag

SEQ ID NO: 6601 - DNA, 25 bp, Rattus norvegicus
aaacgcaccaatcagtgctctctgt

SEQ ID NO: 6602 - DNA, 25 bp, Rattus norvegicus
aaacgcaccaatgagtgctctctgt

SEQ ID NO: 6603 - DNA, 25 bp, Rattus norvegicus
aaacgcactaagacgtctccaagtt

SEQ ID NO: 6604 - DNA, 25 bp, Rattus norvegicus
aaacgcactaagtcgtctccaagtt

SEQ ID NO: 6605 - DNA, 25 bp, Rattus norvegicus
aaacgcacttcgattctgtgggaga

SEQ ID NO: 6606 - DNA, 25 bp, Rattus norvegicus
aaacgcacttcgtttctgtgggaga

SEQ ID NO: 6607 - DNA, 25 bp, Rattus norvegicus
aaacgcagccagacagtctcctgag

SEQ ID NO: 6608 - DNA, 25 bp, Rattus norvegicus
aaacgcagccagagtcttaaccatt

SEQ ID NO: 6609 - DNA, 25 bp, Rattus norvegicus
aaacgcagccagtcagtctcctgag

SEQ ID NO: 6610 - DNA, 25 bp, Rattus norvegicus
aaacgcagccagtgtcttaaccatt

SEQ ID NO: 6611 - DNA, 25 bp, Rattus norvegicus
aaacgcagcctaatgtggagatcct

SEQ ID NO: 6612 - DNA, 25 bp, Rattus norvegicus
aaacgcagcctattgtggagatcct

SEQ ID NO: 6613 - DNA, 25 bp, Rattus norvegicus
aaacgcagcctcagtacgtggcctt

SEQ ID NO: 6614 - DNA, 25 bp, Rattus norvegicus
aaacgcagcctctgtacgtggcctt

SEQ ID NO: 6615 - DNA, 25 bp, Rattus norvegicus
aaacgcatcggaccctaagcacctg

SEQ ID NO: 6616 - DNA, 25 bp, Rattus norvegicus
aaacgcatcggagcctaagcacctg

SEQ ID NO: 6617 - DNA, 25 bp, Rattus norvegicus
aaacgcatgcagatatcgctcacct

SEQ ID NO: 6618 - DNA, 25 bp, Rattus norvegicus
aaacgcatgcagttatcgctcacct

SEQ ID NO: 6619 - DNA, 25 bp, Rattus norvegicus
aaacgcatgggtctatggccatcat

SEQ ID NO: 6620 - DNA, 25 bp, Rattus norvegicus
aaacgcatgggtgtatggccatcat

SEQ ID NO: 6621 - DNA, 25 bp, Rattus norvegicus
aaacgcattggactcatctgtgaag

SEQ ID NO: 6622 - DNA, 25 bp, Rattus norvegicus
aaacgcattggagtcatctgtgaag

SEQ ID NO: 6623 - DNA, 25 bp, Rattus norvegicus
aaacgcattgttagtgtctggctac

SEQ ID NO: 6624 - DNA, 25 bp, Rattus norvegicus
aaacgcattgtttgtgtctggctac

SEQ ID NO: 6625 - DNA, 25 bp, Rattus norvegicus
aaacgccaaaatcggaagctcatgt

SEQ ID NO: 6626 - DNA, 25 bp, Rattus norvegicus
aaacgccaaaatgggaagctcatgt

SEQ ID NO: 6627 - DNA, 25 bp, Rattus norvegicus
aaacgccacgtgatgtttctggtct

SEQ ID NO: 6628 - DNA, 25 bp, Rattus norvegicus
aaacgccacgtgttgtttctggtct

SEQ ID NO: 6629 - DNA, 25 bp, Rattus norvegicus
aaacgccagctgagcccaagcatga

SEQ ID NO: 6630 - DNA, 25 bp, Rattus norvegicus
aaacgccagctgtgcccaagcatga

SEQ ID NO: 6631 - DNA, 25 bp, Rattus norvegicus
aaacgccagggccgtaccctctatg

SEQ ID NO: 6632 - DNA, 25 bp, Rattus norvegicus
aaacgccagggcggtaccctctatg

SEQ ID NO: 6633 - DNA, 25 bp, Rattus norvegicus
aaacgcccagtgaggtttatccagt

SEQ ID NO: 6634 - DNA, 25 bp, Rattus norvegicus
aaacgcccagtgtggtttatccagt

SEQ ID NO: 6635 - DNA, 25 bp, Rattus norvegicus
aaacgcccatgaaagtagcttcaaa

SEQ ID NO: 6636 - DNA, 25 bp, Rattus norvegicus
aaacgcccatgatagtagcttcaaa

SEQ ID NO: 6637 - DNA, 25 bp, Rattus norvegicus
aaacgcccctagatgtgagctgctg

SEQ ID NO: 6638 - DNA, 25 bp, Rattus norvegicus
aaacgcccctagttgtgagctgctg

SEQ ID NO: 6639 - DNA, 25 bp, Rattus norvegicus
aaacgccctattccggcaggaggtg

SEQ ID NO: 6640 - DNA, 25 bp, Rattus norvegicus
aaacgccctattgcggcaggaggtg

SEQ ID NO: 6641 - DNA, 25 bp, Rattus norvegicus
aaacgccctgagctgcgaggtgtca

SEQ ID NO: 6642 - DNA, 25 bp, Rattus norvegicus
aaacgccctgaggtgcgaggtgtca

SEQ ID NO: 6643 - DNA, 25 bp, Rattus norvegicus
aaacgccgacgtattgctctgaaga

SEQ ID NO: 6644 - DNA, 25 bp, Rattus norvegicus
aaacgccgacgttttgctctgaaga

SEQ ID NO: 6645 - DNA, 25 bp, Rattus norvegicus
aaacgccgattaccacaatctaaat

SEQ ID NO: 6646 - DNA, 25 bp, Rattus norvegicus
aaacgccgattagcacaatctaaat

SEQ ID NO: 6647 - DNA, 25 bp, Rattus norvegicus
aaacgccgcagccaaaggtcagtac

SEQ ID NO: 6648 - DNA, 25 bp, Rattus norvegicus
aaacgccgcagcgaaaggtcagtac

SEQ ID NO: 6649 - DNA, 25 bp, Rattus norvegicus
aaacgccggtgtagtgcggccagcc

SEQ ID NO: 6650 - DNA, 25 bp, Rattus norvegicus
aaacgccggtgttgtgcggccagcc

SEQ ID NO: 6651 - DNA, 25 bp, Rattus norvegicus
aaacgcctaaatcgctcagtgcctt

SEQ ID NO: 6652 - DNA, 25 bp, Rattus norvegicus
aaacgcctaaatggctcagtgcctt

SEQ ID NO: 6653 - DNA, 25 bp, Rattus norvegicus
aaacgcctaattcccctaagcaaat

SEQ ID NO: 6654 - DNA, 25 bp, Rattus norvegicus
aaacgcctaattgccctaagcaaat

SEQ ID NO: 6655 - DNA, 25 bp, Rattus norvegicus
aaacgcctatttacacatgtcttgc

SEQ ID NO: 6656 - DNA, 25 bp, Rattus norvegicus
aaacgcctattttcacatgtcttgc

SEQ ID NO: 6657 - DNA, 25 bp, Rattus norvegicus
aaacgcctccagagagctgctgtgc

SEQ ID NO: 6658 - DNA, 25 bp, Rattus norvegicus
aaacgcctccagtgagctgctgtgc

SEQ ID NO: 6659 - DNA, 25 bp, Rattus norvegicus
aaacgcctcctgaatatgatgtgtc

SEQ ID NO: 6660 - DNA, 25 bp, Rattus norvegicus
aaacgcctcctgtatatgatgtgtc

SEQ ID NO: 6661 - DNA, 25 bp, Rattus norvegicus
aaacgcctcgtcctaaccagacatt

SEQ ID NO: 6662 - DNA, 25 bp, Rattus norvegicus
aaacgcctcgtcgtaaccagacatt

SEQ ID NO: 6663 - DNA, 25 bp, Rattus norvegicus
aaacgcctctggacggagtctctgt

SEQ ID NO: 6664 - DNA, 25 bp, Rattus norvegicus
aaacgcctctggtcggagtctctgt

SEQ ID NO: 6665 - DNA, 25 bp, Rattus norvegicus
aaacgcctgcaaaccatctgcatgt

SEQ ID NO: 6666 - DNA, 25 bp, Rattus norvegicus
aaacgcctgcaatccatctgcatgt

SEQ ID NO: 6667 - DNA, 25 bp, Rattus norvegicus
aaacgccttcagaagctgagctcgg

SEQ ID NO: 6668 - DNA, 25 bp, Rattus norvegicus
aaacgccttcagcaagccttagagc

SEQ ID NO: 6669 - DNA, 25 bp, Rattus norvegicus
aaacgccttcaggaagccttagagc

SEQ ID NO: 6670 - DNA, 25 bp, Rattus norvegicus
aaacgccttcagtagctgagctcgg

SEQ ID NO: 6671 - DNA, 25 bp, Rattus norvegicus
aaacgcgatgggacacagtccggaa

SEQ ID NO: 6672 - DNA, 25 bp, Rattus norvegicus
aaacgcgatgggtcacagtccggaa

SEQ ID NO: 6673 - DNA, 25 bp, Rattus norvegicus
aaacgcgcgaccacagatgccacag

SEQ ID NO: 6674 - DNA, 25 bp, Rattus norvegicus
aaacgcgcgacctcagatgccacag

SEQ ID NO: 6675 - DNA, 25 bp, Rattus norvegicus
aaacgctactttcaatgccaggcca

SEQ ID NO: 6676 - DNA, 25 bp, Rattus norvegicus
aaacgctactttgaatgccaggcca

SEQ ID NO: 6677 - DNA, 25 bp, Rattus norvegicus
aaacgctagctaatcctctggaagg

SEQ ID NO: 6678 - DNA, 25 bp, Rattus norvegicus
aaacgctagctattcctctggaagg

SEQ ID NO: 6679 - DNA, 25 bp, Rattus norvegicus
aaacgctaggacacagggtgtggcc

SEQ ID NO: 6680 - DNA, 25 bp, Rattus norvegicus
aaacgctaggactcagggtgtggcc

SEQ ID NO: 6681 - DNA, 25 bp, Rattus norvegicus
aaacgctcagagcatgctggacaac

SEQ ID NO: 6682 - DNA, 25 bp, Rattus norvegicus
aaacgctcagaggatgctggacaac

SEQ ID NO: 6683 - DNA, 25 bp, Rattus norvegicus
aaacgctcgggcagcttctaccgca

SEQ ID NO: 6684 - DNA, 25 bp, Rattus norvegicus
aaacgctcgggctgcttctaccgca

SEQ ID NO: 6685 - DNA, 25 bp, Rattus norvegicus
aaacgctgaccaactttgttcgctc

SEQ ID NO: 6686 - DNA, 25 bp, Rattus norvegicus
aaacgctgaccatctttgttcgctc

SEQ ID NO: 6687 - DNA, 25 bp, Rattus norvegicus
aaacgctgacggctgtgccaatttg

SEQ ID NO: 6688 - DNA, 25 bp, Rattus norvegicus
aaacgctgacgggtgtgccaatttg

SEQ ID NO: 6689 - DNA, 25 bp, Rattus norvegicus
aaacgctgccacaaatcaagtccaa

SEQ ID NO: 6690 - DNA, 25 bp, Rattus norvegicus
aaacgctgccactaatcaagtccaa

SEQ ID NO: 6691 - DNA, 25 bp, Rattus norvegicus
aaacgctgctatcttagtcatgaac

SEQ ID NO: 6692 - DNA, 25 bp, Rattus norvegicus
aaacgctgctatgttagtcatgaac

SEQ ID NO: 6693 - DNA, 25 bp, Rattus norvegicus
aaacgctgcttcacgtccatgaggc

SEQ ID NO: 6694 - DNA, 25 bp, Rattus norvegicus
aaacgctgcttctcgtccatgaggc

SEQ ID NO: 6695 - DNA, 25 bp, Rattus norvegicus
aaacgctggcttccacaactggtga

SEQ ID NO: 6696 - DNA, 25 bp, Rattus norvegicus
aaacgctggcttgcacaactggtga

SEQ ID NO: 6697 - DNA, 25 bp, Rattus norvegicus
aaacgcttcaagctgctcatgaccc

SEQ ID NO: 6698 - DNA, 25 bp, Rattus norvegicus
aaacgcttcaaggtgctcatgaccc

SEQ ID NO: 6699 - DNA, 25 bp, Rattus norvegicus
aaacgcttcagtcccctggagttgg

SEQ ID NO: 6700 - DNA, 25 bp, Rattus norvegicus
aaacgcttcagtgccctggagttgg

SEQ ID NO: 6701 - DNA, 25 bp, Rattus norvegicus
aaacgcttctgtaagctccctctgg

SEQ ID NO: 6702 - DNA, 25 bp, Rattus norvegicus
aaacgcttctgttagctccctctgg

SEQ ID NO: 6703 - DNA, 25 bp, Rattus norvegicus
aaacgcttcttcagttgggtcagct

SEQ ID NO: 6704 - DNA, 25 bp, Rattus norvegicus
aaacgcttcttctgttgggtcagct

SEQ ID NO: 6705 - DNA, 25 bp, Rattus norvegicus
aaacgcttgccacagaacctagcag

SEQ ID NO: 6706 - DNA, 25 bp, Rattus norvegicus
aaacgcttgccagagaacctagcag

SEQ ID NO: 6707 - DNA, 25 bp, Rattus norvegicus
aaacgcttggtcaataagtgccaga

SEQ ID NO: 6708 - DNA, 25 bp, Rattus norvegicus
aaacgcttggtctataagtgccaga

SEQ ID NO: 6709 - DNA, 25 bp, Rattus norvegicus
aaacgctttgttcctcatcgaagta

SEQ ID NO: 6710 - DNA, 25 bp, Rattus norvegicus
aaacgctttgttgctcatcgaagta

SEQ ID NO: 6711 - DNA, 25 bp, Rattus norvegicus
aaacggaaattgcacagagactctc

SEQ ID NO: 6712 - DNA, 25 bp, Rattus norvegicus
aaacggaaattggacagagactctc

SEQ ID NO: 6713 - DNA, 25 bp, Rattus norvegicus
aaacggaactgactatgccactggg

SEQ ID NO: 6714 - DNA, 25 bp, Rattus norvegicus
aaacggaactgagtatgccactggg

SEQ ID NO: 6715 - DNA, 25 bp, Rattus norvegicus
aaacggaatctcctcacggagtgac

SEQ ID NO: 6716 - DNA, 25 bp, Rattus norvegicus
aaacggaatctcgtcacggagtgac

SEQ ID NO: 6717 - DNA, 25 bp, Rattus norvegicus
aaacggacagacattcagcccagat

SEQ ID NO: 6718 - DNA, 25 bp, Rattus norvegicus
aaacggacagacctcacctgtcgga

SEQ ID NO: 6719 - DNA, 25 bp, Rattus norvegicus
aaacggacagacgtcacctgtcgga

SEQ ID NO: 6720 - DNA, 25 bp, Rattus norvegicus
aaacggacagactttcagcccagat

SEQ ID NO: 6721 - DNA, 25 bp, Rattus norvegicus
aaacggactgggacgaggcttgcct

SEQ ID NO: 6722 - DNA, 25 bp, Rattus norvegicus
aaacggactgggtcgaggcttgcct

SEQ ID NO: 6723 - DNA, 25 bp, Rattus norvegicus
aaacggagatgacctttattttgca

SEQ ID NO: 6724 - DNA, 25 bp, Rattus norvegicus
aaacggagatgagctttattttgca

SEQ ID NO: 6725 - DNA, 25 bp, Rattus norvegicus
aaacggaggcacacatcagctttgc

SEQ ID NO: 6726 - DNA, 25 bp, Rattus norvegicus
aaacggaggcactcatcagctttgc

SEQ ID NO: 6727 - DNA, 25 bp, Rattus norvegicus
aaacggaggcgccatagccacggta

SEQ ID NO: 6728 - DNA, 25 bp, Rattus norvegicus
aaacggaggcgcgatagccacggta

SEQ ID NO: 6729 - DNA, 25 bp, Rattus norvegicus
aaacggatacctctcacacattttg

SEQ ID NO: 6730 - DNA, 25 bp, Rattus norvegicus
aaacggatacctgtcacacattttg

SEQ ID NO: 6731 - DNA, 25 bp, Rattus norvegicus
aaacggatgccgcatgtgaactatt

SEQ ID NO: 6732 - DNA, 25 bp, Rattus norvegicus
aaacggatgccggatgtgaactatt

SEQ ID NO: 6733 - DNA, 25 bp, Rattus norvegicus
aaacggatgcttatctgggatggaa

SEQ ID NO: 6734 - DNA, 25 bp, Rattus norvegicus
aaacggatgcttttctgggatggaa

SEQ ID NO: 6735 - DNA, 25 bp, Rattus norvegicus
aaacggattcacatttagcagcaga

SEQ ID NO: 6736 - DNA, 25 bp, Rattus norvegicus
aaacggattcacttttagcagcaga

SEQ ID NO: 6737 - DNA, 25 bp, Rattus norvegicus
aaacggattctgcagtgcgcactat

SEQ ID NO: 6738 - DNA, 25 bp, Rattus norvegicus
aaacggattctggagtgcgcactat

SEQ ID NO: 6739 - DNA, 25 bp, Rattus norvegicus
aaacggatttgtctgctactcctga

SEQ ID NO: 6740 - DNA, 25 bp, Rattus norvegicus
aaacggatttgtgtgctactcctga

SEQ ID NO: 6741 - DNA, 25 bp, Rattus norvegicus
aaacggcacagccaaatgtactact

SEQ ID NO: 6742 - DNA, 25 bp, Rattus norvegicus
aaacggcacagcgaaatgtactact

SEQ ID NO: 6743 - DNA, 25 bp, Rattus norvegicus
aaacggcacctacagatgctcctgt

SEQ ID NO: 6744 - DNA, 25 bp, Rattus norvegicus
aaacggcacctagagatgctcctgt

SEQ ID NO: 6745 - DNA, 25 bp, Rattus norvegicus
aaacggcactacaagctgcagacca

SEQ ID NO: 6746 - DNA, 25 bp, Rattus norvegicus
aaacggcactactagctgcagacca

SEQ ID NO: 6747 - DNA, 25 bp, Rattus norvegicus
aaacggcagtctagtattttatcac

SEQ ID NO: 6748 - DNA, 25 bp, Rattus norvegicus
aaacggcagtcttgtattttatcac

SEQ ID NO: 6749 - DNA, 25 bp, Rattus norvegicus
aaacggcagtgcacggttctttatg

SEQ ID NO: 6750 - DNA, 25 bp, Rattus norvegicus
aaacggcagtgctcggttctttatg

SEQ ID NO: 6751 - DNA, 25 bp, Rattus norvegicus
aaacggcataaacgaactgggcttg

SEQ ID NO: 6752 - DNA, 25 bp, Rattus norvegicus
aaacggcataaaggaactgggcttg

SEQ ID NO: 6753 - DNA, 25 bp, Rattus norvegicus
aaacggcattgacttctaccctcag

SEQ ID NO: 6754 - DNA, 25 bp, Rattus norvegicus
aaacggcattgagttctaccctcag

SEQ ID NO: 6755 - DNA, 25 bp, Rattus norvegicus
aaacggccctggatcatttattctg

SEQ ID NO: 6756 - DNA, 25 bp, Rattus norvegicus
aaacggccctggttcatttattctg

SEQ ID NO: 6757 - DNA, 25 bp, Rattus norvegicus
aaacggccgctgagtacatcgatga

SEQ ID NO: 6758 - DNA, 25 bp, Rattus norvegicus
aaacggccgctgtgtacatcgatga

SEQ ID NO: 6759 - DNA, 25 bp, Rattus norvegicus
aaacggccgggaactgctgaatgta

SEQ ID NO: 6760 - DNA, 25 bp, Rattus norvegicus
aaacggccgggatctgctgaatgta

SEQ ID NO: 6761 - DNA, 25 bp, Rattus norvegicus
aaacggcctttcagtccagtgtgga

SEQ ID NO: 6762 - DNA, 25 bp, Rattus norvegicus
aaacggcctttctgtccagtgtgga

SEQ ID NO: 6763 - DNA, 25 bp, Rattus norvegicus
aaacggcgctctacacaaagacagt

SEQ ID NO: 6764 - DNA, 25 bp, Rattus norvegicus
aaacggcgctcttcacaaagacagt

SEQ ID NO: 6765 - DNA, 25 bp, Rattus norvegicus
aaacggcggcgaaatatggaagaag

SEQ ID NO: 6766 - DNA, 25 bp, Rattus norvegicus
aaacggcggcgatatatggaagaag

SEQ ID NO: 6767 - DNA, 25 bp, Rattus norvegicus
aaacggcgggccatggctgaccctg

SEQ ID NO: 6768 - DNA, 25 bp, Rattus norvegicus
aaacggcgggccttggctgaccctg

SEQ ID NO: 6769 - DNA, 25 bp, Rattus norvegicus
aaacggctacacatgattcatgatt

SEQ ID NO: 6770 - DNA, 25 bp, Rattus norvegicus
aaacggctacacttgattcatgatt

SEQ ID NO: 6771 - DNA, 25 bp, Rattus norvegicus
aaacggctacagatcttagcaggag

SEQ ID NO: 6772 - DNA, 25 bp, Rattus norvegicus
aaacggctacagttcttagcaggag

SEQ ID NO: 6773 - DNA, 25 bp, Rattus norvegicus
aaacggctctgcaaggttcaaccct

SEQ ID NO: 6774 - DNA, 25 bp, Rattus norvegicus
aaacggctctgctaggttcaaccct

SEQ ID NO: 6775 - DNA, 25 bp, Rattus norvegicus
aaacggctgatgattttcttagtag

SEQ ID NO: 6776 - DNA, 25 bp, Rattus norvegicus
aaacggctgatgtttttcttagtag

SEQ ID NO: 6777 - DNA, 25 bp, Rattus norvegicus
aaacggctgcgtagttcaaccgcgg

SEQ ID NO: 6778 - DNA, 25 bp, Rattus norvegicus
aaacggctgcgttgttcaaccgcgg

SEQ ID NO: 6779 - DNA, 25 bp, Rattus norvegicus
aaacggctggctctcctggagaaca

SEQ ID NO: 6780 - DNA, 25 bp, Rattus norvegicus
aaacggctggctgtcctggagaaca

SEQ ID NO: 6781 - DNA, 25 bp, Rattus norvegicus
aaacggctgggacagcaagctccac

SEQ ID NO: 6782 - DNA, 25 bp, Rattus norvegicus
aaacggctgggagagcaagctccac

SEQ ID NO: 6783 - DNA, 25 bp, Rattus norvegicus
aaacggctgttcatggctgatgcca

SEQ ID NO: 6784 - DNA, 25 bp, Rattus norvegicus
aaacggctgttcttggctgatgcca

SEQ ID NO: 6785 - DNA, 25 bp, Rattus norvegicus
aaacggcttcctactgcttccagag

SEQ ID NO: 6786 - DNA, 25 bp, Rattus norvegicus
aaacggcttccttctgcttccagag

SEQ ID NO: 6787 - DNA, 25 bp, Rattus norvegicus
aaacggcttggaatttgactgtact

SEQ ID NO: 6788 - DNA, 25 bp, Rattus norvegicus
aaacggcttggattttgactgtact

SEQ ID NO: 6789 - DNA, 25 bp, Rattus norvegicus
aaacggctttcccatcagtgcagga

SEQ ID NO: 6790 - DNA, 25 bp, Rattus norvegicus
aaacggctttccgatcagtgcagga

SEQ ID NO: 6791 - DNA, 25 bp, Rattus norvegicus
aaacggctttcgcttgagctgacca

SEQ ID NO: 6792 - DNA, 25 bp, Rattus norvegicus
aaacggctttcggttgagctgacca

SEQ ID NO: 6793 - DNA, 25 bp, Rattus norvegicus
aaacgggaagtgaccatttctggct

SEQ ID NO: 6794 - DNA, 25 bp, Rattus norvegicus
aaacgggaagtgtccatttctggct

SEQ ID NO: 6795 - DNA, 25 bp, Rattus norvegicus
aaacgggagaccatgaatgttgaca

SEQ ID NO: 6796 - DNA, 25 bp, Rattus norvegicus
aaacgggagaccttgaatgttgaca

SEQ ID NO: 6797 - DNA, 25 bp, Rattus norvegicus
aaacgggattgaagactgcgatgat

SEQ ID NO: 6798 - DNA, 25 bp, Rattus norvegicus
aaacgggattgatgactgcgatgat

SEQ ID NO: 6799 - DNA, 25 bp, Rattus norvegicus
aaacgggcaactctggccagggact

SEQ ID NO: 6800 - DNA, 25 bp, Rattus norvegicus
aaacgggcaactgtggccagggact

SEQ ID NO: 6801 - DNA, 25 bp, Rattus norvegicus
aaacgggcaagcatcgtcagtcaca

SEQ ID NO: 6802 - DNA, 25 bp, Rattus norvegicus
aaacgggcaagcttcgtcagtcaca

SEQ ID NO: 6803 - DNA, 25 bp, Rattus norvegicus
aaacgggccatacaatttggatcta

SEQ ID NO: 6804 - DNA, 25 bp, Rattus norvegicus
aaacgggccatagaatttggatcta

SEQ ID NO: 6805 - DNA, 25 bp, Rattus norvegicus
aaacgggcccgacagaagcgcaaca

SEQ ID NO: 6806 - DNA, 25 bp, Rattus norvegicus
aaacgggcccgagagaagcgcaaca

SEQ ID NO: 6807 - DNA, 25 bp, Rattus norvegicus
aaacgggccttgagtcaggctcagc

SEQ ID NO: 6808 - DNA, 25 bp, Rattus norvegicus
aaacgggccttgtgtcaggctcagc

SEQ ID NO: 6809 - DNA, 25 bp, Rattus norvegicus
aaacgggctagccaacaggcgtgca

SEQ ID NO: 6810 - DNA, 25 bp, Rattus norvegicus
aaacgggctagcgaacaggcgtgca

SEQ ID NO: 6811 - DNA, 25 bp, Rattus norvegicus
aaacgggctttactcattaatgtga

SEQ ID NO: 6812 - DNA, 25 bp, Rattus norvegicus
aaacgggctttagtcattaatgtga

SEQ ID NO: 6813 - DNA, 25 bp, Rattus norvegicus
aaacgggtgactatggcaagggtat

SEQ ID NO: 6814 - DNA, 25 bp, Rattus norvegicus
aaacgggtgactttggcaagggtat

SEQ ID NO: 6815 - DNA, 25 bp, Rattus norvegicus
aaacgggtttgacctggcccagcta

SEQ ID NO: 6816 - DNA, 25 bp, Rattus norvegicus
aaacgggtttgagctggcccagcta

SEQ ID NO: 6817 - DNA, 25 bp, Rattus norvegicus
aaacggtacatcagacactcatcca

SEQ ID NO: 6818 - DNA, 25 bp, Rattus norvegicus
aaacggtacatctgacactcatcca

SEQ ID NO: 6819 - DNA, 25 bp, Rattus norvegicus
aaacggtaccgtccagtgtatgact

SEQ ID NO: 6820 - DNA, 25 bp, Rattus norvegicus
aaacggtaccgtgcagtgtatgact

SEQ ID NO: 6821 - DNA, 25 bp, Rattus norvegicus
aaacggtagggcagcttgccgatgc

SEQ ID NO: 6822 - DNA, 25 bp, Rattus norvegicus
aaacggtagggctgcttgccgatgc

SEQ ID NO: 6823 - DNA, 25 bp, Rattus norvegicus
aaacggtccctcatagttgctgtgg

SEQ ID NO: 6824 - DNA, 25 bp, Rattus norvegicus
aaacggtccctcttagttgctgtgg

SEQ ID NO: 6825 - DNA, 25 bp, Rattus norvegicus
aaacggtctgctcgattaaatgtga

SEQ ID NO: 6826 - DNA, 25 bp, Rattus norvegicus
aaacggtctgctggattaaatgtga

SEQ ID NO: 6827 - DNA, 25 bp, Rattus norvegicus
aaacggtgaatgaactccagaattt

SEQ ID NO: 6828 - DNA, 25 bp, Rattus norvegicus
aaacggtgaatgtactccagaattt

SEQ ID NO: 6829 - DNA, 25 bp, Rattus norvegicus
aaacggtgacgcagtgtctgtatat

SEQ ID NO: 6830 - DNA, 25 bp, Rattus norvegicus
aaacggtgacgctgtgtctgtatat

SEQ ID NO: 6831 - DNA, 25 bp, Rattus norvegicus
aaacggtgcagacagcagcttctgt

SEQ ID NO: 6832 - DNA, 25 bp, Rattus norvegicus
aaacggtgcagagagcagcttctgt

SEQ ID NO: 6833 - DNA, 25 bp, Rattus norvegicus
aaacggtggttcagtcttctgaagc

SEQ ID NO: 6834 - DNA, 25 bp, Rattus norvegicus
aaacggtggttctgtcttctgaagc

SEQ ID NO: 6835 - DNA, 25 bp, Rattus norvegicus
aaacggttagacagctcaattcaag

SEQ ID NO: 6836 - DNA, 25 bp, Rattus norvegicus
aaacggttagactgctcaattcaag

SEQ ID NO: 6837 - DNA, 25 bp, Rattus norvegicus
aaacggttcaggaagctgctaccaa

SEQ ID NO: 6838 - DNA, 25 bp, Rattus norvegicus
aaacggttcaggtagctgctaccaa

SEQ ID NO: 6839 - DNA, 25 bp, Rattus norvegicus
aaacggttccagaagacgctgatat

SEQ ID NO: 6840 - DNA, 25 bp, Rattus norvegicus
aaacggttccagtagacgctgatat

SEQ ID NO: 6841 - DNA, 25 bp, Rattus norvegicus
aaacggttcttacataacatcgaga

SEQ ID NO: 6842 - DNA, 25 bp, Rattus norvegicus
aaacggttcttagataacatcgaga

SEQ ID NO: 6843 - DNA, 25 bp, Rattus norvegicus
aaacggtttgtaattgtctgctgag

SEQ ID NO: 6844 - DNA, 25 bp, Rattus norvegicus
aaacggtttgtatttgtctgctgag

SEQ ID NO: 6845 - DNA, 25 bp, Rattus norvegicus
aaacggttttgcacggatctgtgga

SEQ ID NO: 6846 - DNA, 25 bp, Rattus norvegicus
aaacggttttgctcggatctgtgga

SEQ ID NO: 6847 - DNA, 25 bp, Rattus norvegicus
aaacgtaaccaaactgtgcatcggt

SEQ ID NO: 6848 - DNA, 25 bp, Rattus norvegicus
aaacgtaaccaatctgtgcatcggt

SEQ ID NO: 6849 - DNA, 25 bp, Rattus norvegicus
aaacgtaactgcactgctgactgcg

SEQ ID NO: 6850 - DNA, 25 bp, Rattus norvegicus
aaacgtaactgctctgctgactgcg

SEQ ID NO: 6851 - DNA, 25 bp, Rattus norvegicus
aaacgtatctagcaagttctgggaa

SEQ ID NO: 6852 - DNA, 25 bp, Rattus norvegicus
aaacgtatctaggaagttctgggaa

SEQ ID NO: 6853 - DNA, 25 bp, Rattus norvegicus
aaacgtatctttactttccgatcag

SEQ ID NO: 6854 - DNA, 25 bp, Rattus norvegicus
aaacgtatcttttctttccgatcag

SEQ ID NO: 6855 - DNA, 25 bp, Rattus norvegicus
aaacgtatgccacacttattcttag

SEQ ID NO: 6856 - DNA, 25 bp, Rattus norvegicus
aaacgtatgccagacttattcttag

SEQ ID NO: 6857 - DNA, 25 bp, Rattus norvegicus
aaacgtatgtctatctaaatgctaa

SEQ ID NO: 6858 - DNA, 25 bp, Rattus norvegicus
aaacgtatgtctttctaaatgctaa

SEQ ID NO: 6859 - DNA, 25 bp, Rattus norvegicus
aaacgtcaagataggcagtctgcag

SEQ ID NO: 6860 - DNA, 25 bp, Rattus norvegicus
aaacgtcaagattggcagtctgcag

SEQ ID NO: 6861 - DNA, 25 bp, Rattus norvegicus
aaacgtcacgctcaatatatgacca

SEQ ID NO: 6862 - DNA, 25 bp, Rattus norvegicus
aaacgtcacgctgaatatatgacca

SEQ ID NO: 6863 - DNA, 25 bp, Rattus norvegicus
aaacgtcagcaaccaaaggcaccgg

SEQ ID NO: 6864 - DNA, 25 bp, Rattus norvegicus
aaacgtcagcaacccgagacacagc

SEQ ID NO: 6865 - DNA, 25 bp, Rattus norvegicus
aaacgtcagcaagcaaaggcaccgg

SEQ ID NO: 6866 - DNA, 25 bp, Rattus norvegicus
aaacgtcagcaagccgagacacagc

SEQ ID NO: 6867 - DNA, 25 bp, Rattus norvegicus
aaacgtcagtatcttctggtcagga

SEQ ID NO: 6868 - DNA, 25 bp, Rattus norvegicus
aaacgtcagtatgttctggtcagga

SEQ ID NO: 6869 - DNA, 25 bp, Rattus norvegicus
aaacgtcagtccagggttgcttgat

SEQ ID NO: 6870 - DNA, 25 bp, Rattus norvegicus
aaacgtcagtcctgggttgcttgat

SEQ ID NO: 6871 - DNA, 25 bp, Rattus norvegicus
aaacgtccagagagctacagagagt

SEQ ID NO: 6872 - DNA, 25 bp, Rattus norvegicus
aaacgtccagagtgctacagagagt

SEQ ID NO: 6873 - DNA, 25 bp, Rattus norvegicus
aaacgtccagatctcaagtaccagc

SEQ ID NO: 6874 - DNA, 25 bp, Rattus norvegicus
aaacgtccagatgtcaagtaccagc

SEQ ID NO: 6875 - DNA, 25 bp, Rattus norvegicus
aaacgtcctaatatactgagcacaa

SEQ ID NO: 6876 - DNA, 25 bp, Rattus norvegicus
aaacgtcctaatttactgagcacaa

SEQ ID NO: 6877 - DNA, 25 bp, Rattus norvegicus
aaacgtcctgtccagtgagtagtct

SEQ ID NO: 6878 - DNA, 25 bp, Rattus norvegicus
aaacgtcctgtcgagtgagtagtct

SEQ ID NO: 6879 - DNA, 25 bp, Rattus norvegicus
aaacgtcgtgccagtacggagtgtc

SEQ ID NO: 6880 - DNA, 25 bp, Rattus norvegicus
aaacgtcgtgcctgtacggagtgtc

SEQ ID NO: 6881 - DNA, 25 bp, Rattus norvegicus
aaacgtctacatcccagcattttgt

SEQ ID NO: 6882 - DNA, 25 bp, Rattus norvegicus
aaacgtctacatgccagcattttgt

SEQ ID NO: 6883 - DNA, 25 bp, Rattus norvegicus
aaacgtctactcaaagggcgagcat

SEQ ID NO: 6884 - DNA, 25 bp, Rattus norvegicus
aaacgtctactctaagggcgagcat

SEQ ID NO: 6885 - DNA, 25 bp, Rattus norvegicus
aaacgtctcaataatgcgcctctgg

SEQ ID NO: 6886 - DNA, 25 bp, Rattus norvegicus
aaacgtctcaattatgcgcctctgg

SEQ ID NO: 6887 - DNA, 25 bp, Rattus norvegicus
aaacgtctcactcctttaaatccta

SEQ ID NO: 6888 - DNA, 25 bp, Rattus norvegicus
aaacgtctcactgctttaaatccta

SEQ ID NO: 6889 - DNA, 25 bp, Rattus norvegicus
aaacgtctcgtgacttgtgttctct

SEQ ID NO: 6890 - DNA, 25 bp, Rattus norvegicus
aaacgtctcgtgtcttgtgttctct

SEQ ID NO: 6891 - DNA, 25 bp, Rattus norvegicus
aaacgtctctaaaggcctggtcatc

SEQ ID NO: 6892 - DNA, 25 bp, Rattus norvegicus
aaacgtctctaatggcctggtcatc

SEQ ID NO: 6893 - DNA, 25 bp, Rattus norvegicus
aaacgtctgcatattcaacatctct

SEQ ID NO: 6894 - DNA, 25 bp, Rattus norvegicus
aaacgtctgcattttcaacatctct

SEQ ID NO: 6895 - DNA, 25 bp, Rattus norvegicus
aaacgtcttaatctggtgcctcttg

SEQ ID NO: 6896 - DNA, 25 bp, Rattus norvegicus
aaacgtcttaatgtggtgcctcttg

SEQ ID NO: 6897 - DNA, 25 bp, Rattus norvegicus
aaacgtcttactactgtgggcttga

SEQ ID NO: 6898 - DNA, 25 bp, Rattus norvegicus
aaacgtcttacttctgtgggcttga

SEQ ID NO: 6899 - DNA, 25 bp, Rattus norvegicus
aaacgtcttctcctttgaggcagta

SEQ ID NO: 6900 - DNA, 25 bp, Rattus norvegicus
aaacgtcttctcgtttgaggcagta

SEQ ID NO: 6901 - DNA, 25 bp, Rattus norvegicus
aaacgtcttttgaacacttggctgg

SEQ ID NO: 6902 - DNA, 25 bp, Rattus norvegicus
aaacgtcttttgatcaggattcaga

SEQ ID NO: 6903 - DNA, 25 bp, Rattus norvegicus
aaacgtcttttgtacacttggctgg

SEQ ID NO: 6904 - DNA, 25 bp, Rattus norvegicus
aaacgtcttttgttcaggattcaga

SEQ ID NO: 6905 - DNA, 25 bp, Rattus norvegicus
aaacgtgagaccaggctctgacttc

SEQ ID NO: 6906 - DNA, 25 bp, Rattus norvegicus
aaacgtgagacctggctctgacttc

SEQ ID NO: 6907 - DNA, 25 bp, Rattus norvegicus
aaacgtgagcagacattgggcaaga

SEQ ID NO: 6908 - DNA, 25 bp, Rattus norvegicus
aaacgtgagcagtcattgggcaaga

SEQ ID NO: 6909 - DNA, 25 bp, Rattus norvegicus
aaacgtgcaaatcccagtggccggt

SEQ ID NO: 6910 - DNA, 25 bp, Rattus norvegicus
aaacgtgcaaatgccagtggccggt

SEQ ID NO: 6911 - DNA, 25 bp, Rattus norvegicus
aaacgtgcagcgctccatgagaggt

SEQ ID NO: 6912 - DNA, 25 bp, Rattus norvegicus
aaacgtgcagcggtccatgagaggt

SEQ ID NO: 6913 - DNA, 25 bp, Rattus norvegicus
aaacgtgcgactcgaatgtgcctct

SEQ ID NO: 6914 - DNA, 25 bp, Rattus norvegicus
aaacgtgcgactggaatgtgcctct

SEQ ID NO: 6915 - DNA, 25 bp, Rattus norvegicus
aaacgtgcgtttcactgaacctgtc

SEQ ID NO: 6916 - DNA, 25 bp, Rattus norvegicus
aaacgtgcgtttgactgaacctgtc

SEQ ID NO: 6917 - DNA, 25 bp, Rattus norvegicus
aaacgtgctatgataatggacttgt

SEQ ID NO: 6918 - DNA, 25 bp, Rattus norvegicus
aaacgtgctatgttaatggacttgt

SEQ ID NO: 6919 - DNA, 25 bp, Rattus norvegicus
aaacgtggaaagctgcgtcccatgc

SEQ ID NO: 6920 - DNA, 25 bp, Rattus norvegicus
aaacgtggaaaggtgcgtcccatgc

SEQ ID NO: 6921 - DNA, 25 bp, Rattus norvegicus
aaacgtggattgacttgaggaagct

SEQ ID NO: 6922 - DNA, 25 bp, Rattus norvegicus
aaacgtggattgtcttgaggaagct

SEQ ID NO: 6923 - DNA, 25 bp, Rattus norvegicus
aaacgtggcattccacacgcctatg

SEQ ID NO: 6924 - DNA, 25 bp, Rattus norvegicus
aaacgtggcattgcacacgcctatg

SEQ ID NO: 6925 - DNA, 25 bp, Rattus norvegicus
aaacgtggccgtcgtagcatcatcc

SEQ ID NO: 6926 - DNA, 25 bp, Rattus norvegicus
aaacgtggccgtggtagcatcatcc

SEQ ID NO: 6927 - DNA, 25 bp, Rattus norvegicus
aaacgtgggaccaagttcacgcagt

SEQ ID NO: 6928 - DNA, 25 bp, Rattus norvegicus
aaacgtgggacctagttcacgcagt

SEQ ID NO: 6929 - DNA, 25 bp, Rattus norvegicus
aaacgtggtgtcaggctcaggatcg

SEQ ID NO: 6930 - DNA, 25 bp, Rattus norvegicus
aaacgtggtgtctggctcaggatcg

SEQ ID NO: 6931 - DNA, 25 bp, Rattus norvegicus
aaacgtggttatctctgtagatgaa

SEQ ID NO: 6932 - DNA, 25 bp, Rattus norvegicus
aaacgtggttatgtctgtagatgaa

SEQ ID NO: 6933 - DNA, 25 bp, Rattus norvegicus
aaacgtgtagtcctgagtctgtaag

SEQ ID NO: 6934 - DNA, 25 bp, Rattus norvegicus
aaacgtgtagtcgtgagtctgtaag

SEQ ID NO: 6935 - DNA, 25 bp, Rattus norvegicus
aaacgtgtcaggcatctcattttac

SEQ ID NO: 6936 - DNA, 25 bp, Rattus norvegicus
aaacgtgtcagggatctcattttac

SEQ ID NO: 6937 - DNA, 25 bp, Rattus norvegicus
aaacgtgtccaaatctgccacaggt

SEQ ID NO: 6938 - DNA, 25 bp, Rattus norvegicus
aaacgtgtccaattctgccacaggt

SEQ ID NO: 6939 - DNA, 25 bp, Rattus norvegicus
aaacgtgtctgcatttctgtccaag

SEQ ID NO: 6940 - DNA, 25 bp, Rattus norvegicus
aaacgtgtctgcttttctgtccaag

SEQ ID NO: 6941 - DNA, 25 bp, Rattus norvegicus
aaacgtgtgcttactatctcatctc

SEQ ID NO: 6942 - DNA, 25 bp, Rattus norvegicus
aaacgtgtgctttctatctcatctc

SEQ ID NO: 6943 - DNA, 25 bp, Rattus norvegicus
aaacgtgtgtgcacctactgtaata

SEQ ID NO: 6944 - DNA, 25 bp, Rattus norvegicus
aaacgtgtgtgctcctactgtaata

SEQ ID NO: 6945 - DNA, 25 bp, Rattus norvegicus
aaacgtgttcttctgatgatgccta

SEQ ID NO: 6946 - DNA, 25 bp, Rattus norvegicus
aaacgtgttcttgtgatgatgccta

SEQ ID NO: 6947 - DNA, 25 bp, Rattus norvegicus
aaacgtgttttaactgcaacaggta

SEQ ID NO: 6948 - DNA, 25 bp, Rattus norvegicus
aaacgtgttttatctgcaacaggta

SEQ ID NO: 6949 - DNA, 25 bp, Rattus norvegicus
aaacgttacctgacactgtatatta

SEQ ID NO: 6950 - DNA, 25 bp, Rattus norvegicus
aaacgttacctgtcactgtatatta

SEQ ID NO: 6951 - DNA, 25 bp, Rattus norvegicus
aaacgttacttgagagccagccatg

SEQ ID NO: 6952 - DNA, 25 bp, Rattus norvegicus
aaacgttacttgtgagccagccatg

SEQ ID NO: 6953 - DNA, 25 bp, Rattus norvegicus
aaacgttagtgcagtcataaccttt

SEQ ID NO: 6954 - DNA, 25 bp, Rattus norvegicus
aaacgttagtgctgtcataaccttt

SEQ ID NO: 6955 - DNA, 25 bp, Rattus norvegicus
aaacgttattagacccagccaatgt

SEQ ID NO: 6956 - DNA, 25 bp, Rattus norvegicus
aaacgttattagtcccagccaatgt

SEQ ID NO: 6957 - DNA, 25 bp, Rattus norvegicus
aaacgttccattaaattgctgtaat

SEQ ID NO: 6958 - DNA, 25 bp, Rattus norvegicus
aaacgttccatttaattgctgtaat

SEQ ID NO: 6959 - DNA, 25 bp, Rattus norvegicus
aaacgttcctatcttcagtagcatg

SEQ ID NO: 6960 - DNA, 25 bp, Rattus norvegicus
aaacgttcctatgttcagtagcatg

SEQ ID NO: 6961 - DNA, 25 bp, Rattus norvegicus
aaacgttcctgcagttttgcgattg

SEQ ID NO: 6962 - DNA, 25 bp, Rattus norvegicus
aaacgttcctgctgttttgcgattg

SEQ ID NO: 6963 - DNA, 25 bp, Rattus norvegicus
aaacgttctgtgaaatcttcattaa

SEQ ID NO: 6964 - DNA, 25 bp, Rattus norvegicus
aaacgttctgtgtaatcttcattaa

SEQ ID NO: 6965 - DNA, 25 bp, Rattus norvegicus
aaacgttcttctaacattcttgtgt

SEQ ID NO: 6966 - DNA, 25 bp, Rattus norvegicus
aaacgttcttcttacattcttgtgt

SEQ ID NO: 6967 - DNA, 25 bp, Rattus norvegicus
aaacgttgcacacactattttagta

SEQ ID NO: 6968 - DNA, 25 bp, Rattus norvegicus
aaacgttgcacagactattttagta

SEQ ID NO: 6969 - DNA, 25 bp, Rattus norvegicus
aaacgttgggtcatctgtgtgcact

SEQ ID NO: 6970 - DNA, 25 bp, Rattus norvegicus
aaacgttgggtcttctgtgtgcact

SEQ ID NO: 6971 - DNA, 25 bp, Rattus norvegicus
aaacgttgtgacagtcccactttgg

SEQ ID NO: 6972 - DNA, 25 bp, Rattus norvegicus
aaacgttgtgactgtcccactttgg

SEQ ID NO: 6973 - DNA, 25 bp, Rattus norvegicus
aaacgtttgcttcaacagcttccca

SEQ ID NO: 6974 - DNA, 25 bp, Rattus norvegicus
aaacgtttgcttgaacagcttccca

SEQ ID NO: 6975 - DNA, 25 bp, Rattus norvegicus
aaacgtttgttcactatgtcccagg

SEQ ID NO: 6976 - DNA, 25 bp, Rattus norvegicus
aaacgtttgttctctatgtcccagg

SEQ ID NO: 6977 - DNA, 25 bp, Rattus norvegicus
aaacgttttcctaagccaggcatgg

SEQ ID NO: 6978 - DNA, 25 bp, Rattus norvegicus
aaacgttttccttagccaggcatgg

SEQ ID NO: 6979 - DNA, 25 bp, Rattus norvegicus
aaacgtttttgcatgttgtgaacat

SEQ ID NO: 6980 - DNA, 25 bp, Rattus norvegicus
aaacgtttttgcttgttgtgaacat

SEQ ID NO: 6981 - DNA, 25 bp, Rattus norvegicus
aaactaaacaccatgtcctcttaca

SEQ ID NO: 6982 - DNA, 25 bp, Rattus norvegicus
aaactaaacaccttgtcctcttaca

SEQ ID NO: 6983 - DNA, 25 bp, Rattus norvegicus
aaactaaacattccaacagctgtaa

SEQ ID NO: 6984 - DNA, 25 bp, Rattus norvegicus
aaactaaacattgcaacagctgtaa

SEQ ID NO: 6985 - DNA, 25 bp, Rattus norvegicus
aaactaaagcagcatttccccagcc

SEQ ID NO: 6986 - DNA, 25 bp, Rattus norvegicus
aaactaaagcaggatttccccagcc

SEQ ID NO: 6987 - DNA, 25 bp, Rattus norvegicus
aaactaaagcctccctcacagagac

SEQ ID NO: 6988 - DNA, 25 bp, Rattus norvegicus
aaactaaagcctgcctcacagagac

SEQ ID NO: 6989 - DNA, 25 bp, Rattus norvegicus
aaactaaagcttaagagcgctgcct

SEQ ID NO: 6990 - DNA, 25 bp, Rattus norvegicus
aaactaaagctttagagcgctgcct

SEQ ID NO: 6991 - DNA, 25 bp, Rattus norvegicus
aaactaaatacccaccgatggctct

SEQ ID NO: 6992 - DNA, 25 bp, Rattus norvegicus
aaactaaataccgaccgatggctct

SEQ ID NO: 6993 - DNA, 25 bp, Rattus norvegicus
aaactaaatgccatctcggtcctgt

SEQ ID NO: 6994 - DNA, 25 bp, Rattus norvegicus
aaactaaatgccttctcggtcctgt

SEQ ID NO: 6995 - DNA, 25 bp, Rattus norvegicus
aaactaacctgcattgcccaggtca

SEQ ID NO: 6996 - DNA, 25 bp, Rattus norvegicus
aaactaacctgctttgcccaggtca

SEQ ID NO: 6997 - DNA, 25 bp, Rattus norvegicus
aaactaaccttcattctgcatgtca

SEQ ID NO: 6998 - DNA, 25 bp, Rattus norvegicus
aaactaaccttccagcatattctca

SEQ ID NO: 6999 - DNA, 25 bp, Rattus norvegicus
aaactaaccttcgagcatattctca

SEQ ID NO: 7000 - DNA, 25 bp, Rattus norvegicus
aaactaaccttctttctgcatgtca

SEQ ID NO: 7001 - DNA, 25 bp, Rattus norvegicus
aaactaactgtcacacatacacgtg

SEQ ID NO: 7002 - DNA, 25 bp, Rattus norvegicus
aaactaactgtctcacatacacgtg

SEQ ID NO: 7003 - DNA, 25 bp, Rattus norvegicus
aaactaagtctgactgtcgtctgca

SEQ ID NO: 7004 - DNA, 25 bp, Rattus norvegicus
aaactaagtctgtctgtcgtctgca

SEQ ID NO: 7005 - DNA, 25 bp, Rattus norvegicus
aaactaagtgccactatctcataag

SEQ ID NO: 7006 - DNA, 25 bp, Rattus norvegicus
aaactaagtgcctctatctcataag

SEQ ID NO: 7007 - DNA, 25 bp, Rattus norvegicus
aaactaatctggctgctttctgtaa

SEQ ID NO: 7008 - DNA, 25 bp, Rattus norvegicus
aaactaatctgggtgctttctgtaa

SEQ ID NO: 7009 - DNA, 25 bp, Rattus norvegicus
aaactaatgattcgccagtggtctt

SEQ ID NO: 7010 - DNA, 25 bp, Rattus norvegicus
aaactaatgattggccagtggtctt

SEQ ID NO: 7011 - DNA, 25 bp, Rattus norvegicus
aaactaatgctacgccaccaggtaa

SEQ ID NO: 7012 - DNA, 25 bp, Rattus norvegicus
aaactaatgctaggccaccaggtaa

SEQ ID NO: 7013 - DNA, 25 bp, Rattus norvegicus
aaactacaactcagtcaccttttca

SEQ ID NO: 7014 - DNA, 25 bp, Rattus norvegicus
aaactacaactctgtcaccttttca

SEQ ID NO: 7015 - DNA, 25 bp, Rattus norvegicus
aaactacaattaccctctaaggatg

SEQ ID NO: 7016 - DNA, 25 bp, Rattus norvegicus
aaactacaattagcctctaaggatg

SEQ ID NO: 7017 - DNA, 25 bp, Rattus norvegicus
aaactacacatgcaggtgcacacct

SEQ ID NO: 7018 - DNA, 25 bp, Rattus norvegicus
aaactacacatggaggtgcacacct

SEQ ID NO: 7019 - DNA, 25 bp, Rattus norvegicus
aaactacaggatcaccagggccgaa

SEQ ID NO: 7020 - DNA, 25 bp, Rattus norvegicus
aaactacaggatgaccagggccgaa

SEQ ID NO: 7021 - DNA, 25 bp, Rattus norvegicus
aaactacagtctattgattctccag

SEQ ID NO: 7022 - DNA, 25 bp, Rattus norvegicus
aaactacagtcttttgattctccag

SEQ ID NO: 7023 - DNA, 25 bp, Rattus norvegicus
aaactacagtgcaagcctttctctt

SEQ ID NO: 7024 - DNA, 25 bp, Rattus norvegicus
aaactacagtgctagcctttctctt

SEQ ID NO: 7025 - DNA, 25 bp, Rattus norvegicus
aaactacatggcacttaatggacac

SEQ ID NO: 7026 - DNA, 25 bp, Rattus norvegicus
aaactacatggctcttaatggacac

SEQ ID NO: 7027 - DNA, 25 bp, Rattus norvegicus
aaactacattccagttactgaccac

SEQ ID NO: 7028 - DNA, 25 bp, Rattus norvegicus
aaactacattcctgttactgaccac

SEQ ID NO: 7029 - DNA, 25 bp, Rattus norvegicus
aaactacatttaatgtcctgaggaa

SEQ ID NO: 7030 - DNA, 25 bp, Rattus norvegicus
aaactacatttattgtcctgaggaa

SEQ ID NO: 7031 - DNA, 25 bp, Rattus norvegicus
aaactaccaagaagcctgaggcaga

SEQ ID NO: 7032 - DNA, 25 bp, Rattus norvegicus
aaactaccaagatgcctgaggcaga

SEQ ID NO: 7033 - DNA, 25 bp, Rattus norvegicus
aaactaccagaactttaccagctgg

SEQ ID NO: 7034 - DNA, 25 bp, Rattus norvegicus
aaactaccagaagtttaccagctgg

SEQ ID NO: 7035 - DNA, 25 bp, Rattus norvegicus
aaactaccccacatatggtttacat

SEQ ID NO: 7036 - DNA, 25 bp, Rattus norvegicus
aaactaccccacttatggtttacat

SEQ ID NO: 7037 - DNA, 25 bp, Rattus norvegicus
aaactacggaatcttcatccagcct

SEQ ID NO: 7038 - DNA, 25 bp, Rattus norvegicus
aaactacggaatgttcatccagcct

SEQ ID NO: 7039 - DNA, 25 bp, Rattus norvegicus
aaactacgtaatcgccagcttctac

SEQ ID NO: 7040 - DNA, 25 bp, Rattus norvegicus
aaactacgtaatggccagcttctac

SEQ ID NO: 7041 - DNA, 25 bp, Rattus norvegicus
aaactactacgacagtttgggctgt

SEQ ID NO: 7042 - DNA, 25 bp, Rattus norvegicus
aaactactacgagagtttgggctgt

SEQ ID NO: 7043 - DNA, 25 bp, Rattus norvegicus
aaactactactacctctacacttct

SEQ ID NO: 7044 - DNA, 25 bp, Rattus norvegicus
aaactactactagctctacacttct

SEQ ID NO: 7045 - DNA, 25 bp, Rattus norvegicus
aaactactcataagccctgtattat

SEQ ID NO: 7046 - DNA, 25 bp, Rattus norvegicus
aaactactcatatgccctgtattat

SEQ ID NO: 7047 - DNA, 25 bp, Rattus norvegicus
aaactactccggatggacactccaa

SEQ ID NO: 7048 - DNA, 25 bp, Rattus norvegicus
aaactactccggttggacactccaa

SEQ ID NO: 7049 - DNA, 25 bp, Rattus norvegicus
aaactactgaatacctgtgcagggt

SEQ ID NO: 7050 - DNA, 25 bp, Rattus norvegicus
aaactactgaattcctgtgcagggt

SEQ ID NO: 7051 - DNA, 25 bp, Rattus norvegicus
aaactactgatgacttgacttaaaa

SEQ ID NO: 7052 - DNA, 25 bp, Rattus norvegicus
aaactactgatgcttgcttgcttcc

SEQ ID NO: 7053 - DNA, 25 bp, Rattus norvegicus
aaactactgatggttgcttgcttcc

SEQ ID NO: 7054 - DNA, 25 bp, Rattus norvegicus
aaactactgatgtcttgacttaaaa

SEQ ID NO: 7055 - DNA, 25 bp, Rattus norvegicus
aaactactgcatattaagcttccta

SEQ ID NO: 7056 - DNA, 25 bp, Rattus norvegicus
aaactactgcattttaagcttccta

SEQ ID NO: 7057 - DNA, 25 bp, Rattus norvegicus
aaactactggacataccaccctcat

SEQ ID NO: 7058 - DNA, 25 bp, Rattus norvegicus
aaactactggacttaccaccctcat

SEQ ID NO: 7059 - DNA, 25 bp, Rattus norvegicus
aaactactggcccttttatgtgaca

SEQ ID NO: 7060 - DNA, 25 bp, Rattus norvegicus
aaactactggccgttttatgtgaca

SEQ ID NO: 7061 - DNA, 25 bp, Rattus norvegicus
aaactactgtcgaattctggtctca

SEQ ID NO: 7062 - DNA, 25 bp, Rattus norvegicus
aaactactgtcgtattctggtctca

SEQ ID NO: 7063 - DNA, 25 bp, Rattus norvegicus
aaactactgtctcttcatttctgaa

SEQ ID NO: 7064 - DNA, 25 bp, Rattus norvegicus
aaactactgtctgttcatttctgaa

SEQ ID NO: 7065 - DNA, 25 bp, Rattus norvegicus
aaactactgtgcctgttgttgctgc

SEQ ID NO: 7066 - DNA, 25 bp, Rattus norvegicus
aaactactgtgcgtgttgttgctgc

SEQ ID NO: 7067 - DNA, 25 bp, Rattus norvegicus
aaactactgttcaagacaatcctaa

SEQ ID NO: 7068 - DNA, 25 bp, Rattus norvegicus
aaactactgttctagacaatcctaa

SEQ ID NO: 7069 - DNA, 25 bp, Rattus norvegicus
aaactacttatgcatctgcctctgc

SEQ ID NO: 7070 - DNA, 25 bp, Rattus norvegicus
aaactacttatggatctgcctctgc

SEQ ID NO: 7071 - DNA, 25 bp, Rattus norvegicus
aaactacttcatcacattttcatat

SEQ ID NO: 7072 - DNA, 25 bp, Rattus norvegicus
aaactacttcatgacattttcatat

SEQ ID NO: 7073 - DNA, 25 bp, Rattus norvegicus
aaactacttcccatattagatagat

SEQ ID NO: 7074 - DNA, 25 bp, Rattus norvegicus
aaactacttcccttattagatagat

SEQ ID NO: 7075 - DNA, 25 bp, Rattus norvegicus
aaactactttgacagcactcataat

SEQ ID NO: 7076 - DNA, 25 bp, Rattus norvegicus
aaactactttgagagcactcataat

SEQ ID NO: 7077 - DNA, 25 bp, Rattus norvegicus
aaactagaagatcctgggtttaagc

SEQ ID NO: 7078 - DNA, 25 bp, Rattus norvegicus
aaactagaagatgctgggtttaagc

SEQ ID NO: 7079 - DNA, 25 bp, Rattus norvegicus
aaactagaagtgagtctccggctgt

SEQ ID NO: 7080 - DNA, 25 bp, Rattus norvegicus
aaactagaagtgtgtctccggctgt

SEQ ID NO: 7081 - DNA, 25 bp, Rattus norvegicus
aaactagattgtccgctcctcgaga

SEQ ID NO: 7082 - DNA, 25 bp, Rattus norvegicus
aaactagattgtgcgctcctcgaga

SEQ ID NO: 7083 - DNA, 25 bp, Rattus norvegicus
aaactagcaactctggcttcttcct

SEQ ID NO: 7084 - DNA, 25 bp, Rattus norvegicus
aaactagcaactgtggcttcttcct

SEQ ID NO: 7085 - DNA, 25 bp, Rattus norvegicus
aaactagcagtgagcttcagccctg

SEQ ID NO: 7086 - DNA, 25 bp, Rattus norvegicus
aaactagcagtgtgcttcagccctg

SEQ ID NO: 7087 - DNA, 25 bp, Rattus norvegicus
aaactagcatgtctccattgaacaa

SEQ ID NO: 7088 - DNA, 25 bp, Rattus norvegicus
aaactagcatgtgtccattgaacaa

SEQ ID NO: 7089 - DNA, 25 bp, Rattus norvegicus
aaactagcctatccatgaagtggat

SEQ ID NO: 7090 - DNA, 25 bp, Rattus norvegicus
aaactagcctatgcatgaagtggat

SEQ ID NO: 7091 - DNA, 25 bp, Rattus norvegicus
aaactagcgtttccatttgataata

SEQ ID NO: 7092 - DNA, 25 bp, Rattus norvegicus
aaactagcgtttgcatttgataata

SEQ ID NO: 7093 - DNA, 25 bp, Rattus norvegicus
aaactagctacgaagccaggctggc

SEQ ID NO: 7094 - DNA, 25 bp, Rattus norvegicus
aaactagctacgtagccaggctggc

SEQ ID NO: 7095 - DNA, 25 bp, Rattus norvegicus
aaactaggagatcttgcccaccatc

SEQ ID NO: 7096 - DNA, 25 bp, Rattus norvegicus
aaactaggagatgttgcccaccatc

SEQ ID NO: 7097 - DNA, 25 bp, Rattus norvegicus
aaactaggattcacaagcaagtgct

SEQ ID NO: 7098 - DNA, 25 bp, Rattus norvegicus
aaactaggattctcaagcaagtgct

SEQ ID NO: 7099 - DNA, 25 bp, Rattus norvegicus
aaactagtgggcattgcgatttctc

SEQ ID NO: 7100 - DNA, 25 bp, Rattus norvegicus
aaactagtgggctttgcgatttctc

SEQ ID NO: 7101 - DNA, 25 bp, Rattus norvegicus
aaactagttgcaccctgaggcttct

SEQ ID NO: 7102 - DNA, 25 bp, Rattus norvegicus
aaactagttgcagcctgaggcttct

SEQ ID NO: 7103 - DNA, 25 bp, Rattus norvegicus
aaactagttgtgagtctgtctggga

SEQ ID NO: 7104 - DNA, 25 bp, Rattus norvegicus
aaactagttgtgtgtctgtctggga

SEQ ID NO: 7105 - DNA, 25 bp, Rattus norvegicus
aaactataggagctgcgtctacaat

SEQ ID NO: 7106 - DNA, 25 bp, Rattus norvegicus
aaactataggaggtgcgtctacaat

SEQ ID NO: 7107 - DNA, 25 bp, Rattus norvegicus
aaactatatttcacctatcaaggat

SEQ ID NO: 7108 - DNA, 25 bp, Rattus norvegicus
aaactatatttctcctatcaaggat

SEQ ID NO: 7109 - DNA, 25 bp, Rattus norvegicus
aaactatccccgcaagctgaggaat

SEQ ID NO: 7110 - DNA, 25 bp, Rattus norvegicus
aaactatccccggaagctgaggaat

SEQ ID NO: 7111 - DNA, 25 bp, Rattus norvegicus
aaactatctgaaactggcctaccac

SEQ ID NO: 7112 - DNA, 25 bp, Rattus norvegicus
aaactatctgaatctggcctaccac

SEQ ID NO: 7113 - DNA, 25 bp, Rattus norvegicus
aaactatctgggacatcattcttga

SEQ ID NO: 7114 - DNA, 25 bp, Rattus norvegicus
aaactatctgggtcatcattcttga

SEQ ID NO: 7115 - DNA, 25 bp, Rattus norvegicus
aaactatgattcagagggcccacac

SEQ ID NO: 7116 - DNA, 25 bp, Rattus norvegicus
aaactatgattctgagggcccacac

SEQ ID NO: 7117 - DNA, 25 bp, Rattus norvegicus
aaactattagcacccatattacctg

SEQ ID NO: 7118 - DNA, 25 bp, Rattus norvegicus
aaactattagcagccatattacctg

SEQ ID NO: 7119 - DNA, 25 bp, Rattus norvegicus
aaactattccctacaactcgtgtgt

SEQ ID NO: 7120 - DNA, 25 bp, Rattus norvegicus
aaactattcccttcaactcgtgtgt

SEQ ID NO: 7121 - DNA, 25 bp, Rattus norvegicus
aaactattctgcagctttctttaaa

SEQ ID NO: 7122 - DNA, 25 bp, Rattus norvegicus
aaactattctgctgctttctttaaa

SEQ ID NO: 7123 - DNA, 25 bp, Rattus norvegicus
aaactattctttatctccactttgt

SEQ ID NO: 7124 - DNA, 25 bp, Rattus norvegicus
aaactattctttttctccactttgt

SEQ ID NO: 7125 - DNA, 25 bp, Rattus norvegicus
aaactattgcatatgttcacaggaa

SEQ ID NO: 7126 - DNA, 25 bp, Rattus norvegicus
aaactattgcatttgttcacaggaa

SEQ ID NO: 7127 - DNA, 25 bp, Rattus norvegicus
aaactatttccactcttgttcttag

SEQ ID NO: 7128 - DNA, 25 bp, Rattus norvegicus
aaactatttccagtcttgttcttag

SEQ ID NO: 7129 - DNA, 25 bp, Rattus norvegicus
aaactatttcgtcattcttcccaag

SEQ ID NO: 7130 - DNA, 25 bp, Rattus norvegicus
aaactatttcgtgattcttcccaag

SEQ ID NO: 7131 - DNA, 25 bp, Rattus norvegicus
aaactcaaactcatacaccgcggtg

SEQ ID NO: 7132 - DNA, 25 bp, Rattus norvegicus
aaactcaaactcttacaccgcggtg

SEQ ID NO: 7133 - DNA, 25 bp, Rattus norvegicus
aaactcaaagacatcctcctgcctt

SEQ ID NO: 7134 - DNA, 25 bp, Rattus norvegicus
aaactcaaagacttcctcctgcctt

SEQ ID NO: 7135 - DNA, 25 bp, Rattus norvegicus
aaactcaacgggagctgctgcccga

SEQ ID NO: 7136 - DNA, 25 bp, Rattus norvegicus
aaactcaacgggtgctgctgcccga

SEQ ID NO: 7137 - DNA, 25 bp, Rattus norvegicus
aaactcaagccccatcccatgttgt

SEQ ID NO: 7138 - DNA, 25 bp, Rattus norvegicus
aaactcaagcccgatcccatgttgt

SEQ ID NO: 7139 - DNA, 25 bp, Rattus norvegicus
aaactcaagcgtaagagcagtccaa

SEQ ID NO: 7140 - DNA, 25 bp, Rattus norvegicus
aaactcaagcgttagagcagtccaa

SEQ ID NO: 7141 - DNA, 25 bp, Rattus norvegicus
aaactcaaggacctggctacccaga

SEQ ID NO: 7142 - DNA, 25 bp, Rattus norvegicus
aaactcaaggacgtggctacccaga

SEQ ID NO: 7143 - DNA, 25 bp, Rattus norvegicus
aaactcaagtgcctgctacacatac

SEQ ID NO: 7144 - DNA, 25 bp, Rattus norvegicus
aaactcaagtgcgtgctacacatac

SEQ ID NO: 7145 - DNA, 25 bp, Rattus norvegicus
aaactcaagtggaagcctgcctaag

SEQ ID NO: 7146 - DNA, 25 bp, Rattus norvegicus
aaactcaagtggtagcctgcctaag

SEQ ID NO: 7147 - DNA, 25 bp, Rattus norvegicus
aaactcaagtgtccctcgcctgaaa

SEQ ID NO: 7148 - DNA, 25 bp, Rattus norvegicus
aaactcaagtgtgcctcgcctgaaa

SEQ ID NO: 7149 - DNA, 25 bp, Rattus norvegicus
aaactcaagttcaggtacactaaat

SEQ ID NO: 7150 - DNA, 25 bp, Rattus norvegicus
aaactcaagttctggtacactaaat

SEQ ID NO: 7151 - DNA, 25 bp, Rattus norvegicus
aaactcaatggcagcgatgaataca

SEQ ID NO: 7152 - DNA, 25 bp, Rattus norvegicus
aaactcaatggcatttgctgcttgc

SEQ ID NO: 7153 - DNA, 25 bp, Rattus norvegicus
aaactcaatggctgcgatgaataca

SEQ ID NO: 7154 - DNA, 25 bp, Rattus norvegicus
aaactcaatggcttttgctgcttgc

SEQ ID NO: 7155 - DNA, 25 bp, Rattus norvegicus
aaactcacagccagactcttgtgac

SEQ ID NO: 7156 - DNA, 25 bp, Rattus norvegicus
aaactcacagcctgactcttgtgac

SEQ ID NO: 7157 - DNA, 25 bp, Rattus norvegicus
aaactcacagctacaatggctccta

SEQ ID NO: 7158 - DNA, 25 bp, Rattus norvegicus
aaactcacagcttcaatggctccta

SEQ ID NO: 7159 - DNA, 25 bp, Rattus norvegicus
aaactcacagtaccagctgggcatg

SEQ ID NO: 7160 - DNA, 25 bp, Rattus norvegicus
aaactcacagtagcagctgggcatg

SEQ ID NO: 7161 - DNA, 25 bp, Rattus norvegicus
aaactcacatagcttacttctctct

SEQ ID NO: 7162 - DNA, 25 bp, Rattus norvegicus
aaactcacataggttacttctctct

SEQ ID NO: 7163 - DNA, 25 bp, Rattus norvegicus
aaactcacccaaatgcaactaaata

SEQ ID NO: 7164 - DNA, 25 bp, Rattus norvegicus
aaactcacccaattgcaactaaata

SEQ ID NO: 7165 - DNA, 25 bp, Rattus norvegicus
aaactcacctccacctggaaggctt

SEQ ID NO: 7166 - DNA, 25 bp, Rattus norvegicus
aaactcacctcctcctggaaggctt

SEQ ID NO: 7167 - DNA, 25 bp, Rattus norvegicus
aaactcacgttaagaccttgccttg

SEQ ID NO: 7168 - DNA, 25 bp, Rattus norvegicus
aaactcacgttatgaccttgccttg

SEQ ID NO: 7169 - DNA, 25 bp, Rattus norvegicus
aaactcactagcacatttttatcag

SEQ ID NO: 7170 - DNA, 25 bp, Rattus norvegicus
aaactcactagctcatttttatcag

SEQ ID NO: 7171 - DNA, 25 bp, Rattus norvegicus
aaactcactccgcacaccagatgta

SEQ ID NO: 7172 - DNA, 25 bp, Rattus norvegicus
aaactcactccggacaccagatgta

SEQ ID NO: 7173 - DNA, 25 bp, Rattus norvegicus
aaactcactgttacggagccacggc

SEQ ID NO: 7174 - DNA, 25 bp, Rattus norvegicus
aaactcactgtttcggagccacggc

SEQ ID NO: 7175 - DNA, 25 bp, Rattus norvegicus
aaactcagaatgatactcccgcctg

SEQ ID NO: 7176 - DNA, 25 bp, Rattus norvegicus
aaactcagaatgttactcccgcctg

SEQ ID NO: 7177 - DNA, 25 bp, Rattus norvegicus
aaactcagacagattcgcaagcgct

SEQ ID NO: 7178 - DNA, 25 bp, Rattus norvegicus
aaactcagacagtttcgcaagcgct

SEQ ID NO: 7179 - DNA, 25 bp, Rattus norvegicus
aaactcagaccaatagtcctacctc

SEQ ID NO: 7180 - DNA, 25 bp, Rattus norvegicus
aaactcagaccattagtcctacctc

SEQ ID NO: 7181 - DNA, 25 bp, Rattus norvegicus
aaactcagactgaccccagatgtca

SEQ ID NO: 7182 - DNA, 25 bp, Rattus norvegicus
aaactcagactgtccccagatgtca

SEQ ID NO: 7183 - DNA, 25 bp, Rattus norvegicus
aaactcagatacagctcctaattgg

SEQ ID NO: 7184 - DNA, 25 bp, Rattus norvegicus
aaactcagatactgctcctaattgg

SEQ ID NO: 7185 - DNA, 25 bp, Rattus norvegicus
aaactcagattgacaaacttggcag

SEQ ID NO: 7186 - DNA, 25 bp, Rattus norvegicus
aaactcagattgtcaaacttggcag

SEQ ID NO: 7187 - DNA, 25 bp, Rattus norvegicus
aaactcagcacgagcagctcaacac

SEQ ID NO: 7188 - DNA, 25 bp, Rattus norvegicus
aaactcagcacgtgcagctcaacac

SEQ ID NO: 7189 - DNA, 25 bp, Rattus norvegicus
aaactcagcagactttggacacatg

SEQ ID NO: 7190 - DNA, 25 bp, Rattus norvegicus
aaactcagcagagtttggacacatg

SEQ ID NO: 7191 - DNA, 25 bp, Rattus norvegicus
aaactcagccgtctggctttcatcg

SEQ ID NO: 7192 - DNA, 25 bp, Rattus norvegicus
aaactcagccgtgtggctttcatcg

SEQ ID NO: 7193 - DNA, 25 bp, Rattus norvegicus
aaactcagcgggagcaagtcttaat

SEQ ID NO: 7194 - DNA, 25 bp, Rattus norvegicus
aaactcagcgggtgcaagtcttaat

SEQ ID NO: 7195 - DNA, 25 bp, Rattus norvegicus
aaactcaggagtactccccgccaga

SEQ ID NO: 7196 - DNA, 25 bp, Rattus norvegicus
aaactcaggagttctccccgccaga

SEQ ID NO: 7197 - DNA, 25 bp, Rattus norvegicus
aaactcaggatcctgtctgagagga

SEQ ID NO: 7198 - DNA, 25 bp, Rattus norvegicus
aaactcaggatcgtgtctgagagga

SEQ ID NO: 7199 - DNA, 25 bp, Rattus norvegicus
aaactcaggctgacgggcttggcag

SEQ ID NO: 7200 - DNA, 25 bp, Rattus norvegicus
aaactcaggctgtcgggcttggcag

SEQ ID NO: 7201 - DNA, 25 bp, Rattus norvegicus
aaactcaggtgaccctggaccttag

SEQ ID NO: 7202 - DNA, 25 bp, Rattus norvegicus
aaactcaggtgagcctggaccttag

SEQ ID NO: 7203 - DNA, 25 bp, Rattus norvegicus
aaactcaggtttacagtggctatgc

SEQ ID NO: 7204 - DNA, 25 bp, Rattus norvegicus
aaactcaggttttcagtggctatgc

SEQ ID NO: 7205 - DNA, 25 bp, Rattus norvegicus
aaactcagtccaacggtccgtggaa

SEQ ID NO: 7206 - DNA, 25 bp, Rattus norvegicus
aaactcagtccatcggtccgtggaa

SEQ ID NO: 7207 - DNA, 25 bp, Rattus norvegicus
aaactcagtgacctccgaaccaggg

SEQ ID NO: 7208 - DNA, 25 bp, Rattus norvegicus
aaactcagtgacgtccgaaccaggg

SEQ ID NO: 7209 - DNA, 25 bp, Rattus norvegicus
aaactcagtgttcagagctcgggca

SEQ ID NO: 7210 - DNA, 25 bp, Rattus norvegicus
aaactcagtgttgagagctcgggca

SEQ ID NO: 7211 - DNA, 25 bp, Rattus norvegicus
aaactcataattcttccatcatcag

SEQ ID NO: 7212 - DNA, 25 bp, Rattus norvegicus
aaactcataattgttccatcatcag

SEQ ID NO: 7213 - DNA, 25 bp, Rattus norvegicus
aaactcatcattctcgcttctggtt

SEQ ID NO: 7214 - DNA, 25 bp, Rattus norvegicus
aaactcatcattgtcgcttctggtt

SEQ ID NO: 7215 - DNA, 25 bp, Rattus norvegicus
aaactcatcgagcactaaacacaaa

SEQ ID NO: 7216 - DNA, 25 bp, Rattus norvegicus
aaactcatcgaggactaaacacaaa

SEQ ID NO: 7217 - DNA, 25 bp, Rattus norvegicus
aaactcatcggcagccttagggttt

SEQ ID NO: 7218 - DNA, 25 bp, Rattus norvegicus
aaactcatcggctgccttagggttt

SEQ ID NO: 7219 - DNA, 25 bp, Rattus norvegicus
aaactcatcttacacagcaccgtag

SEQ ID NO: 7220 - DNA, 25 bp, Rattus norvegicus
aaactcatcttagacagcaccgtag

SEQ ID NO: 7221 - DNA, 25 bp, Rattus norvegicus
aaactcatctttccaaactaacttg

SEQ ID NO: 7222 - DNA, 25 bp, Rattus norvegicus
aaactcatctttgcaaactaacttg

SEQ ID NO: 7223 - DNA, 25 bp, Rattus norvegicus
aaactcatgactaatctttgtgcaa

SEQ ID NO: 7224 - DNA, 25 bp, Rattus norvegicus
aaactcatgacttatctttgtgcaa

SEQ ID NO: 7225 - DNA, 25 bp, Rattus norvegicus
aaactcatgctcagtgtctctatct

SEQ ID NO: 7226 - DNA, 25 bp, Rattus norvegicus
aaactcatgctctgtgtctctatct

SEQ ID NO: 7227 - DNA, 25 bp, Rattus norvegicus
aaactcatggagacatgccagggaa

SEQ ID NO: 7228 - DNA, 25 bp, Rattus norvegicus
aaactcatggagtcatgccagggaa

SEQ ID NO: 7229 - DNA, 25 bp, Rattus norvegicus
aaactcatggctatgtgcatcggaa

SEQ ID NO: 7230 - DNA, 25 bp, Rattus norvegicus
aaactcatggctttgtgcatcggaa

SEQ ID NO: 7231 - DNA, 25 bp, Rattus norvegicus
aaactcattacaatacttcagacaa

SEQ ID NO: 7232 - DNA, 25 bp, Rattus norvegicus
aaactcattacattacttcagacaa

SEQ ID NO: 7233 - DNA, 25 bp, Rattus norvegicus
aaactcattccaaggatggctgcct

SEQ ID NO: 7234 - DNA, 25 bp, Rattus norvegicus
aaactcattccatggatggctgcct

SEQ ID NO: 7235 - DNA, 25 bp, Rattus norvegicus
aaactcatttcacatccttctgtat

SEQ ID NO: 7236 - DNA, 25 bp, Rattus norvegicus
aaactcatttcagatccttctgtat

SEQ ID NO: 7237 - DNA, 25 bp, Rattus norvegicus
aaactcatttccagcttccggatac

SEQ ID NO: 7238 - DNA, 25 bp, Rattus norvegicus
aaactcatttcctgcttccggatac

SEQ ID NO: 7239 - DNA, 25 bp, Rattus norvegicus
aaactcatttgtatcgtctgctcta

SEQ ID NO: 7240 - DNA, 25 bp, Rattus norvegicus
aaactcatttgtttcgtctgctcta

SEQ ID NO: 7241 - DNA, 25 bp, Rattus norvegicus
aaactcattttaatcttattcagac

SEQ ID NO: 7242 - DNA, 25 bp, Rattus norvegicus
aaactcattttattcttattcagac

SEQ ID NO: 7243 - DNA, 25 bp, Rattus norvegicus
aaactcattttgcttgtggcgccac

SEQ ID NO: 7244 - DNA, 25 bp, Rattus norvegicus
aaactcattttggttgtggcgccac

SEQ ID NO: 7245 - DNA, 25 bp, Rattus norvegicus
aaactccaacccagatgagattgag

SEQ ID NO: 7246 - DNA, 25 bp, Rattus norvegicus
aaactccaaccctgatgagattgag

SEQ ID NO: 7247 - DNA, 25 bp, Rattus norvegicus
aaactccaactacagcagctctgcg

SEQ ID NO: 7248 - DNA, 25 bp, Rattus norvegicus
aaactccaactagagcagctctgcg

SEQ ID NO: 7249 - DNA, 25 bp, Rattus norvegicus
aaactccacactacacaaattatcc

SEQ ID NO: 7250 - DNA, 25 bp, Rattus norvegicus
aaactccacacttcacaaattatcc

SEQ ID NO: 7251 - DNA, 25 bp, Rattus norvegicus
aaactccacctccttttgtgtgaag

SEQ ID NO: 7252 - DNA, 25 bp, Rattus norvegicus
aaactccacctcgttttgtgtgaag

SEQ ID NO: 7253 - DNA, 25 bp, Rattus norvegicus
aaactccactgtagttctcaaatct

SEQ ID NO: 7254 - DNA, 25 bp, Rattus norvegicus
aaactccactgttgttctcaaatct

SEQ ID NO: 7255 - DNA, 25 bp, Rattus norvegicus
aaactccagagtatgcccactgggt

SEQ ID NO: 7256 - DNA, 25 bp, Rattus norvegicus
aaactccagagtttgcccactgggt

SEQ ID NO: 7257 - DNA, 25 bp, Rattus norvegicus
aaactccaggacactcaggacagaa

SEQ ID NO: 7258 - DNA, 25 bp, Rattus norvegicus
aaactccaggacagtatctgtgact

SEQ ID NO: 7259 - DNA, 25 bp, Rattus norvegicus
aaactccaggactctcaggacagaa

SEQ ID NO: 7260 - DNA, 25 bp, Rattus norvegicus
aaactccaggactgtatctgtgact

SEQ ID NO: 7261 - DNA, 25 bp, Rattus norvegicus
aaactccagggtatcctgcgagtat

SEQ ID NO: 7262 - DNA, 25 bp, Rattus norvegicus
aaactccagggtttcctgcgagtat

SEQ ID NO: 7263 - DNA, 25 bp, Rattus norvegicus
aaactccaggtcaagcttgttgtat

SEQ ID NO: 7264 - DNA, 25 bp, Rattus norvegicus
aaactccaggtctagcttgttgtat

SEQ ID NO: 7265 - DNA, 25 bp, Rattus norvegicus
aaactccaggtgctgtgatcactac

SEQ ID NO: 7266 - DNA, 25 bp, Rattus norvegicus
aaactccaggtggtgtgatcactac

SEQ ID NO: 7267 - DNA, 25 bp, Rattus norvegicus
aaactccagtgtcggacaagcctgt

SEQ ID NO: 7268 - DNA, 25 bp, Rattus norvegicus
aaactccagtgtgggacaagcctgt

SEQ ID NO: 7269 - DNA, 25 bp, Rattus norvegicus
aaactccatcccatggtttgtgttg

SEQ ID NO: 7270 - DNA, 25 bp, Rattus norvegicus
aaactccatcccttggtttgtgttg

SEQ ID NO: 7271 - DNA, 25 bp, Rattus norvegicus
aaactccatgccagactcatcataa

SEQ ID NO: 7272 - DNA, 25 bp, Rattus norvegicus
aaactccatgcctgactcatcataa

SEQ ID NO: 7273 - DNA, 25 bp, Rattus norvegicus
aaactccattacacagctttgcttc

SEQ ID NO: 7274 - DNA, 25 bp, Rattus norvegicus
aaactccattactcagctttgcttc

SEQ ID NO: 7275 - DNA, 25 bp, Rattus norvegicus
aaactccattagaacaacgctcctg

SEQ ID NO: 7276 - DNA, 25 bp, Rattus norvegicus
aaactccattagtacaacgctcctg

SEQ ID NO: 7277 - DNA, 25 bp, Rattus norvegicus
aaactccattccacagtgtcttttt

SEQ ID NO: 7278 - DNA, 25 bp, Rattus norvegicus
aaactccattcctcagtgtcttttt

SEQ ID NO: 7279 - DNA, 25 bp, Rattus norvegicus
aaactccattgtacggactcatcac

SEQ ID NO: 7280 - DNA, 25 bp, Rattus norvegicus
aaactccattgttcggactcatcac

SEQ ID NO: 7281 - DNA, 25 bp, Rattus norvegicus
aaactccatttcacatatcattcgc

SEQ ID NO: 7282 - DNA, 25 bp, Rattus norvegicus
aaactccatttctcatatcattcgc

SEQ ID NO: 7283 - DNA, 25 bp, Rattus norvegicus
aaactccattttagagctctctgcc

SEQ ID NO: 7284 - DNA, 25 bp, Rattus norvegicus
aaactccatttttgagctctctgcc

SEQ ID NO: 7285 - DNA, 25 bp, Rattus norvegicus
aaactcccaagacttgtctccttgt

SEQ ID NO: 7286 - DNA, 25 bp, Rattus norvegicus
aaactcccaagagttgtctccttgt

SEQ ID NO: 7287 - DNA, 25 bp, Rattus norvegicus
aaactcccacaaagcagccgggtaa

SEQ ID NO: 7288 - DNA, 25 bp, Rattus norvegicus
aaactcccacaatgcagccgggtaa

SEQ ID NO: 7289 - DNA, 25 bp, Rattus norvegicus
aaactcccagcacgcgtaccaagaa

SEQ ID NO: 7290 - DNA, 25 bp, Rattus norvegicus
aaactcccagcactgttacttcctt

SEQ ID NO: 7291 - DNA, 25 bp, Rattus norvegicus
aaactcccagcaggcgtaccaagaa

SEQ ID NO: 7292 - DNA, 25 bp, Rattus norvegicus
aaactcccagcagtgttacttcctt

SEQ ID NO: 7293 - DNA, 25 bp, Rattus norvegicus
aaactcccagctcggtacgatcaaa

SEQ ID NO: 7294 - DNA, 25 bp, Rattus norvegicus
aaactcccagctgggtacgatcaaa

SEQ ID NO: 7295 - DNA, 25 bp, Rattus norvegicus
aaactcccagttctgtccttcagtg

SEQ ID NO: 7296 - DNA, 25 bp, Rattus norvegicus
aaactcccagttgtgtccttcagtg

SEQ ID NO: 7297 - DNA, 25 bp, Rattus norvegicus
aaactcccctacaggtttcagatag

SEQ ID NO: 7298 - DNA, 25 bp, Rattus norvegicus
aaactcccctactggtttcagatag

SEQ ID NO: 7299 - DNA, 25 bp, Rattus norvegicus
aaactcccgccgatgagtgagtaca

SEQ ID NO: 7300 - DNA, 25 bp, Rattus norvegicus
aaactcccgccgttgagtgagtaca

SEQ ID NO: 7301 - DNA, 25 bp, Rattus norvegicus
aaactcccgctccaagcagaggaga

SEQ ID NO: 7302 - DNA, 25 bp, Rattus norvegicus
aaactcccgctcgaagcagaggaga

SEQ ID NO: 7303 - DNA, 25 bp, Rattus norvegicus
aaactccctaacacatgtgccagat

SEQ ID NO: 7304 - DNA, 25 bp, Rattus norvegicus
aaactccctaactcatgtgccagat

SEQ ID NO: 7305 - DNA, 25 bp, Rattus norvegicus
aaactcccttttctcctgcagcaat

SEQ ID NO: 7306 - DNA, 25 bp, Rattus norvegicus
aaactcccttttgtcctgcagcaat

SEQ ID NO: 7307 - DNA, 25 bp, Rattus norvegicus
aaactccgaccaatcagctactgtg

SEQ ID NO: 7308 - DNA, 25 bp, Rattus norvegicus
aaactccgaccattcagctactgtg

SEQ ID NO: 7309 - DNA, 25 bp, Rattus norvegicus
aaactccggaatcctagtctgtatt

SEQ ID NO: 7310 - DNA, 25 bp, Rattus norvegicus
aaactccggaatgctagtctgtatt

SEQ ID NO: 7311 - DNA, 25 bp, Rattus norvegicus
aaactccgtcatcttggactgggta

SEQ ID NO: 7312 - DNA, 25 bp, Rattus norvegicus
aaactccgtcatgttggactgggta

SEQ ID NO: 7313 - DNA, 25 bp, Rattus norvegicus
aaactccgtcgtcagatctacaagg

SEQ ID NO: 7314 - DNA, 25 bp, Rattus norvegicus
aaactccgtcgtgagatctacaagg

SEQ ID NO: 7315 - DNA, 25 bp, Rattus norvegicus
aaactccgtggcagatgtcatgtca

SEQ ID NO: 7316 - DNA, 25 bp, Rattus norvegicus
aaactccgtggctgatgtcatgtca

SEQ ID NO: 7317 - DNA, 25 bp, Rattus norvegicus
aaactcctcagcacctcaataggat

SEQ ID NO: 7318 - DNA, 25 bp, Rattus norvegicus
aaactcctcagctcctcaataggat

SEQ ID NO: 7319 - DNA, 25 bp, Rattus norvegicus
aaactcctcatcagtctcatgtgac

SEQ ID NO: 7320 - DNA, 25 bp, Rattus norvegicus
aaactcctcatctgtctcatgtgac

SEQ ID NO: 7321 - DNA, 25 bp, Rattus norvegicus
aaactcctgcataagtactgtgcgt

SEQ ID NO: 7322 - DNA, 25 bp, Rattus norvegicus
aaactcctgcattagtactgtgcgt

SEQ ID NO: 7323 - DNA, 25 bp, Rattus norvegicus
aaactcctgcccatgcacttgaggt

SEQ ID NO: 7324 - DNA, 25 bp, Rattus norvegicus
aaactcctgcccctgcagtgagaaa

SEQ ID NO: 7325 - DNA, 25 bp, Rattus norvegicus
aaactcctgcccgtgcagtgagaaa

SEQ ID NO: 7326 - DNA, 25 bp, Rattus norvegicus
aaactcctgcccttgcacttgaggt

SEQ ID NO: 7327 - DNA, 25 bp, Rattus norvegicus
aaactcctgctgaagcccatgatga

SEQ ID NO: 7328 - DNA, 25 bp, Rattus norvegicus
aaactcctgctgtagcccatgatga

SEQ ID NO: 7329 - DNA, 25 bp, Rattus norvegicus
aaactcctggccctgaagttatcgt

SEQ ID NO: 7330 - DNA, 25 bp, Rattus norvegicus
aaactcctggccgtgaagttatcgt

SEQ ID NO: 7331 - DNA, 25 bp, Rattus norvegicus
aaactcctgggtcttagacatcgtc

SEQ ID NO: 7332 - DNA, 25 bp, Rattus norvegicus
aaactcctgggtgttagacatcgtc

SEQ ID NO: 7333 - DNA, 25 bp, Rattus norvegicus
aaactcctgtcgatgcatttataat

SEQ ID NO: 7334 - DNA, 25 bp, Rattus norvegicus
aaactcctgtcgttgcatttataat

SEQ ID NO: 7335 - DNA, 25 bp, Rattus norvegicus
aaactccttcaaatggtccttagca

SEQ ID NO: 7336 - DNA, 25 bp, Rattus norvegicus
aaactccttcaattggtccttagca

SEQ ID NO: 7337 - DNA, 25 bp, Rattus norvegicus
aaactccttcttattgtacacgtga

SEQ ID NO: 7338 - DNA, 25 bp, Rattus norvegicus
aaactccttctttttgtacacgtga

SEQ ID NO: 7339 - DNA, 25 bp, Rattus norvegicus
aaactccttgttagactgttcatag

SEQ ID NO: 7340 - DNA, 25 bp, Rattus norvegicus
aaactccttgtttgactgttcatag

SEQ ID NO: 7341 - DNA, 25 bp, Rattus norvegicus
aaactcgagaggacagtgtcactca

SEQ ID NO: 7342 - DNA, 25 bp, Rattus norvegicus
aaactcgagaggtcagtgtcactca

SEQ ID NO: 7343 - DNA, 25 bp, Rattus norvegicus
aaactcgagggtcctctttgctgtg

SEQ ID NO: 7344 - DNA, 25 bp, Rattus norvegicus
aaactcgagggtgctctttgctgtg

SEQ ID NO: 7345 - DNA, 25 bp, Rattus norvegicus
aaactcgagtgacaagcccgtagcc

SEQ ID NO: 7346 - DNA, 25 bp, Rattus norvegicus
aaactcgagtgagaagcccgtagcc

SEQ ID NO: 7347 - DNA, 25 bp, Rattus norvegicus
aaactcgattcaattggcctgagct

SEQ ID NO: 7348 - DNA, 25 bp, Rattus norvegicus
aaactcgattcatttggcctgagct

SEQ ID NO: 7349 - DNA, 25 bp, Rattus norvegicus
aaactcgcactgagagcccatggac

SEQ ID NO: 7350 - DNA, 25 bp, Rattus norvegicus
aaactcgcactgtgagcccatggac

SEQ ID NO: 7351 - DNA, 25 bp, Rattus norvegicus
aaactcgcagctcgcctggcagtgg

SEQ ID NO: 7352 - DNA, 25 bp, Rattus norvegicus
aaactcgcagctggcctggcagtgg

SEQ ID NO: 7353 - DNA, 25 bp, Rattus norvegicus
aaactcgcctgcatttgatttcttt

SEQ ID NO: 7354 - DNA, 25 bp, Rattus norvegicus
aaactcgcctgcttttgatttcttt

SEQ ID NO: 7355 - DNA, 25 bp, Rattus norvegicus
aaactcgcggagctcagtgcttaca

SEQ ID NO: 7356 - DNA, 25 bp, Rattus norvegicus
aaactcgcggaggtcagtgcttaca

SEQ ID NO: 7357 - DNA, 25 bp, Rattus norvegicus
aaactcgctgcacgacaacaacaac

SEQ ID NO: 7358 - DNA, 25 bp, Rattus norvegicus
aaactcgctgcaggacaacaacaac

SEQ ID NO: 7359 - DNA, 25 bp, Rattus norvegicus
aaactcggaaagctgtgtgggtcac

SEQ ID NO: 7360 - DNA, 25 bp, Rattus norvegicus
aaactcggaaaggtgtgtgggtcac

SEQ ID NO: 7361 - DNA, 25 bp, Rattus norvegicus
aaactcggatttaagccatcctgtc

SEQ ID NO: 7362 - DNA, 25 bp, Rattus norvegicus
aaactcggattttagccatcctgtc

SEQ ID NO: 7363 - DNA, 25 bp, Rattus norvegicus
aaactcggcagtcgctctacctgaa

SEQ ID NO: 7364 - DNA, 25 bp, Rattus norvegicus
aaactcggcagtggctctacctgaa

SEQ ID NO: 7365 - DNA, 25 bp, Rattus norvegicus
aaactcgggaagcagagcggactct

SEQ ID NO: 7366 - DNA, 25 bp, Rattus norvegicus
aaactcgggaaggagagcggactct

SEQ ID NO: 7367 - DNA, 25 bp, Rattus norvegicus
aaactcgggagaacactcagggctg

SEQ ID NO: 7368 - DNA, 25 bp, Rattus norvegicus
aaactcgggagatcactcagggctg

SEQ ID NO: 7369 - DNA, 25 bp, Rattus norvegicus
aaactcgggtctacaggattggtgg

SEQ ID NO: 7370 - DNA, 25 bp, Rattus norvegicus
aaactcgggtcttcaggattggtgg

SEQ ID NO: 7371 - DNA, 25 bp, Rattus norvegicus
aaactcggtaccatactctgacttt

SEQ ID NO: 7372 - DNA, 25 bp, Rattus norvegicus
aaactcggtaccttactctgacttt

SEQ ID NO: 7373 - DNA, 25 bp, Rattus norvegicus
aaactcggtctgagaacctattgat

SEQ ID NO: 7374 - DNA, 25 bp, Rattus norvegicus
aaactcggtctgtgaacctattgat

SEQ ID NO: 7375 - DNA, 25 bp, Rattus norvegicus
aaactcggttgcactaaggtcctgg

SEQ ID NO: 7376 - DNA, 25 bp, Rattus norvegicus
aaactcggttgctctaaggtcctgg

SEQ ID NO: 7377 - DNA, 25 bp, Rattus norvegicus
aaactcgtagatctcagctctgaat

SEQ ID NO: 7378 - DNA, 25 bp, Rattus norvegicus
aaactcgtagatgtcagctctgaat

SEQ ID NO: 7379 - DNA, 25 bp, Rattus norvegicus
aaactcgtaggtagtcctttgctgc

SEQ ID NO: 7380 - DNA, 25 bp, Rattus norvegicus
aaactcgtaggttgtcctttgctgc

SEQ ID NO: 7381 - DNA, 25 bp, Rattus norvegicus
aaactcgtattcattctgccaagcc

SEQ ID NO: 7382 - DNA, 25 bp, Rattus norvegicus
aaactcgtattctttctgccaagcc

SEQ ID NO: 7383 - DNA, 25 bp, Rattus norvegicus
aaactcgtcagcaactatctggagg

SEQ ID NO: 7384 - DNA, 25 bp, Rattus norvegicus
aaactcgtcagctactatctggagg

SEQ ID NO: 7385 - DNA, 25 bp, Rattus norvegicus
aaactcgtcagtctctttcacggat

SEQ ID NO: 7386 - DNA, 25 bp, Rattus norvegicus
aaactcgtcagtgtctttcacggat

SEQ ID NO: 7387 - DNA, 25 bp, Rattus norvegicus
aaactcgtgatcatgtgaaagctac

SEQ ID NO: 7388 - DNA, 25 bp, Rattus norvegicus
aaactcgtgatcttgtgaaagctac

SEQ ID NO: 7389 - DNA, 25 bp, Rattus norvegicus
aaactcgtggccagtgtgagtcaag

SEQ ID NO: 7390 - DNA, 25 bp, Rattus norvegicus
aaactcgtggcctgtgtgagtcaag

SEQ ID NO: 7391 - DNA, 25 bp, Rattus norvegicus
aaactcgtgtcaatagtctgtgggt

SEQ ID NO: 7392 - DNA, 25 bp, Rattus norvegicus
aaactcgtgtcattagtctgtgggt

SEQ ID NO: 7393 - DNA, 25 bp, Rattus norvegicus
aaactcgttttcctcattagccagc

SEQ ID NO: 7394 - DNA, 25 bp, Rattus norvegicus
aaactcgttttcgtcattagccagc

SEQ ID NO: 7395 - DNA, 25 bp, Rattus norvegicus
aaactctaaggcaccagcaatctct

SEQ ID NO: 7396 - DNA, 25 bp, Rattus norvegicus
aaactctaaggctccagcaatctct

SEQ ID NO: 7397 - DNA, 25 bp, Rattus norvegicus
aaactctactatagtggcttttcca

SEQ ID NO: 7398 - DNA, 25 bp, Rattus norvegicus
aaactctactattgtggcttttcca

SEQ ID NO: 7399 - DNA, 25 bp, Rattus norvegicus
aaactctagctcaaccacaaattgc

SEQ ID NO: 7400 - DNA, 25 bp, Rattus norvegicus
aaactctagctcacggtgagagaaa

SEQ ID NO: 7401 - DNA, 25 bp, Rattus norvegicus
aaactctagctcagtggtaactttt

SEQ ID NO: 7402 - DNA, 25 bp, Rattus norvegicus
aaactctagctctaccacaaattgc

SEQ ID NO: 7403 - DNA, 25 bp, Rattus norvegicus
aaactctagctctcggtgagagaaa

SEQ ID NO: 7404 - DNA, 25 bp, Rattus norvegicus
aaactctagctctgtggtaactttt

SEQ ID NO: 7405 - DNA, 25 bp, Rattus norvegicus
aaactctaggccagtctacattgat

SEQ ID NO: 7406 - DNA, 25 bp, Rattus norvegicus
aaactctaggcctgtctacattgat

SEQ ID NO: 7407 - DNA, 25 bp, Rattus norvegicus
aaactctaggtcacattcttacact

SEQ ID NO: 7408 - DNA, 25 bp, Rattus norvegicus
aaactctaggtctcattcttacact

SEQ ID NO: 7409 - DNA, 25 bp, Rattus norvegicus
aaactctagtctaagtcctgcctgt

SEQ ID NO: 7410 - DNA, 25 bp, Rattus norvegicus
aaactctagtcttagtcctgcctgt

SEQ ID NO: 7411 - DNA, 25 bp, Rattus norvegicus
aaactctatcctatgctgaggaaca

SEQ ID NO: 7412 - DNA, 25 bp, Rattus norvegicus
aaactctatcctttgctgaggaaca

SEQ ID NO: 7413 - DNA, 25 bp, Rattus norvegicus
aaactctcaattacagtgtggctat

SEQ ID NO: 7414 - DNA, 25 bp, Rattus norvegicus
aaactctcaattatgctgttagcaa

SEQ ID NO: 7415 - DNA, 25 bp, Rattus norvegicus
aaactctcaatttcagtgtggctat

SEQ ID NO: 7416 - DNA, 25 bp, Rattus norvegicus
aaactctcaattttgctgttagcaa

SEQ ID NO: 7417 - DNA, 25 bp, Rattus norvegicus
aaactctcaccaaggatctcatttc

SEQ ID NO: 7418 - DNA, 25 bp, Rattus norvegicus
aaactctcaccatggatctcatttc

SEQ ID NO: 7419 - DNA, 25 bp, Rattus norvegicus
aaactctcacccattttctctttgg

SEQ ID NO: 7420 - DNA, 25 bp, Rattus norvegicus
aaactctcaccctttttctctttgg

SEQ ID NO: 7421 - DNA, 25 bp, Rattus norvegicus
aaactctcacttaggatcctatttt

SEQ ID NO: 7422 - DNA, 25 bp, Rattus norvegicus
aaactctcactttggatcctatttt

SEQ ID NO: 7423 - DNA, 25 bp, Rattus norvegicus
aaactctcatcgcaggccacttagg

SEQ ID NO: 7424 - DNA, 25 bp, Rattus norvegicus
aaactctcatcggaggccacttagg

SEQ ID NO: 7425 - DNA, 25 bp, Rattus norvegicus
aaactctcccaaaaagctgtgacct

SEQ ID NO: 7426 - DNA, 25 bp, Rattus norvegicus
aaactctcccaataagctgtgacct

SEQ ID NO: 7427 - DNA, 25 bp, Rattus norvegicus
aaactctccctcaggaccaatatta

SEQ ID NO: 7428 - DNA, 25 bp, Rattus norvegicus
aaactctccctcatctttttagatg

SEQ ID NO: 7429 - DNA, 25 bp, Rattus norvegicus
aaactctccctctggaccaatatta

SEQ ID NO: 7430 - DNA, 25 bp, Rattus norvegicus
aaactctccctcttctttttagatg

SEQ ID NO: 7431 - DNA, 25 bp, Rattus norvegicus
aaactctccggaaacttcacatcag

SEQ ID NO: 7432 - DNA, 25 bp, Rattus norvegicus
aaactctccggatacttcacatcag

SEQ ID NO: 7433 - DNA, 25 bp, Rattus norvegicus
aaactctccgttaggcaaatgcttg

SEQ ID NO: 7434 - DNA, 25 bp, Rattus norvegicus
aaactctccgtttggcaaatgcttg

SEQ ID NO: 7435 - DNA, 25 bp, Rattus norvegicus
aaactctcgattatctctcctgctc

SEQ ID NO: 7436 - DNA, 25 bp, Rattus norvegicus
aaactctcgattttctctcctgctc

SEQ ID NO: 7437 - DNA, 25 bp, Rattus norvegicus
aaactctcgcttcgtctttagatcc

SEQ ID NO: 7438 - DNA, 25 bp, Rattus norvegicus
aaactctcgcttggtctttagatcc

SEQ ID NO: 7439 - DNA, 25 bp, Rattus norvegicus
aaactctcggacaaagttctcctca

SEQ ID NO: 7440 - DNA, 25 bp, Rattus norvegicus
aaactctcggactaagttctcctca

SEQ ID NO: 7441 - DNA, 25 bp, Rattus norvegicus
aaactctcggtgaacgagcctctgt

SEQ ID NO: 7442 - DNA, 25 bp, Rattus norvegicus
aaactctcggtgtacgagcctctgt

SEQ ID NO: 7443 - DNA, 25 bp, Rattus norvegicus
aaactctctaagaagctcaggatag

SEQ ID NO: 7444 - DNA, 25 bp, Rattus norvegicus
aaactctctaagtagctcaggatag

SEQ ID NO: 7445 - DNA, 25 bp, Rattus norvegicus
aaactctctcttctattaacgggct

SEQ ID NO: 7446 - DNA, 25 bp, Rattus norvegicus
aaactctctcttgtattaacgggct

SEQ ID NO: 7447 - DNA, 25 bp, Rattus norvegicus
aaactctcttcacctaaatgctttc

SEQ ID NO: 7448 - DNA, 25 bp, Rattus norvegicus
aaactctcttcagctaaatgctttc

SEQ ID NO: 7449 - DNA, 25 bp, Rattus norvegicus
aaactctgaagtcaacaagatgcca

SEQ ID NO: 7450 - DNA, 25 bp, Rattus norvegicus
aaactctgaagtgaacaagatgcca

SEQ ID NO: 7451 - DNA, 25 bp, Rattus norvegicus
aaactctgacacaatctcacagcag

SEQ ID NO: 7452 - DNA, 25 bp, Rattus norvegicus
aaactctgacactatctcacagcag

SEQ ID NO: 7453 - DNA, 25 bp, Rattus norvegicus
aaactctgagatctagctgcggcac

SEQ ID NO: 7454 - DNA, 25 bp, Rattus norvegicus
aaactctgagatgtagctgcggcac

SEQ ID NO: 7455 - DNA, 25 bp, Rattus norvegicus
aaactctgagcccttcaagactgga

SEQ ID NO: 7456 - DNA, 25 bp, Rattus norvegicus
aaactctgagccgttcaagactgga

SEQ ID NO: 7457 - DNA, 25 bp, Rattus norvegicus
aaactctgaggcaaccttagtctgc

SEQ ID NO: 7458 - DNA, 25 bp, Rattus norvegicus
aaactctgaggctaccttagtctgc

SEQ ID NO: 7459 - DNA, 25 bp, Rattus norvegicus
aaactctgatggacacactttttag

SEQ ID NO: 7460 - DNA, 25 bp, Rattus norvegicus
aaactctgatggtcacactttttag

SEQ ID NO: 7461 - DNA, 25 bp, Rattus norvegicus
aaactctgcagccaggttcgcaaga

SEQ ID NO: 7462 - DNA, 25 bp, Rattus norvegicus
aaactctgcagcgaggttcgcaaga

SEQ ID NO: 7463 - DNA, 25 bp, Rattus norvegicus
aaactctgcatcactcatttagtga

SEQ ID NO: 7464 - DNA, 25 bp, Rattus norvegicus
aaactctgcatctctcatttagtga

SEQ ID NO: 7465 - DNA, 25 bp, Rattus norvegicus
aaactctgccaacccggtgtggcgc

SEQ ID NO: 7466 - DNA, 25 bp, Rattus norvegicus
aaactctgccaagccggtgtggcgc

SEQ ID NO: 7467 - DNA, 25 bp, Rattus norvegicus
aaactctgccttagggatccggaga

SEQ ID NO: 7468 - DNA, 25 bp, Rattus norvegicus
aaactctgcctttgggatccggaga

SEQ ID NO: 7469 - DNA, 25 bp, Rattus norvegicus
aaactctgctaccttatgacacctt

SEQ ID NO: 7470 - DNA, 25 bp, Rattus norvegicus
aaactctgctacgttatgacacctt

SEQ ID NO: 7471 - DNA, 25 bp, Rattus norvegicus
aaactctgctataagctccttgtct

SEQ ID NO: 7472 - DNA, 25 bp, Rattus norvegicus
aaactctgctattagctccttgtct

SEQ ID NO: 7473 - DNA, 25 bp, Rattus norvegicus
aaactctgctccagggctgaactta

SEQ ID NO: 7474 - DNA, 25 bp, Rattus norvegicus
aaactctgctcctgggctgaactta

SEQ ID NO: 7475 - DNA, 25 bp, Rattus norvegicus
aaactctggactcatgtcatcgtgc

SEQ ID NO: 7476 - DNA, 25 bp, Rattus norvegicus
aaactctggactgatgtcatcgtgc

SEQ ID NO: 7477 - DNA, 25 bp, Rattus norvegicus
aaactctggatccaaaatgtggcat

SEQ ID NO: 7478 - DNA, 25 bp, Rattus norvegicus
aaactctggatcgaaaatgtggcat

SEQ ID NO: 7479 - DNA, 25 bp, Rattus norvegicus
aaactctggattaccacttgtgcct

SEQ ID NO: 7480 - DNA, 25 bp, Rattus norvegicus
aaactctggatttccacttgtgcct

SEQ ID NO: 7481 - DNA, 25 bp, Rattus norvegicus
aaactctggcagctcctttcctgtg

SEQ ID NO: 7482 - DNA, 25 bp, Rattus norvegicus
aaactctggcaggtcctttcctgtg

SEQ ID NO: 7483 - DNA, 25 bp, Rattus norvegicus
aaactctggcgaagcttagtcttgt

SEQ ID NO: 7484 - DNA, 25 bp, Rattus norvegicus
aaactctggcgatgcttagtcttgt

SEQ ID NO: 7485 - DNA, 25 bp, Rattus norvegicus
aaactctggctgattggcctgtcag

SEQ ID NO: 7486 - DNA, 25 bp, Rattus norvegicus
aaactctggctgtttggcctgtcag

SEQ ID NO: 7487 - DNA, 25 bp, Rattus norvegicus
aaactctggcttcggcagcagaaaa

SEQ ID NO: 7488 - DNA, 25 bp, Rattus norvegicus
aaactctggcttgggcagcagaaaa

SEQ ID NO: 7489 - DNA, 25 bp, Rattus norvegicus
aaactctgggaacagtcagggcact

SEQ ID NO: 7490 - DNA, 25 bp, Rattus norvegicus
aaactctgggaagagtcagggcact

SEQ ID NO: 7491 - DNA, 25 bp, Rattus norvegicus
aaactctgggcaccatccacaatgc

SEQ ID NO: 7492 - DNA, 25 bp, Rattus norvegicus
aaactctgggcagcatccacaatgc

SEQ ID NO: 7493 - DNA, 25 bp, Rattus norvegicus
aaactctgtcagatctctgtggatc

SEQ ID NO: 7494 - DNA, 25 bp, Rattus norvegicus
aaactctgtcagttctctgtggatc

SEQ ID NO: 7495 - DNA, 25 bp, Rattus norvegicus
aaactctgttccctttgtcctggat

SEQ ID NO: 7496 - DNA, 25 bp, Rattus norvegicus
aaactctgttccgtttgtcctggat

SEQ ID NO: 7497 - DNA, 25 bp, Rattus norvegicus
aaactcttaggaaccttgttgggca

SEQ ID NO: 7498 - DNA, 25 bp, Rattus norvegicus
aaactcttaggacggcttgcagttc

SEQ ID NO: 7499 - DNA, 25 bp, Rattus norvegicus
aaactcttaggagggcttgcagttc

SEQ ID NO: 7500 - DNA, 25 bp, Rattus norvegicus
aaactcttaggatccttgttgggca

SEQ ID NO: 7501 - DNA, 25 bp, Rattus norvegicus
aaactcttaggtcttgagtagccta

SEQ ID NO: 7502 - DNA, 25 bp, Rattus norvegicus
aaactcttaggtgttgagtagccta

SEQ ID NO: 7503 - DNA, 25 bp, Rattus norvegicus
aaactcttagtcatgaaggccacat

SEQ ID NO: 7504 - DNA, 25 bp, Rattus norvegicus
aaactcttagtcttgaaggccacat

SEQ ID NO: 7505 - DNA, 25 bp, Rattus norvegicus
aaactcttagtgacagggattgctg

SEQ ID NO: 7506 - DNA, 25 bp, Rattus norvegicus
aaactcttagtgtcagggattgctg

SEQ ID NO: 7507 - DNA, 25 bp, Rattus norvegicus
aaactcttcacaccaagcttgcctt

SEQ ID NO: 7508 - DNA, 25 bp, Rattus norvegicus
aaactcttcacagcaagcttgcctt

SEQ ID NO: 7509 - DNA, 25 bp, Rattus norvegicus
aaactcttcactcttgtgcatactg

SEQ ID NO: 7510 - DNA, 25 bp, Rattus norvegicus
aaactcttcactgttgtgcatactg

SEQ ID NO: 7511 - DNA, 25 bp, Rattus norvegicus
aaactcttccaactagggagagcgg

SEQ ID NO: 7512 - DNA, 25 bp, Rattus norvegicus
aaactcttccaagtagggagagcgg

SEQ ID NO: 7513 - DNA, 25 bp, Rattus norvegicus
aaactcttctccacagaggcaagac

SEQ ID NO: 7514 - DNA, 25 bp, Rattus norvegicus
aaactcttctccacataagttggtt

SEQ ID NO: 7515 - DNA, 25 bp, Rattus norvegicus
aaactcttctcctcagaggcaagac

SEQ ID NO: 7516 - DNA, 25 bp, Rattus norvegicus
aaactcttctcctcataagttggtt

SEQ ID NO: 7517 - DNA, 25 bp, Rattus norvegicus
aaactcttctctatgttgttagtgg

SEQ ID NO: 7518 - DNA, 25 bp, Rattus norvegicus
aaactcttctctttgttgttagtgg

SEQ ID NO: 7519 - DNA, 25 bp, Rattus norvegicus
aaactcttgaggcttgatgatgctg

SEQ ID NO: 7520 - DNA, 25 bp, Rattus norvegicus
aaactcttgagggttgatgatgctg

SEQ ID NO: 7521 - DNA, 25 bp, Rattus norvegicus
aaactcttgagtcccacaaaatctg

SEQ ID NO: 7522 - DNA, 25 bp, Rattus norvegicus
aaactcttgagtgccacaaaatctg

SEQ ID NO: 7523 - DNA, 25 bp, Rattus norvegicus
aaactcttgccccaacagaggtgtg

SEQ ID NO: 7524 - DNA, 25 bp, Rattus norvegicus
aaactcttgcccgaacagaggtgtg

SEQ ID NO: 7525 - DNA, 25 bp, Rattus norvegicus
aaactcttgcttcggcattcttctg

SEQ ID NO: 7526 - DNA, 25 bp, Rattus norvegicus
aaactcttgcttgggcattcttctg

SEQ ID NO: 7527 - DNA, 25 bp, Rattus norvegicus
aaactcttgtggatcttcccatata

SEQ ID NO: 7528 - DNA, 25 bp, Rattus norvegicus
aaactcttgtggttcttcccatata

SEQ ID NO: 7529 - DNA, 25 bp, Rattus norvegicus
aaactctttactcactatccatagt

SEQ ID NO: 7530 - DNA, 25 bp, Rattus norvegicus
aaactctttactgactatccatagt

SEQ ID NO: 7531 - DNA, 25 bp, Rattus norvegicus
aaactctttcagcaaaactgcctcc

SEQ ID NO: 7532 - DNA, 25 bp, Rattus norvegicus
aaactctttcaggaaaactgcctcc

SEQ ID NO: 7533 - DNA, 25 bp, Rattus norvegicus
aaactctttgcgctatctcactggg

SEQ ID NO: 7534 - DNA, 25 bp, Rattus norvegicus
aaactctttgcggtatctcactggg

SEQ ID NO: 7535 - DNA, 25 bp, Rattus norvegicus
aaactctttggcagagtgctttcca

SEQ ID NO: 7536 - DNA, 25 bp, Rattus norvegicus
aaactctttggctgagtgctttcca

SEQ ID NO: 7537 - DNA, 25 bp, Rattus norvegicus
aaactctttgggacttgccacataa

SEQ ID NO: 7538 - DNA, 25 bp, Rattus norvegicus
aaactctttgggtcttgccacataa

SEQ ID NO: 7539 - DNA, 25 bp, Rattus norvegicus
aaactctttttgctctacaatgctg

SEQ ID NO: 7540 - DNA, 25 bp, Rattus norvegicus
aaactctttttggtctacaatgctg

SEQ ID NO: 7541 - DNA, 25 bp, Rattus norvegicus
aaactgaacagtcctgcgctggccc

SEQ ID NO: 7542 - DNA, 25 bp, Rattus norvegicus
aaactgaacagtgctgcgctggccc

SEQ ID NO: 7543 - DNA, 25 bp, Rattus norvegicus
aaactgaaccccagtgactgcgatg

SEQ ID NO: 7544 - DNA, 25 bp, Rattus norvegicus
aaactgaacccctgtgactgcgatg

SEQ ID NO: 7545 - DNA, 25 bp, Rattus norvegicus
aaactgaagatccacctactcatgc

SEQ ID NO: 7546 - DNA, 25 bp, Rattus norvegicus
aaactgaagatcgacctactcatgc

SEQ ID NO: 7547 - DNA, 25 bp, Rattus norvegicus
aaactgaatagccagagcagtcctg

SEQ ID NO: 7548 - DNA, 25 bp, Rattus norvegicus
aaactgaatagcgagagcagtcctg

SEQ ID NO: 7549 - DNA, 25 bp, Rattus norvegicus
aaactgaattctccacttgtgtcct

SEQ ID NO: 7550 - DNA, 25 bp, Rattus norvegicus
aaactgaattctgcacttgtgtcct

SEQ ID NO: 7551 - DNA, 25 bp, Rattus norvegicus
aaactgaatttactatattgcgaaa

SEQ ID NO: 7552 - DNA, 25 bp, Rattus norvegicus
aaactgaatttagtatattgcgaaa

SEQ ID NO: 7553 - DNA, 25 bp, Rattus norvegicus
aaactgaatttcaagcggctgggag

SEQ ID NO: 7554 - DNA, 25 bp, Rattus norvegicus
aaactgaatttctagcggctgggag

SEQ ID NO: 7555 - DNA, 25 bp, Rattus norvegicus
aaactgacaaacatccttcttttat

SEQ ID NO: 7556 - DNA, 25 bp, Rattus norvegicus
aaactgacaaacttccttcttttat

SEQ ID NO: 7557 - DNA, 25 bp, Rattus norvegicus
aaactgacacctactcaggagcaga

SEQ ID NO: 7558 - DNA, 25 bp, Rattus norvegicus
aaactgacaccttctcaggagcaga

SEQ ID NO: 7559 - DNA, 25 bp, Rattus norvegicus
aaactgaccaaccagtgccaggtat

SEQ ID NO: 7560 - DNA, 25 bp, Rattus norvegicus
aaactgaccaacgagtgccaggtat

SEQ ID NO: 7561 - DNA, 25 bp, Rattus norvegicus
aaactgaccagaatcccctacctag

SEQ ID NO: 7562 - DNA, 25 bp, Rattus norvegicus
aaactgaccagattcccctacctag

SEQ ID NO: 7563 - DNA, 25 bp, Rattus norvegicus
aaactgacccatagagagctcacct

SEQ ID NO: 7564 - DNA, 25 bp, Rattus norvegicus
aaactgacccattgagagctcacct

SEQ ID NO: 7565 - DNA, 25 bp, Rattus norvegicus
aaactgaccgcaaaagttgtcttct

SEQ ID NO: 7566 - DNA, 25 bp, Rattus norvegicus
aaactgaccgcataagttgtcttct

SEQ ID NO: 7567 - DNA, 25 bp, Rattus norvegicus
aaactgacgaggatgccagcatcca

SEQ ID NO: 7568 - DNA, 25 bp, Rattus norvegicus
aaactgacgaggttgccagcatcca

SEQ ID NO: 7569 - DNA, 25 bp, Rattus norvegicus
aaactgacgatgacgcggaagccat

SEQ ID NO: 7570 - DNA, 25 bp, Rattus norvegicus
aaactgacgatgtcgcggaagccat

SEQ ID NO: 7571 - DNA, 25 bp, Rattus norvegicus
aaactgactcgccatgcgatgcact

SEQ ID NO: 7572 - DNA, 25 bp, Rattus norvegicus
aaactgactcgcgatgcgatgcact

SEQ ID NO: 7573 - DNA, 25 bp, Rattus norvegicus
aaactgactgctcggaaggctcctg

SEQ ID NO: 7574 - DNA, 25 bp, Rattus norvegicus
aaactgactgctgggaaggctcctg

SEQ ID NO: 7575 - DNA, 25 bp, Rattus norvegicus
aaactgactgtgatgtgctcggcac

SEQ ID NO: 7576 - DNA, 25 bp, Rattus norvegicus
aaactgactgtgttgtgctcggcac

SEQ ID NO: 7577 - DNA, 25 bp, Rattus norvegicus
aaactgacttctaacatacctcacc

SEQ ID NO: 7578 - DNA, 25 bp, Rattus norvegicus
aaactgacttcttacatacctcacc

SEQ ID NO: 7579 - DNA, 25 bp, Rattus norvegicus
aaactgagacccagacatgctccag

SEQ ID NO: 7580 - DNA, 25 bp, Rattus norvegicus
aaactgagacccatagtgtcctgtc

SEQ ID NO: 7581 - DNA, 25 bp, Rattus norvegicus
aaactgagaccctgacatgctccag

SEQ ID NO: 7582 - DNA, 25 bp, Rattus norvegicus
aaactgagacccttagtgtcctgtc

SEQ ID NO: 7583 - DNA, 25 bp, Rattus norvegicus
aaactgagagccctgtcctttggtt

SEQ ID NO: 7584 - DNA, 25 bp, Rattus norvegicus
aaactgagagccgtgtcctttggtt

SEQ ID NO: 7585 - DNA, 25 bp, Rattus norvegicus
aaactgagcagccaactggtggaga

SEQ ID NO: 7586 - DNA, 25 bp, Rattus norvegicus
aaactgagcagcgaactggtggaga

SEQ ID NO: 7587 - DNA, 25 bp, Rattus norvegicus
aaactgaggcagcagcttatagaag

SEQ ID NO: 7588 - DNA, 25 bp, Rattus norvegicus
aaactgaggcaggagcttatagaag

SEQ ID NO: 7589 - DNA, 25 bp, Rattus norvegicus
aaactgaggcgcaggccagagcctg

SEQ ID NO: 7590 - DNA, 25 bp, Rattus norvegicus
aaactgaggcgctggccagagcctg

SEQ ID NO: 7591 - DNA, 25 bp, Rattus norvegicus
aaactgaggctcatagaacttgagt

SEQ ID NO: 7592 - DNA, 25 bp, Rattus norvegicus
aaactgaggctcttagaacttgagt

SEQ ID NO: 7593 - DNA, 25 bp, Rattus norvegicus
aaactgagtccaactgggccatggt

SEQ ID NO: 7594 - DNA, 25 bp, Rattus norvegicus
aaactgagtccatctgggccatggt

SEQ ID NO: 7595 - DNA, 25 bp, Rattus norvegicus
aaactgagtgaaagcctgagagtct

SEQ ID NO: 7596 - DNA, 25 bp, Rattus norvegicus
aaactgagtgaatgcctgagagtct

SEQ ID NO: 7597 - DNA, 25 bp, Rattus norvegicus
aaactgagtgttccgtacttcttcc

SEQ ID NO: 7598 - DNA, 25 bp, Rattus norvegicus
aaactgagtgttgcgtacttcttcc

SEQ ID NO: 7599 - DNA, 25 bp, Rattus norvegicus
aaactgagttctaaacacactgtta

SEQ ID NO: 7600 - DNA, 25 bp, Rattus norvegicus
aaactgagttcttaacacactgtta

SEQ ID NO: 7601 - DNA, 25 bp, Rattus norvegicus
aaactgatcagcctttgtacaatgt

SEQ ID NO: 7602 - DNA, 25 bp, Rattus norvegicus
aaactgatcagcgtttgtacaatgt

SEQ ID NO: 7603 - DNA, 25 bp, Rattus norvegicus
aaactgatctctccccagggaagga

SEQ ID NO: 7604 - DNA, 25 bp, Rattus norvegicus
aaactgatctctgcccagggaagga

SEQ ID NO: 7605 - DNA, 25 bp, Rattus norvegicus
aaactgatgctcctatctctgtctt

SEQ ID NO: 7606 - DNA, 25 bp, Rattus norvegicus
aaactgatgctcgtatctctgtctt

SEQ ID NO: 7607 - DNA, 25 bp, Rattus norvegicus
aaactgatgggcagggtgacaatac

SEQ ID NO: 7608 - DNA, 25 bp, Rattus norvegicus
aaactgatgggctgggtgacaatac

SEQ ID NO: 7609 - DNA, 25 bp, Rattus norvegicus
aaactgattaagagggacgagactg

SEQ ID NO: 7610 - DNA, 25 bp, Rattus norvegicus
aaactgattaagtgggacgagactg

SEQ ID NO: 7611 - DNA, 25 bp, Rattus norvegicus
aaactgattcttctgagccttcttc

SEQ ID NO: 7612 - DNA, 25 bp, Rattus norvegicus
aaactgattcttgtgagccttcttc

SEQ ID NO: 7613 - DNA, 25 bp, Rattus norvegicus
aaactgattgttatgctgggcagta

SEQ ID NO: 7614 - DNA, 25 bp, Rattus norvegicus
aaactgattgttttgctgggcagta

SEQ ID NO: 7615 - DNA, 25 bp, Rattus norvegicus
aaactgatttcaattgatgctgcat

SEQ ID NO: 7616 - DNA, 25 bp, Rattus norvegicus
aaactgatttcatttgatgctgcat

SEQ ID NO: 7617 - DNA, 25 bp, Rattus norvegicus
aaactgcaaccacgtcttccagagg

SEQ ID NO: 7618 - DNA, 25 bp, Rattus norvegicus
aaactgcaaccaggtcttccagagg

SEQ ID NO: 7619 - DNA, 25 bp, Rattus norvegicus
aaactgcaacctatctgacataacc

SEQ ID NO: 7620 - DNA, 25 bp, Rattus norvegicus
aaactgcaacctttctgacataacc

SEQ ID NO: 7621 - DNA, 25 bp, Rattus norvegicus
aaactgcaactgcaagcccgcggcg

SEQ ID NO: 7622 - DNA, 25 bp, Rattus norvegicus
aaactgcaactggaagcccgcggcg

SEQ ID NO: 7623 - DNA, 25 bp, Rattus norvegicus
aaactgcaacttagtggtcaccact

SEQ ID NO: 7624 - DNA, 25 bp, Rattus norvegicus
aaactgcaactttgtggtcaccact

SEQ ID NO: 7625 - DNA, 25 bp, Rattus norvegicus
aaactgcaagatatcctccttagac

SEQ ID NO: 7626 - DNA, 25 bp, Rattus norvegicus
aaactgcaagatttcctccttagac

SEQ ID NO: 7627 - DNA, 25 bp, Rattus norvegicus
aaactgcacctacttcaagttcttc

SEQ ID NO: 7628 - DNA, 25 bp, Rattus norvegicus
aaactgcacctagttcaagttcttc

SEQ ID NO: 7629 - DNA, 25 bp, Rattus norvegicus
aaactgcagccgctggtcagagacg

SEQ ID NO: 7630 - DNA, 25 bp, Rattus norvegicus
aaactgcagccggtggtcagagacg

SEQ ID NO: 7631 - DNA, 25 bp, Rattus norvegicus
aaactgcaggcgcagacacacttac

SEQ ID NO: 7632 - DNA, 25 bp, Rattus norvegicus
aaactgcaggcggagacacacttac

SEQ ID NO: 7633 - DNA, 25 bp, Rattus norvegicus
aaactgcagtaactttttctcaaag

SEQ ID NO: 7634 - DNA, 25 bp, Rattus norvegicus
aaactgcagtaagtttttctcaaag

SEQ ID NO: 7635 - DNA, 25 bp, Rattus norvegicus
aaactgcagtgaccggaaaatgacc

SEQ ID NO: 7636 - DNA, 25 bp, Rattus norvegicus
aaactgcagtgagcggaaaatgacc

SEQ ID NO: 7637 - DNA, 25 bp, Rattus norvegicus
aaactgcagtggaggctctgcccct

SEQ ID NO: 7638 - DNA, 25 bp, Rattus norvegicus
aaactgcagtggtggctctgcccct

SEQ ID NO: 7639 - DNA, 25 bp, Rattus norvegicus
aaactgcagttcatttggcttcgta

SEQ ID NO: 7640 - DNA, 25 bp, Rattus norvegicus
aaactgcagttcttttggcttcgta

SEQ ID NO: 7641 - DNA, 25 bp, Rattus norvegicus
aaactgcatggtcttgccctgtcac

SEQ ID NO: 7642 - DNA, 25 bp, Rattus norvegicus
aaactgcatggtgttgccctgtcac

SEQ ID NO: 7643 - DNA, 25 bp, Rattus norvegicus
aaactgcatgtgatccttttgttcc

SEQ ID NO: 7644 - DNA, 25 bp, Rattus norvegicus
aaactgcatgtgatgccttcaccga

SEQ ID NO: 7645 - DNA, 25 bp, Rattus norvegicus
aaactgcatgtgttccttttgttcc

SEQ ID NO: 7646 - DNA, 25 bp, Rattus norvegicus
aaactgcatgtgttgccttcaccga

SEQ ID NO: 7647 - DNA, 25 bp, Rattus norvegicus
aaactgccaaaaacctgcctgtttc

SEQ ID NO: 7648 - DNA, 25 bp, Rattus norvegicus
aaactgccaaaatcctgcctgtttc

SEQ ID NO: 7649 - DNA, 25 bp, Rattus norvegicus
aaactgccaaacatcctctgagcga

SEQ ID NO: 7650 - DNA, 25 bp, Rattus norvegicus
aaactgccaaacttcctctgagcga

SEQ ID NO: 7651 - DNA, 25 bp, Rattus norvegicus
aaactgccatctaccctttgaaaat

SEQ ID NO: 7652 - DNA, 25 bp, Rattus norvegicus
aaactgccatcttccctttgaaaat

SEQ ID NO: 7653 - DNA, 25 bp, Rattus norvegicus
aaactgccattcagcctggatgggc

SEQ ID NO: 7654 - DNA, 25 bp, Rattus norvegicus
aaactgccattctgcctggatgggc

SEQ ID NO: 7655 - DNA, 25 bp, Rattus norvegicus
aaactgcccagcattgtgattttgc

SEQ ID NO: 7656 - DNA, 25 bp, Rattus norvegicus
aaactgcccagctttgtgattttgc

SEQ ID NO: 7657 - DNA, 25 bp, Rattus norvegicus
aaactgcccataacaggtggactgt

SEQ ID NO: 7658 - DNA, 25 bp, Rattus norvegicus
aaactgcccatatcaggtggactgt

SEQ ID NO: 7659 - DNA, 25 bp, Rattus norvegicus
aaactgccccagctgaagtctgtgc

SEQ ID NO: 7660 - DNA, 25 bp, Rattus norvegicus
aaactgccccaggtgaagtctgtgc

SEQ ID NO: 7661 - DNA, 25 bp, Rattus norvegicus
aaactgcccctgagttatttctggt

SEQ ID NO: 7662 - DNA, 25 bp, Rattus norvegicus
aaactgcccctgtgttatttctggt

SEQ ID NO: 7663 - DNA, 25 bp, Rattus norvegicus
aaactgccgagcagcatttctccat

SEQ ID NO: 7664 - DNA, 25 bp, Rattus norvegicus
aaactgccgagctgcatttctccat

SEQ ID NO: 7665 - DNA, 25 bp, Rattus norvegicus
aaactgccggcgattctggaattct

SEQ ID NO: 7666 - DNA, 25 bp, Rattus norvegicus
aaactgccggcgtttctggaattct

SEQ ID NO: 7667 - DNA, 25 bp, Rattus norvegicus
aaactgccgtctcgcttcatttttt

SEQ ID NO: 7668 - DNA, 25 bp, Rattus norvegicus
aaactgccgtctggcttcatttttt

SEQ ID NO: 7669 - DNA, 25 bp, Rattus norvegicus
aaactgcctcttcaagtgtttgcct

SEQ ID NO: 7670 - DNA, 25 bp, Rattus norvegicus
aaactgcctcttgaagtgtttgcct

SEQ ID NO: 7671 - DNA, 25 bp, Rattus norvegicus
aaactgcctgttagctagggtcttg

SEQ ID NO: 7672 - DNA, 25 bp, Rattus norvegicus
aaactgcctgtttgctagggtcttg

SEQ ID NO: 7673 - DNA, 25 bp, Rattus norvegicus
aaactgccttatctcaccatgggtt

SEQ ID NO: 7674 - DNA, 25 bp, Rattus norvegicus
aaactgccttatgtcaccatgggtt

SEQ ID NO: 7675 - DNA, 25 bp, Rattus norvegicus
aaactgccttggcttaagtgggcac

SEQ ID NO: 7676 - DNA, 25 bp, Rattus norvegicus
aaactgccttgggttaagtgggcac

SEQ ID NO: 7677 - DNA, 25 bp, Rattus norvegicus
aaactgcggcagagcaatcctgaat

SEQ ID NO: 7678 - DNA, 25 bp, Rattus norvegicus
aaactgcggcagtgcaatcctgaat

SEQ ID NO: 7679 - DNA, 25 bp, Rattus norvegicus
aaactgcggcttagagtagctcacc

SEQ ID NO: 7680 - DNA, 25 bp, Rattus norvegicus
aaactgcggctttgagtagctcacc

SEQ ID NO: 7681 - DNA, 25 bp, Rattus norvegicus
aaactgcgggctcgacatgcacagg

SEQ ID NO: 7682 - DNA, 25 bp, Rattus norvegicus
aaactgcgggctggacatgcacagg

SEQ ID NO: 7683 - DNA, 25 bp, Rattus norvegicus
aaactgcggtcgatggcctgcacct

SEQ ID NO: 7684 - DNA, 25 bp, Rattus norvegicus
aaactgcggtcgttggcctgcacct

SEQ ID NO: 7685 - DNA, 25 bp, Rattus norvegicus
aaactgctagacatgccagagtgat

SEQ ID NO: 7686 - DNA, 25 bp, Rattus norvegicus
aaactgctagacttgccagagtgat

SEQ ID NO: 7687 - DNA, 25 bp, Rattus norvegicus
aaactgctagttcctatcttgctcc

SEQ ID NO: 7688 - DNA, 25 bp, Rattus norvegicus
aaactgctagttgctatcttgctcc

SEQ ID NO: 7689 - DNA, 25 bp, Rattus norvegicus
aaactgctcaacactgttaacttct

SEQ ID NO: 7690 - DNA, 25 bp, Rattus norvegicus
aaactgctcaactctgttaacttct

SEQ ID NO: 7691 - DNA, 25 bp, Rattus norvegicus
aaactgctcaagaccctcgatgccg

SEQ ID NO: 7692 - DNA, 25 bp, Rattus norvegicus
aaactgctcaagtccctcgatgccg

SEQ ID NO: 7693 - DNA, 25 bp, Rattus norvegicus
aaactgctcagaatgtctctagtac

SEQ ID NO: 7694 - DNA, 25 bp, Rattus norvegicus
aaactgctcagattgtctctagtac

SEQ ID NO: 7695 - DNA, 25 bp, Rattus norvegicus
aaactgctccaacaatttttcttat

SEQ ID NO: 7696 - DNA, 25 bp, Rattus norvegicus
aaactgctccaagaatttttcttat

SEQ ID NO: 7697 - DNA, 25 bp, Rattus norvegicus
aaactgctccacatctatcagcaat

SEQ ID NO: 7698 - DNA, 25 bp, Rattus norvegicus
aaactgctccacttctatcagcaat

SEQ ID NO: 7699 - DNA, 25 bp, Rattus norvegicus
aaactgctccatctctttttgttat

SEQ ID NO: 7700 - DNA, 25 bp, Rattus norvegicus
aaactgctccatgtctttttgttat

SEQ ID NO: 7701 - DNA, 25 bp, Rattus norvegicus
aaactgctcccacactaactgcata

SEQ ID NO: 7702 - DNA, 25 bp, Rattus norvegicus
aaactgctcccagactaactgcata

SEQ ID NO: 7703 - DNA, 25 bp, Rattus norvegicus
aaactgctccccaacagaggctgga

SEQ ID NO: 7704 - DNA, 25 bp, Rattus norvegicus
aaactgctcccctacagaggctgga

SEQ ID NO: 7705 - DNA, 25 bp, Rattus norvegicus
aaactgctcctaaactttccacatc

SEQ ID NO: 7706 - DNA, 25 bp, Rattus norvegicus
aaactgctcctatactttccacatc

SEQ ID NO: 7707 - DNA, 25 bp, Rattus norvegicus
aaactgctctgtcccaggagccagt

SEQ ID NO: 7708 - DNA, 25 bp, Rattus norvegicus
aaactgctctgtgccaggagccagt

SEQ ID NO: 7709 - DNA, 25 bp, Rattus norvegicus
aaactgctcttcacagacgacagcg

SEQ ID NO: 7710 - DNA, 25 bp, Rattus norvegicus
aaactgctcttctcagacgacagcg

SEQ ID NO: 7711 - DNA, 25 bp, Rattus norvegicus
aaactgctctttctaatgttcatta

SEQ ID NO: 7712 - DNA, 25 bp, Rattus norvegicus
aaactgctctttgtaatgttcatta

SEQ ID NO: 7713 - DNA, 25 bp, Rattus norvegicus
aaactgctgacccacaattttaagg

SEQ ID NO: 7714 - DNA, 25 bp, Rattus norvegicus
aaactgctgaccgacaattttaagg

SEQ ID NO: 7715 - DNA, 25 bp, Rattus norvegicus
aaactgctgcaccaaatcatgaaca

SEQ ID NO: 7716 - DNA, 25 bp, Rattus norvegicus
aaactgctgcacgaaatcatgaaca

SEQ ID NO: 7717 - DNA, 25 bp, Rattus norvegicus
aaactgctgcccctggtgatggctg

SEQ ID NO: 7718 - DNA, 25 bp, Rattus norvegicus
aaactgctgcccgtggtgatggctg

SEQ ID NO: 7719 - DNA, 25 bp, Rattus norvegicus
aaactgctgcctacgaagtgtgcga

SEQ ID NO: 7720 - DNA, 25 bp, Rattus norvegicus
aaactgctgccttcgaagtgtgcga

SEQ ID NO: 7721 - DNA, 25 bp, Rattus norvegicus
aaactgctgcgcatctttcctaaag

SEQ ID NO: 7722 - DNA, 25 bp, Rattus norvegicus
aaactgctgcgcttctttcctaaag

SEQ ID NO: 7723 - DNA, 25 bp, Rattus norvegicus
aaactgctgctaaggccactgttga

SEQ ID NO: 7724 - DNA, 25 bp, Rattus norvegicus
aaactgctgctatggccactgttga

SEQ ID NO: 7725 - DNA, 25 bp, Rattus norvegicus
aaactgctgcttaatcttgtcttgt

SEQ ID NO: 7726 - DNA, 25 bp, Rattus norvegicus
aaactgctgctttatcttgtcttgt

SEQ ID NO: 7727 - DNA, 25 bp, Rattus norvegicus
aaactgctgtacactatctgtataa

SEQ ID NO: 7728 - DNA, 25 bp, Rattus norvegicus
aaactgctgtactctatctgtataa

SEQ ID NO: 7729 - DNA, 25 bp, Rattus norvegicus
aaactgctgtttcaccctggtagac

SEQ ID NO: 7730 - DNA, 25 bp, Rattus norvegicus
aaactgctgtttgaccctggtagac

SEQ ID NO: 7731 - DNA, 25 bp, Rattus norvegicus
aaactgcttatgctaatgaggtata

SEQ ID NO: 7732 - DNA, 25 bp, Rattus norvegicus
aaactgcttatggtaatgaggtata

SEQ ID NO: 7733 - DNA, 25 bp, Rattus norvegicus
aaactgcttcatcaggttgcactgt

SEQ ID NO: 7734 - DNA, 25 bp, Rattus norvegicus
aaactgcttcatgaggttgcactgt

SEQ ID NO: 7735 - DNA, 25 bp, Rattus norvegicus
aaactgcttcccaatagctggactt

SEQ ID NO: 7736 - DNA, 25 bp, Rattus norvegicus
aaactgcttcccagcgtgggtgaag

SEQ ID NO: 7737 - DNA, 25 bp, Rattus norvegicus
aaactgcttccctatagctggactt

SEQ ID NO: 7738 - DNA, 25 bp, Rattus norvegicus
aaactgcttccctgcgtgggtgaag

SEQ ID NO: 7739 - DNA, 25 bp, Rattus norvegicus
aaactgcttcgtacttgctttgttt

SEQ ID NO: 7740 - DNA, 25 bp, Rattus norvegicus
aaactgcttcgttcttgctttgttt

SEQ ID NO: 7741 - DNA, 25 bp, Rattus norvegicus
aaactgcttgaccagcccctcagat

SEQ ID NO: 7742 - DNA, 25 bp, Rattus norvegicus
aaactgcttgacgagcccctcagat

SEQ ID NO: 7743 - DNA, 25 bp, Rattus norvegicus
aaactgcttgctctacacatgaaag

SEQ ID NO: 7744 - DNA, 25 bp, Rattus norvegicus
aaactgcttgctgtacacatgaaag

SEQ ID NO: 7745 - DNA, 25 bp, Rattus norvegicus
aaactgctttccctagatcttaatg

SEQ ID NO: 7746 - DNA, 25 bp, Rattus norvegicus
aaactgctttccgtagatcttaatg

SEQ ID NO: 7747 - DNA, 25 bp, Rattus norvegicus
aaactgctttctaattggatctgag

SEQ ID NO: 7748 - DNA, 25 bp, Rattus norvegicus
aaactgctttcttattggatctgag

SEQ ID NO: 7749 - DNA, 25 bp, Rattus norvegicus
aaactggaaactatggctcgaggtg

SEQ ID NO: 7750 - DNA, 25 bp, Rattus norvegicus
aaactggaaactttggctcgaggtg

SEQ ID NO: 7751 - DNA, 25 bp, Rattus norvegicus
aaactggaaatgctggtctctgcca

SEQ ID NO: 7752 - DNA, 25 bp, Rattus norvegicus
aaactggaaatggtggtctctgcca

SEQ ID NO: 7753 - DNA, 25 bp, Rattus norvegicus
aaactggaatcgctgactccttctg

SEQ ID NO: 7754 - DNA, 25 bp, Rattus norvegicus
aaactggaatcggtgactccttctg

SEQ ID NO: 7755 - DNA, 25 bp, Rattus norvegicus
aaactggaccagagcactaacgcct

SEQ ID NO: 7756 - DNA, 25 bp, Rattus norvegicus
aaactggaccagtgcactaacgcct

SEQ ID NO: 7757 - DNA, 25 bp, Rattus norvegicus
aaactggagctgaggtctctgcttc

SEQ ID NO: 7758 - DNA, 25 bp, Rattus norvegicus
aaactggagctgtggtctctgcttc

SEQ ID NO: 7759 - DNA, 25 bp, Rattus norvegicus
aaactggaggctacgcattttgatg

SEQ ID NO: 7760 - DNA, 25 bp, Rattus norvegicus
aaactggaggcttcgcattttgatg

SEQ ID NO: 7761 - DNA, 25 bp, Rattus norvegicus
aaactggatctcctcactatcactg

SEQ ID NO: 7762 - DNA, 25 bp, Rattus norvegicus
aaactggatctcgtcactatcactg

SEQ ID NO: 7763 - DNA, 25 bp, Rattus norvegicus
aaactggatctgatcaagcctggct

SEQ ID NO: 7764 - DNA, 25 bp, Rattus norvegicus
aaactggatctgttcaagcctggct

SEQ ID NO: 7765 - DNA, 25 bp, Rattus norvegicus
aaactggatgtgaatctgtaacctc

SEQ ID NO: 7766 - DNA, 25 bp, Rattus norvegicus
aaactggatgtgtatctgtaacctc

SEQ ID NO: 7767 - DNA, 25 bp, Rattus norvegicus
aaactggattctctcagcttctgac

SEQ ID NO: 7768 - DNA, 25 bp, Rattus norvegicus
aaactggattctgtcagcttctgac

SEQ ID NO: 7769 - DNA, 25 bp, Rattus norvegicus
aaactggcagctcttttgtgacttc

SEQ ID NO: 7770 - DNA, 25 bp, Rattus norvegicus
aaactggcagctgttttgtgacttc

SEQ ID NO: 7771 - DNA, 25 bp, Rattus norvegicus
aaactggccgctatgcttgatggac

SEQ ID NO: 7772 - DNA, 25 bp, Rattus norvegicus
aaactggccgctttgcttgatggac

SEQ ID NO: 7773 - DNA, 25 bp, Rattus norvegicus
aaactggcctgaaactcaagatctg

SEQ ID NO: 7774 - DNA, 25 bp, Rattus norvegicus
aaactggcctgatactcaagatctg

SEQ ID NO: 7775 - DNA, 25 bp, Rattus norvegicus
aaactggcgcttacactgaactctt

SEQ ID NO: 7776 - DNA, 25 bp, Rattus norvegicus
aaactggcgctttcactgaactctt

SEQ ID NO: 7777 - DNA, 25 bp, Rattus norvegicus
aaactggcgggcagtcagggaacat

SEQ ID NO: 7778 - DNA, 25 bp, Rattus norvegicus
aaactggcgggctgtcagggaacat

SEQ ID NO: 7779 - DNA, 25 bp, Rattus norvegicus
aaactggcgtggcatcctggttagc

SEQ ID NO: 7780 - DNA, 25 bp, Rattus norvegicus
aaactggcgtgggatcctggttagc

SEQ ID NO: 7781 - DNA, 25 bp, Rattus norvegicus
aaactggctcagctgcggacttgca

SEQ ID NO: 7782 - DNA, 25 bp, Rattus norvegicus
aaactggctcaggtgcggacttgca

SEQ ID NO: 7783 - DNA, 25 bp, Rattus norvegicus
aaactggctcttctctctaagatac

SEQ ID NO: 7784 - DNA, 25 bp, Rattus norvegicus
aaactggctcttgtctctaagatac

SEQ ID NO: 7785 - DNA, 25 bp, Rattus norvegicus
aaactggctgtactcctagcttcga

SEQ ID NO: 7786 - DNA, 25 bp, Rattus norvegicus
aaactggctgtagtcctagcttcga

SEQ ID NO: 7787 - DNA, 25 bp, Rattus norvegicus
aaactggcttcacgactgtttcaag

SEQ ID NO: 7788 - DNA, 25 bp, Rattus norvegicus
aaactggcttcaggactgtttcaag

SEQ ID NO: 7789 - DNA, 25 bp, Rattus norvegicus
aaactggcttccatctatgtcttca

SEQ ID NO: 7790 - DNA, 25 bp, Rattus norvegicus
aaactggcttccttctatgtcttca

SEQ ID NO: 7791 - DNA, 25 bp, Rattus norvegicus
aaactggctttcaggcattttggtc

SEQ ID NO: 7792 - DNA, 25 bp, Rattus norvegicus
aaactggctttctggcattttggtc

SEQ ID NO: 7793 - DNA, 25 bp, Rattus norvegicus
aaactggctttgcttcttcgacaaa

SEQ ID NO: 7794 - DNA, 25 bp, Rattus norvegicus
aaactggctttggttcttcgacaaa

SEQ ID NO: 7795 - DNA, 25 bp, Rattus norvegicus
aaactggcttttcaccagagggtat

SEQ ID NO: 7796 - DNA, 25 bp, Rattus norvegicus
aaactggcttttctttcagcatgta

SEQ ID NO: 7797 - DNA, 25 bp, Rattus norvegicus
aaactggcttttgaccagagggtat

SEQ ID NO: 7798 - DNA, 25 bp, Rattus norvegicus
aaactggcttttgtttcagcatgta

SEQ ID NO: 7799 - DNA, 25 bp, Rattus norvegicus
aaactgggaacaattacagcgatgt

SEQ ID NO: 7800 - DNA, 25 bp, Rattus norvegicus
aaactgggaacatttacagcgatgt

SEQ ID NO: 7801 - DNA, 25 bp, Rattus norvegicus
aaactgggatgaagccaccctgtgc

SEQ ID NO: 7802 - DNA, 25 bp, Rattus norvegicus
aaactgggatgatgccaccctgtgc

SEQ ID NO: 7803 - DNA, 25 bp, Rattus norvegicus
aaactgggctaacattcccttcctg

SEQ ID NO: 7804 - DNA, 25 bp, Rattus norvegicus
aaactgggctaagattcccttcctg

SEQ ID NO: 7805 - DNA, 25 bp, Rattus norvegicus
aaactgggtcacagcagggtctgca

SEQ ID NO: 7806 - DNA, 25 bp, Rattus norvegicus
aaactgggtcactgcagggtctgca

SEQ ID NO: 7807 - DNA, 25 bp, Rattus norvegicus
aaactgggttctaacatcccttgct

SEQ ID NO: 7808 - DNA, 25 bp, Rattus norvegicus
aaactgggttcttacatcccttgct

SEQ ID NO: 7809 - DNA, 25 bp, Rattus norvegicus
aaactggtatctacctcaatgacga

SEQ ID NO: 7810 - DNA, 25 bp, Rattus norvegicus
aaactggtatcttcctcaatgacga

SEQ ID NO: 7811 - DNA, 25 bp, Rattus norvegicus
aaactggtcagtcagctttgtccct

SEQ ID NO: 7812 - DNA, 25 bp, Rattus norvegicus
aaactggtcagtgagctttgtccct

SEQ ID NO: 7813 - DNA, 25 bp, Rattus norvegicus
aaactggtcattcggcggatctttc

SEQ ID NO: 7814 - DNA, 25 bp, Rattus norvegicus
aaactggtcattgggcggatctttc

SEQ ID NO: 7815 - DNA, 25 bp, Rattus norvegicus
aaactggtccttatcttcatctgtt

SEQ ID NO: 7816 - DNA, 25 bp, Rattus norvegicus
aaactggtccttttcttcatctgtt

SEQ ID NO: 7817 - DNA, 25 bp, Rattus norvegicus
aaactggtctgcaacttgctctgta

SEQ ID NO: 7818 - DNA, 25 bp, Rattus norvegicus
aaactggtctgctacttgctctgta

SEQ ID NO: 7819 - DNA, 25 bp, Rattus norvegicus
aaactggtctttctcctcagatagt

SEQ ID NO: 7820 - DNA, 25 bp, Rattus norvegicus
aaactggtctttgtcctcagatagt

SEQ ID NO: 7821 - DNA, 25 bp, Rattus norvegicus
aaactggtgccgagggagctgttct

SEQ ID NO: 7822 - DNA, 25 bp, Rattus norvegicus
aaactggtgccgtgggagctgttct

SEQ ID NO: 7823 - DNA, 25 bp, Rattus norvegicus
aaactggtgctcaaggccctgtgca

SEQ ID NO: 7824 - DNA, 25 bp, Rattus norvegicus
aaactggtgctctaggccctgtgca

SEQ ID NO: 7825 - DNA, 25 bp, Rattus norvegicus
aaactggtggctcaggtgtccctga

SEQ ID NO: 7826 - DNA, 25 bp, Rattus norvegicus
aaactggtggctgaggtgtccctga

SEQ ID NO: 7827 - DNA, 25 bp, Rattus norvegicus
aaactggtgggaaacgccatgtcca

SEQ ID NO: 7828 - DNA, 25 bp, Rattus norvegicus
aaactggtgggatacgccatgtcca

SEQ ID NO: 7829 - DNA, 25 bp, Rattus norvegicus
aaactggtgtacaatttatggcctc

SEQ ID NO: 7830 - DNA, 25 bp, Rattus norvegicus
aaactggtgtactatttatggcctc

SEQ ID NO: 7831 - DNA, 25 bp, Rattus norvegicus
aaactggtgtccatcactacagtgg

SEQ ID NO: 7832 - DNA, 25 bp, Rattus norvegicus
aaactggtgtccttcactacagtgg

SEQ ID NO: 7833 - DNA, 25 bp, Rattus norvegicus
aaactggttcagcattgtgactaat

SEQ ID NO: 7834 - DNA, 25 bp, Rattus norvegicus
aaactggttcaggattgtgactaat

SEQ ID NO: 7835 - DNA, 25 bp, Rattus norvegicus
aaactggttccaatgtatcctctgc

SEQ ID NO: 7836 - DNA, 25 bp, Rattus norvegicus
aaactggttccattgtatcctctgc

SEQ ID NO: 7837 - DNA, 25 bp, Rattus norvegicus
aaactggttgcacatgagcatttct

SEQ ID NO: 7838 - DNA, 25 bp, Rattus norvegicus
aaactggttgcagatgagcatttct

SEQ ID NO: 7839 - DNA, 25 bp, Rattus norvegicus
aaactggttgccaacagcgctgagc

SEQ ID NO: 7840 - DNA, 25 bp, Rattus norvegicus
aaactggttgcctacagcgctgagc

SEQ ID NO: 7841 - DNA, 25 bp, Rattus norvegicus
aaactggtttgcctaagattggcca

SEQ ID NO: 7842 - DNA, 25 bp, Rattus norvegicus
aaactggtttgcgtaagattggcca

SEQ ID NO: 7843 - DNA, 25 bp, Rattus norvegicus
aaactggttttgaatcacttgaata

SEQ ID NO: 7844 - DNA, 25 bp, Rattus norvegicus
aaactggttttgagcagccactgaa

SEQ ID NO: 7845 - DNA, 25 bp, Rattus norvegicus
aaactggttttgtatcacttgaata

SEQ ID NO: 7846 - DNA, 25 bp, Rattus norvegicus
aaactggttttgtgcagccactgaa

SEQ ID NO: 7847 - DNA, 25 bp, Rattus norvegicus
aaactgtaagcaaagcccagaatta

SEQ ID NO: 7848 - DNA, 25 bp, Rattus norvegicus
aaactgtaagcatagcccagaatta

SEQ ID NO: 7849 - DNA, 25 bp, Rattus norvegicus
aaactgtacgcgcacaagctggaat

SEQ ID NO: 7850 - DNA, 25 bp, Rattus norvegicus
aaactgtacgcggacaagctggaat

SEQ ID NO: 7851 - DNA, 25 bp, Rattus norvegicus
aaactgtactatagtctcacctgac

SEQ ID NO: 7852 - DNA, 25 bp, Rattus norvegicus
aaactgtactattgtctcacctgac

SEQ ID NO: 7853 - DNA, 25 bp, Rattus norvegicus
aaactgtagaacactggatcctcca

SEQ ID NO: 7854 - DNA, 25 bp, Rattus norvegicus
aaactgtagaactctggatcctcca

SEQ ID NO: 7855 - DNA, 25 bp, Rattus norvegicus
aaactgtagatgagcccgagtctcc

SEQ ID NO: 7856 - DNA, 25 bp, Rattus norvegicus
aaactgtagatgtgcccgagtctcc

SEQ ID NO: 7857 - DNA, 25 bp, Rattus norvegicus
aaactgtatcctaagcttacctgag

SEQ ID NO: 7858 - DNA, 25 bp, Rattus norvegicus
aaactgtatccttagcttacctgag

SEQ ID NO: 7859 - DNA, 25 bp, Rattus norvegicus
aaactgtatcttcatgctcatcgct

SEQ ID NO: 7860 - DNA, 25 bp, Rattus norvegicus
aaactgtatcttgatgctcatcgct

SEQ ID NO: 7861 - DNA, 25 bp, Rattus norvegicus
aaactgtattcgcactgttggaaca

SEQ ID NO: 7862 - DNA, 25 bp, Rattus norvegicus
aaactgtattcggactgttggaaca

SEQ ID NO: 7863 - DNA, 25 bp, Rattus norvegicus
aaactgtattttaccattctgtaat

SEQ ID NO: 7864 - DNA, 25 bp, Rattus norvegicus
aaactgtatttttccattctgtaat

SEQ ID NO: 7865 - DNA, 25 bp, Rattus norvegicus
aaactgtcaatcaaagccacctatg

SEQ ID NO: 7866 - DNA, 25 bp, Rattus norvegicus
aaactgtcaatctaagccacctatg

SEQ ID NO: 7867 - DNA, 25 bp, Rattus norvegicus
aaactgtcagcacgttaagtaggga

SEQ ID NO: 7868 - DNA, 25 bp, Rattus norvegicus
aaactgtcagcaggttaagtaggga

SEQ ID NO: 7869 - DNA, 25 bp, Rattus norvegicus
aaactgtcataccaagctacctgtg

SEQ ID NO: 7870 - DNA, 25 bp, Rattus norvegicus
aaactgtcatacgaagctacctgtg

SEQ ID NO: 7871 - DNA, 25 bp, Rattus norvegicus
aaactgtcccagacaaactgccatg

SEQ ID NO: 7872 - DNA, 25 bp, Rattus norvegicus
aaactgtcccagtcaaactgccatg

SEQ ID NO: 7873 - DNA, 25 bp, Rattus norvegicus
aaactgtcccggagactgtagtagc

SEQ ID NO: 7874 - DNA, 25 bp, Rattus norvegicus
aaactgtcccggtgactgtagtagc

SEQ ID NO: 7875 - DNA, 25 bp, Rattus norvegicus
aaactgtccggaaggaggcctgagc

SEQ ID NO: 7876 - DNA, 25 bp, Rattus norvegicus
aaactgtccggatggaggcctgagc

SEQ ID NO: 7877 - DNA, 25 bp, Rattus norvegicus
aaactgtcctctaggtaccctggag

SEQ ID NO: 7878 - DNA, 25 bp, Rattus norvegicus
aaactgtcctcttggtaccctggag

SEQ ID NO: 7879 - DNA, 25 bp, Rattus norvegicus
aaactgtcctgtcgccattttactg

SEQ ID NO: 7880 - DNA, 25 bp, Rattus norvegicus
aaactgtcctgtggccattttactg

SEQ ID NO: 7881 - DNA, 25 bp, Rattus norvegicus
aaactgtcgccgaaaatcgctttat

SEQ ID NO: 7882 - DNA, 25 bp, Rattus norvegicus
aaactgtcgccgtaaatcgctttat

SEQ ID NO: 7883 - DNA, 25 bp, Rattus norvegicus
aaactgtctgctatggtttgcatag

SEQ ID NO: 7884 - DNA, 25 bp, Rattus norvegicus
aaactgtctgctttggtttgcatag

SEQ ID NO: 7885 - DNA, 25 bp, Rattus norvegicus
aaactgtctgttacccatttgttgg

SEQ ID NO: 7886 - DNA, 25 bp, Rattus norvegicus
aaactgtctgtttcccatttgttgg

SEQ ID NO: 7887 - DNA, 25 bp, Rattus norvegicus
aaactgtcttctcaacaattccacg

SEQ ID NO: 7888 - DNA, 25 bp, Rattus norvegicus
aaactgtcttctccagcattccatt

SEQ ID NO: 7889 - DNA, 25 bp, Rattus norvegicus
aaactgtcttctgaacaattccacg

SEQ ID NO: 7890 - DNA, 25 bp, Rattus norvegicus
aaactgtcttctgcagcattccatt

SEQ ID NO: 7891 - DNA, 25 bp, Rattus norvegicus
aaactgtctttgatctacgcagcca

SEQ ID NO: 7892 - DNA, 25 bp, Rattus norvegicus
aaactgtctttgttctacgcagcca

SEQ ID NO: 7893 - DNA, 25 bp, Rattus norvegicus
aaactgtgaaataccatgccaggac

SEQ ID NO: 7894 - DNA, 25 bp, Rattus norvegicus
aaactgtgaaattccatgccaggac

SEQ ID NO: 7895 - DNA, 25 bp, Rattus norvegicus
aaactgtgaagcctagtgtgaccac

SEQ ID NO: 7896 - DNA, 25 bp, Rattus norvegicus
aaactgtgaagcgtagtgtgaccac

SEQ ID NO: 7897 - DNA, 25 bp, Rattus norvegicus
aaactgtgacaccatgactgactcc

SEQ ID NO: 7898 - DNA, 25 bp, Rattus norvegicus
aaactgtgacacgatgactgactcc

SEQ ID NO: 7899 - DNA, 25 bp, Rattus norvegicus
aaactgtgacagctgaaccctttga

SEQ ID NO: 7900 - DNA, 25 bp, Rattus norvegicus
aaactgtgacaggtgaaccctttga

SEQ ID NO: 7901 - DNA, 25 bp, Rattus norvegicus
aaactgtgacgtactgcgataaccc

SEQ ID NO: 7902 - DNA, 25 bp, Rattus norvegicus
aaactgtgacgttctgcgataaccc

SEQ ID NO: 7903 - DNA, 25 bp, Rattus norvegicus
aaactgtgactccagaccttggccc

SEQ ID NO: 7904 - DNA, 25 bp, Rattus norvegicus
aaactgtgactcgagaccttggccc

SEQ ID NO: 7905 - DNA, 25 bp, Rattus norvegicus
aaactgtgcattaattcacgctaac

SEQ ID NO: 7906 - DNA, 25 bp, Rattus norvegicus
aaactgtgcatttattcacgctaac

SEQ ID NO: 7907 - DNA, 25 bp, Rattus norvegicus
aaactgtgccaaaaaacctgccctg

SEQ ID NO: 7908 - DNA, 25 bp, Rattus norvegicus
aaactgtgccaataaacctgccctg

SEQ ID NO: 7909 - DNA, 25 bp, Rattus norvegicus
aaactgtgccataaagccatttcat

SEQ ID NO: 7910 - DNA, 25 bp, Rattus norvegicus
aaactgtgccattaagccatttcat

SEQ ID NO: 7911 - DNA, 25 bp, Rattus norvegicus
aaactgtgctatctagtccggcctt

SEQ ID NO: 7912 - DNA, 25 bp, Rattus norvegicus
aaactgtgctatgtagtccggcctt

SEQ ID NO: 7913 - DNA, 25 bp, Rattus norvegicus
aaactgtgctctagaatcgctctct

SEQ ID NO: 7914 - DNA, 25 bp, Rattus norvegicus
aaactgtgctctataatccgcttcc

SEQ ID NO: 7915 - DNA, 25 bp, Rattus norvegicus
aaactgtgctcttgaatcgctctct

SEQ ID NO: 7916 - DNA, 25 bp, Rattus norvegicus
aaactgtgctctttaatccgcttcc

SEQ ID NO: 7917 - DNA, 25 bp, Rattus norvegicus
aaactgtgctgccaactgagctacg

SEQ ID NO: 7918 - DNA, 25 bp, Rattus norvegicus
aaactgtgctgcgaactgagctacg

SEQ ID NO: 7919 - DNA, 25 bp, Rattus norvegicus
aaactgtgctggagggatcaagccc

SEQ ID NO: 7920 - DNA, 25 bp, Rattus norvegicus
aaactgtgctggtgggatcaagccc

SEQ ID NO: 7921 - DNA, 25 bp, Rattus norvegicus
aaactgtgctgtattctggacctca

SEQ ID NO: 7922 - DNA, 25 bp, Rattus norvegicus
aaactgtgctgttttctggacctca

SEQ ID NO: 7923 - DNA, 25 bp, Rattus norvegicus
aaactgtggactcagactgcagctc

SEQ ID NO: 7924 - DNA, 25 bp, Rattus norvegicus
aaactgtggactgagactgcagctc

SEQ ID NO: 7925 - DNA, 25 bp, Rattus norvegicus
aaactgtgggtcctcgagtctcaga

SEQ ID NO: 7926 - DNA, 25 bp, Rattus norvegicus
aaactgtgggtcgtcgagtctcaga

SEQ ID NO: 7927 - DNA, 25 bp, Rattus norvegicus
aaactgtggtttcatcttggactat

SEQ ID NO: 7928 - DNA, 25 bp, Rattus norvegicus
aaactgtggtttgatcttggactat

SEQ ID NO: 7929 - DNA, 25 bp, Rattus norvegicus
aaactgtgtactcctgtaaatgctg

SEQ ID NO: 7930 - DNA, 25 bp, Rattus norvegicus
aaactgtgtactgctgtaaatgctg

SEQ ID NO: 7931 - DNA, 25 bp, Rattus norvegicus
aaactgtgtccacctatgtgtttcc

SEQ ID NO: 7932 - DNA, 25 bp, Rattus norvegicus
aaactgtgtccagctatgtgtttcc

SEQ ID NO: 7933 - DNA, 25 bp, Rattus norvegicus
aaactgtgtggaccagccgtgaaca

SEQ ID NO: 7934 - DNA, 25 bp, Rattus norvegicus
aaactgtgtggagcagccgtgaaca

SEQ ID NO: 7935 - DNA, 25 bp, Rattus norvegicus
aaactgtgttccacctggttgtaat

SEQ ID NO: 7936 - DNA, 25 bp, Rattus norvegicus
aaactgtgttcctcctggttgtaat

SEQ ID NO: 7937 - DNA, 25 bp, Rattus norvegicus
aaactgtgttggatccgcatgtgta

SEQ ID NO: 7938 - DNA, 25 bp, Rattus norvegicus
aaactgtgttggttccgcatgtgta

SEQ ID NO: 7939 - DNA, 25 bp, Rattus norvegicus
aaactgttacttagaacttttgatg

SEQ ID NO: 7940 - DNA, 25 bp, Rattus norvegicus
aaactgttactttgaacttttgatg

SEQ ID NO: 7941 - DNA, 25 bp, Rattus norvegicus
aaactgttcaatcccaggttgtgga

SEQ ID NO: 7942 - DNA, 25 bp, Rattus norvegicus
aaactgttcaatgccaggttgtgga

SEQ ID NO: 7943 - DNA, 25 bp, Rattus norvegicus
aaactgttctgtccaaagctttgtg

SEQ ID NO: 7944 - DNA, 25 bp, Rattus norvegicus
aaactgttctgtgcaaagctttgtg

SEQ ID NO: 7945 - DNA, 25 bp, Rattus norvegicus
aaactgttcttgagcccgggcacgc

SEQ ID NO: 7946 - DNA, 25 bp, Rattus norvegicus
aaactgttcttgtgcccgggcacgc

SEQ ID NO: 7947 - DNA, 25 bp, Rattus norvegicus
aaactgttgactctcctctgcctta

SEQ ID NO: 7948 - DNA, 25 bp, Rattus norvegicus
aaactgttgactgtcctctgcctta

SEQ ID NO: 7949 - DNA, 25 bp, Rattus norvegicus
aaactgttgcaccttcttctgaaat

SEQ ID NO: 7950 - DNA, 25 bp, Rattus norvegicus
aaactgttgcacgttcttctgaaat

SEQ ID NO: 7951 - DNA, 25 bp, Rattus norvegicus
aaactgttgctaattcctaacctgc

SEQ ID NO: 7952 - DNA, 25 bp, Rattus norvegicus
aaactgttgctatttcctaacctgc

SEQ ID NO: 7953 - DNA, 25 bp, Rattus norvegicus
aaactgttgctgacacaaggcccgc

SEQ ID NO: 7954 - DNA, 25 bp, Rattus norvegicus
aaactgttgctgtcacaaggcccgc

SEQ ID NO: 7955 - DNA, 25 bp, Rattus norvegicus
aaactgttggagaatcttttacttg

SEQ ID NO: 7956 - DNA, 25 bp, Rattus norvegicus
aaactgttggagtatcttttacttg

SEQ ID NO: 7957 - DNA, 25 bp, Rattus norvegicus
aaactgttggcaagacttgcctcaa

SEQ ID NO: 7958 - DNA, 25 bp, Rattus norvegicus
aaactgttggcatgacttgcctcaa

SEQ ID NO: 7959 - DNA, 25 bp, Rattus norvegicus
aaactgttggttaccatggcagcaa

SEQ ID NO: 7960 - DNA, 25 bp, Rattus norvegicus
aaactgttggtttccatggcagcaa

SEQ ID NO: 7961 - DNA, 25 bp, Rattus norvegicus
aaactgttgtttaccgtgtatgaga

SEQ ID NO: 7962 - DNA, 25 bp, Rattus norvegicus
aaactgttgttttccgtgtatgaga

SEQ ID NO: 7963 - DNA, 25 bp, Rattus norvegicus
aaactgtttccgatgtgccaagtgt

SEQ ID NO: 7964 - DNA, 25 bp, Rattus norvegicus
aaactgtttccgttgtgccaagtgt

SEQ ID NO: 7965 - DNA, 25 bp, Rattus norvegicus
aaactgtttctgaggttgacaattc

SEQ ID NO: 7966 - DNA, 25 bp, Rattus norvegicus
aaactgtttctgtggttgacaattc

SEQ ID NO: 7967 - DNA, 25 bp, Rattus norvegicus
aaactgtttgggagcttcaattgta

SEQ ID NO: 7968 - DNA, 25 bp, Rattus norvegicus
aaactgtttgggtgcttcaattgta

SEQ ID NO: 7969 - DNA, 25 bp, Rattus norvegicus
aaactgttttgtaaatcctgtcaga

SEQ ID NO: 7970 - DNA, 25 bp, Rattus norvegicus
aaactgttttgttaatcctgtcaga

SEQ ID NO: 7971 - DNA, 25 bp, Rattus norvegicus
aaacttaaacttcctgttgtgccaa

SEQ ID NO: 7972 - DNA, 25 bp, Rattus norvegicus
aaacttaaacttgctgttgtgccaa

SEQ ID NO: 7973 - DNA, 25 bp, Rattus norvegicus
aaacttaaccttccctcttcattga

SEQ ID NO: 7974 - DNA, 25 bp, Rattus norvegicus
aaacttaaccttgcctcttcattga

SEQ ID NO: 7975 - DNA, 25 bp, Rattus norvegicus
aaacttaactgtagcgcttcattat

SEQ ID NO: 7976 - DNA, 25 bp, Rattus norvegicus
aaacttaactgttgcgcttcattat

SEQ ID NO: 7977 - DNA, 25 bp, Rattus norvegicus
aaacttaatgcgctcaaaactactg

SEQ ID NO: 7978 - DNA, 25 bp, Rattus norvegicus
aaacttaatgcggtcaaaactactg

SEQ ID NO: 7979 - DNA, 25 bp, Rattus norvegicus
aaacttacagtcacgtcttcgtatt

SEQ ID NO: 7980 - DNA, 25 bp, Rattus norvegicus
aaacttacagtctcgtcttcgtatt

SEQ ID NO: 7981 - DNA, 25 bp, Rattus norvegicus
aaacttaccatgaatctggcagaaa

SEQ ID NO: 7982 - DNA, 25 bp, Rattus norvegicus
aaacttaccatgtatctggcagaaa

SEQ ID NO: 7983 - DNA, 25 bp, Rattus norvegicus
aaacttacgcgcacagggtgagaga

SEQ ID NO: 7984 - DNA, 25 bp, Rattus norvegicus
aaacttacgcgctcagggtgagaga

SEQ ID NO: 7985 - DNA, 25 bp, Rattus norvegicus
aaacttacttcacttatcccaccag

SEQ ID NO: 7986 - DNA, 25 bp, Rattus norvegicus
aaacttacttcagttatcccaccag

SEQ ID NO: 7987 - DNA, 25 bp, Rattus norvegicus
aaacttagactaacattcactgctg

SEQ ID NO: 7988 - DNA, 25 bp, Rattus norvegicus
aaacttagactatcattcactgctg

SEQ ID NO: 7989 - DNA, 25 bp, Rattus norvegicus
aaacttagcattagccgcagctgtc

SEQ ID NO: 7990 - DNA, 25 bp, Rattus norvegicus
aaacttagcatttgccgcagctgtc

SEQ ID NO: 7991 - DNA, 25 bp, Rattus norvegicus
aaacttagccttactccacatggaa

SEQ ID NO: 7992 - DNA, 25 bp, Rattus norvegicus
aaacttagcctttctccacatggaa

SEQ ID NO: 7993 - DNA, 25 bp, Rattus norvegicus
aaacttagctgtacgttcctattca

SEQ ID NO: 7994 - DNA, 25 bp, Rattus norvegicus
aaacttagctgttcgttcctattca

SEQ ID NO: 7995 - DNA, 25 bp, Rattus norvegicus
aaacttataggtccgccttctcaag

SEQ ID NO: 7996 - DNA, 25 bp, Rattus norvegicus
aaacttataggtgcgccttctcaag

SEQ ID NO: 7997 - DNA, 25 bp, Rattus norvegicus
aaacttatgccgaaggtggcggact

SEQ ID NO: 7998 - DNA, 25 bp, Rattus norvegicus
aaacttatgccgtaggtggcggact

SEQ ID NO: 7999 - DNA, 25 bp, Rattus norvegicus
aaacttatggttagatagcattatc

SEQ ID NO: 8000 - DNA, 25 bp, Rattus norvegicus
aaacttatggtttgatagcattatc

SEQ ID NO: 8001 - DNA, 25 bp, Rattus norvegicus
aaacttcaaaggaccagcactggag

SEQ ID NO: 8002 - DNA, 25 bp, Rattus norvegicus
aaacttcaaaggtccagcactggag

SEQ ID NO: 8003 - DNA, 25 bp, Rattus norvegicus
aaacttcaaattacctcatctccct

SEQ ID NO: 8004 - DNA, 25 bp, Rattus norvegicus
aaacttcaaatttcctcatctccct

SEQ ID NO: 8005 - DNA, 25 bp, Rattus norvegicus
aaacttcaagtcaacctgtcagcgg

SEQ ID NO: 8006 - DNA, 25 bp, Rattus norvegicus
aaacttcaagtctacctgtcagcgg

SEQ ID NO: 8007 - DNA, 25 bp, Rattus norvegicus
aaacttcacactcagtttcccatcg

SEQ ID NO: 8008 - DNA, 25 bp, Rattus norvegicus
aaacttcacactgagtttcccatcg

SEQ ID NO: 8009 - DNA, 25 bp, Rattus norvegicus
aaacttcacagaactgcttccagct

SEQ ID NO: 8010 - DNA, 25 bp, Rattus norvegicus
aaacttcacagatctgcttccagct

SEQ ID NO: 8011 - DNA, 25 bp, Rattus norvegicus
aaacttcacccacaaatatacacac

SEQ ID NO: 8012 - DNA, 25 bp, Rattus norvegicus
aaacttcacccagaaatatacacac

SEQ ID NO: 8013 - DNA, 25 bp, Rattus norvegicus
aaacttcactacacaattcctgcat

SEQ ID NO: 8014 - DNA, 25 bp, Rattus norvegicus
aaacttcactactcaattcctgcat

SEQ ID NO: 8015 - DNA, 25 bp, Rattus norvegicus
aaacttcactgaaagctccacttaa

SEQ ID NO: 8016 - DNA, 25 bp, Rattus norvegicus
aaacttcactgatagctccacttaa

SEQ ID NO: 8017 - DNA, 25 bp, Rattus norvegicus
aaacttcaggtgacgaatacagcat

SEQ ID NO: 8018 - DNA, 25 bp, Rattus norvegicus
aaacttcaggtgtcgaatacagcat

SEQ ID NO: 8019 - DNA, 25 bp, Rattus norvegicus
aaacttcatagtccagccaacacat

SEQ ID NO: 8020 - DNA, 25 bp, Rattus norvegicus
aaacttcatagtgcagccaacacat

SEQ ID NO: 8021 - DNA, 25 bp, Rattus norvegicus
aaacttcatgacagcgtgggtccca

SEQ ID NO: 8022 - DNA, 25 bp, Rattus norvegicus
aaacttcatgactgcgtgggtccca

SEQ ID NO: 8023 - DNA, 25 bp, Rattus norvegicus
aaacttcattacacagggtccctat

SEQ ID NO: 8024 - DNA, 25 bp, Rattus norvegicus
aaacttcattactcagggtccctat

SEQ ID NO: 8025 - DNA, 25 bp, Rattus norvegicus
aaacttccaagacagctggtcccct

SEQ ID NO: 8026 - DNA, 25 bp, Rattus norvegicus
aaacttccaagagagctggtcccct

SEQ ID NO: 8027 - DNA, 25 bp, Rattus norvegicus
aaacttccaggacttctacagctct

SEQ ID NO: 8028 - DNA, 25 bp, Rattus norvegicus
aaacttccaggagttctacagctct

SEQ ID NO: 8029 - DNA, 25 bp, Rattus norvegicus
aaacttccagtcactgcagaacgtg

SEQ ID NO: 8030 - DNA, 25 bp, Rattus norvegicus
aaacttccagtctctgcagaacgtg

SEQ ID NO: 8031 - DNA, 25 bp, Rattus norvegicus
aaacttccatagagacctgtcagat

SEQ ID NO: 8032 - DNA, 25 bp, Rattus norvegicus
aaacttccatagtgacctgtcagat

SEQ ID NO: 8033 - DNA, 25 bp, Rattus norvegicus
aaacttccctagagacattcctgga

SEQ ID NO: 8034 - DNA, 25 bp, Rattus norvegicus
aaacttccctagtgacattcctgga

SEQ ID NO: 8035 - DNA, 25 bp, Rattus norvegicus
aaacttcctcagactgtgcactgtt

SEQ ID NO: 8036 - DNA, 25 bp, Rattus norvegicus
aaacttcctcagtctgtgcactgtt

SEQ ID NO: 8037 - DNA, 25 bp, Rattus norvegicus
aaacttcctccgcagatcaatttat

SEQ ID NO: 8038 - DNA, 25 bp, Rattus norvegicus
aaacttcctccggagatcaatttat

SEQ ID NO: 8039 - DNA, 25 bp, Rattus norvegicus
aaacttcctcggaactgagccgatc

SEQ ID NO: 8040 - DNA, 25 bp, Rattus norvegicus
aaacttcctcggtactgagccgatc

SEQ ID NO: 8041 - DNA, 25 bp, Rattus norvegicus
aaacttcctgatcttgtactcgttc

SEQ ID NO: 8042 - DNA, 25 bp, Rattus norvegicus
aaacttcctgatgttgtactcgttc

SEQ ID NO: 8043 - DNA, 25 bp, Rattus norvegicus
aaacttcctgctcagattgcactgt

SEQ ID NO: 8044 - DNA, 25 bp, Rattus norvegicus
aaacttcctgctgagattgcactgt

SEQ ID NO: 8045 - DNA, 25 bp, Rattus norvegicus
aaacttcctgtaacatctagcggcc

SEQ ID NO: 8046 - DNA, 25 bp, Rattus norvegicus
aaacttcctgtacttcgtgcatgcc

SEQ ID NO: 8047 - DNA, 25 bp, Rattus norvegicus
aaacttcctgtagttcgtgcatgcc

SEQ ID NO: 8048 - DNA, 25 bp, Rattus norvegicus
aaacttcctgtatcatctagcggcc

SEQ ID NO: 8049 - DNA, 25 bp, Rattus norvegicus
aaacttccttttcattctagccacg

SEQ ID NO: 8050 - DNA, 25 bp, Rattus norvegicus
aaacttccttttgattctagccacg

SEQ ID NO: 8051 - DNA, 25 bp, Rattus norvegicus
aaacttcgcatcatgaaaccccagg

SEQ ID NO: 8052 - DNA, 25 bp, Rattus norvegicus
aaacttcgcatcttgaaaccccagg

SEQ ID NO: 8053 - DNA, 25 bp, Rattus norvegicus
aaacttcgctgcctggtttctgcca

SEQ ID NO: 8054 - DNA, 25 bp, Rattus norvegicus
aaacttcgctgcgtggtttctgcca

SEQ ID NO: 8055 - DNA, 25 bp, Rattus norvegicus
aaacttcggataatgtatcttagaa

SEQ ID NO: 8056 - DNA, 25 bp, Rattus norvegicus
aaacttcggatattgtatcttagaa

SEQ ID NO: 8057 - DNA, 25 bp, Rattus norvegicus
aaacttcgtcgaatccattgtgata

SEQ ID NO: 8058 - DNA, 25 bp, Rattus norvegicus
aaacttcgtcgattccattgtgata

SEQ ID NO: 8059 - DNA, 25 bp, Rattus norvegicus
aaacttcgtctcaaacagctgcttt

SEQ ID NO: 8060 - DNA, 25 bp, Rattus norvegicus
aaacttcgtctctaacagctgcttt

SEQ ID NO: 8061 - DNA, 25 bp, Rattus norvegicus
aaacttctaaccatctcttttgtgt

SEQ ID NO: 8062 - DNA, 25 bp, Rattus norvegicus
aaacttctaaccttctcttttgtgt

SEQ ID NO: 8063 - DNA, 25 bp, Rattus norvegicus
aaacttctagccagagacttagtct

SEQ ID NO: 8064 - DNA, 25 bp, Rattus norvegicus
aaacttctagcctgagacttagtct

SEQ ID NO: 8065 - DNA, 25 bp, Rattus norvegicus
aaacttctagtgctacagaacctaa

SEQ ID NO: 8066 - DNA, 25 bp, Rattus norvegicus
aaacttctagtggtacagaacctaa

SEQ ID NO: 8067 - DNA, 25 bp, Rattus norvegicus
aaacttctatggcagacttcttagt

SEQ ID NO: 8068 - DNA, 25 bp, Rattus norvegicus
aaacttctatgggagacttcttagt

SEQ ID NO: 8069 - DNA, 25 bp, Rattus norvegicus
aaacttctccataattacagtgcaa

SEQ ID NO: 8070 - DNA, 25 bp, Rattus norvegicus
aaacttctccattattacagtgcaa

SEQ ID NO: 8071 - DNA, 25 bp, Rattus norvegicus
aaacttctctatcctctcactttat

SEQ ID NO: 8072 - DNA, 25 bp, Rattus norvegicus
aaacttctctatgctctcactttat

SEQ ID NO: 8073 - DNA, 25 bp, Rattus norvegicus
aaacttctctcaacagccccagggc

SEQ ID NO: 8074 - DNA, 25 bp, Rattus norvegicus
aaacttctctcatcagccccagggc

SEQ ID NO: 8075 - DNA, 25 bp, Rattus norvegicus
aaacttctgactattgagaccacat

SEQ ID NO: 8076 - DNA, 25 bp, Rattus norvegicus
aaacttctgacttttgagaccacat

SEQ ID NO: 8077 - DNA, 25 bp, Rattus norvegicus
aaacttctgaggcagtgttccccga

SEQ ID NO: 8078 - DNA, 25 bp, Rattus norvegicus
aaacttctgagggagtgttccccga

SEQ ID NO: 8079 - DNA, 25 bp, Rattus norvegicus
aaacttctgcatctgtcttgtgtac

SEQ ID NO: 8080 - DNA, 25 bp, Rattus norvegicus
aaacttctgcatgtgtcttgtgtac

SEQ ID NO: 8081 - DNA, 25 bp, Rattus norvegicus
aaacttctggatatctgcaagtcta

SEQ ID NO: 8082 - DNA, 25 bp, Rattus norvegicus
aaacttctggatttctgcaagtcta

SEQ ID NO: 8083 - DNA, 25 bp, Rattus norvegicus
aaacttctgggtcactcaggtccct

SEQ ID NO: 8084 - DNA, 25 bp, Rattus norvegicus
aaacttctgggtgactcaggtccct

SEQ ID NO: 8085 - DNA, 25 bp, Rattus norvegicus
aaacttctgtaacagtgggtggcat

SEQ ID NO: 8086 - DNA, 25 bp, Rattus norvegicus
aaacttctgtaagagtgggtggcat

SEQ ID NO: 8087 - DNA, 25 bp, Rattus norvegicus
aaacttctgtgaaccgtgaaacctg

SEQ ID NO: 8088 - DNA, 25 bp, Rattus norvegicus
aaacttctgtgatccgtgaaacctg

SEQ ID NO: 8089 - DNA, 25 bp, Rattus norvegicus
aaacttctgtttcacctgatgccca

SEQ ID NO: 8090 - DNA, 25 bp, Rattus norvegicus
aaacttctgtttgacctgatgccca

SEQ ID NO: 8091 - DNA, 25 bp, Rattus norvegicus
aaacttcttatgagaatctgtggct

SEQ ID NO: 8092 - DNA, 25 bp, Rattus norvegicus
aaacttcttatgtgaatctgtggct

SEQ ID NO: 8093 - DNA, 25 bp, Rattus norvegicus
aaacttcttcagacaatggccgtgc

SEQ ID NO: 8094 - DNA, 25 bp, Rattus norvegicus
aaacttcttcagtcaatggccgtgc

SEQ ID NO: 8095 - DNA, 25 bp, Rattus norvegicus
aaacttcttccaacgaaatctcagg

SEQ ID NO: 8096 - DNA, 25 bp, Rattus norvegicus
aaacttcttccatcgaaatctcagg

SEQ ID NO: 8097 - DNA, 25 bp, Rattus norvegicus
aaacttcttgcaagttacctcacgt

SEQ ID NO: 8098 - DNA, 25 bp, Rattus norvegicus
aaacttcttgcatgttacctcacgt

SEQ ID NO: 8099 - DNA, 25 bp, Rattus norvegicus
aaacttctttagctgggctgtcagt

SEQ ID NO: 8100 - DNA, 25 bp, Rattus norvegicus
aaacttctttaggtgggctgtcagt

SEQ ID NO: 8101 - DNA, 25 bp, Rattus norvegicus
aaacttctttgacttcagatgcaga

SEQ ID NO: 8102 - DNA, 25 bp, Rattus norvegicus
aaacttctttgagttcagatgcaga

SEQ ID NO: 8103 - DNA, 25 bp, Rattus norvegicus
aaacttgaagcaataaagccagcca

SEQ ID NO: 8104 - DNA, 25 bp, Rattus norvegicus
aaacttgaagcattaaagccagcca

SEQ ID NO: 8105 - DNA, 25 bp, Rattus norvegicus
aaacttgaattcagtgcactgggag

SEQ ID NO: 8106 - DNA, 25 bp, Rattus norvegicus
aaacttgaattctgtgcactgggag

SEQ ID NO: 8107 - DNA, 25 bp, Rattus norvegicus
aaacttgaccatctgcttggctgga

SEQ ID NO: 8108 - DNA, 25 bp, Rattus norvegicus
aaacttgaccatgtgcttggctgga

SEQ ID NO: 8109 - DNA, 25 bp, Rattus norvegicus
aaacttgaccctcagttggactcct

SEQ ID NO: 8110 - DNA, 25 bp, Rattus norvegicus
aaacttgaccctgagttggactcct

SEQ ID NO: 8111 - DNA, 25 bp, Rattus norvegicus
aaacttgagatccacctcctagggc

SEQ ID NO: 8112 - DNA, 25 bp, Rattus norvegicus
aaacttgagatcgacctcctagggc

SEQ ID NO: 8113 - DNA, 25 bp, Rattus norvegicus
aaacttgaggtgctacttgcttagt

SEQ ID NO: 8114 - DNA, 25 bp, Rattus norvegicus
aaacttgaggtggtacttgcttagt

SEQ ID NO: 8115 - DNA, 25 bp, Rattus norvegicus
aaacttgatactatgtatttcagga

SEQ ID NO: 8116 - DNA, 25 bp, Rattus norvegicus
aaacttgatactttgtatttcagga

SEQ ID NO: 8117 - DNA, 25 bp, Rattus norvegicus
aaacttgatctccatctttggctcg

SEQ ID NO: 8118 - DNA, 25 bp, Rattus norvegicus
aaacttgatctcgatctttggctcg

SEQ ID NO: 8119 - DNA, 25 bp, Rattus norvegicus
aaacttgatgctagctttggccaaa

SEQ ID NO: 8120 - DNA, 25 bp, Rattus norvegicus
aaacttgatgcttgctttggccaaa

SEQ ID NO: 8121 - DNA, 25 bp, Rattus norvegicus
aaacttgcaatcatctgccgtgtag

SEQ ID NO: 8122 - DNA, 25 bp, Rattus norvegicus
aaacttgcaatcttctgccgtgtag

SEQ ID NO: 8123 - DNA, 25 bp, Rattus norvegicus
aaacttgcactcaagtacgtccttt

SEQ ID NO: 8124 - DNA, 25 bp, Rattus norvegicus
aaacttgcactctagtacgtccttt

SEQ ID NO: 8125 - DNA, 25 bp, Rattus norvegicus
aaacttgccgtcacattggtaggtc

SEQ ID NO: 8126 - DNA, 25 bp, Rattus norvegicus
aaacttgccgtctcattggtaggtc

SEQ ID NO: 8127 - DNA, 25 bp, Rattus norvegicus
aaacttgcctgtcttcccaaatact

SEQ ID NO: 8128 - DNA, 25 bp, Rattus norvegicus
aaacttgcctgtgttcccaaatact

SEQ ID NO: 8129 - DNA, 25 bp, Rattus norvegicus
aaacttgcctttaatagatttgatt

SEQ ID NO: 8130 - DNA, 25 bp, Rattus norvegicus
aaacttgccttttatagatttgatt

SEQ ID NO: 8131 - DNA, 25 bp, Rattus norvegicus
aaacttgctaatacagactctttaa

SEQ ID NO: 8132 - DNA, 25 bp, Rattus norvegicus
aaacttgctaattcagactctttaa

SEQ ID NO: 8133 - DNA, 25 bp, Rattus norvegicus
aaacttgctatgactgctacatcaa

SEQ ID NO: 8134 - DNA, 25 bp, Rattus norvegicus
aaacttgctatgtctgctacatcaa

SEQ ID NO: 8135 - DNA, 25 bp, Rattus norvegicus
aaacttgctgcacccagcttgtgtg

SEQ ID NO: 8136 - DNA, 25 bp, Rattus norvegicus
aaacttgctgcagccagcttgtgtg

SEQ ID NO: 8137 - DNA, 25 bp, Rattus norvegicus
aaacttgctgctataactgttgtaa

SEQ ID NO: 8138 - DNA, 25 bp, Rattus norvegicus
aaacttgctgctttaactgttgtaa

SEQ ID NO: 8139 - DNA, 25 bp, Rattus norvegicus
aaacttgctgggatcaaggactgca

SEQ ID NO: 8140 - DNA, 25 bp, Rattus norvegicus
aaacttgctgggttcaaggactgca

SEQ ID NO: 8141 - DNA, 25 bp, Rattus norvegicus
aaacttgctgtcataggagtcctgc

SEQ ID NO: 8142 - DNA, 25 bp, Rattus norvegicus
aaacttgctgtcttaggagtcctgc

SEQ ID NO: 8143 - DNA, 25 bp, Rattus norvegicus
aaacttgcttgtatttctagagcag

SEQ ID NO: 8144 - DNA, 25 bp, Rattus norvegicus
aaacttgcttgtttttctagagcag

SEQ ID NO: 8145 - DNA, 25 bp, Rattus norvegicus
aaacttggagagctgggtccttcct

SEQ ID NO: 8146 - DNA, 25 bp, Rattus norvegicus
aaacttggagaggtgggtccttcct

SEQ ID NO: 8147 - DNA, 25 bp, Rattus norvegicus
aaacttggagctattgtgtcactga

SEQ ID NO: 8148 - DNA, 25 bp, Rattus norvegicus
aaacttggagcttttgtgtcactga

SEQ ID NO: 8149 - DNA, 25 bp, Rattus norvegicus
aaacttggatccatagggctcccag

SEQ ID NO: 8150 - DNA, 25 bp, Rattus norvegicus
aaacttggatccttagggctcccag

SEQ ID NO: 8151 - DNA, 25 bp, Rattus norvegicus
aaacttggcacacctcctgaaggat

SEQ ID NO: 8152 - DNA, 25 bp, Rattus norvegicus
aaacttggcacagctcctgaaggat

SEQ ID NO: 8153 - DNA, 25 bp, Rattus norvegicus
aaacttggcattaaacactttgtgt

SEQ ID NO: 8154 - DNA, 25 bp, Rattus norvegicus
aaacttggcatttaacactttgtgt

SEQ ID NO: 8155 - DNA, 25 bp, Rattus norvegicus
aaacttggccacatgaagtcttgta

SEQ ID NO: 8156 - DNA, 25 bp, Rattus norvegicus
aaacttggccacttgaagtcttgta

SEQ ID NO: 8157 - DNA, 25 bp, Rattus norvegicus
aaacttggccttccttggctttgga

SEQ ID NO: 8158 - DNA, 25 bp, Rattus norvegicus
aaacttggccttgcttggctttgga

SEQ ID NO: 8159 - DNA, 25 bp, Rattus norvegicus
aaacttggcttgagacacctggcac

SEQ ID NO: 8160 - DNA, 25 bp, Rattus norvegicus
aaacttggcttgtgacacctggcac

SEQ ID NO: 8161 - DNA, 25 bp, Rattus norvegicus
aaacttgggcaactttatcagaata

SEQ ID NO: 8162 - DNA, 25 bp, Rattus norvegicus
aaacttgggcaagtttatcagaata

SEQ ID NO: 8163 - DNA, 25 bp, Rattus norvegicus
aaacttgggcctaccagtcttgtct

SEQ ID NO: 8164 - DNA, 25 bp, Rattus norvegicus
aaacttgggccttccagtcttgtct

SEQ ID NO: 8165 - DNA, 25 bp, Rattus norvegicus
aaacttggtgagatgtgcctgccgc

SEQ ID NO: 8166 - DNA, 25 bp, Rattus norvegicus
aaacttggtgagttgtgcctgccgc

SEQ ID NO: 8167 - DNA, 25 bp, Rattus norvegicus
aaacttggtggcaacagtgatcccc

SEQ ID NO: 8168 - DNA, 25 bp, Rattus norvegicus
aaacttggtggctacagtgatcccc

SEQ ID NO: 8169 - DNA, 25 bp, Rattus norvegicus
aaacttggttcgaacttctgctcct

SEQ ID NO: 8170 - DNA, 25 bp, Rattus norvegicus
aaacttggttcgtacttctgctcct

SEQ ID NO: 8171 - DNA, 25 bp, Rattus norvegicus
aaacttgtaaagacatcagtatgat

SEQ ID NO: 8172 - DNA, 25 bp, Rattus norvegicus
aaacttgtaaagtcatcagtatgat

SEQ ID NO: 8173 - DNA, 25 bp, Rattus norvegicus
aaacttgtatggactcacacaatac

SEQ ID NO: 8174 - DNA, 25 bp, Rattus norvegicus
aaacttgtatggtctcacacaatac

SEQ ID NO: 8175 - DNA, 25 bp, Rattus norvegicus
aaacttgtcaccctcttggtctcag

SEQ ID NO: 8176 - DNA, 25 bp, Rattus norvegicus
aaacttgtcaccgtcttggtctcag

SEQ ID NO: 8177 - DNA, 25 bp, Rattus norvegicus
aaacttgtcagcaatctaactggct

SEQ ID NO: 8178 - DNA, 25 bp, Rattus norvegicus
aaacttgtcagctatctaactggct

SEQ ID NO: 8179 - DNA, 25 bp, Rattus norvegicus
aaacttgtcgctcacttcatggcta

SEQ ID NO: 8180 - DNA, 25 bp, Rattus norvegicus
aaacttgtcgctgacttcatggcta

SEQ ID NO: 8181 - DNA, 25 bp, Rattus norvegicus
aaacttgtcttaccatttccatttg

SEQ ID NO: 8182 - DNA, 25 bp, Rattus norvegicus
aaacttgtcttagcatttccatttg

SEQ ID NO: 8183 - DNA, 25 bp, Rattus norvegicus
aaacttgtgagcatccgaactccgc

SEQ ID NO: 8184 - DNA, 25 bp, Rattus norvegicus
aaacttgtgagcttccgaactccgc

SEQ ID NO: 8185 - DNA, 25 bp, Rattus norvegicus
aaacttgtgcatcgagttcgtgctg

SEQ ID NO: 8186 - DNA, 25 bp, Rattus norvegicus
aaacttgtgcatggagttcgtgctg

SEQ ID NO: 8187 - DNA, 25 bp, Rattus norvegicus
aaacttgtgctcacctcttgggcag

SEQ ID NO: 8188 - DNA, 25 bp, Rattus norvegicus
aaacttgtgctctcctcttgggcag

SEQ ID NO: 8189 - DNA, 25 bp, Rattus norvegicus
aaacttgtggagactgagtgccgcc

SEQ ID NO: 8190 - DNA, 25 bp, Rattus norvegicus
aaacttgtggagtctgagtgccgcc

SEQ ID NO: 8191 - DNA, 25 bp, Rattus norvegicus
aaacttgtggctacaggatctctga

SEQ ID NO: 8192 - DNA, 25 bp, Rattus norvegicus
aaacttgtggcttcaggatctctga

SEQ ID NO: 8193 - DNA, 25 bp, Rattus norvegicus
aaacttgtggtgctcaggatgccta

SEQ ID NO: 8194 - DNA, 25 bp, Rattus norvegicus
aaacttgtggtggtcaggatgccta

SEQ ID NO: 8195 - DNA, 25 bp, Rattus norvegicus
aaacttgtgtgcagaggagactcga

SEQ ID NO: 8196 - DNA, 25 bp, Rattus norvegicus
aaacttgtgtgctgaggagactcga

SEQ ID NO: 8197 - DNA, 25 bp, Rattus norvegicus
aaacttgtgtttaatgtctactttg

SEQ ID NO: 8198 - DNA, 25 bp, Rattus norvegicus
aaacttgtgttttatgtctactttg

SEQ ID NO: 8199 - DNA, 25 bp, Rattus norvegicus
aaacttgttaagagcacctgccacc

SEQ ID NO: 8200 - DNA, 25 bp, Rattus norvegicus
aaacttgttaagtgcacctgccacc

SEQ ID NO: 8201 - DNA, 25 bp, Rattus norvegicus
aaacttgttattctgcctattttca

SEQ ID NO: 8202 - DNA, 25 bp, Rattus norvegicus
aaacttgttattgtgcctattttca

SEQ ID NO: 8203 - DNA, 25 bp, Rattus norvegicus
aaactttacatgactctttgagtta

SEQ ID NO: 8204 - DNA, 25 bp, Rattus norvegicus
aaactttacatgtctctttgagtta

SEQ ID NO: 8205 - DNA, 25 bp, Rattus norvegicus
aaactttacgtgagctttgagagcc

SEQ ID NO: 8206 - DNA, 25 bp, Rattus norvegicus
aaactttacgtgtgctttgagagcc

SEQ ID NO: 8207 - DNA, 25 bp, Rattus norvegicus
aaactttactgcagcgtgtgtgtgt

SEQ ID NO: 8208 - DNA, 25 bp, Rattus norvegicus
aaactttactgctgcgtgtgtgtgt

SEQ ID NO: 8209 - DNA, 25 bp, Rattus norvegicus
aaactttagagcacactgcggccgc

SEQ ID NO: 8210 - DNA, 25 bp, Rattus norvegicus
aaactttagagctcactgcggccgc

SEQ ID NO: 8211 - DNA, 25 bp, Rattus norvegicus
aaactttagtacatttccatgcaga

SEQ ID NO: 8212 - DNA, 25 bp, Rattus norvegicus
aaactttagtacttttccatgcaga

SEQ ID NO: 8213 - DNA, 25 bp, Rattus norvegicus
aaactttatctgacttcactcacaa

SEQ ID NO: 8214 - DNA, 25 bp, Rattus norvegicus
aaactttatctgtcttcactcacaa

SEQ ID NO: 8215 - DNA, 25 bp, Rattus norvegicus
aaactttatgaccatatggcacaag

SEQ ID NO: 8216 - DNA, 25 bp, Rattus norvegicus
aaactttatgacgatatggcacaag

SEQ ID NO: 8217 - DNA, 25 bp, Rattus norvegicus
aaactttatgcaagtttaagccata

SEQ ID NO: 8218 - DNA, 25 bp, Rattus norvegicus
aaactttatgcatgtttaagccata

SEQ ID NO: 8219 - DNA, 25 bp, Rattus norvegicus
aaactttatttgacttcatcaggag

SEQ ID NO: 8220 - DNA, 25 bp, Rattus norvegicus
aaactttatttgtcttcatcaggag

SEQ ID NO: 8221 - DNA, 25 bp, Rattus norvegicus
aaactttcaagtactcaaggccagg

SEQ ID NO: 8222 - DNA, 25 bp, Rattus norvegicus
aaactttcaagttctcaaggccagg

SEQ ID NO: 8223 - DNA, 25 bp, Rattus norvegicus
aaactttcacacagcgtcttcatct

SEQ ID NO: 8224 - DNA, 25 bp, Rattus norvegicus
aaactttcacactgcgtcttcatct

SEQ ID NO: 8225 - DNA, 25 bp, Rattus norvegicus
aaactttcatgaccacaccctaata

SEQ ID NO: 8226 - DNA, 25 bp, Rattus norvegicus
aaactttcatgacccgtgagtcact

SEQ ID NO: 8227 - DNA, 25 bp, Rattus norvegicus
aaactttcatgagcacaccctaata

SEQ ID NO: 8228 - DNA, 25 bp, Rattus norvegicus
aaactttcatgagccgtgagtcact

SEQ ID NO: 8229 - DNA, 25 bp, Rattus norvegicus
aaactttccatgaacatagggctag

SEQ ID NO: 8230 - DNA, 25 bp, Rattus norvegicus
aaactttccatgtacatagggctag

SEQ ID NO: 8231 - DNA, 25 bp, Rattus norvegicus
aaactttcctacacatgtagtgtga

SEQ ID NO: 8232 - DNA, 25 bp, Rattus norvegicus
aaactttcctactcatgtagtgtga

SEQ ID NO: 8233 - DNA, 25 bp, Rattus norvegicus
aaactttcgcttccagcgcagcctt

SEQ ID NO: 8234 - DNA, 25 bp, Rattus norvegicus
aaactttcgcttgcagcgcagcctt

SEQ ID NO: 8235 - DNA, 25 bp, Rattus norvegicus
aaactttctatcatctctcttcaag

SEQ ID NO: 8236 - DNA, 25 bp, Rattus norvegicus
aaactttctatcttctctcttcaag

SEQ ID NO: 8237 - DNA, 25 bp, Rattus norvegicus
aaactttctgtccagctagggatgt

SEQ ID NO: 8238 - DNA, 25 bp, Rattus norvegicus
aaactttctgtcgagctagggatgt

SEQ ID NO: 8239 - DNA, 25 bp, Rattus norvegicus
aaactttcttggacaccatgggtca

SEQ ID NO: 8240 - DNA, 25 bp, Rattus norvegicus
aaactttcttggtcaccatgggtca

SEQ ID NO: 8241 - DNA, 25 bp, Rattus norvegicus
aaactttgagcccagttctcacagg

SEQ ID NO: 8242 - DNA, 25 bp, Rattus norvegicus
aaactttgagccgagttctcacagg

SEQ ID NO: 8243 - DNA, 25 bp, Rattus norvegicus
aaactttgatccacctttgaaccag

SEQ ID NO: 8244 - DNA, 25 bp, Rattus norvegicus
aaactttgatcctcctttgaaccag

SEQ ID NO: 8245 - DNA, 25 bp, Rattus norvegicus
aaactttgcaatccagggatgctgg

SEQ ID NO: 8246 - DNA, 25 bp, Rattus norvegicus
aaactttgcaatgcagggatgctgg

SEQ ID NO: 8247 - DNA, 25 bp, Rattus norvegicus
aaactttgccagcttcagaagtctg

SEQ ID NO: 8248 - DNA, 25 bp, Rattus norvegicus
aaactttgccaggttcagaagtctg

SEQ ID NO: 8249 - DNA, 25 bp, Rattus norvegicus
aaactttgctgtcttgttctccaac

SEQ ID NO: 8250 - DNA, 25 bp, Rattus norvegicus
aaactttgctgtgttgttctccaac

SEQ ID NO: 8251 - DNA, 25 bp, Rattus norvegicus
aaactttggcgacgccgagtgactc

SEQ ID NO: 8252 - DNA, 25 bp, Rattus norvegicus
aaactttggcgaggccgagtgactc

SEQ ID NO: 8253 - DNA, 25 bp, Rattus norvegicus
aaactttgtaccacaacctggcagg

SEQ ID NO: 8254 - DNA, 25 bp, Rattus norvegicus
aaactttgtacctcaacctggcagg

SEQ ID NO: 8255 - DNA, 25 bp, Rattus norvegicus
aaactttgtcaaccagctccttcag

SEQ ID NO: 8256 - DNA, 25 bp, Rattus norvegicus
aaactttgtcaagcagctccttcag

SEQ ID NO: 8257 - DNA, 25 bp, Rattus norvegicus
aaactttgtcatagcaacttagaag

SEQ ID NO: 8258 - DNA, 25 bp, Rattus norvegicus
aaactttgtcattgcaacttagaag

SEQ ID NO: 8259 - DNA, 25 bp, Rattus norvegicus
aaactttgtcccattctggtagcca

SEQ ID NO: 8260 - DNA, 25 bp, Rattus norvegicus
aaactttgtccctttctggtagcca

SEQ ID NO: 8261 - DNA, 25 bp, Rattus norvegicus
aaactttgtctgaggcttcatggtc

SEQ ID NO: 8262 - DNA, 25 bp, Rattus norvegicus
aaactttgtctgtggcttcatggtc

SEQ ID NO: 8263 - DNA, 25 bp, Rattus norvegicus
aaactttgtggtcaggcagcatgca

SEQ ID NO: 8264 - DNA, 25 bp, Rattus norvegicus
aaactttgtggtgaggcagcatgca

SEQ ID NO: 8265 - DNA, 25 bp, Rattus norvegicus
aaacttttatcaagccttctcctga

SEQ ID NO: 8266 - DNA, 25 bp, Rattus norvegicus
aaacttttatcatgccttctcctga

SEQ ID NO: 8267 - DNA, 25 bp, Rattus norvegicus
aaacttttcccaatcagatccagag

SEQ ID NO: 8268 - DNA, 25 bp, Rattus norvegicus
aaacttttcccattcagatccagag

SEQ ID NO: 8269 - DNA, 25 bp, Rattus norvegicus
aaacttttcctcagatcccgctatt

SEQ ID NO: 8270 - DNA, 25 bp, Rattus norvegicus
aaacttttcctctgatcccgctatt

SEQ ID NO: 8271 - DNA, 25 bp, Rattus norvegicus
aaacttttctatatcctgttcgctg

SEQ ID NO: 8272 - DNA, 25 bp, Rattus norvegicus
aaacttttctatttcctgttcgctg

SEQ ID NO: 8273 - DNA, 25 bp, Rattus norvegicus
aaacttttcttgagtcattttcctg

SEQ ID NO: 8274 - DNA, 25 bp, Rattus norvegicus
aaacttttcttgtgtcattttcctg

SEQ ID NO: 8275 - DNA, 25 bp, Rattus norvegicus
aaacttttgctcaaagccttgggag

SEQ ID NO: 8276 - DNA, 25 bp, Rattus norvegicus
aaacttttgctctaagccttgggag

SEQ ID NO: 8277 - DNA, 25 bp, Rattus norvegicus
aaacttttgtttacatccattctgg

SEQ ID NO: 8278 - DNA, 25 bp, Rattus norvegicus
aaacttttgttttcatccattctgg

SEQ ID NO: 8279 - DNA, 25 bp, Rattus norvegicus
aaactttttggaccctgaggtcact

SEQ ID NO: 8280 - DNA, 25 bp, Rattus norvegicus
aaactttttggagcctgaggtcact

SEQ ID NO: 8281 - DNA, 25 bp, Rattus norvegicus
aaactttttgtacgtgtgtctgagc

SEQ ID NO: 8282 - DNA, 25 bp, Rattus norvegicus
aaactttttgtaggtgtgtctgagc

SEQ ID NO: 8283 - DNA, 25 bp, Rattus norvegicus
aaactttttgtccacactgatactg

SEQ ID NO: 8284 - DNA, 25 bp, Rattus norvegicus
aaactttttgtcgacactgatactg

SEQ ID NO: 8285 - DNA, 25 bp, Rattus norvegicus
aaagaaaaatcaactgagccagaat

SEQ ID NO: 8286 - DNA, 25 bp, Rattus norvegicus
aaagaaaaatcatctgagccagaat

SEQ ID NO: 8287 - DNA, 25 bp, Rattus norvegicus
aaagaaaacattaagctggcccaat

SEQ ID NO: 8288 - DNA, 25 bp, Rattus norvegicus
aaagaaaacatttagctggcccaat

SEQ ID NO: 8289 - DNA, 25 bp, Rattus norvegicus
aaagaaaactgactcgctcccatga

SEQ ID NO: 8290 - DNA, 25 bp, Rattus norvegicus
aaagaaaactgagtcgctcccatga

SEQ ID NO: 8291 - DNA, 25 bp, Rattus norvegicus
aaagaaaagcccacctcctaatatg

SEQ ID NO: 8292 - DNA, 25 bp, Rattus norvegicus
aaagaaaagccctcctcctaatatg

SEQ ID NO: 8293 - DNA, 25 bp, Rattus norvegicus
aaagaaacacctactgacttgcagt

SEQ ID NO: 8294 - DNA, 25 bp, Rattus norvegicus
aaagaaacaccttctgacttgcagt

SEQ ID NO: 8295 - DNA, 25 bp, Rattus norvegicus
aaagaaacagccagctcctggtcaa

SEQ ID NO: 8296 - DNA, 25 bp, Rattus norvegicus
aaagaaacagcctgctcctggtcaa

SEQ ID NO: 8297 - DNA, 25 bp, Rattus norvegicus
aaagaaacagtgacatgcccctccc

SEQ ID NO: 8298 - DNA, 25 bp, Rattus norvegicus
aaagaaacagtgtcatgcccctccc

SEQ ID NO: 8299 - DNA, 25 bp, Rattus norvegicus
aaagaaacataacgcccatggctac

SEQ ID NO: 8300 - DNA, 25 bp, Rattus norvegicus
aaagaaacataaggcccatggctac

SEQ ID NO: 8301 - DNA, 25 bp, Rattus norvegicus
aaagaaacatcacctgccctttcag

SEQ ID NO: 8302 - DNA, 25 bp, Rattus norvegicus
aaagaaacatcagctgccctttcag

SEQ ID NO: 8303 - DNA, 25 bp, Rattus norvegicus
aaagaaaccagacgcacttcaagaa

SEQ ID NO: 8304 - DNA, 25 bp, Rattus norvegicus
aaagaaaccagaggcacttcaagaa

SEQ ID NO: 8305 - DNA, 25 bp, Rattus norvegicus
aaagaaacctgccaccaagtctgac

SEQ ID NO: 8306 - DNA, 25 bp, Rattus norvegicus
aaagaaacctgcgaccaagtctgac

SEQ ID NO: 8307 - DNA, 25 bp, Rattus norvegicus
aaagaaactgctacatgccccagtc

SEQ ID NO: 8308 - DNA, 25 bp, Rattus norvegicus
aaagaaactgcttcatgccccagtc

SEQ ID NO: 8309 - DNA, 25 bp, Rattus norvegicus
aaagaaacttctaggcttagctgaa

SEQ ID NO: 8310 - DNA, 25 bp, Rattus norvegicus
aaagaaacttcttggcttagctgaa

SEQ ID NO: 8311 - DNA, 25 bp, Rattus norvegicus
aaagaaagaccaaatgctgccgcat

SEQ ID NO: 8312 - DNA, 25 bp, Rattus norvegicus
aaagaaagaccatatgctgccgcat

SEQ ID NO: 8313 - DNA, 25 bp, Rattus norvegicus
aaagaaagagctctggcgctcccta

SEQ ID NO: 8314 - DNA, 25 bp, Rattus norvegicus
aaagaaagagctgtggcgctcccta

SEQ ID NO: 8315 - DNA, 25 bp, Rattus norvegicus
aaagaaagatgcagcccctgtgtgt

SEQ ID NO: 8316 - DNA, 25 bp, Rattus norvegicus
aaagaaagatgctgcccctgtgtgt

SEQ ID NO: 8317 - DNA, 25 bp, Rattus norvegicus
aaagaaagattcactcctcacctct

SEQ ID NO: 8318 - DNA, 25 bp, Rattus norvegicus
aaagaaagattctctcctcacctct

SEQ ID NO: 8319 - DNA, 25 bp, Rattus norvegicus
aaagaaagcacaccgcctgagggcg

SEQ ID NO: 8320 - DNA, 25 bp, Rattus norvegicus
aaagaaagcacagcgcctgagggcg

SEQ ID NO: 8321 - DNA, 25 bp, Rattus norvegicus
aaagaaagccccaccttgacagtgc

SEQ ID NO: 8322 - DNA, 25 bp, Rattus norvegicus
aaagaaagcccctccttgacagtgc

SEQ ID NO: 8323 - DNA, 25 bp, Rattus norvegicus
aaagaaagccggctcctgctccacg

SEQ ID NO: 8324 - DNA, 25 bp, Rattus norvegicus
aaagaaagccgggtcctgctccacg

SEQ ID NO: 8325 - DNA, 25 bp, Rattus norvegicus
aaagaaagcctgctacctcatcgca

SEQ ID NO: 8326 - DNA, 25 bp, Rattus norvegicus
aaagaaagcctggtacctcatcgca

SEQ ID NO: 8327 - DNA, 25 bp, Rattus norvegicus
aaagaaagctctctggctcccgagg

SEQ ID NO: 8328 - DNA, 25 bp, Rattus norvegicus
aaagaaagctctgtggctcccgagg

SEQ ID NO: 8329 - DNA, 25 bp, Rattus norvegicus
aaagaaagtcgcaggcatccgcaat

SEQ ID NO: 8330 - DNA, 25 bp, Rattus norvegicus
aaagaaagtcgctggcatccgcaat

SEQ ID NO: 8331 - DNA, 25 bp, Rattus norvegicus
aaagaaatccccatattgccctaat

SEQ ID NO: 8332 - DNA, 25 bp, Rattus norvegicus
aaagaaatccccttattgccctaat

SEQ ID NO: 8333 - DNA, 25 bp, Rattus norvegicus
aaagaaatcgttcaggcccttgaca

SEQ ID NO: 8334 - DNA, 25 bp, Rattus norvegicus
aaagaaatcgttgaggcccttgaca

SEQ ID NO: 8335 - DNA, 25 bp, Rattus norvegicus
aaagaaatctctaacccatgtggaa

SEQ ID NO: 8336 - DNA, 25 bp, Rattus norvegicus
aaagaaatctcttacccatgtggaa

SEQ ID NO: 8337 - DNA, 25 bp, Rattus norvegicus
aaagaaatggccagcgtggctccac

SEQ ID NO: 8338 - DNA, 25 bp, Rattus norvegicus
aaagaaatggcctgcgtggctccac

SEQ ID NO: 8339 - DNA, 25 bp, Rattus norvegicus
aaagaacaaagtcctgcttctacac

SEQ ID NO: 8340 - DNA, 25 bp, Rattus norvegicus
aaagaacaaagtgctgcttctacac

SEQ ID NO: 8341 - DNA, 25 bp, Rattus norvegicus
aaagaacagagacccctgtcagtgc

SEQ ID NO: 8342 - DNA, 25 bp, Rattus norvegicus
aaagaacagagagccctgtcagtgc

SEQ ID NO: 8343 - DNA, 25 bp, Rattus norvegicus
aaagaacagctcccgcttcatttcc

SEQ ID NO: 8344 - DNA, 25 bp, Rattus norvegicus
aaagaacagctcgcgcttcatttcc

SEQ ID NO: 8345 - DNA, 25 bp, Rattus norvegicus
aaagaacagggaccatttgaccaag

SEQ ID NO: 8346 - DNA, 25 bp, Rattus norvegicus
aaagaacagggagcatttgaccaag

SEQ ID NO: 8347 - DNA, 25 bp, Rattus norvegicus
aaagaacagggtctattgttagcct

SEQ ID NO: 8348 - DNA, 25 bp, Rattus norvegicus
aaagaacagggtgtattgttagcct

SEQ ID NO: 8349 - DNA, 25 bp, Rattus norvegicus
aaagaacagtgcacagggtcctgca

SEQ ID NO: 8350 - DNA, 25 bp, Rattus norvegicus
aaagaacagtgctcagggtcctgca

SEQ ID NO: 8351 - DNA, 25 bp, Rattus norvegicus
aaagaacatacacggtctggaccta

SEQ ID NO: 8352 - DNA, 25 bp, Rattus norvegicus
aaagaacatacagggtctggaccta

SEQ ID NO: 8353 - DNA, 25 bp, Rattus norvegicus
aaagaacataccattgaccccagca

SEQ ID NO: 8354 - DNA, 25 bp, Rattus norvegicus
aaagaacatacctttgaccccagca

SEQ ID NO: 8355 - DNA, 25 bp, Rattus norvegicus
aaagaacatcacagcttccattcac

SEQ ID NO: 8356 - DNA, 25 bp, Rattus norvegicus
aaagaacatcactgcttccattcac

SEQ ID NO: 8357 - DNA, 25 bp, Rattus norvegicus
aaagaacatccgacacaggccaggt

SEQ ID NO: 8358 - DNA, 25 bp, Rattus norvegicus
aaagaacatccgtcacaggccaggt

SEQ ID NO: 8359 - DNA, 25 bp, Rattus norvegicus
aaagaacatgtgaggcctggctgcc

SEQ ID NO: 8360 - DNA, 25 bp, Rattus norvegicus
aaagaacatgtgtggcctggctgcc

SEQ ID NO: 8361 - DNA, 25 bp, Rattus norvegicus
aaagaacattttcagcagcagagga

SEQ ID NO: 8362 - DNA, 25 bp, Rattus norvegicus
aaagaacattttgagcagcagagga

SEQ ID NO: 8363 - DNA, 25 bp, Rattus norvegicus
aaagaaccaccacgcgctgttcagt

SEQ ID NO: 8364 - DNA, 25 bp, Rattus norvegicus
aaagaaccaccaggcgctgttcagt

SEQ ID NO: 8365 - DNA, 25 bp, Rattus norvegicus
aaagaaccatgcacactgagaataa

SEQ ID NO: 8366 - DNA, 25 bp, Rattus norvegicus
aaagaaccatgctcactgagaataa

SEQ ID NO: 8367 - DNA, 25 bp, Rattus norvegicus
aaagaaccatttctgtgactgctgg

SEQ ID NO: 8368 - DNA, 25 bp, Rattus norvegicus
aaagaaccatttgtgtgactgctgg

SEQ ID NO: 8369 - DNA, 25 bp, Rattus norvegicus
aaagaacccaccatggcactattgg

SEQ ID NO: 8370 - DNA, 25 bp, Rattus norvegicus
aaagaacccaccttggcactattgg

SEQ ID NO: 8371 - DNA, 25 bp, Rattus norvegicus
aaagaacccagcatggtcacaccgt

SEQ ID NO: 8372 - DNA, 25 bp, Rattus norvegicus
aaagaacccagcttggtcacaccgt

SEQ ID NO: 8373 - DNA, 25 bp, Rattus norvegicus
aaagaacccatgacgggctggagag

SEQ ID NO: 8374 - DNA, 25 bp, Rattus norvegicus
aaagaacccatgcagaggccagtga

SEQ ID NO: 8375 - DNA, 25 bp, Rattus norvegicus
aaagaacccatggagaggccagtga

SEQ ID NO: 8376 - DNA, 25 bp, Rattus norvegicus
aaagaacccatgtcgggctggagag

SEQ ID NO: 8377 - DNA, 25 bp, Rattus norvegicus
aaagaacccctcctgtgaggtgtca

SEQ ID NO: 8378 - DNA, 25 bp, Rattus norvegicus
aaagaacccctcgtgtgaggtgtca

SEQ ID NO: 8379 - DNA, 25 bp, Rattus norvegicus
aaagaaccgcacattatatccaaag

SEQ ID NO: 8380 - DNA, 25 bp, Rattus norvegicus
aaagaaccgcactttatatccaaag

SEQ ID NO: 8381 - DNA, 25 bp, Rattus norvegicus
aaagaacctagcaacctggagcgcc

SEQ ID NO: 8382 - DNA, 25 bp, Rattus norvegicus
aaagaacctagctacctggagcgcc

SEQ ID NO: 8383 - DNA, 25 bp, Rattus norvegicus
aaagaacctattcagatcctgccca

SEQ ID NO: 8384 - DNA, 25 bp, Rattus norvegicus
aaagaacctattgagatcctgccca

SEQ ID NO: 8385 - DNA, 25 bp, Rattus norvegicus
aaagaacctcccatggatctcgtga

SEQ ID NO: 8386 - DNA, 25 bp, Rattus norvegicus
aaagaacctcccttggatctcgtga

SEQ ID NO: 8387 - DNA, 25 bp, Rattus norvegicus
aaagaacctgccatcagagtggaga

SEQ ID NO: 8388 - DNA, 25 bp, Rattus norvegicus
aaagaacctgccttcagagtggaga

SEQ ID NO: 8389 - DNA, 25 bp, Rattus norvegicus
aaagaacctgctaccatgagatgag

SEQ ID NO: 8390 - DNA, 25 bp, Rattus norvegicus
aaagaacctgcttccatgagatgag

SEQ ID NO: 8391 - DNA, 25 bp, Rattus norvegicus
aaagaacctggcctatctccagtga

SEQ ID NO: 8392 - DNA, 25 bp, Rattus norvegicus
aaagaacctggcgtatctccagtga

SEQ ID NO: 8393 - DNA, 25 bp, Rattus norvegicus
aaagaaccttctcgatgtaccctgc

SEQ ID NO: 8394 - DNA, 25 bp, Rattus norvegicus
aaagaaccttctggatgtaccctgc

SEQ ID NO: 8395 - DNA, 25 bp, Rattus norvegicus
aaagaacgagagaccatctgcccag

SEQ ID NO: 8396 - DNA, 25 bp, Rattus norvegicus
aaagaacgagagtccatctgcccag

SEQ ID NO: 8397 - DNA, 25 bp, Rattus norvegicus
aaagaacgcagcaacggaggcccta

SEQ ID NO: 8398 - DNA, 25 bp, Rattus norvegicus
aaagaacgcagctacggaggcccta

SEQ ID NO: 8399 - DNA, 25 bp, Rattus norvegicus
aaagaactagcaaggtgcccgctgc

SEQ ID NO: 8400 - DNA, 25 bp, Rattus norvegicus
aaagaactagcatggtgcccgctgc

SEQ ID NO: 8401 - DNA, 25 bp, Rattus norvegicus
aaagaactcagaccccggatccaga

SEQ ID NO: 8402 - DNA, 25 bp, Rattus norvegicus
aaagaactcagagcccggatccaga

SEQ ID NO: 8403 - DNA, 25 bp, Rattus norvegicus
aaagaactccacagtgtcctcagaa

SEQ ID NO: 8404 - DNA, 25 bp, Rattus norvegicus
aaagaactccactgtgtcctcagaa

SEQ ID NO: 8405 - DNA, 25 bp, Rattus norvegicus
aaagaactcttccatgagccatgac

SEQ ID NO: 8406 - DNA, 25 bp, Rattus norvegicus
aaagaactcttcgatgagccatgac

SEQ ID NO: 8407 - DNA, 25 bp, Rattus norvegicus
aaagaactgccacactcatcatctc

SEQ ID NO: 8408 - DNA, 25 bp, Rattus norvegicus
aaagaactgccagactcatcatctc

SEQ ID NO: 8409 - DNA, 25 bp, Rattus norvegicus
aaagaactgccccatacaggatggc

SEQ ID NO: 8410 - DNA, 25 bp, Rattus norvegicus
aaagaactgccccatttcctccagg

SEQ ID NO: 8411 - DNA, 25 bp, Rattus norvegicus
aaagaactgcccgatacaggatggc

SEQ ID NO: 8412 - DNA, 25 bp, Rattus norvegicus
aaagaactgcccgatttcctccagg

SEQ ID NO: 8413 - DNA, 25 bp, Rattus norvegicus
aaagaactggatcccttgcccagca

SEQ ID NO: 8414 - DNA, 25 bp, Rattus norvegicus
aaagaactggatgccttgcccagca

SEQ ID NO: 8415 - DNA, 25 bp, Rattus norvegicus
aaagaactggctacttgtggctggg

SEQ ID NO: 8416 - DNA, 25 bp, Rattus norvegicus
aaagaactggcttcttgtggctggg

SEQ ID NO: 8417 - DNA, 25 bp, Rattus norvegicus
aaagaactgtatcccatggctgacc

SEQ ID NO: 8418 - DNA, 25 bp, Rattus norvegicus
aaagaactgtatgccatggctgacc

SEQ ID NO: 8419 - DNA, 25 bp, Rattus norvegicus
aaagaactgtcgacagctgcctgca

SEQ ID NO: 8420 - DNA, 25 bp, Rattus norvegicus
aaagaactgtcgtcagctgcctgca

SEQ ID NO: 8421 - DNA, 25 bp, Rattus norvegicus
aaagaactgtctctttcagtctaca

SEQ ID NO: 8422 - DNA, 25 bp, Rattus norvegicus
aaagaactgtctgtttcagtctaca

SEQ ID NO: 8423 - DNA, 25 bp, Rattus norvegicus
aaagaactgtgcacaatttcctggg

SEQ ID NO: 8424 - DNA, 25 bp, Rattus norvegicus
aaagaactgtgccaacctttccctg

SEQ ID NO: 8425 - DNA, 25 bp, Rattus norvegicus
aaagaactgtgcgaacctttccctg

SEQ ID NO: 8426 - DNA, 25 bp, Rattus norvegicus
aaagaactgtgctcaatttcctggg

SEQ ID NO: 8427 - DNA, 25 bp, Rattus norvegicus
aaagaactgtgtcgccatcgctgca

SEQ ID NO: 8428 - DNA, 25 bp, Rattus norvegicus
aaagaactgtgtggccatcgctgca

SEQ ID NO: 8429 - DNA, 25 bp, Rattus norvegicus
aaagaactgtttactgtgtgccaca

SEQ ID NO: 8430 - DNA, 25 bp, Rattus norvegicus
aaagaactgttttctgtgtgccaca

SEQ ID NO: 8431 - DNA, 25 bp, Rattus norvegicus
aaagaacttctcagccacacctcag

SEQ ID NO: 8432 - DNA, 25 bp, Rattus norvegicus
aaagaacttctctgccacacctcag

SEQ ID NO: 8433 - DNA, 25 bp, Rattus norvegicus
aaagaacttgctctaggctgcttca

SEQ ID NO: 8434 - DNA, 25 bp, Rattus norvegicus
aaagaacttgctgtaggctgcttca

SEQ ID NO: 8435 - DNA, 25 bp, Rattus norvegicus
aaagaagaactcaggtgacccctgt

SEQ ID NO: 8436 - DNA, 25 bp, Rattus norvegicus
aaagaagaactctggtgacccctgt

SEQ ID NO: 8437 - DNA, 25 bp, Rattus norvegicus
aaagaagaagacagtcactctccaa

SEQ ID NO: 8438 - DNA, 25 bp, Rattus norvegicus
aaagaagaagactgtcactctccaa

SEQ ID NO: 8439 - DNA, 25 bp, Rattus norvegicus
aaagaagacacaagctccccaggac

SEQ ID NO: 8440 - DNA, 25 bp, Rattus norvegicus
aaagaagacacatgctccccaggac

SEQ ID NO: 8441 - DNA, 25 bp, Rattus norvegicus
aaagaagacagtcctgactggccgg

SEQ ID NO: 8442 - DNA, 25 bp, Rattus norvegicus
aaagaagacagtgctgactggccgg

SEQ ID NO: 8443 - DNA, 25 bp, Rattus norvegicus
aaagaagacgctccagaggccagga

SEQ ID NO: 8444 - DNA, 25 bp, Rattus norvegicus
aaagaagacgctgcagaggccagga

SEQ ID NO: 8445 - DNA, 25 bp, Rattus norvegicus
aaagaagagcctctatagggccttt

SEQ ID NO: 8446 - DNA, 25 bp, Rattus norvegicus
aaagaagagcctgtatagggccttt

SEQ ID NO: 8447 - DNA, 25 bp, Rattus norvegicus
aaagaagaggccctgtgcccctggc

SEQ ID NO: 8448 - DNA, 25 bp, Rattus norvegicus
aaagaagaggccgtgtgcccctggc

SEQ ID NO: 8449 - DNA, 25 bp, Rattus norvegicus
aaagaagaggtcatggcgctgtcat

SEQ ID NO: 8450 - DNA, 25 bp, Rattus norvegicus
aaagaagaggtcttggcgctgtcat

SEQ ID NO: 8451 - DNA, 25 bp, Rattus norvegicus
aaagaagagttccattgcccacgtc

SEQ ID NO: 8452 - DNA, 25 bp, Rattus norvegicus
aaagaagagttcgattgcccacgtc

SEQ ID NO: 8453 - DNA, 25 bp, Rattus norvegicus
aaagaagatcccaagcgttccaact

SEQ ID NO: 8454 - DNA, 25 bp, Rattus norvegicus
aaagaagatccctagcgttccaact

SEQ ID NO: 8455 - DNA, 25 bp, Rattus norvegicus
aaagaagattgtcctcaggcttgag

SEQ ID NO: 8456 - DNA, 25 bp, Rattus norvegicus
aaagaagattgtgctcaggcttgag

SEQ ID NO: 8457 - DNA, 25 bp, Rattus norvegicus
aaagaagcagaaccctcccagcctt

SEQ ID NO: 8458 - DNA, 25 bp, Rattus norvegicus
aaagaagcagaagcctcccagcctt

SEQ ID NO: 8459 - DNA, 25 bp, Rattus norvegicus
aaagaagcagcaacacctgcccttt

SEQ ID NO: 8460 - DNA, 25 bp, Rattus norvegicus
aaagaagcagcaccggttgcaccct

SEQ ID NO: 8461 - DNA, 25 bp, Rattus norvegicus
aaagaagcagcagcggttgcaccct

SEQ ID NO: 8462 - DNA, 25 bp, Rattus norvegicus
aaagaagcagcatcacctgcccttt

SEQ ID NO: 8463 - DNA, 25 bp, Rattus norvegicus
aaagaagcagtaatcctgactcctg

SEQ ID NO: 8464 - DNA, 25 bp, Rattus norvegicus
aaagaagcagtattcctgactcctg

SEQ ID NO: 8465 - DNA, 25 bp, Rattus norvegicus
aaagaagccacgagggccatcacct

SEQ ID NO: 8466 - DNA, 25 bp, Rattus norvegicus
aaagaagccacgtgggccatcacct

SEQ ID NO: 8467 - DNA, 25 bp, Rattus norvegicus
aaagaagccatgatgaccctcagta

SEQ ID NO: 8468 - DNA, 25 bp, Rattus norvegicus
aaagaagccatgttgaccctcagta

SEQ ID NO: 8469 - DNA, 25 bp, Rattus norvegicus
aaagaagccggaatcctgctggctg

SEQ ID NO: 8470 - DNA, 25 bp, Rattus norvegicus
aaagaagccggattcctgctggctg

SEQ ID NO: 8471 - DNA, 25 bp, Rattus norvegicus
aaagaagccggcagcagctgcagga

SEQ ID NO: 8472 - DNA, 25 bp, Rattus norvegicus
aaagaagccggctgcagctgcagga

SEQ ID NO: 8473 - DNA, 25 bp, Rattus norvegicus
aaagaagcctggaggcccatagcca

SEQ ID NO: 8474 - DNA, 25 bp, Rattus norvegicus
aaagaagcctggctccagtggcacc

SEQ ID NO: 8475 - DNA, 25 bp, Rattus norvegicus
aaagaagcctgggtccagtggcacc

SEQ ID NO: 8476 - DNA, 25 bp, Rattus norvegicus
aaagaagcctggtggcccatagcca

SEQ ID NO: 8477 - DNA, 25 bp, Rattus norvegicus
aaagaagcgcttatccttcaagaag

SEQ ID NO: 8478 - DNA, 25 bp, Rattus norvegicus
aaagaagcgcttttccttcaagaag

SEQ ID NO: 8479 - DNA, 25 bp, Rattus norvegicus
aaagaagctactcgtttctctccct

SEQ ID NO: 8480 - DNA, 25 bp, Rattus norvegicus
aaagaagctactggtttctctccct

SEQ ID NO: 8481 - DNA, 25 bp, Rattus norvegicus
aaagaagctcctatctagtcgggcc

SEQ ID NO: 8482 - DNA, 25 bp, Rattus norvegicus
aaagaagctcctttctagtcgggcc

SEQ ID NO: 8483 - DNA, 25 bp, Rattus norvegicus
aaagaagctcgccatgccgaagccg

SEQ ID NO: 8484 - DNA, 25 bp, Rattus norvegicus
aaagaagctcgcgatgccgaagccg

SEQ ID NO: 8485 - DNA, 25 bp, Rattus norvegicus
aaagaagctggtctatcctcctttc

SEQ ID NO: 8486 - DNA, 25 bp, Rattus norvegicus
aaagaagctggtgtatcctcctttc

SEQ ID NO: 8487 - DNA, 25 bp, Rattus norvegicus
aaagaagcttcacacccagtcacca

SEQ ID NO: 8488 - DNA, 25 bp, Rattus norvegicus
aaagaagcttcagacccagtcacca

SEQ ID NO: 8489 - DNA, 25 bp, Rattus norvegicus
aaagaaggactgatgcatccgcact

SEQ ID NO: 8490 - DNA, 25 bp, Rattus norvegicus
aaagaaggactgttgcatccgcact

SEQ ID NO: 8491 - DNA, 25 bp, Rattus norvegicus
aaagaaggcgacctccgcattatgc

SEQ ID NO: 8492 - DNA, 25 bp, Rattus norvegicus
aaagaaggcgacgtccgcattatgc

SEQ ID NO: 8493 - DNA, 25 bp, Rattus norvegicus
aaagaaggcgatccaaaccagctgt

SEQ ID NO: 8494 - DNA, 25 bp, Rattus norvegicus
aaagaaggcgatgcaaaccagctgt

SEQ ID NO: 8495 - DNA, 25 bp, Rattus norvegicus
aaagaagggcgcaaccagtcatttg

SEQ ID NO: 8496 - DNA, 25 bp, Rattus norvegicus
aaagaagggcgctaccagtcatttg

SEQ ID NO: 8497 - DNA, 25 bp, Rattus norvegicus
aaagaagggtcacccaacatgccca

SEQ ID NO: 8498 - DNA, 25 bp, Rattus norvegicus
aaagaagggtcagccaacatgccca

SEQ ID NO: 8499 - DNA, 25 bp, Rattus norvegicus
aaagaagggtccacaagtgtgtgtg

SEQ ID NO: 8500 - DNA, 25 bp, Rattus norvegicus
aaagaagggtcctcaagtgtgtgtg

SEQ ID NO: 8501 - DNA, 25 bp, Rattus norvegicus
aaagaagtcactcccttagttgtcg

SEQ ID NO: 8502 - DNA, 25 bp, Rattus norvegicus
aaagaagtcactgccttagttgtcg

SEQ ID NO: 8503 - DNA, 25 bp, Rattus norvegicus
aaagaagtcatgatcccacctggga

SEQ ID NO: 8504 - DNA, 25 bp, Rattus norvegicus
aaagaagtcatgttcccacctggga

SEQ ID NO: 8505 - DNA, 25 bp, Rattus norvegicus
aaagaagtgataagggcctgggcct

SEQ ID NO: 8506 - DNA, 25 bp, Rattus norvegicus
aaagaagtgatatgggcctgggcct

SEQ ID NO: 8507 - DNA, 25 bp, Rattus norvegicus
aaagaagtgcccaccaacttgtctg

SEQ ID NO: 8508 - DNA, 25 bp, Rattus norvegicus
aaagaagtgccctccaacttgtctg

SEQ ID NO: 8509 - DNA, 25 bp, Rattus norvegicus
aaagaagttcctaggccacctagag

SEQ ID NO: 8510 - DNA, 25 bp, Rattus norvegicus
aaagaagttccttggccacctagag

SEQ ID NO: 8511 - DNA, 25 bp, Rattus norvegicus
aaagaagttctccatgcctctgaca

SEQ ID NO: 8512 - DNA, 25 bp, Rattus norvegicus
aaagaagttctcgatgcctctgaca

SEQ ID NO: 8513 - DNA, 25 bp, Rattus norvegicus
aaagaagttgccatcctctgcagct

SEQ ID NO: 8514 - DNA, 25 bp, Rattus norvegicus
aaagaagttgccttcctctgcagct

SEQ ID NO: 8515 - DNA, 25 bp, Rattus norvegicus
aaagaagtttctcgtgggtcactct

SEQ ID NO: 8516 - DNA, 25 bp, Rattus norvegicus
aaagaagtttctggtgggtcactct

SEQ ID NO: 8517 - DNA, 25 bp, Rattus norvegicus
aaagaagtttgcctcttgcctattc

SEQ ID NO: 8518 - DNA, 25 bp, Rattus norvegicus
aaagaagtttgcgtcttgcctattc

SEQ ID NO: 8519 - DNA, 25 bp, Rattus norvegicus
aaagaagtttgtctccatgtggaaa

SEQ ID NO: 8520 - DNA, 25 bp, Rattus norvegicus
aaagaagtttgtgtccatgtggaaa

SEQ ID NO: 8521 - DNA, 25 bp, Rattus norvegicus
aaagaatacctaaggctcctccact

SEQ ID NO: 8522 - DNA, 25 bp, Rattus norvegicus
aaagaatacctatggctcctccact

SEQ ID NO: 8523 - DNA, 25 bp, Rattus norvegicus
aaagaatacctcagccacaagggca

SEQ ID NO: 8524 - DNA, 25 bp, Rattus norvegicus
aaagaatacctctgccacaagggca

SEQ ID NO: 8525 - DNA, 25 bp, Rattus norvegicus
aaagaatactcaatgtcaggacaga

SEQ ID NO: 8526 - DNA, 25 bp, Rattus norvegicus
aaagaatactcattgtcaggacaga

SEQ ID NO: 8527 - DNA, 25 bp, Rattus norvegicus
aaagaatactggctccatgacccac

SEQ ID NO: 8528 - DNA, 25 bp, Rattus norvegicus
aaagaatactgggtccatgacccac

SEQ ID NO: 8529 - DNA, 25 bp, Rattus norvegicus
aaagaatcacccacattgtcggaag

SEQ ID NO: 8530 - DNA, 25 bp, Rattus norvegicus
aaagaatcaccctcattgtcggaag

SEQ ID NO: 8531 - DNA, 25 bp, Rattus norvegicus
aaagaatcaggcatgtcccgttgtc

SEQ ID NO: 8532 - DNA, 25 bp, Rattus norvegicus
aaagaatcaggcttgtcccgttgtc

SEQ ID NO: 8533 - DNA, 25 bp, Rattus norvegicus
aaagaatcatgaactatacgcaacc

SEQ ID NO: 8534 - DNA, 25 bp, Rattus norvegicus
aaagaatcatgatctatacgcaacc

SEQ ID NO: 8535 - DNA, 25 bp, Rattus norvegicus
aaagaatccatcaccagaatataga

SEQ ID NO: 8536 - DNA, 25 bp, Rattus norvegicus
aaagaatccatctccagaatataga

SEQ ID NO: 8537 - DNA, 25 bp, Rattus norvegicus
aaagaatccctaactgttcagtgac

SEQ ID NO: 8538 - DNA, 25 bp, Rattus norvegicus
aaagaatccctatctgttcagtgac

SEQ ID NO: 8539 - DNA, 25 bp, Rattus norvegicus
aaagaatccggaccttgcacttatc

SEQ ID NO: 8540 - DNA, 25 bp, Rattus norvegicus
aaagaatccggagcttgcacttatc

SEQ ID NO: 8541 - DNA, 25 bp, Rattus norvegicus
aaagaatcctctaacatgcaccaac

SEQ ID NO: 8542 - DNA, 25 bp, Rattus norvegicus
aaagaatcctcttacatgcaccaac

SEQ ID NO: 8543 - DNA, 25 bp, Rattus norvegicus
aaagaatcctggcttttagcacaat

SEQ ID NO: 8544 - DNA, 25 bp, Rattus norvegicus
aaagaatcctgggttttagcacaat

SEQ ID NO: 8545 - DNA, 25 bp, Rattus norvegicus
aaagaatccttcatggaccattgag

SEQ ID NO: 8546 - DNA, 25 bp, Rattus norvegicus
aaagaatccttcttggaccattgag

SEQ ID NO: 8547 - DNA, 25 bp, Rattus norvegicus
aaagaatctgatccccagaactagc

SEQ ID NO: 8548 - DNA, 25 bp, Rattus norvegicus
aaagaatctgatgcccagaactagc

SEQ ID NO: 8549 - DNA, 25 bp, Rattus norvegicus
aaagaatcttcactggttgcctgca

SEQ ID NO: 8550 - DNA, 25 bp, Rattus norvegicus
aaagaatcttcagtggttgcctgca

SEQ ID NO: 8551 - DNA, 25 bp, Rattus norvegicus
aaagaatgacccactgtttcaacag

SEQ ID NO: 8552 - DNA, 25 bp, Rattus norvegicus
aaagaatgaccctctgtttcaacag

SEQ ID NO: 8553 - DNA, 25 bp, Rattus norvegicus
aaagaatgacgaaacccaggcaagc

SEQ ID NO: 8554 - DNA, 25 bp, Rattus norvegicus
aaagaatgacgatacccaggcaagc

SEQ ID NO: 8555 - DNA, 25 bp, Rattus norvegicus
aaagaatgatcacagctaggtgctg

SEQ ID NO: 8556 - DNA, 25 bp, Rattus norvegicus
aaagaatgatcagagctaggtgctg

SEQ ID NO: 8557 - DNA, 25 bp, Rattus norvegicus
aaagaatgatgtctgccgtcctggg

SEQ ID NO: 8558 - DNA, 25 bp, Rattus norvegicus
aaagaatgatgtgtgccgtcctggg

SEQ ID NO: 8559 - DNA, 25 bp, Rattus norvegicus
aaagaatgcatgctgcgtggcctgc

SEQ ID NO: 8560 - DNA, 25 bp, Rattus norvegicus
aaagaatgcatggtgcgtggcctgc

SEQ ID NO: 8561 - DNA, 25 bp, Rattus norvegicus
aaagaatgctacaacctaacgtggt

SEQ ID NO: 8562 - DNA, 25 bp, Rattus norvegicus
aaagaatgctactacctaacgtggt

SEQ ID NO: 8563 - DNA, 25 bp, Rattus norvegicus
aaagaatgctgcagactctcataaa

SEQ ID NO: 8564 - DNA, 25 bp, Rattus norvegicus
aaagaatgctgctgactctcataaa

SEQ ID NO: 8565 - DNA, 25 bp, Rattus norvegicus
aaagaatgtttgagagagctctcag

SEQ ID NO: 8566 - DNA, 25 bp, Rattus norvegicus
aaagaatgtttgtgagagctctcag

SEQ ID NO: 8567 - DNA, 25 bp, Rattus norvegicus
aaagaattcagtatgccctcttcga

SEQ ID NO: 8568 - DNA, 25 bp, Rattus norvegicus
aaagaattcagtttgccctcttcga

SEQ ID NO: 8569 - DNA, 25 bp, Rattus norvegicus
aaagaattctctcgtgtccctcttc

SEQ ID NO: 8570 - DNA, 25 bp, Rattus norvegicus
aaagaattctctggtgtccctcttc

SEQ ID NO: 8571 - DNA, 25 bp, Rattus norvegicus
aaagaattctgtattgaggctacat

SEQ ID NO: 8572 - DNA, 25 bp, Rattus norvegicus
aaagaattctgttttgaggctacat

SEQ ID NO: 8573 - DNA, 25 bp, Rattus norvegicus
aaagaattcttgcagcccgatagct

SEQ ID NO: 8574 - DNA, 25 bp, Rattus norvegicus
aaagaattcttggagcccgatagct

SEQ ID NO: 8575 - DNA, 25 bp, Rattus norvegicus
aaagaattgcccatggcctaggcct

SEQ ID NO: 8576 - DNA, 25 bp, Rattus norvegicus
aaagaattgcccttggcctaggcct

SEQ ID NO: 8577 - DNA, 25 bp, Rattus norvegicus
aaagaattgtccatgaacatcacca

SEQ ID NO: 8578 - DNA, 25 bp, Rattus norvegicus
aaagaattgtccttgaacatcacca

SEQ ID NO: 8579 - DNA, 25 bp, Rattus norvegicus
aaagaattgttcacccatgactaat

SEQ ID NO: 8580 - DNA, 25 bp, Rattus norvegicus
aaagaattgttctcccatgactaat

SEQ ID NO: 8581 - DNA, 25 bp, Rattus norvegicus
aaagaatttattatccagtgtggtt

SEQ ID NO: 8582 - DNA, 25 bp, Rattus norvegicus
aaagaatttattttccagtgtggtt

SEQ ID NO: 8583 - DNA, 25 bp, Rattus norvegicus
aaagacaaagcaagccgggcgtggt

SEQ ID NO: 8584 - DNA, 25 bp, Rattus norvegicus
aaagacaaagcatgccgggcgtggt

SEQ ID NO: 8585 - DNA, 25 bp, Rattus norvegicus
aaagacaaagtgcttcctctggaca

SEQ ID NO: 8586 - DNA, 25 bp, Rattus norvegicus
aaagacaaagtggttcctctggaca

SEQ ID NO: 8587 - DNA, 25 bp, Rattus norvegicus
aaagacaacacgagttctcctcagg

SEQ ID NO: 8588 - DNA, 25 bp, Rattus norvegicus
aaagacaacacgtgttctcctcagg

SEQ ID NO: 8589 - DNA, 25 bp, Rattus norvegicus
aaagacaacattcgccaggagccct

SEQ ID NO: 8590 - DNA, 25 bp, Rattus norvegicus
aaagacaacattggccaggagccct

SEQ ID NO: 8591 - DNA, 25 bp, Rattus norvegicus
aaagacaacgatcctgccatccgca

SEQ ID NO: 8592 - DNA, 25 bp, Rattus norvegicus
aaagacaacgatgctgccatccgca

SEQ ID NO: 8593 - DNA, 25 bp, Rattus norvegicus
aaagacaacgttcatccagggacaa

SEQ ID NO: 8594 - DNA, 25 bp, Rattus norvegicus
aaagacaacgttgatccagggacaa

SEQ ID NO: 8595 - DNA, 25 bp, Rattus norvegicus
aaagacaagagtcccggtacttcat

SEQ ID NO: 8596 - DNA, 25 bp, Rattus norvegicus
aaagacaagagtgccggtacttcat

SEQ ID NO: 8597 - DNA, 25 bp, Rattus norvegicus
aaagacaagtgcctccggatatgga

SEQ ID NO: 8598 - DNA, 25 bp, Rattus norvegicus
aaagacaagtgcgtccggatatgga

SEQ ID NO: 8599 - DNA, 25 bp, Rattus norvegicus
aaagacaataaacctccctcagaat

SEQ ID NO: 8600 - DNA, 25 bp, Rattus norvegicus
aaagacaataaagctccctcagaat

SEQ ID NO: 8601 - DNA, 25 bp, Rattus norvegicus
aaagacaatcacaggacagtccatc

SEQ ID NO: 8602 - DNA, 25 bp, Rattus norvegicus
aaagacaatcactggacagtccatc

SEQ ID NO: 8603 - DNA, 25 bp, Rattus norvegicus
aaagacaatctcctcctagcactac

SEQ ID NO: 8604 - DNA, 25 bp, Rattus norvegicus
aaagacaatctcgtcctagcactac

SEQ ID NO: 8605 - DNA, 25 bp, Rattus norvegicus
aaagacaatgcccactatgcagtcc

SEQ ID NO: 8606 - DNA, 25 bp, Rattus norvegicus
aaagacaatgccgactatgcagtcc

SEQ ID NO: 8607 - DNA, 25 bp, Rattus norvegicus
aaagacaatgttcagcctctgtgcc

SEQ ID NO: 8608 - DNA, 25 bp, Rattus norvegicus
aaagacaatgttgagcctctgtgcc

SEQ ID NO: 8609 - DNA, 25 bp, Rattus norvegicus
aaagacacaagccagttccacaagc

SEQ ID NO: 8610 - DNA, 25 bp, Rattus norvegicus
aaagacacaagcgagttccacaagc

SEQ ID NO: 8611 - DNA, 25 bp, Rattus norvegicus
aaagacacaattcctgttcttcctc

SEQ ID NO: 8612 - DNA, 25 bp, Rattus norvegicus
aaagacacaattgctgttcttcctc

SEQ ID NO: 8613 - DNA, 25 bp, Rattus norvegicus
aaagacacatggcagccctcagtcc

SEQ ID NO: 8614 - DNA, 25 bp, Rattus norvegicus
aaagacacatgggagccctcagtcc

SEQ ID NO: 8615 - DNA, 25 bp, Rattus norvegicus
aaagacaccaagaacgcgcgcatcc

SEQ ID NO: 8616 - DNA, 25 bp, Rattus norvegicus
aaagacaccaagtacgcgcgcatcc

SEQ ID NO: 8617 - DNA, 25 bp, Rattus norvegicus
aaagacacccatagtgtgcgagcat

SEQ ID NO: 8618 - DNA, 25 bp, Rattus norvegicus
aaagacacccattgtgtgcgagcat

SEQ ID NO: 8619 - DNA, 25 bp, Rattus norvegicus
aaagacaccgtacatcgtgctcagt

SEQ ID NO: 8620 - DNA, 25 bp, Rattus norvegicus
aaagacaccgtagatcgtgctcagt

SEQ ID NO: 8621 - DNA, 25 bp, Rattus norvegicus
aaagacacctacctcttcggctgtg

SEQ ID NO: 8622 - DNA, 25 bp, Rattus norvegicus
aaagacacctacgtcttcggctgtg

SEQ ID NO: 8623 - DNA, 25 bp, Rattus norvegicus
aaagacactacactggaccactact

SEQ ID NO: 8624 - DNA, 25 bp, Rattus norvegicus
aaagacactacagtggaccactact

SEQ ID NO: 8625 - DNA, 25 bp, Rattus norvegicus
aaagacactgctcaattccttcctt

SEQ ID NO: 8626 - DNA, 25 bp, Rattus norvegicus
aaagacactgctgaattccttcctt

SEQ ID NO: 8627 - DNA, 25 bp, Rattus norvegicus
aaagacactggcctatgttctctgt

SEQ ID NO: 8628 - DNA, 25 bp, Rattus norvegicus
aaagacactggcgtatgttctctgt

SEQ ID NO: 8629 - DNA, 25 bp, Rattus norvegicus
aaagacagacttacacgttcgtaga

SEQ ID NO: 8630 - DNA, 25 bp, Rattus norvegicus
aaagacagactttcacgttcgtaga

SEQ ID NO: 8631 - DNA, 25 bp, Rattus norvegicus
aaagacagagatcccttctctcctt

SEQ ID NO: 8632 - DNA, 25 bp, Rattus norvegicus
aaagacagagatgccttctctcctt

SEQ ID NO: 8633 - DNA, 25 bp, Rattus norvegicus
aaagacagcacacggcatacttcgg

SEQ ID NO: 8634 - DNA, 25 bp, Rattus norvegicus
aaagacagcacagggcatacttcgg

SEQ ID NO: 8635 - DNA, 25 bp, Rattus norvegicus
aaagacagcgccatgctcaagcgtg

SEQ ID NO: 8636 - DNA, 25 bp, Rattus norvegicus
aaagacagcgccttgctcaagcgtg

SEQ ID NO: 8637 - DNA, 25 bp, Rattus norvegicus
aaagacagcgggagtctctctttgt

SEQ ID NO: 8638 - DNA, 25 bp, Rattus norvegicus
aaagacagcgggtgtctctctttgt

SEQ ID NO: 8639 - DNA, 25 bp, Rattus norvegicus
aaagacagctcaattctcgagcctt

SEQ ID NO: 8640 - DNA, 25 bp, Rattus norvegicus
aaagacagctcatttctcgagcctt

SEQ ID NO: 8641 - DNA, 25 bp, Rattus norvegicus
aaagacagctgaagtccttcctgtg

SEQ ID NO: 8642 - DNA, 25 bp, Rattus norvegicus
aaagacagctgatgtccttcctgtg

SEQ ID NO: 8643 - DNA, 25 bp, Rattus norvegicus
aaagacagctgcacctagcgggcga

SEQ ID NO: 8644 - DNA, 25 bp, Rattus norvegicus
aaagacagctgctcctagcgggcga

SEQ ID NO: 8645 - DNA, 25 bp, Rattus norvegicus
aaagacagctgtattgtcccactct

SEQ ID NO: 8646 - DNA, 25 bp, Rattus norvegicus
aaagacagctgtctacctcatctca

SEQ ID NO: 8647 - DNA, 25 bp, Rattus norvegicus
aaagacagctgtgtacctcatctca

SEQ ID NO: 8648 - DNA, 25 bp, Rattus norvegicus
aaagacagctgttttgtcccactct

SEQ ID NO: 8649 - DNA, 25 bp, Rattus norvegicus
aaagacaggctacgctgatcagcat

SEQ ID NO: 8650 - DNA, 25 bp, Rattus norvegicus
aaagacaggctaggctgatcagcat

SEQ ID NO: 8651 - DNA, 25 bp, Rattus norvegicus
aaagacaggcttacaccttagcggc

SEQ ID NO: 8652 - DNA, 25 bp, Rattus norvegicus
aaagacaggctttcaccttagcggc

SEQ ID NO: 8653 - DNA, 25 bp, Rattus norvegicus
aaagacagggagctgcagccctcag

SEQ ID NO: 8654 - DNA, 25 bp, Rattus norvegicus
aaagacagggaggtgcagccctcag

SEQ ID NO: 8655 - DNA, 25 bp, Rattus norvegicus
aaagacagggcccttgcctgggcat

SEQ ID NO: 8656 - DNA, 25 bp, Rattus norvegicus
aaagacagggccgttgcctgggcat

SEQ ID NO: 8657 - DNA, 25 bp, Rattus norvegicus
aaagacaggtcacttttcctcaggc

SEQ ID NO: 8658 - DNA, 25 bp, Rattus norvegicus
aaagacaggtcagttttcctcaggc

SEQ ID NO: 8659 - DNA, 25 bp, Rattus norvegicus
aaagacaggtgaccgactcctctta

SEQ ID NO: 8660 - DNA, 25 bp, Rattus norvegicus
aaagacaggtgagcgactcctctta

SEQ ID NO: 8661 - DNA, 25 bp, Rattus norvegicus
aaagacaggtgtccctcagtgaaca

SEQ ID NO: 8662 - DNA, 25 bp, Rattus norvegicus
aaagacaggtgtgcctcagtgaaca

SEQ ID NO: 8663 - DNA, 25 bp, Rattus norvegicus
aaagacaggtttctgctcacaacgt

SEQ ID NO: 8664 - DNA, 25 bp, Rattus norvegicus
aaagacaggtttgtgctcacaacgt

SEQ ID NO: 8665 - DNA, 25 bp, Rattus norvegicus
aaagacagtgcaaggacattcccca

SEQ ID NO: 8666 - DNA, 25 bp, Rattus norvegicus
aaagacagtgcatggacattcccca

SEQ ID NO: 8667 - DNA, 25 bp, Rattus norvegicus
aaagacagtgtacagcccatccaaa

SEQ ID NO: 8668 - DNA, 25 bp, Rattus norvegicus
aaagacagtgtagagcccatccaaa

SEQ ID NO: 8669 - DNA, 25 bp, Rattus norvegicus
aaagacatcacacacaccctggtgg

SEQ ID NO: 8670 - DNA, 25 bp, Rattus norvegicus
aaagacatcacagacaccctggtgg

SEQ ID NO: 8671 - DNA, 25 bp, Rattus norvegicus
aaagacatcgtccagtgagcccatc

SEQ ID NO: 8672 - DNA, 25 bp, Rattus norvegicus
aaagacatcgtccttgcctctgtac

SEQ ID NO: 8673 - DNA, 25 bp, Rattus norvegicus
aaagacatcgtcgagtgagcccatc

SEQ ID NO: 8674 - DNA, 25 bp, Rattus norvegicus
aaagacatcgtcgttgcctctgtac

SEQ ID NO: 8675 - DNA, 25 bp, Rattus norvegicus
aaagacatctgaaggccctgtctct

SEQ ID NO: 8676 - DNA, 25 bp, Rattus norvegicus
aaagacatctgatggccctgtctct

SEQ ID NO: 8677 - DNA, 25 bp, Rattus norvegicus
aaagacatgctgaagcttttcgtat

SEQ ID NO: 8678 - DNA, 25 bp, Rattus norvegicus
aaagacatgctgtagcttttcgtat

SEQ ID NO: 8679 - DNA, 25 bp, Rattus norvegicus
aaagacatggatcagccctctccag

SEQ ID NO: 8680 - DNA, 25 bp, Rattus norvegicus
aaagacatggatgagccctctccag

SEQ ID NO: 8681 - DNA, 25 bp, Rattus norvegicus
aaagacatggctcacattcccaacc

SEQ ID NO: 8682 - DNA, 25 bp, Rattus norvegicus
aaagacatggctgacattcccaacc

SEQ ID NO: 8683 - DNA, 25 bp, Rattus norvegicus
aaagacatgggcctctgttctagct

SEQ ID NO: 8684 - DNA, 25 bp, Rattus norvegicus
aaagacatgggcgtctgttctagct

SEQ ID NO: 8685 - DNA, 25 bp, Rattus norvegicus
aaagacatggtgataattcccgtat

SEQ ID NO: 8686 - DNA, 25 bp, Rattus norvegicus
aaagacatggtgttaattcccgtat

SEQ ID NO: 8687 - DNA, 25 bp, Rattus norvegicus
aaagacattaccatgtccaccaggg

SEQ ID NO: 8688 - DNA, 25 bp, Rattus norvegicus
aaagacattaccttgtccaccaggg

SEQ ID NO: 8689 - DNA, 25 bp, Rattus norvegicus
aaagacattcacactgccctgctgg

SEQ ID NO: 8690 - DNA, 25 bp, Rattus norvegicus
aaagacattcactctgccctgctgg

SEQ ID NO: 8691 - DNA, 25 bp, Rattus norvegicus
aaagacattgccattgcagcacgtg

SEQ ID NO: 8692 - DNA, 25 bp, Rattus norvegicus
aaagacattgcctttgcagcacgtg

SEQ ID NO: 8693 - DNA, 25 bp, Rattus norvegicus
aaagacattgttacatcctccatgc

SEQ ID NO: 8694 - DNA, 25 bp, Rattus norvegicus
aaagacattgtttcatcctccatgc

SEQ ID NO: 8695 - DNA, 25 bp, Rattus norvegicus
aaagacatttcacctcttcaagccc

SEQ ID NO: 8696 - DNA, 25 bp, Rattus norvegicus
aaagacatttcagctcttcaagccc

SEQ ID NO: 8697 - DNA, 25 bp, Rattus norvegicus
aaagacatttctcgtattcataaag

SEQ ID NO: 8698 - DNA, 25 bp, Rattus norvegicus
aaagacatttctggtattcataaag

SEQ ID NO: 8699 - DNA, 25 bp, Rattus norvegicus
aaagaccacaagaagctgagggcaa

SEQ ID NO: 8700 - DNA, 25 bp, Rattus norvegicus
aaagaccacaagtagctgagggcaa

SEQ ID NO: 8701 - DNA, 25 bp, Rattus norvegicus
aaagaccacagaatcaccatgccgt

SEQ ID NO: 8702 - DNA, 25 bp, Rattus norvegicus
aaagaccacagattcaccatgccgt

SEQ ID NO: 8703 - DNA, 25 bp, Rattus norvegicus
aaagaccaccttctatgctctttgc

SEQ ID NO: 8704 - DNA, 25 bp, Rattus norvegicus
aaagaccaccttgtatgctctttgc

SEQ ID NO: 8705 - DNA, 25 bp, Rattus norvegicus
aaagaccacgtgactctgggagact

SEQ ID NO: 8706 - DNA, 25 bp, Rattus norvegicus
aaagaccacgtgtctctgggagact

SEQ ID NO: 8707 - DNA, 25 bp, Rattus norvegicus
aaagaccactctaatgttctgctca

SEQ ID NO: 8708 - DNA, 25 bp, Rattus norvegicus
aaagaccactcttatgttctgctca

SEQ ID NO: 8709 - DNA, 25 bp, Rattus norvegicus
aaagaccactgcacaagctttgcgc

SEQ ID NO: 8710 - DNA, 25 bp, Rattus norvegicus
aaagaccactgctcaagctttgcgc

SEQ ID NO: 8711 - DNA, 25 bp, Rattus norvegicus
aaagaccacttgacacactctggag

SEQ ID NO: 8712 - DNA, 25 bp, Rattus norvegicus
aaagaccacttgtcacactctggag

SEQ ID NO: 8713 - DNA, 25 bp, Rattus norvegicus
aaagaccagagacctcattatcccc

SEQ ID NO: 8714 - DNA, 25 bp, Rattus norvegicus
aaagaccagagagctcattatcccc

SEQ ID NO: 8715 - DNA, 25 bp, Rattus norvegicus
aaagaccagcatcgccaagttctgt

SEQ ID NO: 8716 - DNA, 25 bp, Rattus norvegicus
aaagaccagcatggccaagttctgt

SEQ ID NO: 8717 - DNA, 25 bp, Rattus norvegicus
aaagaccagccaacagaggccttta

SEQ ID NO: 8718 - DNA, 25 bp, Rattus norvegicus
aaagaccagccatcagaggccttta

SEQ ID NO: 8719 - DNA, 25 bp, Rattus norvegicus
aaagaccagttccacactcagtaaa

SEQ ID NO: 8720 - DNA, 25 bp, Rattus norvegicus
aaagaccagttcgacactcagtaaa

SEQ ID NO: 8721 - DNA, 25 bp, Rattus norvegicus
aaagaccagtttctctcctttgctc

SEQ ID NO: 8722 - DNA, 25 bp, Rattus norvegicus
aaagaccagtttgtctcctttgctc

SEQ ID NO: 8723 - DNA, 25 bp, Rattus norvegicus
aaagaccatgagacagaacttctgt

SEQ ID NO: 8724 - DNA, 25 bp, Rattus norvegicus
aaagaccatgagtcagaacttctgt

SEQ ID NO: 8725 - DNA, 25 bp, Rattus norvegicus
aaagaccatgatcgtaagagtgtgt

SEQ ID NO: 8726 - DNA, 25 bp, Rattus norvegicus
aaagaccatgatggtaagagtgtgt

SEQ ID NO: 8727 - DNA, 25 bp, Rattus norvegicus
aaagaccatggcatcactactgtag

SEQ ID NO: 8728 - DNA, 25 bp, Rattus norvegicus
aaagaccatggcttcactactgtag

SEQ ID NO: 8729 - DNA, 25 bp, Rattus norvegicus
aaagaccatggtagtgtccaaggta

SEQ ID NO: 8730 - DNA, 25 bp, Rattus norvegicus
aaagaccatggttgtgtccaaggta

SEQ ID NO: 8731 - DNA, 25 bp, Rattus norvegicus
aaagaccattcacagacctgccctt

SEQ ID NO: 8732 - DNA, 25 bp, Rattus norvegicus
aaagaccattcagagacctgccctt

SEQ ID NO: 8733 - DNA, 25 bp, Rattus norvegicus
aaagaccattttcccttatgagtgt

SEQ ID NO: 8734 - DNA, 25 bp, Rattus norvegicus
aaagaccattttgccttatgagtgt

SEQ ID NO: 8735 - DNA, 25 bp, Rattus norvegicus
aaagacccgaatagcatttgagatg

SEQ ID NO: 8736 - DNA, 25 bp, Rattus norvegicus
aaagacccgaattgcatttgagatg

SEQ ID NO: 8737 - DNA, 25 bp, Rattus norvegicus
aaagaccctatcctgaagacatcga

SEQ ID NO: 8738 - DNA, 25 bp, Rattus norvegicus
aaagaccctatcgtgaagacatcga

SEQ ID NO: 8739 - DNA, 25 bp, Rattus norvegicus
aaagaccctcgacgcatgtatcagt

SEQ ID NO: 8740 - DNA, 25 bp, Rattus norvegicus
aaagaccctcgaggcatgtatcagt

SEQ ID NO: 8741 - DNA, 25 bp, Rattus norvegicus
aaagaccctctgcaacatctagtga

SEQ ID NO: 8742 - DNA, 25 bp, Rattus norvegicus
aaagaccctctggaacatctagtga

SEQ ID NO: 8743 - DNA, 25 bp, Rattus norvegicus
aaagaccctggactcttggcggcgc

SEQ ID NO: 8744 - DNA, 25 bp, Rattus norvegicus
aaagaccctggagtcttggcggcgc

SEQ ID NO: 8745 - DNA, 25 bp, Rattus norvegicus
aaagaccgcacgagagccttcagat

SEQ ID NO: 8746 - DNA, 25 bp, Rattus norvegicus
aaagaccgcacgtgagccttcagat

SEQ ID NO: 8747 - DNA, 25 bp, Rattus norvegicus
aaagaccgctgaatatgtttaccat

SEQ ID NO: 8748 - DNA, 25 bp, Rattus norvegicus
aaagaccgctgattatgtttaccat

SEQ ID NO: 8749 - DNA, 25 bp, Rattus norvegicus
aaagaccggctgatttggacctgag

SEQ ID NO: 8750 - DNA, 25 bp, Rattus norvegicus
aaagaccggctgttttggacctgag

SEQ ID NO: 8751 - DNA, 25 bp, Rattus norvegicus
aaagaccgtccccatctgatgtgtt

SEQ ID NO: 8752 - DNA, 25 bp, Rattus norvegicus
aaagaccgtcccgatctgatgtgtt

SEQ ID NO: 8753 - DNA, 25 bp, Rattus norvegicus
aaagacctactgctgtacactggat

SEQ ID NO: 8754 - DNA, 25 bp, Rattus norvegicus
aaagacctactggtgtacactggat

SEQ ID NO: 8755 - DNA, 25 bp, Rattus norvegicus
aaagacctcataaagcgtgtggctc

SEQ ID NO: 8756 - DNA, 25 bp, Rattus norvegicus
aaagacctcatatagcgtgtggctc

SEQ ID NO: 8757 - DNA, 25 bp, Rattus norvegicus
aaagacctccacagcctttacagag

SEQ ID NO: 8758 - DNA, 25 bp, Rattus norvegicus
aaagacctccactgcctttacagag

SEQ ID NO: 8759 - DNA, 25 bp, Rattus norvegicus
aaagacctcgagatatgtgcaataa

SEQ ID NO: 8760 - DNA, 25 bp, Rattus norvegicus
aaagacctcgagttatgtgcaataa

SEQ ID NO: 8761 - DNA, 25 bp, Rattus norvegicus
aaagacctctacaactggatttgga

SEQ ID NO: 8762 - DNA, 25 bp, Rattus norvegicus
aaagacctctactactggatttgga

SEQ ID NO: 8763 - DNA, 25 bp, Rattus norvegicus
aaagacctctcacctgggcaggaga

SEQ ID NO: 8764 - DNA, 25 bp, Rattus norvegicus
aaagacctctcagctgggcaggaga

SEQ ID NO: 8765 - DNA, 25 bp, Rattus norvegicus
aaagacctgcttatgcgacttcaca

SEQ ID NO: 8766 - DNA, 25 bp, Rattus norvegicus
aaagacctgcttttgcgacttcaca

SEQ ID NO: 8767 - DNA, 25 bp, Rattus norvegicus
aaagacctggagctcacgttgtggc

SEQ ID NO: 8768 - DNA, 25 bp, Rattus norvegicus
aaagacctggaggtcacgttgtggc

SEQ ID NO: 8769 - DNA, 25 bp, Rattus norvegicus
aaagacctgggtctactactgggca

SEQ ID NO: 8770 - DNA, 25 bp, Rattus norvegicus
aaagacctgggtgtactactgggca

SEQ ID NO: 8771 - DNA, 25 bp, Rattus norvegicus
aaagacctgtctcctactcaattat

SEQ ID NO: 8772 - DNA, 25 bp, Rattus norvegicus
aaagacctgtctgctactcaattat

SEQ ID NO: 8773 - DNA, 25 bp, Rattus norvegicus
aaagacctgtttagtgactcccttg

SEQ ID NO: 8774 - DNA, 25 bp, Rattus norvegicus
aaagacctgttttgtgactcccttg

SEQ ID NO: 8775 - DNA, 25 bp, Rattus norvegicus
aaagaccttcctctggtggattgtt

SEQ ID NO: 8776 - DNA, 25 bp, Rattus norvegicus
aaagaccttcctgtggtggattgtt

SEQ ID NO: 8777 - DNA, 25 bp, Rattus norvegicus
aaagaccttctcactggtcaaggag

SEQ ID NO: 8778 - DNA, 25 bp, Rattus norvegicus
aaagaccttctctctggtcaaggag

SEQ ID NO: 8779 - DNA, 25 bp, Rattus norvegicus
aaagaccttctgacaactcagcctt

SEQ ID NO: 8780 - DNA, 25 bp, Rattus norvegicus
aaagaccttctgtcaactcagcctt

SEQ ID NO: 8781 - DNA, 25 bp, Rattus norvegicus
aaagaccttggaacttccctgaagc

SEQ ID NO: 8782 - DNA, 25 bp, Rattus norvegicus
aaagaccttggactttgttctgcaa

SEQ ID NO: 8783 - DNA, 25 bp, Rattus norvegicus
aaagaccttggagtttgttctgcaa

SEQ ID NO: 8784 - DNA, 25 bp, Rattus norvegicus
aaagaccttggatcttccctgaagc

SEQ ID NO: 8785 - DNA, 25 bp, Rattus norvegicus
aaagacctttagctttcatgtgaaa

SEQ ID NO: 8786 - DNA, 25 bp, Rattus norvegicus
aaagacctttaggtttcatgtgaaa

SEQ ID NO: 8787 - DNA, 25 bp, Rattus norvegicus
aaagacctttttaaccagtgcaatg

SEQ ID NO: 8788 - DNA, 25 bp, Rattus norvegicus
aaagaccttttttaccagtgcaatg

SEQ ID NO: 8789 - DNA, 25 bp, Rattus norvegicus
aaagacgaagccagtctcatgccaa

SEQ ID NO: 8790 - DNA, 25 bp, Rattus norvegicus
aaagacgaagcctgtctcatgccaa

SEQ ID NO: 8791 - DNA, 25 bp, Rattus norvegicus
aaagacgacattcaccggatggtgc

SEQ ID NO: 8792 - DNA, 25 bp, Rattus norvegicus
aaagacgacattgaccggatggtgc

SEQ ID NO: 8793 - DNA, 25 bp, Rattus norvegicus
aaagacgaccacattagagccctgc

SEQ ID NO: 8794 - DNA, 25 bp, Rattus norvegicus
aaagacgaccactttagagccctgc

SEQ ID NO: 8795 - DNA, 25 bp, Rattus norvegicus
aaagacgacgtgcattgcctcagcg

SEQ ID NO: 8796 - DNA, 25 bp, Rattus norvegicus
aaagacgacgtggattgcctcagcg

SEQ ID NO: 8797 - DNA, 25 bp, Rattus norvegicus
aaagacgatccacgaagaggcttcc

SEQ ID NO: 8798 - DNA, 25 bp, Rattus norvegicus
aaagacgatccaggaagaggcttcc

SEQ ID NO: 8799 - DNA, 25 bp, Rattus norvegicus
aaagacgatgctatcctggagaact

SEQ ID NO: 8800 - DNA, 25 bp, Rattus norvegicus
aaagacgatgctttcctggagaact

SEQ ID NO: 8801 - DNA, 25 bp, Rattus norvegicus
aaagacgattttacagtggccaaga

SEQ ID NO: 8802 - DNA, 25 bp, Rattus norvegicus
aaagacgatttttcagtggccaaga

SEQ ID NO: 8803 - DNA, 25 bp, Rattus norvegicus
aaagacgcgcacatcacaggtgtta

SEQ ID NO: 8804 - DNA, 25 bp, Rattus norvegicus
aaagacgcgcacttcacaggtgtta

SEQ ID NO: 8805 - DNA, 25 bp, Rattus norvegicus
aaagacgcgtgtcacagatctgtgc

SEQ ID NO: 8806 - DNA, 25 bp, Rattus norvegicus
aaagacgcgtgtgacagatctgtgc

SEQ ID NO: 8807 - DNA, 25 bp, Rattus norvegicus
aaagacgcttttatattgctgccct

SEQ ID NO: 8808 - DNA, 25 bp, Rattus norvegicus
aaagacgcttttttattgctgccct

SEQ ID NO: 8809 - DNA, 25 bp, Rattus norvegicus
aaagacggagtgagtctcttccagc

SEQ ID NO: 8810 - DNA, 25 bp, Rattus norvegicus
aaagacggagtgtgtctcttccagc

SEQ ID NO: 8811 - DNA, 25 bp, Rattus norvegicus
aaagacgggatcagcaggagaccat

SEQ ID NO: 8812 - DNA, 25 bp, Rattus norvegicus
aaagacgggatctgcaggagaccat

SEQ ID NO: 8813 - DNA, 25 bp, Rattus norvegicus
aaagacgggcgcaccctgtgcgaga

SEQ ID NO: 8814 - DNA, 25 bp, Rattus norvegicus
aaagacgggcgctccctgtgcgaga

SEQ ID NO: 8815 - DNA, 25 bp, Rattus norvegicus
aaagacggtctcacagtgtggtcct

SEQ ID NO: 8816 - DNA, 25 bp, Rattus norvegicus
aaagacggtctctcagtgtggtcct

SEQ ID NO: 8817 - DNA, 25 bp, Rattus norvegicus
aaagacggttccaagactgcgcgtt

SEQ ID NO: 8818 - DNA, 25 bp, Rattus norvegicus
aaagacggttcctagactgcgcgtt

SEQ ID NO: 8819 - DNA, 25 bp, Rattus norvegicus
aaagacgtcgctccacgtttcttat

SEQ ID NO: 8820 - DNA, 25 bp, Rattus norvegicus
aaagacgtcgctgcacgtttcttat

SEQ ID NO: 8821 - DNA, 25 bp, Rattus norvegicus
aaagacgtgggcatgagaaagtagt

SEQ ID NO: 8822 - DNA, 25 bp, Rattus norvegicus
aaagacgtgggcttgagaaagtagt

SEQ ID NO: 8823 - DNA, 25 bp, Rattus norvegicus
aaagacgtgtcccagtacagctgcc

SEQ ID NO: 8824 - DNA, 25 bp, Rattus norvegicus
aaagacgtgtccgagtacagctgcc

SEQ ID NO: 8825 - DNA, 25 bp, Rattus norvegicus
aaagacgtgtgcagggatttcacaa

SEQ ID NO: 8826 - DNA, 25 bp, Rattus norvegicus
aaagacgtgtgctgggatttcacaa

SEQ ID NO: 8827 - DNA, 25 bp, Rattus norvegicus
aaagactaagaaatcgcttcctaca

SEQ ID NO: 8828 - DNA, 25 bp, Rattus norvegicus
aaagactaagaattcgcttcctaca

SEQ ID NO: 8829 - DNA, 25 bp, Rattus norvegicus
aaagactacaacatccagcgggccg

SEQ ID NO: 8830 - DNA, 25 bp, Rattus norvegicus
aaagactacaacttccagcgggccg

SEQ ID NO: 8831 - DNA, 25 bp, Rattus norvegicus
aaagactacggaatgcactgacccc

SEQ ID NO: 8832 - DNA, 25 bp, Rattus norvegicus
aaagactacggattgcactgacccc

SEQ ID NO: 8833 - DNA, 25 bp, Rattus norvegicus
aaagactacgtgagacagcggcgaa

SEQ ID NO: 8834 - DNA, 25 bp, Rattus norvegicus
aaagactacgtgtgacagcggcgaa

SEQ ID NO: 8835 - DNA, 25 bp, Rattus norvegicus
aaagactatataattcaggctgtgg

SEQ ID NO: 8836 - DNA, 25 bp, Rattus norvegicus
aaagactatatatttcaggctgtgg

SEQ ID NO: 8837 - DNA, 25 bp, Rattus norvegicus
aaagactatcgcaggtgttcaaaaa

SEQ ID NO: 8838 - DNA, 25 bp, Rattus norvegicus
aaagactatcgctggtgttcaaaaa

SEQ ID NO: 8839 - DNA, 25 bp, Rattus norvegicus
aaagactattaaaccctctcgccta

SEQ ID NO: 8840 - DNA, 25 bp, Rattus norvegicus
aaagactattaatccctctcgccta

SEQ ID NO: 8841 - DNA, 25 bp, Rattus norvegicus
aaagactattccagtccttggcggg

SEQ ID NO: 8842 - DNA, 25 bp, Rattus norvegicus
aaagactattcctgtccttggcggg

SEQ ID NO: 8843 - DNA, 25 bp, Rattus norvegicus
aaagactattctaccacacgatccc

SEQ ID NO: 8844 - DNA, 25 bp, Rattus norvegicus
aaagactattcttccacacgatccc

SEQ ID NO: 8845 - DNA, 25 bp, Rattus norvegicus
aaagactcaagcatccagacaggga

SEQ ID NO: 8846 - DNA, 25 bp, Rattus norvegicus
aaagactcaagcttccagacaggga

SEQ ID NO: 8847 - DNA, 25 bp, Rattus norvegicus
aaagactcacatatggttcctgaat

SEQ ID NO: 8848 - DNA, 25 bp, Rattus norvegicus
aaagactcacatttggttcctgaat

SEQ ID NO: 8849 - DNA, 25 bp, Rattus norvegicus
aaagactcagaacaagcactctggg

SEQ ID NO: 8850 - DNA, 25 bp, Rattus norvegicus
aaagactcagaagaagcactctggg

SEQ ID NO: 8851 - DNA, 25 bp, Rattus norvegicus
aaagactcctcacatgcatggcact

SEQ ID NO: 8852 - DNA, 25 bp, Rattus norvegicus
aaagactcctcagatgcatggcact

SEQ ID NO: 8853 - DNA, 25 bp, Rattus norvegicus
aaagactcgctgctgctgaggaatt

SEQ ID NO: 8854 - DNA, 25 bp, Rattus norvegicus
aaagactcgctggtgctgaggaatt

SEQ ID NO: 8855 - DNA, 25 bp, Rattus norvegicus
aaagactcgcttagcttacgttcta

SEQ ID NO: 8856 - DNA, 25 bp, Rattus norvegicus
aaagactcgctttgcttacgttcta

SEQ ID NO: 8857 - DNA, 25 bp, Rattus norvegicus
aaagactctctgctccctattgtat

SEQ ID NO: 8858 - DNA, 25 bp, Rattus norvegicus
aaagactctctggtccctattgtat

SEQ ID NO: 8859 - DNA, 25 bp, Rattus norvegicus
aaagactctgccatgggtctcttat

SEQ ID NO: 8860 - DNA, 25 bp, Rattus norvegicus
aaagactctgccttgggtctcttat

SEQ ID NO: 8861 - DNA, 25 bp, Rattus norvegicus
aaagactcttcacgacacacgaaat

SEQ ID NO: 8862 - DNA, 25 bp, Rattus norvegicus
aaagactcttcaggacacacgaaat

SEQ ID NO: 8863 - DNA, 25 bp, Rattus norvegicus
aaagactcttttccatcggcctttg

SEQ ID NO: 8864 - DNA, 25 bp, Rattus norvegicus
aaagactcttttgcatcggcctttg

SEQ ID NO: 8865 - DNA, 25 bp, Rattus norvegicus
aaagactgaattctgtcctcctaca

SEQ ID NO: 8866 - DNA, 25 bp, Rattus norvegicus
aaagactgaattgtgtcctcctaca

SEQ ID NO: 8867 - DNA, 25 bp, Rattus norvegicus
aaagactgacaacactccaggtcct

SEQ ID NO: 8868 - DNA, 25 bp, Rattus norvegicus
aaagactgacaagactccaggtcct

SEQ ID NO: 8869 - DNA, 25 bp, Rattus norvegicus
aaagactgagcgctgtttccttagc

SEQ ID NO: 8870 - DNA, 25 bp, Rattus norvegicus
aaagactgagcggtgtttccttagc

SEQ ID NO: 8871 - DNA, 25 bp, Rattus norvegicus
aaagactgagtgctgctcacattca

SEQ ID NO: 8872 - DNA, 25 bp, Rattus norvegicus
aaagactgagtggtgctcacattca

SEQ ID NO: 8873 - DNA, 25 bp, Rattus norvegicus
aaagactgcaaccagtcctccgtac

SEQ ID NO: 8874 - DNA, 25 bp, Rattus norvegicus
aaagactgcaacgagtcctccgtac

SEQ ID NO: 8875 - DNA, 25 bp, Rattus norvegicus
aaagactgcagtcgacatgtccggt

SEQ ID NO: 8876 - DNA, 25 bp, Rattus norvegicus
aaagactgcagtggacatgtccggt

SEQ ID NO: 8877 - DNA, 25 bp, Rattus norvegicus
aaagactgcataattatactcttgc

SEQ ID NO: 8878 - DNA, 25 bp, Rattus norvegicus
aaagactgcatatttatactcttgc

SEQ ID NO: 8879 - DNA, 25 bp, Rattus norvegicus
aaagactgctatcagttcgatgcca

SEQ ID NO: 8880 - DNA, 25 bp, Rattus norvegicus
aaagactgctatgagttcgatgcca

SEQ ID NO: 8881 - DNA, 25 bp, Rattus norvegicus
aaagactggcgccagcagctggaca

SEQ ID NO: 8882 - DNA, 25 bp, Rattus norvegicus
aaagactggcgcgagcagctggaca

SEQ ID NO: 8883 - DNA, 25 bp, Rattus norvegicus
aaagactggcttcccttgtgtcagc

SEQ ID NO: 8884 - DNA, 25 bp, Rattus norvegicus
aaagactggcttgccttgtgtcagc

SEQ ID NO: 8885 - DNA, 25 bp, Rattus norvegicus
aaagactgggtaacatagctcacat

SEQ ID NO: 8886 - DNA, 25 bp, Rattus norvegicus
aaagactgggtatcatagctcacat

SEQ ID NO: 8887 - DNA, 25 bp, Rattus norvegicus
aaagactggtctaactcctttgatg

SEQ ID NO: 8888 - DNA, 25 bp, Rattus norvegicus
aaagactggtcttactcctttgatg

SEQ ID NO: 8889 - DNA, 25 bp, Rattus norvegicus
aaagactggtgtctctcggactcct

SEQ ID NO: 8890 - DNA, 25 bp, Rattus norvegicus
aaagactggtgtgtctcggactcct

SEQ ID NO: 8891 - DNA, 25 bp, Rattus norvegicus
aaagactgtaagcttcctcttctgg

SEQ ID NO: 8892 - DNA, 25 bp, Rattus norvegicus
aaagactgtaaggttcctcttctgg

SEQ ID NO: 8893 - DNA, 25 bp, Rattus norvegicus
aaagactgtactcgccagtgtcatt

SEQ ID NO: 8894 - DNA, 25 bp, Rattus norvegicus
aaagactgtactggccagtgtcatt

SEQ ID NO: 8895 - DNA, 25 bp, Rattus norvegicus
aaagactgtcagcacttggcccaat

SEQ ID NO: 8896 - DNA, 25 bp, Rattus norvegicus
aaagactgtcaggacttggcccaat

SEQ ID NO: 8897 - DNA, 25 bp, Rattus norvegicus
aaagactgtcctcgctttgtgttca

SEQ ID NO: 8898 - DNA, 25 bp, Rattus norvegicus
aaagactgtcctggctttgtgttca

SEQ ID NO: 8899 - DNA, 25 bp, Rattus norvegicus
aaagactgtcttagttcacaaccat

SEQ ID NO: 8900 - DNA, 25 bp, Rattus norvegicus
aaagactgtctttgttcacaaccat

SEQ ID NO: 8901 - DNA, 25 bp, Rattus norvegicus
aaagactgtgcaccttgccaacctt

SEQ ID NO: 8902 - DNA, 25 bp, Rattus norvegicus
aaagactgtgcagcttgccaacctt

SEQ ID NO: 8903 - DNA, 25 bp, Rattus norvegicus
aaagactgtttccacaccataggca

SEQ ID NO: 8904 - DNA, 25 bp, Rattus norvegicus
aaagactgtttcgacaccataggca

SEQ ID NO: 8905 - DNA, 25 bp, Rattus norvegicus
aaagacttaaatctgcttgcactag

SEQ ID NO: 8906 - DNA, 25 bp, Rattus norvegicus
aaagacttaaatgtgcttgcactag

SEQ ID NO: 8907 - DNA, 25 bp, Rattus norvegicus
aaagacttatccaccactgggctaa

SEQ ID NO: 8908 - DNA, 25 bp, Rattus norvegicus
aaagacttatcctccactgggctaa

SEQ ID NO: 8909 - DNA, 25 bp, Rattus norvegicus
aaagacttcaggactctgctttttg

SEQ ID NO: 8910 - DNA, 25 bp, Rattus norvegicus
aaagacttcaggtctctgctttttg

SEQ ID NO: 8911 - DNA, 25 bp, Rattus norvegicus
aaagacttcataagtgtaccatcaa

SEQ ID NO: 8912 - DNA, 25 bp, Rattus norvegicus
aaagacttcatatgtgtaccatcaa

SEQ ID NO: 8913 - DNA, 25 bp, Rattus norvegicus
aaagacttcgacagtctagcccagc

SEQ ID NO: 8914 - DNA, 25 bp, Rattus norvegicus
aaagacttcgactgtctagcccagc

SEQ ID NO: 8915 - DNA, 25 bp, Rattus norvegicus
aaagacttctgacgtagcccatttc

SEQ ID NO: 8916 - DNA, 25 bp, Rattus norvegicus
aaagacttctgaggtagcccatttc

SEQ ID NO: 8917 - DNA, 25 bp, Rattus norvegicus
aaagacttctgtcgtactgtttatt

SEQ ID NO: 8918 - DNA, 25 bp, Rattus norvegicus
aaagacttctgtggtactgtttatt

SEQ ID NO: 8919 - DNA, 25 bp, Rattus norvegicus
aaagacttgagtacatctcccaacc

SEQ ID NO: 8920 - DNA, 25 bp, Rattus norvegicus
aaagacttgagttcatctcccaacc

SEQ ID NO: 8921 - DNA, 25 bp, Rattus norvegicus
aaagacttgcctcctgatgcactta

SEQ ID NO: 8922 - DNA, 25 bp, Rattus norvegicus
aaagacttgcctgctgatgcactta

SEQ ID NO: 8923 - DNA, 25 bp, Rattus norvegicus
aaagacttgctactactgtacagag

SEQ ID NO: 8924 - DNA, 25 bp, Rattus norvegicus
aaagacttgctactctcgtcaggga

SEQ ID NO: 8925 - DNA, 25 bp, Rattus norvegicus
aaagacttgctagtactgtacagag

SEQ ID NO: 8926 - DNA, 25 bp, Rattus norvegicus
aaagacttgctagtctcgtcaggga

SEQ ID NO: 8927 - DNA, 25 bp, Rattus norvegicus
aaagacttgctgatcggtgttcctg

SEQ ID NO: 8928 - DNA, 25 bp, Rattus norvegicus
aaagacttgctgttcggtgttcctg

SEQ ID NO: 8929 - DNA, 25 bp, Rattus norvegicus
aaagacttggcaccagcgacgccca

SEQ ID NO: 8930 - DNA, 25 bp, Rattus norvegicus
aaagacttggcagcagcgacgccca

SEQ ID NO: 8931 - DNA, 25 bp, Rattus norvegicus
aaagacttgtgaactctgctgcaga

SEQ ID NO: 8932 - DNA, 25 bp, Rattus norvegicus
aaagacttgtgatctctgctgcaga

SEQ ID NO: 8933 - DNA, 25 bp, Rattus norvegicus
aaagactttcagcattccaccccag

SEQ ID NO: 8934 - DNA, 25 bp, Rattus norvegicus
aaagactttcaggattccaccccag

SEQ ID NO: 8935 - DNA, 25 bp, Rattus norvegicus
aaagactttcctatgtcagggcctc

SEQ ID NO: 8936 - DNA, 25 bp, Rattus norvegicus
aaagactttcctttgtcagggcctc

SEQ ID NO: 8937 - DNA, 25 bp, Rattus norvegicus
aaagactttgtacagttttctaatg

SEQ ID NO: 8938 - DNA, 25 bp, Rattus norvegicus
aaagactttgtagagttttctaatg

SEQ ID NO: 8939 - DNA, 25 bp, Rattus norvegicus
aaagagaaactcagcctcctaaggc

SEQ ID NO: 8940 - DNA, 25 bp, Rattus norvegicus
aaagagaaactctgcctcctaaggc

SEQ ID NO: 8941 - DNA, 25 bp, Rattus norvegicus
aaagagaaacttagctacacaacaa

SEQ ID NO: 8942 - DNA, 25 bp, Rattus norvegicus
aaagagaaactttgctacacaacaa

SEQ ID NO: 8943 - DNA, 25 bp, Rattus norvegicus
aaagagaaatgccttcccagacaag

SEQ ID NO: 8944 - DNA, 25 bp, Rattus norvegicus
aaagagaaatgcgttcccagacaag

SEQ ID NO: 8945 - DNA, 25 bp, Rattus norvegicus
aaagagaacacgctaagcctctcct

SEQ ID NO: 8946 - DNA, 25 bp, Rattus norvegicus
aaagagaacacggtaagcctctcct

SEQ ID NO: 8947 - DNA, 25 bp, Rattus norvegicus
aaagagaaccttaccagccagtctg

SEQ ID NO: 8948 - DNA, 25 bp, Rattus norvegicus
aaagagaaccttctggctctgacca

SEQ ID NO: 8949 - DNA, 25 bp, Rattus norvegicus
aaagagaaccttgtggctctgacca

SEQ ID NO: 8950 - DNA, 25 bp, Rattus norvegicus
aaagagaacctttccagccagtctg

SEQ ID NO: 8951 - DNA, 25 bp, Rattus norvegicus
aaagagaacgctagtcttcgcctct

SEQ ID NO: 8952 - DNA, 25 bp, Rattus norvegicus
aaagagaacgcttgtcttcgcctct

SEQ ID NO: 8953 - DNA, 25 bp, Rattus norvegicus
aaagagaagcctactgtcccgttgt

SEQ ID NO: 8954 - DNA, 25 bp, Rattus norvegicus
aaagagaagccttctgtcccgttgt

SEQ ID NO: 8955 - DNA, 25 bp, Rattus norvegicus
aaagagaagctcctacttgccttgg

SEQ ID NO: 8956 - DNA, 25 bp, Rattus norvegicus
aaagagaagctcgtacttgccttgg

SEQ ID NO: 8957 - DNA, 25 bp, Rattus norvegicus
aaagagaagcttagttcctgaggaa

SEQ ID NO: 8958 - DNA, 25 bp, Rattus norvegicus
aaagagaagctttgttcctgaggaa

SEQ ID NO: 8959 - DNA, 25 bp, Rattus norvegicus
aaagagaaggcgatctccagcctca

SEQ ID NO: 8960 - DNA, 25 bp, Rattus norvegicus
aaagagaaggcgttctccagcctca

SEQ ID NO: 8961 - DNA, 25 bp, Rattus norvegicus
aaagagaatgctaccacccgaggcg

SEQ ID NO: 8962 - DNA, 25 bp, Rattus norvegicus
aaagagaatgcttccacccgaggcg

SEQ ID NO: 8963 - DNA, 25 bp, Rattus norvegicus
aaagagaattgtcggcctccaggat

SEQ ID NO: 8964 - DNA, 25 bp, Rattus norvegicus
aaagagaattgtgggcctccaggat

SEQ ID NO: 8965 - DNA, 25 bp, Rattus norvegicus
aaagagacagcaatcgttttcccac

SEQ ID NO: 8966 - DNA, 25 bp, Rattus norvegicus
aaagagacagcattcgttttcccac

SEQ ID NO: 8967 - DNA, 25 bp, Rattus norvegicus
aaagagacatttcagcccctccctt

SEQ ID NO: 8968 - DNA, 25 bp, Rattus norvegicus
aaagagacatttgagcccctccctt

SEQ ID NO: 8969 - DNA, 25 bp, Rattus norvegicus
aaagagaccaacaatgccgccatca

SEQ ID NO: 8970 - DNA, 25 bp, Rattus norvegicus
aaagagaccaactatgccgccatca

SEQ ID NO: 8971 - DNA, 25 bp, Rattus norvegicus
aaagagaccaatcccgtctggctag

SEQ ID NO: 8972 - DNA, 25 bp, Rattus norvegicus
aaagagaccaatgccgtctggctag

SEQ ID NO: 8973 - DNA, 25 bp, Rattus norvegicus
aaagagaccacaacctttgttatta

SEQ ID NO: 8974 - DNA, 25 bp, Rattus norvegicus
aaagagaccacatcctttgttatta

SEQ ID NO: 8975 - DNA, 25 bp, Rattus norvegicus
aaagagaccatcctggttcacccag

SEQ ID NO: 8976 - DNA, 25 bp, Rattus norvegicus
aaagagaccatcgtggttcacccag

SEQ ID NO: 8977 - DNA, 25 bp, Rattus norvegicus
aaagagacccacactggcactgtca

SEQ ID NO: 8978 - DNA, 25 bp, Rattus norvegicus
aaagagacccactctggcactgtca

SEQ ID NO: 8979 - DNA, 25 bp, Rattus norvegicus
aaagagacccctcaagcaccagtgt

SEQ ID NO: 8980 - DNA, 25 bp, Rattus norvegicus
aaagagacccctgaagcaccagtgt

SEQ ID NO: 8981 - DNA, 25 bp, Rattus norvegicus
aaagagactaccaagttcacccagt

SEQ ID NO: 8982 - DNA, 25 bp, Rattus norvegicus
aaagagactacctagttcacccagt

SEQ ID NO: 8983 - DNA, 25 bp, Rattus norvegicus
aaagagacttgacttcggctcgcgg

SEQ ID NO: 8984 - DNA, 25 bp, Rattus norvegicus
aaagagacttgagttcggctcgcgg

SEQ ID NO: 8985 - DNA, 25 bp, Rattus norvegicus
aaagagagagagacccacccccttg

SEQ ID NO: 8986 - DNA, 25 bp, Rattus norvegicus
aaagagagagagtcccacccccttg

SEQ ID NO: 8987 - DNA, 25 bp, Rattus norvegicus
aaagagagctcccagaacctacagt

SEQ ID NO: 8988 - DNA, 25 bp, Rattus norvegicus
aaagagagctccgagaacctacagt

SEQ ID NO: 8989 - DNA, 25 bp, Rattus norvegicus
aaagagaggcccagcgagtagaagc

SEQ ID NO: 8990 - DNA, 25 bp, Rattus norvegicus
aaagagaggccctgcgagtagaagc

SEQ ID NO: 8991 - DNA, 25 bp, Rattus norvegicus
aaagagagggctctgcctatagcag

SEQ ID NO: 8992 - DNA, 25 bp, Rattus norvegicus
aaagagagggctgtgcctatagcag

SEQ ID NO: 8993 - DNA, 25 bp, Rattus norvegicus
aaagagagtggtctactcgtcccct

SEQ ID NO: 8994 - DNA, 25 bp, Rattus norvegicus
aaagagagtggtgtactcgtcccct

SEQ ID NO: 8995 - DNA, 25 bp, Rattus norvegicus
aaagagagttctagtccctggcact

SEQ ID NO: 8996 - DNA, 25 bp, Rattus norvegicus
aaagagagttcttgtccctggcact

SEQ ID NO: 8997 - DNA, 25 bp, Rattus norvegicus
aaagagagttgacaatatgcgtacc

SEQ ID NO: 8998 - DNA, 25 bp, Rattus norvegicus
aaagagagttgagaatatgcgtacc

SEQ ID NO: 8999 - DNA, 25 bp, Rattus norvegicus
aaagagatcaagattccagagctgg

SEQ ID NO: 9000 - DNA, 25 bp, Rattus norvegicus
aaagagatcaagtttccagagctgg

SEQ ID NO: 9001 - DNA, 25 bp, Rattus norvegicus
aaagagatcgttatacatgtgtact

SEQ ID NO: 9002 - DNA, 25 bp, Rattus norvegicus
aaagagatcgttttacatgtgtact

SEQ ID NO: 9003 - DNA, 25 bp, Rattus norvegicus
aaagagatctctccgtgacactgga

SEQ ID NO: 9004 - DNA, 25 bp, Rattus norvegicus
aaagagatctctgcgtgacactgga

SEQ ID NO: 9005 - DNA, 25 bp, Rattus norvegicus
aaagagatgcctagcttccatgaac

SEQ ID NO: 9006 - DNA, 25 bp, Rattus norvegicus
aaagagatgccttgcttccatgaac

SEQ ID NO: 9007 - DNA, 25 bp, Rattus norvegicus
aaagagatggtcatccttcttcctc

SEQ ID NO: 9008 - DNA, 25 bp, Rattus norvegicus
aaagagatggtcttccttcttcctc

SEQ ID NO: 9009 - DNA, 25 bp, Rattus norvegicus
aaagagattcaaacactgcggttat

SEQ ID NO: 9010 - DNA, 25 bp, Rattus norvegicus
aaagagattcaatcactgcggttat

SEQ ID NO: 9011 - DNA, 25 bp, Rattus norvegicus
aaagagattcagctgcccacgacca

SEQ ID NO: 9012 - DNA, 25 bp, Rattus norvegicus
aaagagattcaggtgcccacgacca

SEQ ID NO: 9013 - DNA, 25 bp, Rattus norvegicus
aaagagattccacccttgtaaataa

SEQ ID NO: 9014 - DNA, 25 bp, Rattus norvegicus
aaagagattccagccttgtaaataa

SEQ ID NO: 9015 - DNA, 25 bp, Rattus norvegicus
aaagagattcctcgccatattgaat

SEQ ID NO: 9016 - DNA, 25 bp, Rattus norvegicus
aaagagattcctggccatattgaat

SEQ ID NO: 9017 - DNA, 25 bp, Rattus norvegicus
aaagagattcggattgttgcacgca

SEQ ID NO: 9018 - DNA, 25 bp, Rattus norvegicus
aaagagattcggtttgttgcacgca

SEQ ID NO: 9019 - DNA, 25 bp, Rattus norvegicus
aaagagattctcaggcgacccaagg

SEQ ID NO: 9020 - DNA, 25 bp, Rattus norvegicus
aaagagattctctggcgacccaagg

SEQ ID NO: 9021 - DNA, 25 bp, Rattus norvegicus
aaagagatttccacacactgccgtg

SEQ ID NO: 9022 - DNA, 25 bp, Rattus norvegicus
aaagagatttcctcacactgccgtg

SEQ ID NO: 9023 - DNA, 25 bp, Rattus norvegicus
aaagagcaactcatccatcaactca

SEQ ID NO: 9024 - DNA, 25 bp, Rattus norvegicus
aaagagcaactcttccatcaactca

SEQ ID NO: 9025 - DNA, 25 bp, Rattus norvegicus
aaagagcaactgaagccactgccat

SEQ ID NO: 9026 - DNA, 25 bp, Rattus norvegicus
aaagagcaactgtagccactgccat

SEQ ID NO: 9027 - DNA, 25 bp, Rattus norvegicus
aaagagcaacttctaggccagaggg

SEQ ID NO: 9028 - DNA, 25 bp, Rattus norvegicus
aaagagcaacttgtaggccagaggg

SEQ ID NO: 9029 - DNA, 25 bp, Rattus norvegicus
aaagagcaagataccgaggccagta

SEQ ID NO: 9030 - DNA, 25 bp, Rattus norvegicus
aaagagcaagattccgaggccagta

SEQ ID NO: 9031 - DNA, 25 bp, Rattus norvegicus
aaagagcacagcacagtgtctgcct

SEQ ID NO: 9032 - DNA, 25 bp, Rattus norvegicus
aaagagcacagctcagtgtctgcct

SEQ ID NO: 9033 - DNA, 25 bp, Rattus norvegicus
aaagagcaccctatctttgtggctc

SEQ ID NO: 9034 - DNA, 25 bp, Rattus norvegicus
aaagagcaccctcatttcagttccc

SEQ ID NO: 9035 - DNA, 25 bp, Rattus norvegicus
aaagagcaccctgatttcagttccc

SEQ ID NO: 9036 - DNA, 25 bp, Rattus norvegicus
aaagagcaccctttctttgtggctc

SEQ ID NO: 9037 - DNA, 25 bp, Rattus norvegicus
aaagagcactttaacctgttctggc

SEQ ID NO: 9038 - DNA, 25 bp, Rattus norvegicus
aaagagcacttttacctgttctggc

SEQ ID NO: 9039 - DNA, 25 bp, Rattus norvegicus
aaagagcagagcattgcctacctca

SEQ ID NO: 9040 - DNA, 25 bp, Rattus norvegicus
aaagagcagagctttgcctacctca

SEQ ID NO: 9041 - DNA, 25 bp, Rattus norvegicus
aaagagcagattacttcctcctgag

SEQ ID NO: 9042 - DNA, 25 bp, Rattus norvegicus
aaagagcagatttcttcctcctgag

SEQ ID NO: 9043 - DNA, 25 bp, Rattus norvegicus
aaagagcagcaactactcagcaggg

SEQ ID NO: 9044 - DNA, 25 bp, Rattus norvegicus
aaagagcagcaagtactcagcaggg

SEQ ID NO: 9045 - DNA, 25 bp, Rattus norvegicus
aaagagcagcccctgctggttaacc

SEQ ID NO: 9046 - DNA, 25 bp, Rattus norvegicus
aaagagcagcccgtgctggttaacc

SEQ ID NO: 9047 - DNA, 25 bp, Rattus norvegicus
aaagagcagctacctgctttgcagc

SEQ ID NO: 9048 - DNA, 25 bp, Rattus norvegicus
aaagagcagctagctgctttgcagc

SEQ ID NO: 9049 - DNA, 25 bp, Rattus norvegicus
aaagagcagctcaatcattcccggc

SEQ ID NO: 9050 - DNA, 25 bp, Rattus norvegicus
aaagagcagctctatcattcccggc

SEQ ID NO: 9051 - DNA, 25 bp, Rattus norvegicus
aaagagcaggtgaggcgtccttgct

SEQ ID NO: 9052 - DNA, 25 bp, Rattus norvegicus
aaagagcaggtgtggcgtccttgct

SEQ ID NO: 9053 - DNA, 25 bp, Rattus norvegicus
aaagagcagtacagggtccagccca

SEQ ID NO: 9054 - DNA, 25 bp, Rattus norvegicus
aaagagcagtactgggtccagccca

SEQ ID NO: 9055 - DNA, 25 bp, Rattus norvegicus
aaagagcagtctagccatcttcttg

SEQ ID NO: 9056 - DNA, 25 bp, Rattus norvegicus
aaagagcagtcttgccatcttcttg

SEQ ID NO: 9057 - DNA, 25 bp, Rattus norvegicus
aaagagcatatccagtttcaatgcc

SEQ ID NO: 9058 - DNA, 25 bp, Rattus norvegicus
aaagagcatatcgagtttcaatgcc

SEQ ID NO: 9059 - DNA, 25 bp, Rattus norvegicus
aaagagcatgatatccggacagccc

SEQ ID NO: 9060 - DNA, 25 bp, Rattus norvegicus
aaagagcatgatttccggacagccc

SEQ ID NO: 9061 - DNA, 25 bp, Rattus norvegicus
aaagagcattccagggtttgtttgt

SEQ ID NO: 9062 - DNA, 25 bp, Rattus norvegicus
aaagagcattccatcctgtcaggaa

SEQ ID NO: 9063 - DNA, 25 bp, Rattus norvegicus
aaagagcattcctgggtttgtttgt

SEQ ID NO: 9064 - DNA, 25 bp, Rattus norvegicus
aaagagcattccttcctgtcaggaa

SEQ ID NO: 9065 - DNA, 25 bp, Rattus norvegicus
aaagagccaaacactgcttcctggg

SEQ ID NO: 9066 - DNA, 25 bp, Rattus norvegicus
aaagagccaaacatactccagcctc

SEQ ID NO: 9067 - DNA, 25 bp, Rattus norvegicus
aaagagccaaactctgcttcctggg

SEQ ID NO: 9068 - DNA, 25 bp, Rattus norvegicus
aaagagccaaacttactccagcctc

SEQ ID NO: 9069 - DNA, 25 bp, Rattus norvegicus
aaagagccactcaccagtaactggg

SEQ ID NO: 9070 - DNA, 25 bp, Rattus norvegicus
aaagagccactctccagtaactggg

SEQ ID NO: 9071 - DNA, 25 bp, Rattus norvegicus
aaagagccacttacttcagtctgga

SEQ ID NO: 9072 - DNA, 25 bp, Rattus norvegicus
aaagagccactttcttcagtctgga

SEQ ID NO: 9073 - DNA, 25 bp, Rattus norvegicus
aaagagccagctcatttaccttcac

SEQ ID NO: 9074 - DNA, 25 bp, Rattus norvegicus
aaagagccagctgatttaccttcac

SEQ ID NO: 9075 - DNA, 25 bp, Rattus norvegicus
aaagagccatctaaaccagggaatg

SEQ ID NO: 9076 - DNA, 25 bp, Rattus norvegicus
aaagagccatcttaaccagggaatg

SEQ ID NO: 9077 - DNA, 25 bp, Rattus norvegicus
aaagagccatgaactctctcggcgg

SEQ ID NO: 9078 - DNA, 25 bp, Rattus norvegicus
aaagagccatgatctctctcggcgg

SEQ ID NO: 9079 - DNA, 25 bp, Rattus norvegicus
aaagagccattgatccagcaaccta

SEQ ID NO: 9080 - DNA, 25 bp, Rattus norvegicus
aaagagccattgttccagcaaccta

SEQ ID NO: 9081 - DNA, 25 bp, Rattus norvegicus
aaagagcccaagatgcctttccagg

SEQ ID NO: 9082 - DNA, 25 bp, Rattus norvegicus
aaagagcccaagttgcctttccagg

SEQ ID NO: 9083 - DNA, 25 bp, Rattus norvegicus
aaagagcccactcagagggtgcaaa

SEQ ID NO: 9084 - DNA, 25 bp, Rattus norvegicus
aaagagcccactgagagggtgcaaa

SEQ ID NO: 9085 - DNA, 25 bp, Rattus norvegicus
aaagagcccaggacatatttcaaac

SEQ ID NO: 9086 - DNA, 25 bp, Rattus norvegicus
aaagagcccaggtcatatttcaaac

SEQ ID NO: 9087 - DNA, 25 bp, Rattus norvegicus
aaagagcccataatcctcctgggat

SEQ ID NO: 9088 - DNA, 25 bp, Rattus norvegicus
aaagagcccatattcctcctgggat

SEQ ID NO: 9089 - DNA, 25 bp, Rattus norvegicus
aaagagcccgtgactcagcagtgga

SEQ ID NO: 9090 - DNA, 25 bp, Rattus norvegicus
aaagagcccgtgtctcagcagtgga

SEQ ID NO: 9091 - DNA, 25 bp, Rattus norvegicus
aaagagcccttcaggtgcttttgtg

SEQ ID NO: 9092 - DNA, 25 bp, Rattus norvegicus
aaagagcccttctggtgcttttgtg

SEQ ID NO: 9093 - DNA, 25 bp, Rattus norvegicus
aaagagcctcgcagttgctatccca

SEQ ID NO: 9094 - DNA, 25 bp, Rattus norvegicus
aaagagcctcgctgttgctatccca

SEQ ID NO: 9095 - DNA, 25 bp, Rattus norvegicus
aaagagcctgacactgactccacga

SEQ ID NO: 9096 - DNA, 25 bp, Rattus norvegicus
aaagagcctgactctgactccacga

SEQ ID NO: 9097 - DNA, 25 bp, Rattus norvegicus
aaagagcgcccgcatctggaacagc

SEQ ID NO: 9098 - DNA, 25 bp, Rattus norvegicus
aaagagcgcccggatctggaacagc

SEQ ID NO: 9099 - DNA, 25 bp, Rattus norvegicus
aaagagcggatccttgatgttcccc

SEQ ID NO: 9100 - DNA, 25 bp, Rattus norvegicus
aaagagcggatcgttgatgttcccc

SEQ ID NO: 9101 - DNA, 25 bp, Rattus norvegicus
aaagagcgtgagagatccctggcac

SEQ ID NO: 9102 - DNA, 25 bp, Rattus norvegicus
aaagagcgtgagtgatccctggcac

SEQ ID NO: 9103 - DNA, 25 bp, Rattus norvegicus
aaagagctcatcaaagacggcaaga

SEQ ID NO: 9104 - DNA, 25 bp, Rattus norvegicus
aaagagctcatctaagacggcaaga

SEQ ID NO: 9105 - DNA, 25 bp, Rattus norvegicus
aaagagctccagatagacttctaat

SEQ ID NO: 9106 - DNA, 25 bp, Rattus norvegicus
aaagagctccagcaggatcaggaca

SEQ ID NO: 9107 - DNA, 25 bp, Rattus norvegicus
aaagagctccaggaggatcaggaca

SEQ ID NO: 9108 - DNA, 25 bp, Rattus norvegicus
aaagagctccagttagacttctaat

SEQ ID NO: 9109 - DNA, 25 bp, Rattus norvegicus
aaagagctcccaactggcaagaaat

SEQ ID NO: 9110 - DNA, 25 bp, Rattus norvegicus
aaagagctcccatctggcaagaaat

SEQ ID NO: 9111 - DNA, 25 bp, Rattus norvegicus
aaagagctccctcgttgccttggaa

SEQ ID NO: 9112 - DNA, 25 bp, Rattus norvegicus
aaagagctccctggttgccttggaa

SEQ ID NO: 9113 - DNA, 25 bp, Rattus norvegicus
aaagagctctctcgtctcgacagag

SEQ ID NO: 9114 - DNA, 25 bp, Rattus norvegicus
aaagagctctctggtctcgacagag

SEQ ID NO: 9115 - DNA, 25 bp, Rattus norvegicus
aaagagctctttctggtccttctag

SEQ ID NO: 9116 - DNA, 25 bp, Rattus norvegicus
aaagagctctttgtggtccttctag

SEQ ID NO: 9117 - DNA, 25 bp, Rattus norvegicus
aaagagctgcctcagtccttttggg

SEQ ID NO: 9118 - DNA, 25 bp, Rattus norvegicus
aaagagctgcctgagtccttttggg

SEQ ID NO: 9119 - DNA, 25 bp, Rattus norvegicus
aaagagctgctccttttgcaaagac

SEQ ID NO: 9120 - DNA, 25 bp, Rattus norvegicus
aaagagctgctcgttttgcaaagac

SEQ ID NO: 9121 - DNA, 25 bp, Rattus norvegicus
aaagagctggacagcctgcctaggt

SEQ ID NO: 9122 - DNA, 25 bp, Rattus norvegicus
aaagagctggactgcctgcctaggt

SEQ ID NO: 9123 - DNA, 25 bp, Rattus norvegicus
aaagagctggcccacgaggtgttca

SEQ ID NO: 9124 - DNA, 25 bp, Rattus norvegicus
aaagagctggccgacgaggtgttca

SEQ ID NO: 9125 - DNA, 25 bp, Rattus norvegicus
aaagagctgtcacgattaaagtcaa

SEQ ID NO: 9126 - DNA, 25 bp, Rattus norvegicus
aaagagctgtcaggattaaagtcaa

SEQ ID NO: 9127 - DNA, 25 bp, Rattus norvegicus
aaagagctgtgtagcgtaggtaact

SEQ ID NO: 9128 - DNA, 25 bp, Rattus norvegicus
aaagagctgtgttgcgtaggtaact

SEQ ID NO: 9129 - DNA, 25 bp, Rattus norvegicus
aaagagcttcaacgtcccgttctag

SEQ ID NO: 9130 - DNA, 25 bp, Rattus norvegicus
aaagagcttcaaggtcccgttctag

SEQ ID NO: 9131 - DNA, 25 bp, Rattus norvegicus
aaagagcttcatagttgtctaaaac

SEQ ID NO: 9132 - DNA, 25 bp, Rattus norvegicus
aaagagcttcattgttgtctaaaac

SEQ ID NO: 9133 - DNA, 25 bp, Rattus norvegicus
aaagagcttctgacgcagtgcatca

SEQ ID NO: 9134 - DNA, 25 bp, Rattus norvegicus
aaagagcttctgtcgcagtgcatca

SEQ ID NO: 9135 - DNA, 25 bp, Rattus norvegicus
aaagagcttgctaaacgtcacccgg

SEQ ID NO: 9136 - DNA, 25 bp, Rattus norvegicus
aaagagcttgctacttccttgtcaa

SEQ ID NO: 9137 - DNA, 25 bp, Rattus norvegicus
aaagagcttgcttaacgtcacccgg

SEQ ID NO: 9138 - DNA, 25 bp, Rattus norvegicus
aaagagcttgcttcttccttgtcaa

SEQ ID NO: 9139 - DNA, 25 bp, Rattus norvegicus
aaagagctttcgctgacgcacttct

SEQ ID NO: 9140 - DNA, 25 bp, Rattus norvegicus
aaagagctttcggtgacgcacttct

SEQ ID NO: 9141 - DNA, 25 bp, Rattus norvegicus
aaagaggaagttactgtgcggcact

SEQ ID NO: 9142 - DNA, 25 bp, Rattus norvegicus
aaagaggaagtttctgtgcggcact

SEQ ID NO: 9143 - DNA, 25 bp, Rattus norvegicus
aaagaggaatccatccatttaatgc

SEQ ID NO: 9144 - DNA, 25 bp, Rattus norvegicus
aaagaggaatccttccatttaatgc

SEQ ID NO: 9145 - DNA, 25 bp, Rattus norvegicus
aaagaggacaacacggccacaggct

SEQ ID NO: 9146 - DNA, 25 bp, Rattus norvegicus
aaagaggacaactcggccacaggct

SEQ ID NO: 9147 - DNA, 25 bp, Rattus norvegicus
aaagaggacatccagctgctgagct

SEQ ID NO: 9148 - DNA, 25 bp, Rattus norvegicus
aaagaggacatcgagctgctgagct

SEQ ID NO: 9149 - DNA, 25 bp, Rattus norvegicus
aaagaggacctcagggcagcctggc

SEQ ID NO: 9150 - DNA, 25 bp, Rattus norvegicus
aaagaggacctctgggcagcctggc

SEQ ID NO: 9151 - DNA, 25 bp, Rattus norvegicus
aaagaggacttcctgggcccatagg

SEQ ID NO: 9152 - DNA, 25 bp, Rattus norvegicus
aaagaggacttcgtgggcccatagg

SEQ ID NO: 9153 - DNA, 25 bp, Rattus norvegicus
aaagaggagacccagagcctgcctt

SEQ ID NO: 9154 - DNA, 25 bp, Rattus norvegicus
aaagaggagaccgagagcctgcctt

SEQ ID NO: 9155 - DNA, 25 bp, Rattus norvegicus
aaagaggagggacccaggccttcat

SEQ ID NO: 9156 - DNA, 25 bp, Rattus norvegicus
aaagaggagggagccaggccttcat

SEQ ID NO: 9157 - DNA, 25 bp, Rattus norvegicus
aaagaggatagcctgttctcccttc

SEQ ID NO: 9158 - DNA, 25 bp, Rattus norvegicus
aaagaggatagcgtgttctcccttc

SEQ ID NO: 9159 - DNA, 25 bp, Rattus norvegicus
aaagaggatagtccagagccccgtt

SEQ ID NO: 9160 - DNA, 25 bp, Rattus norvegicus
aaagaggatagtgcagagccccgtt

SEQ ID NO: 9161 - DNA, 25 bp, Rattus norvegicus
aaagaggatcgaccagtccgagttc

SEQ ID NO: 9162 - DNA, 25 bp, Rattus norvegicus
aaagaggatcgagcagtccgagttc

SEQ ID NO: 9163 - DNA, 25 bp, Rattus norvegicus
aaagaggattctcaccgtaggtatt

SEQ ID NO: 9164 - DNA, 25 bp, Rattus norvegicus
aaagaggattctgaccgtaggtatt

SEQ ID NO: 9165 - DNA, 25 bp, Rattus norvegicus
aaagaggattgcattgtgcccctta

SEQ ID NO: 9166 - DNA, 25 bp, Rattus norvegicus
aaagaggattgctttgtgcccctta

SEQ ID NO: 9167 - DNA, 25 bp, Rattus norvegicus
aaagaggcacagaccatgtgactgt

SEQ ID NO: 9168 - DNA, 25 bp, Rattus norvegicus
aaagaggcacagtccatgtgactgt

SEQ ID NO: 9169 - DNA, 25 bp, Rattus norvegicus
aaagaggcactacctggccaggaga

SEQ ID NO: 9170 - DNA, 25 bp, Rattus norvegicus
aaagaggcactagctggccaggaga

SEQ ID NO: 9171 - DNA, 25 bp, Rattus norvegicus
aaagaggccatcctcagtgcgtcct

SEQ ID NO: 9172 - DNA, 25 bp, Rattus norvegicus
aaagaggccatcgtcagtgcgtcct

SEQ ID NO: 9173 - DNA, 25 bp, Rattus norvegicus
aaagaggccgccatgactcagagct

SEQ ID NO: 9174 - DNA, 25 bp, Rattus norvegicus
aaagaggccgccttgactcagagct

SEQ ID NO: 9175 - DNA, 25 bp, Rattus norvegicus
aaagaggccgtgacgttgtttgtag

SEQ ID NO: 9176 - DNA, 25 bp, Rattus norvegicus
aaagaggccgtgtcgttgtttgtag

SEQ ID NO: 9177 - DNA, 25 bp, Rattus norvegicus
aaagaggcctgtacactcagcactg

SEQ ID NO: 9178 - DNA, 25 bp, Rattus norvegicus
aaagaggcctgttcactcagcactg

SEQ ID NO: 9179 - DNA, 25 bp, Rattus norvegicus
aaagaggctcagaacttccggctgc

SEQ ID NO: 9180 - DNA, 25 bp, Rattus norvegicus
aaagaggctcagtacttccggctgc

SEQ ID NO: 9181 - DNA, 25 bp, Rattus norvegicus
aaagaggctcggctcagtccccaca

SEQ ID NO: 9182 - DNA, 25 bp, Rattus norvegicus
aaagaggctcgggtcagtccccaca

SEQ ID NO: 9183 - DNA, 25 bp, Rattus norvegicus
aaagaggctcttaggctatttgcat

SEQ ID NO: 9184 - DNA, 25 bp, Rattus norvegicus
aaagaggctctttggctatttgcat

SEQ ID NO: 9185 - DNA, 25 bp, Rattus norvegicus
aaagaggctgagagccattcagact

SEQ ID NO: 9186 - DNA, 25 bp, Rattus norvegicus
aaagaggctgagtgccattcagact

SEQ ID NO: 9187 - DNA, 25 bp, Rattus norvegicus
aaagaggctggacatgtaattcggt

SEQ ID NO: 9188 - DNA, 25 bp, Rattus norvegicus
aaagaggctggacccttgcgagctt

SEQ ID NO: 9189 - DNA, 25 bp, Rattus norvegicus
aaagaggctggagatgtaattcggt

SEQ ID NO: 9190 - DNA, 25 bp, Rattus norvegicus
aaagaggctggagccttgcgagctt

SEQ ID NO: 9191 - DNA, 25 bp, Rattus norvegicus
aaagaggctgtccagtaaatctgat

SEQ ID NO: 9192 - DNA, 25 bp, Rattus norvegicus
aaagaggctgtcgagtaaatctgat

SEQ ID NO: 9193 - DNA, 25 bp, Rattus norvegicus
aaagaggcttctcctactgtcttga

SEQ ID NO: 9194 - DNA, 25 bp, Rattus norvegicus
aaagaggcttctgctactgtcttga

SEQ ID NO: 9195 - DNA, 25 bp, Rattus norvegicus
aaagagggacacagcttcgagtcaa

SEQ ID NO: 9196 - DNA, 25 bp, Rattus norvegicus
aaagagggacactgcttcgagtcaa

SEQ ID NO: 9197 - DNA, 25 bp, Rattus norvegicus
aaagagggcagtccgccccacgcag

SEQ ID NO: 9198 - DNA, 25 bp, Rattus norvegicus
aaagagggcagtgcgccccacgcag

SEQ ID NO: 9199 - DNA, 25 bp, Rattus norvegicus
aaagagggccaacagtccagctggt

SEQ ID NO: 9200 - DNA, 25 bp, Rattus norvegicus
aaagagggccaagagtccagctggt

SEQ ID NO: 9201 - DNA, 25 bp, Rattus norvegicus
aaagagggccctcagatgcttctgt

SEQ ID NO: 9202 - DNA, 25 bp, Rattus norvegicus
aaagagggccctgagatgcttctgt

SEQ ID NO: 9203 - DNA, 25 bp, Rattus norvegicus
aaagaggggtgtcggcatccccatc

SEQ ID NO: 9204 - DNA, 25 bp, Rattus norvegicus
aaagaggggtgtgggcatccccatc

SEQ ID NO: 9205 - DNA, 25 bp, Rattus norvegicus
aaagagggtgctcatgtgcttctca

SEQ ID NO: 9206 - DNA, 25 bp, Rattus norvegicus
aaagagggtgctgatgtgcttctca

SEQ ID NO: 9207 - DNA, 25 bp, Rattus norvegicus
aaagaggtcaccctggagaaccagc

SEQ ID NO: 9208 - DNA, 25 bp, Rattus norvegicus
aaagaggtcaccgtggagaaccagc

SEQ ID NO: 9209 - DNA, 25 bp, Rattus norvegicus
aaagaggtcaggatccgtgtgtcac

SEQ ID NO: 9210 - DNA, 25 bp, Rattus norvegicus
aaagaggtcaggttccgtgtgtcac

SEQ ID NO: 9211 - DNA, 25 bp, Rattus norvegicus
aaagaggtccttctgatacgatccc

SEQ ID NO: 9212 - DNA, 25 bp, Rattus norvegicus
aaagaggtccttgtgatacgatccc

SEQ ID NO: 9213 - DNA, 25 bp, Rattus norvegicus
aaagaggtcggccacctgaacatcc

SEQ ID NO: 9214 - DNA, 25 bp, Rattus norvegicus
aaagaggtcggcgacctgaacatcc

SEQ ID NO: 9215 - DNA, 25 bp, Rattus norvegicus
aaagaggtctctcgtcctgttacac

SEQ ID NO: 9216 - DNA, 25 bp, Rattus norvegicus
aaagaggtctctggtcctgttacac

SEQ ID NO: 9217 - DNA, 25 bp, Rattus norvegicus
aaagaggtgacccacgatctgctct

SEQ ID NO: 9218 - DNA, 25 bp, Rattus norvegicus
aaagaggtgaccgacgatctgctct

SEQ ID NO: 9219 - DNA, 25 bp, Rattus norvegicus
aaagaggttcacatggaagcttcca

SEQ ID NO: 9220 - DNA, 25 bp, Rattus norvegicus
aaagaggttcacttggaagcttcca

SEQ ID NO: 9221 - DNA, 25 bp, Rattus norvegicus
aaagagtacacacctgacggatcag

SEQ ID NO: 9222 - DNA, 25 bp, Rattus norvegicus
aaagagtacacagctgacggatcag

SEQ ID NO: 9223 - DNA, 25 bp, Rattus norvegicus
aaagagtaggctccagggcccagaa

SEQ ID NO: 9224 - DNA, 25 bp, Rattus norvegicus
aaagagtaggctgcagggcccagaa

SEQ ID NO: 9225 - DNA, 25 bp, Rattus norvegicus
aaagagtatgttcgcttcccctaga

SEQ ID NO: 9226 - DNA, 25 bp, Rattus norvegicus
aaagagtatgttggcttcccctaga

SEQ ID NO: 9227 - DNA, 25 bp, Rattus norvegicus
aaagagtcaagcactctgtccacct

SEQ ID NO: 9228 - DNA, 25 bp, Rattus norvegicus
aaagagtcaagctctctgtccacct

SEQ ID NO: 9229 - DNA, 25 bp, Rattus norvegicus
aaagagtcaccaaacatgccaaggg

SEQ ID NO: 9230 - DNA, 25 bp, Rattus norvegicus
aaagagtcaccatacatgccaaggg

SEQ ID NO: 9231 - DNA, 25 bp, Rattus norvegicus
aaagagtcacctcacatggtagctt

SEQ ID NO: 9232 - DNA, 25 bp, Rattus norvegicus
aaagagtcacctgacatggtagctt

SEQ ID NO: 9233 - DNA, 25 bp, Rattus norvegicus
aaagagtcagggagcttcaccgatg

SEQ ID NO: 9234 - DNA, 25 bp, Rattus norvegicus
aaagagtcagggtgcttcaccgatg

SEQ ID NO: 9235 - DNA, 25 bp, Rattus norvegicus
aaagagtccaataactgctgctcat

SEQ ID NO: 9236 - DNA, 25 bp, Rattus norvegicus
aaagagtccaattactgctgctcat

SEQ ID NO: 9237 - DNA, 25 bp, Rattus norvegicus
aaagagtccagcatctaagcccagg

SEQ ID NO: 9238 - DNA, 25 bp, Rattus norvegicus
aaagagtccagcttctaagcccagg

SEQ ID NO: 9239 - DNA, 25 bp, Rattus norvegicus
aaagagtcctcaagttcgcttatcc

SEQ ID NO: 9240 - DNA, 25 bp, Rattus norvegicus
aaagagtcctcatgttcgcttatcc

SEQ ID NO: 9241 - DNA, 25 bp, Rattus norvegicus
aaagagtccttgctaagtctgccac

SEQ ID NO: 9242 - DNA, 25 bp, Rattus norvegicus
aaagagtccttggtaagtctgccac

SEQ ID NO: 9243 - DNA, 25 bp, Rattus norvegicus
aaagagtcctttcctcagagcacaa

SEQ ID NO: 9244 - DNA, 25 bp, Rattus norvegicus
aaagagtcctttgctcagagcacaa

SEQ ID NO: 9245 - DNA, 25 bp, Rattus norvegicus
aaagagtctaatctcctcttctggc

SEQ ID NO: 9246 - DNA, 25 bp, Rattus norvegicus
aaagagtctaatgtcctcttctggc

SEQ ID NO: 9247 - DNA, 25 bp, Rattus norvegicus
aaagagtctccacattggtccggct

SEQ ID NO: 9248 - DNA, 25 bp, Rattus norvegicus
aaagagtctccagattggtccggct

SEQ ID NO: 9249 - DNA, 25 bp, Rattus norvegicus
aaagagtctgaacccacagtgcagc

SEQ ID NO: 9250 - DNA, 25 bp, Rattus norvegicus
aaagagtctgaagccacagtgcagc

SEQ ID NO: 9251 - DNA, 25 bp, Rattus norvegicus
aaagagtcttatccagcctctgagg

SEQ ID NO: 9252 - DNA, 25 bp, Rattus norvegicus
aaagagtcttatgcagcctctgagg

SEQ ID NO: 9253 - DNA, 25 bp, Rattus norvegicus
aaagagtgccatcgtattgaagtca

SEQ ID NO: 9254 - DNA, 25 bp, Rattus norvegicus
aaagagtgccatggtattgaagtca

SEQ ID NO: 9255 - DNA, 25 bp, Rattus norvegicus
aaagagtgggctccactgcacagac

SEQ ID NO: 9256 - DNA, 25 bp, Rattus norvegicus
aaagagtgggctgcactgcacagac

SEQ ID NO: 9257 - DNA, 25 bp, Rattus norvegicus
aaagagtggtgaccccatcgccaat

SEQ ID NO: 9258 - DNA, 25 bp, Rattus norvegicus
aaagagtggtgagcccatcgccaat

SEQ ID NO: 9259 - DNA, 25 bp, Rattus norvegicus
aaagagtgtcacacctggctgtctc

SEQ ID NO: 9260 - DNA, 25 bp, Rattus norvegicus
aaagagtgtcactcctggctgtctc

SEQ ID NO: 9261 - DNA, 25 bp, Rattus norvegicus
aaagagtgtccaccccttgacagat

SEQ ID NO: 9262 - DNA, 25 bp, Rattus norvegicus
aaagagtgtccacctcttcatcact

SEQ ID NO: 9263 - DNA, 25 bp, Rattus norvegicus
aaagagtgtccagcccttgacagat

SEQ ID NO: 9264 - DNA, 25 bp, Rattus norvegicus
aaagagtgtccagctcttcatcact

SEQ ID NO: 9265 - DNA, 25 bp, Rattus norvegicus
aaagagtgtgtcaactttgcctcct

SEQ ID NO: 9266 - DNA, 25 bp, Rattus norvegicus
aaagagtgtgtctactttgcctcct

SEQ ID NO: 9267 - DNA, 25 bp, Rattus norvegicus
aaagagttacctactgggccatcgg

SEQ ID NO: 9268 - DNA, 25 bp, Rattus norvegicus
aaagagttaccttctgggccatcgg

SEQ ID NO: 9269 - DNA, 25 bp, Rattus norvegicus
aaagagttaggtatgtgtagctgta

SEQ ID NO: 9270 - DNA, 25 bp, Rattus norvegicus
aaagagttaggtttgtgtagctgta

SEQ ID NO: 9271 - DNA, 25 bp, Rattus norvegicus
aaagagttcagaattcagcacccac

SEQ ID NO: 9272 - DNA, 25 bp, Rattus norvegicus
aaagagttcagatttcagcacccac

SEQ ID NO: 9273 - DNA, 25 bp, Rattus norvegicus
aaagagttcagcctttctacgctgc

SEQ ID NO: 9274 - DNA, 25 bp, Rattus norvegicus
aaagagttcagcgtttctacgctgc

SEQ ID NO: 9275 - DNA, 25 bp, Rattus norvegicus
aaagagttccagctttgaatctgct

SEQ ID NO: 9276 - DNA, 25 bp, Rattus norvegicus
aaagagttccaggtttgaatctgct

SEQ ID NO: 9277 - DNA, 25 bp, Rattus norvegicus
aaagagttccttcgccctgctttgt

SEQ ID NO: 9278 - DNA, 25 bp, Rattus norvegicus
aaagagttccttggccctgctttgt

SEQ ID NO: 9279 - DNA, 25 bp, Rattus norvegicus
aaagagttctggcttggtcccatct

SEQ ID NO: 9280 - DNA, 25 bp, Rattus norvegicus
aaagagttctgggttggtcccatct

SEQ ID NO: 9281 - DNA, 25 bp, Rattus norvegicus
aaagagttcttgcaggtatctcaaa

SEQ ID NO: 9282 - DNA, 25 bp, Rattus norvegicus
aaagagttcttggaggtatctcaaa

SEQ ID NO: 9283 - DNA, 25 bp, Rattus norvegicus
aaagagttgactcccattacgaggt

SEQ ID NO: 9284 - DNA, 25 bp, Rattus norvegicus
aaagagttgactgccattacgaggt

SEQ ID NO: 9285 - DNA, 25 bp, Rattus norvegicus
aaagagttggctccccaaggcgaac

SEQ ID NO: 9286 - DNA, 25 bp, Rattus norvegicus
aaagagttggctgcccaaggcgaac

SEQ ID NO: 9287 - DNA, 25 bp, Rattus norvegicus
aaagagttgtgacagcagtgtgcct

SEQ ID NO: 9288 - DNA, 25 bp, Rattus norvegicus
aaagagttgtgagagcagtgtgcct

SEQ ID NO: 9289 - DNA, 25 bp, Rattus norvegicus
aaagagtttgccatcttccagcctg

SEQ ID NO: 9290 - DNA, 25 bp, Rattus norvegicus
aaagagtttgccttcttccagcctg

SEQ ID NO: 9291 - DNA, 25 bp, Rattus norvegicus
aaagagtttggtcaggccctccgag

SEQ ID NO: 9292 - DNA, 25 bp, Rattus norvegicus
aaagagtttggtgaggccctccgag

SEQ ID NO: 9293 - DNA, 25 bp, Rattus norvegicus
aaagagtttttgctgatgcaatggt

SEQ ID NO: 9294 - DNA, 25 bp, Rattus norvegicus
aaagagtttttggtgatgcaatggt

SEQ ID NO: 9295 - DNA, 25 bp, Rattus norvegicus
aaagataaactcctgacgtcctgtc

SEQ ID NO: 9296 - DNA, 25 bp, Rattus norvegicus
aaagataaactcgtgacgtcctgtc

SEQ ID NO: 9297 - DNA, 25 bp, Rattus norvegicus
aaagataacgccagccgtcttggaa

SEQ ID NO: 9298 - DNA, 25 bp, Rattus norvegicus
aaagataacgcctgccgtcttggaa

SEQ ID NO: 9299 - DNA, 25 bp, Rattus norvegicus
aaagatacagcaacaatttcaagtg

SEQ ID NO: 9300 - DNA, 25 bp, Rattus norvegicus
aaagatacagcatcaatttcaagtg

SEQ ID NO: 9301 - DNA, 25 bp, Rattus norvegicus
aaagatacaggtccccgcaaacgta

SEQ ID NO: 9302 - DNA, 25 bp, Rattus norvegicus
aaagatacaggtgcccgcaaacgta

SEQ ID NO: 9303 - DNA, 25 bp, Rattus norvegicus
aaagatacatctcacagtcccagta

SEQ ID NO: 9304 - DNA, 25 bp, Rattus norvegicus
aaagatacatctgacagtcccagta

SEQ ID NO: 9305 - DNA, 25 bp, Rattus norvegicus
aaagataccacaaacgcgtccaatg

SEQ ID NO: 9306 - DNA, 25 bp, Rattus norvegicus
aaagataccacatacgcgtccaatg

SEQ ID NO: 9307 - DNA, 25 bp, Rattus norvegicus
aaagatacctcaaactcgtctgcga

SEQ ID NO: 9308 - DNA, 25 bp, Rattus norvegicus
aaagatacctcatactcgtctgcga

SEQ ID NO: 9309 - DNA, 25 bp, Rattus norvegicus
aaagatacggcgctggctgacctcc

SEQ ID NO: 9310 - DNA, 25 bp, Rattus norvegicus
aaagatacggcggtggctgacctcc

SEQ ID NO: 9311 - DNA, 25 bp, Rattus norvegicus
aaagatactgaacaggaggcgcctg

SEQ ID NO: 9312 - DNA, 25 bp, Rattus norvegicus
aaagatactgaagaggaggcgcctg

SEQ ID NO: 9313 - DNA, 25 bp, Rattus norvegicus
aaagatagagctccctcttggccga

SEQ ID NO: 9314 - DNA, 25 bp, Rattus norvegicus
aaagatagagctgcctcttggccga

SEQ ID NO: 9315 - DNA, 25 bp, Rattus norvegicus
aaagatagccaccaaacctgaactc

SEQ ID NO: 9316 - DNA, 25 bp, Rattus norvegicus
aaagatagccacgaaacctgaactc

SEQ ID NO: 9317 - DNA, 25 bp, Rattus norvegicus
aaagatagccccactgaccagaaga

SEQ ID NO: 9318 - DNA, 25 bp, Rattus norvegicus
aaagatagcccctctgaccagaaga

SEQ ID NO: 9319 - DNA, 25 bp, Rattus norvegicus
aaagatagcgccatggtgatcacat

SEQ ID NO: 9320 - DNA, 25 bp, Rattus norvegicus
aaagatagcgccttggtgatcacat

SEQ ID NO: 9321 - DNA, 25 bp, Rattus norvegicus
aaagatagctttctcactccatcaa

SEQ ID NO: 9322 - DNA, 25 bp, Rattus norvegicus
aaagatagctttgtcactccatcaa

SEQ ID NO: 9323 - DNA, 25 bp, Rattus norvegicus
aaagatagggatagcgcctgtgatt

SEQ ID NO: 9324 - DNA, 25 bp, Rattus norvegicus
aaagatagggattgcgcctgtgatt

SEQ ID NO: 9325 - DNA, 25 bp, Rattus norvegicus
aaagatagtattactgcctcccaaa

SEQ ID NO: 9326 - DNA, 25 bp, Rattus norvegicus
aaagatagtatttctgcctcccaaa

SEQ ID NO: 9327 - DNA, 25 bp, Rattus norvegicus
aaagatagtgcgctcgaggcttcta

SEQ ID NO: 9328 - DNA, 25 bp, Rattus norvegicus
aaagatagtgcggtcgaggcttcta

SEQ ID NO: 9329 - DNA, 25 bp, Rattus norvegicus
aaagatagtgctaccagccacagaa

SEQ ID NO: 9330 - DNA, 25 bp, Rattus norvegicus
aaagatagtgcttccagccacagaa

SEQ ID NO: 9331 - DNA, 25 bp, Rattus norvegicus
aaagatatactccaccttctgggct

SEQ ID NO: 9332 - DNA, 25 bp, Rattus norvegicus
aaagatatactcgaccttctgggct

SEQ ID NO: 9333 - DNA, 25 bp, Rattus norvegicus
aaagatatcccacagtgcaccttgt

SEQ ID NO: 9334 - DNA, 25 bp, Rattus norvegicus
aaagatatcccagagtgcaccttgt

SEQ ID NO: 9335 - DNA, 25 bp, Rattus norvegicus
aaagatatctaaatcacgccccact

SEQ ID NO: 9336 - DNA, 25 bp, Rattus norvegicus
aaagatatctaattcacgccccact

SEQ ID NO: 9337 - DNA, 25 bp, Rattus norvegicus
aaagatatgcaaaaccacgccaggt

SEQ ID NO: 9338 - DNA, 25 bp, Rattus norvegicus
aaagatatgcaataccacgccaggt

SEQ ID NO: 9339 - DNA, 25 bp, Rattus norvegicus
aaagatatgggccttctcttgtctg

SEQ ID NO: 9340 - DNA, 25 bp, Rattus norvegicus
aaagatatgggcgttctcttgtctg

SEQ ID NO: 9341 - DNA, 25 bp, Rattus norvegicus
aaagatatttgcactttgccagcat

SEQ ID NO: 9342 - DNA, 25 bp, Rattus norvegicus
aaagatatttgctctttgccagcat

SEQ ID NO: 9343 - DNA, 25 bp, Rattus norvegicus
aaagatcaatgaccacagggccgtg

SEQ ID NO: 9344 - DNA, 25 bp, Rattus norvegicus
aaagatcaatgagcacagggccgtg

SEQ ID NO: 9345 - DNA, 25 bp, Rattus norvegicus
aaagatcacatgctactcctgttgt

SEQ ID NO: 9346 - DNA, 25 bp, Rattus norvegicus
aaagatcacatggtactcctgttgt

SEQ ID NO: 9347 - DNA, 25 bp, Rattus norvegicus
aaagatcacttactctagtcacata

SEQ ID NO: 9348 - DNA, 25 bp, Rattus norvegicus
aaagatcacttagtctagtcacata

SEQ ID NO: 9349 - DNA, 25 bp, Rattus norvegicus
aaagatcaggcaagacctcccaggg

SEQ ID NO: 9350 - DNA, 25 bp, Rattus norvegicus
aaagatcaggcatgacctcccaggg

SEQ ID NO: 9351 - DNA, 25 bp, Rattus norvegicus
aaagatcatcttactcctctttaca

SEQ ID NO: 9352 - DNA, 25 bp, Rattus norvegicus
aaagatcatctttctcctctttaca

SEQ ID NO: 9353 - DNA, 25 bp, Rattus norvegicus
aaagatcatgtgagagctctcaact

SEQ ID NO: 9354 - DNA, 25 bp, Rattus norvegicus
aaagatcatgtgtgagctctcaact

SEQ ID NO: 9355 - DNA, 25 bp, Rattus norvegicus
aaagatcattaccatgccacctacc

SEQ ID NO: 9356 - DNA, 25 bp, Rattus norvegicus
aaagatcattacgatgccacctacc

SEQ ID NO: 9357 - DNA, 25 bp, Rattus norvegicus
aaagatcattcgacaccctgagtat

SEQ ID NO: 9358 - DNA, 25 bp, Rattus norvegicus
aaagatcattcgtcaccctgagtat

SEQ ID NO: 9359 - DNA, 25 bp, Rattus norvegicus
aaagatccacatagggtaccctggt

SEQ ID NO: 9360 - DNA, 25 bp, Rattus norvegicus
aaagatccacattgggtaccctggt

SEQ ID NO: 9361 - DNA, 25 bp, Rattus norvegicus
aaagatccagagacctaccatagcc

SEQ ID NO: 9362 - DNA, 25 bp, Rattus norvegicus
aaagatccagagtcctaccatagcc

SEQ ID NO: 9363 - DNA, 25 bp, Rattus norvegicus
aaagatccagatagcgcaattatta

SEQ ID NO: 9364 - DNA, 25 bp, Rattus norvegicus
aaagatccagatccagagaccccag

SEQ ID NO: 9365 - DNA, 25 bp, Rattus norvegicus
aaagatccagatgcagagaccccag

SEQ ID NO: 9366 - DNA, 25 bp, Rattus norvegicus
aaagatccagattgcgcaattatta

SEQ ID NO: 9367 - DNA, 25 bp, Rattus norvegicus
aaagatccagcacccgtgactgaat

SEQ ID NO: 9368 - DNA, 25 bp, Rattus norvegicus
aaagatccagcagccgtgactgaat

SEQ ID NO: 9369 - DNA, 25 bp, Rattus norvegicus
aaagatccatcccttttggttccat

SEQ ID NO: 9370 - DNA, 25 bp, Rattus norvegicus
aaagatccatccgttttggttccat

SEQ ID NO: 9371 - DNA, 25 bp, Rattus norvegicus
aaagatcccagcatgttctagatga

SEQ ID NO: 9372 - DNA, 25 bp, Rattus norvegicus
aaagatcccagcttgttctagatga

SEQ ID NO: 9373 - DNA, 25 bp, Rattus norvegicus
aaagatccccagaacacagattgtg

SEQ ID NO: 9374 - DNA, 25 bp, Rattus norvegicus
aaagatccccagtacacagattgtg

SEQ ID NO: 9375 - DNA, 25 bp, Rattus norvegicus
aaagatccccgaattgaccgattgc

SEQ ID NO: 9376 - DNA, 25 bp, Rattus norvegicus
aaagatccccgatttgaccgattgc

SEQ ID NO: 9377 - DNA, 25 bp, Rattus norvegicus
aaagatccggtgatctttgcctttg

SEQ ID NO: 9378 - DNA, 25 bp, Rattus norvegicus
aaagatccggtgttctttgcctttg

SEQ ID NO: 9379 - DNA, 25 bp, Rattus norvegicus
aaagatcctcagcttaaagttccag

SEQ ID NO: 9380 - DNA, 25 bp, Rattus norvegicus
aaagatcctcaggttaaagttccag

SEQ ID NO: 9381 - DNA, 25 bp, Rattus norvegicus
aaagatcctcgacattgccaacatg

SEQ ID NO: 9382 - DNA, 25 bp, Rattus norvegicus
aaagatcctcgagattgccaacatg

SEQ ID NO: 9383 - DNA, 25 bp, Rattus norvegicus
aaagatcctctaagtggcctgctac

SEQ ID NO: 9384 - DNA, 25 bp, Rattus norvegicus
aaagatcctctatgtggcctgctac

SEQ ID NO: 9385 - DNA, 25 bp, Rattus norvegicus
aaagatcctgtgaaacatgaaatga

SEQ ID NO: 9386 - DNA, 25 bp, Rattus norvegicus
aaagatcctgtgtaacatgaaatga

SEQ ID NO: 9387 - DNA, 25 bp, Rattus norvegicus
aaagatcctgttccttggctcgtgg

SEQ ID NO: 9388 - DNA, 25 bp, Rattus norvegicus
aaagatcctgttgcttggctcgtgg

SEQ ID NO: 9389 - DNA, 25 bp, Rattus norvegicus
aaagatccttagaggcgctctacat

SEQ ID NO: 9390 - DNA, 25 bp, Rattus norvegicus
aaagatccttagtggcgctctacat

SEQ ID NO: 9391 - DNA, 25 bp, Rattus norvegicus
aaagatccttgcaacatgtccagct

SEQ ID NO: 9392 - DNA, 25 bp, Rattus norvegicus
aaagatccttgctacatgtccagct

SEQ ID NO: 9393 - DNA, 25 bp, Rattus norvegicus
aaagatcgaggcatgtgcctgccag

SEQ ID NO: 9394 - DNA, 25 bp, Rattus norvegicus
aaagatcgaggcttgtgcctgccag

SEQ ID NO: 9395 - DNA, 25 bp, Rattus norvegicus
aaagatcgctagatgacgccacaga

SEQ ID NO: 9396 - DNA, 25 bp, Rattus norvegicus
aaagatcgctagttgacgccacaga

SEQ ID NO: 9397 - DNA, 25 bp, Rattus norvegicus
aaagatcgctctcacattccattat

SEQ ID NO: 9398 - DNA, 25 bp, Rattus norvegicus
aaagatcgctctgacattccattat

SEQ ID NO: 9399 - DNA, 25 bp, Rattus norvegicus
aaagatcggcctctacagcctctga

SEQ ID NO: 9400 - DNA, 25 bp, Rattus norvegicus
aaagatcggcctgtacagcctctga

SEQ ID NO: 9401 - DNA, 25 bp, Rattus norvegicus
aaagatcgggaccatttccaactgg

SEQ ID NO: 9402 - DNA, 25 bp, Rattus norvegicus
aaagatcgggacgatttccaactgg

SEQ ID NO: 9403 - DNA, 25 bp, Rattus norvegicus
aaagatcgtctaccgaagattcaga

SEQ ID NO: 9404 - DNA, 25 bp, Rattus norvegicus
aaagatcgtctagcgaagattcaga

SEQ ID NO: 9405 - DNA, 25 bp, Rattus norvegicus
aaagatctaaccaatgccaagccca

SEQ ID NO: 9406 - DNA, 25 bp, Rattus norvegicus
aaagatctaacctatgccaagccca

SEQ ID NO: 9407 - DNA, 25 bp, Rattus norvegicus
aaagatctccctctggtgactgaat

SEQ ID NO: 9408 - DNA, 25 bp, Rattus norvegicus
aaagatctccctgtggtgactgaat

SEQ ID NO: 9409 - DNA, 25 bp, Rattus norvegicus
aaagatctcctccattttcgatcgg

SEQ ID NO: 9410 - DNA, 25 bp, Rattus norvegicus
aaagatctcctcgattttcgatcgg

SEQ ID NO: 9411 - DNA, 25 bp, Rattus norvegicus
aaagatctccttagtgattccctgc

SEQ ID NO: 9412 - DNA, 25 bp, Rattus norvegicus
aaagatctcctttgtgattccctgc

SEQ ID NO: 9413 - DNA, 25 bp, Rattus norvegicus
aaagatctgcaaacccctccatgaa

SEQ ID NO: 9414 - DNA, 25 bp, Rattus norvegicus
aaagatctgcaatcccctccatgaa

SEQ ID NO: 9415 - DNA, 25 bp, Rattus norvegicus
aaagatctggtcatcagccttgaga

SEQ ID NO: 9416 - DNA, 25 bp, Rattus norvegicus
aaagatctggtcttcagccttgaga

SEQ ID NO: 9417 - DNA, 25 bp, Rattus norvegicus
aaagatctggttatgttccactcca

SEQ ID NO: 9418 - DNA, 25 bp, Rattus norvegicus
aaagatctggttttgttccactcca

SEQ ID NO: 9419 - DNA, 25 bp, Rattus norvegicus
aaagatcttccgagcctcactgttg

SEQ ID NO: 9420 - DNA, 25 bp, Rattus norvegicus
aaagatcttccgtgcctcactgttg

SEQ ID NO: 9421 - DNA, 25 bp, Rattus norvegicus
aaagatcttggtcctccacctgaag

SEQ ID NO: 9422 - DNA, 25 bp, Rattus norvegicus
aaagatcttggtgctccacctgaag

SEQ ID NO: 9423 - DNA, 25 bp, Rattus norvegicus
aaagatcttttccagtcaggcatcc

SEQ ID NO: 9424 - DNA, 25 bp, Rattus norvegicus
aaagatcttttcgagtcaggcatcc

SEQ ID NO: 9425 - DNA, 25 bp, Rattus norvegicus
aaagatgaccagcactccggctgac

SEQ ID NO: 9426 - DNA, 25 bp, Rattus norvegicus
aaagatgaccaggactccggctgac

SEQ ID NO: 9427 - DNA, 25 bp, Rattus norvegicus
aaagatgacccgacagctctgtgtc

SEQ ID NO: 9428 - DNA, 25 bp, Rattus norvegicus
aaagatgacccgtcagctctgtgtc

SEQ ID NO: 9429 - DNA, 25 bp, Rattus norvegicus
aaagatgacctcctggcattggact

SEQ ID NO: 9430 - DNA, 25 bp, Rattus norvegicus
aaagatgacctcgtggcattggact

SEQ ID NO: 9431 - DNA, 25 bp, Rattus norvegicus
aaagatgaccttagcttgtgcatat

SEQ ID NO: 9432 - DNA, 25 bp, Rattus norvegicus
aaagatgacctttgcttgtgcatat

SEQ ID NO: 9433 - DNA, 25 bp, Rattus norvegicus
aaagatgacgagaagcaagcccctg

SEQ ID NO: 9434 - DNA, 25 bp, Rattus norvegicus
aaagatgacgagtagcaagcccctg

SEQ ID NO: 9435 - DNA, 25 bp, Rattus norvegicus
aaagatgactgcatcctgggagctg

SEQ ID NO: 9436 - DNA, 25 bp, Rattus norvegicus
aaagatgactgcttcctgggagctg

SEQ ID NO: 9437 - DNA, 25 bp, Rattus norvegicus
aaagatgagaccatcttgtcctctg

SEQ ID NO: 9438 - DNA, 25 bp, Rattus norvegicus
aaagatgagaccttcttgtcctctg

SEQ ID NO: 9439 - DNA, 25 bp, Rattus norvegicus
aaagatgcaaccagcccctacaagg

SEQ ID NO: 9440 - DNA, 25 bp, Rattus norvegicus
aaagatgcaacctgcccctacaagg

SEQ ID NO: 9441 - DNA, 25 bp, Rattus norvegicus
aaagatgcaagtctcgctctggctt

SEQ ID NO: 9442 - DNA, 25 bp, Rattus norvegicus
aaagatgcaagtgtcgctctggctt

SEQ ID NO: 9443 - DNA, 25 bp, Rattus norvegicus
aaagatgcaccaaacctgatagaaa

SEQ ID NO: 9444 - DNA, 25 bp, Rattus norvegicus
aaagatgcaccatacctgatagaaa

SEQ ID NO: 9445 - DNA, 25 bp, Rattus norvegicus
aaagatgcatctcgctttggagaaa

SEQ ID NO: 9446 - DNA, 25 bp, Rattus norvegicus
aaagatgcatctggctttggagaaa

SEQ ID NO: 9447 - DNA, 25 bp, Rattus norvegicus
aaagatgccatcattccctgtgttt

SEQ ID NO: 9448 - DNA, 25 bp, Rattus norvegicus
aaagatgccatctttccctgtgttt

SEQ ID NO: 9449 - DNA, 25 bp, Rattus norvegicus
aaagatgcccatcattgtgaatgtt

SEQ ID NO: 9450 - DNA, 25 bp, Rattus norvegicus
aaagatgcccatgattgtgaatgtt

SEQ ID NO: 9451 - DNA, 25 bp, Rattus norvegicus
aaagatgccctgctgtttcggagag

SEQ ID NO: 9452 - DNA, 25 bp, Rattus norvegicus
aaagatgccctggtgtttcggagag

SEQ ID NO: 9453 - DNA, 25 bp, Rattus norvegicus
aaagatgcccttaggattggattga

SEQ ID NO: 9454 - DNA, 25 bp, Rattus norvegicus
aaagatgccctttggattggattga

SEQ ID NO: 9455 - DNA, 25 bp, Rattus norvegicus
aaagatgcgctcactttcatagcac

SEQ ID NO: 9456 - DNA, 25 bp, Rattus norvegicus
aaagatgcgctctctttcatagcac

SEQ ID NO: 9457 - DNA, 25 bp, Rattus norvegicus
aaagatgcggatcgcagactcttcg

SEQ ID NO: 9458 - DNA, 25 bp, Rattus norvegicus
aaagatgcggatggcagactcttcg

SEQ ID NO: 9459 - DNA, 25 bp, Rattus norvegicus
aaagatgctattccctgtgcttacg

SEQ ID NO: 9460 - DNA, 25 bp, Rattus norvegicus
aaagatgctattgcctgtgcttacg

SEQ ID NO: 9461 - DNA, 25 bp, Rattus norvegicus
aaagatgctcagagggcacgtagac

SEQ ID NO: 9462 - DNA, 25 bp, Rattus norvegicus
aaagatgctcagtgggcacgtagac

SEQ ID NO: 9463 - DNA, 25 bp, Rattus norvegicus
aaagatgctcctcgctttgattgcg

SEQ ID NO: 9464 - DNA, 25 bp, Rattus norvegicus
aaagatgctcctggctttgattgcg

SEQ ID NO: 9465 - DNA, 25 bp, Rattus norvegicus
aaagatgctgctacgtctgtggttt

SEQ ID NO: 9466 - DNA, 25 bp, Rattus norvegicus
aaagatgctgcttcgtctgtggttt

SEQ ID NO: 9467 - DNA, 25 bp, Rattus norvegicus
aaagatgcttctcagggattggcca

SEQ ID NO: 9468 - DNA, 25 bp, Rattus norvegicus
aaagatgcttctgagggattggcca

SEQ ID NO: 9469 - DNA, 25 bp, Rattus norvegicus
aaagatggacgcagcctgggctccc

SEQ ID NO: 9470 - DNA, 25 bp, Rattus norvegicus
aaagatggacgctgcctgggctccc

SEQ ID NO: 9471 - DNA, 25 bp, Rattus norvegicus
aaagatggagctcacggttttacct

SEQ ID NO: 9472 - DNA, 25 bp, Rattus norvegicus
aaagatggagctgacggttttacct

SEQ ID NO: 9473 - DNA, 25 bp, Rattus norvegicus
aaagatggatatcggctcctgctgg

SEQ ID NO: 9474 - DNA, 25 bp, Rattus norvegicus
aaagatggatatgggctcctgctgg

SEQ ID NO: 9475 - DNA, 25 bp, Rattus norvegicus
aaagatggcaatagtttcgtctcga

SEQ ID NO: 9476 - DNA, 25 bp, Rattus norvegicus
aaagatggcaattgtttcgtctcga

SEQ ID NO: 9477 - DNA, 25 bp, Rattus norvegicus
aaagatggcagaaaccacccttacc

SEQ ID NO: 9478 - DNA, 25 bp, Rattus norvegicus
aaagatggcagataccacccttacc

SEQ ID NO: 9479 - DNA, 25 bp, Rattus norvegicus
aaagatggcattacctagagttgtg

SEQ ID NO: 9480 - DNA, 25 bp, Rattus norvegicus
aaagatggcatttcctagagttgtg

SEQ ID NO: 9481 - DNA, 25 bp, Rattus norvegicus
aaagatggccacaggctcttcaaga

SEQ ID NO: 9482 - DNA, 25 bp, Rattus norvegicus
aaagatggccacagtttatcctgaa

SEQ ID NO: 9483 - DNA, 25 bp, Rattus norvegicus
aaagatggccaccaatgatgctgtt

SEQ ID NO: 9484 - DNA, 25 bp, Rattus norvegicus
aaagatggccacgaatgatgctgtt

SEQ ID NO: 9485 - DNA, 25 bp, Rattus norvegicus
aaagatggccactggctcttcaaga

SEQ ID NO: 9486 - DNA, 25 bp, Rattus norvegicus
aaagatggccactgtttatcctgaa

SEQ ID NO: 9487 - DNA, 25 bp, Rattus norvegicus
aaagatggccccagtgtcagctgat

SEQ ID NO: 9488 - DNA, 25 bp, Rattus norvegicus
aaagatggcccctgtgtcagctgat

SEQ ID NO: 9489 - DNA, 25 bp, Rattus norvegicus
aaagatggccttagcttttggtgtg

SEQ ID NO: 9490 - DNA, 25 bp, Rattus norvegicus
aaagatggccttctgttcatgaagt

SEQ ID NO: 9491 - DNA, 25 bp, Rattus norvegicus
aaagatggccttgtgttcatgaagt

SEQ ID NO: 9492 - DNA, 25 bp, Rattus norvegicus
aaagatggcctttgcttttggtgtg

SEQ ID NO: 9493 - DNA, 25 bp, Rattus norvegicus
aaagatggctaacgaccctggtgtt

SEQ ID NO: 9494 - DNA, 25 bp, Rattus norvegicus
aaagatggctaaggaccctggtgtt

SEQ ID NO: 9495 - DNA, 25 bp, Rattus norvegicus
aaagatggctcgctgttttagaaca

SEQ ID NO: 9496 - DNA, 25 bp, Rattus norvegicus
aaagatggctcggtgttttagaaca

SEQ ID NO: 9497 - DNA, 25 bp, Rattus norvegicus
aaagatggctgacatgtacacccgc

SEQ ID NO: 9498 - DNA, 25 bp, Rattus norvegicus
aaagatggctgagatgtacacccgc

SEQ ID NO: 9499 - DNA, 25 bp, Rattus norvegicus
aaagatggctttcctatgaggaagt

SEQ ID NO: 9500 - DNA, 25 bp, Rattus norvegicus
aaagatggctttgctatgaggaagt

SEQ ID NO: 9501 - DNA, 25 bp, Rattus norvegicus
aaagatgggaagctattgtgtaaac

SEQ ID NO: 9502 - DNA, 25 bp, Rattus norvegicus
aaagatgggaaggtattgtgtaaac

SEQ ID NO: 9503 - DNA, 25 bp, Rattus norvegicus
aaagatgggctcctgttgtgcacac

SEQ ID NO: 9504 - DNA, 25 bp, Rattus norvegicus
aaagatgggctcgtgttgtgcacac

SEQ ID NO: 9505 - DNA, 25 bp, Rattus norvegicus
aaagatgggctgactgtgtagatat

SEQ ID NO: 9506 - DNA, 25 bp, Rattus norvegicus
aaagatgggctgtctgtgtagatat

SEQ ID NO: 9507 - DNA, 25 bp, Rattus norvegicus
aaagatggtgttctcctgccatcta

SEQ ID NO: 9508 - DNA, 25 bp, Rattus norvegicus
aaagatggtgttgtcctgccatcta

SEQ ID NO: 9509 - DNA, 25 bp, Rattus norvegicus
aaagatggttgcatccttgcaaagt

SEQ ID NO: 9510 - DNA, 25 bp, Rattus norvegicus
aaagatggttgcttccttgcaaagt

SEQ ID NO: 9511 - DNA, 25 bp, Rattus norvegicus
aaagatgtataaactgccggcctcc

SEQ ID NO: 9512 - DNA, 25 bp, Rattus norvegicus
aaagatgtataatctgccggcctcc

SEQ ID NO: 9513 - DNA, 25 bp, Rattus norvegicus
aaagatgtcaccatcctttctattc

SEQ ID NO: 9514 - DNA, 25 bp, Rattus norvegicus
aaagatgtcaccttcctttctattc

SEQ ID NO: 9515 - DNA, 25 bp, Rattus norvegicus
aaagatgtcccaccatgggcatcat

SEQ ID NO: 9516 - DNA, 25 bp, Rattus norvegicus
aaagatgtcccagcatgggcatcat

SEQ ID NO: 9517 - DNA, 25 bp, Rattus norvegicus
aaagatgtctaccttgtcccgttgt

SEQ ID NO: 9518 - DNA, 25 bp, Rattus norvegicus
aaagatgtctacgttgtcccgttgt

SEQ ID NO: 9519 - DNA, 25 bp, Rattus norvegicus
aaagatgtctcaccgaagtgcttgc

SEQ ID NO: 9520 - DNA, 25 bp, Rattus norvegicus
aaagatgtctcagcgaagtgcttgc

SEQ ID NO: 9521 - DNA, 25 bp, Rattus norvegicus
aaagatgtctctaagctgcaagctg

SEQ ID NO: 9522 - DNA, 25 bp, Rattus norvegicus
aaagatgtctctctcaaggtgacct

SEQ ID NO: 9523 - DNA, 25 bp, Rattus norvegicus
aaagatgtctctgtcaaggtgacct

SEQ ID NO: 9524 - DNA, 25 bp, Rattus norvegicus
aaagatgtctcttagctgcaagctg

SEQ ID NO: 9525 - DNA, 25 bp, Rattus norvegicus
aaagatgtcttgactctgtccctgc

SEQ ID NO: 9526 - DNA, 25 bp, Rattus norvegicus
aaagatgtcttgtctctgtccctgc

SEQ ID NO: 9527 - DNA, 25 bp, Rattus norvegicus
aaagatgtgaatcccagcacctttc

SEQ ID NO: 9528 - DNA, 25 bp, Rattus norvegicus
aaagatgtgaatgccagcacctttc

SEQ ID NO: 9529 - DNA, 25 bp, Rattus norvegicus
aaagatgtgcctatatgatgacctg

SEQ ID NO: 9530 - DNA, 25 bp, Rattus norvegicus
aaagatgtgcctttatgatgacctg

SEQ ID NO: 9531 - DNA, 25 bp, Rattus norvegicus
aaagatgtggctcagtttctgtacc

SEQ ID NO: 9532 - DNA, 25 bp, Rattus norvegicus
aaagatgtggctgagtttctgtacc

SEQ ID NO: 9533 - DNA, 25 bp, Rattus norvegicus
aaagatgtgggactcgtctgaaaca

SEQ ID NO: 9534 - DNA, 25 bp, Rattus norvegicus
aaagatgtgggagtcgtctgaaaca

SEQ ID NO: 9535 - DNA, 25 bp, Rattus norvegicus
aaagatgtgtatccagtgctgcagc

SEQ ID NO: 9536 - DNA, 25 bp, Rattus norvegicus
aaagatgtgtatcccctctgttggg

SEQ ID NO: 9537 - DNA, 25 bp, Rattus norvegicus
aaagatgtgtatgcagtgctgcagc

SEQ ID NO: 9538 - DNA, 25 bp, Rattus norvegicus
aaagatgtgtatgccctctgttggg

SEQ ID NO: 9539 - DNA, 25 bp, Rattus norvegicus
aaagatgtgtgtctgggacctcata

SEQ ID NO: 9540 - DNA, 25 bp, Rattus norvegicus
aaagatgtgtgtgtgggacctcata

SEQ ID NO: 9541 - DNA, 25 bp, Rattus norvegicus
aaagatgttactctcctgtccatgg

SEQ ID NO: 9542 - DNA, 25 bp, Rattus norvegicus
aaagatgttactgtcctgtccatgg

SEQ ID NO: 9543 - DNA, 25 bp, Rattus norvegicus
aaagatgttaggcacggagtgccat

SEQ ID NO: 9544 - DNA, 25 bp, Rattus norvegicus
aaagatgttagggacggagtgccat

SEQ ID NO: 9545 - DNA, 25 bp, Rattus norvegicus
aaagatgttagtactcctgtgtggg

SEQ ID NO: 9546 - DNA, 25 bp, Rattus norvegicus
aaagatgttagttctcctgtgtggg

SEQ ID NO: 9547 - DNA, 25 bp, Rattus norvegicus
aaagatgttattcagctgggccagt

SEQ ID NO: 9548 - DNA, 25 bp, Rattus norvegicus
aaagatgttattgagctgggccagt

SEQ ID NO: 9549 - DNA, 25 bp, Rattus norvegicus
aaagatgttcagaggtgctgctaca

SEQ ID NO: 9550 - DNA, 25 bp, Rattus norvegicus
aaagatgttcagtggtgctgctaca

SEQ ID NO: 9551 - DNA, 25 bp, Rattus norvegicus
aaagatgttgcaagctgggcatggt

SEQ ID NO: 9552 - DNA, 25 bp, Rattus norvegicus
aaagatgttgcatgctgggcatggt

SEQ ID NO: 9553 - DNA, 25 bp, Rattus norvegicus
aaagatgttttgattggcagttgtt

SEQ ID NO: 9554 - DNA, 25 bp, Rattus norvegicus
aaagatgttttgtttggcagttgtt

SEQ ID NO: 9555 - DNA, 25 bp, Rattus norvegicus
aaagatgtttttacctagctatgaa

SEQ ID NO: 9556 - DNA, 25 bp, Rattus norvegicus
aaagatgtttttactcccacagaag

SEQ ID NO: 9557 - DNA, 25 bp, Rattus norvegicus
aaagatgttttttcctagctatgaa

SEQ ID NO: 9558 - DNA, 25 bp, Rattus norvegicus
aaagatgttttttctcccacagaag

SEQ ID NO: 9559 - DNA, 25 bp, Rattus norvegicus
aaagattaccttagtgtcactcaaa

SEQ ID NO: 9560 - DNA, 25 bp, Rattus norvegicus
aaagattacctttgtgtcactcaaa

SEQ ID NO: 9561 - DNA, 25 bp, Rattus norvegicus
aaagattatacaaggctgcgtggca

SEQ ID NO: 9562 - DNA, 25 bp, Rattus norvegicus
aaagattatacatggctgcgtggca

SEQ ID NO: 9563 - DNA, 25 bp, Rattus norvegicus
aaagattatgccacctgtgccacag

SEQ ID NO: 9564 - DNA, 25 bp, Rattus norvegicus
aaagattatgcctcctgtgccacag

SEQ ID NO: 9565 - DNA, 25 bp, Rattus norvegicus
aaagattcacaccatgtgggcccca

SEQ ID NO: 9566 - DNA, 25 bp, Rattus norvegicus
aaagattcacacgatgtgggcccca

SEQ ID NO: 9567 - DNA, 25 bp, Rattus norvegicus
aaagattcacttcggctctgtcacg

SEQ ID NO: 9568 - DNA, 25 bp, Rattus norvegicus
aaagattcacttgggctctgtcacg

SEQ ID NO: 9569 - DNA, 25 bp, Rattus norvegicus
aaagattcatgtcgcttgtcttcca

SEQ ID NO: 9570 - DNA, 25 bp, Rattus norvegicus
aaagattcatgtggcttgtcttcca

SEQ ID NO: 9571 - DNA, 25 bp, Rattus norvegicus
aaagattcccatctaccttcttact

SEQ ID NO: 9572 - DNA, 25 bp, Rattus norvegicus
aaagattcccatgtaccttcttact

SEQ ID NO: 9573 - DNA, 25 bp, Rattus norvegicus
aaagattcctgcctttgtatctccc

SEQ ID NO: 9574 - DNA, 25 bp, Rattus norvegicus
aaagattcctgcgtttgtatctccc

SEQ ID NO: 9575 - DNA, 25 bp, Rattus norvegicus
aaagattccttgatccagcgggttg

SEQ ID NO: 9576 - DNA, 25 bp, Rattus norvegicus
aaagattccttgttccagcgggttg

SEQ ID NO: 9577 - DNA, 25 bp, Rattus norvegicus
aaagattcggctcttattggaacca

SEQ ID NO: 9578 - DNA, 25 bp, Rattus norvegicus
aaagattcggctgttattggaacca

SEQ ID NO: 9579 - DNA, 25 bp, Rattus norvegicus
aaagattctatcagggccttgggaa

SEQ ID NO: 9580 - DNA, 25 bp, Rattus norvegicus
aaagattctatctgggccttgggaa

SEQ ID NO: 9581 - DNA, 25 bp, Rattus norvegicus
aaagattctctaccatcatttgaaa

SEQ ID NO: 9582 - DNA, 25 bp, Rattus norvegicus
aaagattctctagcatcatttgaaa

SEQ ID NO: 9583 - DNA, 25 bp, Rattus norvegicus
aaagattcttctatctctcaggacg

SEQ ID NO: 9584 - DNA, 25 bp, Rattus norvegicus
aaagattcttctttctctcaggacg

SEQ ID NO: 9585 - DNA, 25 bp, Rattus norvegicus
aaagattgctgtcctgtgggcgaca

SEQ ID NO: 9586 - DNA, 25 bp, Rattus norvegicus
aaagattgctgtgctgtgggcgaca

SEQ ID NO: 9587 - DNA, 25 bp, Rattus norvegicus
aaagattggagacccctgtggccac

SEQ ID NO: 9588 - DNA, 25 bp, Rattus norvegicus
aaagattggagagccctgtggccac

SEQ ID NO: 9589 - DNA, 25 bp, Rattus norvegicus
aaagattgggcaacggcatccaagc

SEQ ID NO: 9590 - DNA, 25 bp, Rattus norvegicus
aaagattgggcatcggcatccaagc

SEQ ID NO: 9591 - DNA, 25 bp, Rattus norvegicus
aaagattgtggaactctgccttatg

SEQ ID NO: 9592 - DNA, 25 bp, Rattus norvegicus
aaagattgtggatctctgccttatg

SEQ ID NO: 9593 - DNA, 25 bp, Rattus norvegicus
aaagattgtgtgaccatccaacagg

SEQ ID NO: 9594 - DNA, 25 bp, Rattus norvegicus
aaagattgtgtgtccatccaacagg

SEQ ID NO: 9595 - DNA, 25 bp, Rattus norvegicus
aaagattgttgcactgatgctggat

SEQ ID NO: 9596 - DNA, 25 bp, Rattus norvegicus
aaagattgttgctctgatgctggat

SEQ ID NO: 9597 - DNA, 25 bp, Rattus norvegicus
aaagatttattaagggttggagaga

SEQ ID NO: 9598 - DNA, 25 bp, Rattus norvegicus
aaagatttattatgggttggagaga

SEQ ID NO: 9599 - DNA, 25 bp, Rattus norvegicus
aaagatttcactacttcctcaagcc

SEQ ID NO: 9600 - DNA, 25 bp, Rattus norvegicus
aaagatttcacttcttcctcaagcc

SEQ ID NO: 9601 - DNA, 25 bp, Rattus norvegicus
aaagatttcagccagttggtcagag

SEQ ID NO: 9602 - DNA, 25 bp, Rattus norvegicus
aaagatttcagcgagttggtcagag

SEQ ID NO: 9603 - DNA, 25 bp, Rattus norvegicus
aaagatttcatcagtcatcacataa

SEQ ID NO: 9604 - DNA, 25 bp, Rattus norvegicus
aaagatttcatctgtcatcacataa

SEQ ID NO: 9605 - DNA, 25 bp, Rattus norvegicus
aaagatttccctctgagacagtcgg

SEQ ID NO: 9606 - DNA, 25 bp, Rattus norvegicus
aaagatttccctgtgagacagtcgg

SEQ ID NO: 9607 - DNA, 25 bp, Rattus norvegicus
aaagatttcttacctgttgacacaa

SEQ ID NO: 9608 - DNA, 25 bp, Rattus norvegicus
aaagatttcttagctgttgacacaa

SEQ ID NO: 9609 - DNA, 25 bp, Rattus norvegicus
aaagatttcttcctcattgtttatg

SEQ ID NO: 9610 - DNA, 25 bp, Rattus norvegicus
aaagatttcttcgtcattgtttatg

SEQ ID NO: 9611 - DNA, 25 bp, Rattus norvegicus
aaagatttgtcccacacgcatggat

SEQ ID NO: 9612 - DNA, 25 bp, Rattus norvegicus
aaagatttgtccgacacgcatggat

SEQ ID NO: 9613 - DNA, 25 bp, Rattus norvegicus
aaagatttgtggcatcccctgcgct

SEQ ID NO: 9614 - DNA, 25 bp, Rattus norvegicus
aaagatttgtgggatcccctgcgct

SEQ ID NO: 9615 - DNA, 25 bp, Rattus norvegicus
aaagatttgttcatgcggcctctgc

SEQ ID NO: 9616 - DNA, 25 bp, Rattus norvegicus
aaagatttgttcttgcggcctctgc

SEQ ID NO: 9617 - DNA, 25 bp, Rattus norvegicus
aaagattttgacctcacaccacagg

SEQ ID NO: 9618 - DNA, 25 bp, Rattus norvegicus
aaagattttgacgtcacaccacagg

SEQ ID NO: 9619 - DNA, 25 bp, Rattus norvegicus
aaagattttggcactctgtgcattt

SEQ ID NO: 9620 - DNA, 25 bp, Rattus norvegicus
aaagattttggctctctgtgcattt

SEQ ID NO: 9621 - DNA, 25 bp, Rattus norvegicus
aaagatttttcaacaagaccatcgg

SEQ ID NO: 9622 - DNA, 25 bp, Rattus norvegicus
aaagatttttcacctttgtggaaat

SEQ ID NO: 9623 - DNA, 25 bp, Rattus norvegicus
aaagatttttcagctttgtggaaat

SEQ ID NO: 9624 - DNA, 25 bp, Rattus norvegicus
aaagatttttcatcaagaccatcgg

SEQ ID NO: 9625 - DNA, 25 bp, Rattus norvegicus
aaagcaaaaccactgtcgcccagac

SEQ ID NO: 9626 - DNA, 25 bp, Rattus norvegicus
aaagcaaaaccagtgtcgcccagac

SEQ ID NO: 9627 - DNA, 25 bp, Rattus norvegicus
aaagcaaaacttacatccctggatt

SEQ ID NO: 9628 - DNA, 25 bp, Rattus norvegicus
aaagcaaaactttcatccctggatt

SEQ ID NO: 9629 - DNA, 25 bp, Rattus norvegicus
aaagcaaacaacaaacaacggtcag

SEQ ID NO: 9630 - DNA, 25 bp, Rattus norvegicus
aaagcaaacaactaacaacggtcag

SEQ ID NO: 9631 - DNA, 25 bp, Rattus norvegicus
aaagcaaacaccacctgttctcact

SEQ ID NO: 9632 - DNA, 25 bp, Rattus norvegicus
aaagcaaacacctcctgttctcact

SEQ ID NO: 9633 - DNA, 25 bp, Rattus norvegicus
aaagcaaacactctatctcttctct

SEQ ID NO: 9634 - DNA, 25 bp, Rattus norvegicus
aaagcaaacactgtatctcttctct

SEQ ID NO: 9635 - DNA, 25 bp, Rattus norvegicus
aaagcaaaccagctaccagctgaca

SEQ ID NO: 9636 - DNA, 25 bp, Rattus norvegicus
aaagcaaaccaggtaccagctgaca

SEQ ID NO: 9637 - DNA, 25 bp, Rattus norvegicus
aaagcaaacctcactcctgcaagtt

SEQ ID NO: 9638 - DNA, 25 bp, Rattus norvegicus
aaagcaaacctctctcctgcaagtt

SEQ ID NO: 9639 - DNA, 25 bp, Rattus norvegicus
aaagcaaactccaccatgtatatgg

SEQ ID NO: 9640 - DNA, 25 bp, Rattus norvegicus
aaagcaaactcctccatgtatatgg

SEQ ID NO: 9641 - DNA, 25 bp, Rattus norvegicus
aaagcaaactgacggctctgctcgc

SEQ ID NO: 9642 - DNA, 25 bp, Rattus norvegicus
aaagcaaactgagggctctgctcgc

SEQ ID NO: 9643 - DNA, 25 bp, Rattus norvegicus
aaagcaaactgcacctttgtaacat

SEQ ID NO: 9644 - DNA, 25 bp, Rattus norvegicus
aaagcaaactgctcctttgtaacat

SEQ ID NO: 9645 - DNA, 25 bp, Rattus norvegicus
aaagcaaacttgcagtagcaggcct

SEQ ID NO: 9646 - DNA, 25 bp, Rattus norvegicus
aaagcaaacttggagtagcaggcct

SEQ ID NO: 9647 - DNA, 25 bp, Rattus norvegicus
aaagcaaagccacacgtccagacgt

SEQ ID NO: 9648 - DNA, 25 bp, Rattus norvegicus
aaagcaaagccagacgtccagacgt

SEQ ID NO: 9649 - DNA, 25 bp, Rattus norvegicus
aaagcaaagctgcataccgtgcacc

SEQ ID NO: 9650 - DNA, 25 bp, Rattus norvegicus
aaagcaaagctggataccgtgcacc

SEQ ID NO: 9651 - DNA, 25 bp, Rattus norvegicus
aaagcaaaggctacccaggtatgtg

SEQ ID NO: 9652 - DNA, 25 bp, Rattus norvegicus
aaagcaaaggcttcccaggtatgtg

SEQ ID NO: 9653 - DNA, 25 bp, Rattus norvegicus
aaagcaaagttcctctggcctggtg

SEQ ID NO: 9654 - DNA, 25 bp, Rattus norvegicus
aaagcaaagttcgtctggcctggtg

SEQ ID NO: 9655 - DNA, 25 bp, Rattus norvegicus
aaagcaacacccataggccaaagcc

SEQ ID NO: 9656 - DNA, 25 bp, Rattus norvegicus
aaagcaacacccttaggccaaagcc

SEQ ID NO: 9657 - DNA, 25 bp, Rattus norvegicus
aaagcaacagacaggcggccctgga

SEQ ID NO: 9658 - DNA, 25 bp, Rattus norvegicus
aaagcaacagactggcggccctgga

SEQ ID NO: 9659 - DNA, 25 bp, Rattus norvegicus
aaagcaacagcacctcacttcagtc

SEQ ID NO: 9660 - DNA, 25 bp, Rattus norvegicus
aaagcaacagcagctcacttcagtc

SEQ ID NO: 9661 - DNA, 25 bp, Rattus norvegicus
aaagcaacataactgctatgggaaa

SEQ ID NO: 9662 - DNA, 25 bp, Rattus norvegicus
aaagcaacataagtgctatgggaaa

SEQ ID NO: 9663 - DNA, 25 bp, Rattus norvegicus
aaagcaacctcaatgtaatactgaa

SEQ ID NO: 9664 - DNA, 25 bp, Rattus norvegicus
aaagcaacctcattgtaatactgaa

SEQ ID NO: 9665 - DNA, 25 bp, Rattus norvegicus
aaagcaacctgtcggatacctgaaa

SEQ ID NO: 9666 - DNA, 25 bp, Rattus norvegicus
aaagcaacctgtgggatacctgaaa

SEQ ID NO: 9667 - DNA, 25 bp, Rattus norvegicus
aaagcaactttcacgtcaggcttgg

SEQ ID NO: 9668 - DNA, 25 bp, Rattus norvegicus
aaagcaactttctcgtcaggcttgg

SEQ ID NO: 9669 - DNA, 25 bp, Rattus norvegicus
aaagcaagaacaacgggaggcctgg

SEQ ID NO: 9670 - DNA, 25 bp, Rattus norvegicus
aaagcaagaacatcgggaggcctgg

SEQ ID NO: 9671 - DNA, 25 bp, Rattus norvegicus
aaagcaagactgatcctatccgtga

SEQ ID NO: 9672 - DNA, 25 bp, Rattus norvegicus
aaagcaagactgcatcatggactgg

SEQ ID NO: 9673 - DNA, 25 bp, Rattus norvegicus
aaagcaagactggatcatggactgg

SEQ ID NO: 9674 - DNA, 25 bp, Rattus norvegicus
aaagcaagactgttcctatccgtga

SEQ ID NO: 9675 - DNA, 25 bp, Rattus norvegicus
aaagcaagagctacctgccaacgtc

SEQ ID NO: 9676 - DNA, 25 bp, Rattus norvegicus
aaagcaagagcttcctgccaacgtc

SEQ ID NO: 9677 - DNA, 25 bp, Rattus norvegicus
aaagcaagccagatgtagtaccaca

SEQ ID NO: 9678 - DNA, 25 bp, Rattus norvegicus
aaagcaagccagttgtagtaccaca

SEQ ID NO: 9679 - DNA, 25 bp, Rattus norvegicus
aaagcaagcctacttctagctgtcg

SEQ ID NO: 9680 - DNA, 25 bp, Rattus norvegicus
aaagcaagcctagttctagctgtcg

SEQ ID NO: 9681 - DNA, 25 bp, Rattus norvegicus
aaagcaagctgcagttaaccatgtt

SEQ ID NO: 9682 - DNA, 25 bp, Rattus norvegicus
aaagcaagctgctgttaaccatgtt

SEQ ID NO: 9683 - DNA, 25 bp, Rattus norvegicus
aaagcaagctttctccagttctcct

SEQ ID NO: 9684 - DNA, 25 bp, Rattus norvegicus
aaagcaagctttgtccagttctcct

SEQ ID NO: 9685 - DNA, 25 bp, Rattus norvegicus
aaagcaaggcagacggccgagtcca

SEQ ID NO: 9686 - DNA, 25 bp, Rattus norvegicus
aaagcaaggcagtcggccgagtcca

SEQ ID NO: 9687 - DNA, 25 bp, Rattus norvegicus
aaagcaaggctacccagcacttcat

SEQ ID NO: 9688 - DNA, 25 bp, Rattus norvegicus
aaagcaaggctagccagcacttcat

SEQ ID NO: 9689 - DNA, 25 bp, Rattus norvegicus
aaagcaaggctcaaagctacccatc

SEQ ID NO: 9690 - DNA, 25 bp, Rattus norvegicus
aaagcaaggctctaagctacccatc

SEQ ID NO: 9691 - DNA, 25 bp, Rattus norvegicus
aaagcaaggctgacagctccgtcaa

SEQ ID NO: 9692 - DNA, 25 bp, Rattus norvegicus
aaagcaaggctgtcagctccgtcaa

SEQ ID NO: 9693 - DNA, 25 bp, Rattus norvegicus
aaagcaaggcttagtgttgaggcct

SEQ ID NO: 9694 - DNA, 25 bp, Rattus norvegicus
aaagcaaggctttgtgttgaggcct

SEQ ID NO: 9695 - DNA, 25 bp, Rattus norvegicus
aaagcaaggtgtctttctccacaag

SEQ ID NO: 9696 - DNA, 25 bp, Rattus norvegicus
aaagcaaggtgtgtttctccacaag

SEQ ID NO: 9697 - DNA, 25 bp, Rattus norvegicus
aaagcaagtaccaagtggcggagag

SEQ ID NO: 9698 - DNA, 25 bp, Rattus norvegicus
aaagcaagtacctagtggcggagag

SEQ ID NO: 9699 - DNA, 25 bp, Rattus norvegicus
aaagcaagtcgtcgccaaggcacca

SEQ ID NO: 9700 - DNA, 25 bp, Rattus norvegicus
aaagcaagtcgtggccaaggcacca

SEQ ID NO: 9701 - DNA, 25 bp, Rattus norvegicus
aaagcaagtgcaccttttcctggct

SEQ ID NO: 9702 - DNA, 25 bp, Rattus norvegicus
aaagcaagtgcagcttttcctggct

SEQ ID NO: 9703 - DNA, 25 bp, Rattus norvegicus
aaagcaagtgtgcatttcaaatcga

SEQ ID NO: 9704 - DNA, 25 bp, Rattus norvegicus
aaagcaagtgtggatttcaaatcga

SEQ ID NO: 9705 - DNA, 25 bp, Rattus norvegicus
aaagcaagttcgatctctgagcctg

SEQ ID NO: 9706 - DNA, 25 bp, Rattus norvegicus
aaagcaagttcgttctctgagcctg

SEQ ID NO: 9707 - DNA, 25 bp, Rattus norvegicus
aaagcaagttttcccctgagacagg

SEQ ID NO: 9708 - DNA, 25 bp, Rattus norvegicus
aaagcaagttttgccctgagacagg

SEQ ID NO: 9709 - DNA, 25 bp, Rattus norvegicus
aaagcaataaccaagagagcacaat

SEQ ID NO: 9710 - DNA, 25 bp, Rattus norvegicus
aaagcaataacctagagagcacaat

SEQ ID NO: 9711 - DNA, 25 bp, Rattus norvegicus
aaagcaatcacaagcacctttcagc

SEQ ID NO: 9712 - DNA, 25 bp, Rattus norvegicus
aaagcaatcacatgcacctttcagc

SEQ ID NO: 9713 - DNA, 25 bp, Rattus norvegicus
aaagcaatcacgacttagcacagat

SEQ ID NO: 9714 - DNA, 25 bp, Rattus norvegicus
aaagcaatcacgtcttagcacagat

SEQ ID NO: 9715 - DNA, 25 bp, Rattus norvegicus
aaagcaatcagcctctaccatcggg

SEQ ID NO: 9716 - DNA, 25 bp, Rattus norvegicus
aaagcaatcagcgtctaccatcggg

SEQ ID NO: 9717 - DNA, 25 bp, Rattus norvegicus
aaagcaatccgaacccttgtgagat

SEQ ID NO: 9718 - DNA, 25 bp, Rattus norvegicus
aaagcaatccgatcccttgtgagat

SEQ ID NO: 9719 - DNA, 25 bp, Rattus norvegicus
aaagcaatccttacttgaggtcagc

SEQ ID NO: 9720 - DNA, 25 bp, Rattus norvegicus
aaagcaatcctttcttgaggtcagc

SEQ ID NO: 9721 - DNA, 25 bp, Rattus norvegicus
aaagcaatcttcacatcatacatcc

SEQ ID NO: 9722 - DNA, 25 bp, Rattus norvegicus
aaagcaatcttctcatcatacatcc

SEQ ID NO: 9723 - DNA, 25 bp, Rattus norvegicus
aaagcaatgtgtacaccctaccata

SEQ ID NO: 9724 - DNA, 25 bp, Rattus norvegicus
aaagcaatgtgttcaccctaccata

SEQ ID NO: 9725 - DNA, 25 bp, Rattus norvegicus
aaagcaatttgcactccggactgtc

SEQ ID NO: 9726 - DNA, 25 bp, Rattus norvegicus
aaagcaatttgctctccggactgtc

SEQ ID NO: 9727 - DNA, 25 bp, Rattus norvegicus
aaagcacaaaacctgtcttcccatg

SEQ ID NO: 9728 - DNA, 25 bp, Rattus norvegicus
aaagcacaaaacgtgtcttcccatg

SEQ ID NO: 9729 - DNA, 25 bp, Rattus norvegicus
aaagcacaaaccctcgaacttggcg

SEQ ID NO: 9730 - DNA, 25 bp, Rattus norvegicus
aaagcacaaaccgtcgaacttggcg

SEQ ID NO: 9731 - DNA, 25 bp, Rattus norvegicus
aaagcacaaagaccacctgtggcct

SEQ ID NO: 9732 - DNA, 25 bp, Rattus norvegicus
aaagcacaaagagcacctgtggcct

SEQ ID NO: 9733 - DNA, 25 bp, Rattus norvegicus
aaagcacaaccccagagaggatccg

SEQ ID NO: 9734 - DNA, 25 bp, Rattus norvegicus
aaagcacaacccgagagaggatccg

SEQ ID NO: 9735 - DNA, 25 bp, Rattus norvegicus
aaagcacacaatctgctgccctggg

SEQ ID NO: 9736 - DNA, 25 bp, Rattus norvegicus
aaagcacacaatgtgctgccctggg

SEQ ID NO: 9737 - DNA, 25 bp, Rattus norvegicus
aaagcacacacaccgagccaataca

SEQ ID NO: 9738 - DNA, 25 bp, Rattus norvegicus
aaagcacacacagcgagccaataca

SEQ ID NO: 9739 - DNA, 25 bp, Rattus norvegicus
aaagcacacacccaatcaatgaatg

SEQ ID NO: 9740 - DNA, 25 bp, Rattus norvegicus
aaagcacacaccgaatcaatgaatg

SEQ ID NO: 9741 - DNA, 25 bp, Rattus norvegicus
aaagcacacactaagtgccctggag

SEQ ID NO: 9742 - DNA, 25 bp, Rattus norvegicus
aaagcacacactcctcagaaaagcc

SEQ ID NO: 9743 - DNA, 25 bp, Rattus norvegicus
aaagcacacactgctcagaaaagcc

SEQ ID NO: 9744 - DNA, 25 bp, Rattus norvegicus
aaagcacacacttagtgccctggag

SEQ ID NO: 9745 - DNA, 25 bp, Rattus norvegicus
aaagcacaccgtaggttatcaagcg

SEQ ID NO: 9746 - DNA, 25 bp, Rattus norvegicus
aaagcacaccgttggttatcaagcg

SEQ ID NO: 9747 - DNA, 25 bp, Rattus norvegicus
aaagcacactatcttagcactcaag

SEQ ID NO: 9748 - DNA, 25 bp, Rattus norvegicus
aaagcacactatgttagcactcaag

SEQ ID NO: 9749 - DNA, 25 bp, Rattus norvegicus
aaagcacactgccatctagtcaagt

SEQ ID NO: 9750 - DNA, 25 bp, Rattus norvegicus
aaagcacactgcgatctagtcaagt

SEQ ID NO: 9751 - DNA, 25 bp, Rattus norvegicus
aaagcacagactatgcccgtggaat

SEQ ID NO: 9752 - DNA, 25 bp, Rattus norvegicus
aaagcacagactttgcccgtggaat

SEQ ID NO: 9753 - DNA, 25 bp, Rattus norvegicus
aaagcacagagtcacctcacaggta

SEQ ID NO: 9754 - DNA, 25 bp, Rattus norvegicus
aaagcacagagtccccaggaaccaa

SEQ ID NO: 9755 - DNA, 25 bp, Rattus norvegicus
aaagcacagagtgacctcacaggta

SEQ ID NO: 9756 - DNA, 25 bp, Rattus norvegicus
aaagcacagagtgcccaggaaccaa

SEQ ID NO: 9757 - DNA, 25 bp, Rattus norvegicus
aaagcacagcggatggatagcaagc

SEQ ID NO: 9758 - DNA, 25 bp, Rattus norvegicus
aaagcacagcggttggatagcaagc

SEQ ID NO: 9759 - DNA, 25 bp, Rattus norvegicus
aaagcacagctgaagtcgcactgga

SEQ ID NO: 9760 - DNA, 25 bp, Rattus norvegicus
aaagcacagctgtagtcgcactgga

SEQ ID NO: 9761 - DNA, 25 bp, Rattus norvegicus
aaagcacagcttcctggtcgtcttt

SEQ ID NO: 9762 - DNA, 25 bp, Rattus norvegicus
aaagcacagcttgctggtcgtcttt

SEQ ID NO: 9763 - DNA, 25 bp, Rattus norvegicus
aaagcacagggcagctgcagctcat

SEQ ID NO: 9764 - DNA, 25 bp, Rattus norvegicus
aaagcacagggctgctgcagctcat

SEQ ID NO: 9765 - DNA, 25 bp, Rattus norvegicus
aaagcacagtacaacccattttatg

SEQ ID NO: 9766 - DNA, 25 bp, Rattus norvegicus
aaagcacagtactacccattttatg

SEQ ID NO: 9767 - DNA, 25 bp, Rattus norvegicus
aaagcacagtagacaccggtgttga

SEQ ID NO: 9768 - DNA, 25 bp, Rattus norvegicus
aaagcacagtagtcaccggtgttga

SEQ ID NO: 9769 - DNA, 25 bp, Rattus norvegicus
aaagcacagtgtcccatcgtggagc

SEQ ID NO: 9770 - DNA, 25 bp, Rattus norvegicus
aaagcacagtgtgccatcgtggagc

SEQ ID NO: 9771 - DNA, 25 bp, Rattus norvegicus
aaagcacatcttatggtattgcctt

SEQ ID NO: 9772 - DNA, 25 bp, Rattus norvegicus
aaagcacatcttttggtattgcctt

SEQ ID NO: 9773 - DNA, 25 bp, Rattus norvegicus
aaagcacatgaaacctctcctaggg

SEQ ID NO: 9774 - DNA, 25 bp, Rattus norvegicus
aaagcacatgaatcctctcctaggg

SEQ ID NO: 9775 - DNA, 25 bp, Rattus norvegicus
aaagcacatgcacagtctaactcct

SEQ ID NO: 9776 - DNA, 25 bp, Rattus norvegicus
aaagcacatgcagagtctaactcct

SEQ ID NO: 9777 - DNA, 25 bp, Rattus norvegicus
aaagcacatgtgatccatcttttaa

SEQ ID NO: 9778 - DNA, 25 bp, Rattus norvegicus
aaagcacatgtgttccatcttttaa

SEQ ID NO: 9779 - DNA, 25 bp, Rattus norvegicus
aaagcacattcactttccatccatc

SEQ ID NO: 9780 - DNA, 25 bp, Rattus norvegicus
aaagcacattcagtttccatccatc

SEQ ID NO: 9781 - DNA, 25 bp, Rattus norvegicus
aaagcacatttgcaatcatcccctt

SEQ ID NO: 9782 - DNA, 25 bp, Rattus norvegicus
aaagcacatttggaatcatcccctt

SEQ ID NO: 9783 - DNA, 25 bp, Rattus norvegicus
aaagcaccacgtatgtcacatttac

SEQ ID NO: 9784 - DNA, 25 bp, Rattus norvegicus
aaagcaccacgtttgtcacatttac

SEQ ID NO: 9785 - DNA, 25 bp, Rattus norvegicus
aaagcaccactccaagtcctctgtg

SEQ ID NO: 9786 - DNA, 25 bp, Rattus norvegicus
aaagcaccactcgaagtcctctgtg

SEQ ID NO: 9787 - DNA, 25 bp, Rattus norvegicus
aaagcaccagagagtttgtcacagt

SEQ ID NO: 9788 - DNA, 25 bp, Rattus norvegicus
aaagcaccagagctcttgggcccgg

SEQ ID NO: 9789 - DNA, 25 bp, Rattus norvegicus
aaagcaccagaggtcttgggcccgg

SEQ ID NO: 9790 - DNA, 25 bp, Rattus norvegicus
aaagcaccagagtgtttgtcacagt

SEQ ID NO: 9791 - DNA, 25 bp, Rattus norvegicus
aaagcaccagcacggtctggatcac

SEQ ID NO: 9792 - DNA, 25 bp, Rattus norvegicus
aaagcaccagcagggtctggatcac

SEQ ID NO: 9793 - DNA, 25 bp, Rattus norvegicus
aaagcaccataacactcctataccg

SEQ ID NO: 9794 - DNA, 25 bp, Rattus norvegicus
aaagcaccataagactcctataccg

SEQ ID NO: 9795 - DNA, 25 bp, Rattus norvegicus
aaagcaccatgacctagcgactctg

SEQ ID NO: 9796 - DNA, 25 bp, Rattus norvegicus
aaagcaccatgagctagcgactctg

SEQ ID NO: 9797 - DNA, 25 bp, Rattus norvegicus
aaagcacccagtctcccttgggtgt

SEQ ID NO: 9798 - DNA, 25 bp, Rattus norvegicus
aaagcacccagtgtcccttgggtgt

SEQ ID NO: 9799 - DNA, 25 bp, Rattus norvegicus
aaagcaccccatctcagtagaatga

SEQ ID NO: 9800 - DNA, 25 bp, Rattus norvegicus
aaagcaccccatgtcagtagaatga

SEQ ID NO: 9801 - DNA, 25 bp, Rattus norvegicus
aaagcacccgacaacagggagacat

SEQ ID NO: 9802 - DNA, 25 bp, Rattus norvegicus
aaagcacccgactacagggagacat

SEQ ID NO: 9803 - DNA, 25 bp, Rattus norvegicus
aaagcacccgctacctgttgagaag

SEQ ID NO: 9804 - DNA, 25 bp, Rattus norvegicus
aaagcacccgcttcctgttgagaag

SEQ ID NO: 9805 - DNA, 25 bp, Rattus norvegicus
aaagcaccctatacctgcaaatgga

SEQ ID NO: 9806 - DNA, 25 bp, Rattus norvegicus
aaagcaccctattcctgcaaatgga

SEQ ID NO: 9807 - DNA, 25 bp, Rattus norvegicus
aaagcaccctcaccgtatttatttg

SEQ ID NO: 9808 - DNA, 25 bp, Rattus norvegicus
aaagcaccctcagcgtatttatttg

SEQ ID NO: 9809 - DNA, 25 bp, Rattus norvegicus
aaagcaccctcgctctggcagaaag

SEQ ID NO: 9810 - DNA, 25 bp, Rattus norvegicus
aaagcaccctcggtctggcagaaag

SEQ ID NO: 9811 - DNA, 25 bp, Rattus norvegicus
aaagcaccctgaacttgagacctca

SEQ ID NO: 9812 - DNA, 25 bp, Rattus norvegicus
aaagcaccctgatcttgagacctca

SEQ ID NO: 9813 - DNA, 25 bp, Rattus norvegicus
aaagcaccctgtcttctgtggatgt

SEQ ID NO: 9814 - DNA, 25 bp, Rattus norvegicus
aaagcaccctgtgttctgtggatgt

SEQ ID NO: 9815 - DNA, 25 bp, Rattus norvegicus
aaagcaccgatcaccagattggaga

SEQ ID NO: 9816 - DNA, 25 bp, Rattus norvegicus
aaagcaccgatctccagattggaga

SEQ ID NO: 9817 - DNA, 25 bp, Rattus norvegicus
aaagcaccggaccaattcaggcagc

SEQ ID NO: 9818 - DNA, 25 bp, Rattus norvegicus
aaagcaccggacgaattcaggcagc

SEQ ID NO: 9819 - DNA, 25 bp, Rattus norvegicus
aaagcacctctgctgtcattcagaa

SEQ ID NO: 9820 - DNA, 25 bp, Rattus norvegicus
aaagcacctctggtgtcattcagaa

SEQ ID NO: 9821 - DNA, 25 bp, Rattus norvegicus
aaagcacctgcgatggaattccagt

SEQ ID NO: 9822 - DNA, 25 bp, Rattus norvegicus
aaagcacctgcgttggaattccagt

SEQ ID NO: 9823 - DNA, 25 bp, Rattus norvegicus
aaagcacctgtgaatttagcatgtt

SEQ ID NO: 9824 - DNA, 25 bp, Rattus norvegicus
aaagcacctgtgtatttagcatgtt

SEQ ID NO: 9825 - DNA, 25 bp, Rattus norvegicus
aaagcaccttatatccatgtatgga

SEQ ID NO: 9826 - DNA, 25 bp, Rattus norvegicus
aaagcaccttatttccatgtatgga

SEQ ID NO: 9827 - DNA, 25 bp, Rattus norvegicus
aaagcaccttgcatatgccttgcac

SEQ ID NO: 9828 - DNA, 25 bp, Rattus norvegicus
aaagcaccttgcttatgccttgcac

SEQ ID NO: 9829 - DNA, 25 bp, Rattus norvegicus
aaagcacctttcactgaaggcagtg

SEQ ID NO: 9830 - DNA, 25 bp, Rattus norvegicus
aaagcacctttctctgaaggcagtg

SEQ ID NO: 9831 - DNA, 25 bp, Rattus norvegicus
aaagcacgactcaaatcaggaaaag

SEQ ID NO: 9832 - DNA, 25 bp, Rattus norvegicus
aaagcacgactctaatcaggaaaag

SEQ ID NO: 9833 - DNA, 25 bp, Rattus norvegicus
aaagcacgagaaagtggtcaaccat

SEQ ID NO: 9834 - DNA, 25 bp, Rattus norvegicus
aaagcacgagaatgtggtcaaccat

SEQ ID NO: 9835 - DNA, 25 bp, Rattus norvegicus
aaagcacgcactcgccctagtatgg

SEQ ID NO: 9836 - DNA, 25 bp, Rattus norvegicus
aaagcacgcactggccctagtatgg

SEQ ID NO: 9837 - DNA, 25 bp, Rattus norvegicus
aaagcacgggatcctgcttggctct

SEQ ID NO: 9838 - DNA, 25 bp, Rattus norvegicus
aaagcacgggatgctgcttggctct

SEQ ID NO: 9839 - DNA, 25 bp, Rattus norvegicus
aaagcacgggctcctgacagctgcc

SEQ ID NO: 9840 - DNA, 25 bp, Rattus norvegicus
aaagcacgggctgctgacagctgcc

SEQ ID NO: 9841 - DNA, 25 bp, Rattus norvegicus
aaagcacgtattcttctgtacaggt

SEQ ID NO: 9842 - DNA, 25 bp, Rattus norvegicus
aaagcacgtattgttctgtacaggt

SEQ ID NO: 9843 - DNA, 25 bp, Rattus norvegicus
aaagcacgtctaaagagccagttga

SEQ ID NO: 9844 - DNA, 25 bp, Rattus norvegicus
aaagcacgtctatagagccagttga

SEQ ID NO: 9845 - DNA, 25 bp, Rattus norvegicus
aaagcacgtgctacgagcagccaga

SEQ ID NO: 9846 - DNA, 25 bp, Rattus norvegicus
aaagcacgtgcttcgagcagccaga

SEQ ID NO: 9847 - DNA, 25 bp, Rattus norvegicus
aaagcacgttccaaagatgtcccat

SEQ ID NO: 9848 - DNA, 25 bp, Rattus norvegicus
aaagcacgttcctaagatgtcccat

SEQ ID NO: 9849 - DNA, 25 bp, Rattus norvegicus
aaagcacgttgcattgtacccgctg

SEQ ID NO: 9850 - DNA, 25 bp, Rattus norvegicus
aaagcacgttgctttgtacccgctg

SEQ ID NO: 9851 - DNA, 25 bp, Rattus norvegicus
aaagcactagttattcagccttgag

SEQ ID NO: 9852 - DNA, 25 bp, Rattus norvegicus
aaagcactagtttttcagccttgag

SEQ ID NO: 9853 - DNA, 25 bp, Rattus norvegicus
aaagcactatgaacccagttggcat

SEQ ID NO: 9854 - DNA, 25 bp, Rattus norvegicus
aaagcactatgatcccagttggcat

SEQ ID NO: 9855 - DNA, 25 bp, Rattus norvegicus
aaagcactcagaacctagtctcaga

SEQ ID NO: 9856 - DNA, 25 bp, Rattus norvegicus
aaagcactcagatcctagtctcaga

SEQ ID NO: 9857 - DNA, 25 bp, Rattus norvegicus
aaagcactcatgagccgtatcggaa

SEQ ID NO: 9858 - DNA, 25 bp, Rattus norvegicus
aaagcactcatgtgccgtatcggaa

SEQ ID NO: 9859 - DNA, 25 bp, Rattus norvegicus
aaagcactcctaaggcaagctggtg

SEQ ID NO: 9860 - DNA, 25 bp, Rattus norvegicus
aaagcactcctatggcaagctggtg

SEQ ID NO: 9861 - DNA, 25 bp, Rattus norvegicus
aaagcactcctccaaacacggtgag

SEQ ID NO: 9862 - DNA, 25 bp, Rattus norvegicus
aaagcactcctcgaaacacggtgag

SEQ ID NO: 9863 - DNA, 25 bp, Rattus norvegicus
aaagcactcggcagccttgttagat

SEQ ID NO: 9864 - DNA, 25 bp, Rattus norvegicus
aaagcactcggctgccttgttagat

SEQ ID NO: 9865 - DNA, 25 bp, Rattus norvegicus
aaagcactcgtcaatgggcaagcat

SEQ ID NO: 9866 - DNA, 25 bp, Rattus norvegicus
aaagcactcgtctatgggcaagcat

SEQ ID NO: 9867 - DNA, 25 bp, Rattus norvegicus
aaagcactgctgatcacgtggaaga

SEQ ID NO: 9868 - DNA, 25 bp, Rattus norvegicus
aaagcactgctgttcacgtggaaga

SEQ ID NO: 9869 - DNA, 25 bp, Rattus norvegicus
aaagcactgcttactgggtacttca

SEQ ID NO: 9870 - DNA, 25 bp, Rattus norvegicus
aaagcactgctttctgggtacttca

SEQ ID NO: 9871 - DNA, 25 bp, Rattus norvegicus
aaagcactggagacgccgctcagat

SEQ ID NO: 9872 - DNA, 25 bp, Rattus norvegicus
aaagcactggagtcgccgctcagat

SEQ ID NO: 9873 - DNA, 25 bp, Rattus norvegicus
aaagcactgggaacctacattttag

SEQ ID NO: 9874 - DNA, 25 bp, Rattus norvegicus
aaagcactgggatcctacattttag

SEQ ID NO: 9875 - DNA, 25 bp, Rattus norvegicus
aaagcactgggcactggatttggca

SEQ ID NO: 9876 - DNA, 25 bp, Rattus norvegicus
aaagcactgggcagattctcagtca

SEQ ID NO: 9877 - DNA, 25 bp, Rattus norvegicus
aaagcactgggctctggatttggca

SEQ ID NO: 9878 - DNA, 25 bp, Rattus norvegicus
aaagcactgggctgattctcagtca

SEQ ID NO: 9879 - DNA, 25 bp, Rattus norvegicus
aaagcactgggtaccttgactgttg

SEQ ID NO: 9880 - DNA, 25 bp, Rattus norvegicus
aaagcactgggttccttgactgttg

SEQ ID NO: 9881 - DNA, 25 bp, Rattus norvegicus
aaagcactgtctacagtcaggccat

SEQ ID NO: 9882 - DNA, 25 bp, Rattus norvegicus
aaagcactgtcttcagtcaggccat

SEQ ID NO: 9883 - DNA, 25 bp, Rattus norvegicus
aaagcactgtgcactctgtaagctc

SEQ ID NO: 9884 - DNA, 25 bp, Rattus norvegicus
aaagcactgtgcatcctgactccag

SEQ ID NO: 9885 - DNA, 25 bp, Rattus norvegicus
aaagcactgtgctctctgtaagctc

SEQ ID NO: 9886 - DNA, 25 bp, Rattus norvegicus
aaagcactgtgcttcctgactccag

SEQ ID NO: 9887 - DNA, 25 bp, Rattus norvegicus
aaagcactgtttcttgagcacctgt

SEQ ID NO: 9888 - DNA, 25 bp, Rattus norvegicus
aaagcactgtttgttgagcacctgt

SEQ ID NO: 9889 - DNA, 25 bp, Rattus norvegicus
aaagcacttcggactgacagccaga

SEQ ID NO: 9890 - DNA, 25 bp, Rattus norvegicus
aaagcacttcggtctgacagccaga

SEQ ID NO: 9891 - DNA, 25 bp, Rattus norvegicus
aaagcacttgcaatccgtgtggtac

SEQ ID NO: 9892 - DNA, 25 bp, Rattus norvegicus
aaagcacttgcattccgtgtggtac

SEQ ID NO: 9893 - DNA, 25 bp, Rattus norvegicus
aaagcacttgtcacacaaactggtg

SEQ ID NO: 9894 - DNA, 25 bp, Rattus norvegicus
aaagcacttgtctcacaaactggtg

SEQ ID NO: 9895 - DNA, 25 bp, Rattus norvegicus
aaagcacttgtgagtctcgtcttgg

SEQ ID NO: 9896 - DNA, 25 bp, Rattus norvegicus
aaagcacttgtgtgtctcgtcttgg

SEQ ID NO: 9897 - DNA, 25 bp, Rattus norvegicus
aaagcacttgttctcagatctccaa

SEQ ID NO: 9898 - DNA, 25 bp, Rattus norvegicus
aaagcacttgttgtcagatctccaa

SEQ ID NO: 9899 - DNA, 25 bp, Rattus norvegicus
aaagcactttacagctgactttcat

SEQ ID NO: 9900 - DNA, 25 bp, Rattus norvegicus
aaagcactttactgctgactttcat

SEQ ID NO: 9901 - DNA, 25 bp, Rattus norvegicus
aaagcactttagcaggtcaaccagg

SEQ ID NO: 9902 - DNA, 25 bp, Rattus norvegicus
aaagcactttaggaggtcaaccagg

SEQ ID NO: 9903 - DNA, 25 bp, Rattus norvegicus
aaagcactttatagactgttgacca

SEQ ID NO: 9904 - DNA, 25 bp, Rattus norvegicus
aaagcactttatcacgtcctatatg

SEQ ID NO: 9905 - DNA, 25 bp, Rattus norvegicus
aaagcactttatgacgtcctatatg

SEQ ID NO: 9906 - DNA, 25 bp, Rattus norvegicus
aaagcactttattgactgttgacca

SEQ ID NO: 9907 - DNA, 25 bp, Rattus norvegicus
aaagcacttttacagtagcgattac

SEQ ID NO: 9908 - DNA, 25 bp, Rattus norvegicus
aaagcacttttagagtagcgattac

SEQ ID NO: 9909 - DNA, 25 bp, Rattus norvegicus
aaagcacttttcactctgtctccgg

SEQ ID NO: 9910 - DNA, 25 bp, Rattus norvegicus
aaagcacttttctctctgtctccgg

SEQ ID NO: 9911 - DNA, 25 bp, Rattus norvegicus
aaagcagaacccaaatcctgttcca

SEQ ID NO: 9912 - DNA, 25 bp, Rattus norvegicus
aaagcagaaccctaatcctgttcca

SEQ ID NO: 9913 - DNA, 25 bp, Rattus norvegicus
aaagcagaagtcagtgcggttcaca

SEQ ID NO: 9914 - DNA, 25 bp, Rattus norvegicus
aaagcagaagtctgtgcggttcaca

SEQ ID NO: 9915 - DNA, 25 bp, Rattus norvegicus
aaagcagaatccatccaagttcctg

SEQ ID NO: 9916 - DNA, 25 bp, Rattus norvegicus
aaagcagaatccttccaagttcctg

SEQ ID NO: 9917 - DNA, 25 bp, Rattus norvegicus
aaagcagaccagatttagggcagta

SEQ ID NO: 9918 - DNA, 25 bp, Rattus norvegicus
aaagcagaccagttttagggcagta

SEQ ID NO: 9919 - DNA, 25 bp, Rattus norvegicus
aaagcagacctgactcaagttctcc

SEQ ID NO: 9920 - DNA, 25 bp, Rattus norvegicus
aaagcagacctgtctcaagttctcc

SEQ ID NO: 9921 - DNA, 25 bp, Rattus norvegicus
aaagcagactcacagccccaagaga

SEQ ID NO: 9922 - DNA, 25 bp, Rattus norvegicus
aaagcagactcagagccccaagaga

SEQ ID NO: 9923 - DNA, 25 bp, Rattus norvegicus
aaagcagactgcctttgtcagctaa

SEQ ID NO: 9924 - DNA, 25 bp, Rattus norvegicus
aaagcagactgcgtttgtcagctaa

SEQ ID NO: 9925 - DNA, 25 bp, Rattus norvegicus
aaagcagagaccagatgggcgatca

SEQ ID NO: 9926 - DNA, 25 bp, Rattus norvegicus
aaagcagagacctgatgggcgatca

SEQ ID NO: 9927 - DNA, 25 bp, Rattus norvegicus
aaagcagagatcacctcagggccat

SEQ ID NO: 9928 - DNA, 25 bp, Rattus norvegicus
aaagcagagatctcctcagggccat

SEQ ID NO: 9929 - DNA, 25 bp, Rattus norvegicus
aaagcagagctgaacctggcgagct

SEQ ID NO: 9930 - DNA, 25 bp, Rattus norvegicus
aaagcagagctgtacctggcgagct

SEQ ID NO: 9931 - DNA, 25 bp, Rattus norvegicus
aaagcagaggccatctgagcagcca

SEQ ID NO: 9932 - DNA, 25 bp, Rattus norvegicus
aaagcagaggccttctgagcagcca

SEQ ID NO: 9933 - DNA, 25 bp, Rattus norvegicus
aaagcagatggcctctaccctgtgg

SEQ ID NO: 9934 - DNA, 25 bp, Rattus norvegicus
aaagcagatggcgtctaccctgtgg

SEQ ID NO: 9935 - DNA, 25 bp, Rattus norvegicus
aaagcagatgtcacagcccatgttt

SEQ ID NO: 9936 - DNA, 25 bp, Rattus norvegicus
aaagcagatgtctcagcccatgttt

SEQ ID NO: 9937 - DNA, 25 bp, Rattus norvegicus
aaagcagatttaagccgttcccttg

SEQ ID NO: 9938 - DNA, 25 bp, Rattus norvegicus
aaagcagatttatgccgttcccttg

SEQ ID NO: 9939 - DNA, 25 bp, Rattus norvegicus
aaagcagcagacatatccctaccga

SEQ ID NO: 9940 - DNA, 25 bp, Rattus norvegicus
aaagcagcagacttatccctaccga

SEQ ID NO: 9941 - DNA, 25 bp, Rattus norvegicus
aaagcagcagctagtgccagccttg

SEQ ID NO: 9942 - DNA, 25 bp, Rattus norvegicus
aaagcagcagcttgtgccagccttg

SEQ ID NO: 9943 - DNA, 25 bp, Rattus norvegicus
aaagcagcatataagacacgagtcc

SEQ ID NO: 9944 - DNA, 25 bp, Rattus norvegicus
aaagcagcatattagacacgagtcc

SEQ ID NO: 9945 - DNA, 25 bp, Rattus norvegicus
aaagcagccaacagctttgctggga

SEQ ID NO: 9946 - DNA, 25 bp, Rattus norvegicus
aaagcagccaactgctttgctggga

SEQ ID NO: 9947 - DNA, 25 bp, Rattus norvegicus
aaagcagccactaccctgggattga

SEQ ID NO: 9948 - DNA, 25 bp, Rattus norvegicus
aaagcagccacttccctgggattga

SEQ ID NO: 9949 - DNA, 25 bp, Rattus norvegicus
aaagcagcccagaccagtgacttgg

SEQ ID NO: 9950 - DNA, 25 bp, Rattus norvegicus
aaagcagcccagtccagtgacttgg

SEQ ID NO: 9951 - DNA, 25 bp, Rattus norvegicus
aaagcagccggcaatggtggacctt

SEQ ID NO: 9952 - DNA, 25 bp, Rattus norvegicus
aaagcagccggcctttgaaggcttt

SEQ ID NO: 9953 - DNA, 25 bp, Rattus norvegicus
aaagcagccggcgtttgaaggcttt

SEQ ID NO: 9954 - DNA, 25 bp, Rattus norvegicus
aaagcagccggctatggtggacctt

SEQ ID NO: 9955 - DNA, 25 bp, Rattus norvegicus
aaagcagcctctcttttgaggaggt

SEQ ID NO: 9956 - DNA, 25 bp, Rattus norvegicus
aaagcagcctctgttttgaggaggt

SEQ ID NO: 9957 - DNA, 25 bp, Rattus norvegicus
aaagcagccttcactcgtgtcagtg

SEQ ID NO: 9958 - DNA, 25 bp, Rattus norvegicus
aaagcagccttctctcgtgtcagtg

SEQ ID NO: 9959 - DNA, 25 bp, Rattus norvegicus
aaagcagccttgaactcgagatcct

SEQ ID NO: 9960 - DNA, 25 bp, Rattus norvegicus
aaagcagccttgtactcgagatcct

SEQ ID NO: 9961 - DNA, 25 bp, Rattus norvegicus
aaagcagcctttccctgaggagttt

SEQ ID NO: 9962 - DNA, 25 bp, Rattus norvegicus
aaagcagcctttgcctgaggagttt

SEQ ID NO: 9963 - DNA, 25 bp, Rattus norvegicus
aaagcagcgatcagtacctctgtgc

SEQ ID NO: 9964 - DNA, 25 bp, Rattus norvegicus
aaagcagcgatctgtacctctgtgc

SEQ ID NO: 9965 - DNA, 25 bp, Rattus norvegicus
aaagcagcgcttccagaacagctct

SEQ ID NO: 9966 - DNA, 25 bp, Rattus norvegicus
aaagcagcgcttgcagaacagctct

SEQ ID NO: 9967 - DNA, 25 bp, Rattus norvegicus
aaagcagcggtgactgtcccttaaa

SEQ ID NO: 9968 - DNA, 25 bp, Rattus norvegicus
aaagcagcggtgtctgtcccttaaa

SEQ ID NO: 9969 - DNA, 25 bp, Rattus norvegicus
aaagcagcgtctccagtgctcggat

SEQ ID NO: 9970 - DNA, 25 bp, Rattus norvegicus
aaagcagcgtctgcagtgctcggat

SEQ ID NO: 9971 - DNA, 25 bp, Rattus norvegicus
aaagcagctaggacaagtgtctgaa

SEQ ID NO: 9972 - DNA, 25 bp, Rattus norvegicus
aaagcagctaggtcaagtgtctgaa

SEQ ID NO: 9973 - DNA, 25 bp, Rattus norvegicus
aaagcagctcctaacaaatgcccac

SEQ ID NO: 9974 - DNA, 25 bp, Rattus norvegicus
aaagcagctccttacaaatgcccac

SEQ ID NO: 9975 - DNA, 25 bp, Rattus norvegicus
aaagcagctcgacgagtccccttta

SEQ ID NO: 9976 - DNA, 25 bp, Rattus norvegicus
aaagcagctcgaggagtccccttta

SEQ ID NO: 9977 - DNA, 25 bp, Rattus norvegicus
aaagcagctctaatggccaagctca

SEQ ID NO: 9978 - DNA, 25 bp, Rattus norvegicus
aaagcagctctattggccaagctca

SEQ ID NO: 9979 - DNA, 25 bp, Rattus norvegicus
aaagcagctgaaattgccacaccct

SEQ ID NO: 9980 - DNA, 25 bp, Rattus norvegicus
aaagcagctgaatttgccacaccct

SEQ ID NO: 9981 - DNA, 25 bp, Rattus norvegicus
aaagcagctgcacataacatgtaaa

SEQ ID NO: 9982 - DNA, 25 bp, Rattus norvegicus
aaagcagctgcagataacatgtaaa

SEQ ID NO: 9983 - DNA, 25 bp, Rattus norvegicus
aaagcagctgccaaaactactattt

SEQ ID NO: 9984 - DNA, 25 bp, Rattus norvegicus
aaagcagctgccatcattacccttt

SEQ ID NO: 9985 - DNA, 25 bp, Rattus norvegicus
aaagcagctgcctaaactactattt

SEQ ID NO: 9986 - DNA, 25 bp, Rattus norvegicus
aaagcagctgccttcattacccttt

SEQ ID NO: 9987 - DNA, 25 bp, Rattus norvegicus
aaagcagctggtccactacacggct

SEQ ID NO: 9988 - DNA, 25 bp, Rattus norvegicus
aaagcagctggtgcactacacggct

SEQ ID NO: 9989 - DNA, 25 bp, Rattus norvegicus
aaagcagctgtactgggtcccctgg

SEQ ID NO: 9990 - DNA, 25 bp, Rattus norvegicus
aaagcagctgtagtgggtcccctgg

SEQ ID NO: 9991 - DNA, 25 bp, Rattus norvegicus
aaagcagcttggactttggtggcag

SEQ ID NO: 9992 - DNA, 25 bp, Rattus norvegicus
aaagcagcttggtctttggtggcag

SEQ ID NO: 9993 - DNA, 25 bp, Rattus norvegicus
aaagcaggaaccatcagaagtcatc

SEQ ID NO: 9994 - DNA, 25 bp, Rattus norvegicus
aaagcaggaaccttcagaagtcatc

SEQ ID NO: 9995 - DNA, 25 bp, Rattus norvegicus
aaagcaggagggacagcactacata

SEQ ID NO: 9996 - DNA, 25 bp, Rattus norvegicus
aaagcaggagggtcagcactacata

SEQ ID NO: 9997 - DNA, 25 bp, Rattus norvegicus
aaagcaggatcaactccttccagta

SEQ ID NO: 9998 - DNA, 25 bp, Rattus norvegicus
aaagcaggatcatctccttccagta

SEQ ID NO: 9999 - DNA, 25 bp, Rattus norvegicus
aaagcaggatctcttgggattaacc

SEQ ID NO: 10000 - DNA, 25 bp, Rattus norvegicus
aaagcaggatctgttgggattaacc

SEQ ID NO: 10001 - DNA, 25 bp, Rattus norvegicus
aaagcaggcaatatgggaccatggg

SEQ ID NO: 10002 - DNA, 25 bp, Rattus norvegicus
aaagcaggcaatttgggaccatggg

SEQ ID NO: 10003 - DNA, 25 bp, Rattus norvegicus
aaagcaggcagtattgccaggaaca

SEQ ID NO: 10004 - DNA, 25 bp, Rattus norvegicus
aaagcaggcagttttgccaggaaca

SEQ ID NO: 10005 - DNA, 25 bp, Rattus norvegicus
aaagcaggcctaattcatcgtgaga

SEQ ID NO: 10006 - DNA, 25 bp, Rattus norvegicus
aaagcaggcctatttcatcgtgaga

SEQ ID NO: 10007 - DNA, 25 bp, Rattus norvegicus
aaagcaggccttacagagacagcag

SEQ ID NO: 10008 - DNA, 25 bp, Rattus norvegicus
aaagcaggcctttcagagacagcag

SEQ ID NO: 10009 - DNA, 25 bp, Rattus norvegicus
aaagcaggctcaccagatcaccaag

SEQ ID NO: 10010 - DNA, 25 bp, Rattus norvegicus
aaagcaggctcagcagatcaccaag

SEQ ID NO: 10011 - DNA, 25 bp, Rattus norvegicus
aaagcagggaccaaaacctctggat

SEQ ID NO: 10012 - DNA, 25 bp, Rattus norvegicus
aaagcagggacctaaacctctggat

SEQ ID NO: 10013 - DNA, 25 bp, Rattus norvegicus
aaagcagggactcacaccagcaccg

SEQ ID NO: 10014 - DNA, 25 bp, Rattus norvegicus
aaagcagggactgacaccagcaccg

SEQ ID NO: 10015 - DNA, 25 bp, Rattus norvegicus
aaagcagggctgaagctgtctctgg

SEQ ID NO: 10016 - DNA, 25 bp, Rattus norvegicus
aaagcagggctgtagctgtctctgg

SEQ ID NO: 10017 - DNA, 25 bp, Rattus norvegicus
aaagcaggtcccaacagttcagttc

SEQ ID NO: 10018 - DNA, 25 bp, Rattus norvegicus
aaagcaggtccctacagttcagttc

SEQ ID NO: 10019 - DNA, 25 bp, Rattus norvegicus
aaagcaggtcctctccattgtgtaa

SEQ ID NO: 10020 - DNA, 25 bp, Rattus norvegicus
aaagcaggtcctgtccattgtgtaa

SEQ ID NO: 10021 - DNA, 25 bp, Rattus norvegicus
aaagcaggtctaccatcacctcaga

SEQ ID NO: 10022 - DNA, 25 bp, Rattus norvegicus
aaagcaggtctagcatcacctcaga

SEQ ID NO: 10023 - DNA, 25 bp, Rattus norvegicus
aaagcaggtctgagactcccaacca

SEQ ID NO: 10024 - DNA, 25 bp, Rattus norvegicus
aaagcaggtctgtgactcccaacca

SEQ ID NO: 10025 - DNA, 25 bp, Rattus norvegicus
aaagcaggtgccctgcctgcctata

SEQ ID NO: 10026 - DNA, 25 bp, Rattus norvegicus
aaagcaggtgccgtgcctgcctata

SEQ ID NO: 10027 - DNA, 25 bp, Rattus norvegicus
aaagcaggtggcagtcttggctcta

SEQ ID NO: 10028 - DNA, 25 bp, Rattus norvegicus
aaagcaggtggcatgttcgttccca

SEQ ID NO: 10029 - DNA, 25 bp, Rattus norvegicus
aaagcaggtggctgtcttggctcta

SEQ ID NO: 10030 - DNA, 25 bp, Rattus norvegicus
aaagcaggtggcttgttcgttccca

SEQ ID NO: 10031 - DNA, 25 bp, Rattus norvegicus
aaagcaggttgaccgcccttagaac

SEQ ID NO: 10032 - DNA, 25 bp, Rattus norvegicus
aaagcaggttgagcgcccttagaac

SEQ ID NO: 10033 - DNA, 25 bp, Rattus norvegicus
aaagcaggttttcggatcagcagac

SEQ ID NO: 10034 - DNA, 25 bp, Rattus norvegicus
aaagcaggttttgggatcagcagac

SEQ ID NO: 10035 - DNA, 25 bp, Rattus norvegicus
aaagcagtacgtcctcttagccact

SEQ ID NO: 10036 - DNA, 25 bp, Rattus norvegicus
aaagcagtacgtgctcttagccact

SEQ ID NO: 10037 - DNA, 25 bp, Rattus norvegicus
aaagcagtagacaccaagttttggc

SEQ ID NO: 10038 - DNA, 25 bp, Rattus norvegicus
aaagcagtagactccaagttttggc

SEQ ID NO: 10039 - DNA, 25 bp, Rattus norvegicus
aaagcagtaggcatcaccggaaatg

SEQ ID NO: 10040 - DNA, 25 bp, Rattus norvegicus
aaagcagtaggcttcaccggaaatg

SEQ ID NO: 10041 - DNA, 25 bp, Rattus norvegicus
aaagcagtatatatgggttgaacct

SEQ ID NO: 10042 - DNA, 25 bp, Rattus norvegicus
aaagcagtatatttgggttgaacct

SEQ ID NO: 10043 - DNA, 25 bp, Rattus norvegicus
aaagcagtcaagctggagcccaaag

SEQ ID NO: 10044 - DNA, 25 bp, Rattus norvegicus
aaagcagtcaaggtggagcccaaag

SEQ ID NO: 10045 - DNA, 25 bp, Rattus norvegicus
aaagcagtcaccaagacccagaaga

SEQ ID NO: 10046 - DNA, 25 bp, Rattus norvegicus
aaagcagtcacctagacccagaaga

SEQ ID NO: 10047 - DNA, 25 bp, Rattus norvegicus
aaagcagtcactaggcaggcaactt

SEQ ID NO: 10048 - DNA, 25 bp, Rattus norvegicus
aaagcagtcacttggcaggcaactt

SEQ ID NO: 10049 - DNA, 25 bp, Rattus norvegicus
aaagcagtccacagattcatccatt

SEQ ID NO: 10050 - DNA, 25 bp, Rattus norvegicus
aaagcagtccactgattcatccatt

SEQ ID NO: 10051 - DNA, 25 bp, Rattus norvegicus
aaagcagtccagcattccgaattct

SEQ ID NO: 10052 - DNA, 25 bp, Rattus norvegicus
aaagcagtccaggattccgaattct

SEQ ID NO: 10053 - DNA, 25 bp, Rattus norvegicus
aaagcagtccccagactactcatgt

SEQ ID NO: 10054 - DNA, 25 bp, Rattus norvegicus
aaagcagtcccctgactactcatgt

SEQ ID NO: 10055 - DNA, 25 bp, Rattus norvegicus
aaagcagtcgtccaatccgagggct

SEQ ID NO: 10056 - DNA, 25 bp, Rattus norvegicus
aaagcagtcgtcgaatccgagggct

SEQ ID NO: 10057 - DNA, 25 bp, Rattus norvegicus
aaagcagtctgtcgaggtcgattta

SEQ ID NO: 10058 - DNA, 25 bp, Rattus norvegicus
aaagcagtctgtggaggtcgattta

SEQ ID NO: 10059 - DNA, 25 bp, Rattus norvegicus
aaagcagtcttcactatcatgattt

SEQ ID NO: 10060 - DNA, 25 bp, Rattus norvegicus
aaagcagtcttctctatcatgattt

SEQ ID NO: 10061 - DNA, 25 bp, Rattus norvegicus
aaagcagtgagtccggcaagctcga

SEQ ID NO: 10062 - DNA, 25 bp, Rattus norvegicus
aaagcagtgagtgcggcaagctcga

SEQ ID NO: 10063 - DNA, 25 bp, Rattus norvegicus
aaagcagtgattacatcgccataaa

SEQ ID NO: 10064 - DNA, 25 bp, Rattus norvegicus
aaagcagtgatttcatcgccataaa

SEQ ID NO: 10065 - DNA, 25 bp, Rattus norvegicus
aaagcagtgcatcctgtcccttacg

SEQ ID NO: 10066 - DNA, 25 bp, Rattus norvegicus
aaagcagtgcatgctgtcccttacg

SEQ ID NO: 10067 - DNA, 25 bp, Rattus norvegicus
aaagcagtgccaaaacaggttgaca

SEQ ID NO: 10068 - DNA, 25 bp, Rattus norvegicus
aaagcagtgccataacaggttgaca

SEQ ID NO: 10069 - DNA, 25 bp, Rattus norvegicus
aaagcagtgcgtcgtcagcgcctgt

SEQ ID NO: 10070 - DNA, 25 bp, Rattus norvegicus
aaagcagtgcgtggtcagcgcctgt

SEQ ID NO: 10071 - DNA, 25 bp, Rattus norvegicus
aaagcagtggccatgttgaatgcag

SEQ ID NO: 10072 - DNA, 25 bp, Rattus norvegicus
aaagcagtggccttgttgaatgcag

SEQ ID NO: 10073 - DNA, 25 bp, Rattus norvegicus
aaagcagtgggaagaccccgcatct

SEQ ID NO: 10074 - DNA, 25 bp, Rattus norvegicus
aaagcagtgggatgaccccgcatct

SEQ ID NO: 10075 - DNA, 25 bp, Rattus norvegicus
aaagcagtgttccatgccagagtga

SEQ ID NO: 10076 - DNA, 25 bp, Rattus norvegicus
aaagcagtgttcgatgccagagtga

SEQ ID NO: 10077 - DNA, 25 bp, Rattus norvegicus
aaagcagtgtttctctattccgtca

SEQ ID NO: 10078 - DNA, 25 bp, Rattus norvegicus
aaagcagtgtttgtctattccgtca

SEQ ID NO: 10079 - DNA, 25 bp, Rattus norvegicus
aaagcagttcatatccagctgagtg

SEQ ID NO: 10080 - DNA, 25 bp, Rattus norvegicus
aaagcagttcatctcatcatcacgt

SEQ ID NO: 10081 - DNA, 25 bp, Rattus norvegicus
aaagcagttcatgtcatcatcacgt

SEQ ID NO: 10082 - DNA, 25 bp, Rattus norvegicus
aaagcagttcatttccagctgagtg

SEQ ID NO: 10083 - DNA, 25 bp, Rattus norvegicus
aaagcagttctgatggaaggacaca

SEQ ID NO: 10084 - DNA, 25 bp, Rattus norvegicus
aaagcagttctgttggaaggacaca

SEQ ID NO: 10085 - DNA, 25 bp, Rattus norvegicus
aaagcagttgacaactaaagcctaa

SEQ ID NO: 10086 - DNA, 25 bp, Rattus norvegicus
aaagcagttgactactaaagcctaa

SEQ ID NO: 10087 - DNA, 25 bp, Rattus norvegicus
aaagcagttgatctcctctgccagt

SEQ ID NO: 10088 - DNA, 25 bp, Rattus norvegicus
aaagcagttgatgtcctctgccagt

SEQ ID NO: 10089 - DNA, 25 bp, Rattus norvegicus
aaagcagttgccagactccatgaca

SEQ ID NO: 10090 - DNA, 25 bp, Rattus norvegicus
aaagcagttgccctggacaaccaaa

SEQ ID NO: 10091 - DNA, 25 bp, Rattus norvegicus
aaagcagttgccgtggacaaccaaa

SEQ ID NO: 10092 - DNA, 25 bp, Rattus norvegicus
aaagcagttgcctgactccatgaca

SEQ ID NO: 10093 - DNA, 25 bp, Rattus norvegicus
aaagcagttgttagtactctcacga

SEQ ID NO: 10094 - DNA, 25 bp, Rattus norvegicus
aaagcagttgtttgtactctcacga

SEQ ID NO: 10095 - DNA, 25 bp, Rattus norvegicus
aaagcagtttatactgatcaacctt

SEQ ID NO: 10096 - DNA, 25 bp, Rattus norvegicus
aaagcagtttattctgatcaacctt

SEQ ID NO: 10097 - DNA, 25 bp, Rattus norvegicus
aaagcagtttccagtgttggagatt

SEQ ID NO: 10098 - DNA, 25 bp, Rattus norvegicus
aaagcagtttcctgtgttggagatt

SEQ ID NO: 10099 - DNA, 25 bp, Rattus norvegicus
aaagcagtttctacactagcctgtg

SEQ ID NO: 10100 - DNA, 25 bp, Rattus norvegicus
aaagcagtttcttcactagcctgtg

SEQ ID NO: 10101 - DNA, 25 bp, Rattus norvegicus
aaagcagttttaaattcacatcaaa

SEQ ID NO: 10102 - DNA, 25 bp, Rattus norvegicus
aaagcagttttatattcacatcaaa

SEQ ID NO: 10103 - DNA, 25 bp, Rattus norvegicus
aaagcagttttcacctctgctgtgg

SEQ ID NO: 10104 - DNA, 25 bp, Rattus norvegicus
aaagcagttttctcctctgctgtgg

SEQ ID NO: 10105 - DNA, 25 bp, Rattus norvegicus
aaagcataccgacttcccagcactg

SEQ ID NO: 10106 - DNA, 25 bp, Rattus norvegicus
aaagcataccgagttcccagcactg

SEQ ID NO: 10107 - DNA, 25 bp, Rattus norvegicus
aaagcatactccataggctggatga

SEQ ID NO: 10108 - DNA, 25 bp, Rattus norvegicus
aaagcatactccttaggctggatga

SEQ ID NO: 10109 - DNA, 25 bp, Rattus norvegicus
aaagcatagtgccttcctagtgaag

SEQ ID NO: 10110 - DNA, 25 bp, Rattus norvegicus
aaagcatagtgcgttcctagtgaag

SEQ ID NO: 10111 - DNA, 25 bp, Rattus norvegicus
aaagcatattttccacttgtaaatg

SEQ ID NO: 10112 - DNA, 25 bp, Rattus norvegicus
aaagcatattttctggacttaaatg

SEQ ID NO: 10113 - DNA, 25 bp, Rattus norvegicus
aaagcatattttgcacttgtaaatg

SEQ ID NO: 10114 - DNA, 25 bp, Rattus norvegicus
aaagcatattttgtggacttaaatg

SEQ ID NO: 10115 - DNA, 25 bp, Rattus norvegicus
aaagcatcacgcctccggtttgcag

SEQ ID NO: 10116 - DNA, 25 bp, Rattus norvegicus
aaagcatcacgcgtccggtttgcag

SEQ ID NO: 10117 - DNA, 25 bp, Rattus norvegicus
aaagcatcacttaggagctgccacc

SEQ ID NO: 10118 - DNA, 25 bp, Rattus norvegicus
aaagcatcactttggagctgccacc

SEQ ID NO: 10119 - DNA, 25 bp, Rattus norvegicus
aaagcatcagagaactttgcaagca

SEQ ID NO: 10120 - DNA, 25 bp, Rattus norvegicus
aaagcatcagagtactttgcaagca

SEQ ID NO: 10121 - DNA, 25 bp, Rattus norvegicus
aaagcatcagtcacagtttgcccca

SEQ ID NO: 10122 - DNA, 25 bp, Rattus norvegicus
aaagcatcagtctcagtttgcccca

SEQ ID NO: 10123 - DNA, 25 bp, Rattus norvegicus
aaagcatcattcagtatcctgtcaa

SEQ ID NO: 10124 - DNA, 25 bp, Rattus norvegicus
aaagcatcattctgtatcctgtcaa

SEQ ID NO: 10125 - DNA, 25 bp, Rattus norvegicus
aaagcatccacaatttaacacacag

SEQ ID NO: 10126 - DNA, 25 bp, Rattus norvegicus
aaagcatccacattttaacacacag

SEQ ID NO: 10127 - DNA, 25 bp, Rattus norvegicus
aaagcatccagtcgtggtaccctgc

SEQ ID NO: 10128 - DNA, 25 bp, Rattus norvegicus
aaagcatccagtggtggtaccctgc

SEQ ID NO: 10129 - DNA, 25 bp, Rattus norvegicus
aaagcatccataaccgtgggacaga

SEQ ID NO: 10130 - DNA, 25 bp, Rattus norvegicus
aaagcatccatatccgtgggacaga

SEQ ID NO: 10131 - DNA, 25 bp, Rattus norvegicus
aaagcatcccagcatcctggcctta

SEQ ID NO: 10132 - DNA, 25 bp, Rattus norvegicus
aaagcatcccaggatcctggcctta

SEQ ID NO: 10133 - DNA, 25 bp, Rattus norvegicus
aaagcatccgctccagtgggtggcc

SEQ ID NO: 10134 - DNA, 25 bp, Rattus norvegicus
aaagcatccgctgcagtgggtggcc

SEQ ID NO: 10135 - DNA, 25 bp, Rattus norvegicus
aaagcatcctctcccagtgttggta

SEQ ID NO: 10136 - DNA, 25 bp, Rattus norvegicus
aaagcatcctctgccagtgttggta

SEQ ID NO: 10137 - DNA, 25 bp, Rattus norvegicus
aaagcatcctgtcacctgattcctt

SEQ ID NO: 10138 - DNA, 25 bp, Rattus norvegicus
aaagcatcctgtgacctgattcctt

SEQ ID NO: 10139 - DNA, 25 bp, Rattus norvegicus
aaagcatcgtagaacaaccaccagg

SEQ ID NO: 10140 - DNA, 25 bp, Rattus norvegicus
aaagcatcgtagtacaaccaccagg

SEQ ID NO: 10141 - DNA, 25 bp, Rattus norvegicus
aaagcatctactcctagctggccac

SEQ ID NO: 10142 - DNA, 25 bp, Rattus norvegicus
aaagcatctactgctagctggccac

SEQ ID NO: 10143 - DNA, 25 bp, Rattus norvegicus
aaagcatctatcaggtcgtgccttg

SEQ ID NO: 10144 - DNA, 25 bp, Rattus norvegicus
aaagcatctatctggtcgtgccttg

SEQ ID NO: 10145 - DNA, 25 bp, Rattus norvegicus
aaagcatctatgagccgcccatggg

SEQ ID NO: 10146 - DNA, 25 bp, Rattus norvegicus
aaagcatctatgagctctgtgaaga

SEQ ID NO: 10147 - DNA, 25 bp, Rattus norvegicus
aaagcatctatgtgccgcccatggg

SEQ ID NO: 10148 - DNA, 25 bp, Rattus norvegicus
aaagcatctatgtgctctgtgaaga

SEQ ID NO: 10149 - DNA, 25 bp, Rattus norvegicus
aaagcatctccgatgtgatttcctt

SEQ ID NO: 10150 - DNA, 25 bp, Rattus norvegicus
aaagcatctccgttgtgatttcctt

SEQ ID NO: 10151 - DNA, 25 bp, Rattus norvegicus
aaagcatctgagctgtgcctcattc

SEQ ID NO: 10152 - DNA, 25 bp, Rattus norvegicus
aaagcatctgaggtgtgcctcattc

SEQ ID NO: 10153 - DNA, 25 bp, Rattus norvegicus
aaagcatctgctctgcaaacatgga

SEQ ID NO: 10154 - DNA, 25 bp, Rattus norvegicus
aaagcatctgctgtgcaaacatgga

SEQ ID NO: 10155 - DNA, 25 bp, Rattus norvegicus
aaagcatctgtcacagacccagaag

SEQ ID NO: 10156 - DNA, 25 bp, Rattus norvegicus
aaagcatctgtctcagacccagaag

SEQ ID NO: 10157 - DNA, 25 bp, Rattus norvegicus
aaagcatctgtgatctataaggcca

SEQ ID NO: 10158 - DNA, 25 bp, Rattus norvegicus
aaagcatctgtgttctataaggcca

SEQ ID NO: 10159 - DNA, 25 bp, Rattus norvegicus
aaagcatcttgcaaactctctgtta

SEQ ID NO: 10160 - DNA, 25 bp, Rattus norvegicus
aaagcatcttgcaacagaggccagt

SEQ ID NO: 10161 - DNA, 25 bp, Rattus norvegicus
aaagcatcttgctaactctctgtta

SEQ ID NO: 10162 - DNA, 25 bp, Rattus norvegicus
aaagcatcttgctacagaggccagt

SEQ ID NO: 10163 - DNA, 25 bp, Rattus norvegicus
aaagcatctttcaaagagtctggat

SEQ ID NO: 10164 - DNA, 25 bp, Rattus norvegicus
aaagcatctttctaagagtctggat

SEQ ID NO: 10165 - DNA, 25 bp, Rattus norvegicus
aaagcatgagctcacttccttcaag

SEQ ID NO: 10166 - DNA, 25 bp, Rattus norvegicus
aaagcatgagctgacttccttcaag

SEQ ID NO: 10167 - DNA, 25 bp, Rattus norvegicus
aaagcatgataacaccgccattcca

SEQ ID NO: 10168 - DNA, 25 bp, Rattus norvegicus
aaagcatgataagaccgccattcca

SEQ ID NO: 10169 - DNA, 25 bp, Rattus norvegicus
aaagcatgatgcctcttgtcggcct

SEQ ID NO: 10170 - DNA, 25 bp, Rattus norvegicus
aaagcatgatgcgtcttgtcggcct

SEQ ID NO: 10171 - DNA, 25 bp, Rattus norvegicus
aaagcatgatggcttgcctcctgtc

SEQ ID NO: 10172 - DNA, 25 bp, Rattus norvegicus
aaagcatgatgggttgcctcctgtc

SEQ ID NO: 10173 - DNA, 25 bp, Rattus norvegicus
aaagcatgatgtacgggtcaaagac

SEQ ID NO: 10174 - DNA, 25 bp, Rattus norvegicus
aaagcatgatgttcgggtcaaagac

SEQ ID NO: 10175 - DNA, 25 bp, Rattus norvegicus
aaagcatgcagccttaagcctcagc

SEQ ID NO: 10176 - DNA, 25 bp, Rattus norvegicus
aaagcatgcagcgttaagcctcagc

SEQ ID NO: 10177 - DNA, 25 bp, Rattus norvegicus
aaagcatgccggaggctgtgttcca

SEQ ID NO: 10178 - DNA, 25 bp, Rattus norvegicus
aaagcatgccggtggctgtgttcca

SEQ ID NO: 10179 - DNA, 25 bp, Rattus norvegicus
aaagcatggactctgaaagcactga

SEQ ID NO: 10180 - DNA, 25 bp, Rattus norvegicus
aaagcatggactgtgaaagcactga

SEQ ID NO: 10181 - DNA, 25 bp, Rattus norvegicus
aaagcatgggtgagttttgagccgt

SEQ ID NO: 10182 - DNA, 25 bp, Rattus norvegicus
aaagcatgggtgctttttctcccac

SEQ ID NO: 10183 - DNA, 25 bp, Rattus norvegicus
aaagcatgggtggtttttctcccac

SEQ ID NO: 10184 - DNA, 25 bp, Rattus norvegicus
aaagcatgggtgtgttttgagccgt

SEQ ID NO: 10185 - DNA, 25 bp, Rattus norvegicus
aaagcatgtgaaacctggcagctca

SEQ ID NO: 10186 - DNA, 25 bp, Rattus norvegicus
aaagcatgtgaatcctggcagctca

SEQ ID NO: 10187 - DNA, 25 bp, Rattus norvegicus
aaagcatgtgctcttatagtgcaga

SEQ ID NO: 10188 - DNA, 25 bp, Rattus norvegicus
aaagcatgtgctgttatagtgcaga

SEQ ID NO: 10189 - DNA, 25 bp, Rattus norvegicus
aaagcatgttctaagggtgcagcag

SEQ ID NO: 10190 - DNA, 25 bp, Rattus norvegicus
aaagcatgttctcgtgtcgctggca

SEQ ID NO: 10191 - DNA, 25 bp, Rattus norvegicus
aaagcatgttctggtgtcgctggca

SEQ ID NO: 10192 - DNA, 25 bp, Rattus norvegicus
aaagcatgttcttagggtgcagcag

SEQ ID NO: 10193 - DNA, 25 bp, Rattus norvegicus
aaagcattaaagaacattgacttaa

SEQ ID NO: 10194 - DNA, 25 bp, Rattus norvegicus
aaagcattaaagtacattgacttaa

SEQ ID NO: 10195 - DNA, 25 bp, Rattus norvegicus
aaagcattacttaaactgacaggga

SEQ ID NO: 10196 - DNA, 25 bp, Rattus norvegicus
aaagcattactttaactgacaggga

SEQ ID NO: 10197 - DNA, 25 bp, Rattus norvegicus
aaagcattcacaaggtcttctccac

SEQ ID NO: 10198 - DNA, 25 bp, Rattus norvegicus
aaagcattcacatggtcttctccac

SEQ ID NO: 10199 - DNA, 25 bp, Rattus norvegicus
aaagcattcctgactttggtctctg

SEQ ID NO: 10200 - DNA, 25 bp, Rattus norvegicus
aaagcattcctgtctttggtctctg

SEQ ID NO: 10201 - DNA, 25 bp, Rattus norvegicus
aaagcattctggcttgaccatgtct

SEQ ID NO: 10202 - DNA, 25 bp, Rattus norvegicus
aaagcattctgggttgaccatgtct

SEQ ID NO: 10203 - DNA, 25 bp, Rattus norvegicus
aaagcattcttgctagcacatcagc

SEQ ID NO: 10204 - DNA, 25 bp, Rattus norvegicus
aaagcattcttggtagcacatcagc

SEQ ID NO: 10205 - DNA, 25 bp, Rattus norvegicus
aaagcattctttcgacttgaggaag

SEQ ID NO: 10206 - DNA, 25 bp, Rattus norvegicus
aaagcattctttcggcctaacatgg

SEQ ID NO: 10207 - DNA, 25 bp, Rattus norvegicus
aaagcattctttggacttgaggaag

SEQ ID NO: 10208 - DNA, 25 bp, Rattus norvegicus
aaagcattctttgggcctaacatgg

SEQ ID NO: 10209 - DNA, 25 bp, Rattus norvegicus
aaagcattgcacagtatttattagt

SEQ ID NO: 10210 - DNA, 25 bp, Rattus norvegicus
aaagcattgcactgtatttattagt

SEQ ID NO: 10211 - DNA, 25 bp, Rattus norvegicus
aaagcattgctcacgtgtacagcac

SEQ ID NO: 10212 - DNA, 25 bp, Rattus norvegicus
aaagcattgctctcgtgtacagcac

SEQ ID NO: 10213 - DNA, 25 bp, Rattus norvegicus
aaagcattggagatgtctctcccca

SEQ ID NO: 10214 - DNA, 25 bp, Rattus norvegicus
aaagcattggagttgtctctcccca

SEQ ID NO: 10215 - DNA, 25 bp, Rattus norvegicus
aaagcattggttaagtgccagtcaa

SEQ ID NO: 10216 - DNA, 25 bp, Rattus norvegicus
aaagcattggtttagtgccagtcaa

SEQ ID NO: 10217 - DNA, 25 bp, Rattus norvegicus
aaagcatttattaacagcctgtgga

SEQ ID NO: 10218 - DNA, 25 bp, Rattus norvegicus
aaagcatttatttacagcctgtgga

SEQ ID NO: 10219 - DNA, 25 bp, Rattus norvegicus
aaagcatttgctaagccctgggttt

SEQ ID NO: 10220 - DNA, 25 bp, Rattus norvegicus
aaagcatttgctcttagtccctgca

SEQ ID NO: 10221 - DNA, 25 bp, Rattus norvegicus
aaagcatttgctgttagtccctgca

SEQ ID NO: 10222 - DNA, 25 bp, Rattus norvegicus
aaagcatttgcttagccctgggttt

SEQ ID NO: 10223 - DNA, 25 bp, Rattus norvegicus
aaagcatttgtgatgttcgtatgat

SEQ ID NO: 10224 - DNA, 25 bp, Rattus norvegicus
aaagcatttgtgttgttcgtatgat

SEQ ID NO: 10225 - DNA, 25 bp, Rattus norvegicus
aaagcattttaactgacttacatca

SEQ ID NO: 10226 - DNA, 25 bp, Rattus norvegicus
aaagcattttaagtgacttacatca

SEQ ID NO: 10227 - DNA, 25 bp, Rattus norvegicus
aaagccaaaaatcatccagacccgg

SEQ ID NO: 10228 - DNA, 25 bp, Rattus norvegicus
aaagccaaaaatgatccagacccgg

SEQ ID NO: 10229 - DNA, 25 bp, Rattus norvegicus
aaagccaaaagacagcacgcagtgc

SEQ ID NO: 10230 - DNA, 25 bp, Rattus norvegicus
aaagccaaaagagagcacgcagtgc

SEQ ID NO: 10231 - DNA, 25 bp, Rattus norvegicus
aaagccaaaatgacacttctgaaaa

SEQ ID NO: 10232 - DNA, 25 bp, Rattus norvegicus
aaagccaaaatgtcacttctgaaaa

SEQ ID NO: 10233 - DNA, 25 bp, Rattus norvegicus
aaagccaaaggcaacatattgagtc

SEQ ID NO: 10234 - DNA, 25 bp, Rattus norvegicus
aaagccaaaggcctcatttcaaatg

SEQ ID NO: 10235 - DNA, 25 bp, Rattus norvegicus
aaagccaaaggcgtcatttcaaatg

SEQ ID NO: 10236 - DNA, 25 bp, Rattus norvegicus
aaagccaaaggctacatattgagtc

SEQ ID NO: 10237 - DNA, 25 bp, Rattus norvegicus
aaagccaactgaccacagtgcgcgt

SEQ ID NO: 10238 - DNA, 25 bp, Rattus norvegicus
aaagccaactgagcacagtgcgcgt

SEQ ID NO: 10239 - DNA, 25 bp, Rattus norvegicus
aaagccaacttcagcctgcaggtta

SEQ ID NO: 10240 - DNA, 25 bp, Rattus norvegicus
aaagccaacttctgcctgcaggtta

SEQ ID NO: 10241 - DNA, 25 bp, Rattus norvegicus
aaagccaagactcataacatgccca

SEQ ID NO: 10242 - DNA, 25 bp, Rattus norvegicus
aaagccaagactgataacatgccca

SEQ ID NO: 10243 - DNA, 25 bp, Rattus norvegicus
aaagccaagattaccaagccagcac

SEQ ID NO: 10244 - DNA, 25 bp, Rattus norvegicus
aaagccaagatttccaagccagcac

SEQ ID NO: 10245 - DNA, 25 bp, Rattus norvegicus
aaagccaagcacctcgtcgggagat

SEQ ID NO: 10246 - DNA, 25 bp, Rattus norvegicus
aaagccaagcacgtcgtcgggagat

SEQ ID NO: 10247 - DNA, 25 bp, Rattus norvegicus
aaagccaagcagactcccaaagcct

SEQ ID NO: 10248 - DNA, 25 bp, Rattus norvegicus
aaagccaagcagtctcccaaagcct

SEQ ID NO: 10249 - DNA, 25 bp, Rattus norvegicus
aaagccaagctaaccctaggcgtgg

SEQ ID NO: 10250 - DNA, 25 bp, Rattus norvegicus
aaagccaagctatccctaggcgtgg

SEQ ID NO: 10251 - DNA, 25 bp, Rattus norvegicus
aaagccaagcttagacttcttgaag

SEQ ID NO: 10252 - DNA, 25 bp, Rattus norvegicus
aaagccaagctttgacttcttgaag

SEQ ID NO: 10253 - DNA, 25 bp, Rattus norvegicus
aaagccaaggtgcagcgcgacattg

SEQ ID NO: 10254 - DNA, 25 bp, Rattus norvegicus
aaagccaaggtggagcgcgacattg

SEQ ID NO: 10255 - DNA, 25 bp, Rattus norvegicus
aaagccaagttgacttcctggtgca

SEQ ID NO: 10256 - DNA, 25 bp, Rattus norvegicus
aaagccaagttgtcttcctggtgca

SEQ ID NO: 10257 - DNA, 25 bp, Rattus norvegicus
aaagccaatcagaaccatgtgcacg

SEQ ID NO: 10258 - DNA, 25 bp, Rattus norvegicus
aaagccaatcagtaccatgtgcacg

SEQ ID NO: 10259 - DNA, 25 bp, Rattus norvegicus
aaagccaatggacccagtcgctgtt

SEQ ID NO: 10260 - DNA, 25 bp, Rattus norvegicus
aaagccaatggagccagtcgctgtt

SEQ ID NO: 10261 - DNA, 25 bp, Rattus norvegicus
aaagccacacagctgcaaacgttga

SEQ ID NO: 10262 - DNA, 25 bp, Rattus norvegicus
aaagccacacaggtgcaaacgttga

SEQ ID NO: 10263 - DNA, 25 bp, Rattus norvegicus
aaagccacaggactggatcgggcct

SEQ ID NO: 10264 - DNA, 25 bp, Rattus norvegicus
aaagccacaggagtggatcgggcct

SEQ ID NO: 10265 - DNA, 25 bp, Rattus norvegicus
aaagccacagtccacttcagaatgt

SEQ ID NO: 10266 - DNA, 25 bp, Rattus norvegicus
aaagccacagtcgacttcagaatgt

SEQ ID NO: 10267 - DNA, 25 bp, Rattus norvegicus
aaagccacatggagaccttttcacc

SEQ ID NO: 10268 - DNA, 25 bp, Rattus norvegicus
aaagccacatggtgaccttttcacc

SEQ ID NO: 10269 - DNA, 25 bp, Rattus norvegicus
aaagccacattccagcttgaaccaa

SEQ ID NO: 10270 - DNA, 25 bp, Rattus norvegicus
aaagccacattcgagcttgaaccaa

SEQ ID NO: 10271 - DNA, 25 bp, Rattus norvegicus
aaagccaccaaaccgtttgagagct

SEQ ID NO: 10272 - DNA, 25 bp, Rattus norvegicus
aaagccaccaaagcgtttgagagct

SEQ ID NO: 10273 - DNA, 25 bp, Rattus norvegicus
aaagccaccacgcactcgaagttgt

SEQ ID NO: 10274 - DNA, 25 bp, Rattus norvegicus
aaagccaccacggactcgaagttgt

SEQ ID NO: 10275 - DNA, 25 bp, Rattus norvegicus
aaagccaccctgaaccgtggaggcg

SEQ ID NO: 10276 - DNA, 25 bp, Rattus norvegicus
aaagccaccctgaggcgagatgcac

SEQ ID NO: 10277 - DNA, 25 bp, Rattus norvegicus
aaagccaccctgtaccgtggaggcg

SEQ ID NO: 10278 - DNA, 25 bp, Rattus norvegicus
aaagccaccctgtggcgagatgcac

SEQ ID NO: 10279 - DNA, 25 bp, Rattus norvegicus
aaagccaccgagatctgagttgtcc

SEQ ID NO: 10280 - DNA, 25 bp, Rattus norvegicus
aaagccaccgagatgtgcgcattct

SEQ ID NO: 10281 - DNA, 25 bp, Rattus norvegicus
aaagccaccgagttctgagttgtcc

SEQ ID NO: 10282 - DNA, 25 bp, Rattus norvegicus
aaagccaccgagttgtgcgcattct

SEQ ID NO: 10283 - DNA, 25 bp, Rattus norvegicus
aaagccacgcctagatgtagcccgg

SEQ ID NO: 10284 - DNA, 25 bp, Rattus norvegicus
aaagccacgccttgatgtagcccgg

SEQ ID NO: 10285 - DNA, 25 bp, Rattus norvegicus
aaagccacgcttatacaggcgcgcg

SEQ ID NO: 10286 - DNA, 25 bp, Rattus norvegicus
aaagccacgcttttacaggcgcgcg

SEQ ID NO: 10287 - DNA, 25 bp, Rattus norvegicus
aaagccacggttaagatcagtcatc

SEQ ID NO: 10288 - DNA, 25 bp, Rattus norvegicus
aaagccacggtttagatcagtcatc

SEQ ID NO: 10289 - DNA, 25 bp, Rattus norvegicus
aaagccactaagagtccagtgcaga

SEQ ID NO: 10290 - DNA, 25 bp, Rattus norvegicus
aaagccactaagtgtccagtgcaga

SEQ ID NO: 10291 - DNA, 25 bp, Rattus norvegicus
aaagccactcagctctgccgtgttt

SEQ ID NO: 10292 - DNA, 25 bp, Rattus norvegicus
aaagccactcaggtctgccgtgttt

SEQ ID NO: 10293 - DNA, 25 bp, Rattus norvegicus
aaagccactctcatggcatttcaaa

SEQ ID NO: 10294 - DNA, 25 bp, Rattus norvegicus
aaagccactctcttggcatttcaaa

SEQ ID NO: 10295 - DNA, 25 bp, Rattus norvegicus
aaagccactgctactaaaagttgtg

SEQ ID NO: 10296 - DNA, 25 bp, Rattus norvegicus
aaagccactgcttctaaaagttgtg

SEQ ID NO: 10297 - DNA, 25 bp, Rattus norvegicus
aaagccactggaaggagcacatact

SEQ ID NO: 10298 - DNA, 25 bp, Rattus norvegicus
aaagccactggactgagtttctgca

SEQ ID NO: 10299 - DNA, 25 bp, Rattus norvegicus
aaagccactggagtgagtttctgca

SEQ ID NO: 10300 - DNA, 25 bp, Rattus norvegicus
aaagccactggatggagcacatact

SEQ ID NO: 10301 - DNA, 25 bp, Rattus norvegicus
aaagccactgggatcatgtctctaa

SEQ ID NO: 10302 - DNA, 25 bp, Rattus norvegicus
aaagccactgggttcatgtctctaa

SEQ ID NO: 10303 - DNA, 25 bp, Rattus norvegicus
aaagccactggtatgagtcaacatt

SEQ ID NO: 10304 - DNA, 25 bp, Rattus norvegicus
aaagccactggtttgagtcaacatt

SEQ ID NO: 10305 - DNA, 25 bp, Rattus norvegicus
aaagccacttacacctaaggccagg

SEQ ID NO: 10306 - DNA, 25 bp, Rattus norvegicus
aaagccacttactcctaaggccagg

SEQ ID NO: 10307 - DNA, 25 bp, Rattus norvegicus
aaagccacttcgacagggccttgga

SEQ ID NO: 10308 - DNA, 25 bp, Rattus norvegicus
aaagccacttcgtcagggccttgga

SEQ ID NO: 10309 - DNA, 25 bp, Rattus norvegicus
aaagccagaaaaatcctcagggtca

SEQ ID NO: 10310 - DNA, 25 bp, Rattus norvegicus
aaagccagaaaattcctcagggtca

SEQ ID NO: 10311 - DNA, 25 bp, Rattus norvegicus
aaagccagacagactttcagggagg

SEQ ID NO: 10312 - DNA, 25 bp, Rattus norvegicus
aaagccagacagtctttcagggagg

SEQ ID NO: 10313 - DNA, 25 bp, Rattus norvegicus
aaagccagaggcagagccacgtcta

SEQ ID NO: 10314 - DNA, 25 bp, Rattus norvegicus
aaagccagaggctgagccacgtcta

SEQ ID NO: 10315 - DNA, 25 bp, Rattus norvegicus
aaagccagcattcattgccctgtgc

SEQ ID NO: 10316 - DNA, 25 bp, Rattus norvegicus
aaagccagcattgattgccctgtgc

SEQ ID NO: 10317 - DNA, 25 bp, Rattus norvegicus
aaagccagccatatgagaccagcgt

SEQ ID NO: 10318 - DNA, 25 bp, Rattus norvegicus
aaagccagccatttgagaccagcgt

SEQ ID NO: 10319 - DNA, 25 bp, Rattus norvegicus
aaagccagcccaaacagccaggagc

SEQ ID NO: 10320 - DNA, 25 bp, Rattus norvegicus
aaagccagcccatacagccaggagc

SEQ ID NO: 10321 - DNA, 25 bp, Rattus norvegicus
aaagccagccttcattatctatcga

SEQ ID NO: 10322 - DNA, 25 bp, Rattus norvegicus
aaagccagccttgattatctatcga

SEQ ID NO: 10323 - DNA, 25 bp, Rattus norvegicus
aaagccagcgccaactgaagtcaag

SEQ ID NO: 10324 - DNA, 25 bp, Rattus norvegicus
aaagccagcgccagttttatctgtc

SEQ ID NO: 10325 - DNA, 25 bp, Rattus norvegicus
aaagccagcgcctactgaagtcaag

SEQ ID NO: 10326 - DNA, 25 bp, Rattus norvegicus
aaagccagcgcctgttttatctgtc

SEQ ID NO: 10327 - DNA, 25 bp, Rattus norvegicus
aaagccagctagactacaaagtaag

SEQ ID NO: 10328 - DNA, 25 bp, Rattus norvegicus
aaagccagctagtctacaaagtaag

SEQ ID NO: 10329 - DNA, 25 bp, Rattus norvegicus
aaagccagctttcgtacaggccaca

SEQ ID NO: 10330 - DNA, 25 bp, Rattus norvegicus
aaagccagctttggtacaggccaca

SEQ ID NO: 10331 - DNA, 25 bp, Rattus norvegicus
aaagccaggactcctaacgtcccat

SEQ ID NO: 10332 - DNA, 25 bp, Rattus norvegicus
aaagccaggactctgatacacctct

SEQ ID NO: 10333 - DNA, 25 bp, Rattus norvegicus
aaagccaggactgctaacgtcccat

SEQ ID NO: 10334 - DNA, 25 bp, Rattus norvegicus
aaagccaggactgtgatacacctct

SEQ ID NO: 10335 - DNA, 25 bp, Rattus norvegicus
aaagccaggcacaaggttagtttca

SEQ ID NO: 10336 - DNA, 25 bp, Rattus norvegicus
aaagccaggcactaggttagtttca

SEQ ID NO: 10337 - DNA, 25 bp, Rattus norvegicus
aaagccaggcatcctagcttgtgct

SEQ ID NO: 10338 - DNA, 25 bp, Rattus norvegicus
aaagccaggcatctatatcccgtgt

SEQ ID NO: 10339 - DNA, 25 bp, Rattus norvegicus
aaagccaggcatgctagcttgtgct

SEQ ID NO: 10340 - DNA, 25 bp, Rattus norvegicus
aaagccaggcatgtatatcccgtgt

SEQ ID NO: 10341 - DNA, 25 bp, Rattus norvegicus
aaagccagggccatctgtcttgtgt

SEQ ID NO: 10342 - DNA, 25 bp, Rattus norvegicus
aaagccagggccttctgtcttgtgt

SEQ ID NO: 10343 - DNA, 25 bp, Rattus norvegicus
aaagccagggctatcgctaggactc

SEQ ID NO: 10344 - DNA, 25 bp, Rattus norvegicus
aaagccagggctttcgctaggactc

SEQ ID NO: 10345 - DNA, 25 bp, Rattus norvegicus
aaagccaggtgcagcatcaatctat

SEQ ID NO: 10346 - DNA, 25 bp, Rattus norvegicus
aaagccaggtgctgcatcaatctat

SEQ ID NO: 10347 - DNA, 25 bp, Rattus norvegicus
aaagccaggttaaccatcactggga

SEQ ID NO: 10348 - DNA, 25 bp, Rattus norvegicus
aaagccaggttatccatcactggga

SEQ ID NO: 10349 - DNA, 25 bp, Rattus norvegicus
aaagccagtggcctttgcatagatt

SEQ ID NO: 10350 - DNA, 25 bp, Rattus norvegicus
aaagccagtggcgtttgcatagatt

SEQ ID NO: 10351 - DNA, 25 bp, Rattus norvegicus
aaagccagtgtgaactatcaggagt

SEQ ID NO: 10352 - DNA, 25 bp, Rattus norvegicus
aaagccagtgtgtactatcaggagt

SEQ ID NO: 10353 - DNA, 25 bp, Rattus norvegicus
aaagccatagaacggatgattcatc

SEQ ID NO: 10354 - DNA, 25 bp, Rattus norvegicus
aaagccatagaagggatgattcatc

SEQ ID NO: 10355 - DNA, 25 bp, Rattus norvegicus
aaagccataggcatctggtaccaca

SEQ ID NO: 10356 - DNA, 25 bp, Rattus norvegicus
aaagccataggccaattgctgggcg

SEQ ID NO: 10357 - DNA, 25 bp, Rattus norvegicus
aaagccataggcgaattgctgggcg

SEQ ID NO: 10358 - DNA, 25 bp, Rattus norvegicus
aaagccataggcttctggtaccaca

SEQ ID NO: 10359 - DNA, 25 bp, Rattus norvegicus
aaagccatcaagaaggacactcaat

SEQ ID NO: 10360 - DNA, 25 bp, Rattus norvegicus
aaagccatcaagtaggacactcaat

SEQ ID NO: 10361 - DNA, 25 bp, Rattus norvegicus
aaagccatcaccctgtgggagcaga

SEQ ID NO: 10362 - DNA, 25 bp, Rattus norvegicus
aaagccatcaccgtgtgggagcaga

SEQ ID NO: 10363 - DNA, 25 bp, Rattus norvegicus
aaagccatcataacgctagttggaa

SEQ ID NO: 10364 - DNA, 25 bp, Rattus norvegicus
aaagccatcatatcgctagttggaa

SEQ ID NO: 10365 - DNA, 25 bp, Rattus norvegicus
aaagccatcccaaggccagatgata

SEQ ID NO: 10366 - DNA, 25 bp, Rattus norvegicus
aaagccatcccatggccagatgata

SEQ ID NO: 10367 - DNA, 25 bp, Rattus norvegicus
aaagccatcctgaaaggtctagaga

SEQ ID NO: 10368 - DNA, 25 bp, Rattus norvegicus
aaagccatcctgtaaggtctagaga

SEQ ID NO: 10369 - DNA, 25 bp, Rattus norvegicus
aaagccatcgggaacttcatgtgat

SEQ ID NO: 10370 - DNA, 25 bp, Rattus norvegicus
aaagccatcgggtacttcatgtgat

SEQ ID NO: 10371 - DNA, 25 bp, Rattus norvegicus
aaagccatcgtcacctcagcattag

SEQ ID NO: 10372 - DNA, 25 bp, Rattus norvegicus
aaagccatcgtctcctcagcattag

SEQ ID NO: 10373 - DNA, 25 bp, Rattus norvegicus
aaagccatctgccattttgtatagc

SEQ ID NO: 10374 - DNA, 25 bp, Rattus norvegicus
aaagccatctgcgattttgtatagc

SEQ ID NO: 10375 - DNA, 25 bp, Rattus norvegicus
aaagccatcttcagtagctgctgtc

SEQ ID NO: 10376 - DNA, 25 bp, Rattus norvegicus
aaagccatcttctgtagctgctgtc

SEQ ID NO: 10377 - DNA, 25 bp, Rattus norvegicus
aaagccatgaccatttccttctggt

SEQ ID NO: 10378 - DNA, 25 bp, Rattus norvegicus
aaagccatgaccttttccttctggt

SEQ ID NO: 10379 - DNA, 25 bp, Rattus norvegicus
aaagccatgcccagttcctgtagtg

SEQ ID NO: 10380 - DNA, 25 bp, Rattus norvegicus
aaagccatgccctgttcctgtagtg

SEQ ID NO: 10381 - DNA, 25 bp, Rattus norvegicus
aaagccatgctgcttccttaggcgc

SEQ ID NO: 10382 - DNA, 25 bp, Rattus norvegicus
aaagccatgctggttccttaggcgc

SEQ ID NO: 10383 - DNA, 25 bp, Rattus norvegicus
aaagccatggacatactcaatttca

SEQ ID NO: 10384 - DNA, 25 bp, Rattus norvegicus
aaagccatggacttactcaatttca

SEQ ID NO: 10385 - DNA, 25 bp, Rattus norvegicus
aaagccatggagctgacactgacaa

SEQ ID NO: 10386 - DNA, 25 bp, Rattus norvegicus
aaagccatggaggtgacactgacaa

SEQ ID NO: 10387 - DNA, 25 bp, Rattus norvegicus
aaagccatggatctcctgctatcct

SEQ ID NO: 10388 - DNA, 25 bp, Rattus norvegicus
aaagccatggatgtcctgctatcct

SEQ ID NO: 10389 - DNA, 25 bp, Rattus norvegicus
aaagccatggtccatgctactcctg

SEQ ID NO: 10390 - DNA, 25 bp, Rattus norvegicus
aaagccatggtcgatgctactcctg

SEQ ID NO: 10391 - DNA, 25 bp, Rattus norvegicus
aaagccatggtgactctgcaatcaa

SEQ ID NO: 10392 - DNA, 25 bp, Rattus norvegicus
aaagccatggtgtctctgcaatcaa

SEQ ID NO: 10393 - DNA, 25 bp, Rattus norvegicus
aaagccatgttcagcagcagcgttt

SEQ ID NO: 10394 - DNA, 25 bp, Rattus norvegicus
aaagccatgttctgcagcagcgttt

SEQ ID NO: 10395 - DNA, 25 bp, Rattus norvegicus
aaagccattattcgctgaggcacca

SEQ ID NO: 10396 - DNA, 25 bp, Rattus norvegicus
aaagccattattggctgaggcacca

SEQ ID NO: 10397 - DNA, 25 bp, Rattus norvegicus
aaagccattcccaggattggataca

SEQ ID NO: 10398 - DNA, 25 bp, Rattus norvegicus
aaagccattccctggattggataca

SEQ ID NO: 10399 - DNA, 25 bp, Rattus norvegicus
aaagccatttcacagcccaacttct

SEQ ID NO: 10400 - DNA, 25 bp, Rattus norvegicus
aaagccatttcagagcccaacttct

SEQ ID NO: 10401 - DNA, 25 bp, Rattus norvegicus
aaagccatttccatcatgtcagaat

SEQ ID NO: 10402 - DNA, 25 bp, Rattus norvegicus
aaagccatttccttcatgtcagaat

SEQ ID NO: 10403 - DNA, 25 bp, Rattus norvegicus
aaagccattttgcatctgtcgagcc

SEQ ID NO: 10404 - DNA, 25 bp, Rattus norvegicus
aaagccattttggatctgtcgagcc

SEQ ID NO: 10405 - DNA, 25 bp, Rattus norvegicus
aaagccatttttacagtcgtcttca

SEQ ID NO: 10406 - DNA, 25 bp, Rattus norvegicus
aaagccattttttcagtcgtcttca

SEQ ID NO: 10407 - DNA, 25 bp, Rattus norvegicus
aaagcccaacacacctgtcttttgt

SEQ ID NO: 10408 - DNA, 25 bp, Rattus norvegicus
aaagcccaacactcctgtcttttgt

SEQ ID NO: 10409 - DNA, 25 bp, Rattus norvegicus
aaagcccaactgagcgcaactgtag

SEQ ID NO: 10410 - DNA, 25 bp, Rattus norvegicus
aaagcccaactgtgcgcaactgtag

SEQ ID NO: 10411 - DNA, 25 bp, Rattus norvegicus
aaagcccaagtccacgtaatcatct

SEQ ID NO: 10412 - DNA, 25 bp, Rattus norvegicus
aaagcccaagtcgacgtaatcatct

SEQ ID NO: 10413 - DNA, 25 bp, Rattus norvegicus
aaagcccaatgaccagatttgtgga

SEQ ID NO: 10414 - DNA, 25 bp, Rattus norvegicus
aaagcccaatgagcagatttgtgga

SEQ ID NO: 10415 - DNA, 25 bp, Rattus norvegicus
aaagcccacaagacctgaatttctc

SEQ ID NO: 10416 - DNA, 25 bp, Rattus norvegicus
aaagcccacaagtcctgaatttctc

SEQ ID NO: 10417 - DNA, 25 bp, Rattus norvegicus
aaagcccacagactcagagcccatg

SEQ ID NO: 10418 - DNA, 25 bp, Rattus norvegicus
aaagcccacagagtcagagcccatg

SEQ ID NO: 10419 - DNA, 25 bp, Rattus norvegicus
aaagcccactataatcgatacgatg

SEQ ID NO: 10420 - DNA, 25 bp, Rattus norvegicus
aaagcccactattatcgatacgatg

SEQ ID NO: 10421 - DNA, 25 bp, Rattus norvegicus
aaagcccactgtcagaggcaccatt

SEQ ID NO: 10422 - DNA, 25 bp, Rattus norvegicus
aaagcccactgtgagaggcaccatt

SEQ ID NO: 10423 - DNA, 25 bp, Rattus norvegicus
aaagcccagaatctacagctaccga

SEQ ID NO: 10424 - DNA, 25 bp, Rattus norvegicus
aaagcccagaatgtacagctaccga

SEQ ID NO: 10425 - DNA, 25 bp, Rattus norvegicus
aaagcccagcacatgaattgttctt

SEQ ID NO: 10426 - DNA, 25 bp, Rattus norvegicus
aaagcccagcacttgaattgttctt

SEQ ID NO: 10427 - DNA, 25 bp, Rattus norvegicus
aaagcccagcagatgtttcactcgg

SEQ ID NO: 10428 - DNA, 25 bp, Rattus norvegicus
aaagcccagcagttgtttcactcgg

SEQ ID NO: 10429 - DNA, 25 bp, Rattus norvegicus
aaagcccagcggatactgaaacagt

SEQ ID NO: 10430 - DNA, 25 bp, Rattus norvegicus
aaagcccagcggttactgaaacagt

SEQ ID NO: 10431 - DNA, 25 bp, Rattus norvegicus
aaagcccaggccagtttgtcaaagg

SEQ ID NO: 10432 - DNA, 25 bp, Rattus norvegicus
aaagcccaggcctgtttgtcaaagg

SEQ ID NO: 10433 - DNA, 25 bp, Rattus norvegicus
aaagcccagggcagttctgaccgtc

SEQ ID NO: 10434 - DNA, 25 bp, Rattus norvegicus
aaagcccagggctgttctgaccgtc

SEQ ID NO: 10435 - DNA, 25 bp, Rattus norvegicus
aaagcccaggtcaatccaggaggaa

SEQ ID NO: 10436 - DNA, 25 bp, Rattus norvegicus
aaagcccaggtcatgtggagctgcc

SEQ ID NO: 10437 - DNA, 25 bp, Rattus norvegicus
aaagcccaggtctatccaggaggaa

SEQ ID NO: 10438 - DNA, 25 bp, Rattus norvegicus
aaagcccaggtcttgtggagctgcc

SEQ ID NO: 10439 - DNA, 25 bp, Rattus norvegicus
aaagcccaggttcagcatcgcggga

SEQ ID NO: 10440 - DNA, 25 bp, Rattus norvegicus
aaagcccaggttgagcatcgcggga

SEQ ID NO: 10441 - DNA, 25 bp, Rattus norvegicus
aaagcccagtcccagtgtttacatc

SEQ ID NO: 10442 - DNA, 25 bp, Rattus norvegicus
aaagcccagtccgagtgtttacatc

SEQ ID NO: 10443 - DNA, 25 bp, Rattus norvegicus
aaagcccagtctcccgcagaaagaa

SEQ ID NO: 10444 - DNA, 25 bp, Rattus norvegicus
aaagcccagtctgccgcagaaagaa

SEQ ID NO: 10445 - DNA, 25 bp, Rattus norvegicus
aaagcccatgccatttccagttagt

SEQ ID NO: 10446 - DNA, 25 bp, Rattus norvegicus
aaagcccatgccttttccagttagt

SEQ ID NO: 10447 - DNA, 25 bp, Rattus norvegicus
aaagcccatgctacttgactttggt

SEQ ID NO: 10448 - DNA, 25 bp, Rattus norvegicus
aaagcccatgcttcttgactttggt

SEQ ID NO: 10449 - DNA, 25 bp, Rattus norvegicus
aaagcccatggtagcagtggtggaa

SEQ ID NO: 10450 - DNA, 25 bp, Rattus norvegicus
aaagcccatggttgcagtggtggaa

SEQ ID NO: 10451 - DNA, 25 bp, Rattus norvegicus
aaagcccattaaattgtgcacacta

SEQ ID NO: 10452 - DNA, 25 bp, Rattus norvegicus
aaagcccattaatttgtgcacacta

SEQ ID NO: 10453 - DNA, 25 bp, Rattus norvegicus
aaagcccattatatctttgccttcg

SEQ ID NO: 10454 - DNA, 25 bp, Rattus norvegicus
aaagcccattatttctttgccttcg

SEQ ID NO: 10455 - DNA, 25 bp, Rattus norvegicus
aaagccccaaatacctgttagccag

SEQ ID NO: 10456 - DNA, 25 bp, Rattus norvegicus
aaagccccaaattcctgttagccag

SEQ ID NO: 10457 - DNA, 25 bp, Rattus norvegicus
aaagccccaagcagtcaaactgaca

SEQ ID NO: 10458 - DNA, 25 bp, Rattus norvegicus
aaagccccaagctgtcaaactgaca

SEQ ID NO: 10459 - DNA, 25 bp, Rattus norvegicus
aaagccccacaaaacagcaatgcaa

SEQ ID NO: 10460 - DNA, 25 bp, Rattus norvegicus
aaagccccacaactgcatctgctga

SEQ ID NO: 10461 - DNA, 25 bp, Rattus norvegicus
aaagccccacaagtgcatctgctga

SEQ ID NO: 10462 - DNA, 25 bp, Rattus norvegicus
aaagccccacaatacagcaatgcaa

SEQ ID NO: 10463 - DNA, 25 bp, Rattus norvegicus
aaagccccagccaggtggatctctg

SEQ ID NO: 10464 - DNA, 25 bp, Rattus norvegicus
aaagccccagcctggtggatctctg

SEQ ID NO: 10465 - DNA, 25 bp, Rattus norvegicus
aaagccccagtcattctcttggatt

SEQ ID NO: 10466 - DNA, 25 bp, Rattus norvegicus
aaagccccagtctttctcttggatt

SEQ ID NO: 10467 - DNA, 25 bp, Rattus norvegicus
aaagccccagtgacctctgaaatgt

SEQ ID NO: 10468 - DNA, 25 bp, Rattus norvegicus
aaagccccagtgtcctctgaaatgt

SEQ ID NO: 10469 - DNA, 25 bp, Rattus norvegicus
aaagccccattgctctagtcaactt

SEQ ID NO: 10470 - DNA, 25 bp, Rattus norvegicus
aaagccccattggtctagtcaactt

SEQ ID NO: 10471 - DNA, 25 bp, Rattus norvegicus
aaagccccatttcgtgtgtctgaga

SEQ ID NO: 10472 - DNA, 25 bp, Rattus norvegicus
aaagccccatttggtgtgtctgaga

SEQ ID NO: 10473 - DNA, 25 bp, Rattus norvegicus
aaagccccgccaagaaagcagccgt

SEQ ID NO: 10474 - DNA, 25 bp, Rattus norvegicus
aaagccccgccatgaaagcagccgt

SEQ ID NO: 10475 - DNA, 25 bp, Rattus norvegicus
aaagcccctaatatgacctcaggaa

SEQ ID NO: 10476 - DNA, 25 bp, Rattus norvegicus
aaagcccctaatttgacctcaggaa

SEQ ID NO: 10477 - DNA, 25 bp, Rattus norvegicus
aaagcccctacaccacagaggtgat

SEQ ID NO: 10478 - DNA, 25 bp, Rattus norvegicus
aaagcccctacagcacagaggtgat

SEQ ID NO: 10479 - DNA, 25 bp, Rattus norvegicus
aaagcccctagacgcgtggccatac

SEQ ID NO: 10480 - DNA, 25 bp, Rattus norvegicus
aaagcccctagaggcgtggccatac

SEQ ID NO: 10481 - DNA, 25 bp, Rattus norvegicus
aaagcccctgtaatctaatcacgga

SEQ ID NO: 10482 - DNA, 25 bp, Rattus norvegicus
aaagcccctgtattctaatcacgga

SEQ ID NO: 10483 - DNA, 25 bp, Rattus norvegicus
aaagcccctgtcactactttgaaga

SEQ ID NO: 10484 - DNA, 25 bp, Rattus norvegicus
aaagcccctgtctctactttgaaga

SEQ ID NO: 10485 - DNA, 25 bp, Rattus norvegicus
aaagccccttccctgcaaacatgtg

SEQ ID NO: 10486 - DNA, 25 bp, Rattus norvegicus
aaagccccttccgtgcaaacatgtg

SEQ ID NO: 10487 - DNA, 25 bp, Rattus norvegicus
aaagcccgagatacagaaacctgca

SEQ ID NO: 10488 - DNA, 25 bp, Rattus norvegicus
aaagcccgagattcagaaacctgca

SEQ ID NO: 10489 - DNA, 25 bp, Rattus norvegicus
aaagcccgcgatcactttgtcgttg

SEQ ID NO: 10490 - DNA, 25 bp, Rattus norvegicus
aaagcccgcgatgactttgtcgttg

SEQ ID NO: 10491 - DNA, 25 bp, Rattus norvegicus
aaagcccggcgactggatgactact

SEQ ID NO: 10492 - DNA, 25 bp, Rattus norvegicus
aaagcccggcgagtggatgactact

SEQ ID NO: 10493 - DNA, 25 bp, Rattus norvegicus
aaagcccgggttctcgcggctccat

SEQ ID NO: 10494 - DNA, 25 bp, Rattus norvegicus
aaagcccgggttgtcgcggctccat

SEQ ID NO: 10495 - DNA, 25 bp, Rattus norvegicus
aaagcccgtccacaggatgtagccc

SEQ ID NO: 10496 - DNA, 25 bp, Rattus norvegicus
aaagcccgtccagaggatgtagccc

SEQ ID NO: 10497 - DNA, 25 bp, Rattus norvegicus
aaagcccgtggaccctggttgcctg

SEQ ID NO: 10498 - DNA, 25 bp, Rattus norvegicus
aaagcccgtggagcctggttgcctg

SEQ ID NO: 10499 - DNA, 25 bp, Rattus norvegicus
aaagccctacagcactttcaccagt

SEQ ID NO: 10500 - DNA, 25 bp, Rattus norvegicus
aaagccctacaggactttcaccagt

SEQ ID NO: 10501 - DNA, 25 bp, Rattus norvegicus
aaagccctaccactgtgtccacgta

SEQ ID NO: 10502 - DNA, 25 bp, Rattus norvegicus
aaagccctaccagtgtgtccacgta

SEQ ID NO: 10503 - DNA, 25 bp, Rattus norvegicus
aaagccctccccaggtgatggacaa

SEQ ID NO: 10504 - DNA, 25 bp, Rattus norvegicus
aaagccctcccctggtgatggacaa

SEQ ID NO: 10505 - DNA, 25 bp, Rattus norvegicus
aaagccctcctgacaacatcagggt

SEQ ID NO: 10506 - DNA, 25 bp, Rattus norvegicus
aaagccctcctgactgagctgtttt

SEQ ID NO: 10507 - DNA, 25 bp, Rattus norvegicus
aaagccctcctgtcaacatcagggt

SEQ ID NO: 10508 - DNA, 25 bp, Rattus norvegicus
aaagccctcctgtctgagctgtttt

SEQ ID NO: 10509 - DNA, 25 bp, Rattus norvegicus
aaagccctcgctctgagaggagcta

SEQ ID NO: 10510 - DNA, 25 bp, Rattus norvegicus
aaagccctcgctgtgagaggagcta

SEQ ID NO: 10511 - DNA, 25 bp, Rattus norvegicus
aaagccctcgggaggtcactgttgt

SEQ ID NO: 10512 - DNA, 25 bp, Rattus norvegicus
aaagccctcgggtggtcactgttgt

SEQ ID NO: 10513 - DNA, 25 bp, Rattus norvegicus
aaagccctctctatgacatcagcta

SEQ ID NO: 10514 - DNA, 25 bp, Rattus norvegicus
aaagccctctctttgacatcagcta

SEQ ID NO: 10515 - DNA, 25 bp, Rattus norvegicus
aaagccctgaagacagatgcctgaa

SEQ ID NO: 10516 - DNA, 25 bp, Rattus norvegicus
aaagccctgaagtcagatgcctgaa

SEQ ID NO: 10517 - DNA, 25 bp, Rattus norvegicus
aaagccctgagcagaaggcctttgc

SEQ ID NO: 10518 - DNA, 25 bp, Rattus norvegicus
aaagccctgagctgaaggcctttgc

SEQ ID NO: 10519 - DNA, 25 bp, Rattus norvegicus
aaagccctgcaacgcctgctgacta

SEQ ID NO: 10520 - DNA, 25 bp, Rattus norvegicus
aaagccctgcaaggcctgctgacta

SEQ ID NO: 10521 - DNA, 25 bp, Rattus norvegicus
aaagccctgccaatgtggctgctgt

SEQ ID NO: 10522 - DNA, 25 bp, Rattus norvegicus
aaagccctgccattgtggctgctgt

SEQ ID NO: 10523 - DNA, 25 bp, Rattus norvegicus
aaagccctgctgattttggatctat

SEQ ID NO: 10524 - DNA, 25 bp, Rattus norvegicus
aaagccctgctgtttttggatctat

SEQ ID NO: 10525 - DNA, 25 bp, Rattus norvegicus
aaagccctggagctgtaccattcag

SEQ ID NO: 10526 - DNA, 25 bp, Rattus norvegicus
aaagccctggaggtgtaccattcag

SEQ ID NO: 10527 - DNA, 25 bp, Rattus norvegicus
aaagccctggcaaaggcgaagacct

SEQ ID NO: 10528 - DNA, 25 bp, Rattus norvegicus
aaagccctggcataggcgaagacct

SEQ ID NO: 10529 - DNA, 25 bp, Rattus norvegicus
aaagccctgggccattgtcttcttg

SEQ ID NO: 10530 - DNA, 25 bp, Rattus norvegicus
aaagccctgggcgattgtcttcttg

SEQ ID NO: 10531 - DNA, 25 bp, Rattus norvegicus
aaagccctggtgacttagccctaga

SEQ ID NO: 10532 - DNA, 25 bp, Rattus norvegicus
aaagccctggtgtcttagccctaga

SEQ ID NO: 10533 - DNA, 25 bp, Rattus norvegicus
aaagccctggttactgtcactcagc

SEQ ID NO: 10534 - DNA, 25 bp, Rattus norvegicus
aaagccctggtttctgtcactcagc

SEQ ID NO: 10535 - DNA, 25 bp, Rattus norvegicus
aaagcccttaggcaggctaccactt

SEQ ID NO: 10536 - DNA, 25 bp, Rattus norvegicus
aaagcccttagggaggctaccactt

SEQ ID NO: 10537 - DNA, 25 bp, Rattus norvegicus
aaagcccttcctagaaattatctgg

SEQ ID NO: 10538 - DNA, 25 bp, Rattus norvegicus
aaagcccttccttgaaattatctgg

SEQ ID NO: 10539 - DNA, 25 bp, Rattus norvegicus
aaagcccttgggacgtgaagctctt

SEQ ID NO: 10540 - DNA, 25 bp, Rattus norvegicus
aaagcccttgggtcgtgaagctctt

SEQ ID NO: 10541 - DNA, 25 bp, Rattus norvegicus
aaagccctttccaatacttgcaggg

SEQ ID NO: 10542 - DNA, 25 bp, Rattus norvegicus
aaagccctttcctatacttgcaggg

SEQ ID NO: 10543 - DNA, 25 bp, Rattus norvegicus
aaagccgaaccgagctttgatctac

SEQ ID NO: 10544 - DNA, 25 bp, Rattus norvegicus
aaagccgaaccgtgctttgatctac

SEQ ID NO: 10545 - DNA, 25 bp, Rattus norvegicus
aaagccgacagcacgagttggttat

SEQ ID NO: 10546 - DNA, 25 bp, Rattus norvegicus
aaagccgacagctcgagttggttat

SEQ ID NO: 10547 - DNA, 25 bp, Rattus norvegicus
aaagccgacatgatagagctcctgg

SEQ ID NO: 10548 - DNA, 25 bp, Rattus norvegicus
aaagccgacatgttagagctcctgg

SEQ ID NO: 10549 - DNA, 25 bp, Rattus norvegicus
aaagccgagaccagtcttttcagtg

SEQ ID NO: 10550 - DNA, 25 bp, Rattus norvegicus
aaagccgagacctgtcttttcagtg

SEQ ID NO: 10551 - DNA, 25 bp, Rattus norvegicus
aaagccgagagtccgcagttaaaca

SEQ ID NO: 10552 - DNA, 25 bp, Rattus norvegicus
aaagccgagagtgcgcagttaaaca

SEQ ID NO: 10553 - DNA, 25 bp, Rattus norvegicus
aaagccgatcccaggacaggagtct

SEQ ID NO: 10554 - DNA, 25 bp, Rattus norvegicus
aaagccgatccctggacaggagtct

SEQ ID NO: 10555 - DNA, 25 bp, Rattus norvegicus
aaagccgatgcgctctcgaatttct

SEQ ID NO: 10556 - DNA, 25 bp, Rattus norvegicus
aaagccgatgcggtctcgaatttct

SEQ ID NO: 10557 - DNA, 25 bp, Rattus norvegicus
aaagccgcaaatcagggcccggtgt

SEQ ID NO: 10558 - DNA, 25 bp, Rattus norvegicus
aaagccgcaaatgagggcccggtgt

SEQ ID NO: 10559 - DNA, 25 bp, Rattus norvegicus
aaagccgcaccacatgcagtgtctt

SEQ ID NO: 10560 - DNA, 25 bp, Rattus norvegicus
aaagccgcaccagatgcagtgtctt

SEQ ID NO: 10561 - DNA, 25 bp, Rattus norvegicus
aaagccgcacttaataccccaactg

SEQ ID NO: 10562 - DNA, 25 bp, Rattus norvegicus
aaagccgcactttataccccaactg

SEQ ID NO: 10563 - DNA, 25 bp, Rattus norvegicus
aaagccgccatgacagctccaattg

SEQ ID NO: 10564 - DNA, 25 bp, Rattus norvegicus
aaagccgccatgtcagctccaattg

SEQ ID NO: 10565 - DNA, 25 bp, Rattus norvegicus
aaagccgccccgaaagcaggaggat

SEQ ID NO: 10566 - DNA, 25 bp, Rattus norvegicus
aaagccgccccgtaagcaggaggat

SEQ ID NO: 10567 - DNA, 25 bp, Rattus norvegicus
aaagccgcccctccatgtgtgattt

SEQ ID NO: 10568 - DNA, 25 bp, Rattus norvegicus
aaagccgcccctgcatgtgtgattt

SEQ ID NO: 10569 - DNA, 25 bp, Rattus norvegicus
aaagccgcctgcaccaaatgggagt

SEQ ID NO: 10570 - DNA, 25 bp, Rattus norvegicus
aaagccgcctgctccaaatgggagt

SEQ ID NO: 10571 - DNA, 25 bp, Rattus norvegicus
aaagccgcggtgcagatgtacatct

SEQ ID NO: 10572 - DNA, 25 bp, Rattus norvegicus
aaagccgcggtggagatgtacatct

SEQ ID NO: 10573 - DNA, 25 bp, Rattus norvegicus
aaagccgctctgagaagaggctcac

SEQ ID NO: 10574 - DNA, 25 bp, Rattus norvegicus
aaagccgctctgtgaagaggctcac

SEQ ID NO: 10575 - DNA, 25 bp, Rattus norvegicus
aaagccgctgacacttggcccgctg

SEQ ID NO: 10576 - DNA, 25 bp, Rattus norvegicus
aaagccgctgactcttggcccgctg

SEQ ID NO: 10577 - DNA, 25 bp, Rattus norvegicus
aaagccgctttccagcctgaagcca

SEQ ID NO: 10578 - DNA, 25 bp, Rattus norvegicus
aaagccgctttcgagcctgaagcca

SEQ ID NO: 10579 - DNA, 25 bp, Rattus norvegicus
aaagccggatcaccaggtatcaaga

SEQ ID NO: 10580 - DNA, 25 bp, Rattus norvegicus
aaagccggatcagcaggtatcaaga

SEQ ID NO: 10581 - DNA, 25 bp, Rattus norvegicus
aaagccggattcagtgtcagtggag

SEQ ID NO: 10582 - DNA, 25 bp, Rattus norvegicus
aaagccggattctgtgtcagtggag

SEQ ID NO: 10583 - DNA, 25 bp, Rattus norvegicus
aaagccggcagcatgtgagtagcaa

SEQ ID NO: 10584 - DNA, 25 bp, Rattus norvegicus
aaagccggcagcttgtgagtagcaa

SEQ ID NO: 10585 - DNA, 25 bp, Rattus norvegicus
aaagccggcatgctagcacaggcct

SEQ ID NO: 10586 - DNA, 25 bp, Rattus norvegicus
aaagccggcatggtagcacaggcct

SEQ ID NO: 10587 - DNA, 25 bp, Rattus norvegicus
aaagccggctttaatgtaatccaat

SEQ ID NO: 10588 - DNA, 25 bp, Rattus norvegicus
aaagccggcttttatgtaatccaat

SEQ ID NO: 10589 - DNA, 25 bp, Rattus norvegicus
aaagccggtatgagcaaccctgcat

SEQ ID NO: 10590 - DNA, 25 bp, Rattus norvegicus
aaagccggtatgtgcaaccctgcat

SEQ ID NO: 10591 - DNA, 25 bp, Rattus norvegicus
aaagccggtgaccagaagacctgcc

SEQ ID NO: 10592 - DNA, 25 bp, Rattus norvegicus
aaagccggtgacgagaagacctgcc

SEQ ID NO: 10593 - DNA, 25 bp, Rattus norvegicus
aaagccggttatatatttgtcgatg

SEQ ID NO: 10594 - DNA, 25 bp, Rattus norvegicus
aaagccggttatttatttgtcgatg

SEQ ID NO: 10595 - DNA, 25 bp, Rattus norvegicus
aaagccggttgaacacagggagcct

SEQ ID NO: 10596 - DNA, 25 bp, Rattus norvegicus
aaagccggttgatcacagggagcct

SEQ ID NO: 10597 - DNA, 25 bp, Rattus norvegicus
aaagccgtcatcctaaagaacattg

SEQ ID NO: 10598 - DNA, 25 bp, Rattus norvegicus
aaagccgtcatcgtaaagaacattg

SEQ ID NO: 10599 - DNA, 25 bp, Rattus norvegicus
aaagccgtccaaagaaattccacat

SEQ ID NO: 10600 - DNA, 25 bp, Rattus norvegicus
aaagccgtccaatgaaattccacat

SEQ ID NO: 10601 - DNA, 25 bp, Rattus norvegicus
aaagccgtccatattcagttgagtt

SEQ ID NO: 10602 - DNA, 25 bp, Rattus norvegicus
aaagccgtccattttcagttgagtt

SEQ ID NO: 10603 - DNA, 25 bp, Rattus norvegicus
aaagccgtccgacccagttcagtgg

SEQ ID NO: 10604 - DNA, 25 bp, Rattus norvegicus
aaagccgtccgagccagttcagtgg

SEQ ID NO: 10605 - DNA, 25 bp, Rattus norvegicus
aaagccgtccgtccgtggactgtca

SEQ ID NO: 10606 - DNA, 25 bp, Rattus norvegicus
aaagccgtccgtgcgtggactgtca

SEQ ID NO: 10607 - DNA, 25 bp, Rattus norvegicus
aaagccgtgcaaccctttgtggacg

SEQ ID NO: 10608 - DNA, 25 bp, Rattus norvegicus
aaagccgtgcaagcctttgtggacg

SEQ ID NO: 10609 - DNA, 25 bp, Rattus norvegicus
aaagccgtgctcagatgtgattttt

SEQ ID NO: 10610 - DNA, 25 bp, Rattus norvegicus
aaagccgtgctctgatgtgattttt

SEQ ID NO: 10611 - DNA, 25 bp, Rattus norvegicus
aaagccgtgcttctttaggctgctg

SEQ ID NO: 10612 - DNA, 25 bp, Rattus norvegicus
aaagccgtgcttgtttaggctgctg

SEQ ID NO: 10613 - DNA, 25 bp, Rattus norvegicus
aaagccgtgtttactgtgcgagtca

SEQ ID NO: 10614 - DNA, 25 bp, Rattus norvegicus
aaagccgtgttttctgtgcgagtca

SEQ ID NO: 10615 - DNA, 25 bp, Rattus norvegicus
aaagccgttactaaggagagcctgt

SEQ ID NO: 10616 - DNA, 25 bp, Rattus norvegicus
aaagccgttacttaggagagcctgt

SEQ ID NO: 10617 - DNA, 25 bp, Rattus norvegicus
aaagcctacaatcatgaggtgacag

SEQ ID NO: 10618 - DNA, 25 bp, Rattus norvegicus
aaagcctacaatgatgaggtgacag

SEQ ID NO: 10619 - DNA, 25 bp, Rattus norvegicus
aaagcctacccgaagtgctagcgaa

SEQ ID NO: 10620 - DNA, 25 bp, Rattus norvegicus
aaagcctacccgtagtgctagcgaa

SEQ ID NO: 10621 - DNA, 25 bp, Rattus norvegicus
aaagcctacctccatgatgtgcttc

SEQ ID NO: 10622 - DNA, 25 bp, Rattus norvegicus
aaagcctacctcgatgatgtgcttc

SEQ ID NO: 10623 - DNA, 25 bp, Rattus norvegicus
aaagcctaccttccctgaagtgtat

SEQ ID NO: 10624 - DNA, 25 bp, Rattus norvegicus
aaagcctaccttgcctgaagtgtat

SEQ ID NO: 10625 - DNA, 25 bp, Rattus norvegicus
aaagcctagactagtctgtctgcct

SEQ ID NO: 10626 - DNA, 25 bp, Rattus norvegicus
aaagcctagacttgtctgtctgcct

SEQ ID NO: 10627 - DNA, 25 bp, Rattus norvegicus
aaagcctagcaccactttgctggta

SEQ ID NO: 10628 - DNA, 25 bp, Rattus norvegicus
aaagcctagcacgactttgctggta

SEQ ID NO: 10629 - DNA, 25 bp, Rattus norvegicus
aaagcctagcgtatccaggcaggat

SEQ ID NO: 10630 - DNA, 25 bp, Rattus norvegicus
aaagcctagcgtttccaggcaggat

SEQ ID NO: 10631 - DNA, 25 bp, Rattus norvegicus
aaagcctaggctactcagaaaacat

SEQ ID NO: 10632 - DNA, 25 bp, Rattus norvegicus
aaagcctaggcttctcagaaaacat

SEQ ID NO: 10633 - DNA, 25 bp, Rattus norvegicus
aaagcctagtgactgcaagctcgtt

SEQ ID NO: 10634 - DNA, 25 bp, Rattus norvegicus
aaagcctagtgagtgcaagctcgtt

SEQ ID NO: 10635 - DNA, 25 bp, Rattus norvegicus
aaagcctatcgaaagatggccttga

SEQ ID NO: 10636 - DNA, 25 bp, Rattus norvegicus
aaagcctatcgatagatggccttga

SEQ ID NO: 10637 - DNA, 25 bp, Rattus norvegicus
aaagcctatgctattctcctggtga

SEQ ID NO: 10638 - DNA, 25 bp, Rattus norvegicus
aaagcctatgcttttctcctggtga

SEQ ID NO: 10639 - DNA, 25 bp, Rattus norvegicus
aaagcctatggcatcagctgcgacg

SEQ ID NO: 10640 - DNA, 25 bp, Rattus norvegicus
aaagcctatggcttcagctgcgacg

SEQ ID NO: 10641 - DNA, 25 bp, Rattus norvegicus
aaagcctcaaagaccctagtgcaag

SEQ ID NO: 10642 - DNA, 25 bp, Rattus norvegicus
aaagcctcaaagtccctagtgcaag

SEQ ID NO: 10643 - DNA, 25 bp, Rattus norvegicus
aaagcctcaatgaacctacttctgg

SEQ ID NO: 10644 - DNA, 25 bp, Rattus norvegicus
aaagcctcaatgtacctacttctgg

SEQ ID NO: 10645 - DNA, 25 bp, Rattus norvegicus
aaagcctcacagacgaggagctgca

SEQ ID NO: 10646 - DNA, 25 bp, Rattus norvegicus
aaagcctcacagtcgaggagctgca

SEQ ID NO: 10647 - DNA, 25 bp, Rattus norvegicus
aaagcctcaccgagtggttcggcga

SEQ ID NO: 10648 - DNA, 25 bp, Rattus norvegicus
aaagcctcaccgtgtggttcggcga

SEQ ID NO: 10649 - DNA, 25 bp, Rattus norvegicus
aaagcctcacctatcagacatattt

SEQ ID NO: 10650 - DNA, 25 bp, Rattus norvegicus
aaagcctcacctttcagacatattt

SEQ ID NO: 10651 - DNA, 25 bp, Rattus norvegicus
aaagcctcacttccactgctgtgat

SEQ ID NO: 10652 - DNA, 25 bp, Rattus norvegicus
aaagcctcacttgcactgctgtgat

SEQ ID NO: 10653 - DNA, 25 bp, Rattus norvegicus
aaagcctcagatacctgttgttaag

SEQ ID NO: 10654 - DNA, 25 bp, Rattus norvegicus
aaagcctcagattcctgttgttaag

SEQ ID NO: 10655 - DNA, 25 bp, Rattus norvegicus
aaagcctcaggaaatcgccttggga

SEQ ID NO: 10656 - DNA, 25 bp, Rattus norvegicus
aaagcctcaggaagtggcctgtgct

SEQ ID NO: 10657 - DNA, 25 bp, Rattus norvegicus
aaagcctcaggatatcgccttggga

SEQ ID NO: 10658 - DNA, 25 bp, Rattus norvegicus
aaagcctcaggatgtggcctgtgct

SEQ ID NO: 10659 - DNA, 25 bp, Rattus norvegicus
aaagcctcagggaaacttggacagg

SEQ ID NO: 10660 - DNA, 25 bp, Rattus norvegicus
aaagcctcagggtaacttggacagg

SEQ ID NO: 10661 - DNA, 25 bp, Rattus norvegicus
aaagcctccactctccgtggaagat

SEQ ID NO: 10662 - DNA, 25 bp, Rattus norvegicus
aaagcctccactgtccgtggaagat

SEQ ID NO: 10663 - DNA, 25 bp, Rattus norvegicus
aaagcctccagcctgtgtctacaag

SEQ ID NO: 10664 - DNA, 25 bp, Rattus norvegicus
aaagcctccagcgtgtgtctacaag

SEQ ID NO: 10665 - DNA, 25 bp, Rattus norvegicus
aaagcctccctgaggtcagagtcag

SEQ ID NO: 10666 - DNA, 25 bp, Rattus norvegicus
aaagcctccctgtggtcagagtcag

SEQ ID NO: 10667 - DNA, 25 bp, Rattus norvegicus
aaagcctccgctctagacaacctga

SEQ ID NO: 10668 - DNA, 25 bp, Rattus norvegicus
aaagcctccgctgtagacaacctga

SEQ ID NO: 10669 - DNA, 25 bp, Rattus norvegicus
aaagcctccggcagtggtgaggcct

SEQ ID NO: 10670 - DNA, 25 bp, Rattus norvegicus
aaagcctccggctgtggtgaggcct

SEQ ID NO: 10671 - DNA, 25 bp, Rattus norvegicus
aaagcctccgtgatctccgcgttgt

SEQ ID NO: 10672 - DNA, 25 bp, Rattus norvegicus
aaagcctccgtgttctccgcgttgt

SEQ ID NO: 10673 - DNA, 25 bp, Rattus norvegicus
aaagcctcctccaaagacagatttc

SEQ ID NO: 10674 - DNA, 25 bp, Rattus norvegicus
aaagcctcctcctaagacagatttc

SEQ ID NO: 10675 - DNA, 25 bp, Rattus norvegicus
aaagcctcctctcaatggttttggg

SEQ ID NO: 10676 - DNA, 25 bp, Rattus norvegicus
aaagcctcctctgaatggttttggg

SEQ ID NO: 10677 - DNA, 25 bp, Rattus norvegicus
aaagcctcctgactggcaaggtctc

SEQ ID NO: 10678 - DNA, 25 bp, Rattus norvegicus
aaagcctcctgagtggcaaggtctc

SEQ ID NO: 10679 - DNA, 25 bp, Rattus norvegicus
aaagcctcctggaagaagccctgcc

SEQ ID NO: 10680 - DNA, 25 bp, Rattus norvegicus
aaagcctcctggtagaagccctgcc

SEQ ID NO: 10681 - DNA, 25 bp, Rattus norvegicus
aaagcctcgaccaaactttggctat

SEQ ID NO: 10682 - DNA, 25 bp, Rattus norvegicus
aaagcctcgacctaactttggctat

SEQ ID NO: 10683 - DNA, 25 bp, Rattus norvegicus
aaagcctcgagtatttcaccttcta

SEQ ID NO: 10684 - DNA, 25 bp, Rattus norvegicus
aaagcctcgagtttttcaccttcta

SEQ ID NO: 10685 - DNA, 25 bp, Rattus norvegicus
aaagcctcgcatcaacagctttgag

SEQ ID NO: 10686 - DNA, 25 bp, Rattus norvegicus
aaagcctcgcatgaacagctttgag

SEQ ID NO: 10687 - DNA, 25 bp, Rattus norvegicus
aaagcctcgccacgtggttagtgcc

SEQ ID NO: 10688 - DNA, 25 bp, Rattus norvegicus
aaagcctcgccaggtggttagtgcc

SEQ ID NO: 10689 - DNA, 25 bp, Rattus norvegicus
aaagcctcgctaagcttaagggcca

SEQ ID NO: 10690 - DNA, 25 bp, Rattus norvegicus
aaagcctcgctatgcttaagggcca

SEQ ID NO: 10691 - DNA, 25 bp, Rattus norvegicus
aaagcctctcacatccaggccaaag

SEQ ID NO: 10692 - DNA, 25 bp, Rattus norvegicus
aaagcctctcacttccaggccaaag

SEQ ID NO: 10693 - DNA, 25 bp, Rattus norvegicus
aaagcctctcctaggatggatgagt

SEQ ID NO: 10694 - DNA, 25 bp, Rattus norvegicus
aaagcctctccttggatggatgagt

SEQ ID NO: 10695 - DNA, 25 bp, Rattus norvegicus
aaagcctctctccatgtggaggact

SEQ ID NO: 10696 - DNA, 25 bp, Rattus norvegicus
aaagcctctctcgatgtggaggact

SEQ ID NO: 10697 - DNA, 25 bp, Rattus norvegicus
aaagcctctcttcctgaattgaagt

SEQ ID NO: 10698 - DNA, 25 bp, Rattus norvegicus
aaagcctctcttgctgaattgaagt

SEQ ID NO: 10699 - DNA, 25 bp, Rattus norvegicus
aaagcctctgatctggcttccttgg

SEQ ID NO: 10700 - DNA, 25 bp, Rattus norvegicus
aaagcctctgatctgtttttactga

SEQ ID NO: 10701 - DNA, 25 bp, Rattus norvegicus
aaagcctctgatgtggcttccttgg

SEQ ID NO: 10702 - DNA, 25 bp, Rattus norvegicus
aaagcctctgatgtgtttttactga

SEQ ID NO: 10703 - DNA, 25 bp, Rattus norvegicus
aaagcctctgcacctccgagtgttt

SEQ ID NO: 10704 - DNA, 25 bp, Rattus norvegicus
aaagcctctgcagctccgagtgttt

SEQ ID NO: 10705 - DNA, 25 bp, Rattus norvegicus
aaagcctctgctatctgtgagtgaa

SEQ ID NO: 10706 - DNA, 25 bp, Rattus norvegicus
aaagcctctgctttctgtgagtgaa

SEQ ID NO: 10707 - DNA, 25 bp, Rattus norvegicus
aaagcctctgttactccctgaggaa

SEQ ID NO: 10708 - DNA, 25 bp, Rattus norvegicus
aaagcctctgtttctccctgaggaa

SEQ ID NO: 10709 - DNA, 25 bp, Rattus norvegicus
aaagcctctttcaactagtagtaag

SEQ ID NO: 10710 - DNA, 25 bp, Rattus norvegicus
aaagcctctttccttactcagctgt

SEQ ID NO: 10711 - DNA, 25 bp, Rattus norvegicus
aaagcctctttcgttactcagctgt

SEQ ID NO: 10712 - DNA, 25 bp, Rattus norvegicus
aaagcctctttctactagtagtaag

SEQ ID NO: 10713 - DNA, 25 bp, Rattus norvegicus
aaagcctgactgctaccctttgggt

SEQ ID NO: 10714 - DNA, 25 bp, Rattus norvegicus
aaagcctgactggtaccctttgggt

SEQ ID NO: 10715 - DNA, 25 bp, Rattus norvegicus
aaagcctgacttccactgtgtttaa

SEQ ID NO: 10716 - DNA, 25 bp, Rattus norvegicus
aaagcctgacttgcactgtgtttaa

SEQ ID NO: 10717 - DNA, 25 bp, Rattus norvegicus
aaagcctgagagactcttgtcatgc

SEQ ID NO: 10718 - DNA, 25 bp, Rattus norvegicus
aaagcctgagagtctcttgtcatgc

SEQ ID NO: 10719 - DNA, 25 bp, Rattus norvegicus
aaagcctgattaaagaatggtccat

SEQ ID NO: 10720 - DNA, 25 bp, Rattus norvegicus
aaagcctgattatagaatggtccat

SEQ ID NO: 10721 - DNA, 25 bp, Rattus norvegicus
aaagcctgcactatgtttgtgtgcc

SEQ ID NO: 10722 - DNA, 25 bp, Rattus norvegicus
aaagcctgcactttgtttgtgtgcc

SEQ ID NO: 10723 - DNA, 25 bp, Rattus norvegicus
aaagcctgcagacttcaaaaataga

SEQ ID NO: 10724 - DNA, 25 bp, Rattus norvegicus
aaagcctgcagagttcaaaaataga

SEQ ID NO: 10725 - DNA, 25 bp, Rattus norvegicus
aaagcctgcagtagttgcgaagtct

SEQ ID NO: 10726 - DNA, 25 bp, Rattus norvegicus
aaagcctgcagttgttgcgaagtct

SEQ ID NO: 10727 - DNA, 25 bp, Rattus norvegicus
aaagcctgccgcagtcagaagtaga

SEQ ID NO: 10728 - DNA, 25 bp, Rattus norvegicus
aaagcctgccgctgtcagaagtaga

SEQ ID NO: 10729 - DNA, 25 bp, Rattus norvegicus
aaagcctgccttcggtgtcacctct

SEQ ID NO: 10730 - DNA, 25 bp, Rattus norvegicus
aaagcctgccttgggtgtcacctct

SEQ ID NO: 10731 - DNA, 25 bp, Rattus norvegicus
aaagcctgctgacgagggcctgcat

SEQ ID NO: 10732 - DNA, 25 bp, Rattus norvegicus
aaagcctgctgaggagggcctgcat

SEQ ID NO: 10733 - DNA, 25 bp, Rattus norvegicus
aaagcctgctgtcgccatgagagaa

SEQ ID NO: 10734 - DNA, 25 bp, Rattus norvegicus
aaagcctgctgtggccatgagagaa

SEQ ID NO: 10735 - DNA, 25 bp, Rattus norvegicus
aaagcctgcttgctgatgggagctc

SEQ ID NO: 10736 - DNA, 25 bp, Rattus norvegicus
aaagcctgcttgctgtcctgttcag

SEQ ID NO: 10737 - DNA, 25 bp, Rattus norvegicus
aaagcctgcttggtgatgggagctc

SEQ ID NO: 10738 - DNA, 25 bp, Rattus norvegicus
aaagcctgcttggtgtcctgttcag

SEQ ID NO: 10739 - DNA, 25 bp, Rattus norvegicus
aaagcctggaagatgggtctcacac

SEQ ID NO: 10740 - DNA, 25 bp, Rattus norvegicus
aaagcctggaagttgggtctcacac

SEQ ID NO: 10741 - DNA, 25 bp, Rattus norvegicus
aaagcctggaggacatccccccttg

SEQ ID NO: 10742 - DNA, 25 bp, Rattus norvegicus
aaagcctggaggtcatccccccttg

SEQ ID NO: 10743 - DNA, 25 bp, Rattus norvegicus
aaagcctggagtcagtcatctcatt

SEQ ID NO: 10744 - DNA, 25 bp, Rattus norvegicus
aaagcctggagtgagtcatctcatt

SEQ ID NO: 10745 - DNA, 25 bp, Rattus norvegicus
aaagcctggtgacctctattcagaa

SEQ ID NO: 10746 - DNA, 25 bp, Rattus norvegicus
aaagcctggtgagctctattcagaa

SEQ ID NO: 10747 - DNA, 25 bp, Rattus norvegicus
aaagcctggtgcagactggagctct

SEQ ID NO: 10748 - DNA, 25 bp, Rattus norvegicus
aaagcctggtgctgactggagctct

SEQ ID NO: 10749 - DNA, 25 bp, Rattus norvegicus
aaagcctggtggcagaaatttctgt

SEQ ID NO: 10750 - DNA, 25 bp, Rattus norvegicus
aaagcctggtgggagaaatttctgt

SEQ ID NO: 10751 - DNA, 25 bp, Rattus norvegicus
aaagcctgtactcagttgcactgct

SEQ ID NO: 10752 - DNA, 25 bp, Rattus norvegicus
aaagcctgtactgagttgcactgct

SEQ ID NO: 10753 - DNA, 25 bp, Rattus norvegicus
aaagcctgtcaccagagctgctgta

SEQ ID NO: 10754 - DNA, 25 bp, Rattus norvegicus
aaagcctgtcacgagagctgctgta

SEQ ID NO: 10755 - DNA, 25 bp, Rattus norvegicus
aaagcctgtcatagcaataccctgc

SEQ ID NO: 10756 - DNA, 25 bp, Rattus norvegicus
aaagcctgtcattgcaataccctgc

SEQ ID NO: 10757 - DNA, 25 bp, Rattus norvegicus
aaagcctgtccgaactcactgggag

SEQ ID NO: 10758 - DNA, 25 bp, Rattus norvegicus
aaagcctgtccgtactcactgggag

SEQ ID NO: 10759 - DNA, 25 bp, Rattus norvegicus
aaagcctgtgctaagggaccctgca

SEQ ID NO: 10760 - DNA, 25 bp, Rattus norvegicus
aaagcctgtgcttagggaccctgca

SEQ ID NO: 10761 - DNA, 25 bp, Rattus norvegicus
aaagcctgtggcagctcagtgctca

SEQ ID NO: 10762 - DNA, 25 bp, Rattus norvegicus
aaagcctgtggctgctcagtgctca

SEQ ID NO: 10763 - DNA, 25 bp, Rattus norvegicus
aaagcctgtggtatttgcatctcct

SEQ ID NO: 10764 - DNA, 25 bp, Rattus norvegicus
aaagcctgtggtttttgcatctcct

SEQ ID NO: 10765 - DNA, 25 bp, Rattus norvegicus
aaagcctgtgttacccaaaggcagt

SEQ ID NO: 10766 - DNA, 25 bp, Rattus norvegicus
aaagcctgtgtttcccaaaggcagt

SEQ ID NO: 10767 - DNA, 25 bp, Rattus norvegicus
aaagcctgttccatatcacggacta

SEQ ID NO: 10768 - DNA, 25 bp, Rattus norvegicus
aaagcctgttccttatcacggacta

SEQ ID NO: 10769 - DNA, 25 bp, Rattus norvegicus
aaagcctgttggcagagcactaaga

SEQ ID NO: 10770 - DNA, 25 bp, Rattus norvegicus
aaagcctgttgggagagcactaaga

SEQ ID NO: 10771 - DNA, 25 bp, Rattus norvegicus
aaagcctgtttaagatccatcctgg

SEQ ID NO: 10772 - DNA, 25 bp, Rattus norvegicus
aaagcctgtttatgatccatcctgg

SEQ ID NO: 10773 - DNA, 25 bp, Rattus norvegicus
aaagcctgttttactctcactttct

SEQ ID NO: 10774 - DNA, 25 bp, Rattus norvegicus
aaagcctgtttttctctcactttct

SEQ ID NO: 10775 - DNA, 25 bp, Rattus norvegicus
aaagccttaaatcctaattggacca

SEQ ID NO: 10776 - DNA, 25 bp, Rattus norvegicus
aaagccttaaatgctaattggacca

SEQ ID NO: 10777 - DNA, 25 bp, Rattus norvegicus
aaagccttaataactttctgtaaca

SEQ ID NO: 10778 - DNA, 25 bp, Rattus norvegicus
aaagccttaatatctttctgtaaca

SEQ ID NO: 10779 - DNA, 25 bp, Rattus norvegicus
aaagccttaggaagctctgcggctc

SEQ ID NO: 10780 - DNA, 25 bp, Rattus norvegicus
aaagccttaggaagggctaccgtgt

SEQ ID NO: 10781 - DNA, 25 bp, Rattus norvegicus
aaagccttaggatgctctgcggctc

SEQ ID NO: 10782 - DNA, 25 bp, Rattus norvegicus
aaagccttaggatgggctaccgtgt

SEQ ID NO: 10783 - DNA, 25 bp, Rattus norvegicus
aaagccttagtgagcaattaatctg

SEQ ID NO: 10784 - DNA, 25 bp, Rattus norvegicus
aaagccttagtgtgcaattaatctg

SEQ ID NO: 10785 - DNA, 25 bp, Rattus norvegicus
aaagccttcacacatacgggtacct

SEQ ID NO: 10786 - DNA, 25 bp, Rattus norvegicus
aaagccttcacagatacgggtacct

SEQ ID NO: 10787 - DNA, 25 bp, Rattus norvegicus
aaagccttcacccatttcaggtttg

SEQ ID NO: 10788 - DNA, 25 bp, Rattus norvegicus
aaagccttcaccgatttcaggtttg

SEQ ID NO: 10789 - DNA, 25 bp, Rattus norvegicus
aaagccttcactaaaattccaccat

SEQ ID NO: 10790 - DNA, 25 bp, Rattus norvegicus
aaagccttcacttaaattccaccat

SEQ ID NO: 10791 - DNA, 25 bp, Rattus norvegicus
aaagccttcaggaggacttgtacat

SEQ ID NO: 10792 - DNA, 25 bp, Rattus norvegicus
aaagccttcaggcatgccaggttcc

SEQ ID NO: 10793 - DNA, 25 bp, Rattus norvegicus
aaagccttcagggatgccaggttcc

SEQ ID NO: 10794 - DNA, 25 bp, Rattus norvegicus
aaagccttcaggtggacttgtacat

SEQ ID NO: 10795 - DNA, 25 bp, Rattus norvegicus
aaagccttcagtctttccttgagga

SEQ ID NO: 10796 - DNA, 25 bp, Rattus norvegicus
aaagccttcagtgtttccttgagga

SEQ ID NO: 10797 - DNA, 25 bp, Rattus norvegicus
aaagccttcctcacctatgtgagca

SEQ ID NO: 10798 - DNA, 25 bp, Rattus norvegicus
aaagccttcctctcctatgtgagca

SEQ ID NO: 10799 - DNA, 25 bp, Rattus norvegicus
aaagccttcgatacatgttctgcat

SEQ ID NO: 10800 - DNA, 25 bp, Rattus norvegicus
aaagccttcgattcatgttctgcat

SEQ ID NO: 10801 - DNA, 25 bp, Rattus norvegicus
aaagccttctgcatctgactgctga

SEQ ID NO: 10802 - DNA, 25 bp, Rattus norvegicus
aaagccttctgcttctgactgctga

SEQ ID NO: 10803 - DNA, 25 bp, Rattus norvegicus
aaagccttctggatccatgggtaga

SEQ ID NO: 10804 - DNA, 25 bp, Rattus norvegicus
aaagccttctggttccatgggtaga

SEQ ID NO: 10805 - DNA, 25 bp, Rattus norvegicus
aaagccttctgtcagagttcgtctc

SEQ ID NO: 10806 - DNA, 25 bp, Rattus norvegicus
aaagccttctgtgagagttcgtctc

SEQ ID NO: 10807 - DNA, 25 bp, Rattus norvegicus
aaagccttcttgaggttgcctgagc

SEQ ID NO: 10808 - DNA, 25 bp, Rattus norvegicus
aaagccttcttgtggttgcctgagc

SEQ ID NO: 10809 - DNA, 25 bp, Rattus norvegicus
aaagccttgcatcccaccaagatgt

SEQ ID NO: 10810 - DNA, 25 bp, Rattus norvegicus
aaagccttgcatcgctctggctcat

SEQ ID NO: 10811 - DNA, 25 bp, Rattus norvegicus
aaagccttgcatgccaccaagatgt

SEQ ID NO: 10812 - DNA, 25 bp, Rattus norvegicus
aaagccttgcatggctctggctcat

SEQ ID NO: 10813 - DNA, 25 bp, Rattus norvegicus
aaagccttgctgctggaggccaagc

SEQ ID NO: 10814 - DNA, 25 bp, Rattus norvegicus
aaagccttgctggtggaggccaagc

SEQ ID NO: 10815 - DNA, 25 bp, Rattus norvegicus
aaagccttggctatggaccattcca

SEQ ID NO: 10816 - DNA, 25 bp, Rattus norvegicus
aaagccttggctcgcagtgcccagg

SEQ ID NO: 10817 - DNA, 25 bp, Rattus norvegicus
aaagccttggctggcagtgcccagg

SEQ ID NO: 10818 - DNA, 25 bp, Rattus norvegicus
aaagccttggctttggaccattcca

SEQ ID NO: 10819 - DNA, 25 bp, Rattus norvegicus
aaagccttgggcatttcctgtcctt

SEQ ID NO: 10820 - DNA, 25 bp, Rattus norvegicus
aaagccttgggcttttcctgtcctt

SEQ ID NO: 10821 - DNA, 25 bp, Rattus norvegicus
aaagccttggttaatgtcgtcatcc

SEQ ID NO: 10822 - DNA, 25 bp, Rattus norvegicus
aaagccttggttacttggctgtaca

SEQ ID NO: 10823 - DNA, 25 bp, Rattus norvegicus
aaagccttggttcatactctctcta

SEQ ID NO: 10824 - DNA, 25 bp, Rattus norvegicus
aaagccttggttgatactctctcta

SEQ ID NO: 10825 - DNA, 25 bp, Rattus norvegicus
aaagccttggtttatgtcgtcatcc

SEQ ID NO: 10826 - DNA, 25 bp, Rattus norvegicus
aaagccttggtttcttggctgtaca

SEQ ID NO: 10827 - DNA, 25 bp, Rattus norvegicus
aaagccttgtcaatggtcaagcggg

SEQ ID NO: 10828 - DNA, 25 bp, Rattus norvegicus
aaagccttgtcattggtcaagcggg

SEQ ID NO: 10829 - DNA, 25 bp, Rattus norvegicus
aaagccttgtttactctgtgtggtt

SEQ ID NO: 10830 - DNA, 25 bp, Rattus norvegicus
aaagccttgttttctctgtgtggtt

SEQ ID NO: 10831 - DNA, 25 bp, Rattus norvegicus
aaagcctttactactcatccgaaga

SEQ ID NO: 10832 - DNA, 25 bp, Rattus norvegicus
aaagcctttacttctcatccgaaga

SEQ ID NO: 10833 - DNA, 25 bp, Rattus norvegicus
aaagcctttagccaatttccacaat

SEQ ID NO: 10834 - DNA, 25 bp, Rattus norvegicus
aaagcctttagcgaatttccacaat

SEQ ID NO: 10835 - DNA, 25 bp, Rattus norvegicus
aaagcctttaggaatcagtgcatct

SEQ ID NO: 10836 - DNA, 25 bp, Rattus norvegicus
aaagcctttaggtatcagtgcatct

SEQ ID NO: 10837 - DNA, 25 bp, Rattus norvegicus
aaagcctttcctcagagttgaccct

SEQ ID NO: 10838 - DNA, 25 bp, Rattus norvegicus
aaagcctttcctgagagttgaccct

SEQ ID NO: 10839 - DNA, 25 bp, Rattus norvegicus
aaagcctttctcaattctcagaaat

SEQ ID NO: 10840 - DNA, 25 bp, Rattus norvegicus
aaagcctttctctattctcagaaat

SEQ ID NO: 10841 - DNA, 25 bp, Rattus norvegicus
aaagcctttctgcacaccgtgacgt

SEQ ID NO: 10842 - DNA, 25 bp, Rattus norvegicus
aaagcctttctggacaccgtgacgt

SEQ ID NO: 10843 - DNA, 25 bp, Rattus norvegicus
aaagcctttgcaagtaacactagtc

SEQ ID NO: 10844 - DNA, 25 bp, Rattus norvegicus
aaagcctttgcactgagcagcctgg

SEQ ID NO: 10845 - DNA, 25 bp, Rattus norvegicus
aaagcctttgcagtgagcagcctgg

SEQ ID NO: 10846 - DNA, 25 bp, Rattus norvegicus
aaagcctttgcatgtaacactagtc

SEQ ID NO: 10847 - DNA, 25 bp, Rattus norvegicus
aaagcctttggacctcacaaagatg

SEQ ID NO: 10848 - DNA, 25 bp, Rattus norvegicus
aaagcctttggacgacaggaaatct

SEQ ID NO: 10849 - DNA, 25 bp, Rattus norvegicus
aaagcctttggagctcacaaagatg

SEQ ID NO: 10850 - DNA, 25 bp, Rattus norvegicus
aaagcctttggaggacaggaaatct

SEQ ID NO: 10851 - DNA, 25 bp, Rattus norvegicus
aaagcctttgtacgtcagaatgacc

SEQ ID NO: 10852 - DNA, 25 bp, Rattus norvegicus
aaagcctttgtaggtcagaatgacc

SEQ ID NO: 10853 - DNA, 25 bp, Rattus norvegicus
aaagcctttgtcaattatgtggaac

SEQ ID NO: 10854 - DNA, 25 bp, Rattus norvegicus
aaagcctttgtccaaagtactgcca

SEQ ID NO: 10855 - DNA, 25 bp, Rattus norvegicus
aaagcctttgtcgaaagtactgcca

SEQ ID NO: 10856 - DNA, 25 bp, Rattus norvegicus
aaagcctttgtctattatgtggaac

SEQ ID NO: 10857 - DNA, 25 bp, Rattus norvegicus
aaagccttttcacatatcatttatc

SEQ ID NO: 10858 - DNA, 25 bp, Rattus norvegicus
aaagccttttcagatatcatttatc

SEQ ID NO: 10859 - DNA, 25 bp, Rattus norvegicus
aaagcgaactaaagccggtgcgtgt

SEQ ID NO: 10860 - DNA, 25 bp, Rattus norvegicus
aaagcgaactaatgccggtgcgtgt

SEQ ID NO: 10861 - DNA, 25 bp, Rattus norvegicus
aaagcgaagccacttcctttggcag

SEQ ID NO: 10862 - DNA, 25 bp, Rattus norvegicus
aaagcgaagccagttcctttggcag

SEQ ID NO: 10863 - DNA, 25 bp, Rattus norvegicus
aaagcgaagtgcatcccattggcca

SEQ ID NO: 10864 - DNA, 25 bp, Rattus norvegicus
aaagcgaagtgcttcccattggcca

SEQ ID NO: 10865 - DNA, 25 bp, Rattus norvegicus
aaagcgacccttccattgtattact

SEQ ID NO: 10866 - DNA, 25 bp, Rattus norvegicus
aaagcgacccttgcattgtattact

SEQ ID NO: 10867 - DNA, 25 bp, Rattus norvegicus
aaagcgaccggccataaggtgtact

SEQ ID NO: 10868 - DNA, 25 bp, Rattus norvegicus
aaagcgaccggcgataaggtgtact

SEQ ID NO: 10869 - DNA, 25 bp, Rattus norvegicus
aaagcgaccgtcattggacattccc

SEQ ID NO: 10870 - DNA, 25 bp, Rattus norvegicus
aaagcgaccgtctttggacattccc

SEQ ID NO: 10871 - DNA, 25 bp, Rattus norvegicus
aaagcgacgcctcggtgctgcagtt

SEQ ID NO: 10872 - DNA, 25 bp, Rattus norvegicus
aaagcgacgcctgggtgctgcagtt

SEQ ID NO: 10873 - DNA, 25 bp, Rattus norvegicus
aaagcgactgctaggcttggagccc

SEQ ID NO: 10874 - DNA, 25 bp, Rattus norvegicus
aaagcgactgcttggcttggagccc

SEQ ID NO: 10875 - DNA, 25 bp, Rattus norvegicus
aaagcgactggcctctggaggacct

SEQ ID NO: 10876 - DNA, 25 bp, Rattus norvegicus
aaagcgactggcgtctggaggacct

SEQ ID NO: 10877 - DNA, 25 bp, Rattus norvegicus
aaagcgagacagctgagcatctctt

SEQ ID NO: 10878 - DNA, 25 bp, Rattus norvegicus
aaagcgagacaggtgagcatctctt

SEQ ID NO: 10879 - DNA, 25 bp, Rattus norvegicus
aaagcgagcatgaccaggcacacga

SEQ ID NO: 10880 - DNA, 25 bp, Rattus norvegicus
aaagcgagcatgacttggagaacaa

SEQ ID NO: 10881 - DNA, 25 bp, Rattus norvegicus
aaagcgagcatgattttcagatatt

SEQ ID NO: 10882 - DNA, 25 bp, Rattus norvegicus
aaagcgagcatgtccaggcacacga

SEQ ID NO: 10883 - DNA, 25 bp, Rattus norvegicus
aaagcgagcatgtcttggagaacaa

SEQ ID NO: 10884 - DNA, 25 bp, Rattus norvegicus
aaagcgagcatgtttttcagatatt

SEQ ID NO: 10885 - DNA, 25 bp, Rattus norvegicus
aaagcgagctcacgtctaggccgac

SEQ ID NO: 10886 - DNA, 25 bp, Rattus norvegicus
aaagcgagctcaggtctaggccgac

SEQ ID NO: 10887 - DNA, 25 bp, Rattus norvegicus
aaagcgaggaagcatgagcaaaact

SEQ ID NO: 10888 - DNA, 25 bp, Rattus norvegicus
aaagcgaggaaggatgagcaaaact

SEQ ID NO: 10889 - DNA, 25 bp, Rattus norvegicus
aaagcgaggctactctcaggcactt

SEQ ID NO: 10890 - DNA, 25 bp, Rattus norvegicus
aaagcgaggctagtctcaggcactt

SEQ ID NO: 10891 - DNA, 25 bp, Rattus norvegicus
aaagcgagtcgcagcggagccgttc

SEQ ID NO: 10892 - DNA, 25 bp, Rattus norvegicus
aaagcgagtcgctgcggagccgttc

SEQ ID NO: 10893 - DNA, 25 bp, Rattus norvegicus
aaagcgatccgactgcatgtctggg

SEQ ID NO: 10894 - DNA, 25 bp, Rattus norvegicus
aaagcgatccgagtgcatgtctggg

SEQ ID NO: 10895 - DNA, 25 bp, Rattus norvegicus
aaagcgatgcttcggaactccggct

SEQ ID NO: 10896 - DNA, 25 bp, Rattus norvegicus
aaagcgatgcttgggaactccggct

SEQ ID NO: 10897 - DNA, 25 bp, Rattus norvegicus
aaagcgcaagatcgccttggcccgt

SEQ ID NO: 10898 - DNA, 25 bp, Rattus norvegicus
aaagcgcaagatggccttggcccgt

SEQ ID NO: 10899 - DNA, 25 bp, Rattus norvegicus
aaagcgcatccgagtgaagttctat

SEQ ID NO: 10900 - DNA, 25 bp, Rattus norvegicus
aaagcgcatccgtgtgaagttctat

SEQ ID NO: 10901 - DNA, 25 bp, Rattus norvegicus
aaagcgccagatcttttcagtcagg

SEQ ID NO: 10902 - DNA, 25 bp, Rattus norvegicus
aaagcgccagatgttttcagtcagg

SEQ ID NO: 10903 - DNA, 25 bp, Rattus norvegicus
aaagcgcccagccaatgggactatg

SEQ ID NO: 10904 - DNA, 25 bp, Rattus norvegicus
aaagcgcccagcgaatgggactatg

SEQ ID NO: 10905 - DNA, 25 bp, Rattus norvegicus
aaagcgcccatccagtttgagaaag

SEQ ID NO: 10906 - DNA, 25 bp, Rattus norvegicus
aaagcgcccatcgagtttgagaaag

SEQ ID NO: 10907 - DNA, 25 bp, Rattus norvegicus
aaagcgccggtgacaaagtaagcat

SEQ ID NO: 10908 - DNA, 25 bp, Rattus norvegicus
aaagcgccggtgtcaaagtaagcat

SEQ ID NO: 10909 - DNA, 25 bp, Rattus norvegicus
aaagcgcctgacaggctgggctgat

SEQ ID NO: 10910 - DNA, 25 bp, Rattus norvegicus
aaagcgcctgactggctgggctgat

SEQ ID NO: 10911 - DNA, 25 bp, Rattus norvegicus
aaagcgcgccgcctcgcaggttgac

SEQ ID NO: 10912 - DNA, 25 bp, Rattus norvegicus
aaagcgcgccgcgtcgcaggttgac

SEQ ID NO: 10913 - DNA, 25 bp, Rattus norvegicus
aaagcgctatgtcgcagctgctttc

SEQ ID NO: 10914 - DNA, 25 bp, Rattus norvegicus
aaagcgctatgtggcagctgctttc

SEQ ID NO: 10915 - DNA, 25 bp, Rattus norvegicus
aaagcgctcagtatcatatcagtaa

SEQ ID NO: 10916 - DNA, 25 bp, Rattus norvegicus
aaagcgctcagtttcatatcagtaa

SEQ ID NO: 10917 - DNA, 25 bp, Rattus norvegicus
aaagcgctcgtcatgatcaaactca

SEQ ID NO: 10918 - DNA, 25 bp, Rattus norvegicus
aaagcgctcgtcttgatcaaactca

SEQ ID NO: 10919 - DNA, 25 bp, Rattus norvegicus
aaagcgctgataactgttaacaact

SEQ ID NO: 10920 - DNA, 25 bp, Rattus norvegicus
aaagcgctgatatctgttaacaact

SEQ ID NO: 10921 - DNA, 25 bp, Rattus norvegicus
aaagcgctgtccagcgcgctggtca

SEQ ID NO: 10922 - DNA, 25 bp, Rattus norvegicus
aaagcgctgtcctgcgcgctggtca

SEQ ID NO: 10923 - DNA, 25 bp, Rattus norvegicus
aaagcgcttgctactcttttagagt

SEQ ID NO: 10924 - DNA, 25 bp, Rattus norvegicus
aaagcgcttgcttctcttttagagt

SEQ ID NO: 10925 - DNA, 25 bp, Rattus norvegicus
aaagcggaagtgctttaaatggcat

SEQ ID NO: 10926 - DNA, 25 bp, Rattus norvegicus
aaagcggaagtggtttaaatggcat

SEQ ID NO: 10927 - DNA, 25 bp, Rattus norvegicus
aaagcggacattcctacattccttt

SEQ ID NO: 10928 - DNA, 25 bp, Rattus norvegicus
aaagcggacattgctacattccttt

SEQ ID NO: 10929 - DNA, 25 bp, Rattus norvegicus
aaagcggagaacagccgcgtcgagc

SEQ ID NO: 10930 - DNA, 25 bp, Rattus norvegicus
aaagcggagaactgccgcgtcgagc

SEQ ID NO: 10931 - DNA, 25 bp, Rattus norvegicus
aaagcggagactcgtgagtgacaca

SEQ ID NO: 10932 - DNA, 25 bp, Rattus norvegicus
aaagcggagactggtgagtgacaca

SEQ ID NO: 10933 - DNA, 25 bp, Rattus norvegicus
aaagcggatgccctgtttgatttct

SEQ ID NO: 10934 - DNA, 25 bp, Rattus norvegicus
aaagcggatgccgtgtttgatttct

SEQ ID NO: 10935 - DNA, 25 bp, Rattus norvegicus
aaagcggatttcacacatgcctagc

SEQ ID NO: 10936 - DNA, 25 bp, Rattus norvegicus
aaagcggatttctcacatgcctagc

SEQ ID NO: 10937 - DNA, 25 bp, Rattus norvegicus
aaagcggcagcacgaaaaggttcat

SEQ ID NO: 10938 - DNA, 25 bp, Rattus norvegicus
aaagcggcagcaggaaaaggttcat

SEQ ID NO: 10939 - DNA, 25 bp, Rattus norvegicus
aaagcggcagtccatggttttaagg

SEQ ID NO: 10940 - DNA, 25 bp, Rattus norvegicus
aaagcggcagtcgatggttttaagg

SEQ ID NO: 10941 - DNA, 25 bp, Rattus norvegicus
aaagcggccaagcacagcgcatcca

SEQ ID NO: 10942 - DNA, 25 bp, Rattus norvegicus
aaagcggccaaggacagcgcatcca

SEQ ID NO: 10943 - DNA, 25 bp, Rattus norvegicus
aaagcggccattcagtggtgctagc

SEQ ID NO: 10944 - DNA, 25 bp, Rattus norvegicus
aaagcggccattgagtggtgctagc

SEQ ID NO: 10945 - DNA, 25 bp, Rattus norvegicus
aaagcggccgtgatgtacctcaggc

SEQ ID NO: 10946 - DNA, 25 bp, Rattus norvegicus
aaagcggccgtgttgtacctcaggc

SEQ ID NO: 10947 - DNA, 25 bp, Rattus norvegicus
aaagcggctcagaccttgagtgcca

SEQ ID NO: 10948 - DNA, 25 bp, Rattus norvegicus
aaagcggctcagtccttgagtgcca

SEQ ID NO: 10949 - DNA, 25 bp, Rattus norvegicus
aaagcggctgccactcaagagaagt

SEQ ID NO: 10950 - DNA, 25 bp, Rattus norvegicus
aaagcggctgcctctcaagagaagt

SEQ ID NO: 10951 - DNA, 25 bp, Rattus norvegicus
aaagcggctgctctgtgcactgtga

SEQ ID NO: 10952 - DNA, 25 bp, Rattus norvegicus
aaagcggctgctgtgtgcactgtga

SEQ ID NO: 10953 - DNA, 25 bp, Rattus norvegicus
aaagcgggaagccagtatctgtcat

SEQ ID NO: 10954 - DNA, 25 bp, Rattus norvegicus
aaagcgggaagcgagtatctgtcat

SEQ ID NO: 10955 - DNA, 25 bp, Rattus norvegicus
aaagcgggcattctgttccaacccg

SEQ ID NO: 10956 - DNA, 25 bp, Rattus norvegicus
aaagcgggcattgtgttccaacccg

SEQ ID NO: 10957 - DNA, 25 bp, Rattus norvegicus
aaagcggtccatcgtcggatagtgg

SEQ ID NO: 10958 - DNA, 25 bp, Rattus norvegicus
aaagcggtccatggtcggatagtgg

SEQ ID NO: 10959 - DNA, 25 bp, Rattus norvegicus
aaagcggtgctgaggagactgataa

SEQ ID NO: 10960 - DNA, 25 bp, Rattus norvegicus
aaagcggtgctgtggagactgataa

SEQ ID NO: 10961 - DNA, 25 bp, Rattus norvegicus
aaagcgtatgtcacccagtcaggct

SEQ ID NO: 10962 - DNA, 25 bp, Rattus norvegicus
aaagcgtatgtctcccagtcaggct

SEQ ID NO: 10963 - DNA, 25 bp, Rattus norvegicus
aaagcgtcaccaaaccatgagctgt

SEQ ID NO: 10964 - DNA, 25 bp, Rattus norvegicus
aaagcgtcaccataccatgagctgt

SEQ ID NO: 10965 - DNA, 25 bp, Rattus norvegicus
aaagcgtccaccacagcagaggcac

SEQ ID NO: 10966 - DNA, 25 bp, Rattus norvegicus
aaagcgtccacctcagcagaggcac

SEQ ID NO: 10967 - DNA, 25 bp, Rattus norvegicus
aaagcgtcctacaagcgtctggctg

SEQ ID NO: 10968 - DNA, 25 bp, Rattus norvegicus
aaagcgtcctactagcgtctggctg

SEQ ID NO: 10969 - DNA, 25 bp, Rattus norvegicus
aaagcgtcctatacatcatctgtga

SEQ ID NO: 10970 - DNA, 25 bp, Rattus norvegicus
aaagcgtcctattcatcatctgtga

SEQ ID NO: 10971 - DNA, 25 bp, Rattus norvegicus
aaagcgtctcggctctcagtaagaa

SEQ ID NO: 10972 - DNA, 25 bp, Rattus norvegicus
aaagcgtctcgggtctcagtaagaa

SEQ ID NO: 10973 - DNA, 25 bp, Rattus norvegicus
aaagcgtctctactgcagtgtgtgc

SEQ ID NO: 10974 - DNA, 25 bp, Rattus norvegicus
aaagcgtctctagtgcagtgtgtgc

SEQ ID NO: 10975 - DNA, 25 bp, Rattus norvegicus
aaagcgtctgccagagcgttttcta

SEQ ID NO: 10976 - DNA, 25 bp, Rattus norvegicus
aaagcgtctgcctgagcgttttcta

SEQ ID NO: 10977 - DNA, 25 bp, Rattus norvegicus
aaagcgtgacttcggtgatctgcaa

SEQ ID NO: 10978 - DNA, 25 bp, Rattus norvegicus
aaagcgtgacttgggtgatctgcaa

SEQ ID NO: 10979 - DNA, 25 bp, Rattus norvegicus
aaagcgtgaggcacagctccagcag

SEQ ID NO: 10980 - DNA, 25 bp, Rattus norvegicus
aaagcgtgaggctcagctccagcag

SEQ ID NO: 10981 - DNA, 25 bp, Rattus norvegicus
aaagcgtgatgtatgtgtttctaag

SEQ ID NO: 10982 - DNA, 25 bp, Rattus norvegicus
aaagcgtgatgtttgtgtttctaag

SEQ ID NO: 10983 - DNA, 25 bp, Rattus norvegicus
aaagcgtgatttcgagctggcccag

SEQ ID NO: 10984 - DNA, 25 bp, Rattus norvegicus
aaagcgtgatttggagctggcccag

SEQ ID NO: 10985 - DNA, 25 bp, Rattus norvegicus
aaagcgtgccggatcctaatgaaga

SEQ ID NO: 10986 - DNA, 25 bp, Rattus norvegicus
aaagcgtgccggttcctaatgaaga

SEQ ID NO: 10987 - DNA, 25 bp, Rattus norvegicus
aaagcgtggtgtagctctcatctgt

SEQ ID NO: 10988 - DNA, 25 bp, Rattus norvegicus
aaagcgtggtgttgctctcatctgt

SEQ ID NO: 10989 - DNA, 25 bp, Rattus norvegicus
aaagcgtgtgcaagctgctgctggt

SEQ ID NO: 10990 - DNA, 25 bp, Rattus norvegicus
aaagcgtgtgcaaggccagtagcca

SEQ ID NO: 10991 - DNA, 25 bp, Rattus norvegicus
aaagcgtgtgcatgctgctgctggt

SEQ ID NO: 10992 - DNA, 25 bp, Rattus norvegicus
aaagcgtgtgcatggccagtagcca

SEQ ID NO: 10993 - DNA, 25 bp, Rattus norvegicus
aaagcgtgtggcactagctgtaccc

SEQ ID NO: 10994 - DNA, 25 bp, Rattus norvegicus
aaagcgtgtggctctagctgtaccc

SEQ ID NO: 10995 - DNA, 25 bp, Rattus norvegicus
aaagcgtgtgttacttcagcgagaa

SEQ ID NO: 10996 - DNA, 25 bp, Rattus norvegicus
aaagcgtgtgtttcttcagcgagaa

SEQ ID NO: 10997 - DNA, 25 bp, Rattus norvegicus
aaagcgtgttcaatcgctgttcctg

SEQ ID NO: 10998 - DNA, 25 bp, Rattus norvegicus
aaagcgtgttcattcgctgttcctg

SEQ ID NO: 10999 - DNA, 25 bp, Rattus norvegicus
aaagcgttcacccaaaggatccata

SEQ ID NO: 11000 - DNA, 25 bp, Rattus norvegicus
aaagcgttcaccgaaaggatccata

SEQ ID NO: 11001 - DNA, 25 bp, Rattus norvegicus
aaagcgttgccaaggacagcccagt

SEQ ID NO: 11002 - DNA, 25 bp, Rattus norvegicus
aaagcgttgccatggacagcccagt

SEQ ID NO: 11003 - DNA, 25 bp, Rattus norvegicus
aaagcgttgtggacctggctgcaat

SEQ ID NO: 11004 - DNA, 25 bp, Rattus norvegicus
aaagcgttgtggtcctggctgcaat

SEQ ID NO: 11005 - DNA, 25 bp, Rattus norvegicus
aaagctaaacttcccagcccatgag

SEQ ID NO: 11006 - DNA, 25 bp, Rattus norvegicus
aaagctaaacttgccagcccatgag

SEQ ID NO: 11007 - DNA, 25 bp, Rattus norvegicus
aaagctaaaggccaccgtgactgca

SEQ ID NO: 11008 - DNA, 25 bp, Rattus norvegicus
aaagctaaaggcgaccgtgactgca

SEQ ID NO: 11009 - DNA, 25 bp, Rattus norvegicus
aaagctaaattcacacaccactaca

SEQ ID NO: 11010 - DNA, 25 bp, Rattus norvegicus
aaagctaaattctcacaccactaca

SEQ ID NO: 11011 - DNA, 25 bp, Rattus norvegicus
aaagctaagccgctcttcgttttgt

SEQ ID NO: 11012 - DNA, 25 bp, Rattus norvegicus
aaagctaagccggtcttcgttttgt

SEQ ID NO: 11013 - DNA, 25 bp, Rattus norvegicus
aaagctaagcgcctacgtggatgaa

SEQ ID NO: 11014 - DNA, 25 bp, Rattus norvegicus
aaagctaagcgcgtacgtggatgaa

SEQ ID NO: 11015 - DNA, 25 bp, Rattus norvegicus
aaagctaatcgacccacatgttcag

SEQ ID NO: 11016 - DNA, 25 bp, Rattus norvegicus
aaagctaatcgagccacatgttcag

SEQ ID NO: 11017 - DNA, 25 bp, Rattus norvegicus
aaagctaattacactgctcctgtat

SEQ ID NO: 11018 - DNA, 25 bp, Rattus norvegicus
aaagctaattactctgctcctgtat

SEQ ID NO: 11019 - DNA, 25 bp, Rattus norvegicus
aaagctaattataacggcgccaaag

SEQ ID NO: 11020 - DNA, 25 bp, Rattus norvegicus
aaagctaattattacggcgccaaag

SEQ ID NO: 11021 - DNA, 25 bp, Rattus norvegicus
aaagctacacagacgtcttcagaaa

SEQ ID NO: 11022 - DNA, 25 bp, Rattus norvegicus
aaagctacacagtcgtcttcagaaa

SEQ ID NO: 11023 - DNA, 25 bp, Rattus norvegicus
aaagctacagaaaccctttttgctg

SEQ ID NO: 11024 - DNA, 25 bp, Rattus norvegicus
aaagctacagaatccctttttgctg

SEQ ID NO: 11025 - DNA, 25 bp, Rattus norvegicus
aaagctacaggaccatcttcggcaa

SEQ ID NO: 11026 - DNA, 25 bp, Rattus norvegicus
aaagctacaggagcatcttcggcaa

SEQ ID NO: 11027 - DNA, 25 bp, Rattus norvegicus
aaagctacaggcaggcatcctagat

SEQ ID NO: 11028 - DNA, 25 bp, Rattus norvegicus
aaagctacaggctggcatcctagat

SEQ ID NO: 11029 - DNA, 25 bp, Rattus norvegicus
aaagctacatctaccgcacacaggg

SEQ ID NO: 11030 - DNA, 25 bp, Rattus norvegicus
aaagctacatcttccgcacacaggg

SEQ ID NO: 11031 - DNA, 25 bp, Rattus norvegicus
aaagctaccagcaggccaggcaagg

SEQ ID NO: 11032 - DNA, 25 bp, Rattus norvegicus
aaagctaccagctggccaggcaagg

SEQ ID NO: 11033 - DNA, 25 bp, Rattus norvegicus
aaagctaccccaaaagtgtgcagga

SEQ ID NO: 11034 - DNA, 25 bp, Rattus norvegicus
aaagctaccccataagtgtgcagga

SEQ ID NO: 11035 - DNA, 25 bp, Rattus norvegicus
aaagctacctagagtttgagcccct

SEQ ID NO: 11036 - DNA, 25 bp, Rattus norvegicus
aaagctacctagtgtttgagcccct

SEQ ID NO: 11037 - DNA, 25 bp, Rattus norvegicus
aaagctacgcccacaaagggttctg

SEQ ID NO: 11038 - DNA, 25 bp, Rattus norvegicus
aaagctacgccctcaaagggttctg

SEQ ID NO: 11039 - DNA, 25 bp, Rattus norvegicus
aaagctacgtgtaccgggagccgca

SEQ ID NO: 11040 - DNA, 25 bp, Rattus norvegicus
aaagctacgtgttccgggagccgca

SEQ ID NO: 11041 - DNA, 25 bp, Rattus norvegicus
aaagctactgaaaattgtggaagat

SEQ ID NO: 11042 - DNA, 25 bp, Rattus norvegicus
aaagctactgaactgccttgggcaa

SEQ ID NO: 11043 - DNA, 25 bp, Rattus norvegicus
aaagctactgaagtgccttgggcaa

SEQ ID NO: 11044 - DNA, 25 bp, Rattus norvegicus
aaagctactgaatattgtggaagat

SEQ ID NO: 11045 - DNA, 25 bp, Rattus norvegicus
aaagctactggaatactgctagaat

SEQ ID NO: 11046 - DNA, 25 bp, Rattus norvegicus
aaagctactggattactgctagaat

SEQ ID NO: 11047 - DNA, 25 bp, Rattus norvegicus
aaagctactgtcaacacaggctact

SEQ ID NO: 11048 - DNA, 25 bp, Rattus norvegicus
aaagctactgtctacacaggctact

SEQ ID NO: 11049 - DNA, 25 bp, Rattus norvegicus
aaagctacttagactagctcctccg

SEQ ID NO: 11050 - DNA, 25 bp, Rattus norvegicus
aaagctacttagtctagctcctccg

SEQ ID NO: 11051 - DNA, 25 bp, Rattus norvegicus
aaagctagaagaacccaggcgccct

SEQ ID NO: 11052 - DNA, 25 bp, Rattus norvegicus
aaagctagaagatcccaggcgccct

SEQ ID NO: 11053 - DNA, 25 bp, Rattus norvegicus
aaagctagacatcctccagagggaa

SEQ ID NO: 11054 - DNA, 25 bp, Rattus norvegicus
aaagctagacatgctccagagggaa

SEQ ID NO: 11055 - DNA, 25 bp, Rattus norvegicus
aaagctagacttcctccaagatccc

SEQ ID NO: 11056 - DNA, 25 bp, Rattus norvegicus
aaagctagacttgctccaagatccc

SEQ ID NO: 11057 - DNA, 25 bp, Rattus norvegicus
aaagctagagggatcgagcggccat

SEQ ID NO: 11058 - DNA, 25 bp, Rattus norvegicus
aaagctagagggttcgagcggccat

SEQ ID NO: 11059 - DNA, 25 bp, Rattus norvegicus
aaagctagcactactgttgccatct

SEQ ID NO: 11060 - DNA, 25 bp, Rattus norvegicus
aaagctagcacttctgttgccatct

SEQ ID NO: 11061 - DNA, 25 bp, Rattus norvegicus
aaagctagcccgaggtggtctggtc

SEQ ID NO: 11062 - DNA, 25 bp, Rattus norvegicus
aaagctagcccgtggtggtctggtc

SEQ ID NO: 11063 - DNA, 25 bp, Rattus norvegicus
aaagctagcctcaactgttagaata

SEQ ID NO: 11064 - DNA, 25 bp, Rattus norvegicus
aaagctagcctctactgttagaata

SEQ ID NO: 11065 - DNA, 25 bp, Rattus norvegicus
aaagctagcgctaggccacgaggat

SEQ ID NO: 11066 - DNA, 25 bp, Rattus norvegicus
aaagctagcgcttggccacgaggat

SEQ ID NO: 11067 - DNA, 25 bp, Rattus norvegicus
aaagctagctgcagggcagagtgca

SEQ ID NO: 11068 - DNA, 25 bp, Rattus norvegicus
aaagctagctgctgggcagagtgca

SEQ ID NO: 11069 - DNA, 25 bp, Rattus norvegicus
aaagctagctttccaacatgtgtag

SEQ ID NO: 11070 - DNA, 25 bp, Rattus norvegicus
aaagctagctttcccacacagtgaa

SEQ ID NO: 11071 - DNA, 25 bp, Rattus norvegicus
aaagctagctttgcaacatgtgtag

SEQ ID NO: 11072 - DNA, 25 bp, Rattus norvegicus
aaagctagctttgccacacagtgaa

SEQ ID NO: 11073 - DNA, 25 bp, Rattus norvegicus
aaagctaggtgcactaccaccacgg

SEQ ID NO: 11074 - DNA, 25 bp, Rattus norvegicus
aaagctaggtgctctaccaccacgg

SEQ ID NO: 11075 - DNA, 25 bp, Rattus norvegicus
aaagctagtcccacaggcgtgatct

SEQ ID NO: 11076 - DNA, 25 bp, Rattus norvegicus
aaagctagtccccagagggcaagat

SEQ ID NO: 11077 - DNA, 25 bp, Rattus norvegicus
aaagctagtcccgagagggcaagat

SEQ ID NO: 11078 - DNA, 25 bp, Rattus norvegicus
aaagctagtccctcaggcgtgatct

SEQ ID NO: 11079 - DNA, 25 bp, Rattus norvegicus
aaagctagtctgacttgaaacttgt

SEQ ID NO: 11080 - DNA, 25 bp, Rattus norvegicus
aaagctagtctgtcttgaaacttgt

SEQ ID NO: 11081 - DNA, 25 bp, Rattus norvegicus
aaagctagtgtcactaaaatcttag

SEQ ID NO: 11082 - DNA, 25 bp, Rattus norvegicus
aaagctagtgtctctaaaatcttag

SEQ ID NO: 11083 - DNA, 25 bp, Rattus norvegicus
aaagctagttgcactcaacctggac

SEQ ID NO: 11084 - DNA, 25 bp, Rattus norvegicus
aaagctagttgctctcaacctggac

SEQ ID NO: 11085 - DNA, 25 bp, Rattus norvegicus
aaagctatacaaagtgtctgacccc

SEQ ID NO: 11086 - DNA, 25 bp, Rattus norvegicus
aaagctatacaatgtgtctgacccc

SEQ ID NO: 11087 - DNA, 25 bp, Rattus norvegicus
aaagctatacagctgtatcctcctc

SEQ ID NO: 11088 - DNA, 25 bp, Rattus norvegicus
aaagctatacaggtgtatcctcctc

SEQ ID NO: 11089 - DNA, 25 bp, Rattus norvegicus
aaagctatagctagcctagtgtaag

SEQ ID NO: 11090 - DNA, 25 bp, Rattus norvegicus
aaagctatagcttgcctagtgtaag

SEQ ID NO: 11091 - DNA, 25 bp, Rattus norvegicus
aaagctatatttctgtgcattatat

SEQ ID NO: 11092 - DNA, 25 bp, Rattus norvegicus
aaagctatatttgtgtgcattatat

SEQ ID NO: 11093 - DNA, 25 bp, Rattus norvegicus
aaagctatcgcacatttaagggtct

SEQ ID NO: 11094 - DNA, 25 bp, Rattus norvegicus
aaagctatcgcagatttaagggtct

SEQ ID NO: 11095 - DNA, 25 bp, Rattus norvegicus
aaagctatctggagatacattgcca

SEQ ID NO: 11096 - DNA, 25 bp, Rattus norvegicus
aaagctatctggtgatacattgcca

SEQ ID NO: 11097 - DNA, 25 bp, Rattus norvegicus
aaagctatgcaaactcacggtcaaa

SEQ ID NO: 11098 - DNA, 25 bp, Rattus norvegicus
aaagctatgcaatctcacggtcaaa

SEQ ID NO: 11099 - DNA, 25 bp, Rattus norvegicus
aaagctatgcacatgttctgaaagt

SEQ ID NO: 11100 - DNA, 25 bp, Rattus norvegicus
aaagctatgcacttgttctgaaagt

SEQ ID NO: 11101 - DNA, 25 bp, Rattus norvegicus
aaagctatgctacatatgactggac

SEQ ID NO: 11102 - DNA, 25 bp, Rattus norvegicus
aaagctatgctagatatgactggac

SEQ ID NO: 11103 - DNA, 25 bp, Rattus norvegicus
aaagctatggatcagtcagtggcaa

SEQ ID NO: 11104 - DNA, 25 bp, Rattus norvegicus
aaagctatggatgagtcagtggcaa

SEQ ID NO: 11105 - DNA, 25 bp, Rattus norvegicus
aaagctatgtggattctctcacccg

SEQ ID NO: 11106 - DNA, 25 bp, Rattus norvegicus
aaagctatgtggtttctctcacccg

SEQ ID NO: 11107 - DNA, 25 bp, Rattus norvegicus
aaagctatgtgtattgggactgcac

SEQ ID NO: 11108 - DNA, 25 bp, Rattus norvegicus
aaagctatgtgttttgggactgcac

SEQ ID NO: 11109 - DNA, 25 bp, Rattus norvegicus
aaagctatgttcatcttggctagca

SEQ ID NO: 11110 - DNA, 25 bp, Rattus norvegicus
aaagctatgttcttcttggctagca

SEQ ID NO: 11111 - DNA, 25 bp, Rattus norvegicus
aaagctatgtttcttacacctcacc

SEQ ID NO: 11112 - DNA, 25 bp, Rattus norvegicus
aaagctatgtttgttacacctcacc

SEQ ID NO: 11113 - DNA, 25 bp, Rattus norvegicus
aaagctattcttccctttcaggaga

SEQ ID NO: 11114 - DNA, 25 bp, Rattus norvegicus
aaagctattcttgcctttcaggaga

SEQ ID NO: 11115 - DNA, 25 bp, Rattus norvegicus
aaagctattgggattgttgccggga

SEQ ID NO: 11116 - DNA, 25 bp, Rattus norvegicus
aaagctattgggtttgttgccggga

SEQ ID NO: 11117 - DNA, 25 bp, Rattus norvegicus
aaagctattgtcagcgtgtgggcta

SEQ ID NO: 11118 - DNA, 25 bp, Rattus norvegicus
aaagctattgtctgcgtgtgggcta

SEQ ID NO: 11119 - DNA, 25 bp, Rattus norvegicus
aaagctattttcacatgctttgttt

SEQ ID NO: 11120 - DNA, 25 bp, Rattus norvegicus
aaagctattttctcatgctttgttt

SEQ ID NO: 11121 - DNA, 25 bp, Rattus norvegicus
aaagctcaaagccagtgtttccctt

SEQ ID NO: 11122 - DNA, 25 bp, Rattus norvegicus
aaagctcaaagcgagtgtttccctt

SEQ ID NO: 11123 - DNA, 25 bp, Rattus norvegicus
aaagctcaaagtagcctgctggctt

SEQ ID NO: 11124 - DNA, 25 bp, Rattus norvegicus
aaagctcaaagttgcctgctggctt

SEQ ID NO: 11125 - DNA, 25 bp, Rattus norvegicus
aaagctcaagaactctgtgccctcg

SEQ ID NO: 11126 - DNA, 25 bp, Rattus norvegicus
aaagctcaagaagtctgtgccctcg

SEQ ID NO: 11127 - DNA, 25 bp, Rattus norvegicus
aaagctcacattctgctgcaagtgc

SEQ ID NO: 11128 - DNA, 25 bp, Rattus norvegicus
aaagctcacattgtgctgcaagtgc

SEQ ID NO: 11129 - DNA, 25 bp, Rattus norvegicus
aaagctcaccatcctgactgaaata

SEQ ID NO: 11130 - DNA, 25 bp, Rattus norvegicus
aaagctcaccatgctgactgaaata

SEQ ID NO: 11131 - DNA, 25 bp, Rattus norvegicus
aaagctcacctgaggactcatacgg

SEQ ID NO: 11132 - DNA, 25 bp, Rattus norvegicus
aaagctcacctgcatttccactgta

SEQ ID NO: 11133 - DNA, 25 bp, Rattus norvegicus
aaagctcacctggatttccactgta

SEQ ID NO: 11134 - DNA, 25 bp, Rattus norvegicus
aaagctcacctgtggactcatacgg

SEQ ID NO: 11135 - DNA, 25 bp, Rattus norvegicus
aaagctcacggcatacatagggtgc

SEQ ID NO: 11136 - DNA, 25 bp, Rattus norvegicus
aaagctcacggcttacatagggtgc

SEQ ID NO: 11137 - DNA, 25 bp, Rattus norvegicus
aaagctcactcgacatttccttgtt

SEQ ID NO: 11138 - DNA, 25 bp, Rattus norvegicus
aaagctcactcgtcatttccttgtt

SEQ ID NO: 11139 - DNA, 25 bp, Rattus norvegicus
aaagctcagagcctgtccccagtga

SEQ ID NO: 11140 - DNA, 25 bp, Rattus norvegicus
aaagctcagagcgtgtccccagtga

SEQ ID NO: 11141 - DNA, 25 bp, Rattus norvegicus
aaagctcagaggctgctcaaagcaa

SEQ ID NO: 11142 - DNA, 25 bp, Rattus norvegicus
aaagctcagagggtgctcaaagcaa

SEQ ID NO: 11143 - DNA, 25 bp, Rattus norvegicus
aaagctcagagtagtatccccagca

SEQ ID NO: 11144 - DNA, 25 bp, Rattus norvegicus
aaagctcagagttgtatccccagca

SEQ ID NO: 11145 - DNA, 25 bp, Rattus norvegicus
aaagctcagcagagcttgactgcct

SEQ ID NO: 11146 - DNA, 25 bp, Rattus norvegicus
aaagctcagcagtgcttgactgcct

SEQ ID NO: 11147 - DNA, 25 bp, Rattus norvegicus
aaagctcagggtactccttggccat

SEQ ID NO: 11148 - DNA, 25 bp, Rattus norvegicus
aaagctcagggttctccttggccat

SEQ ID NO: 11149 - DNA, 25 bp, Rattus norvegicus
aaagctcagttaaatccaagtacaa

SEQ ID NO: 11150 - DNA, 25 bp, Rattus norvegicus
aaagctcagttatatccaagtacaa

SEQ ID NO: 11151 - DNA, 25 bp, Rattus norvegicus
aaagctcatcccaactgggcttatt

SEQ ID NO: 11152 - DNA, 25 bp, Rattus norvegicus
aaagctcatccctactgggcttatt

SEQ ID NO: 11153 - DNA, 25 bp, Rattus norvegicus
aaagctcatgatatggcctgggaca

SEQ ID NO: 11154 - DNA, 25 bp, Rattus norvegicus
aaagctcatgatttggcctgggaca

SEQ ID NO: 11155 - DNA, 25 bp, Rattus norvegicus
aaagctcatttaattgtgaggcact

SEQ ID NO: 11156 - DNA, 25 bp, Rattus norvegicus
aaagctcatttatttgtgaggcact

SEQ ID NO: 11157 - DNA, 25 bp, Rattus norvegicus
aaagctccacagaccactggtaaca

SEQ ID NO: 11158 - DNA, 25 bp, Rattus norvegicus
aaagctccacagtccactggtaaca

SEQ ID NO: 11159 - DNA, 25 bp, Rattus norvegicus
aaagctccagctaaggcccaggcca

SEQ ID NO: 11160 - DNA, 25 bp, Rattus norvegicus
aaagctccagctactactctaacat

SEQ ID NO: 11161 - DNA, 25 bp, Rattus norvegicus
aaagctccagcttaggcccaggcca

SEQ ID NO: 11162 - DNA, 25 bp, Rattus norvegicus
aaagctccagcttctactctaacat

SEQ ID NO: 11163 - DNA, 25 bp, Rattus norvegicus
aaagctccatgtatgctgacaggca

SEQ ID NO: 11164 - DNA, 25 bp, Rattus norvegicus
aaagctccatgtttgctgacaggca

SEQ ID NO: 11165 - DNA, 25 bp, Rattus norvegicus
aaagctccatttctgtactttggtt

SEQ ID NO: 11166 - DNA, 25 bp, Rattus norvegicus
aaagctccatttgtgtactttggtt

SEQ ID NO: 11167 - DNA, 25 bp, Rattus norvegicus
aaagctccccaacagtgtgactgga

SEQ ID NO: 11168 - DNA, 25 bp, Rattus norvegicus
aaagctccccaacatctgacagttc

SEQ ID NO: 11169 - DNA, 25 bp, Rattus norvegicus
aaagctccccaagagtgtgactgga

SEQ ID NO: 11170 - DNA, 25 bp, Rattus norvegicus
aaagctccccaagatctgacagttc

SEQ ID NO: 11171 - DNA, 25 bp, Rattus norvegicus
aaagctccctcaagggttttcatgg

SEQ ID NO: 11172 - DNA, 25 bp, Rattus norvegicus
aaagctccctcatgggttttcatgg

SEQ ID NO: 11173 - DNA, 25 bp, Rattus norvegicus
aaagctcccttacctactgtactca

SEQ ID NO: 11174 - DNA, 25 bp, Rattus norvegicus
aaagctcccttagctactgtactca

SEQ ID NO: 11175 - DNA, 25 bp, Rattus norvegicus
aaagctccgactcgcgggcgtagct

SEQ ID NO: 11176 - DNA, 25 bp, Rattus norvegicus
aaagctccgactggcgggcgtagct

SEQ ID NO: 11177 - DNA, 25 bp, Rattus norvegicus
aaagctccgcccagccgaatgtgtg

SEQ ID NO: 11178 - DNA, 25 bp, Rattus norvegicus
aaagctccgccctgccgaatgtgtg

SEQ ID NO: 11179 - DNA, 25 bp, Rattus norvegicus
aaagctcctacaccctttattttgc

SEQ ID NO: 11180 - DNA, 25 bp, Rattus norvegicus
aaagctcctacagcctttattttgc

SEQ ID NO: 11181 - DNA, 25 bp, Rattus norvegicus
aaagctcctataaacttccacattc

SEQ ID NO: 11182 - DNA, 25 bp, Rattus norvegicus
aaagctcctatatacttccacattc

SEQ ID NO: 11183 - DNA, 25 bp, Rattus norvegicus
aaagctcctgaaagttccatcgtca

SEQ ID NO: 11184 - DNA, 25 bp, Rattus norvegicus
aaagctcctgaatgttccatcgtca

SEQ ID NO: 11185 - DNA, 25 bp, Rattus norvegicus
aaagctcctgcacggtttgttctca

SEQ ID NO: 11186 - DNA, 25 bp, Rattus norvegicus
aaagctcctgcagggtttgttctca

SEQ ID NO: 11187 - DNA, 25 bp, Rattus norvegicus
aaagctcctgctcgactgtggtgct

SEQ ID NO: 11188 - DNA, 25 bp, Rattus norvegicus
aaagctcctgctggactgtggtgct

SEQ ID NO: 11189 - DNA, 25 bp, Rattus norvegicus
aaagctcctggtactctgctttcac

SEQ ID NO: 11190 - DNA, 25 bp, Rattus norvegicus
aaagctcctggtattgttgactctt

SEQ ID NO: 11191 - DNA, 25 bp, Rattus norvegicus
aaagctcctggttctctgctttcac

SEQ ID NO: 11192 - DNA, 25 bp, Rattus norvegicus
aaagctcctggttttgttgactctt

SEQ ID NO: 11193 - DNA, 25 bp, Rattus norvegicus
aaagctccttaactagccctgtcct

SEQ ID NO: 11194 - DNA, 25 bp, Rattus norvegicus
aaagctccttaagtagccctgtcct

SEQ ID NO: 11195 - DNA, 25 bp, Rattus norvegicus
aaagctccttgtaggtcttagccct

SEQ ID NO: 11196 - DNA, 25 bp, Rattus norvegicus
aaagctccttgttggtcttagccct

SEQ ID NO: 11197 - DNA, 25 bp, Rattus norvegicus
aaagctcctttaaatacctccatac

SEQ ID NO: 11198 - DNA, 25 bp, Rattus norvegicus
aaagctcctttatatacctccatac

SEQ ID NO: 11199 - DNA, 25 bp, Rattus norvegicus
aaagctcgaatcacactggctctgg

SEQ ID NO: 11200 - DNA, 25 bp, Rattus norvegicus
aaagctcgaatctcactggctctgg

SEQ ID NO: 11201 - DNA, 25 bp, Rattus norvegicus
aaagctcgacagacagcagccctta

SEQ ID NO: 11202 - DNA, 25 bp, Rattus norvegicus
aaagctcgacagtcagcagccctta

SEQ ID NO: 11203 - DNA, 25 bp, Rattus norvegicus
aaagctcgagccaaagtccaagcca

SEQ ID NO: 11204 - DNA, 25 bp, Rattus norvegicus
aaagctcgagcctaagtccaagcca

SEQ ID NO: 11205 - DNA, 25 bp, Rattus norvegicus
aaagctcgcaaactcttcattcctg

SEQ ID NO: 11206 - DNA, 25 bp, Rattus norvegicus
aaagctcgcaaagtcttcattcctg

SEQ ID NO: 11207 - DNA, 25 bp, Rattus norvegicus
aaagctcgccacagttttttgtagt

SEQ ID NO: 11208 - DNA, 25 bp, Rattus norvegicus
aaagctcgccactgttttttgtagt

SEQ ID NO: 11209 - DNA, 25 bp, Rattus norvegicus
aaagctcgtactctggactccaaga

SEQ ID NO: 11210 - DNA, 25 bp, Rattus norvegicus
aaagctcgtactgtggactccaaga

SEQ ID NO: 11211 - DNA, 25 bp, Rattus norvegicus
aaagctcgtgttcctaaggctgcga

SEQ ID NO: 11212 - DNA, 25 bp, Rattus norvegicus
aaagctcgtgttgctaaggctgcga

SEQ ID NO: 11213 - DNA, 25 bp, Rattus norvegicus
aaagctctacacacaggttactgca

SEQ ID NO: 11214 - DNA, 25 bp, Rattus norvegicus
aaagctctacactcaggttactgca

SEQ ID NO: 11215 - DNA, 25 bp, Rattus norvegicus
aaagctctactgatgcagacacact

SEQ ID NO: 11216 - DNA, 25 bp, Rattus norvegicus
aaagctctactgttgcagacacact

SEQ ID NO: 11217 - DNA, 25 bp, Rattus norvegicus
aaagctctccggacaatgcatttgc

SEQ ID NO: 11218 - DNA, 25 bp, Rattus norvegicus
aaagctctccggtcaatgcatttgc

SEQ ID NO: 11219 - DNA, 25 bp, Rattus norvegicus
aaagctctctaaagttacttcccac

SEQ ID NO: 11220 - DNA, 25 bp, Rattus norvegicus
aaagctctctaatgttacttcccac

SEQ ID NO: 11221 - DNA, 25 bp, Rattus norvegicus
aaagctctctgaacccaggacaaat

SEQ ID NO: 11222 - DNA, 25 bp, Rattus norvegicus
aaagctctctgacttgcgccaactg

SEQ ID NO: 11223 - DNA, 25 bp, Rattus norvegicus
aaagctctctgagttgcgccaactg

SEQ ID NO: 11224 - DNA, 25 bp, Rattus norvegicus
aaagctctctgatcccaggacaaat

SEQ ID NO: 11225 - DNA, 25 bp, Rattus norvegicus
aaagctctgaaacgctgcagtcctg

SEQ ID NO: 11226 - DNA, 25 bp, Rattus norvegicus
aaagctctgaaaggctgcagtcctg

SEQ ID NO: 11227 - DNA, 25 bp, Rattus norvegicus
aaagctctgacaaaggcacctgtgt

SEQ ID NO: 11228 - DNA, 25 bp, Rattus norvegicus
aaagctctgacataggcacctgtgt

SEQ ID NO: 11229 - DNA, 25 bp, Rattus norvegicus
aaagctctgaggaccagttattcct

SEQ ID NO: 11230 - DNA, 25 bp, Rattus norvegicus
aaagctctgaggtccagttattcct

SEQ ID NO: 11231 - DNA, 25 bp, Rattus norvegicus
aaagctctgagtcagggctgtccac

SEQ ID NO: 11232 - DNA, 25 bp, Rattus norvegicus
aaagctctgagtgagggctgtccac

SEQ ID NO: 11233 - DNA, 25 bp, Rattus norvegicus
aaagctctgatcagctctgggtgta

SEQ ID NO: 11234 - DNA, 25 bp, Rattus norvegicus
aaagctctgatctgctctgggtgta

SEQ ID NO: 11235 - DNA, 25 bp, Rattus norvegicus
aaagctctggacctagttctttaga

SEQ ID NO: 11236 - DNA, 25 bp, Rattus norvegicus
aaagctctggacgtagttctttaga

SEQ ID NO: 11237 - DNA, 25 bp, Rattus norvegicus
aaagctctggtgatgaccagccttt

SEQ ID NO: 11238 - DNA, 25 bp, Rattus norvegicus
aaagctctggtgttgaccagccttt

SEQ ID NO: 11239 - DNA, 25 bp, Rattus norvegicus
aaagctctgtagaatgtctgtggtt

SEQ ID NO: 11240 - DNA, 25 bp, Rattus norvegicus
aaagctctgtagtatgtctgtggtt

SEQ ID NO: 11241 - DNA, 25 bp, Rattus norvegicus
aaagctctgtgcctattcctcaggg

SEQ ID NO: 11242 - DNA, 25 bp, Rattus norvegicus
aaagctctgtgcgtattcctcaggg

SEQ ID NO: 11243 - DNA, 25 bp, Rattus norvegicus
aaagctcttactccacactacaaat

SEQ ID NO: 11244 - DNA, 25 bp, Rattus norvegicus
aaagctcttactgcacactacaaat

SEQ ID NO: 11245 - DNA, 25 bp, Rattus norvegicus
aaagctcttcagagagcccaagcct

SEQ ID NO: 11246 - DNA, 25 bp, Rattus norvegicus
aaagctcttcagtgagcccaagcct

SEQ ID NO: 11247 - DNA, 25 bp, Rattus norvegicus
aaagctcttcatctgtcctgtgact

SEQ ID NO: 11248 - DNA, 25 bp, Rattus norvegicus
aaagctcttcatgtgtcctgtgact

SEQ ID NO: 11249 - DNA, 25 bp, Rattus norvegicus
aaagctcttctgaggtcagatctgg

SEQ ID NO: 11250 - DNA, 25 bp, Rattus norvegicus
aaagctcttctgtggtcagatctgg

SEQ ID NO: 11251 - DNA, 25 bp, Rattus norvegicus
aaagctcttgagctacactgtgtat

SEQ ID NO: 11252 - DNA, 25 bp, Rattus norvegicus
aaagctcttgaggtacactgtgtat

SEQ ID NO: 11253 - DNA, 25 bp, Rattus norvegicus
aaagctcttggcagactcctcaggg

SEQ ID NO: 11254 - DNA, 25 bp, Rattus norvegicus
aaagctcttggctgactcctcaggg

SEQ ID NO: 11255 - DNA, 25 bp, Rattus norvegicus
aaagctcttgtaccgctggagaaat

SEQ ID NO: 11256 - DNA, 25 bp, Rattus norvegicus
aaagctcttgtagcgctggagaaat

SEQ ID NO: 11257 - DNA, 25 bp, Rattus norvegicus
aaagctcttgtgaggttcacccaca

SEQ ID NO: 11258 - DNA, 25 bp, Rattus norvegicus
aaagctcttgtgtggttcacccaca

SEQ ID NO: 11259 - DNA, 25 bp, Rattus norvegicus
aaagctctttctccttgtcccaggt

SEQ ID NO: 11260 - DNA, 25 bp, Rattus norvegicus
aaagctctttctgcttgtcccaggt

SEQ ID NO: 11261 - DNA, 25 bp, Rattus norvegicus
aaagctctttgaaggcctacagatc

SEQ ID NO: 11262 - DNA, 25 bp, Rattus norvegicus
aaagctctttgatggcctacagatc

SEQ ID NO: 11263 - DNA, 25 bp, Rattus norvegicus
aaagctgaaagcacatggcccttcc

SEQ ID NO: 11264 - DNA, 25 bp, Rattus norvegicus
aaagctgaaagctcatggcccttcc

SEQ ID NO: 11265 - DNA, 25 bp, Rattus norvegicus
aaagctgaagcccaagagccacaaa

SEQ ID NO: 11266 - DNA, 25 bp, Rattus norvegicus
aaagctgaagccgaagagccacaaa

SEQ ID NO: 11267 - DNA, 25 bp, Rattus norvegicus
aaagctgaagctacgccgtgagcga

SEQ ID NO: 11268 - DNA, 25 bp, Rattus norvegicus
aaagctgaagcttcgccgtgagcga

SEQ ID NO: 11269 - DNA, 25 bp, Rattus norvegicus
aaagctgaagtgagcaaccctgttt

SEQ ID NO: 11270 - DNA, 25 bp, Rattus norvegicus
aaagctgaagtgtgcaaccctgttt

SEQ ID NO: 11271 - DNA, 25 bp, Rattus norvegicus
aaagctgaatccagtttggctgtgg

SEQ ID NO: 11272 - DNA, 25 bp, Rattus norvegicus
aaagctgaatcctgtttggctgtgg

SEQ ID NO: 11273 - DNA, 25 bp, Rattus norvegicus
aaagctgaatgccaggctctgtgcc

SEQ ID NO: 11274 - DNA, 25 bp, Rattus norvegicus
aaagctgaatgcgaggctctgtgcc

SEQ ID NO: 11275 - DNA, 25 bp, Rattus norvegicus
aaagctgaattcaaccgagggtctc

SEQ ID NO: 11276 - DNA, 25 bp, Rattus norvegicus
aaagctgaattccatctgtgttctt

SEQ ID NO: 11277 - DNA, 25 bp, Rattus norvegicus
aaagctgaattcgatctgtgttctt

SEQ ID NO: 11278 - DNA, 25 bp, Rattus norvegicus
aaagctgaattctaccgagggtctc

SEQ ID NO: 11279 - DNA, 25 bp, Rattus norvegicus
aaagctgaccgtctttttctgaagg

SEQ ID NO: 11280 - DNA, 25 bp, Rattus norvegicus
aaagctgaccgtgtttttctgaagg

SEQ ID NO: 11281 - DNA, 25 bp, Rattus norvegicus
aaagctgaccttcgtggattttctc

SEQ ID NO: 11282 - DNA, 25 bp, Rattus norvegicus
aaagctgaccttggtggattttctc

SEQ ID NO: 11283 - DNA, 25 bp, Rattus norvegicus
aaagctgacggaactcttaggaatg

SEQ ID NO: 11284 - DNA, 25 bp, Rattus norvegicus
aaagctgacggatctcttaggaatg

SEQ ID NO: 11285 - DNA, 25 bp, Rattus norvegicus
aaagctgacttcattgaaccagaaa

SEQ ID NO: 11286 - DNA, 25 bp, Rattus norvegicus
aaagctgacttctttgaaccagaaa

SEQ ID NO: 11287 - DNA, 25 bp, Rattus norvegicus
aaagctgagaccacagtttccacca

SEQ ID NO: 11288 - DNA, 25 bp, Rattus norvegicus
aaagctgagacctcagtttccacca

SEQ ID NO: 11289 - DNA, 25 bp, Rattus norvegicus
aaagctgagactctgttgcttctcc

SEQ ID NO: 11290 - DNA, 25 bp, Rattus norvegicus
aaagctgagactgtgttgcttctcc

SEQ ID NO: 11291 - DNA, 25 bp, Rattus norvegicus
aaagctgagcagagggaactctcca

SEQ ID NO: 11292 - DNA, 25 bp, Rattus norvegicus
aaagctgagcagtgggaactctcca

SEQ ID NO: 11293 - DNA, 25 bp, Rattus norvegicus
aaagctgagcctatggtaacagggc

SEQ ID NO: 11294 - DNA, 25 bp, Rattus norvegicus
aaagctgagcctttggtaacagggc

SEQ ID NO: 11295 - DNA, 25 bp, Rattus norvegicus
aaagctgagcgaacttgagaagtcc

SEQ ID NO: 11296 - DNA, 25 bp, Rattus norvegicus
aaagctgagcgatcttgagaagtcc

SEQ ID NO: 11297 - DNA, 25 bp, Rattus norvegicus
aaagctgagctcaccaagctggtga

SEQ ID NO: 11298 - DNA, 25 bp, Rattus norvegicus
aaagctgagctctccaagctggtga

SEQ ID NO: 11299 - DNA, 25 bp, Rattus norvegicus
aaagctgaggctaggacttgctccc

SEQ ID NO: 11300 - DNA, 25 bp, Rattus norvegicus
aaagctgaggcttggacttgctccc

SEQ ID NO: 11301 - DNA, 25 bp, Rattus norvegicus
aaagctgatgagaccctccgaagaa

SEQ ID NO: 11302 - DNA, 25 bp, Rattus norvegicus
aaagctgatgagtccctccgaagaa

SEQ ID NO: 11303 - DNA, 25 bp, Rattus norvegicus
aaagctgatttcagcagctgcagat

SEQ ID NO: 11304 - DNA, 25 bp, Rattus norvegicus
aaagctgatttctgcagctgcagat

SEQ ID NO: 11305 - DNA, 25 bp, Rattus norvegicus
aaagctgcaagcattcagaaagagt

SEQ ID NO: 11306 - DNA, 25 bp, Rattus norvegicus
aaagctgcaagctttcagaaagagt

SEQ ID NO: 11307 - DNA, 25 bp, Rattus norvegicus
aaagctgcaaggagcccaccccaag

SEQ ID NO: 11308 - DNA, 25 bp, Rattus norvegicus
aaagctgcaaggtgcccaccccaag

SEQ ID NO: 11309 - DNA, 25 bp, Rattus norvegicus
aaagctgcacagagcctcttggtaa

SEQ ID NO: 11310 - DNA, 25 bp, Rattus norvegicus
aaagctgcacagtgcctcttggtaa

SEQ ID NO: 11311 - DNA, 25 bp, Rattus norvegicus
aaagctgcaccaacaagacaccttg

SEQ ID NO: 11312 - DNA, 25 bp, Rattus norvegicus
aaagctgcaccatcaagacaccttg

SEQ ID NO: 11313 - DNA, 25 bp, Rattus norvegicus
aaagctgcactgctaaacctttcca

SEQ ID NO: 11314 - DNA, 25 bp, Rattus norvegicus
aaagctgcactggtaaacctttcca

SEQ ID NO: 11315 - DNA, 25 bp, Rattus norvegicus
aaagctgcagacatcattggtgtgg

SEQ ID NO: 11316 - DNA, 25 bp, Rattus norvegicus
aaagctgcagaccacgtcgaagacc

SEQ ID NO: 11317 - DNA, 25 bp, Rattus norvegicus
aaagctgcagacgacgtcgaagacc

SEQ ID NO: 11318 - DNA, 25 bp, Rattus norvegicus
aaagctgcagacttcattggtgtgg

SEQ ID NO: 11319 - DNA, 25 bp, Rattus norvegicus
aaagctgcagcaactctatagggat

SEQ ID NO: 11320 - DNA, 25 bp, Rattus norvegicus
aaagctgcagcatctctatagggat

SEQ ID NO: 11321 - DNA, 25 bp, Rattus norvegicus
aaagctgcagccctagtcctcaaag

SEQ ID NO: 11322 - DNA, 25 bp, Rattus norvegicus
aaagctgcagccgtagtcctcaaag

SEQ ID NO: 11323 - DNA, 25 bp, Rattus norvegicus
aaagctgcagctcctattgttgaat

SEQ ID NO: 11324 - DNA, 25 bp, Rattus norvegicus
aaagctgcagctgctattgttgaat

SEQ ID NO: 11325 - DNA, 25 bp, Rattus norvegicus
aaagctgcaggtaagtccgtctcgt

SEQ ID NO: 11326 - DNA, 25 bp, Rattus norvegicus
aaagctgcaggttagtccgtctcgt

SEQ ID NO: 11327 - DNA, 25 bp, Rattus norvegicus
aaagctgcagttagctctcagggaa

SEQ ID NO: 11328 - DNA, 25 bp, Rattus norvegicus
aaagctgcagtttgctctcagggaa

SEQ ID NO: 11329 - DNA, 25 bp, Rattus norvegicus
aaagctgcataaaagtcttcttgat

SEQ ID NO: 11330 - DNA, 25 bp, Rattus norvegicus
aaagctgcataatagtcttcttgat

SEQ ID NO: 11331 - DNA, 25 bp, Rattus norvegicus
aaagctgcatgaaatgtgtttactc

SEQ ID NO: 11332 - DNA, 25 bp, Rattus norvegicus
aaagctgcatgatatgtgtttactc

SEQ ID NO: 11333 - DNA, 25 bp, Rattus norvegicus
aaagctgcatgccagaaatcctgag

SEQ ID NO: 11334 - DNA, 25 bp, Rattus norvegicus
aaagctgcatgcgagaaatcctgag

SEQ ID NO: 11335 - DNA, 25 bp, Rattus norvegicus
aaagctgccaacctcctttcactgt

SEQ ID NO: 11336 - DNA, 25 bp, Rattus norvegicus
aaagctgccaacgtcctttcactgt

SEQ ID NO: 11337 - DNA, 25 bp, Rattus norvegicus
aaagctgccatgcatttacccttga

SEQ ID NO: 11338 - DNA, 25 bp, Rattus norvegicus
aaagctgccatgctttagaccagta

SEQ ID NO: 11339 - DNA, 25 bp, Rattus norvegicus
aaagctgccatggatttacccttga

SEQ ID NO: 11340 - DNA, 25 bp, Rattus norvegicus
aaagctgccatggtttagaccagta

SEQ ID NO: 11341 - DNA, 25 bp, Rattus norvegicus
aaagctgccattcggaaggaactca

SEQ ID NO: 11342 - DNA, 25 bp, Rattus norvegicus
aaagctgccattgggaaggaactca

SEQ ID NO: 11343 - DNA, 25 bp, Rattus norvegicus
aaagctgcccaaactcatgccagtc

SEQ ID NO: 11344 - DNA, 25 bp, Rattus norvegicus
aaagctgcccaatctcatgccagtc

SEQ ID NO: 11345 - DNA, 25 bp, Rattus norvegicus
aaagctgcccgtcactacgacttag

SEQ ID NO: 11346 - DNA, 25 bp, Rattus norvegicus
aaagctgcccgtgactacgacttag

SEQ ID NO: 11347 - DNA, 25 bp, Rattus norvegicus
aaagctgccctcaccgtgcaatgtc

SEQ ID NO: 11348 - DNA, 25 bp, Rattus norvegicus
aaagctgccctctccgtgcaatgtc

SEQ ID NO: 11349 - DNA, 25 bp, Rattus norvegicus
aaagctgccgctacctcactaaatg

SEQ ID NO: 11350 - DNA, 25 bp, Rattus norvegicus
aaagctgccgctcaatgttttgccc

SEQ ID NO: 11351 - DNA, 25 bp, Rattus norvegicus
aaagctgccgctgaatgttttgccc

SEQ ID NO: 11352 - DNA, 25 bp, Rattus norvegicus
aaagctgccgcttcctcactaaatg

SEQ ID NO: 11353 - DNA, 25 bp, Rattus norvegicus
aaagctgccgggagcgtttatcctt

SEQ ID NO: 11354 - DNA, 25 bp, Rattus norvegicus
aaagctgccgggtgcgtttatcctt

SEQ ID NO: 11355 - DNA, 25 bp, Rattus norvegicus
aaagctgccgttcagctcttctgga

SEQ ID NO: 11356 - DNA, 25 bp, Rattus norvegicus
aaagctgccgttgagctcttctgga

SEQ ID NO: 11357 - DNA, 25 bp, Rattus norvegicus
aaagctgcctgtcgctaatgccggg

SEQ ID NO: 11358 - DNA, 25 bp, Rattus norvegicus
aaagctgcctgtctgggataatttg

SEQ ID NO: 11359 - DNA, 25 bp, Rattus norvegicus
aaagctgcctgtggctaatgccggg

SEQ ID NO: 11360 - DNA, 25 bp, Rattus norvegicus
aaagctgcctgtgtgggataatttg

SEQ ID NO: 11361 - DNA, 25 bp, Rattus norvegicus
aaagctgccttgatgccatatctaa

SEQ ID NO: 11362 - DNA, 25 bp, Rattus norvegicus
aaagctgccttgttgccatatctaa

SEQ ID NO: 11363 - DNA, 25 bp, Rattus norvegicus
aaagctgcctttctctcttaagagt

SEQ ID NO: 11364 - DNA, 25 bp, Rattus norvegicus
aaagctgcctttgtctcttaagagt

SEQ ID NO: 11365 - DNA, 25 bp, Rattus norvegicus
aaagctgcgagacctcggagcctta

SEQ ID NO: 11366 - DNA, 25 bp, Rattus norvegicus
aaagctgcgagagctcggagcctta

SEQ ID NO: 11367 - DNA, 25 bp, Rattus norvegicus
aaagctgcgcccaggatttactctt

SEQ ID NO: 11368 - DNA, 25 bp, Rattus norvegicus
aaagctgcgccctggatttactctt

SEQ ID NO: 11369 - DNA, 25 bp, Rattus norvegicus
aaagctgctagacttccttagccgg

SEQ ID NO: 11370 - DNA, 25 bp, Rattus norvegicus
aaagctgctagagttccttagccgg

SEQ ID NO: 11371 - DNA, 25 bp, Rattus norvegicus
aaagctgctattacggtaacttact

SEQ ID NO: 11372 - DNA, 25 bp, Rattus norvegicus
aaagctgctatttcggtaacttact

SEQ ID NO: 11373 - DNA, 25 bp, Rattus norvegicus
aaagctgctcacagtttctctagag

SEQ ID NO: 11374 - DNA, 25 bp, Rattus norvegicus
aaagctgctcactgtttctctagag

SEQ ID NO: 11375 - DNA, 25 bp, Rattus norvegicus
aaagctgctcatcgctgcaacacta

SEQ ID NO: 11376 - DNA, 25 bp, Rattus norvegicus
aaagctgctcatggctgcaacacta

SEQ ID NO: 11377 - DNA, 25 bp, Rattus norvegicus
aaagctgctctcctggaggaaccag

SEQ ID NO: 11378 - DNA, 25 bp, Rattus norvegicus
aaagctgctctcgtggaggaaccag

SEQ ID NO: 11379 - DNA, 25 bp, Rattus norvegicus
aaagctgctgaacggcattttgcct

SEQ ID NO: 11380 - DNA, 25 bp, Rattus norvegicus
aaagctgctgaagggcattttgcct

SEQ ID NO: 11381 - DNA, 25 bp, Rattus norvegicus
aaagctgctgagacctactacttac

SEQ ID NO: 11382 - DNA, 25 bp, Rattus norvegicus
aaagctgctgagtcctactacttac

SEQ ID NO: 11383 - DNA, 25 bp, Rattus norvegicus
aaagctgctgatctgaagaacctct

SEQ ID NO: 11384 - DNA, 25 bp, Rattus norvegicus
aaagctgctgatgtgaagaacctct

SEQ ID NO: 11385 - DNA, 25 bp, Rattus norvegicus
aaagctgctgcaaattctactctaa

SEQ ID NO: 11386 - DNA, 25 bp, Rattus norvegicus
aaagctgctgcatattctactctaa

SEQ ID NO: 11387 - DNA, 25 bp, Rattus norvegicus
aaagctgctgccaaaacgcaagccc

SEQ ID NO: 11388 - DNA, 25 bp, Rattus norvegicus
aaagctgctgcctaaacgcaagccc

SEQ ID NO: 11389 - DNA, 25 bp, Rattus norvegicus
aaagctgctgctccatgcaacctta

SEQ ID NO: 11390 - DNA, 25 bp, Rattus norvegicus
aaagctgctgctgcatgcaacctta

SEQ ID NO: 11391 - DNA, 25 bp, Rattus norvegicus
aaagctgctgtcagttcaggttgaa

SEQ ID NO: 11392 - DNA, 25 bp, Rattus norvegicus
aaagctgctgtctgttcaggttgaa

SEQ ID NO: 11393 - DNA, 25 bp, Rattus norvegicus
aaagctgcttacactgttcacctgg

SEQ ID NO: 11394 - DNA, 25 bp, Rattus norvegicus
aaagctgcttactctgttcacctgg

SEQ ID NO: 11395 - DNA, 25 bp, Rattus norvegicus
aaagctgctttcacaaggaatccat

SEQ ID NO: 11396 - DNA, 25 bp, Rattus norvegicus
aaagctgctttctcaaggaatccat

SEQ ID NO: 11397 - DNA, 25 bp, Rattus norvegicus
aaagctgctttgattctgcagacct

SEQ ID NO: 11398 - DNA, 25 bp, Rattus norvegicus
aaagctgctttgtttctgcagacct

SEQ ID NO: 11399 - DNA, 25 bp, Rattus norvegicus
aaagctgcttttcaatgctggtggt

SEQ ID NO: 11400 - DNA, 25 bp, Rattus norvegicus
aaagctgcttttgaatgctggtggt

SEQ ID NO: 11401 - DNA, 25 bp, Rattus norvegicus
aaagctggacacctgagctccattc

SEQ ID NO: 11402 - DNA, 25 bp, Rattus norvegicus
aaagctggacacgtgagctccattc

SEQ ID NO: 11403 - DNA, 25 bp, Rattus norvegicus
aaagctggacatcaggcctgcggca

SEQ ID NO: 11404 - DNA, 25 bp, Rattus norvegicus
aaagctggacatgaggcctgcggca

SEQ ID NO: 11405 - DNA, 25 bp, Rattus norvegicus
aaagctggaccaactatggccacaa

SEQ ID NO: 11406 - DNA, 25 bp, Rattus norvegicus
aaagctggaccatctatggccacaa

SEQ ID NO: 11407 - DNA, 25 bp, Rattus norvegicus
aaagctggactacacttggaaggac

SEQ ID NO: 11408 - DNA, 25 bp, Rattus norvegicus
aaagctggactagacttggaaggac

SEQ ID NO: 11409 - DNA, 25 bp, Rattus norvegicus
aaagctggagccagttgttcttttc

SEQ ID NO: 11410 - DNA, 25 bp, Rattus norvegicus
aaagctggagcctgttgttcttttc

SEQ ID NO: 11411 - DNA, 25 bp, Rattus norvegicus
aaagctggatctactcaccaaagtc

SEQ ID NO: 11412 - DNA, 25 bp, Rattus norvegicus
aaagctggatcttctcaccaaagtc

SEQ ID NO: 11413 - DNA, 25 bp, Rattus norvegicus
aaagctggcaacatctatgtgcccg

SEQ ID NO: 11414 - DNA, 25 bp, Rattus norvegicus
aaagctggcaacttctatgtgcccg

SEQ ID NO: 11415 - DNA, 25 bp, Rattus norvegicus
aaagctggcattcgacttgtgtcac

SEQ ID NO: 11416 - DNA, 25 bp, Rattus norvegicus
aaagctggcattggacttgtgtcac

SEQ ID NO: 11417 - DNA, 25 bp, Rattus norvegicus
aaagctggccagcttctctttagct

SEQ ID NO: 11418 - DNA, 25 bp, Rattus norvegicus
aaagctggccaggttctctttagct

SEQ ID NO: 11419 - DNA, 25 bp, Rattus norvegicus
aaagctggcgatctcatctttgttg

SEQ ID NO: 11420 - DNA, 25 bp, Rattus norvegicus
aaagctggcgatgtcatctttgttg

SEQ ID NO: 11421 - DNA, 25 bp, Rattus norvegicus
aaagctggcgttcaaacgcattggg

SEQ ID NO: 11422 - DNA, 25 bp, Rattus norvegicus
aaagctggcgttgaaacgcattggg

SEQ ID NO: 11423 - DNA, 25 bp, Rattus norvegicus
aaagctggctcacagatggtaccaa

SEQ ID NO: 11424 - DNA, 25 bp, Rattus norvegicus
aaagctggctcagagatggtaccaa

SEQ ID NO: 11425 - DNA, 25 bp, Rattus norvegicus
aaagctggctccatcatcggactct

SEQ ID NO: 11426 - DNA, 25 bp, Rattus norvegicus
aaagctggctccttcatcggactct

SEQ ID NO: 11427 - DNA, 25 bp, Rattus norvegicus
aaagctggctgtcgtcatgtgtcat

SEQ ID NO: 11428 - DNA, 25 bp, Rattus norvegicus
aaagctggctgtggtcatgtgtcat

SEQ ID NO: 11429 - DNA, 25 bp, Rattus norvegicus
aaagctggctttcattgtgcctcat

SEQ ID NO: 11430 - DNA, 25 bp, Rattus norvegicus
aaagctggctttgattgtgcctcat

SEQ ID NO: 11431 - DNA, 25 bp, Rattus norvegicus
aaagctgggaccaagaccactcact

SEQ ID NO: 11432 - DNA, 25 bp, Rattus norvegicus
aaagctgggacctagaccactcact

SEQ ID NO: 11433 - DNA, 25 bp, Rattus norvegicus
aaagctgggcacagcagacgagcct

SEQ ID NO: 11434 - DNA, 25 bp, Rattus norvegicus
aaagctgggcacatgccagcttcat

SEQ ID NO: 11435 - DNA, 25 bp, Rattus norvegicus
aaagctgggcactgcagacgagcct

SEQ ID NO: 11436 - DNA, 25 bp, Rattus norvegicus
aaagctgggcacttgccagcttcat

SEQ ID NO: 11437 - DNA, 25 bp, Rattus norvegicus
aaagctgggcatcgtatctaatctc

SEQ ID NO: 11438 - DNA, 25 bp, Rattus norvegicus
aaagctgggcatggtatctaatctc

SEQ ID NO: 11439 - DNA, 25 bp, Rattus norvegicus
aaagctgggccaactgaataacttc

SEQ ID NO: 11440 - DNA, 25 bp, Rattus norvegicus
aaagctgggccatctgaataacttc

SEQ ID NO: 11441 - DNA, 25 bp, Rattus norvegicus
aaagctgggcctatattcatcttcc

SEQ ID NO: 11442 - DNA, 25 bp, Rattus norvegicus
aaagctgggcctctgagtctactaa

SEQ ID NO: 11443 - DNA, 25 bp, Rattus norvegicus
aaagctgggcctgtgagtctactaa

SEQ ID NO: 11444 - DNA, 25 bp, Rattus norvegicus
aaagctgggcctttattcatcttcc

SEQ ID NO: 11445 - DNA, 25 bp, Rattus norvegicus
aaagctgggcttcactttggcgcac

SEQ ID NO: 11446 - DNA, 25 bp, Rattus norvegicus
aaagctgggcttgactttggcgcac

SEQ ID NO: 11447 - DNA, 25 bp, Rattus norvegicus
aaagctgggtctcactctgtcaact

SEQ ID NO: 11448 - DNA, 25 bp, Rattus norvegicus
aaagctgggtctgactctgtcaact

SEQ ID NO: 11449 - DNA, 25 bp, Rattus norvegicus
aaagctgggttccaactgaagcctc

SEQ ID NO: 11450 - DNA, 25 bp, Rattus norvegicus
aaagctgggttcgaactgaagcctc

SEQ ID NO: 11451 - DNA, 25 bp, Rattus norvegicus
aaagctggtcgcaatcgtagatgtt

SEQ ID NO: 11452 - DNA, 25 bp, Rattus norvegicus
aaagctggtcgctatcgtagatgtt

SEQ ID NO: 11453 - DNA, 25 bp, Rattus norvegicus
aaagctggtcgtaccaaaggcaagt

SEQ ID NO: 11454 - DNA, 25 bp, Rattus norvegicus
aaagctggtcgttccaaaggcaagt

SEQ ID NO: 11455 - DNA, 25 bp, Rattus norvegicus
aaagctggtctcatccataagtgcc

SEQ ID NO: 11456 - DNA, 25 bp, Rattus norvegicus
aaagctggtctcttccataagtgcc

SEQ ID NO: 11457 - DNA, 25 bp, Rattus norvegicus
aaagctggtgctcgtgagttccatc

SEQ ID NO: 11458 - DNA, 25 bp, Rattus norvegicus
aaagctggtgctggtgagttccatc

SEQ ID NO: 11459 - DNA, 25 bp, Rattus norvegicus
aaagctggtgtgctcacttctgtga

SEQ ID NO: 11460 - DNA, 25 bp, Rattus norvegicus
aaagctggtgtggtcacttctgtga

SEQ ID NO: 11461 - DNA, 25 bp, Rattus norvegicus
aaagctggttggagttttataacat

SEQ ID NO: 11462 - DNA, 25 bp, Rattus norvegicus
aaagctggttggtgttttataacat

SEQ ID NO: 11463 - DNA, 25 bp, Rattus norvegicus
aaagctggtttacttcctggaacag

SEQ ID NO: 11464 - DNA, 25 bp, Rattus norvegicus
aaagctggtttagttcctggaacag

SEQ ID NO: 11465 - DNA, 25 bp, Rattus norvegicus
aaagctggtttccaagcacttgcct

SEQ ID NO: 11466 - DNA, 25 bp, Rattus norvegicus
aaagctggtttcgaagcacttgcct

SEQ ID NO: 11467 - DNA, 25 bp, Rattus norvegicus
aaagctggttttagggctcactcta

SEQ ID NO: 11468 - DNA, 25 bp, Rattus norvegicus
aaagctggtttttgggctcactcta

SEQ ID NO: 11469 - DNA, 25 bp, Rattus norvegicus
aaagctgtaattcccagtgtctgcc

SEQ ID NO: 11470 - DNA, 25 bp, Rattus norvegicus
aaagctgtaattgccagtgtctgcc

SEQ ID NO: 11471 - DNA, 25 bp, Rattus norvegicus
aaagctgtacagactgaccagtgaa

SEQ ID NO: 11472 - DNA, 25 bp, Rattus norvegicus
aaagctgtacagtctgaccagtgaa

SEQ ID NO: 11473 - DNA, 25 bp, Rattus norvegicus
aaagctgtacccagccgaccaagga

SEQ ID NO: 11474 - DNA, 25 bp, Rattus norvegicus
aaagctgtaccctgccgaccaagga

SEQ ID NO: 11475 - DNA, 25 bp, Rattus norvegicus
aaagctgtattccttagagggctac

SEQ ID NO: 11476 - DNA, 25 bp, Rattus norvegicus
aaagctgtattcgttagagggctac

SEQ ID NO: 11477 - DNA, 25 bp, Rattus norvegicus
aaagctgtcaaacacctggtggtgc

SEQ ID NO: 11478 - DNA, 25 bp, Rattus norvegicus
aaagctgtcaaagacctggtggtgc

SEQ ID NO: 11479 - DNA, 25 bp, Rattus norvegicus
aaagctgtcactaacttcattcgaa

SEQ ID NO: 11480 - DNA, 25 bp, Rattus norvegicus
aaagctgtcacttacttcattcgaa

SEQ ID NO: 11481 - DNA, 25 bp, Rattus norvegicus
aaagctgtcagaaccttcagaaagg

SEQ ID NO: 11482 - DNA, 25 bp, Rattus norvegicus
aaagctgtcagaccattctggcctc

SEQ ID NO: 11483 - DNA, 25 bp, Rattus norvegicus
aaagctgtcagagcattctggcctc

SEQ ID NO: 11484 - DNA, 25 bp, Rattus norvegicus
aaagctgtcagatccttcagaaagg

SEQ ID NO: 11485 - DNA, 25 bp, Rattus norvegicus
aaagctgtcaggatctaaggcaact

SEQ ID NO: 11486 - DNA, 25 bp, Rattus norvegicus
aaagctgtcaggttctaaggcaact

SEQ ID NO: 11487 - DNA, 25 bp, Rattus norvegicus
aaagctgtcagtagacttgttagaa

SEQ ID NO: 11488 - DNA, 25 bp, Rattus norvegicus
aaagctgtcagttgacttgttagaa

SEQ ID NO: 11489 - DNA, 25 bp, Rattus norvegicus
aaagctgtcatcagaccaaggtctc

SEQ ID NO: 11490 - DNA, 25 bp, Rattus norvegicus
aaagctgtcatcagggtgtgcagct

SEQ ID NO: 11491 - DNA, 25 bp, Rattus norvegicus
aaagctgtcatctgaccaaggtctc

SEQ ID NO: 11492 - DNA, 25 bp, Rattus norvegicus
aaagctgtcatctgggtgtgcagct

SEQ ID NO: 11493 - DNA, 25 bp, Rattus norvegicus
aaagctgtccagagatacccatctt

SEQ ID NO: 11494 - DNA, 25 bp, Rattus norvegicus
aaagctgtccagtgatacccatctt

SEQ ID NO: 11495 - DNA, 25 bp, Rattus norvegicus
aaagctgtccatacaattccaaata

SEQ ID NO: 11496 - DNA, 25 bp, Rattus norvegicus
aaagctgtccattcaattccaaata

SEQ ID NO: 11497 - DNA, 25 bp, Rattus norvegicus
aaagctgtccgtacatgacctgaag

SEQ ID NO: 11498 - DNA, 25 bp, Rattus norvegicus
aaagctgtccgttcatgacctgaag

SEQ ID NO: 11499 - DNA, 25 bp, Rattus norvegicus
aaagctgtctcacgcacttcagtct

SEQ ID NO: 11500 - DNA, 25 bp, Rattus norvegicus
aaagctgtctcaggcacttcagtct

SEQ ID NO: 11501 - DNA, 25 bp, Rattus norvegicus
aaagctgtctctagccccagcagtg

SEQ ID NO: 11502 - DNA, 25 bp, Rattus norvegicus
aaagctgtctcttgccccagcagtg

SEQ ID NO: 11503 - DNA, 25 bp, Rattus norvegicus
aaagctgtcttacacattgagtagt

SEQ ID NO: 11504 - DNA, 25 bp, Rattus norvegicus
aaagctgtcttagacattgagtagt

SEQ ID NO: 11505 - DNA, 25 bp, Rattus norvegicus
aaagctgtgaatactgttgcactga

SEQ ID NO: 11506 - DNA, 25 bp, Rattus norvegicus
aaagctgtgaattctgttgcactga

SEQ ID NO: 11507 - DNA, 25 bp, Rattus norvegicus
aaagctgtgcatcgcaaagatggca

SEQ ID NO: 11508 - DNA, 25 bp, Rattus norvegicus
aaagctgtgcatggcaaagatggca

SEQ ID NO: 11509 - DNA, 25 bp, Rattus norvegicus
aaagctgtgcctcctggagccccag

SEQ ID NO: 11510 - DNA, 25 bp, Rattus norvegicus
aaagctgtgcctgctggagccccag

SEQ ID NO: 11511 - DNA, 25 bp, Rattus norvegicus
aaagctgtgcggatgcatcccgggc

SEQ ID NO: 11512 - DNA, 25 bp, Rattus norvegicus
aaagctgtgcggttgcatcccgggc

SEQ ID NO: 11513 - DNA, 25 bp, Rattus norvegicus
aaagctgtggccacctatgttctgt

SEQ ID NO: 11514 - DNA, 25 bp, Rattus norvegicus
aaagctgtggcctcctatgttctgt

SEQ ID NO: 11515 - DNA, 25 bp, Rattus norvegicus
aaagctgtggctaactgctcacttt

SEQ ID NO: 11516 - DNA, 25 bp, Rattus norvegicus
aaagctgtggcttactgctcacttt

SEQ ID NO: 11517 - DNA, 25 bp, Rattus norvegicus
aaagctgtgggtcttgcaccttctc

SEQ ID NO: 11518 - DNA, 25 bp, Rattus norvegicus
aaagctgtgggtgttgcaccttctc

SEQ ID NO: 11519 - DNA, 25 bp, Rattus norvegicus
aaagctgtggtcctgcatttctgcc

SEQ ID NO: 11520 - DNA, 25 bp, Rattus norvegicus
aaagctgtggtcgtgcatttctgcc

SEQ ID NO: 11521 - DNA, 25 bp, Rattus norvegicus
aaagctgtggtgagactgtgaactc

SEQ ID NO: 11522 - DNA, 25 bp, Rattus norvegicus
aaagctgtggtgtgactgtgaactc

SEQ ID NO: 11523 - DNA, 25 bp, Rattus norvegicus
aaagctgtggttccgtgatgctcca

SEQ ID NO: 11524 - DNA, 25 bp, Rattus norvegicus
aaagctgtggttgcgtgatgctcca

SEQ ID NO: 11525 - DNA, 25 bp, Rattus norvegicus
aaagctgtgtatccatgcctcaatt

SEQ ID NO: 11526 - DNA, 25 bp, Rattus norvegicus
aaagctgtgtatgcatgcctcaatt

SEQ ID NO: 11527 - DNA, 25 bp, Rattus norvegicus
aaagctgtgtcccactcactgaata

SEQ ID NO: 11528 - DNA, 25 bp, Rattus norvegicus
aaagctgtgtccgactcactgaata

SEQ ID NO: 11529 - DNA, 25 bp, Rattus norvegicus
aaagctgtgttcagaactctgccca

SEQ ID NO: 11530 - DNA, 25 bp, Rattus norvegicus
aaagctgtgttccagtgtgctgtgc

SEQ ID NO: 11531 - DNA, 25 bp, Rattus norvegicus
aaagctgtgttccatttgccagtgg

SEQ ID NO: 11532 - DNA, 25 bp, Rattus norvegicus
aaagctgtgttcgagtgtgctgtgc

SEQ ID NO: 11533 - DNA, 25 bp, Rattus norvegicus
aaagctgtgttcgatttgccagtgg

SEQ ID NO: 11534 - DNA, 25 bp, Rattus norvegicus
aaagctgtgttctgaactctgccca

SEQ ID NO: 11535 - DNA, 25 bp, Rattus norvegicus
aaagctgtgtttctggcagtcctgg

SEQ ID NO: 11536 - DNA, 25 bp, Rattus norvegicus
aaagctgtgtttgtggcagtcctgg

SEQ ID NO: 11537 - DNA, 25 bp, Rattus norvegicus
aaagctgttaaaccagtgtatttta

SEQ ID NO: 11538 - DNA, 25 bp, Rattus norvegicus
aaagctgttaaagcagtgtatttta

SEQ ID NO: 11539 - DNA, 25 bp, Rattus norvegicus
aaagctgttcacaagtccttcattg

SEQ ID NO: 11540 - DNA, 25 bp, Rattus norvegicus
aaagctgttcactagtccttcattg

SEQ ID NO: 11541 - DNA, 25 bp, Rattus norvegicus
aaagctgttcagagtctccatcagc

SEQ ID NO: 11542 - DNA, 25 bp, Rattus norvegicus
aaagctgttcagtgtctccatcagc

SEQ ID NO: 11543 - DNA, 25 bp, Rattus norvegicus
aaagctgttctaattaatcgtgtga

SEQ ID NO: 11544 - DNA, 25 bp, Rattus norvegicus
aaagctgttctatttaatcgtgtga

SEQ ID NO: 11545 - DNA, 25 bp, Rattus norvegicus
aaagctgttctgaatcaaaccatct

SEQ ID NO: 11546 - DNA, 25 bp, Rattus norvegicus
aaagctgttctgtatcaaaccatct

SEQ ID NO: 11547 - DNA, 25 bp, Rattus norvegicus
aaagctgttgagacaccacttgagt

SEQ ID NO: 11548 - DNA, 25 bp, Rattus norvegicus
aaagctgttgagtcaccacttgagt

SEQ ID NO: 11549 - DNA, 25 bp, Rattus norvegicus
aaagctgttggcagtacatggaata

SEQ ID NO: 11550 - DNA, 25 bp, Rattus norvegicus
aaagctgttggctgtacatggaata

SEQ ID NO: 11551 - DNA, 25 bp, Rattus norvegicus
aaagctgttgtcagctcatgggtgc

SEQ ID NO: 11552 - DNA, 25 bp, Rattus norvegicus
aaagctgttgtccatctgaatggga

SEQ ID NO: 11553 - DNA, 25 bp, Rattus norvegicus
aaagctgttgtcgatctgaatggga

SEQ ID NO: 11554 - DNA, 25 bp, Rattus norvegicus
aaagctgttgtctgctcatgggtgc

SEQ ID NO: 11555 - DNA, 25 bp, Rattus norvegicus
aaagctgtttccatgagctcaggct

SEQ ID NO: 11556 - DNA, 25 bp, Rattus norvegicus
aaagctgtttccttgagctcaggct

SEQ ID NO: 11557 - DNA, 25 bp, Rattus norvegicus
aaagctgttttcatttggagaggca

SEQ ID NO: 11558 - DNA, 25 bp, Rattus norvegicus
aaagctgttttcttttggagaggca

SEQ ID NO: 11559 - DNA, 25 bp, Rattus norvegicus
aaagctgtttttcaggaacacggag

SEQ ID NO: 11560 - DNA, 25 bp, Rattus norvegicus
aaagctgtttttgaggaacacggag

SEQ ID NO: 11561 - DNA, 25 bp, Rattus norvegicus
aaagcttaagccatgtgcttccagg

SEQ ID NO: 11562 - DNA, 25 bp, Rattus norvegicus
aaagcttaagccttgtgcttccagg

SEQ ID NO: 11563 - DNA, 25 bp, Rattus norvegicus
aaagcttagcccctggactgatgtc

SEQ ID NO: 11564 - DNA, 25 bp, Rattus norvegicus
aaagcttagcccgtggactgatgtc

SEQ ID NO: 11565 - DNA, 25 bp, Rattus norvegicus
aaagcttagcttccttttgttcagg

SEQ ID NO: 11566 - DNA, 25 bp, Rattus norvegicus
aaagcttagcttgcttttgttcagg

SEQ ID NO: 11567 - DNA, 25 bp, Rattus norvegicus
aaagcttaggcaatgatcatgtgat

SEQ ID NO: 11568 - DNA, 25 bp, Rattus norvegicus
aaagcttaggcattgatcatgtgat

SEQ ID NO: 11569 - DNA, 25 bp, Rattus norvegicus
aaagcttatcaacaactgggctaaa

SEQ ID NO: 11570 - DNA, 25 bp, Rattus norvegicus
aaagcttatcaagaactgggctaaa

SEQ ID NO: 11571 - DNA, 25 bp, Rattus norvegicus
aaagcttatcctcagtttgtcaaaa

SEQ ID NO: 11572 - DNA, 25 bp, Rattus norvegicus
aaagcttatcctgagtttgtcaaaa

SEQ ID NO: 11573 - DNA, 25 bp, Rattus norvegicus
aaagcttatgtgattcaccatctct

SEQ ID NO: 11574 - DNA, 25 bp, Rattus norvegicus
aaagcttatgtgtttcaccatctct

SEQ ID NO: 11575 - DNA, 25 bp, Rattus norvegicus
aaagcttatttcacttcagaagaca

SEQ ID NO: 11576 - DNA, 25 bp, Rattus norvegicus
aaagcttatttctcttcagaagaca

SEQ ID NO: 11577 - DNA, 25 bp, Rattus norvegicus
aaagcttcaagaccgcctggacagg

SEQ ID NO: 11578 - DNA, 25 bp, Rattus norvegicus
aaagcttcaagagcgcctggacagg

SEQ ID NO: 11579 - DNA, 25 bp, Rattus norvegicus
aaagcttcaagtattcactatcaat

SEQ ID NO: 11580 - DNA, 25 bp, Rattus norvegicus
aaagcttcaagtctcacagcgacgt

SEQ ID NO: 11581 - DNA, 25 bp, Rattus norvegicus
aaagcttcaagtgtcacagcgacgt

SEQ ID NO: 11582 - DNA, 25 bp, Rattus norvegicus
aaagcttcaagttttcactatcaat

SEQ ID NO: 11583 - DNA, 25 bp, Rattus norvegicus
aaagcttcacttagacaagggacac

SEQ ID NO: 11584 - DNA, 25 bp, Rattus norvegicus
aaagcttcactttgacaagggacac

SEQ ID NO: 11585 - DNA, 25 bp, Rattus norvegicus
aaagcttcatgaagtaggcctcaag

SEQ ID NO: 11586 - DNA, 25 bp, Rattus norvegicus
aaagcttcatgatgtaggcctcaag

SEQ ID NO: 11587 - DNA, 25 bp, Rattus norvegicus
aaagcttccaggacacaggcagtgt

SEQ ID NO: 11588 - DNA, 25 bp, Rattus norvegicus
aaagcttccaggtcacaggcagtgt

SEQ ID NO: 11589 - DNA, 25 bp, Rattus norvegicus
aaagcttcccagcactagtgatgat

SEQ ID NO: 11590 - DNA, 25 bp, Rattus norvegicus
aaagcttcccaggactagtgatgat

SEQ ID NO: 11591 - DNA, 25 bp, Rattus norvegicus
aaagcttcccgcacagtgtcaagac

SEQ ID NO: 11592 - DNA, 25 bp, Rattus norvegicus
aaagcttcccgctcagtgtcaagac

SEQ ID NO: 11593 - DNA, 25 bp, Rattus norvegicus
aaagcttcccttagatttcgatgag

SEQ ID NO: 11594 - DNA, 25 bp, Rattus norvegicus
aaagcttcccttaggcactttgtca

SEQ ID NO: 11595 - DNA, 25 bp, Rattus norvegicus
aaagcttccctttgatttcgatgag

SEQ ID NO: 11596 - DNA, 25 bp, Rattus norvegicus
aaagcttccctttggcactttgtca

SEQ ID NO: 11597 - DNA, 25 bp, Rattus norvegicus
aaagcttccgggaatcccaagacag

SEQ ID NO: 11598 - DNA, 25 bp, Rattus norvegicus
aaagcttccgggtatcccaagacag

SEQ ID NO: 11599 - DNA, 25 bp, Rattus norvegicus
aaagcttcctcaaagtccagtgtct

SEQ ID NO: 11600 - DNA, 25 bp, Rattus norvegicus
aaagcttcctcatagtccagtgtct

SEQ ID NO: 11601 - DNA, 25 bp, Rattus norvegicus
aaagcttcctctcacttgttttata

SEQ ID NO: 11602 - DNA, 25 bp, Rattus norvegicus
aaagcttcctctgacttgttttata

SEQ ID NO: 11603 - DNA, 25 bp, Rattus norvegicus
aaagcttccttcatgtgtctcaatg

SEQ ID NO: 11604 - DNA, 25 bp, Rattus norvegicus
aaagcttccttcttgtgtctcaatg

SEQ ID NO: 11605 - DNA, 25 bp, Rattus norvegicus
aaagcttcgcgaagtcattgcccag

SEQ ID NO: 11606 - DNA, 25 bp, Rattus norvegicus
aaagcttcgcgatgtcattgcccag

SEQ ID NO: 11607 - DNA, 25 bp, Rattus norvegicus
aaagcttctactctacactgggtgc

SEQ ID NO: 11608 - DNA, 25 bp, Rattus norvegicus
aaagcttctactgtacactgggtgc

SEQ ID NO: 11609 - DNA, 25 bp, Rattus norvegicus
aaagcttctccaagttaggttgact

SEQ ID NO: 11610 - DNA, 25 bp, Rattus norvegicus
aaagcttctccatgttaggttgact

SEQ ID NO: 11611 - DNA, 25 bp, Rattus norvegicus
aaagcttctgcaatggattcctaaa

SEQ ID NO: 11612 - DNA, 25 bp, Rattus norvegicus
aaagcttctgcattggattcctaaa

SEQ ID NO: 11613 - DNA, 25 bp, Rattus norvegicus
aaagcttctgtcagagggtttcgta

SEQ ID NO: 11614 - DNA, 25 bp, Rattus norvegicus
aaagcttctgtctgagggtttcgta

SEQ ID NO: 11615 - DNA, 25 bp, Rattus norvegicus
aaagcttgacccacgtgtctgtgac

SEQ ID NO: 11616 - DNA, 25 bp, Rattus norvegicus
aaagcttgaccctcgtgtctgtgac

SEQ ID NO: 11617 - DNA, 25 bp, Rattus norvegicus
aaagcttgacttactgctccacagt

SEQ ID NO: 11618 - DNA, 25 bp, Rattus norvegicus
aaagcttgactttctgctccacagt

SEQ ID NO: 11619 - DNA, 25 bp, Rattus norvegicus
aaagcttgagacagcttcctgcggg

SEQ ID NO: 11620 - DNA, 25 bp, Rattus norvegicus
aaagcttgagactgcttcctgcggg

SEQ ID NO: 11621 - DNA, 25 bp, Rattus norvegicus
aaagcttgagtcagtttgggatctg

SEQ ID NO: 11622 - DNA, 25 bp, Rattus norvegicus
aaagcttgagtctgtttgggatctg

SEQ ID NO: 11623 - DNA, 25 bp, Rattus norvegicus
aaagcttgcctgatgcaatgtggta

SEQ ID NO: 11624 - DNA, 25 bp, Rattus norvegicus
aaagcttgcctgttgcaatgtggta

SEQ ID NO: 11625 - DNA, 25 bp, Rattus norvegicus
aaagcttgccttcttatataaatgc

SEQ ID NO: 11626 - DNA, 25 bp, Rattus norvegicus
aaagcttgccttgttatataaatgc

SEQ ID NO: 11627 - DNA, 25 bp, Rattus norvegicus
aaagcttgctacattcccagagttt

SEQ ID NO: 11628 - DNA, 25 bp, Rattus norvegicus
aaagcttgctactttcccagagttt

SEQ ID NO: 11629 - DNA, 25 bp, Rattus norvegicus
aaagcttggagcattgtgtggctca

SEQ ID NO: 11630 - DNA, 25 bp, Rattus norvegicus
aaagcttggagctttgtgtggctca

SEQ ID NO: 11631 - DNA, 25 bp, Rattus norvegicus
aaagcttggcaaaaaacttatgtcc

SEQ ID NO: 11632 - DNA, 25 bp, Rattus norvegicus
aaagcttggcaataaacttatgtcc

SEQ ID NO: 11633 - DNA, 25 bp, Rattus norvegicus
aaagcttggcggctcgtgcgttaca

SEQ ID NO: 11634 - DNA, 25 bp, Rattus norvegicus
aaagcttggcgggtcgtgcgttaca

SEQ ID NO: 11635 - DNA, 25 bp, Rattus norvegicus
aaagcttggctcagaaaacctcaga

SEQ ID NO: 11636 - DNA, 25 bp, Rattus norvegicus
aaagcttggctctgaaaacctcaga

SEQ ID NO: 11637 - DNA, 25 bp, Rattus norvegicus
aaagcttggtggcttccttctctga

SEQ ID NO: 11638 - DNA, 25 bp, Rattus norvegicus
aaagcttggtgggttccttctctga

SEQ ID NO: 11639 - DNA, 25 bp, Rattus norvegicus
aaagcttgtaaaacatggtcccctg

SEQ ID NO: 11640 - DNA, 25 bp, Rattus norvegicus
aaagcttgtaaatcatggtcccctg

SEQ ID NO: 11641 - DNA, 25 bp, Rattus norvegicus
aaagcttgtaggctcttttcccagc

SEQ ID NO: 11642 - DNA, 25 bp, Rattus norvegicus
aaagcttgtagggtcttttcccagc

SEQ ID NO: 11643 - DNA, 25 bp, Rattus norvegicus
aaagcttgtctcctgcaacagaggg

SEQ ID NO: 11644 - DNA, 25 bp, Rattus norvegicus
aaagcttgtctcgtgcaacagaggg

SEQ ID NO: 11645 - DNA, 25 bp, Rattus norvegicus
aaagcttgtgctaatatttacagtg

SEQ ID NO: 11646 - DNA, 25 bp, Rattus norvegicus
aaagcttgtgctcgctgagcgtgtc

SEQ ID NO: 11647 - DNA, 25 bp, Rattus norvegicus
aaagcttgtgctggctgagcgtgtc

SEQ ID NO: 11648 - DNA, 25 bp, Rattus norvegicus
aaagcttgtgcttatatttacagtg

SEQ ID NO: 11649 - DNA, 25 bp, Rattus norvegicus
aaagcttgtgtcctttgcataagca

SEQ ID NO: 11650 - DNA, 25 bp, Rattus norvegicus
aaagcttgtgtcgtttgcataagca

SEQ ID NO: 11651 - DNA, 25 bp, Rattus norvegicus
aaagcttgtgttactaatttcattt

SEQ ID NO: 11652 - DNA, 25 bp, Rattus norvegicus
aaagcttgtgtttctaatttcattt

SEQ ID NO: 11653 - DNA, 25 bp, Rattus norvegicus
aaagcttgttagacattctgctaga

SEQ ID NO: 11654 - DNA, 25 bp, Rattus norvegicus
aaagcttgttagtcattctgctaga

SEQ ID NO: 11655 - DNA, 25 bp, Rattus norvegicus
aaagcttgttcactggcctttcact

SEQ ID NO: 11656 - DNA, 25 bp, Rattus norvegicus
aaagcttgttcagtggcctttcact

SEQ ID NO: 11657 - DNA, 25 bp, Rattus norvegicus
aaagcttgttcgattacttgccagg

SEQ ID NO: 11658 - DNA, 25 bp, Rattus norvegicus
aaagcttgttcgtttacttgccagg

SEQ ID NO: 11659 - DNA, 25 bp, Rattus norvegicus
aaagctttacttactgggtcagtgc

SEQ ID NO: 11660 - DNA, 25 bp, Rattus norvegicus
aaagctttactttctgggtcagtgc

SEQ ID NO: 11661 - DNA, 25 bp, Rattus norvegicus
aaagctttagcaatgttttggccaa

SEQ ID NO: 11662 - DNA, 25 bp, Rattus norvegicus
aaagctttagcattgttttggccaa

SEQ ID NO: 11663 - DNA, 25 bp, Rattus norvegicus
aaagctttatttatgtccccagtgt

SEQ ID NO: 11664 - DNA, 25 bp, Rattus norvegicus
aaagctttatttttgtccccagtgt

SEQ ID NO: 11665 - DNA, 25 bp, Rattus norvegicus
aaagctttcagcattgagattctgc

SEQ ID NO: 11666 - DNA, 25 bp, Rattus norvegicus
aaagctttcagccactctgggcctc

SEQ ID NO: 11667 - DNA, 25 bp, Rattus norvegicus
aaagctttcagcgactctgggcctc

SEQ ID NO: 11668 - DNA, 25 bp, Rattus norvegicus
aaagctttcagctttgagattctgc

SEQ ID NO: 11669 - DNA, 25 bp, Rattus norvegicus
aaagctttcatacactcacttggat

SEQ ID NO: 11670 - DNA, 25 bp, Rattus norvegicus
aaagctttcatagactcacttggat

SEQ ID NO: 11671 - DNA, 25 bp, Rattus norvegicus
aaagctttcatgatacttcttaata

SEQ ID NO: 11672 - DNA, 25 bp, Rattus norvegicus
aaagctttcatgttacttcttaata

SEQ ID NO: 11673 - DNA, 25 bp, Rattus norvegicus
aaagctttcctcatggatatttgag

SEQ ID NO: 11674 - DNA, 25 bp, Rattus norvegicus
aaagctttcctcttggatatttgag

SEQ ID NO: 11675 - DNA, 25 bp, Rattus norvegicus
aaagctttcctgagtgccagtgatc

SEQ ID NO: 11676 - DNA, 25 bp, Rattus norvegicus
aaagctttcctgtgtgccagtgatc

SEQ ID NO: 11677 - DNA, 25 bp, Rattus norvegicus
aaagctttctgacaccctttgtggt

SEQ ID NO: 11678 - DNA, 25 bp, Rattus norvegicus
aaagctttctgagaccctttgtggt

SEQ ID NO: 11679 - DNA, 25 bp, Rattus norvegicus
aaagctttctgccagaccgagggtg

SEQ ID NO: 11680 - DNA, 25 bp, Rattus norvegicus
aaagctttctgcgagaccgagggtg

SEQ ID NO: 11681 - DNA, 25 bp, Rattus norvegicus
aaagctttctggagctgttatgaat

SEQ ID NO: 11682 - DNA, 25 bp, Rattus norvegicus
aaagctttctggtgctgttatgaat

SEQ ID NO: 11683 - DNA, 25 bp, Rattus norvegicus
aaagctttctttaggctgccggtca

SEQ ID NO: 11684 - DNA, 25 bp, Rattus norvegicus
aaagctttcttttggctgccggtca

SEQ ID NO: 11685 - DNA, 25 bp, Rattus norvegicus
aaagctttgatcaaggtcgtctctt

SEQ ID NO: 11686 - DNA, 25 bp, Rattus norvegicus
aaagctttgatctaggtcgtctctt

SEQ ID NO: 11687 - DNA, 25 bp, Rattus norvegicus
aaagctttgcacctgtgacagttga

SEQ ID NO: 11688 - DNA, 25 bp, Rattus norvegicus
aaagctttgcacgtgtgacagttga

SEQ ID NO: 11689 - DNA, 25 bp, Rattus norvegicus
aaagctttggctcgtttgtgacaac

SEQ ID NO: 11690 - DNA, 25 bp, Rattus norvegicus
aaagctttggctggtttgtgacaac

SEQ ID NO: 11691 - DNA, 25 bp, Rattus norvegicus
aaagctttggttcacactggctgcc

SEQ ID NO: 11692 - DNA, 25 bp, Rattus norvegicus
aaagctttggttctccacatcctag

SEQ ID NO: 11693 - DNA, 25 bp, Rattus norvegicus
aaagctttggttgacactggctgcc

SEQ ID NO: 11694 - DNA, 25 bp, Rattus norvegicus
aaagctttggttgtccacatcctag

SEQ ID NO: 11695 - DNA, 25 bp, Rattus norvegicus
aaagctttgtgaccagtcttgactg

SEQ ID NO: 11696 - DNA, 25 bp, Rattus norvegicus
aaagctttgtgagcagtcttgactg

SEQ ID NO: 11697 - DNA, 25 bp, Rattus norvegicus
aaagcttttactacacgacttgccg

SEQ ID NO: 11698 - DNA, 25 bp, Rattus norvegicus
aaagcttttacttcacgacttgccg

SEQ ID NO: 11699 - DNA, 25 bp, Rattus norvegicus
aaagcttttagcatttgatccactg

SEQ ID NO: 11700 - DNA, 25 bp, Rattus norvegicus
aaagcttttagcttttgatccactg

SEQ ID NO: 11701 - DNA, 25 bp, Rattus norvegicus
aaagcttttcagaatgccaggcaaa

SEQ ID NO: 11702 - DNA, 25 bp, Rattus norvegicus
aaagcttttcagtatgccaggcaaa

SEQ ID NO: 11703 - DNA, 25 bp, Rattus norvegicus
aaagcttttccaattgtttatattg

SEQ ID NO: 11704 - DNA, 25 bp, Rattus norvegicus
aaagcttttccatttgtttatattg

SEQ ID NO: 11705 - DNA, 25 bp, Rattus norvegicus
aaagcttttctcctagtaggactca

SEQ ID NO: 11706 - DNA, 25 bp, Rattus norvegicus
aaagcttttctcgtagtaggactca

SEQ ID NO: 11707 - DNA, 25 bp, Rattus norvegicus
aaagcttttctgcagcgcgtggacc

SEQ ID NO: 11708 - DNA, 25 bp, Rattus norvegicus
aaagcttttctggagcgcgtggacc

SEQ ID NO: 11709 - DNA, 25 bp, Rattus norvegicus
aaagcttttggaactgtctgcaagt

SEQ ID NO: 11710 - DNA, 25 bp, Rattus norvegicus
aaagcttttggatctgtctgcaagt

SEQ ID NO: 11711 - DNA, 25 bp, Rattus norvegicus
aaagcttttggcctgagctgtcttc

SEQ ID NO: 11712 - DNA, 25 bp, Rattus norvegicus
aaagcttttggcgtgagctgtcttc

SEQ ID NO: 11713 - DNA, 25 bp, Rattus norvegicus
aaagcttttgtaactgtcatttgaa

SEQ ID NO: 11714 - DNA, 25 bp, Rattus norvegicus
aaagcttttgtatctgtcatttgaa

SEQ ID NO: 11715 - DNA, 25 bp, Rattus norvegicus
aaagcttttttcagtgtcttggcgt

SEQ ID NO: 11716 - DNA, 25 bp, Rattus norvegicus
aaagcttttttctgtgtcttggcgt

SEQ ID NO: 11717 - DNA, 25 bp, Rattus norvegicus
aaaggaaactgaagaccgccccttg

SEQ ID NO: 11718 - DNA, 25 bp, Rattus norvegicus
aaaggaaactgatgaccgccccttg

SEQ ID NO: 11719 - DNA, 25 bp, Rattus norvegicus
aaaggaaaggccagcgctactcacc

SEQ ID NO: 11720 - DNA, 25 bp, Rattus norvegicus
aaaggaaaggcctgcgctactcacc

SEQ ID NO: 11721 - DNA, 25 bp, Rattus norvegicus
aaaggaacactgagcgtggcctcca

SEQ ID NO: 11722 - DNA, 25 bp, Rattus norvegicus
aaaggaacactgtgcgtggcctcca

SEQ ID NO: 11723 - DNA, 25 bp, Rattus norvegicus
aaaggaacatcgagctgctacctca

SEQ ID NO: 11724 - DNA, 25 bp, Rattus norvegicus
aaaggaacatcgtgctgctacctca

SEQ ID NO: 11725 - DNA, 25 bp, Rattus norvegicus
aaaggaacatggagtcttagaacaa

SEQ ID NO: 11726 - DNA, 25 bp, Rattus norvegicus
aaaggaacatggtgtcttagaacaa

SEQ ID NO: 11727 - DNA, 25 bp, Rattus norvegicus
aaaggaacccttacagctgccaatt

SEQ ID NO: 11728 - DNA, 25 bp, Rattus norvegicus
aaaggaacccttcggctatcatgaa

SEQ ID NO: 11729 - DNA, 25 bp, Rattus norvegicus
aaaggaacccttgggctatcatgaa

SEQ ID NO: 11730 - DNA, 25 bp, Rattus norvegicus
aaaggaaccctttcagctgccaatt

SEQ ID NO: 11731 - DNA, 25 bp, Rattus norvegicus
aaaggaacgggcagactgtccatcc

SEQ ID NO: 11732 - DNA, 25 bp, Rattus norvegicus
aaaggaacgggctgactgtccatcc

SEQ ID NO: 11733 - DNA, 25 bp, Rattus norvegicus
aaaggaactacaccggcaagccagc

SEQ ID NO: 11734 - DNA, 25 bp, Rattus norvegicus
aaaggaactacagcggcaagccagc

SEQ ID NO: 11735 - DNA, 25 bp, Rattus norvegicus
aaaggaactcccaagagcctgctgt

SEQ ID NO: 11736 - DNA, 25 bp, Rattus norvegicus
aaaggaactccctagagcctgctgt

SEQ ID NO: 11737 - DNA, 25 bp, Rattus norvegicus
aaaggaactccgatcacgtcactgc

SEQ ID NO: 11738 - DNA, 25 bp, Rattus norvegicus
aaaggaactccgttcacgtcactgc

SEQ ID NO: 11739 - DNA, 25 bp, Rattus norvegicus
aaaggaactgtcctgggtccacaga

SEQ ID NO: 11740 - DNA, 25 bp, Rattus norvegicus
aaaggaactgtcgtgggtccacaga

SEQ ID NO: 11741 - DNA, 25 bp, Rattus norvegicus
aaaggaagaacaccctggattcact

SEQ ID NO: 11742 - DNA, 25 bp, Rattus norvegicus
aaaggaagaacagcctggattcact

SEQ ID NO: 11743 - DNA, 25 bp, Rattus norvegicus
aaaggaagacaacgcccacctgcag

SEQ ID NO: 11744 - DNA, 25 bp, Rattus norvegicus
aaaggaagacaaggcccacctgcag

SEQ ID NO: 11745 - DNA, 25 bp, Rattus norvegicus
aaaggaagatctcctgtccggctgg

SEQ ID NO: 11746 - DNA, 25 bp, Rattus norvegicus
aaaggaagatctgctgtccggctgg

SEQ ID NO: 11747 - DNA, 25 bp, Rattus norvegicus
aaaggaagcaacaagcccagctcac

SEQ ID NO: 11748 - DNA, 25 bp, Rattus norvegicus
aaaggaagcaactagcccagctcac

SEQ ID NO: 11749 - DNA, 25 bp, Rattus norvegicus
aaaggaagcaccatctatgtccctg

SEQ ID NO: 11750 - DNA, 25 bp, Rattus norvegicus
aaaggaagcaccttctatgtccctg

SEQ ID NO: 11751 - DNA, 25 bp, Rattus norvegicus
aaaggaaggcatcgtctttccccag

SEQ ID NO: 11752 - DNA, 25 bp, Rattus norvegicus
aaaggaaggcatggtctttccccag

SEQ ID NO: 11753 - DNA, 25 bp, Rattus norvegicus
aaaggaaggtcaactgcctgctcaa

SEQ ID NO: 11754 - DNA, 25 bp, Rattus norvegicus
aaaggaaggtcatctgcctgctcaa

SEQ ID NO: 11755 - DNA, 25 bp, Rattus norvegicus
aaaggaagtccacagcacgctagag

SEQ ID NO: 11756 - DNA, 25 bp, Rattus norvegicus
aaaggaagtccagagcacgctagag

SEQ ID NO: 11757 - DNA, 25 bp, Rattus norvegicus
aaaggaagtgcgagtgatcccagcg

SEQ ID NO: 11758 - DNA, 25 bp, Rattus norvegicus
aaaggaagtgcgtgtgatcccagcg

SEQ ID NO: 11759 - DNA, 25 bp, Rattus norvegicus
aaaggaatactgactctctacgctc

SEQ ID NO: 11760 - DNA, 25 bp, Rattus norvegicus
aaaggaatactgtctctctacgctc

SEQ ID NO: 11761 - DNA, 25 bp, Rattus norvegicus
aaaggaatagggagctctccctcct

SEQ ID NO: 11762 - DNA, 25 bp, Rattus norvegicus
aaaggaatagggtgctctccctcct

SEQ ID NO: 11763 - DNA, 25 bp, Rattus norvegicus
aaaggaatcaatcagcccctcctag

SEQ ID NO: 11764 - DNA, 25 bp, Rattus norvegicus
aaaggaatcaatgagcccctcctag

SEQ ID NO: 11765 - DNA, 25 bp, Rattus norvegicus
aaaggaatcacgacccgcaggttga

SEQ ID NO: 11766 - DNA, 25 bp, Rattus norvegicus
aaaggaatcacgtcccgcaggttga

SEQ ID NO: 11767 - DNA, 25 bp, Rattus norvegicus
aaaggaatcccacatctggtgaccc

SEQ ID NO: 11768 - DNA, 25 bp, Rattus norvegicus
aaaggaatcccagatctggtgaccc

SEQ ID NO: 11769 - DNA, 25 bp, Rattus norvegicus
aaaggaatgaatccgtgccccatgg

SEQ ID NO: 11770 - DNA, 25 bp, Rattus norvegicus
aaaggaatgaatgcgtgccccatgg

SEQ ID NO: 11771 - DNA, 25 bp, Rattus norvegicus
aaaggaatgcccaggccctgtagca

SEQ ID NO: 11772 - DNA, 25 bp, Rattus norvegicus
aaaggaatgccctggccctgtagca

SEQ ID NO: 11773 - DNA, 25 bp, Rattus norvegicus
aaaggaatgcctctgtttcttcatg

SEQ ID NO: 11774 - DNA, 25 bp, Rattus norvegicus
aaaggaatgcctgtgtttcttcatg

SEQ ID NO: 11775 - DNA, 25 bp, Rattus norvegicus
aaaggaatgtctcgtgctgttctgt

SEQ ID NO: 11776 - DNA, 25 bp, Rattus norvegicus
aaaggaatgtctctggctcatgtca

SEQ ID NO: 11777 - DNA, 25 bp, Rattus norvegicus
aaaggaatgtctggtgctgttctgt

SEQ ID NO: 11778 - DNA, 25 bp, Rattus norvegicus
aaaggaatgtctgtggctcatgtca

SEQ ID NO: 11779 - DNA, 25 bp, Rattus norvegicus
aaaggaatgtgcatgggctaactat

SEQ ID NO: 11780 - DNA, 25 bp, Rattus norvegicus
aaaggaatgtgcttgggctaactat

SEQ ID NO: 11781 - DNA, 25 bp, Rattus norvegicus
aaaggaattcacagctccctgggac

SEQ ID NO: 11782 - DNA, 25 bp, Rattus norvegicus
aaaggaattcactgctccctgggac

SEQ ID NO: 11783 - DNA, 25 bp, Rattus norvegicus
aaaggaattctcactgatgggacga

SEQ ID NO: 11784 - DNA, 25 bp, Rattus norvegicus
aaaggaattctctctgatgggacga

SEQ ID NO: 11785 - DNA, 25 bp, Rattus norvegicus
aaaggacaaacgagaccgcagcgtc

SEQ ID NO: 11786 - DNA, 25 bp, Rattus norvegicus
aaaggacaaacgtgaccgcagcgtc

SEQ ID NO: 11787 - DNA, 25 bp, Rattus norvegicus
aaaggacaacctcccaggctactgt

SEQ ID NO: 11788 - DNA, 25 bp, Rattus norvegicus
aaaggacaacctgccaggctactgt

SEQ ID NO: 11789 - DNA, 25 bp, Rattus norvegicus
aaaggacacagaagctctgctggcc

SEQ ID NO: 11790 - DNA, 25 bp, Rattus norvegicus
aaaggacacagatgctctgctggcc

SEQ ID NO: 11791 - DNA, 25 bp, Rattus norvegicus
aaaggacacagcagcgtaccatgct

SEQ ID NO: 11792 - DNA, 25 bp, Rattus norvegicus
aaaggacacagctgcgtaccatgct

SEQ ID NO: 11793 - DNA, 25 bp, Rattus norvegicus
aaaggacacatcacaacagaaactg

SEQ ID NO: 11794 - DNA, 25 bp, Rattus norvegicus
aaaggacacatctcaacagaaactg

SEQ ID NO: 11795 - DNA, 25 bp, Rattus norvegicus
aaaggacaccatcacgtccatacat

SEQ ID NO: 11796 - DNA, 25 bp, Rattus norvegicus
aaaggacaccatgacgtccatacat

SEQ ID NO: 11797 - DNA, 25 bp, Rattus norvegicus
aaaggacactggagtctccgtccga

SEQ ID NO: 11798 - DNA, 25 bp, Rattus norvegicus
aaaggacactggtgtctccgtccga

SEQ ID NO: 11799 - DNA, 25 bp, Rattus norvegicus
aaaggacactttaacctgcctgcag

SEQ ID NO: 11800 - DNA, 25 bp, Rattus norvegicus
aaaggacacttttacctgcctgcag

SEQ ID NO: 11801 - DNA, 25 bp, Rattus norvegicus
aaaggacagccgctcggcctcgctg

SEQ ID NO: 11802 - DNA, 25 bp, Rattus norvegicus
aaaggacagccggtcggcctcgctg

SEQ ID NO: 11803 - DNA, 25 bp, Rattus norvegicus
aaaggacagcctccctttggagctg

SEQ ID NO: 11804 - DNA, 25 bp, Rattus norvegicus
aaaggacagcctgcctttggagctg

SEQ ID NO: 11805 - DNA, 25 bp, Rattus norvegicus
aaaggacataggattctttctgttg

SEQ ID NO: 11806 - DNA, 25 bp, Rattus norvegicus
aaaggacataggtttctttctgttg

SEQ ID NO: 11807 - DNA, 25 bp, Rattus norvegicus
aaaggacatccacacagcactgaat

SEQ ID NO: 11808 - DNA, 25 bp, Rattus norvegicus
aaaggacatccagacagcactgaat

SEQ ID NO: 11809 - DNA, 25 bp, Rattus norvegicus
aaaggacatcgtatgttcctccgat

SEQ ID NO: 11810 - DNA, 25 bp, Rattus norvegicus
aaaggacatcgtttgttcctccgat

SEQ ID NO: 11811 - DNA, 25 bp, Rattus norvegicus
aaaggacatctcagtccccgtgcac

SEQ ID NO: 11812 - DNA, 25 bp, Rattus norvegicus
aaaggacatctctgtccccgtgcac

SEQ ID NO: 11813 - DNA, 25 bp, Rattus norvegicus
aaaggacatggtcacatcccttcca

SEQ ID NO: 11814 - DNA, 25 bp, Rattus norvegicus
aaaggacatggtgacatcccttcca

SEQ ID NO: 11815 - DNA, 25 bp, Rattus norvegicus
aaaggacattggcttccgtgctgtg

SEQ ID NO: 11816 - DNA, 25 bp, Rattus norvegicus
aaaggacattgggttccgtgctgtg

SEQ ID NO: 11817 - DNA, 25 bp, Rattus norvegicus
aaaggaccaagcctctgtctgttct

SEQ ID NO: 11818 - DNA, 25 bp, Rattus norvegicus
aaaggaccaagcgtctgtctgttct

SEQ ID NO: 11819 - DNA, 25 bp, Rattus norvegicus
aaaggaccacaaacccatgaccagg

SEQ ID NO: 11820 - DNA, 25 bp, Rattus norvegicus
aaaggaccacaatcccatgaccagg

SEQ ID NO: 11821 - DNA, 25 bp, Rattus norvegicus
aaaggaccacctccacaatgtgatg

SEQ ID NO: 11822 - DNA, 25 bp, Rattus norvegicus
aaaggaccacctgcacaatgtgatg

SEQ ID NO: 11823 - DNA, 25 bp, Rattus norvegicus
aaaggaccactgaactcaggcttcc

SEQ ID NO: 11824 - DNA, 25 bp, Rattus norvegicus
aaaggaccactgtactcaggcttcc

SEQ ID NO: 11825 - DNA, 25 bp, Rattus norvegicus
aaaggaccacttacggttcatgcag

SEQ ID NO: 11826 - DNA, 25 bp, Rattus norvegicus
aaaggaccactttcggttcatgcag

SEQ ID NO: 11827 - DNA, 25 bp, Rattus norvegicus
aaaggaccagaaatcaagccagctc

SEQ ID NO: 11828 - DNA, 25 bp, Rattus norvegicus
aaaggaccagaattcaagccagctc

SEQ ID NO: 11829 - DNA, 25 bp, Rattus norvegicus
aaaggaccagcccagattatcggat

SEQ ID NO: 11830 - DNA, 25 bp, Rattus norvegicus
aaaggaccagccgagattatcggat

SEQ ID NO: 11831 - DNA, 25 bp, Rattus norvegicus
aaaggacccagtcttgcagacactc

SEQ ID NO: 11832 - DNA, 25 bp, Rattus norvegicus
aaaggacccagtgttgcagacactc

SEQ ID NO: 11833 - DNA, 25 bp, Rattus norvegicus
aaaggaccccatcaaaagcctgcta

SEQ ID NO: 11834 - DNA, 25 bp, Rattus norvegicus
aaaggaccccatgaaaagcctgcta

SEQ ID NO: 11835 - DNA, 25 bp, Rattus norvegicus
aaaggacccctgaactgagacccat

SEQ ID NO: 11836 - DNA, 25 bp, Rattus norvegicus
aaaggacccctgcaggatggcccca

SEQ ID NO: 11837 - DNA, 25 bp, Rattus norvegicus
aaaggacccctggaggatggcccca

SEQ ID NO: 11838 - DNA, 25 bp, Rattus norvegicus
aaaggacccctgtactgagacccat

SEQ ID NO: 11839 - DNA, 25 bp, Rattus norvegicus
aaaggaccctggaacacctgaacag

SEQ ID NO: 11840 - DNA, 25 bp, Rattus norvegicus
aaaggaccctggtacacctgaacag

SEQ ID NO: 11841 - DNA, 25 bp, Rattus norvegicus
aaaggacctagacggctccataatt

SEQ ID NO: 11842 - DNA, 25 bp, Rattus norvegicus
aaaggacctagagggctccataatt

SEQ ID NO: 11843 - DNA, 25 bp, Rattus norvegicus
aaaggacctgatcggttggccctgc

SEQ ID NO: 11844 - DNA, 25 bp, Rattus norvegicus
aaaggacctgatgggttggccctgc

SEQ ID NO: 11845 - DNA, 25 bp, Rattus norvegicus
aaaggacctgccaaccattccaggg

SEQ ID NO: 11846 - DNA, 25 bp, Rattus norvegicus
aaaggacctgcctaccattccaggg

SEQ ID NO: 11847 - DNA, 25 bp, Rattus norvegicus
aaaggacctgtcactgctgcgatga

SEQ ID NO: 11848 - DNA, 25 bp, Rattus norvegicus
aaaggacctgtctctgctgcgatga

SEQ ID NO: 11849 - DNA, 25 bp, Rattus norvegicus
aaaggacctgttccatgcactaatc

SEQ ID NO: 11850 - DNA, 25 bp, Rattus norvegicus
aaaggacctgttgcatgcactaatc

SEQ ID NO: 11851 - DNA, 25 bp, Rattus norvegicus
aaaggaccttggatcacttctcagc

SEQ ID NO: 11852 - DNA, 25 bp, Rattus norvegicus
aaaggaccttggttcacttctcagc

SEQ ID NO: 11853 - DNA, 25 bp, Rattus norvegicus
aaaggaccttgtagcttctttctgg

SEQ ID NO: 11854 - DNA, 25 bp, Rattus norvegicus
aaaggaccttgttgcttctttctgg

SEQ ID NO: 11855 - DNA, 25 bp, Rattus norvegicus
aaaggacgacaactgactcacgaga

SEQ ID NO: 11856 - DNA, 25 bp, Rattus norvegicus
aaaggacgacaagtgactcacgaga

SEQ ID NO: 11857 - DNA, 25 bp, Rattus norvegicus
aaaggacgatgtactgggctgtaca

SEQ ID NO: 11858 - DNA, 25 bp, Rattus norvegicus
aaaggacgatgttctgggctgtaca

SEQ ID NO: 11859 - DNA, 25 bp, Rattus norvegicus
aaaggacgcaccactatgtttgcat

SEQ ID NO: 11860 - DNA, 25 bp, Rattus norvegicus
aaaggacgcacctctatgtttgcat

SEQ ID NO: 11861 - DNA, 25 bp, Rattus norvegicus
aaaggacgtctcaggctggtgtgaa

SEQ ID NO: 11862 - DNA, 25 bp, Rattus norvegicus
aaaggacgtctctggctggtgtgaa

SEQ ID NO: 11863 - DNA, 25 bp, Rattus norvegicus
aaaggactccacacacaagccaggg

SEQ ID NO: 11864 - DNA, 25 bp, Rattus norvegicus
aaaggactccactcacaagccaggg

SEQ ID NO: 11865 - DNA, 25 bp, Rattus norvegicus
aaaggactccagctgcttgagctgc

SEQ ID NO: 11866 - DNA, 25 bp, Rattus norvegicus
aaaggactccaggtgcttgagctgc

SEQ ID NO: 11867 - DNA, 25 bp, Rattus norvegicus
aaaggactccatcgcaacccgattt

SEQ ID NO: 11868 - DNA, 25 bp, Rattus norvegicus
aaaggactccatggcaacccgattt

SEQ ID NO: 11869 - DNA, 25 bp, Rattus norvegicus
aaaggactcgctattcctgagttca

SEQ ID NO: 11870 - DNA, 25 bp, Rattus norvegicus
aaaggactcgcttttcctgagttca

SEQ ID NO: 11871 - DNA, 25 bp, Rattus norvegicus
aaaggactctggatttcgacccact

SEQ ID NO: 11872 - DNA, 25 bp, Rattus norvegicus
aaaggactctggttttcgacccact

SEQ ID NO: 11873 - DNA, 25 bp, Rattus norvegicus
aaaggactctgtcattctgctctca

SEQ ID NO: 11874 - DNA, 25 bp, Rattus norvegicus
aaaggactctgtgattctgctctca

SEQ ID NO: 11875 - DNA, 25 bp, Rattus norvegicus
aaaggactctttcctagttcttgaa

SEQ ID NO: 11876 - DNA, 25 bp, Rattus norvegicus
aaaggactctttgctagttcttgaa

SEQ ID NO: 11877 - DNA, 25 bp, Rattus norvegicus
aaaggactgactcgacgtctcctgc

SEQ ID NO: 11878 - DNA, 25 bp, Rattus norvegicus
aaaggactgactggacgtctcctgc

SEQ ID NO: 11879 - DNA, 25 bp, Rattus norvegicus
aaaggactgcaacccagtgtcaaca

SEQ ID NO: 11880 - DNA, 25 bp, Rattus norvegicus
aaaggactgcaagccagtgtcaaca

SEQ ID NO: 11881 - DNA, 25 bp, Rattus norvegicus
aaaggactgcacacacgagcacaag

SEQ ID NO: 11882 - DNA, 25 bp, Rattus norvegicus
aaaggactgcactcacgagcacaag

SEQ ID NO: 11883 - DNA, 25 bp, Rattus norvegicus
aaaggactgcccattatcctcatcc

SEQ ID NO: 11884 - DNA, 25 bp, Rattus norvegicus
aaaggactgccctttatcctcatcc

SEQ ID NO: 11885 - DNA, 25 bp, Rattus norvegicus
aaaggactgctaattcatttgaaag

SEQ ID NO: 11886 - DNA, 25 bp, Rattus norvegicus
aaaggactgctatttcatttgaaag

SEQ ID NO: 11887 - DNA, 25 bp, Rattus norvegicus
aaaggactgcttcatgcagccaggc

SEQ ID NO: 11888 - DNA, 25 bp, Rattus norvegicus
aaaggactgcttgatgcagccaggc

SEQ ID NO: 11889 - DNA, 25 bp, Rattus norvegicus
aaaggacttctgagtgccgtttgtc

SEQ ID NO: 11890 - DNA, 25 bp, Rattus norvegicus
aaaggacttctgtgtgccgtttgtc

SEQ ID NO: 11891 - DNA, 25 bp, Rattus norvegicus
aaaggacttgccctggacctggtct

SEQ ID NO: 11892 - DNA, 25 bp, Rattus norvegicus
aaaggacttgccgtggacctggtct

SEQ ID NO: 11893 - DNA, 25 bp, Rattus norvegicus
aaaggacttggaaggcgctcttgtc

SEQ ID NO: 11894 - DNA, 25 bp, Rattus norvegicus
aaaggacttggatggcgctcttgtc

SEQ ID NO: 11895 - DNA, 25 bp, Rattus norvegicus
aaaggacttgtgctccctgctgctt

SEQ ID NO: 11896 - DNA, 25 bp, Rattus norvegicus
aaaggacttgtggtccctgctgctt

SEQ ID NO: 11897 - DNA, 25 bp, Rattus norvegicus
aaaggactttctctgactaactgca

SEQ ID NO: 11898 - DNA, 25 bp, Rattus norvegicus
aaaggactttctgtgactaactgca

SEQ ID NO: 11899 - DNA, 25 bp, Rattus norvegicus
aaaggactttgtcgaccctctgtga

SEQ ID NO: 11900 - DNA, 25 bp, Rattus norvegicus
aaaggactttgtggaccctctgtga

SEQ ID NO: 11901 - DNA, 25 bp, Rattus norvegicus
aaaggagaaattcgctctgactgtt

SEQ ID NO: 11902 - DNA, 25 bp, Rattus norvegicus
aaaggagaaattggctctgactgtt

SEQ ID NO: 11903 - DNA, 25 bp, Rattus norvegicus
aaaggagaagatagaccgtcgctct

SEQ ID NO: 11904 - DNA, 25 bp, Rattus norvegicus
aaaggagaagattgaccgtcgctct

SEQ ID NO: 11905 - DNA, 25 bp, Rattus norvegicus
aaaggagaaggcctcagctaccagc

SEQ ID NO: 11906 - DNA, 25 bp, Rattus norvegicus
aaaggagaaggcgtcagctaccagc

SEQ ID NO: 11907 - DNA, 25 bp, Rattus norvegicus
aaaggagaagtcagccgccctgaaa

SEQ ID NO: 11908 - DNA, 25 bp, Rattus norvegicus
aaaggagaagtctgccgccctgaaa

SEQ ID NO: 11909 - DNA, 25 bp, Rattus norvegicus
aaaggagaagttagacggcgccacg

SEQ ID NO: 11910 - DNA, 25 bp, Rattus norvegicus
aaaggagaagtttgacggcgccacg

SEQ ID NO: 11911 - DNA, 25 bp, Rattus norvegicus
aaaggagaatgcagtcaccctctga

SEQ ID NO: 11912 - DNA, 25 bp, Rattus norvegicus
aaaggagaatgctgtcaccctctga

SEQ ID NO: 11913 - DNA, 25 bp, Rattus norvegicus
aaaggagacaagagtcccaccctca

SEQ ID NO: 11914 - DNA, 25 bp, Rattus norvegicus
aaaggagacaagtgtcccaccctca

SEQ ID NO: 11915 - DNA, 25 bp, Rattus norvegicus
aaaggagaccgcactggcagctaca

SEQ ID NO: 11916 - DNA, 25 bp, Rattus norvegicus
aaaggagaccgctctggcagctaca

SEQ ID NO: 11917 - DNA, 25 bp, Rattus norvegicus
aaaggagactctcgaggccccttgg

SEQ ID NO: 11918 - DNA, 25 bp, Rattus norvegicus
aaaggagactctggaggccccttgg

SEQ ID NO: 11919 - DNA, 25 bp, Rattus norvegicus
aaaggagagacccagcttcagcttc

SEQ ID NO: 11920 - DNA, 25 bp, Rattus norvegicus
aaaggagagaccgagcttcagcttc

SEQ ID NO: 11921 - DNA, 25 bp, Rattus norvegicus
aaaggagagatcacttcctcaccac

SEQ ID NO: 11922 - DNA, 25 bp, Rattus norvegicus
aaaggagagatctcttcctcaccac

SEQ ID NO: 11923 - DNA, 25 bp, Rattus norvegicus
aaaggagagttcactgtgcctgtcc

SEQ ID NO: 11924 - DNA, 25 bp, Rattus norvegicus
aaaggagagttctctgtgcctgtcc

SEQ ID NO: 11925 - DNA, 25 bp, Rattus norvegicus
aaaggagatgtgctgcctctttgtc

SEQ ID NO: 11926 - DNA, 25 bp, Rattus norvegicus
aaaggagatgtggtgcctctttgtc

SEQ ID NO: 11927 - DNA, 25 bp, Rattus norvegicus
aaaggagatttcctttgcagccggg

SEQ ID NO: 11928 - DNA, 25 bp, Rattus norvegicus
aaaggagatttcgtttgcagccggg

SEQ ID NO: 11929 - DNA, 25 bp, Rattus norvegicus
aaaggagcacaacaccatcaagaac

SEQ ID NO: 11930 - DNA, 25 bp, Rattus norvegicus
aaaggagcacaagaccatcaagaac

SEQ ID NO: 11931 - DNA, 25 bp, Rattus norvegicus
aaaggagcagagaacacttgtgact

SEQ ID NO: 11932 - DNA, 25 bp, Rattus norvegicus
aaaggagcagagtacacttgtgact

SEQ ID NO: 11933 - DNA, 25 bp, Rattus norvegicus
aaaggagcagcaccaccggaagtgc

SEQ ID NO: 11934 - DNA, 25 bp, Rattus norvegicus
aaaggagcagcagcaccggaagtgc

SEQ ID NO: 11935 - DNA, 25 bp, Rattus norvegicus
aaaggagcagctcacctactttcct

SEQ ID NO: 11936 - DNA, 25 bp, Rattus norvegicus
aaaggagcagctgacctactttcct

SEQ ID NO: 11937 - DNA, 25 bp, Rattus norvegicus
aaaggagcaggcatctcatctggga

SEQ ID NO: 11938 - DNA, 25 bp, Rattus norvegicus
aaaggagcaggcttctcatctggga

SEQ ID NO: 11939 - DNA, 25 bp, Rattus norvegicus
aaaggagcaggtacttcatcagccg

SEQ ID NO: 11940 - DNA, 25 bp, Rattus norvegicus
aaaggagcaggttcttcatcagccg

SEQ ID NO: 11941 - DNA, 25 bp, Rattus norvegicus
aaaggagcagtcacatgtcctgcca

SEQ ID NO: 11942 - DNA, 25 bp, Rattus norvegicus
aaaggagcagtctcatgtcctgcca

SEQ ID NO: 11943 - DNA, 25 bp, Rattus norvegicus
aaaggagcatcaagggtgacctgaa

SEQ ID NO: 11944 - DNA, 25 bp, Rattus norvegicus
aaaggagcatcatgggtgacctgaa

SEQ ID NO: 11945 - DNA, 25 bp, Rattus norvegicus
aaaggagccacccactgcatttgat

SEQ ID NO: 11946 - DNA, 25 bp, Rattus norvegicus
aaaggagccaccgactgcatttgat

SEQ ID NO: 11947 - DNA, 25 bp, Rattus norvegicus
aaaggagccatgaagaagcaagcca

SEQ ID NO: 11948 - DNA, 25 bp, Rattus norvegicus
aaaggagccatgtagaagcaagcca

SEQ ID NO: 11949 - DNA, 25 bp, Rattus norvegicus
aaaggagccctgcagtccagagctt

SEQ ID NO: 11950 - DNA, 25 bp, Rattus norvegicus
aaaggagccctggagtccagagctt

SEQ ID NO: 11951 - DNA, 25 bp, Rattus norvegicus
aaaggagccgccatgatcatcgaga

SEQ ID NO: 11952 - DNA, 25 bp, Rattus norvegicus
aaaggagccgccttgatcatcgaga

SEQ ID NO: 11953 - DNA, 25 bp, Rattus norvegicus
aaaggagccggcatactcagcgcga

SEQ ID NO: 11954 - DNA, 25 bp, Rattus norvegicus
aaaggagccggcttactcagcgcga

SEQ ID NO: 11955 - DNA, 25 bp, Rattus norvegicus
aaaggagcgctcatttgtccctgga

SEQ ID NO: 11956 - DNA, 25 bp, Rattus norvegicus
aaaggagcgctcttttgtccctgga

SEQ ID NO: 11957 - DNA, 25 bp, Rattus norvegicus
aaaggagctagactgccaaatgcat

SEQ ID NO: 11958 - DNA, 25 bp, Rattus norvegicus
aaaggagctagagtgccaaatgcat

SEQ ID NO: 11959 - DNA, 25 bp, Rattus norvegicus
aaaggagctccgcaaggccattgaa

SEQ ID NO: 11960 - DNA, 25 bp, Rattus norvegicus
aaaggagctccggaaggccattgaa

SEQ ID NO: 11961 - DNA, 25 bp, Rattus norvegicus
aaaggagctcgtatgtgcgcacacc

SEQ ID NO: 11962 - DNA, 25 bp, Rattus norvegicus
aaaggagctcgtttgtgcgcacacc

SEQ ID NO: 11963 - DNA, 25 bp, Rattus norvegicus
aaaggagctgctatggacacacgtg

SEQ ID NO: 11964 - DNA, 25 bp, Rattus norvegicus
aaaggagctgctttggacacacgtg

SEQ ID NO: 11965 - DNA, 25 bp, Rattus norvegicus
aaaggagcttgaaccccagaatgcc

SEQ ID NO: 11966 - DNA, 25 bp, Rattus norvegicus
aaaggagcttgatccccagaatgcc

SEQ ID NO: 11967 - DNA, 25 bp, Rattus norvegicus
aaaggagcttgccactctgcatggc

SEQ ID NO: 11968 - DNA, 25 bp, Rattus norvegicus
aaaggagcttgcgactctgcatggc

SEQ ID NO: 11969 - DNA, 25 bp, Rattus norvegicus
aaaggaggagctccttccgaagaca

SEQ ID NO: 11970 - DNA, 25 bp, Rattus norvegicus
aaaggaggagctgcttccgaagaca

SEQ ID NO: 11971 - DNA, 25 bp, Rattus norvegicus
aaaggaggatgtcacccctgaggaa

SEQ ID NO: 11972 - DNA, 25 bp, Rattus norvegicus
aaaggaggatgtgacccctgaggaa

SEQ ID NO: 11973 - DNA, 25 bp, Rattus norvegicus
aaaggaggcactcatttcccagctg

SEQ ID NO: 11974 - DNA, 25 bp, Rattus norvegicus
aaaggaggcactgatttcccagctg

SEQ ID NO: 11975 - DNA, 25 bp, Rattus norvegicus
aaaggaggcattctggtcctctccc

SEQ ID NO: 11976 - DNA, 25 bp, Rattus norvegicus
aaaggaggcattgtggtcctctccc

SEQ ID NO: 11977 - DNA, 25 bp, Rattus norvegicus
aaaggaggccgcatgaccttggtgt

SEQ ID NO: 11978 - DNA, 25 bp, Rattus norvegicus
aaaggaggccgcttgaccttggtgt

SEQ ID NO: 11979 - DNA, 25 bp, Rattus norvegicus
aaaggaggcctgatcttcgcgggcc

SEQ ID NO: 11980 - DNA, 25 bp, Rattus norvegicus
aaaggaggcctgttcttcgcgggcc

SEQ ID NO: 11981 - DNA, 25 bp, Rattus norvegicus
aaaggaggcgtacttccagcacatg

SEQ ID NO: 11982 - DNA, 25 bp, Rattus norvegicus
aaaggaggcgtagttccagcacatg

SEQ ID NO: 11983 - DNA, 25 bp, Rattus norvegicus
aaaggaggctataccactcctacgt

SEQ ID NO: 11984 - DNA, 25 bp, Rattus norvegicus
aaaggaggctattccactcctacgt

SEQ ID NO: 11985 - DNA, 25 bp, Rattus norvegicus
aaaggaggctcaattccactgtttc

SEQ ID NO: 11986 - DNA, 25 bp, Rattus norvegicus
aaaggaggctcatttccactgtttc

SEQ ID NO: 11987 - DNA, 25 bp, Rattus norvegicus
aaaggaggctgcacccagcaggcta

SEQ ID NO: 11988 - DNA, 25 bp, Rattus norvegicus
aaaggaggctgctcccagcaggcta

SEQ ID NO: 11989 - DNA, 25 bp, Rattus norvegicus
aaaggagggcatcatctacccacac

SEQ ID NO: 11990 - DNA, 25 bp, Rattus norvegicus
aaaggagggcatgatctacccacac

SEQ ID NO: 11991 - DNA, 25 bp, Rattus norvegicus
aaaggagggccccagcctctgacta

SEQ ID NO: 11992 - DNA, 25 bp, Rattus norvegicus
aaaggagggcccgagcctctgacta

SEQ ID NO: 11993 - DNA, 25 bp, Rattus norvegicus
aaaggagggtgtagcctgcttcttc

SEQ ID NO: 11994 - DNA, 25 bp, Rattus norvegicus
aaaggagggtgttgcctgcttcttc

SEQ ID NO: 11995 - DNA, 25 bp, Rattus norvegicus
aaaggaggtaccaactgccagtgaa

SEQ ID NO: 11996 - DNA, 25 bp, Rattus norvegicus
aaaggaggtaccacgggccatggct

SEQ ID NO: 11997 - DNA, 25 bp, Rattus norvegicus
aaaggaggtacctactgccagtgaa

SEQ ID NO: 11998 - DNA, 25 bp, Rattus norvegicus
aaaggaggtacctcgggccatggct

SEQ ID NO: 11999 - DNA, 25 bp, Rattus norvegicus
aaaggaggtagtcaggcccacagct

SEQ ID NO: 12000 - DNA, 25 bp, Rattus norvegicus
aaaggaggtagtgaggcccacagct

SEQ ID NO: 12001 - DNA, 25 bp, Rattus norvegicus
aaaggaggtcatccagcccgcagat

SEQ ID NO: 12002 - DNA, 25 bp, Rattus norvegicus
aaaggaggtcatcgcagctgaatca

SEQ ID NO: 12003 - DNA, 25 bp, Rattus norvegicus
aaaggaggtcatgcagcccgcagat

SEQ ID NO: 12004 - DNA, 25 bp, Rattus norvegicus
aaaggaggtcatggcagctgaatca

SEQ ID NO: 12005 - DNA, 25 bp, Rattus norvegicus
aaaggaggtcttccagtatcgccgt

SEQ ID NO: 12006 - DNA, 25 bp, Rattus norvegicus
aaaggaggtcttgcagtatcgccgt

SEQ ID NO: 12007 - DNA, 25 bp, Rattus norvegicus
aaaggagtacctaactatgcctggt

SEQ ID NO: 12008 - DNA, 25 bp, Rattus norvegicus
aaaggagtaccttactatgcctggt

SEQ ID NO: 12009 - DNA, 25 bp, Rattus norvegicus
aaaggagtatgcagctgtgcccatc

SEQ ID NO: 12010 - DNA, 25 bp, Rattus norvegicus
aaaggagtatgctgctgtgcccatc

SEQ ID NO: 12011 - DNA, 25 bp, Rattus norvegicus
aaaggagtcaatccgggcttgcttc

SEQ ID NO: 12012 - DNA, 25 bp, Rattus norvegicus
aaaggagtcaatgcgggcttgcttc

SEQ ID NO: 12013 - DNA, 25 bp, Rattus norvegicus
aaaggagtcatcaactgcttgggat

SEQ ID NO: 12014 - DNA, 25 bp, Rattus norvegicus
aaaggagtcatctactgcttgggat

SEQ ID NO: 12015 - DNA, 25 bp, Rattus norvegicus
aaaggagtccacaacgccgagcgag

SEQ ID NO: 12016 - DNA, 25 bp, Rattus norvegicus
aaaggagtccactacgccgagcgag

SEQ ID NO: 12017 - DNA, 25 bp, Rattus norvegicus
aaaggagtccctaaagcatacacgg

SEQ ID NO: 12018 - DNA, 25 bp, Rattus norvegicus
aaaggagtcccttaagcatacacgg

SEQ ID NO: 12019 - DNA, 25 bp, Rattus norvegicus
aaaggagtcgtgaggttcgtgtcac

SEQ ID NO: 12020 - DNA, 25 bp, Rattus norvegicus
aaaggagtcgtgtggttcgtgtcac

SEQ ID NO: 12021 - DNA, 25 bp, Rattus norvegicus
aaaggagtctctctgcccacatgaa

SEQ ID NO: 12022 - DNA, 25 bp, Rattus norvegicus
aaaggagtctctgtgcccacatgaa

SEQ ID NO: 12023 - DNA, 25 bp, Rattus norvegicus
aaaggagtctgcctaggtgacctga

SEQ ID NO: 12024 - DNA, 25 bp, Rattus norvegicus
aaaggagtctgcgtaggtgacctga

SEQ ID NO: 12025 - DNA, 25 bp, Rattus norvegicus
aaaggagtctggctccttccagcct

SEQ ID NO: 12026 - DNA, 25 bp, Rattus norvegicus
aaaggagtctgggtccttccagcct

SEQ ID NO: 12027 - DNA, 25 bp, Rattus norvegicus
aaaggagtgcctcggtgttctccag

SEQ ID NO: 12028 - DNA, 25 bp, Rattus norvegicus
aaaggagtgcctgggtgttctccag

SEQ ID NO: 12029 - DNA, 25 bp, Rattus norvegicus
aaaggagtgttgctcacagccctct

SEQ ID NO: 12030 - DNA, 25 bp, Rattus norvegicus
aaaggagtgttggtcacagccctct

SEQ ID NO: 12031 - DNA, 25 bp, Rattus norvegicus
aaaggagttatcacacctgccattt

SEQ ID NO: 12032 - DNA, 25 bp, Rattus norvegicus
aaaggagttatctcacctgccattt

SEQ ID NO: 12033 - DNA, 25 bp, Rattus norvegicus
aaaggagttcacagccacctgggaa

SEQ ID NO: 12034 - DNA, 25 bp, Rattus norvegicus
aaaggagttcactgccacctgggaa

SEQ ID NO: 12035 - DNA, 25 bp, Rattus norvegicus
aaaggagttcagagctatcccacca

SEQ ID NO: 12036 - DNA, 25 bp, Rattus norvegicus
aaaggagttcagtgctatcccacca

SEQ ID NO: 12037 - DNA, 25 bp, Rattus norvegicus
aaaggataatttaaagccaggcatg

SEQ ID NO: 12038 - DNA, 25 bp, Rattus norvegicus
aaaggataattttaagccaggcatg

SEQ ID NO: 12039 - DNA, 25 bp, Rattus norvegicus
aaaggatactttacagccaaattct

SEQ ID NO: 12040 - DNA, 25 bp, Rattus norvegicus
aaaggatacttttcagccaaattct

SEQ ID NO: 12041 - DNA, 25 bp, Rattus norvegicus
aaaggatagattaaatctggttgga

SEQ ID NO: 12042 - DNA, 25 bp, Rattus norvegicus
aaaggatagatttaatctggttgga

SEQ ID NO: 12043 - DNA, 25 bp, Rattus norvegicus
aaaggatagtgcaccgtggctcctc

SEQ ID NO: 12044 - DNA, 25 bp, Rattus norvegicus
aaaggatagtgctccgtggctcctc

SEQ ID NO: 12045 - DNA, 25 bp, Rattus norvegicus
aaaggatattttagctctgctcagc

SEQ ID NO: 12046 - DNA, 25 bp, Rattus norvegicus
aaaggatatttttgctctgctcagc

SEQ ID NO: 12047 - DNA, 25 bp, Rattus norvegicus
aaaggatcacttcctctctcatttc

SEQ ID NO: 12048 - DNA, 25 bp, Rattus norvegicus
aaaggatcacttgctctctcatttc

SEQ ID NO: 12049 - DNA, 25 bp, Rattus norvegicus
aaaggatcatctcctttcccttact

SEQ ID NO: 12050 - DNA, 25 bp, Rattus norvegicus
aaaggatcatctgctttcccttact

SEQ ID NO: 12051 - DNA, 25 bp, Rattus norvegicus
aaaggatcatgtacaggcggcagca

SEQ ID NO: 12052 - DNA, 25 bp, Rattus norvegicus
aaaggatcatgttcaggcggcagca

SEQ ID NO: 12053 - DNA, 25 bp, Rattus norvegicus
aaaggatcattcatcctcacagaaa

SEQ ID NO: 12054 - DNA, 25 bp, Rattus norvegicus
aaaggatcattcttcctcacagaaa

SEQ ID NO: 12055 - DNA, 25 bp, Rattus norvegicus
aaaggatccagtccttgcttctcac

SEQ ID NO: 12056 - DNA, 25 bp, Rattus norvegicus
aaaggatccagtgcttgcttctcac

SEQ ID NO: 12057 - DNA, 25 bp, Rattus norvegicus
aaaggatccattctttgcccagtgt

SEQ ID NO: 12058 - DNA, 25 bp, Rattus norvegicus
aaaggatccattgtttgcccagtgt

SEQ ID NO: 12059 - DNA, 25 bp, Rattus norvegicus
aaaggatcccttccaaatgtctgaa

SEQ ID NO: 12060 - DNA, 25 bp, Rattus norvegicus
aaaggatcccttgcaaatgtctgaa

SEQ ID NO: 12061 - DNA, 25 bp, Rattus norvegicus
aaaggatcctgcatactctgggcga

SEQ ID NO: 12062 - DNA, 25 bp, Rattus norvegicus
aaaggatcctgcatctggcatctgt

SEQ ID NO: 12063 - DNA, 25 bp, Rattus norvegicus
aaaggatcctgcttactctgggcga

SEQ ID NO: 12064 - DNA, 25 bp, Rattus norvegicus
aaaggatcctgcttctggcatctgt

SEQ ID NO: 12065 - DNA, 25 bp, Rattus norvegicus
aaaggatcgcagctctgtccagtga

SEQ ID NO: 12066 - DNA, 25 bp, Rattus norvegicus
aaaggatcgcaggtctgtccagtga

SEQ ID NO: 12067 - DNA, 25 bp, Rattus norvegicus
aaaggatctactaccctttgctgac

SEQ ID NO: 12068 - DNA, 25 bp, Rattus norvegicus
aaaggatctacttccctttgctgac

SEQ ID NO: 12069 - DNA, 25 bp, Rattus norvegicus
aaaggatctgaacgtgctgctacat

SEQ ID NO: 12070 - DNA, 25 bp, Rattus norvegicus
aaaggatctgaaggtgctgctacat

SEQ ID NO: 12071 - DNA, 25 bp, Rattus norvegicus
aaaggatctggcctgtgtgtatccc

SEQ ID NO: 12072 - DNA, 25 bp, Rattus norvegicus
aaaggatctggcgtgtgtgtatccc

SEQ ID NO: 12073 - DNA, 25 bp, Rattus norvegicus
aaaggatctggtatgtgtgcctcct

SEQ ID NO: 12074 - DNA, 25 bp, Rattus norvegicus
aaaggatctggtttgtgtgcctcct

SEQ ID NO: 12075 - DNA, 25 bp, Rattus norvegicus
aaaggatcttgactcgtgtggaacc

SEQ ID NO: 12076 - DNA, 25 bp, Rattus norvegicus
aaaggatcttgagtcgtgtggaacc

SEQ ID NO: 12077 - DNA, 25 bp, Rattus norvegicus
aaaggatgaagtcgcccacacagtc

SEQ ID NO: 12078 - DNA, 25 bp, Rattus norvegicus
aaaggatgaagtggcccacacagtc

SEQ ID NO: 12079 - DNA, 25 bp, Rattus norvegicus
aaaggatgactcatactttgaccgg

SEQ ID NO: 12080 - DNA, 25 bp, Rattus norvegicus
aaaggatgactcttactttgaccgg

SEQ ID NO: 12081 - DNA, 25 bp, Rattus norvegicus
aaaggatgcaagagcccgatcccca

SEQ ID NO: 12082 - DNA, 25 bp, Rattus norvegicus
aaaggatgcaagtgcccgatcccca

SEQ ID NO: 12083 - DNA, 25 bp, Rattus norvegicus
aaaggatgcactacccatctctgga

SEQ ID NO: 12084 - DNA, 25 bp, Rattus norvegicus
aaaggatgcacttcccatctctgga

SEQ ID NO: 12085 - DNA, 25 bp, Rattus norvegicus
aaaggatgcatcaggtctaccccag

SEQ ID NO: 12086 - DNA, 25 bp, Rattus norvegicus
aaaggatgcatctggtctaccccag

SEQ ID NO: 12087 - DNA, 25 bp, Rattus norvegicus
aaaggatgccaacaacctgacgcta

SEQ ID NO: 12088 - DNA, 25 bp, Rattus norvegicus
aaaggatgccaagaacctgacgcta

SEQ ID NO: 12089 - DNA, 25 bp, Rattus norvegicus
aaaggatgccacaataagctgctgt

SEQ ID NO: 12090 - DNA, 25 bp, Rattus norvegicus
aaaggatgccactataagctgctgt

SEQ ID NO: 12091 - DNA, 25 bp, Rattus norvegicus
aaaggatgctgcagtacaggtccct

SEQ ID NO: 12092 - DNA, 25 bp, Rattus norvegicus
aaaggatgctgctgtacaggtccct

SEQ ID NO: 12093 - DNA, 25 bp, Rattus norvegicus
aaaggatgctggaccagaccctgct

SEQ ID NO: 12094 - DNA, 25 bp, Rattus norvegicus
aaaggatgctggtccagaccctgct

SEQ ID NO: 12095 - DNA, 25 bp, Rattus norvegicus
aaaggatgggcccactgtccagttc

SEQ ID NO: 12096 - DNA, 25 bp, Rattus norvegicus
aaaggatgggccgactgtccagttc

SEQ ID NO: 12097 - DNA, 25 bp, Rattus norvegicus
aaaggattagccactgcagttctcc

SEQ ID NO: 12098 - DNA, 25 bp, Rattus norvegicus
aaaggattagcctctgcagttctcc

SEQ ID NO: 12099 - DNA, 25 bp, Rattus norvegicus
aaaggattcagtctcttcccttggt

SEQ ID NO: 12100 - DNA, 25 bp, Rattus norvegicus
aaaggattcagtgtcttcccttggt

SEQ ID NO: 12101 - DNA, 25 bp, Rattus norvegicus
aaaggattcctccaagaagacagag

SEQ ID NO: 12102 - DNA, 25 bp, Rattus norvegicus
aaaggattcctcgaagaagacagag

SEQ ID NO: 12103 - DNA, 25 bp, Rattus norvegicus
aaaggattctacaattcacacaaaa

SEQ ID NO: 12104 - DNA, 25 bp, Rattus norvegicus
aaaggattctactattcacacaaaa

SEQ ID NO: 12105 - DNA, 25 bp, Rattus norvegicus
aaaggattctttcagtgtacattta

SEQ ID NO: 12106 - DNA, 25 bp, Rattus norvegicus
aaaggattctttgagtgtacattta

SEQ ID NO: 12107 - DNA, 25 bp, Rattus norvegicus
aaaggattgaaccaaggcttgccat

SEQ ID NO: 12108 - DNA, 25 bp, Rattus norvegicus
aaaggattgaacgaaggcttgccat

SEQ ID NO: 12109 - DNA, 25 bp, Rattus norvegicus
aaaggattgactcggctacctcagc

SEQ ID NO: 12110 - DNA, 25 bp, Rattus norvegicus
aaaggattgactgggctacctcagc

SEQ ID NO: 12111 - DNA, 25 bp, Rattus norvegicus
aaaggattgcacatgttcgctccgt

SEQ ID NO: 12112 - DNA, 25 bp, Rattus norvegicus
aaaggattgcacttgttcgctccgt

SEQ ID NO: 12113 - DNA, 25 bp, Rattus norvegicus
aaaggattgcatctatgccactgac

SEQ ID NO: 12114 - DNA, 25 bp, Rattus norvegicus
aaaggattgcatgtatgccactgac

SEQ ID NO: 12115 - DNA, 25 bp, Rattus norvegicus
aaaggattgtgtctgccatgtggct

SEQ ID NO: 12116 - DNA, 25 bp, Rattus norvegicus
aaaggattgtgtgtgccatgtggct

SEQ ID NO: 12117 - DNA, 25 bp, Rattus norvegicus
aaaggatttagtctgctgtgcaaac

SEQ ID NO: 12118 - DNA, 25 bp, Rattus norvegicus
aaaggatttagtgtgctgtgcaaac

SEQ ID NO: 12119 - DNA, 25 bp, Rattus norvegicus
aaaggatttcagcatgccaaggtga

SEQ ID NO: 12120 - DNA, 25 bp, Rattus norvegicus
aaaggatttcaggatgccaaggtga

SEQ ID NO: 12121 - DNA, 25 bp, Rattus norvegicus
aaaggatttctcacttggccatggc

SEQ ID NO: 12122 - DNA, 25 bp, Rattus norvegicus
aaaggatttctctcttggccatggc

SEQ ID NO: 12123 - DNA, 25 bp, Rattus norvegicus
aaaggatttcttcacttacacgtat

SEQ ID NO: 12124 - DNA, 25 bp, Rattus norvegicus
aaaggatttcttgacttacacgtat

SEQ ID NO: 12125 - DNA, 25 bp, Rattus norvegicus
aaaggatttgccacgcacggaacct

SEQ ID NO: 12126 - DNA, 25 bp, Rattus norvegicus
aaaggatttgcctcgcacggaacct

SEQ ID NO: 12127 - DNA, 25 bp, Rattus norvegicus
aaaggcaaaagactgttacactagg

SEQ ID NO: 12128 - DNA, 25 bp, Rattus norvegicus
aaaggcaaaagagtgttacactagg

SEQ ID NO: 12129 - DNA, 25 bp, Rattus norvegicus
aaaggcaaaattccacatatagctt

SEQ ID NO: 12130 - DNA, 25 bp, Rattus norvegicus
aaaggcaaaattgcacatatagctt

SEQ ID NO: 12131 - DNA, 25 bp, Rattus norvegicus
aaaggcaaacttcactctaatcagt

SEQ ID NO: 12132 - DNA, 25 bp, Rattus norvegicus
aaaggcaaacttgactctaatcagt

SEQ ID NO: 12133 - DNA, 25 bp, Rattus norvegicus
aaaggcaaagcactccacggtttct

SEQ ID NO: 12134 - DNA, 25 bp, Rattus norvegicus
aaaggcaaagcagtccacggtttct

SEQ ID NO: 12135 - DNA, 25 bp, Rattus norvegicus
aaaggcaacaccaccattcatcatg

SEQ ID NO: 12136 - DNA, 25 bp, Rattus norvegicus
aaaggcaacacctccattcatcatg

SEQ ID NO: 12137 - DNA, 25 bp, Rattus norvegicus
aaaggcaacaggcttctctctagaa

SEQ ID NO: 12138 - DNA, 25 bp, Rattus norvegicus
aaaggcaacagggttctctctagaa

SEQ ID NO: 12139 - DNA, 25 bp, Rattus norvegicus
aaaggcaacgccaaccatctgatgc

SEQ ID NO: 12140 - DNA, 25 bp, Rattus norvegicus
aaaggcaacgcctaccatctgatgc

SEQ ID NO: 12141 - DNA, 25 bp, Rattus norvegicus
aaaggcaagtgcagccaggctaggc

SEQ ID NO: 12142 - DNA, 25 bp, Rattus norvegicus
aaaggcaagtgctgccaggctaggc

SEQ ID NO: 12143 - DNA, 25 bp, Rattus norvegicus
aaaggcaatcttatgggctggacac

SEQ ID NO: 12144 - DNA, 25 bp, Rattus norvegicus
aaaggcaatcttttgggctggacac

SEQ ID NO: 12145 - DNA, 25 bp, Rattus norvegicus
aaaggcaatgaaatcctcccgttct

SEQ ID NO: 12146 - DNA, 25 bp, Rattus norvegicus
aaaggcaatgaattcctcccgttct

SEQ ID NO: 12147 - DNA, 25 bp, Rattus norvegicus
aaaggcaatgccctttcctcattgg

SEQ ID NO: 12148 - DNA, 25 bp, Rattus norvegicus
aaaggcaatgccgtttcctcattgg

SEQ ID NO: 12149 - DNA, 25 bp, Rattus norvegicus
aaaggcaattgcagccagacctgac

SEQ ID NO: 12150 - DNA, 25 bp, Rattus norvegicus
aaaggcaattgctgccagacctgac

SEQ ID NO: 12151 - DNA, 25 bp, Rattus norvegicus
aaaggcaattttcatgtatctccag

SEQ ID NO: 12152 - DNA, 25 bp, Rattus norvegicus
aaaggcaattttgatgtatctccag

SEQ ID NO: 12153 - DNA, 25 bp, Rattus norvegicus
aaaggcacaagactctgacacccag

SEQ ID NO: 12154 - DNA, 25 bp, Rattus norvegicus
aaaggcacaagagtctgacacccag

SEQ ID NO: 12155 - DNA, 25 bp, Rattus norvegicus
aaaggcacaggtcagaccgtctgaa

SEQ ID NO: 12156 - DNA, 25 bp, Rattus norvegicus
aaaggcacaggtgagaccgtctgaa

SEQ ID NO: 12157 - DNA, 25 bp, Rattus norvegicus
aaaggcacagtgagctctgccacag

SEQ ID NO: 12158 - DNA, 25 bp, Rattus norvegicus
aaaggcacagtgtgctctgccacag

SEQ ID NO: 12159 - DNA, 25 bp, Rattus norvegicus
aaaggcacatccagtccagtgtcac

SEQ ID NO: 12160 - DNA, 25 bp, Rattus norvegicus
aaaggcacatcctgtccagtgtcac

SEQ ID NO: 12161 - DNA, 25 bp, Rattus norvegicus
aaaggcacatgtatacccacttcag

SEQ ID NO: 12162 - DNA, 25 bp, Rattus norvegicus
aaaggcacatgtcgcagtctgctct

SEQ ID NO: 12163 - DNA, 25 bp, Rattus norvegicus
aaaggcacatgtggcagtctgctct

SEQ ID NO: 12164 - DNA, 25 bp, Rattus norvegicus
aaaggcacatgtttacccacttcag

SEQ ID NO: 12165 - DNA, 25 bp, Rattus norvegicus
aaaggcaccacacgtcgtctccgga

SEQ ID NO: 12166 - DNA, 25 bp, Rattus norvegicus
aaaggcaccacaggtcgtctccgga

SEQ ID NO: 12167 - DNA, 25 bp, Rattus norvegicus
aaaggcaccagcatgtgactcgtct

SEQ ID NO: 12168 - DNA, 25 bp, Rattus norvegicus
aaaggcaccagcttgtgactcgtct

SEQ ID NO: 12169 - DNA, 25 bp, Rattus norvegicus
aaaggcaccaggcttggacctccgt

SEQ ID NO: 12170 - DNA, 25 bp, Rattus norvegicus
aaaggcaccagggttggacctccgt

SEQ ID NO: 12171 - DNA, 25 bp, Rattus norvegicus
aaaggcaccatccagtctacacatt

SEQ ID NO: 12172 - DNA, 25 bp, Rattus norvegicus
aaaggcaccatcgagtctacacatt

SEQ ID NO: 12173 - DNA, 25 bp, Rattus norvegicus
aaaggcaccgatctttacaagtgaa

SEQ ID NO: 12174 - DNA, 25 bp, Rattus norvegicus
aaaggcaccgatgtttacaagtgaa

SEQ ID NO: 12175 - DNA, 25 bp, Rattus norvegicus
aaaggcaccgtgaccagtggcatgg

SEQ ID NO: 12176 - DNA, 25 bp, Rattus norvegicus
aaaggcaccgtgtccagtggcatgg

SEQ ID NO: 12177 - DNA, 25 bp, Rattus norvegicus
aaaggcacctccatcgagttcgaag

SEQ ID NO: 12178 - DNA, 25 bp, Rattus norvegicus
aaaggcacctccttcgagttcgaag

SEQ ID NO: 12179 - DNA, 25 bp, Rattus norvegicus
aaaggcacctggactacagcgcatg

SEQ ID NO: 12180 - DNA, 25 bp, Rattus norvegicus
aaaggcacctggctctaactttcat

SEQ ID NO: 12181 - DNA, 25 bp, Rattus norvegicus
aaaggcacctgggtctaactttcat

SEQ ID NO: 12182 - DNA, 25 bp, Rattus norvegicus
aaaggcacctggtctacagcgcatg

SEQ ID NO: 12183 - DNA, 25 bp, Rattus norvegicus
aaaggcacctttattgaccttggag

SEQ ID NO: 12184 - DNA, 25 bp, Rattus norvegicus
aaaggcaccttttttgaccttggag

SEQ ID NO: 12185 - DNA, 25 bp, Rattus norvegicus
aaaggcactatgacaccacctaaaa

SEQ ID NO: 12186 - DNA, 25 bp, Rattus norvegicus
aaaggcactatgtcaccacctaaaa

SEQ ID NO: 12187 - DNA, 25 bp, Rattus norvegicus
aaaggcactctgaaactctgcatat

SEQ ID NO: 12188 - DNA, 25 bp, Rattus norvegicus
aaaggcactctgtaactctgcatat

SEQ ID NO: 12189 - DNA, 25 bp, Rattus norvegicus
aaaggcactgacatcccaattgaca

SEQ ID NO: 12190 - DNA, 25 bp, Rattus norvegicus
aaaggcactgacttcccaattgaca

SEQ ID NO: 12191 - DNA, 25 bp, Rattus norvegicus
aaaggcactggcacaaaaccaagag

SEQ ID NO: 12192 - DNA, 25 bp, Rattus norvegicus
aaaggcactggctcaaaaccaagag

SEQ ID NO: 12193 - DNA, 25 bp, Rattus norvegicus
aaaggcactgtaatgctgggctaga

SEQ ID NO: 12194 - DNA, 25 bp, Rattus norvegicus
aaaggcactgtattgctgggctaga

SEQ ID NO: 12195 - DNA, 25 bp, Rattus norvegicus
aaaggcactgtcagtgtcccgggtt

SEQ ID NO: 12196 - DNA, 25 bp, Rattus norvegicus
aaaggcactgtcctagttgggagtt

SEQ ID NO: 12197 - DNA, 25 bp, Rattus norvegicus
aaaggcactgtcgtagttgggagtt

SEQ ID NO: 12198 - DNA, 25 bp, Rattus norvegicus
aaaggcactgtctgtgtcccgggtt

SEQ ID NO: 12199 - DNA, 25 bp, Rattus norvegicus
aaaggcactgttagccatcctgcag

SEQ ID NO: 12200 - DNA, 25 bp, Rattus norvegicus
aaaggcactgtttgccatcctgcag

SEQ ID NO: 12201 - DNA, 25 bp, Rattus norvegicus
aaaggcacttataaacttgtctttg

SEQ ID NO: 12202 - DNA, 25 bp, Rattus norvegicus
aaaggcacttattaacttgtctttg

SEQ ID NO: 12203 - DNA, 25 bp, Rattus norvegicus
aaaggcacttgcaaccatgactaat

SEQ ID NO: 12204 - DNA, 25 bp, Rattus norvegicus
aaaggcacttgccacaaaacttggg

SEQ ID NO: 12205 - DNA, 25 bp, Rattus norvegicus
aaaggcacttgcgacaaaacttggg

SEQ ID NO: 12206 - DNA, 25 bp, Rattus norvegicus
aaaggcacttgctaccatgactaat

SEQ ID NO: 12207 - DNA, 25 bp, Rattus norvegicus
aaaggcagagcccagcatcttgtgc

SEQ ID NO: 12208 - DNA, 25 bp, Rattus norvegicus
aaaggcagagccgagcatcttgtgc

SEQ ID NO: 12209 - DNA, 25 bp, Rattus norvegicus
aaaggcagagggatgcccggcttta

SEQ ID NO: 12210 - DNA, 25 bp, Rattus norvegicus
aaaggcagagggttgcccggcttta

SEQ ID NO: 12211 - DNA, 25 bp, Rattus norvegicus
aaaggcagagtacaccgcgtgctgt

SEQ ID NO: 12212 - DNA, 25 bp, Rattus norvegicus
aaaggcagagtagaccgcgtgctgt

SEQ ID NO: 12213 - DNA, 25 bp, Rattus norvegicus
aaaggcagatagcactttcagcccc

SEQ ID NO: 12214 - DNA, 25 bp, Rattus norvegicus
aaaggcagataggactttcagcccc

SEQ ID NO: 12215 - DNA, 25 bp, Rattus norvegicus
aaaggcagcatccttctggcactac

SEQ ID NO: 12216 - DNA, 25 bp, Rattus norvegicus
aaaggcagcatcgttctggcactac

SEQ ID NO: 12217 - DNA, 25 bp, Rattus norvegicus
aaaggcagccttctgtcacacacag

SEQ ID NO: 12218 - DNA, 25 bp, Rattus norvegicus
aaaggcagccttgtgtcacacacag

SEQ ID NO: 12219 - DNA, 25 bp, Rattus norvegicus
aaaggcagcgcgatcacttggcatg

SEQ ID NO: 12220 - DNA, 25 bp, Rattus norvegicus
aaaggcagcgcgttcacttggcatg

SEQ ID NO: 12221 - DNA, 25 bp, Rattus norvegicus
aaaggcagctctacattggaattaa

SEQ ID NO: 12222 - DNA, 25 bp, Rattus norvegicus
aaaggcagctcttcattggaattaa

SEQ ID NO: 12223 - DNA, 25 bp, Rattus norvegicus
aaaggcagctgtcgcatgacggatc

SEQ ID NO: 12224 - DNA, 25 bp, Rattus norvegicus
aaaggcagctgtggcatgacggatc

SEQ ID NO: 12225 - DNA, 25 bp, Rattus norvegicus
aaaggcaggacaatcagcgtgaggt

SEQ ID NO: 12226 - DNA, 25 bp, Rattus norvegicus
aaaggcaggacaccccttctctgta

SEQ ID NO: 12227 - DNA, 25 bp, Rattus norvegicus
aaaggcaggacagcccttctctgta

SEQ ID NO: 12228 - DNA, 25 bp, Rattus norvegicus
aaaggcaggacattcagcgtgaggt

SEQ ID NO: 12229 - DNA, 25 bp, Rattus norvegicus
aaaggcaggcgaaactgagacacca

SEQ ID NO: 12230 - DNA, 25 bp, Rattus norvegicus
aaaggcaggcgatactgagacacca

SEQ ID NO: 12231 - DNA, 25 bp, Rattus norvegicus
aaaggcaggcttattggcgtgagac

SEQ ID NO: 12232 - DNA, 25 bp, Rattus norvegicus
aaaggcaggctttttggcgtgagac

SEQ ID NO: 12233 - DNA, 25 bp, Rattus norvegicus
aaaggcaggtgcagttccctagagc

SEQ ID NO: 12234 - DNA, 25 bp, Rattus norvegicus
aaaggcaggtgctgttccctagagc

SEQ ID NO: 12235 - DNA, 25 bp, Rattus norvegicus
aaaggcaggttgctttgcagacatt

SEQ ID NO: 12236 - DNA, 25 bp, Rattus norvegicus
aaaggcaggttggtttgcagacatt

SEQ ID NO: 12237 - DNA, 25 bp, Rattus norvegicus
aaaggcagtcagacatcggtcacat

SEQ ID NO: 12238 - DNA, 25 bp, Rattus norvegicus
aaaggcagtcagtcatcggtcacat

SEQ ID NO: 12239 - DNA, 25 bp, Rattus norvegicus
aaaggcagtctccacgttatcacta

SEQ ID NO: 12240 - DNA, 25 bp, Rattus norvegicus
aaaggcagtctcgacgttatcacta

SEQ ID NO: 12241 - DNA, 25 bp, Rattus norvegicus
aaaggcagtggcagtgccagctctg

SEQ ID NO: 12242 - DNA, 25 bp, Rattus norvegicus
aaaggcagtggctgtgccagctctg

SEQ ID NO: 12243 - DNA, 25 bp, Rattus norvegicus
aaaggcagttggagtcctttgccat

SEQ ID NO: 12244 - DNA, 25 bp, Rattus norvegicus
aaaggcagttggtgtcctttgccat

SEQ ID NO: 12245 - DNA, 25 bp, Rattus norvegicus
aaaggcatacctcctgcagtgggaa

SEQ ID NO: 12246 - DNA, 25 bp, Rattus norvegicus
aaaggcatacctgctgcagtgggaa

SEQ ID NO: 12247 - DNA, 25 bp, Rattus norvegicus
aaaggcatagacaccatgtgcagcc

SEQ ID NO: 12248 - DNA, 25 bp, Rattus norvegicus
aaaggcatagactccatgtgcagcc

SEQ ID NO: 12249 - DNA, 25 bp, Rattus norvegicus
aaaggcatatcgactgtaattaaaa

SEQ ID NO: 12250 - DNA, 25 bp, Rattus norvegicus
aaaggcatatcgtctgtaattaaaa

SEQ ID NO: 12251 - DNA, 25 bp, Rattus norvegicus
aaaggcatcattacagtcgttgtat

SEQ ID NO: 12252 - DNA, 25 bp, Rattus norvegicus
aaaggcatcatttcagtcgttgtat

SEQ ID NO: 12253 - DNA, 25 bp, Rattus norvegicus
aaaggcatccagactctgcttgaga

SEQ ID NO: 12254 - DNA, 25 bp, Rattus norvegicus
aaaggcatccagtctctgcttgaga

SEQ ID NO: 12255 - DNA, 25 bp, Rattus norvegicus
aaaggcatcctcaagaagaagtgtc

SEQ ID NO: 12256 - DNA, 25 bp, Rattus norvegicus
aaaggcatcctctagaagaagtgtc

SEQ ID NO: 12257 - DNA, 25 bp, Rattus norvegicus
aaaggcatcctgcacccacgaggga

SEQ ID NO: 12258 - DNA, 25 bp, Rattus norvegicus
aaaggcatcctggacccacgaggga

SEQ ID NO: 12259 - DNA, 25 bp, Rattus norvegicus
aaaggcatcgatacatatccgaata

SEQ ID NO: 12260 - DNA, 25 bp, Rattus norvegicus
aaaggcatcgattcatatccgaata

SEQ ID NO: 12261 - DNA, 25 bp, Rattus norvegicus
aaaggcatctagcaaaagcatggat

SEQ ID NO: 12262 - DNA, 25 bp, Rattus norvegicus
aaaggcatctaggaaaagcatggat

SEQ ID NO: 12263 - DNA, 25 bp, Rattus norvegicus
aaaggcatgagtacagtctgagacc

SEQ ID NO: 12264 - DNA, 25 bp, Rattus norvegicus
aaaggcatgagttcagtctgagacc

SEQ ID NO: 12265 - DNA, 25 bp, Rattus norvegicus
aaaggcatgattcacctgctctcgg

SEQ ID NO: 12266 - DNA, 25 bp, Rattus norvegicus
aaaggcatgattgacctgctctcgg

SEQ ID NO: 12267 - DNA, 25 bp, Rattus norvegicus
aaaggcatgcacaatgaccaacacc

SEQ ID NO: 12268 - DNA, 25 bp, Rattus norvegicus
aaaggcatgcactatgaccaacacc

SEQ ID NO: 12269 - DNA, 25 bp, Rattus norvegicus
aaaggcatgtcaccatcaggtctgc

SEQ ID NO: 12270 - DNA, 25 bp, Rattus norvegicus
aaaggcatgtcagcatcaggtctgc

SEQ ID NO: 12271 - DNA, 25 bp, Rattus norvegicus
aaaggcatgtgtcatccctgcctga

SEQ ID NO: 12272 - DNA, 25 bp, Rattus norvegicus
aaaggcatgtgtgatccctgcctga

SEQ ID NO: 12273 - DNA, 25 bp, Rattus norvegicus
aaaggcattacaagttctgaccaac

SEQ ID NO: 12274 - DNA, 25 bp, Rattus norvegicus
aaaggcattacatgttctgaccaac

SEQ ID NO: 12275 - DNA, 25 bp, Rattus norvegicus
aaaggcattatcagggtcttacaga

SEQ ID NO: 12276 - DNA, 25 bp, Rattus norvegicus
aaaggcattatctgggtcttacaga

SEQ ID NO: 12277 - DNA, 25 bp, Rattus norvegicus
aaaggcattcatactcataacccaa

SEQ ID NO: 12278 - DNA, 25 bp, Rattus norvegicus
aaaggcattcattctcataacccaa

SEQ ID NO: 12279 - DNA, 25 bp, Rattus norvegicus
aaaggcattcccacagctgagttca

SEQ ID NO: 12280 - DNA, 25 bp, Rattus norvegicus
aaaggcattccctcagctgagttca

SEQ ID NO: 12281 - DNA, 25 bp, Rattus norvegicus
aaaggcattgtcatctggtcaatat

SEQ ID NO: 12282 - DNA, 25 bp, Rattus norvegicus
aaaggcattgtcctcctgggttaga

SEQ ID NO: 12283 - DNA, 25 bp, Rattus norvegicus
aaaggcattgtcgtcctgggttaga

SEQ ID NO: 12284 - DNA, 25 bp, Rattus norvegicus
aaaggcattgtcttctggtcaatat

SEQ ID NO: 12285 - DNA, 25 bp, Rattus norvegicus
aaaggcattgttacaggctctgtga

SEQ ID NO: 12286 - DNA, 25 bp, Rattus norvegicus
aaaggcattgtttcaggctctgtga

SEQ ID NO: 12287 - DNA, 25 bp, Rattus norvegicus
aaaggcatttatcgtggccctctgc

SEQ ID NO: 12288 - DNA, 25 bp, Rattus norvegicus
aaaggcatttatggtggccctctgc

SEQ ID NO: 12289 - DNA, 25 bp, Rattus norvegicus
aaaggcatttcgaacattcataatt

SEQ ID NO: 12290 - DNA, 25 bp, Rattus norvegicus
aaaggcatttcgtacattcataatt

SEQ ID NO: 12291 - DNA, 25 bp, Rattus norvegicus
aaaggcatttgtacgcagagattgg

SEQ ID NO: 12292 - DNA, 25 bp, Rattus norvegicus
aaaggcatttgttcgcagagattgg

SEQ ID NO: 12293 - DNA, 25 bp, Rattus norvegicus
aaaggcattttcaacctgtagctcc

SEQ ID NO: 12294 - DNA, 25 bp, Rattus norvegicus
aaaggcattttcactggtgtgttcc

SEQ ID NO: 12295 - DNA, 25 bp, Rattus norvegicus
aaaggcattttctacctgtagctcc

SEQ ID NO: 12296 - DNA, 25 bp, Rattus norvegicus
aaaggcattttctctggtgtgttcc

SEQ ID NO: 12297 - DNA, 25 bp, Rattus norvegicus
aaaggccaacagacttcctttactg

SEQ ID NO: 12298 - DNA, 25 bp, Rattus norvegicus
aaaggccaacagtcttcctttactg

SEQ ID NO: 12299 - DNA, 25 bp, Rattus norvegicus
aaaggccaacctcgaggagctacct

SEQ ID NO: 12300 - DNA, 25 bp, Rattus norvegicus
aaaggccaacctggaggagctacct

SEQ ID NO: 12301 - DNA, 25 bp, Rattus norvegicus
aaaggccaagcaatacatttataaa

SEQ ID NO: 12302 - DNA, 25 bp, Rattus norvegicus
aaaggccaagcattacatttataaa

SEQ ID NO: 12303 - DNA, 25 bp, Rattus norvegicus
aaaggccaagttccctgcatttgaa

SEQ ID NO: 12304 - DNA, 25 bp, Rattus norvegicus
aaaggccaagttgcctgcatttgaa

SEQ ID NO: 12305 - DNA, 25 bp, Rattus norvegicus
aaaggccaatttcgatttcatatct

SEQ ID NO: 12306 - DNA, 25 bp, Rattus norvegicus
aaaggccaatttggatttcatatct

SEQ ID NO: 12307 - DNA, 25 bp, Rattus norvegicus
aaaggccacaccaagcatttaaaca

SEQ ID NO: 12308 - DNA, 25 bp, Rattus norvegicus
aaaggccacacctagcatttaaaca

SEQ ID NO: 12309 - DNA, 25 bp, Rattus norvegicus
aaaggccacactccctacagtgagg

SEQ ID NO: 12310 - DNA, 25 bp, Rattus norvegicus
aaaggccacactgcctacagtgagg

SEQ ID NO: 12311 - DNA, 25 bp, Rattus norvegicus
aaaggccacatcatcctggatggga

SEQ ID NO: 12312 - DNA, 25 bp, Rattus norvegicus
aaaggccacatcttcctggatggga

SEQ ID NO: 12313 - DNA, 25 bp, Rattus norvegicus
aaaggccacctgaatggtcatctaa

SEQ ID NO: 12314 - DNA, 25 bp, Rattus norvegicus
aaaggccacctgtatggtcatctaa

SEQ ID NO: 12315 - DNA, 25 bp, Rattus norvegicus
aaaggccaccttctgtataagctaa

SEQ ID NO: 12316 - DNA, 25 bp, Rattus norvegicus
aaaggccaccttgtgtataagctaa

SEQ ID NO: 12317 - DNA, 25 bp, Rattus norvegicus
aaaggccacgcaaaggttctcagca

SEQ ID NO: 12318 - DNA, 25 bp, Rattus norvegicus
aaaggccacgcataggttctcagca

SEQ ID NO: 12319 - DNA, 25 bp, Rattus norvegicus
aaaggccacggtcaccagaaccagc

SEQ ID NO: 12320 - DNA, 25 bp, Rattus norvegicus
aaaggccacggtgaccagaaccagc

SEQ ID NO: 12321 - DNA, 25 bp, Rattus norvegicus
aaaggccactctcgtatcaatcacc

SEQ ID NO: 12322 - DNA, 25 bp, Rattus norvegicus
aaaggccactctggtatcaatcacc

SEQ ID NO: 12323 - DNA, 25 bp, Rattus norvegicus
aaaggccactgaacaacaactctca

SEQ ID NO: 12324 - DNA, 25 bp, Rattus norvegicus
aaaggccactgatcaacaactctca

SEQ ID NO: 12325 - DNA, 25 bp, Rattus norvegicus
aaaggccagaacagcttccagatct

SEQ ID NO: 12326 - DNA, 25 bp, Rattus norvegicus
aaaggccagaactgcttccagatct

SEQ ID NO: 12327 - DNA, 25 bp, Rattus norvegicus
aaaggccagactaaaccacactcct

SEQ ID NO: 12328 - DNA, 25 bp, Rattus norvegicus
aaaggccagactcatcagcactgat

SEQ ID NO: 12329 - DNA, 25 bp, Rattus norvegicus
aaaggccagactgatcagcactgat

SEQ ID NO: 12330 - DNA, 25 bp, Rattus norvegicus
aaaggccagacttaaccacactcct

SEQ ID NO: 12331 - DNA, 25 bp, Rattus norvegicus
aaaggccagagtagccatggcagca

SEQ ID NO: 12332 - DNA, 25 bp, Rattus norvegicus
aaaggccagagttgccatggcagca

SEQ ID NO: 12333 - DNA, 25 bp, Rattus norvegicus
aaaggccagatcatcaacgtcctca

SEQ ID NO: 12334 - DNA, 25 bp, Rattus norvegicus
aaaggccagatcttcaacgtcctca

SEQ ID NO: 12335 - DNA, 25 bp, Rattus norvegicus
aaaggccagcagcttgccagtgtcc

SEQ ID NO: 12336 - DNA, 25 bp, Rattus norvegicus
aaaggccagcaggttgccagtgtcc

SEQ ID NO: 12337 - DNA, 25 bp, Rattus norvegicus
aaaggccagcctaattcaaaatgct

SEQ ID NO: 12338 - DNA, 25 bp, Rattus norvegicus
aaaggccagccttattcaaaatgct

SEQ ID NO: 12339 - DNA, 25 bp, Rattus norvegicus
aaaggccagggtagagtcaaagact

SEQ ID NO: 12340 - DNA, 25 bp, Rattus norvegicus
aaaggccagggttgagtcaaagact

SEQ ID NO: 12341 - DNA, 25 bp, Rattus norvegicus
aaaggccagtgtaacagagtcaaac

SEQ ID NO: 12342 - DNA, 25 bp, Rattus norvegicus
aaaggccagtgttacagagtcaaac

SEQ ID NO: 12343 - DNA, 25 bp, Rattus norvegicus
aaaggccagttgacccaacctggag

SEQ ID NO: 12344 - DNA, 25 bp, Rattus norvegicus
aaaggccagttgtcccaacctggag

SEQ ID NO: 12345 - DNA, 25 bp, Rattus norvegicus
aaaggccatatcctagtggacgagt

SEQ ID NO: 12346 - DNA, 25 bp, Rattus norvegicus
aaaggccatatcgtagtggacgagt

SEQ ID NO: 12347 - DNA, 25 bp, Rattus norvegicus
aaaggccatgcgcagagtcctcggt

SEQ ID NO: 12348 - DNA, 25 bp, Rattus norvegicus
aaaggccatgcggagagtcctcggt

SEQ ID NO: 12349 - DNA, 25 bp, Rattus norvegicus
aaaggccatgtgcacatcctggcac

SEQ ID NO: 12350 - DNA, 25 bp, Rattus norvegicus
aaaggccatgtggacatcctggcac

SEQ ID NO: 12351 - DNA, 25 bp, Rattus norvegicus
aaaggccatgttccccattacttgt

SEQ ID NO: 12352 - DNA, 25 bp, Rattus norvegicus
aaaggccatgttgcccattacttgt

SEQ ID NO: 12353 - DNA, 25 bp, Rattus norvegicus
aaaggccattcaaccaacaaaatag

SEQ ID NO: 12354 - DNA, 25 bp, Rattus norvegicus
aaaggccattcatccaacaaaatag

SEQ ID NO: 12355 - DNA, 25 bp, Rattus norvegicus
aaaggccatttgcagtttcagtgat

SEQ ID NO: 12356 - DNA, 25 bp, Rattus norvegicus
aaaggccatttggagtttcagtgat

SEQ ID NO: 12357 - DNA, 25 bp, Rattus norvegicus
aaaggcccaacgctgatcgtggata

SEQ ID NO: 12358 - DNA, 25 bp, Rattus norvegicus
aaaggcccaacggtgatcgtggata

SEQ ID NO: 12359 - DNA, 25 bp, Rattus norvegicus
aaaggcccagacctccacttagagt

SEQ ID NO: 12360 - DNA, 25 bp, Rattus norvegicus
aaaggcccagacgtccacttagagt

SEQ ID NO: 12361 - DNA, 25 bp, Rattus norvegicus
aaaggcccagagcaccagtttagag

SEQ ID NO: 12362 - DNA, 25 bp, Rattus norvegicus
aaaggcccagaggaccagtttagag

SEQ ID NO: 12363 - DNA, 25 bp, Rattus norvegicus
aaaggcccagccaattgtaaagaat

SEQ ID NO: 12364 - DNA, 25 bp, Rattus norvegicus
aaaggcccagcctattgtaaagaat

SEQ ID NO: 12365 - DNA, 25 bp, Rattus norvegicus
aaaggcccagctcaatatcggcaat

SEQ ID NO: 12366 - DNA, 25 bp, Rattus norvegicus
aaaggcccagctgaatatcggcaat

SEQ ID NO: 12367 - DNA, 25 bp, Rattus norvegicus
aaaggcccaggcacaccatggtgaa

SEQ ID NO: 12368 - DNA, 25 bp, Rattus norvegicus
aaaggcccaggctcaccatggtgaa

SEQ ID NO: 12369 - DNA, 25 bp, Rattus norvegicus
aaaggcccatccaggtgacaactcg

SEQ ID NO: 12370 - DNA, 25 bp, Rattus norvegicus
aaaggcccatcctggtgacaactcg

SEQ ID NO: 12371 - DNA, 25 bp, Rattus norvegicus
aaaggcccatctagtctggaagcag

SEQ ID NO: 12372 - DNA, 25 bp, Rattus norvegicus
aaaggcccatcttgtctggaagcag

SEQ ID NO: 12373 - DNA, 25 bp, Rattus norvegicus
aaaggcccccagagaggtctctgaa

SEQ ID NO: 12374 - DNA, 25 bp, Rattus norvegicus
aaaggcccccagtgaggtctctgaa

SEQ ID NO: 12375 - DNA, 25 bp, Rattus norvegicus
aaaggcccggatccgcatcttggtg

SEQ ID NO: 12376 - DNA, 25 bp, Rattus norvegicus
aaaggcccggatgcgcatcttggtg

SEQ ID NO: 12377 - DNA, 25 bp, Rattus norvegicus
aaaggcccggctcaatgcaggacaa

SEQ ID NO: 12378 - DNA, 25 bp, Rattus norvegicus
aaaggcccggctgaatgcaggacaa

SEQ ID NO: 12379 - DNA, 25 bp, Rattus norvegicus
aaaggcccgtggatatggtccagct

SEQ ID NO: 12380 - DNA, 25 bp, Rattus norvegicus
aaaggcccgtggttatggtccagct

SEQ ID NO: 12381 - DNA, 25 bp, Rattus norvegicus
aaaggccctagacctagtggacaca

SEQ ID NO: 12382 - DNA, 25 bp, Rattus norvegicus
aaaggccctagagctagtggacaca

SEQ ID NO: 12383 - DNA, 25 bp, Rattus norvegicus
aaaggccctgagcagttttcatgga

SEQ ID NO: 12384 - DNA, 25 bp, Rattus norvegicus
aaaggccctgaggagttttcatgga

SEQ ID NO: 12385 - DNA, 25 bp, Rattus norvegicus
aaaggccctggcagatttcatccgc

SEQ ID NO: 12386 - DNA, 25 bp, Rattus norvegicus
aaaggccctggctgatttcatccgc

SEQ ID NO: 12387 - DNA, 25 bp, Rattus norvegicus
aaaggccctgggaactaagcatcct

SEQ ID NO: 12388 - DNA, 25 bp, Rattus norvegicus
aaaggccctgggtactaagcatcct

SEQ ID NO: 12389 - DNA, 25 bp, Rattus norvegicus
aaaggccctgtgacggtagacaaga

SEQ ID NO: 12390 - DNA, 25 bp, Rattus norvegicus
aaaggccctgtgtcggtagacaaga

SEQ ID NO: 12391 - DNA, 25 bp, Rattus norvegicus
aaaggcccttgcatgggtgtagtga

SEQ ID NO: 12392 - DNA, 25 bp, Rattus norvegicus
aaaggcccttgcttgggtgtagtga

SEQ ID NO: 12393 - DNA, 25 bp, Rattus norvegicus
aaaggccgaaatctagaccacactc

SEQ ID NO: 12394 - DNA, 25 bp, Rattus norvegicus
aaaggccgaaatgtagaccacactc

SEQ ID NO: 12395 - DNA, 25 bp, Rattus norvegicus
aaaggccgagcactgcaggagtcca

SEQ ID NO: 12396 - DNA, 25 bp, Rattus norvegicus
aaaggccgagcagtgcaggagtcca

SEQ ID NO: 12397 - DNA, 25 bp, Rattus norvegicus
aaaggccgagccagaagttcccaca

SEQ ID NO: 12398 - DNA, 25 bp, Rattus norvegicus
aaaggccgagcctgaagttcccaca

SEQ ID NO: 12399 - DNA, 25 bp, Rattus norvegicus
aaaggccgatagattgtccaggaca

SEQ ID NO: 12400 - DNA, 25 bp, Rattus norvegicus
aaaggccgatagtttgtccaggaca

SEQ ID NO: 12401 - DNA, 25 bp, Rattus norvegicus
aaaggccgcatgacaatccttccaa

SEQ ID NO: 12402 - DNA, 25 bp, Rattus norvegicus
aaaggccgcatgtcaatccttccaa

SEQ ID NO: 12403 - DNA, 25 bp, Rattus norvegicus
aaaggccgccgccattaatacggca

SEQ ID NO: 12404 - DNA, 25 bp, Rattus norvegicus
aaaggccgccgcgattaatacggca

SEQ ID NO: 12405 - DNA, 25 bp, Rattus norvegicus
aaaggccggtgtctgtaatctcttc

SEQ ID NO: 12406 - DNA, 25 bp, Rattus norvegicus
aaaggccggtgtgtgtaatctcttc

SEQ ID NO: 12407 - DNA, 25 bp, Rattus norvegicus
aaaggccgtgccatgttcttagtgt

SEQ ID NO: 12408 - DNA, 25 bp, Rattus norvegicus
aaaggccgtgccttgttcttagtgt

SEQ ID NO: 12409 - DNA, 25 bp, Rattus norvegicus
aaaggcctaactcaggtctgctggc

SEQ ID NO: 12410 - DNA, 25 bp, Rattus norvegicus
aaaggcctaactgaggtctgctggc

SEQ ID NO: 12411 - DNA, 25 bp, Rattus norvegicus
aaaggcctaagtcgccagccagact

SEQ ID NO: 12412 - DNA, 25 bp, Rattus norvegicus
aaaggcctaagtggccagccagact

SEQ ID NO: 12413 - DNA, 25 bp, Rattus norvegicus
aaaggcctacagaacacagacccat

SEQ ID NO: 12414 - DNA, 25 bp, Rattus norvegicus
aaaggcctacagtacacagacccat

SEQ ID NO: 12415 - DNA, 25 bp, Rattus norvegicus
aaaggcctagggatcaatacacagt

SEQ ID NO: 12416 - DNA, 25 bp, Rattus norvegicus
aaaggcctagggttcaatacacagt

SEQ ID NO: 12417 - DNA, 25 bp, Rattus norvegicus
aaaggcctcagtctcactcagtctt

SEQ ID NO: 12418 - DNA, 25 bp, Rattus norvegicus
aaaggcctcagtgtcactcagtctt

SEQ ID NO: 12419 - DNA, 25 bp, Rattus norvegicus
aaaggcctcattacaaatgcagcat

SEQ ID NO: 12420 - DNA, 25 bp, Rattus norvegicus
aaaggcctcattcatgtgatttagt

SEQ ID NO: 12421 - DNA, 25 bp, Rattus norvegicus
aaaggcctcattgatgtgatttagt

SEQ ID NO: 12422 - DNA, 25 bp, Rattus norvegicus
aaaggcctcatttcaaatgcagcat

SEQ ID NO: 12423 - DNA, 25 bp, Rattus norvegicus
aaaggcctccataagctcaggctgt

SEQ ID NO: 12424 - DNA, 25 bp, Rattus norvegicus
aaaggcctccattagctcaggctgt

SEQ ID NO: 12425 - DNA, 25 bp, Rattus norvegicus
aaaggcctccgtaggtgacaagtga

SEQ ID NO: 12426 - DNA, 25 bp, Rattus norvegicus
aaaggcctccgttggtgacaagtga

SEQ ID NO: 12427 - DNA, 25 bp, Rattus norvegicus
aaaggcctcgaccagcagcttgatg

SEQ ID NO: 12428 - DNA, 25 bp, Rattus norvegicus
aaaggcctcgacgagcagcttgatg

SEQ ID NO: 12429 - DNA, 25 bp, Rattus norvegicus
aaaggcctctccacattgcatatag

SEQ ID NO: 12430 - DNA, 25 bp, Rattus norvegicus
aaaggcctctcctcattgcatatag

SEQ ID NO: 12431 - DNA, 25 bp, Rattus norvegicus
aaaggcctctggattgattgtcatt

SEQ ID NO: 12432 - DNA, 25 bp, Rattus norvegicus
aaaggcctctggtttgattgtcatt

SEQ ID NO: 12433 - DNA, 25 bp, Rattus norvegicus
aaaggcctgaatctggaactccaac

SEQ ID NO: 12434 - DNA, 25 bp, Rattus norvegicus
aaaggcctgaatgtggaactccaac

SEQ ID NO: 12435 - DNA, 25 bp, Rattus norvegicus
aaaggcctgccaactgcatggcaaa

SEQ ID NO: 12436 - DNA, 25 bp, Rattus norvegicus
aaaggcctgccatctgcatggcaaa

SEQ ID NO: 12437 - DNA, 25 bp, Rattus norvegicus
aaaggcctgcttcctggactgttgg

SEQ ID NO: 12438 - DNA, 25 bp, Rattus norvegicus
aaaggcctgcttgctggactgttgg

SEQ ID NO: 12439 - DNA, 25 bp, Rattus norvegicus
aaaggcctggaaaatctccccaggt

SEQ ID NO: 12440 - DNA, 25 bp, Rattus norvegicus
aaaggcctggaatatctccccaggt

SEQ ID NO: 12441 - DNA, 25 bp, Rattus norvegicus
aaaggcctggcacctcaaacaagct

SEQ ID NO: 12442 - DNA, 25 bp, Rattus norvegicus
aaaggcctggcacttgtgcacgctg

SEQ ID NO: 12443 - DNA, 25 bp, Rattus norvegicus
aaaggcctggcagctcaaacaagct

SEQ ID NO: 12444 - DNA, 25 bp, Rattus norvegicus
aaaggcctggcagttgtgcacgctg

SEQ ID NO: 12445 - DNA, 25 bp, Rattus norvegicus
aaaggcctggctcgcagccttgttt

SEQ ID NO: 12446 - DNA, 25 bp, Rattus norvegicus
aaaggcctggctctcgtcaaaactg

SEQ ID NO: 12447 - DNA, 25 bp, Rattus norvegicus
aaaggcctggctggcagccttgttt

SEQ ID NO: 12448 - DNA, 25 bp, Rattus norvegicus
aaaggcctggctgtcgtcaaaactg

SEQ ID NO: 12449 - DNA, 25 bp, Rattus norvegicus
aaaggcctgtataaccatgctggta

SEQ ID NO: 12450 - DNA, 25 bp, Rattus norvegicus
aaaggcctgtattaccatgctggta

SEQ ID NO: 12451 - DNA, 25 bp, Rattus norvegicus
aaaggcctgtctccatttggagagc

SEQ ID NO: 12452 - DNA, 25 bp, Rattus norvegicus
aaaggcctgtctgcatttggagagc

SEQ ID NO: 12453 - DNA, 25 bp, Rattus norvegicus
aaaggcctgtgcatattttgtctag

SEQ ID NO: 12454 - DNA, 25 bp, Rattus norvegicus
aaaggcctgtgcttattttgtctag

SEQ ID NO: 12455 - DNA, 25 bp, Rattus norvegicus
aaaggcctgttcagctcttatttaa

SEQ ID NO: 12456 - DNA, 25 bp, Rattus norvegicus
aaaggcctgttctgctcttatttaa

SEQ ID NO: 12457 - DNA, 25 bp, Rattus norvegicus
aaaggccttatcagctgaacaccac

SEQ ID NO: 12458 - DNA, 25 bp, Rattus norvegicus
aaaggccttatctgctgaacaccac

SEQ ID NO: 12459 - DNA, 25 bp, Rattus norvegicus
aaaggccttatgacttgtatataca

SEQ ID NO: 12460 - DNA, 25 bp, Rattus norvegicus
aaaggccttatgtcttgtatataca

SEQ ID NO: 12461 - DNA, 25 bp, Rattus norvegicus
aaaggccttcacatttgaggaatgc

SEQ ID NO: 12462 - DNA, 25 bp, Rattus norvegicus
aaaggccttcacttttgaggaatgc

SEQ ID NO: 12463 - DNA, 25 bp, Rattus norvegicus
aaaggccttcagaccatctttcagg

SEQ ID NO: 12464 - DNA, 25 bp, Rattus norvegicus
aaaggccttcagtccatctttcagg

SEQ ID NO: 12465 - DNA, 25 bp, Rattus norvegicus
aaaggccttctccttctgtctaggg

SEQ ID NO: 12466 - DNA, 25 bp, Rattus norvegicus
aaaggccttctcgttctgtctaggg

SEQ ID NO: 12467 - DNA, 25 bp, Rattus norvegicus
aaaggccttgcaattgctgctctat

SEQ ID NO: 12468 - DNA, 25 bp, Rattus norvegicus
aaaggccttgcatttgctgctctat

SEQ ID NO: 12469 - DNA, 25 bp, Rattus norvegicus
aaaggccttggcaattatttgtata

SEQ ID NO: 12470 - DNA, 25 bp, Rattus norvegicus
aaaggccttggcagccggccaggct

SEQ ID NO: 12471 - DNA, 25 bp, Rattus norvegicus
aaaggccttggctattatttgtata

SEQ ID NO: 12472 - DNA, 25 bp, Rattus norvegicus
aaaggccttggctgccggccaggct

SEQ ID NO: 12473 - DNA, 25 bp, Rattus norvegicus
aaaggccttgttatcttggatgaca

SEQ ID NO: 12474 - DNA, 25 bp, Rattus norvegicus
aaaggccttgttttcttggatgaca

SEQ ID NO: 12475 - DNA, 25 bp, Rattus norvegicus
aaaggcgaagctcctcggctgccaa

SEQ ID NO: 12476 - DNA, 25 bp, Rattus norvegicus
aaaggcgaagctgctcggctgccaa

SEQ ID NO: 12477 - DNA, 25 bp, Rattus norvegicus
aaaggcgaagtgatacgaggctgta

SEQ ID NO: 12478 - DNA, 25 bp, Rattus norvegicus
aaaggcgaagtgttacgaggctgta

SEQ ID NO: 12479 - DNA, 25 bp, Rattus norvegicus
aaaggcgacgggatatccagcacca

SEQ ID NO: 12480 - DNA, 25 bp, Rattus norvegicus
aaaggcgacgggttatccagcacca

SEQ ID NO: 12481 - DNA, 25 bp, Rattus norvegicus
aaaggcgagctgacagggtcctcac

SEQ ID NO: 12482 - DNA, 25 bp, Rattus norvegicus
aaaggcgagctgtcagggtcctcac

SEQ ID NO: 12483 - DNA, 25 bp, Rattus norvegicus
aaaggcgatgtgatgacagcttcaa

SEQ ID NO: 12484 - DNA, 25 bp, Rattus norvegicus
aaaggcgatgtgttgacagcttcaa

SEQ ID NO: 12485 - DNA, 25 bp, Rattus norvegicus
aaaggcgcagatcagttgccgtact

SEQ ID NO: 12486 - DNA, 25 bp, Rattus norvegicus
aaaggcgcagatgagttgccgtact

SEQ ID NO: 12487 - DNA, 25 bp, Rattus norvegicus
aaaggcggaattatagggcacagag

SEQ ID NO: 12488 - DNA, 25 bp, Rattus norvegicus
aaaggcggaattttagggcacagag

SEQ ID NO: 12489 - DNA, 25 bp, Rattus norvegicus
aaaggcggagtcacctctgggagac

SEQ ID NO: 12490 - DNA, 25 bp, Rattus norvegicus
aaaggcggagtctcctctgggagac

SEQ ID NO: 12491 - DNA, 25 bp, Rattus norvegicus
aaaggcggatatagtctcattaaac

SEQ ID NO: 12492 - DNA, 25 bp, Rattus norvegicus
aaaggcggatattgtctcattaaac

SEQ ID NO: 12493 - DNA, 25 bp, Rattus norvegicus
aaaggcggcagcatcttgtcctgga

SEQ ID NO: 12494 - DNA, 25 bp, Rattus norvegicus
aaaggcggcagcttcttgtcctgga

SEQ ID NO: 12495 - DNA, 25 bp, Rattus norvegicus
aaaggcggcaggctcacgatgctaa

SEQ ID NO: 12496 - DNA, 25 bp, Rattus norvegicus
aaaggcggcagggtcacgatgctaa

SEQ ID NO: 12497 - DNA, 25 bp, Rattus norvegicus
aaaggcgggttcatgtgatgcgttc

SEQ ID NO: 12498 - DNA, 25 bp, Rattus norvegicus
aaaggcgggttcttgtgatgcgttc

SEQ ID NO: 12499 - DNA, 25 bp, Rattus norvegicus
aaaggcgtatttaggcactggtttg

SEQ ID NO: 12500 - DNA, 25 bp, Rattus norvegicus
aaaggcgtattttggcactggtttg

SEQ ID NO: 12501 - DNA, 25 bp, Rattus norvegicus
aaaggcgtcatgctggtactcaaaa

SEQ ID NO: 12502 - DNA, 25 bp, Rattus norvegicus
aaaggcgtcatggtggtactcaaaa

SEQ ID NO: 12503 - DNA, 25 bp, Rattus norvegicus
aaaggcgtgagcacatgcagtggct

SEQ ID NO: 12504 - DNA, 25 bp, Rattus norvegicus
aaaggcgtgagcatgtctgtgccaa

SEQ ID NO: 12505 - DNA, 25 bp, Rattus norvegicus
aaaggcgtgagctcatgcagtggct

SEQ ID NO: 12506 - DNA, 25 bp, Rattus norvegicus
aaaggcgtgagcttgtctgtgccaa

SEQ ID NO: 12507 - DNA, 25 bp, Rattus norvegicus
aaaggcgtgcacaggtgtgccctac

SEQ ID NO: 12508 - DNA, 25 bp, Rattus norvegicus
aaaggcgtgcactggtgtgccctac

SEQ ID NO: 12509 - DNA, 25 bp, Rattus norvegicus
aaaggcgtgcgccacaaccagcagc

SEQ ID NO: 12510 - DNA, 25 bp, Rattus norvegicus
aaaggcgtgcgcgacaaccagcagc

SEQ ID NO: 12511 - DNA, 25 bp, Rattus norvegicus
aaaggcgtggccaccctgatgctga

SEQ ID NO: 12512 - DNA, 25 bp, Rattus norvegicus
aaaggcgtggcctccctgatgctga

SEQ ID NO: 12513 - DNA, 25 bp, Rattus norvegicus
aaaggcgttcatcatcatccacacc

SEQ ID NO: 12514 - DNA, 25 bp, Rattus norvegicus
aaaggcgttcatcgaggctctccag

SEQ ID NO: 12515 - DNA, 25 bp, Rattus norvegicus
aaaggcgttcatgatcatccacacc

SEQ ID NO: 12516 - DNA, 25 bp, Rattus norvegicus
aaaggcgttcatggaggctctccag

SEQ ID NO: 12517 - DNA, 25 bp, Rattus norvegicus
aaaggcgttcctacggctcaggtag

SEQ ID NO: 12518 - DNA, 25 bp, Rattus norvegicus
aaaggcgttccttcggctcaggtag

SEQ ID NO: 12519 - DNA, 25 bp, Rattus norvegicus
aaaggcgttttcatcacagactctc

SEQ ID NO: 12520 - DNA, 25 bp, Rattus norvegicus
aaaggcgttttcttcacagactctc

SEQ ID NO: 12521 - DNA, 25 bp, Rattus norvegicus
aaaggctaaagcctggtgccagctt

SEQ ID NO: 12522 - DNA, 25 bp, Rattus norvegicus
aaaggctaaagcgtggtgccagctt

SEQ ID NO: 12523 - DNA, 25 bp, Rattus norvegicus
aaaggctaagttctgctgctgcttg

SEQ ID NO: 12524 - DNA, 25 bp, Rattus norvegicus
aaaggctaagttgtgctgctgcttg

SEQ ID NO: 12525 - DNA, 25 bp, Rattus norvegicus
aaaggctaccatcaccgaacagaga

SEQ ID NO: 12526 - DNA, 25 bp, Rattus norvegicus
aaaggctaccatgaccgaacagaga

SEQ ID NO: 12527 - DNA, 25 bp, Rattus norvegicus
aaaggctaccccactgagttctcaa

SEQ ID NO: 12528 - DNA, 25 bp, Rattus norvegicus
aaaggctacccctctgagttctcaa

SEQ ID NO: 12529 - DNA, 25 bp, Rattus norvegicus
aaaggctaccgtagctgcgtttgct

SEQ ID NO: 12530 - DNA, 25 bp, Rattus norvegicus
aaaggctaccgttgctgcgtttgct

SEQ ID NO: 12531 - DNA, 25 bp, Rattus norvegicus
aaaggctacgtcattcagatggaaa

SEQ ID NO: 12532 - DNA, 25 bp, Rattus norvegicus
aaaggctacgtctttcagatggaaa

SEQ ID NO: 12533 - DNA, 25 bp, Rattus norvegicus
aaaggctactacaggagggacgttg

SEQ ID NO: 12534 - DNA, 25 bp, Rattus norvegicus
aaaggctactactggagggacgttg

SEQ ID NO: 12535 - DNA, 25 bp, Rattus norvegicus
aaaggctactgcaggagcttgccca

SEQ ID NO: 12536 - DNA, 25 bp, Rattus norvegicus
aaaggctactgctggagcttgccca

SEQ ID NO: 12537 - DNA, 25 bp, Rattus norvegicus
aaaggctagagcatgtcagtggcat

SEQ ID NO: 12538 - DNA, 25 bp, Rattus norvegicus
aaaggctagagcttgtcagtggcat

SEQ ID NO: 12539 - DNA, 25 bp, Rattus norvegicus
aaaggctaggagagccctgggactc

SEQ ID NO: 12540 - DNA, 25 bp, Rattus norvegicus
aaaggctaggagtgccctgggactc

SEQ ID NO: 12541 - DNA, 25 bp, Rattus norvegicus
aaaggctatcctcctgaagacatct

SEQ ID NO: 12542 - DNA, 25 bp, Rattus norvegicus
aaaggctatcctgctgaagacatct

SEQ ID NO: 12543 - DNA, 25 bp, Rattus norvegicus
aaaggctatctgctgagctgcttgt

SEQ ID NO: 12544 - DNA, 25 bp, Rattus norvegicus
aaaggctatctgctgtgtagccccg

SEQ ID NO: 12545 - DNA, 25 bp, Rattus norvegicus
aaaggctatctggtgagctgcttgt

SEQ ID NO: 12546 - DNA, 25 bp, Rattus norvegicus
aaaggctatctggtgtgtagccccg

SEQ ID NO: 12547 - DNA, 25 bp, Rattus norvegicus
aaaggctatgtcagctctagctctc

SEQ ID NO: 12548 - DNA, 25 bp, Rattus norvegicus
aaaggctatgtctgctctagctctc

SEQ ID NO: 12549 - DNA, 25 bp, Rattus norvegicus
aaaggctatgttaggcgctcagctg

SEQ ID NO: 12550 - DNA, 25 bp, Rattus norvegicus
aaaggctatgttctcttggctcgga

SEQ ID NO: 12551 - DNA, 25 bp, Rattus norvegicus
aaaggctatgttgtcttggctcgga

SEQ ID NO: 12552 - DNA, 25 bp, Rattus norvegicus
aaaggctatgtttggcgctcagctg

SEQ ID NO: 12553 - DNA, 25 bp, Rattus norvegicus
aaaggctatttcatggagctggaga

SEQ ID NO: 12554 - DNA, 25 bp, Rattus norvegicus
aaaggctatttcttggagctggaga

SEQ ID NO: 12555 - DNA, 25 bp, Rattus norvegicus
aaaggctcaaaacttgcccttcagc

SEQ ID NO: 12556 - DNA, 25 bp, Rattus norvegicus
aaaggctcaaaagttgcccttcagc

SEQ ID NO: 12557 - DNA, 25 bp, Rattus norvegicus
aaaggctcaaccaacttgcagctgg

SEQ ID NO: 12558 - DNA, 25 bp, Rattus norvegicus
aaaggctcaacctacttgcagctgg

SEQ ID NO: 12559 - DNA, 25 bp, Rattus norvegicus
aaaggctcaatcctcactttgtaac

SEQ ID NO: 12560 - DNA, 25 bp, Rattus norvegicus
aaaggctcaatcgtcactttgtaac

SEQ ID NO: 12561 - DNA, 25 bp, Rattus norvegicus
aaaggctcacatccatgacagtctt

SEQ ID NO: 12562 - DNA, 25 bp, Rattus norvegicus
aaaggctcacatgcatgacagtctt

SEQ ID NO: 12563 - DNA, 25 bp, Rattus norvegicus
aaaggctcagagaaccgatgggcag

SEQ ID NO: 12564 - DNA, 25 bp, Rattus norvegicus
aaaggctcagagtaccgatgggcag

SEQ ID NO: 12565 - DNA, 25 bp, Rattus norvegicus
aaaggctcagttagcctccagtgtc

SEQ ID NO: 12566 - DNA, 25 bp, Rattus norvegicus
aaaggctcagtttgcctccagtgtc

SEQ ID NO: 12567 - DNA, 25 bp, Rattus norvegicus
aaaggctccactcgctactaacaaa

SEQ ID NO: 12568 - DNA, 25 bp, Rattus norvegicus
aaaggctccactggctactaacaaa

SEQ ID NO: 12569 - DNA, 25 bp, Rattus norvegicus
aaaggctcccatatgaggccatccc

SEQ ID NO: 12570 - DNA, 25 bp, Rattus norvegicus
aaaggctcccatttgaggccatccc

SEQ ID NO: 12571 - DNA, 25 bp, Rattus norvegicus
aaaggctccctgcattgctgtgaga

SEQ ID NO: 12572 - DNA, 25 bp, Rattus norvegicus
aaaggctccctggattgctgtgaga

SEQ ID NO: 12573 - DNA, 25 bp, Rattus norvegicus
aaaggctccgagattgagatcccgg

SEQ ID NO: 12574 - DNA, 25 bp, Rattus norvegicus
aaaggctccgagtttgagatcccgg

SEQ ID NO: 12575 - DNA, 25 bp, Rattus norvegicus
aaaggctcctgaacacttctttact

SEQ ID NO: 12576 - DNA, 25 bp, Rattus norvegicus
aaaggctcctgatcacttctttact

SEQ ID NO: 12577 - DNA, 25 bp, Rattus norvegicus
aaaggctccttcaagacctgttctg

SEQ ID NO: 12578 - DNA, 25 bp, Rattus norvegicus
aaaggctccttcacagcttcagcgg

SEQ ID NO: 12579 - DNA, 25 bp, Rattus norvegicus
aaaggctccttctagacctgttctg

SEQ ID NO: 12580 - DNA, 25 bp, Rattus norvegicus
aaaggctccttctcagcttcagcgg

SEQ ID NO: 12581 - DNA, 25 bp, Rattus norvegicus
aaaggctcgactcgagattgaacca

SEQ ID NO: 12582 - DNA, 25 bp, Rattus norvegicus
aaaggctcgactggagattgaacca

SEQ ID NO: 12583 - DNA, 25 bp, Rattus norvegicus
aaaggctctatgcaacttttctcaa

SEQ ID NO: 12584 - DNA, 25 bp, Rattus norvegicus
aaaggctctatggaacttttctcaa

SEQ ID NO: 12585 - DNA, 25 bp, Rattus norvegicus
aaaggctctgccacttcagggaccc

SEQ ID NO: 12586 - DNA, 25 bp, Rattus norvegicus
aaaggctctgcctcttcagggaccc

SEQ ID NO: 12587 - DNA, 25 bp, Rattus norvegicus
aaaggctctggccatttgccggcga

SEQ ID NO: 12588 - DNA, 25 bp, Rattus norvegicus
aaaggctctggcgatttgccggcga

SEQ ID NO: 12589 - DNA, 25 bp, Rattus norvegicus
aaaggctcttatactctttctctct

SEQ ID NO: 12590 - DNA, 25 bp, Rattus norvegicus
aaaggctcttattctctttctctct

SEQ ID NO: 12591 - DNA, 25 bp, Rattus norvegicus
aaaggctcttgtagaagttgggtat

SEQ ID NO: 12592 - DNA, 25 bp, Rattus norvegicus
aaaggctcttgttgaagttgggtat

SEQ ID NO: 12593 - DNA, 25 bp, Rattus norvegicus
aaaggctctttcagtcaagtatgat

SEQ ID NO: 12594 - DNA, 25 bp, Rattus norvegicus
aaaggctctttctgtcaagtatgat

SEQ ID NO: 12595 - DNA, 25 bp, Rattus norvegicus
aaaggctgacaaaacgggcacttcc

SEQ ID NO: 12596 - DNA, 25 bp, Rattus norvegicus
aaaggctgacaatacgggcacttcc

SEQ ID NO: 12597 - DNA, 25 bp, Rattus norvegicus
aaaggctgacttacgtttacctcat

SEQ ID NO: 12598 - DNA, 25 bp, Rattus norvegicus
aaaggctgactttcgtttacctcat

SEQ ID NO: 12599 - DNA, 25 bp, Rattus norvegicus
aaaggctgagcgaggttcccagtct

SEQ ID NO: 12600 - DNA, 25 bp, Rattus norvegicus
aaaggctgagcgtggttcccagtct

SEQ ID NO: 12601 - DNA, 25 bp, Rattus norvegicus
aaaggctgagctcggccagctgatc

SEQ ID NO: 12602 - DNA, 25 bp, Rattus norvegicus
aaaggctgagctgggccagctgatc

SEQ ID NO: 12603 - DNA, 25 bp, Rattus norvegicus
aaaggctgataccatgttgctctaa

SEQ ID NO: 12604 - DNA, 25 bp, Rattus norvegicus
aaaggctgatacgatgttgctctaa

SEQ ID NO: 12605 - DNA, 25 bp, Rattus norvegicus
aaaggctgatctcagattgggccag

SEQ ID NO: 12606 - DNA, 25 bp, Rattus norvegicus
aaaggctgatctgagattgggccag

SEQ ID NO: 12607 - DNA, 25 bp, Rattus norvegicus
aaaggctgatgcagcttcagctcta

SEQ ID NO: 12608 - DNA, 25 bp, Rattus norvegicus
aaaggctgatgctgcttcagctcta

SEQ ID NO: 12609 - DNA, 25 bp, Rattus norvegicus
aaaggctgcaatatcttgttcacca

SEQ ID NO: 12610 - DNA, 25 bp, Rattus norvegicus
aaaggctgcaatttcttgttcacca

SEQ ID NO: 12611 - DNA, 25 bp, Rattus norvegicus
aaaggctgcaccactgcaatcggct

SEQ ID NO: 12612 - DNA, 25 bp, Rattus norvegicus
aaaggctgcacctctgcaatcggct

SEQ ID NO: 12613 - DNA, 25 bp, Rattus norvegicus
aaaggctgccagactcaaaatcccg

SEQ ID NO: 12614 - DNA, 25 bp, Rattus norvegicus
aaaggctgccagtctcaaaatcccg

SEQ ID NO: 12615 - DNA, 25 bp, Rattus norvegicus
aaaggctgccctaaagcagttgcag

SEQ ID NO: 12616 - DNA, 25 bp, Rattus norvegicus
aaaggctgcccttaagcagttgcag

SEQ ID NO: 12617 - DNA, 25 bp, Rattus norvegicus
aaaggctgctaaatgtccacatctg

SEQ ID NO: 12618 - DNA, 25 bp, Rattus norvegicus
aaaggctgctaattgtccacatctg

SEQ ID NO: 12619 - DNA, 25 bp, Rattus norvegicus
aaaggctgctccattgggctctgtg

SEQ ID NO: 12620 - DNA, 25 bp, Rattus norvegicus
aaaggctgctcctttgggctctgtg

SEQ ID NO: 12621 - DNA, 25 bp, Rattus norvegicus
aaaggctgctctactgaaccagcac

SEQ ID NO: 12622 - DNA, 25 bp, Rattus norvegicus
aaaggctgctcttctgaaccagcac

SEQ ID NO: 12623 - DNA, 25 bp, Rattus norvegicus
aaaggctgctttatattcctggtgc

SEQ ID NO: 12624 - DNA, 25 bp, Rattus norvegicus
aaaggctgctttttattcctggtgc

SEQ ID NO: 12625 - DNA, 25 bp, Rattus norvegicus
aaaggctggaacaggtacggctgcc

SEQ ID NO: 12626 - DNA, 25 bp, Rattus norvegicus
aaaggctggaactggtacggctgcc

SEQ ID NO: 12627 - DNA, 25 bp, Rattus norvegicus
aaaggctggagacaccccactgtag

SEQ ID NO: 12628 - DNA, 25 bp, Rattus norvegicus
aaaggctggagagaccccactgtag

SEQ ID NO: 12629 - DNA, 25 bp, Rattus norvegicus
aaaggctggcagatcctgttgtgaa

SEQ ID NO: 12630 - DNA, 25 bp, Rattus norvegicus
aaaggctggcagttcctgttgtgaa

SEQ ID NO: 12631 - DNA, 25 bp, Rattus norvegicus
aaaggctggcttcagttgacaccca

SEQ ID NO: 12632 - DNA, 25 bp, Rattus norvegicus
aaaggctggcttgagttgacaccca

SEQ ID NO: 12633 - DNA, 25 bp, Rattus norvegicus
aaaggctgtcctccacaagagtata

SEQ ID NO: 12634 - DNA, 25 bp, Rattus norvegicus
aaaggctgtcctgcacaagagtata

SEQ ID NO: 12635 - DNA, 25 bp, Rattus norvegicus
aaaggctgtcttctttgcctgtgca

SEQ ID NO: 12636 - DNA, 25 bp, Rattus norvegicus
aaaggctgtcttgtttgcctgtgca

SEQ ID NO: 12637 - DNA, 25 bp, Rattus norvegicus
aaaggctgtgagacccaactgttgg

SEQ ID NO: 12638 - DNA, 25 bp, Rattus norvegicus
aaaggctgtgagtcccaactgttgg

SEQ ID NO: 12639 - DNA, 25 bp, Rattus norvegicus
aaaggctgtgccattcattccatgc

SEQ ID NO: 12640 - DNA, 25 bp, Rattus norvegicus
aaaggctgtgcctttcattccatgc

SEQ ID NO: 12641 - DNA, 25 bp, Rattus norvegicus
aaaggctgtggactcttctctaggc

SEQ ID NO: 12642 - DNA, 25 bp, Rattus norvegicus
aaaggctgtggagtcttctctaggc

SEQ ID NO: 12643 - DNA, 25 bp, Rattus norvegicus
aaaggctgtgggatagaggctctct

SEQ ID NO: 12644 - DNA, 25 bp, Rattus norvegicus
aaaggctgtgggttagaggctctct

SEQ ID NO: 12645 - DNA, 25 bp, Rattus norvegicus
aaaggctgtgtgcatctcagctcct

SEQ ID NO: 12646 - DNA, 25 bp, Rattus norvegicus
aaaggctgtgtggatctcagctcct

SEQ ID NO: 12647 - DNA, 25 bp, Rattus norvegicus
aaaggcttaattctgctcacgggca

SEQ ID NO: 12648 - DNA, 25 bp, Rattus norvegicus
aaaggcttaattgtgctcacgggca

SEQ ID NO: 12649 - DNA, 25 bp, Rattus norvegicus
aaaggcttagccatcttttcctggg

SEQ ID NO: 12650 - DNA, 25 bp, Rattus norvegicus
aaaggcttagccttcttttcctggg

SEQ ID NO: 12651 - DNA, 25 bp, Rattus norvegicus
aaaggcttagtcaaggccagtgaag

SEQ ID NO: 12652 - DNA, 25 bp, Rattus norvegicus
aaaggcttagtctaggccagtgaag

SEQ ID NO: 12653 - DNA, 25 bp, Rattus norvegicus
aaaggcttcactccttttgcatgca

SEQ ID NO: 12654 - DNA, 25 bp, Rattus norvegicus
aaaggcttcactgcttttgcatgca

SEQ ID NO: 12655 - DNA, 25 bp, Rattus norvegicus
aaaggcttcagccagagctcacatc

SEQ ID NO: 12656 - DNA, 25 bp, Rattus norvegicus
aaaggcttcagcgagagctcacatc

SEQ ID NO: 12657 - DNA, 25 bp, Rattus norvegicus
aaaggcttcattaccattgttgatg

SEQ ID NO: 12658 - DNA, 25 bp, Rattus norvegicus
aaaggcttcattcaattttatgcta

SEQ ID NO: 12659 - DNA, 25 bp, Rattus norvegicus
aaaggcttcattgaattttatgcta

SEQ ID NO: 12660 - DNA, 25 bp, Rattus norvegicus
aaaggcttcatttccattgttgatg

SEQ ID NO: 12661 - DNA, 25 bp, Rattus norvegicus
aaaggcttcccgagactgataacag

SEQ ID NO: 12662 - DNA, 25 bp, Rattus norvegicus
aaaggcttcccgtgactgataacag

SEQ ID NO: 12663 - DNA, 25 bp, Rattus norvegicus
aaaggcttccgtagaggccctggtg

SEQ ID NO: 12664 - DNA, 25 bp, Rattus norvegicus
aaaggcttccgttgaggccctggtg

SEQ ID NO: 12665 - DNA, 25 bp, Rattus norvegicus
aaaggcttcctccaaaacatgaaat

SEQ ID NO: 12666 - DNA, 25 bp, Rattus norvegicus
aaaggcttcctcgaaaacatgaaat

SEQ ID NO: 12667 - DNA, 25 bp, Rattus norvegicus
aaaggcttcgagaagttgaacatca

SEQ ID NO: 12668 - DNA, 25 bp, Rattus norvegicus
aaaggcttcgagtagttgaacatca

SEQ ID NO: 12669 - DNA, 25 bp, Rattus norvegicus
aaaggcttcgatctagcacaggtca

SEQ ID NO: 12670 - DNA, 25 bp, Rattus norvegicus
aaaggcttcgatgtagcacaggtca

SEQ ID NO: 12671 - DNA, 25 bp, Rattus norvegicus
aaaggcttctccaggaacagcgaca

SEQ ID NO: 12672 - DNA, 25 bp, Rattus norvegicus
aaaggcttctcctggaacagcgaca

SEQ ID NO: 12673 - DNA, 25 bp, Rattus norvegicus
aaaggcttctgacgcctgatggtca

SEQ ID NO: 12674 - DNA, 25 bp, Rattus norvegicus
aaaggcttctgaggcctgatggtca

SEQ ID NO: 12675 - DNA, 25 bp, Rattus norvegicus
aaaggcttctgtaaactggcttctt

SEQ ID NO: 12676 - DNA, 25 bp, Rattus norvegicus
aaaggcttctgttaactggcttctt

SEQ ID NO: 12677 - DNA, 25 bp, Rattus norvegicus
aaaggcttgatcagtgagtcactcc

SEQ ID NO: 12678 - DNA, 25 bp, Rattus norvegicus
aaaggcttgatctgtgagtcactcc

SEQ ID NO: 12679 - DNA, 25 bp, Rattus norvegicus
aaaggcttgcgcactggaggcacgc

SEQ ID NO: 12680 - DNA, 25 bp, Rattus norvegicus
aaaggcttgcgctctggaggcacgc

SEQ ID NO: 12681 - DNA, 25 bp, Rattus norvegicus
aaaggcttgctcactgtgctgctca

SEQ ID NO: 12682 - DNA, 25 bp, Rattus norvegicus
aaaggcttgctccagtgttctttgc

SEQ ID NO: 12683 - DNA, 25 bp, Rattus norvegicus
aaaggcttgctcgagtgttctttgc

SEQ ID NO: 12684 - DNA, 25 bp, Rattus norvegicus
aaaggcttgctctctgtgctgctca

SEQ ID NO: 12685 - DNA, 25 bp, Rattus norvegicus
aaaggcttgcttagaggtgtttttg

SEQ ID NO: 12686 - DNA, 25 bp, Rattus norvegicus
aaaggcttgctttgaggtgtttttg

SEQ ID NO: 12687 - DNA, 25 bp, Rattus norvegicus
aaaggcttggagatcgcccaacact

SEQ ID NO: 12688 - DNA, 25 bp, Rattus norvegicus
aaaggcttggagttcgcccaacact

SEQ ID NO: 12689 - DNA, 25 bp, Rattus norvegicus
aaaggcttgggaatgtgtgcacacc

SEQ ID NO: 12690 - DNA, 25 bp, Rattus norvegicus
aaaggcttgggattgtgtgcacacc

SEQ ID NO: 12691 - DNA, 25 bp, Rattus norvegicus
aaaggcttgggtcaggtcttgaact

SEQ ID NO: 12692 - DNA, 25 bp, Rattus norvegicus
aaaggcttgggtgaggtcttgaact

SEQ ID NO: 12693 - DNA, 25 bp, Rattus norvegicus
aaaggcttgtctcgacttccagtaa

SEQ ID NO: 12694 - DNA, 25 bp, Rattus norvegicus
aaaggcttgtctggacttccagtaa

SEQ ID NO: 12695 - DNA, 25 bp, Rattus norvegicus
aaaggctttaagcaactcatgacta

SEQ ID NO: 12696 - DNA, 25 bp, Rattus norvegicus
aaaggctttaaggaactcatgacta

SEQ ID NO: 12697 - DNA, 25 bp, Rattus norvegicus
aaaggctttagcagttggaggacta

SEQ ID NO: 12698 - DNA, 25 bp, Rattus norvegicus
aaaggctttagctgttggaggacta

SEQ ID NO: 12699 - DNA, 25 bp, Rattus norvegicus
aaaggctttcagagcagttttgtta

SEQ ID NO: 12700 - DNA, 25 bp, Rattus norvegicus
aaaggctttcagtgcagttttgtta

SEQ ID NO: 12701 - DNA, 25 bp, Rattus norvegicus
aaaggctttgcaacagcagagagct

SEQ ID NO: 12702 - DNA, 25 bp, Rattus norvegicus
aaaggctttgcatcagcagagagct

SEQ ID NO: 12703 - DNA, 25 bp, Rattus norvegicus
aaaggctttgttatccctggactga

SEQ ID NO: 12704 - DNA, 25 bp, Rattus norvegicus
aaaggctttgttcctctctgttctg

SEQ ID NO: 12705 - DNA, 25 bp, Rattus norvegicus
aaaggctttgttgctctctgttctg

SEQ ID NO: 12706 - DNA, 25 bp, Rattus norvegicus
aaaggctttgttttccctggactga

SEQ ID NO: 12707 - DNA, 25 bp, Rattus norvegicus
aaaggctttttacttctcacaggat

SEQ ID NO: 12708 - DNA, 25 bp, Rattus norvegicus
aaaggctttttagttctcacaggat

SEQ ID NO: 12709 - DNA, 25 bp, Rattus norvegicus
aaagggaaactcacctgtgtcctgg

SEQ ID NO: 12710 - DNA, 25 bp, Rattus norvegicus
aaagggaaactctcctgtgtcctgg

SEQ ID NO: 12711 - DNA, 25 bp, Rattus norvegicus
aaagggaacaggccagctgacactg

SEQ ID NO: 12712 - DNA, 25 bp, Rattus norvegicus
aaagggaacagggcagctgacactg

SEQ ID NO: 12713 - DNA, 25 bp, Rattus norvegicus
aaagggaaccacacacttctttgtg

SEQ ID NO: 12714 - DNA, 25 bp, Rattus norvegicus
aaagggaaccactcacttctttgtg

SEQ ID NO: 12715 - DNA, 25 bp, Rattus norvegicus
aaagggaacctgcaataatcttggg

SEQ ID NO: 12716 - DNA, 25 bp, Rattus norvegicus
aaagggaacctggaataatcttggg

SEQ ID NO: 12717 - DNA, 25 bp, Rattus norvegicus
aaagggaactgcatcctgtcattgc

SEQ ID NO: 12718 - DNA, 25 bp, Rattus norvegicus
aaagggaactgcttcctgtcattgc

SEQ ID NO: 12719 - DNA, 25 bp, Rattus norvegicus
aaagggaagactatcttgcgctcat

SEQ ID NO: 12720 - DNA, 25 bp, Rattus norvegicus
aaagggaagactttcttgcgctcat

SEQ ID NO: 12721 - DNA, 25 bp, Rattus norvegicus
aaagggaagttcaccccactagcag

SEQ ID NO: 12722 - DNA, 25 bp, Rattus norvegicus
aaagggaagttctccccactagcag

SEQ ID NO: 12723 - DNA, 25 bp, Rattus norvegicus
aaagggaattctcaccatgtctctc

SEQ ID NO: 12724 - DNA, 25 bp, Rattus norvegicus
aaagggaattctgaccatgtctctc

SEQ ID NO: 12725 - DNA, 25 bp, Rattus norvegicus
aaagggacaccacctatccttagca

SEQ ID NO: 12726 - DNA, 25 bp, Rattus norvegicus
aaagggacaccagctatccttagca

SEQ ID NO: 12727 - DNA, 25 bp, Rattus norvegicus
aaagggacacctaccaatctggagc

SEQ ID NO: 12728 - DNA, 25 bp, Rattus norvegicus
aaagggacaccttccaatctggagc

SEQ ID NO: 12729 - DNA, 25 bp, Rattus norvegicus
aaagggacacttcgattgccagaga

SEQ ID NO: 12730 - DNA, 25 bp, Rattus norvegicus
aaagggacacttggattgccagaga

SEQ ID NO: 12731 - DNA, 25 bp, Rattus norvegicus
aaagggacattgctacctgctttcc

SEQ ID NO: 12732 - DNA, 25 bp, Rattus norvegicus
aaagggacattggtacctgctttcc

SEQ ID NO: 12733 - DNA, 25 bp, Rattus norvegicus
aaagggaccagacgaatccttcact

SEQ ID NO: 12734 - DNA, 25 bp, Rattus norvegicus
aaagggaccagaggaatccttcact

SEQ ID NO: 12735 - DNA, 25 bp, Rattus norvegicus
aaagggacccaccacaatgacaatg

SEQ ID NO: 12736 - DNA, 25 bp, Rattus norvegicus
aaagggacccacgacaatgacaatg

SEQ ID NO: 12737 - DNA, 25 bp, Rattus norvegicus
aaagggaccgctatgtcacaaatgc

SEQ ID NO: 12738 - DNA, 25 bp, Rattus norvegicus
aaagggaccgctttgtcacaaatgc

SEQ ID NO: 12739 - DNA, 25 bp, Rattus norvegicus
aaagggacgatactgctgtgcatga

SEQ ID NO: 12740 - DNA, 25 bp, Rattus norvegicus
aaagggacgatagtgctgtgcatga

SEQ ID NO: 12741 - DNA, 25 bp, Rattus norvegicus
aaagggacgcttctttcagaaacat

SEQ ID NO: 12742 - DNA, 25 bp, Rattus norvegicus
aaagggacgcttgtttcagaaacat

SEQ ID NO: 12743 - DNA, 25 bp, Rattus norvegicus
aaagggactcaacgtgcctaccact

SEQ ID NO: 12744 - DNA, 25 bp, Rattus norvegicus
aaagggactcaaggtgcctaccact

SEQ ID NO: 12745 - DNA, 25 bp, Rattus norvegicus
aaagggactccaagcaccgagatgt

SEQ ID NO: 12746 - DNA, 25 bp, Rattus norvegicus
aaagggactccatgcaccgagatgt

SEQ ID NO: 12747 - DNA, 25 bp, Rattus norvegicus
aaagggactgcaccctgtgacacaa

SEQ ID NO: 12748 - DNA, 25 bp, Rattus norvegicus
aaagggactgcagcctgtgacacaa

SEQ ID NO: 12749 - DNA, 25 bp, Rattus norvegicus
aaagggactgtaaccctgtggcggc

SEQ ID NO: 12750 - DNA, 25 bp, Rattus norvegicus
aaagggactgtatccctgtggcggc

SEQ ID NO: 12751 - DNA, 25 bp, Rattus norvegicus
aaagggacttgcactgactttgggt

SEQ ID NO: 12752 - DNA, 25 bp, Rattus norvegicus
aaagggacttgctctgactttgggt

SEQ ID NO: 12753 - DNA, 25 bp, Rattus norvegicus
aaagggacttttagcccaggcagtg

SEQ ID NO: 12754 - DNA, 25 bp, Rattus norvegicus
aaagggactttttgcccaggcagtg

SEQ ID NO: 12755 - DNA, 25 bp, Rattus norvegicus
aaagggagcaccagacatcgcaagt

SEQ ID NO: 12756 - DNA, 25 bp, Rattus norvegicus
aaagggagcacctgacatcgcaagt

SEQ ID NO: 12757 - DNA, 25 bp, Rattus norvegicus
aaagggagcagcagcttacctgaca

SEQ ID NO: 12758 - DNA, 25 bp, Rattus norvegicus
aaagggagcagctgcttacctgaca

SEQ ID NO: 12759 - DNA, 25 bp, Rattus norvegicus
aaagggagcatccagatggcagtct

SEQ ID NO: 12760 - DNA, 25 bp, Rattus norvegicus
aaagggagcatcgagatggcagtct

SEQ ID NO: 12761 - DNA, 25 bp, Rattus norvegicus
aaagggagccttcatctttctgatc

SEQ ID NO: 12762 - DNA, 25 bp, Rattus norvegicus
aaagggagccttgatctttctgatc

SEQ ID NO: 12763 - DNA, 25 bp, Rattus norvegicus
aaagggagcggcacgctcatcaaca

SEQ ID NO: 12764 - DNA, 25 bp, Rattus norvegicus
aaagggagcggctcgctcatcaaca

SEQ ID NO: 12765 - DNA, 25 bp, Rattus norvegicus
aaagggagctcacggtcttctccac

SEQ ID NO: 12766 - DNA, 25 bp, Rattus norvegicus
aaagggagctcagggtcttctccac

SEQ ID NO: 12767 - DNA, 25 bp, Rattus norvegicus
aaagggagtttcaccagtcactggg

SEQ ID NO: 12768 - DNA, 25 bp, Rattus norvegicus
aaagggagtttctccagtcactggg

SEQ ID NO: 12769 - DNA, 25 bp, Rattus norvegicus
aaagggatagcaactgccctgtggc

SEQ ID NO: 12770 - DNA, 25 bp, Rattus norvegicus
aaagggatagcatctgccctgtggc

SEQ ID NO: 12771 - DNA, 25 bp, Rattus norvegicus
aaagggatagctcgtgcattttaac

SEQ ID NO: 12772 - DNA, 25 bp, Rattus norvegicus
aaagggatagctggtgcattttaac

SEQ ID NO: 12773 - DNA, 25 bp, Rattus norvegicus
aaagggatccaactggcctccaagg

SEQ ID NO: 12774 - DNA, 25 bp, Rattus norvegicus
aaagggatccaagtggcctccaagg

SEQ ID NO: 12775 - DNA, 25 bp, Rattus norvegicus
aaagggatcgacaactggaaggctc

SEQ ID NO: 12776 - DNA, 25 bp, Rattus norvegicus
aaagggatcgactactggaaggctc

SEQ ID NO: 12777 - DNA, 25 bp, Rattus norvegicus
aaagggatgttgaccagatgatgca

SEQ ID NO: 12778 - DNA, 25 bp, Rattus norvegicus
aaagggatgttgtccagatgatgca

SEQ ID NO: 12779 - DNA, 25 bp, Rattus norvegicus
aaagggattactccctgccagatct

SEQ ID NO: 12780 - DNA, 25 bp, Rattus norvegicus
aaagggattactgcctgccagatct

SEQ ID NO: 12781 - DNA, 25 bp, Rattus norvegicus
aaagggattctaccaacaatatttg

SEQ ID NO: 12782 - DNA, 25 bp, Rattus norvegicus
aaagggattctagcaacaatatttg

SEQ ID NO: 12783 - DNA, 25 bp, Rattus norvegicus
aaagggattgagctggcctatctta

SEQ ID NO: 12784 - DNA, 25 bp, Rattus norvegicus
aaagggattgaggtggcctatctta

SEQ ID NO: 12785 - DNA, 25 bp, Rattus norvegicus
aaagggattggccatgttctccgat

SEQ ID NO: 12786 - DNA, 25 bp, Rattus norvegicus
aaagggattggcgatgttctccgat

SEQ ID NO: 12787 - DNA, 25 bp, Rattus norvegicus
aaagggattgtgatgctagctgcat

SEQ ID NO: 12788 - DNA, 25 bp, Rattus norvegicus
aaagggattgtgttgctagctgcat

SEQ ID NO: 12789 - DNA, 25 bp, Rattus norvegicus
aaagggcaacccaaagagattgatt

SEQ ID NO: 12790 - DNA, 25 bp, Rattus norvegicus
aaagggcaaccctaagagattgatt

SEQ ID NO: 12791 - DNA, 25 bp, Rattus norvegicus
aaagggcaacctcttcagaaaatga

SEQ ID NO: 12792 - DNA, 25 bp, Rattus norvegicus
aaagggcaacctgttcagaaaatga

SEQ ID NO: 12793 - DNA, 25 bp, Rattus norvegicus
aaagggcaactcatgtagtacactt

SEQ ID NO: 12794 - DNA, 25 bp, Rattus norvegicus
aaagggcaactcttgtagtacactt

SEQ ID NO: 12795 - DNA, 25 bp, Rattus norvegicus
aaagggcaagatcaggcacctgttc

SEQ ID NO: 12796 - DNA, 25 bp, Rattus norvegicus
aaagggcaagatgaggcacctgttc

SEQ ID NO: 12797 - DNA, 25 bp, Rattus norvegicus
aaagggcacagcaagcccttcttgg

SEQ ID NO: 12798 - DNA, 25 bp, Rattus norvegicus
aaagggcacagctagcccttcttgg

SEQ ID NO: 12799 - DNA, 25 bp, Rattus norvegicus
aaagggcacatcagaattttatagt

SEQ ID NO: 12800 - DNA, 25 bp, Rattus norvegicus
aaagggcacatcatgtagttccatt

SEQ ID NO: 12801 - DNA, 25 bp, Rattus norvegicus
aaagggcacatctgaattttatagt

SEQ ID NO: 12802 - DNA, 25 bp, Rattus norvegicus
aaagggcacatcttgtagttccatt

SEQ ID NO: 12803 - DNA, 25 bp, Rattus norvegicus
aaagggcacgtgactcatctgttca

SEQ ID NO: 12804 - DNA, 25 bp, Rattus norvegicus
aaagggcacgtgtctcatctgttca

SEQ ID NO: 12805 - DNA, 25 bp, Rattus norvegicus
aaagggcagactctctaagctctca

SEQ ID NO: 12806 - DNA, 25 bp, Rattus norvegicus
aaagggcagactgtctaagctctca

SEQ ID NO: 12807 - DNA, 25 bp, Rattus norvegicus
aaagggcagcctcttgccctgagga

SEQ ID NO: 12808 - DNA, 25 bp, Rattus norvegicus
aaagggcagcctgttgccctgagga

SEQ ID NO: 12809 - DNA, 25 bp, Rattus norvegicus
aaagggcagcttccaccctggtggt

SEQ ID NO: 12810 - DNA, 25 bp, Rattus norvegicus
aaagggcagcttgcaccctggtggt

SEQ ID NO: 12811 - DNA, 25 bp, Rattus norvegicus
aaagggcaggcaaccacagccagca

SEQ ID NO: 12812 - DNA, 25 bp, Rattus norvegicus
aaagggcaggcatccacagccagca

SEQ ID NO: 12813 - DNA, 25 bp, Rattus norvegicus
aaagggcaggttaggcctctctgct

SEQ ID NO: 12814 - DNA, 25 bp, Rattus norvegicus
aaagggcaggtttggcctctctgct

SEQ ID NO: 12815 - DNA, 25 bp, Rattus norvegicus
aaagggcagtgcacaacatagggta

SEQ ID NO: 12816 - DNA, 25 bp, Rattus norvegicus
aaagggcagtgctcaacatagggta

SEQ ID NO: 12817 - DNA, 25 bp, Rattus norvegicus
aaagggcatagcaggacactcctgc

SEQ ID NO: 12818 - DNA, 25 bp, Rattus norvegicus
aaagggcatagctggacactcctgc

SEQ ID NO: 12819 - DNA, 25 bp, Rattus norvegicus
aaagggcatcatagctgctggagct

SEQ ID NO: 12820 - DNA, 25 bp, Rattus norvegicus
aaagggcatcattgctgctggagct

SEQ ID NO: 12821 - DNA, 25 bp, Rattus norvegicus
aaagggcatctgcttcattcggacc

SEQ ID NO: 12822 - DNA, 25 bp, Rattus norvegicus
aaagggcatctggttcattcggacc

SEQ ID NO: 12823 - DNA, 25 bp, Rattus norvegicus
aaagggcattggcactttgcatact

SEQ ID NO: 12824 - DNA, 25 bp, Rattus norvegicus
aaagggcattgggactttgcatact

SEQ ID NO: 12825 - DNA, 25 bp, Rattus norvegicus
aaagggccacacagaccatcctgat

SEQ ID NO: 12826 - DNA, 25 bp, Rattus norvegicus
aaagggccacaccatggtcaaatga

SEQ ID NO: 12827 - DNA, 25 bp, Rattus norvegicus
aaagggccacacgatggtcaaatga

SEQ ID NO: 12828 - DNA, 25 bp, Rattus norvegicus
aaagggccacactgaccatcctgat

SEQ ID NO: 12829 - DNA, 25 bp, Rattus norvegicus
aaagggccagcgctctggagaccta

SEQ ID NO: 12830 - DNA, 25 bp, Rattus norvegicus
aaagggccagcggtctggagaccta

SEQ ID NO: 12831 - DNA, 25 bp, Rattus norvegicus
aaagggccattcaatgcccaaaggg

SEQ ID NO: 12832 - DNA, 25 bp, Rattus norvegicus
aaagggccattctatgcccaaaggg

SEQ ID NO: 12833 - DNA, 25 bp, Rattus norvegicus
aaagggcccagtactgaggactcaa

SEQ ID NO: 12834 - DNA, 25 bp, Rattus norvegicus
aaagggcccagttctgaggactcaa

SEQ ID NO: 12835 - DNA, 25 bp, Rattus norvegicus
aaagggcccttgctgagccaagcat

SEQ ID NO: 12836 - DNA, 25 bp, Rattus norvegicus
aaagggcccttggtgagccaagcat

SEQ ID NO: 12837 - DNA, 25 bp, Rattus norvegicus
aaagggccgccgcagagaccctacg

SEQ ID NO: 12838 - DNA, 25 bp, Rattus norvegicus
aaagggccgccggagagaccctacg

SEQ ID NO: 12839 - DNA, 25 bp, Rattus norvegicus
aaagggcctgttatgatttcttgct

SEQ ID NO: 12840 - DNA, 25 bp, Rattus norvegicus
aaagggcctgttttgatttcttgct

SEQ ID NO: 12841 - DNA, 25 bp, Rattus norvegicus
aaagggccttggatctcctaagtcg

SEQ ID NO: 12842 - DNA, 25 bp, Rattus norvegicus
aaagggccttggttctcctaagtcg

SEQ ID NO: 12843 - DNA, 25 bp, Rattus norvegicus
aaagggcctttaagaatgtctgttg

SEQ ID NO: 12844 - DNA, 25 bp, Rattus norvegicus
aaagggcctttatgaatgtctgttg

SEQ ID NO: 12845 - DNA, 25 bp, Rattus norvegicus
aaagggcgaattccatgacagctgt

SEQ ID NO: 12846 - DNA, 25 bp, Rattus norvegicus
aaagggcgaattgcatgacagctgt

SEQ ID NO: 12847 - DNA, 25 bp, Rattus norvegicus
aaagggcgacacagttttcttccat

SEQ ID NO: 12848 - DNA, 25 bp, Rattus norvegicus
aaagggcgacactgttttcttccat

SEQ ID NO: 12849 - DNA, 25 bp, Rattus norvegicus
aaagggcgggtgattgccaatgctc

SEQ ID NO: 12850 - DNA, 25 bp, Rattus norvegicus
aaagggcgggtgtttgccaatgctc

SEQ ID NO: 12851 - DNA, 25 bp, Rattus norvegicus
aaagggcggtgaccatgagcctctc

SEQ ID NO: 12852 - DNA, 25 bp, Rattus norvegicus
aaagggcggtgagcatgagcctctc

SEQ ID NO: 12853 - DNA, 25 bp, Rattus norvegicus
aaagggcgttttctatactgtgaca

SEQ ID NO: 12854 - DNA, 25 bp, Rattus norvegicus
aaagggcgttttgtatactgtgaca

SEQ ID NO: 12855 - DNA, 25 bp, Rattus norvegicus
aaagggctatttctgctgccctgaa

SEQ ID NO: 12856 - DNA, 25 bp, Rattus norvegicus
aaagggctatttgtgctgccctgaa

SEQ ID NO: 12857 - DNA, 25 bp, Rattus norvegicus
aaagggctcaaaactgggcagctca

SEQ ID NO: 12858 - DNA, 25 bp, Rattus norvegicus
aaagggctcaaaatcttcacgctgc

SEQ ID NO: 12859 - DNA, 25 bp, Rattus norvegicus
aaagggctcaaatctgggcagctca

SEQ ID NO: 12860 - DNA, 25 bp, Rattus norvegicus
aaagggctcaaattcttcacgctgc

SEQ ID NO: 12861 - DNA, 25 bp, Rattus norvegicus
aaagggctcaggcttctcacagttc

SEQ ID NO: 12862 - DNA, 25 bp, Rattus norvegicus
aaagggctcagggttctcacagttc

SEQ ID NO: 12863 - DNA, 25 bp, Rattus norvegicus
aaagggctcctgctttgtgcaggcc

SEQ ID NO: 12864 - DNA, 25 bp, Rattus norvegicus
aaagggctcctggtttgtgcaggcc

SEQ ID NO: 12865 - DNA, 25 bp, Rattus norvegicus
aaagggctccttaaatgtacacatg

SEQ ID NO: 12866 - DNA, 25 bp, Rattus norvegicus
aaagggctcctttaatgtacacatg

SEQ ID NO: 12867 - DNA, 25 bp, Rattus norvegicus
aaagggctcgatccctgtaggcctg

SEQ ID NO: 12868 - DNA, 25 bp, Rattus norvegicus
aaagggctcgatgcctgtaggcctg

SEQ ID NO: 12869 - DNA, 25 bp, Rattus norvegicus
aaagggctctttccagaccaatcaa

SEQ ID NO: 12870 - DNA, 25 bp, Rattus norvegicus
aaagggctctttgcagaccaatcaa

SEQ ID NO: 12871 - DNA, 25 bp, Rattus norvegicus
aaagggctgactacaaccctggtct

SEQ ID NO: 12872 - DNA, 25 bp, Rattus norvegicus
aaagggctgactatgccagatgatt

SEQ ID NO: 12873 - DNA, 25 bp, Rattus norvegicus
aaagggctgacttcaaccctggtct

SEQ ID NO: 12874 - DNA, 25 bp, Rattus norvegicus
aaagggctgactttgccagatgatt

SEQ ID NO: 12875 - DNA, 25 bp, Rattus norvegicus
aaagggctgaggagactgctctcta

SEQ ID NO: 12876 - DNA, 25 bp, Rattus norvegicus
aaagggctgaggtgactgctctcta

SEQ ID NO: 12877 - DNA, 25 bp, Rattus norvegicus
aaagggctgcatccttattattttt

SEQ ID NO: 12878 - DNA, 25 bp, Rattus norvegicus
aaagggctgcatgcttattattttt

SEQ ID NO: 12879 - DNA, 25 bp, Rattus norvegicus
aaagggctgggcagacctcaggacc

SEQ ID NO: 12880 - DNA, 25 bp, Rattus norvegicus
aaagggctgggctgacctcaggacc

SEQ ID NO: 12881 - DNA, 25 bp, Rattus norvegicus
aaagggctgtccaagaacttcgccg

SEQ ID NO: 12882 - DNA, 25 bp, Rattus norvegicus
aaagggctgtcctagaacttcgccg

SEQ ID NO: 12883 - DNA, 25 bp, Rattus norvegicus
aaagggctgttccacagactcttca

SEQ ID NO: 12884 - DNA, 25 bp, Rattus norvegicus
aaagggctgttcgacagactcttca

SEQ ID NO: 12885 - DNA, 25 bp, Rattus norvegicus
aaagggcttttcactaaatgacaag

SEQ ID NO: 12886 - DNA, 25 bp, Rattus norvegicus
aaagggcttttctctaaatgacaag

SEQ ID NO: 12887 - DNA, 25 bp, Rattus norvegicus
aaagggctttttctttcatcctgcg

SEQ ID NO: 12888 - DNA, 25 bp, Rattus norvegicus
aaagggctttttgtttcatcctgcg

SEQ ID NO: 12889 - DNA, 25 bp, Rattus norvegicus
aaagggtaacccaagctcattgctt

SEQ ID NO: 12890 - DNA, 25 bp, Rattus norvegicus
aaagggtaaccctagctcattgctt

SEQ ID NO: 12891 - DNA, 25 bp, Rattus norvegicus
aaagggtatcacaacctcctggttg

SEQ ID NO: 12892 - DNA, 25 bp, Rattus norvegicus
aaagggtatcactacctcctggttg

SEQ ID NO: 12893 - DNA, 25 bp, Rattus norvegicus
aaagggtatggtcttctgccctcct

SEQ ID NO: 12894 - DNA, 25 bp, Rattus norvegicus
aaagggtatggtgttctgccctcct

SEQ ID NO: 12895 - DNA, 25 bp, Rattus norvegicus
aaagggtcaagaagcctggcctaat

SEQ ID NO: 12896 - DNA, 25 bp, Rattus norvegicus
aaagggtcaagatgcctggcctaat

SEQ ID NO: 12897 - DNA, 25 bp, Rattus norvegicus
aaagggtcaaggatctctgaatcag

SEQ ID NO: 12898 - DNA, 25 bp, Rattus norvegicus
aaagggtcaaggttctctgaatcag

SEQ ID NO: 12899 - DNA, 25 bp, Rattus norvegicus
aaagggtcaccaccagcttagctga

SEQ ID NO: 12900 - DNA, 25 bp, Rattus norvegicus
aaagggtcaccagcagcttagctga

SEQ ID NO: 12901 - DNA, 25 bp, Rattus norvegicus
aaagggtcactgagatctggaggct

SEQ ID NO: 12902 - DNA, 25 bp, Rattus norvegicus
aaagggtcactgctggcttcatctc

SEQ ID NO: 12903 - DNA, 25 bp, Rattus norvegicus
aaagggtcactggtggcttcatctc

SEQ ID NO: 12904 - DNA, 25 bp, Rattus norvegicus
aaagggtcactgtgatctggaggct

SEQ ID NO: 12905 - DNA, 25 bp, Rattus norvegicus
aaagggtcagagatgtattcatgcc

SEQ ID NO: 12906 - DNA, 25 bp, Rattus norvegicus
aaagggtcagagttgtattcatgcc

SEQ ID NO: 12907 - DNA, 25 bp, Rattus norvegicus
aaagggtcagccaatcagcagcact

SEQ ID NO: 12908 - DNA, 25 bp, Rattus norvegicus
aaagggtcagcctatcagcagcact

SEQ ID NO: 12909 - DNA, 25 bp, Rattus norvegicus
aaagggtcatctacagctacacgct

SEQ ID NO: 12910 - DNA, 25 bp, Rattus norvegicus
aaagggtcatcttcagctacacgct

SEQ ID NO: 12911 - DNA, 25 bp, Rattus norvegicus
aaagggtccctgatgtgcctgctgg

SEQ ID NO: 12912 - DNA, 25 bp, Rattus norvegicus
aaagggtccctgttgtgcctgctgg

SEQ ID NO: 12913 - DNA, 25 bp, Rattus norvegicus
aaagggtcctgcctcagacaccgat

SEQ ID NO: 12914 - DNA, 25 bp, Rattus norvegicus
aaagggtcctgcgtcagacaccgat

SEQ ID NO: 12915 - DNA, 25 bp, Rattus norvegicus
aaagggtcctgtcagtgccatacaa

SEQ ID NO: 12916 - DNA, 25 bp, Rattus norvegicus
aaagggtcctgtgagtgccatacaa

SEQ ID NO: 12917 - DNA, 25 bp, Rattus norvegicus
aaagggtctagcctcatgcttctaa

SEQ ID NO: 12918 - DNA, 25 bp, Rattus norvegicus
aaagggtctagcgtcatgcttctaa

SEQ ID NO: 12919 - DNA, 25 bp, Rattus norvegicus
aaagggtctagtattgccgctgcta

SEQ ID NO: 12920 - DNA, 25 bp, Rattus norvegicus
aaagggtctagttttgccgctgcta

SEQ ID NO: 12921 - DNA, 25 bp, Rattus norvegicus
aaagggtctcagatcgcccagatga

SEQ ID NO: 12922 - DNA, 25 bp, Rattus norvegicus
aaagggtctcagttcgcccagatga

SEQ ID NO: 12923 - DNA, 25 bp, Rattus norvegicus
aaagggtctctcaggtgcatggtcg

SEQ ID NO: 12924 - DNA, 25 bp, Rattus norvegicus
aaagggtctctctggtgcatggtcg

SEQ ID NO: 12925 - DNA, 25 bp, Rattus norvegicus
aaagggtctctgattcatttatccg

SEQ ID NO: 12926 - DNA, 25 bp, Rattus norvegicus
aaagggtctctgtttcatttatccg

SEQ ID NO: 12927 - DNA, 25 bp, Rattus norvegicus
aaagggtctgacacagtcggcagca

SEQ ID NO: 12928 - DNA, 25 bp, Rattus norvegicus
aaagggtctgactcagtcggcagca

SEQ ID NO: 12929 - DNA, 25 bp, Rattus norvegicus
aaagggtctgccatatccacaatgt

SEQ ID NO: 12930 - DNA, 25 bp, Rattus norvegicus
aaagggtctgccttatccacaatgt

SEQ ID NO: 12931 - DNA, 25 bp, Rattus norvegicus
aaagggtctgggagtcactgccgct

SEQ ID NO: 12932 - DNA, 25 bp, Rattus norvegicus
aaagggtctgggtgtcactgccgct

SEQ ID NO: 12933 - DNA, 25 bp, Rattus norvegicus
aaagggtgattgcacgcctgctcaa

SEQ ID NO: 12934 - DNA, 25 bp, Rattus norvegicus
aaagggtgattggacgcctgctcaa

SEQ ID NO: 12935 - DNA, 25 bp, Rattus norvegicus
aaagggtgctcacactctcttatac

SEQ ID NO: 12936 - DNA, 25 bp, Rattus norvegicus
aaagggtgctcagactctcttatac

SEQ ID NO: 12937 - DNA, 25 bp, Rattus norvegicus
aaagggtgcttgcttctgaaaaggt

SEQ ID NO: 12938 - DNA, 25 bp, Rattus norvegicus
aaagggtgcttggttctgaaaaggt

SEQ ID NO: 12939 - DNA, 25 bp, Rattus norvegicus
aaagggtggcctcttggtcacctgc

SEQ ID NO: 12940 - DNA, 25 bp, Rattus norvegicus
aaagggtggcctgttggtcacctgc

SEQ ID NO: 12941 - DNA, 25 bp, Rattus norvegicus
aaagggtgtcttattctgtcagtgt

SEQ ID NO: 12942 - DNA, 25 bp, Rattus norvegicus
aaagggtgtctttttctgtcagtgt

SEQ ID NO: 12943 - DNA, 25 bp, Rattus norvegicus
aaagggtgtgccacagttgtacagc

SEQ ID NO: 12944 - DNA, 25 bp, Rattus norvegicus
aaagggtgtgcctcagttgtacagc

SEQ ID NO: 12945 - DNA, 25 bp, Rattus norvegicus
aaagggtgtgttcatggtcgcccat

SEQ ID NO: 12946 - DNA, 25 bp, Rattus norvegicus
aaagggtgtgttgatggtcgcccat

SEQ ID NO: 12947 - DNA, 25 bp, Rattus norvegicus
aaagggtgttggagtagctgcatcc

SEQ ID NO: 12948 - DNA, 25 bp, Rattus norvegicus
aaagggtgttggtgtagctgcatcc

SEQ ID NO: 12949 - DNA, 25 bp, Rattus norvegicus
aaagggttactgatattcatttgat

SEQ ID NO: 12950 - DNA, 25 bp, Rattus norvegicus
aaagggttactgttattcatttgat

SEQ ID NO: 12951 - DNA, 25 bp, Rattus norvegicus
aaagggttatgacccagatcctaat

SEQ ID NO: 12952 - DNA, 25 bp, Rattus norvegicus
aaagggttatgagccagatcctaat

SEQ ID NO: 12953 - DNA, 25 bp, Rattus norvegicus
aaagggttattcattctcatagaga

SEQ ID NO: 12954 - DNA, 25 bp, Rattus norvegicus
aaagggttattctttctcatagaga

SEQ ID NO: 12955 - DNA, 25 bp, Rattus norvegicus
aaagggttcagcagtctgcttcggc

SEQ ID NO: 12956 - DNA, 25 bp, Rattus norvegicus
aaagggttcagctgtctgcttcggc

SEQ ID NO: 12957 - DNA, 25 bp, Rattus norvegicus
aaagggttcatacctgcctcattag

SEQ ID NO: 12958 - DNA, 25 bp, Rattus norvegicus
aaagggttcatagctgcctcattag

SEQ ID NO: 12959 - DNA, 25 bp, Rattus norvegicus
aaagggttcttgagcttgccttccg

SEQ ID NO: 12960 - DNA, 25 bp, Rattus norvegicus
aaagggttcttgtgcttgccttccg

SEQ ID NO: 12961 - DNA, 25 bp, Rattus norvegicus
aaagggttctttcctctcatgctca

SEQ ID NO: 12962 - DNA, 25 bp, Rattus norvegicus
aaagggttctttgctctcatgctca

SEQ ID NO: 12963 - DNA, 25 bp, Rattus norvegicus
aaagggttgcaacgctctcgcatgt

SEQ ID NO: 12964 - DNA, 25 bp, Rattus norvegicus
aaagggttgcaaggctctcgcatgt

SEQ ID NO: 12965 - DNA, 25 bp, Rattus norvegicus
aaagggttgcttctttccagtcaga

SEQ ID NO: 12966 - DNA, 25 bp, Rattus norvegicus
aaagggttgcttgtttccagtcaga

SEQ ID NO: 12967 - DNA, 25 bp, Rattus norvegicus
aaagggttttctatccactgtcaat

SEQ ID NO: 12968 - DNA, 25 bp, Rattus norvegicus
aaagggttttctttccactgtcaat

SEQ ID NO: 12969 - DNA, 25 bp, Rattus norvegicus
aaaggtaatttaagtctctgggagt

SEQ ID NO: 12970 - DNA, 25 bp, Rattus norvegicus
aaaggtaatttatgtctctgggagt

SEQ ID NO: 12971 - DNA, 25 bp, Rattus norvegicus
aaaggtacagccctcacctgtaggt

SEQ ID NO: 12972 - DNA, 25 bp, Rattus norvegicus
aaaggtacagccgtcacctgtaggt

SEQ ID NO: 12973 - DNA, 25 bp, Rattus norvegicus
aaaggtacaggcactctgcatccag

SEQ ID NO: 12974 - DNA, 25 bp, Rattus norvegicus
aaaggtacaggctctctgcatccag

SEQ ID NO: 12975 - DNA, 25 bp, Rattus norvegicus
aaaggtacatcccaaccagtctggt

SEQ ID NO: 12976 - DNA, 25 bp, Rattus norvegicus
aaaggtacatccgaaccagtctggt

SEQ ID NO: 12977 - DNA, 25 bp, Rattus norvegicus
aaaggtacattgcaagtgcccagga

SEQ ID NO: 12978 - DNA, 25 bp, Rattus norvegicus
aaaggtacattggaagtgcccagga

SEQ ID NO: 12979 - DNA, 25 bp, Rattus norvegicus
aaaggtaccagacccatgccagtcc

SEQ ID NO: 12980 - DNA, 25 bp, Rattus norvegicus
aaaggtaccagagccatgccagtcc

SEQ ID NO: 12981 - DNA, 25 bp, Rattus norvegicus
aaaggtaccagcaactacagcgcct

SEQ ID NO: 12982 - DNA, 25 bp, Rattus norvegicus
aaaggtaccagctactacagcgcct

SEQ ID NO: 12983 - DNA, 25 bp, Rattus norvegicus
aaaggtaccatcctaggctggctcc

SEQ ID NO: 12984 - DNA, 25 bp, Rattus norvegicus
aaaggtaccatcgtaggctggctcc

SEQ ID NO: 12985 - DNA, 25 bp, Rattus norvegicus
aaaggtaccatgaaagtcctctcgt

SEQ ID NO: 12986 - DNA, 25 bp, Rattus norvegicus
aaaggtaccatgtaagtcctctcgt

SEQ ID NO: 12987 - DNA, 25 bp, Rattus norvegicus
aaaggtaccattatccagctccaat

SEQ ID NO: 12988 - DNA, 25 bp, Rattus norvegicus
aaaggtaccattttccagctccaat

SEQ ID NO: 12989 - DNA, 25 bp, Rattus norvegicus
aaaggtaccctgaggcgtgacagtc

SEQ ID NO: 12990 - DNA, 25 bp, Rattus norvegicus
aaaggtaccctgtggcgtgacagtc

SEQ ID NO: 12991 - DNA, 25 bp, Rattus norvegicus
aaaggtaccgagctgctgcctactg

SEQ ID NO: 12992 - DNA, 25 bp, Rattus norvegicus
aaaggtaccgaggtgctgcctactg

SEQ ID NO: 12993 - DNA, 25 bp, Rattus norvegicus
aaaggtactggcagctgtaccccaa

SEQ ID NO: 12994 - DNA, 25 bp, Rattus norvegicus
aaaggtactggctgctgtaccccaa

SEQ ID NO: 12995 - DNA, 25 bp, Rattus norvegicus
aaaggtacttgcaaccctccttgat

SEQ ID NO: 12996 - DNA, 25 bp, Rattus norvegicus
aaaggtacttgctaccctccttgat

SEQ ID NO: 12997 - DNA, 25 bp, Rattus norvegicus
aaaggtactttcaggatcccagcac

SEQ ID NO: 12998 - DNA, 25 bp, Rattus norvegicus
aaaggtactttctggatcccagcac

SEQ ID NO: 12999 - DNA, 25 bp, Rattus norvegicus
aaaggtagagttcctgcggtctctg

SEQ ID NO: 13000 - DNA, 25 bp, Rattus norvegicus
aaaggtagagttgctgcggtctctg

SEQ ID NO: 13001 - DNA, 25 bp, Rattus norvegicus
aaaggtagctacaggacgctcgacc

SEQ ID NO: 13002 - DNA, 25 bp, Rattus norvegicus
aaaggtagctactggacgctcgacc

SEQ ID NO: 13003 - DNA, 25 bp, Rattus norvegicus
aaaggtaggatgctctgccagcacc

SEQ ID NO: 13004 - DNA, 25 bp, Rattus norvegicus
aaaggtaggatggtctgccagcacc

SEQ ID NO: 13005 - DNA, 25 bp, Rattus norvegicus
aaaggtaggattcccttcagggagt

SEQ ID NO: 13006 - DNA, 25 bp, Rattus norvegicus
aaaggtaggattgccttcagggagt

SEQ ID NO: 13007 - DNA, 25 bp, Rattus norvegicus
aaaggtaggcgcacccaggctcagc

SEQ ID NO: 13008 - DNA, 25 bp, Rattus norvegicus
aaaggtaggcgctcccaggctcagc

SEQ ID NO: 13009 - DNA, 25 bp, Rattus norvegicus
aaaggtatcatcacgcagtgcacaa

SEQ ID NO: 13010 - DNA, 25 bp, Rattus norvegicus
aaaggtatcatctcgcagtgcacaa

SEQ ID NO: 13011 - DNA, 25 bp, Rattus norvegicus
aaaggtatccttcgccagataacaa

SEQ ID NO: 13012 - DNA, 25 bp, Rattus norvegicus
aaaggtatccttggccagataacaa

SEQ ID NO: 13013 - DNA, 25 bp, Rattus norvegicus
aaaggtatgagtcaccaccgcccgt

SEQ ID NO: 13014 - DNA, 25 bp, Rattus norvegicus
aaaggtatgagtgaccaccgcccgt

SEQ ID NO: 13015 - DNA, 25 bp, Rattus norvegicus
aaaggtatgattatctgccaactga

SEQ ID NO: 13016 - DNA, 25 bp, Rattus norvegicus
aaaggtatgattttctgccaactga

SEQ ID NO: 13017 - DNA, 25 bp, Rattus norvegicus
aaaggtatttccatgtgactgtata

SEQ ID NO: 13018 - DNA, 25 bp, Rattus norvegicus
aaaggtatttccttgtgactgtata

SEQ ID NO: 13019 - DNA, 25 bp, Rattus norvegicus
aaaggtcaacgtcggaatcaccatc

SEQ ID NO: 13020 - DNA, 25 bp, Rattus norvegicus
aaaggtcaacgtgggaatcaccatc

SEQ ID NO: 13021 - DNA, 25 bp, Rattus norvegicus
aaaggtcaagttcagttcaagcaaa

SEQ ID NO: 13022 - DNA, 25 bp, Rattus norvegicus
aaaggtcaagttgagttcaagcaaa

SEQ ID NO: 13023 - DNA, 25 bp, Rattus norvegicus
aaaggtcacacaagttggccatccc

SEQ ID NO: 13024 - DNA, 25 bp, Rattus norvegicus
aaaggtcacacatgttggccatccc

SEQ ID NO: 13025 - DNA, 25 bp, Rattus norvegicus
aaaggtcacacgcactgcacgtttt

SEQ ID NO: 13026 - DNA, 25 bp, Rattus norvegicus
aaaggtcacacggactgcacgtttt

SEQ ID NO: 13027 - DNA, 25 bp, Rattus norvegicus
aaaggtcacagcatgggttcctctg

SEQ ID NO: 13028 - DNA, 25 bp, Rattus norvegicus
aaaggtcacagcttgggttcctctg

SEQ ID NO: 13029 - DNA, 25 bp, Rattus norvegicus
aaaggtcacagtaggtgctcacccc

SEQ ID NO: 13030 - DNA, 25 bp, Rattus norvegicus
aaaggtcacagttggtgctcacccc

SEQ ID NO: 13031 - DNA, 25 bp, Rattus norvegicus
aaaggtcaccgtccatctgcagacg

SEQ ID NO: 13032 - DNA, 25 bp, Rattus norvegicus
aaaggtcaccgtgcatctgcagacg

SEQ ID NO: 13033 - DNA, 25 bp, Rattus norvegicus
aaaggtcagacaccctggcacgcag

SEQ ID NO: 13034 - DNA, 25 bp, Rattus norvegicus
aaaggtcagacagcctggcacgcag

SEQ ID NO: 13035 - DNA, 25 bp, Rattus norvegicus
aaaggtcagagcagttgttttccag

SEQ ID NO: 13036 - DNA, 25 bp, Rattus norvegicus
aaaggtcagagctgttgttttccag

SEQ ID NO: 13037 - DNA, 25 bp, Rattus norvegicus
aaaggtcagtagcttcatcaaaagt

SEQ ID NO: 13038 - DNA, 25 bp, Rattus norvegicus
aaaggtcagtaggttcatcaaaagt

SEQ ID NO: 13039 - DNA, 25 bp, Rattus norvegicus
aaaggtcagtatagtttccacaggg

SEQ ID NO: 13040 - DNA, 25 bp, Rattus norvegicus
aaaggtcagtattgtttccacaggg

SEQ ID NO: 13041 - DNA, 25 bp, Rattus norvegicus
aaaggtcatacactggttgctagaa

SEQ ID NO: 13042 - DNA, 25 bp, Rattus norvegicus
aaaggtcatacagtggttgctagaa

SEQ ID NO: 13043 - DNA, 25 bp, Rattus norvegicus
aaaggtcatataccctcgagcctct

SEQ ID NO: 13044 - DNA, 25 bp, Rattus norvegicus
aaaggtcatatagcctcgagcctct

SEQ ID NO: 13045 - DNA, 25 bp, Rattus norvegicus
aaaggtcatcaaaaggaactaatga

SEQ ID NO: 13046 - DNA, 25 bp, Rattus norvegicus
aaaggtcatcaataggaactaatga

SEQ ID NO: 13047 - DNA, 25 bp, Rattus norvegicus
aaaggtcatcctcggtatgccaata

SEQ ID NO: 13048 - DNA, 25 bp, Rattus norvegicus
aaaggtcatcctgggtatgccaata

SEQ ID NO: 13049 - DNA, 25 bp, Rattus norvegicus
aaaggtcatgacactgagattctca

SEQ ID NO: 13050 - DNA, 25 bp, Rattus norvegicus
aaaggtcatgactctgagattctca

SEQ ID NO: 13051 - DNA, 25 bp, Rattus norvegicus
aaaggtcatggcattactcaaagaa

SEQ ID NO: 13052 - DNA, 25 bp, Rattus norvegicus
aaaggtcatggctttactcaaagaa

SEQ ID NO: 13053 - DNA, 25 bp, Rattus norvegicus
aaaggtcatgtgaaggattgtcgtg

SEQ ID NO: 13054 - DNA, 25 bp, Rattus norvegicus
aaaggtcatgtgtaggattgtcgtg

SEQ ID NO: 13055 - DNA, 25 bp, Rattus norvegicus
aaaggtcattcactggtgcacccac

SEQ ID NO: 13056 - DNA, 25 bp, Rattus norvegicus
aaaggtcattcagtggtgcacccac

SEQ ID NO: 13057 - DNA, 25 bp, Rattus norvegicus
aaaggtcattctctgcgctgtcttc

SEQ ID NO: 13058 - DNA, 25 bp, Rattus norvegicus
aaaggtcattctgtgcgctgtcttc

SEQ ID NO: 13059 - DNA, 25 bp, Rattus norvegicus
aaaggtccacagatctacagtatta

SEQ ID NO: 13060 - DNA, 25 bp, Rattus norvegicus
aaaggtccacagttctacagtatta

SEQ ID NO: 13061 - DNA, 25 bp, Rattus norvegicus
aaaggtccaggcagacgatgggtct

SEQ ID NO: 13062 - DNA, 25 bp, Rattus norvegicus
aaaggtccaggctgacgatgggtct

SEQ ID NO: 13063 - DNA, 25 bp, Rattus norvegicus
aaaggtccaggtcacagagtttcac

SEQ ID NO: 13064 - DNA, 25 bp, Rattus norvegicus
aaaggtccaggtgacagagtttcac

SEQ ID NO: 13065 - DNA, 25 bp, Rattus norvegicus
aaaggtccccagaaaagaagatcat

SEQ ID NO: 13066 - DNA, 25 bp, Rattus norvegicus
aaaggtccccagtaaagaagatcat

SEQ ID NO: 13067 - DNA, 25 bp, Rattus norvegicus
aaaggtcccggaaattcaggtctct

SEQ ID NO: 13068 - DNA, 25 bp, Rattus norvegicus
aaaggtcccggaactggctgccgat

SEQ ID NO: 13069 - DNA, 25 bp, Rattus norvegicus
aaaggtcccggatattcaggtctct

SEQ ID NO: 13070 - DNA, 25 bp, Rattus norvegicus
aaaggtcccggatctggctgccgat

SEQ ID NO: 13071 - DNA, 25 bp, Rattus norvegicus
aaaggtcccggcacatccaggcatg

SEQ ID NO: 13072 - DNA, 25 bp, Rattus norvegicus
aaaggtcccggctcatccaggcatg

SEQ ID NO: 13073 - DNA, 25 bp, Rattus norvegicus
aaaggtccctaaatgactgctgtag

SEQ ID NO: 13074 - DNA, 25 bp, Rattus norvegicus
aaaggtccctaattgactgctgtag

SEQ ID NO: 13075 - DNA, 25 bp, Rattus norvegicus
aaaggtccgatgctttcacagccta

SEQ ID NO: 13076 - DNA, 25 bp, Rattus norvegicus
aaaggtccgatggtttcacagccta

SEQ ID NO: 13077 - DNA, 25 bp, Rattus norvegicus
aaaggtccgcatatacttgtagctg

SEQ ID NO: 13078 - DNA, 25 bp, Rattus norvegicus
aaaggtccgcatttacttgtagctg

SEQ ID NO: 13079 - DNA, 25 bp, Rattus norvegicus
aaaggtccgtatactgtcatcacag

SEQ ID NO: 13080 - DNA, 25 bp, Rattus norvegicus
aaaggtccgtattctgtcatcacag

SEQ ID NO: 13081 - DNA, 25 bp, Rattus norvegicus
aaaggtccgtcccatgaagcctctc

SEQ ID NO: 13082 - DNA, 25 bp, Rattus norvegicus
aaaggtccgtccgatgaagcctctc

SEQ ID NO: 13083 - DNA, 25 bp, Rattus norvegicus
aaaggtcctagcacagattcttaag

SEQ ID NO: 13084 - DNA, 25 bp, Rattus norvegicus
aaaggtcctagctcagattcttaag

SEQ ID NO: 13085 - DNA, 25 bp, Rattus norvegicus
aaaggtcctctgattatgtattaca

SEQ ID NO: 13086 - DNA, 25 bp, Rattus norvegicus
aaaggtcctctgtttatgtattaca

SEQ ID NO: 13087 - DNA, 25 bp, Rattus norvegicus
aaaggtcctggaacctgtgagcctc

SEQ ID NO: 13088 - DNA, 25 bp, Rattus norvegicus
aaaggtcctggatcctgtgagcctc

SEQ ID NO: 13089 - DNA, 25 bp, Rattus norvegicus
aaaggtcctgtgaggcgaatgctct

SEQ ID NO: 13090 - DNA, 25 bp, Rattus norvegicus
aaaggtcctgtgcatccgaattcaa

SEQ ID NO: 13091 - DNA, 25 bp, Rattus norvegicus
aaaggtcctgtggatccgaattcaa

SEQ ID NO: 13092 - DNA, 25 bp, Rattus norvegicus
aaaggtcctgtgtggcgaatgctct

SEQ ID NO: 13093 - DNA, 25 bp, Rattus norvegicus
aaaggtcgaactcttggatgccctg

SEQ ID NO: 13094 - DNA, 25 bp, Rattus norvegicus
aaaggtcgaactgttggatgccctg

SEQ ID NO: 13095 - DNA, 25 bp, Rattus norvegicus
aaaggtcgcttacagctcacatcgt

SEQ ID NO: 13096 - DNA, 25 bp, Rattus norvegicus
aaaggtcgcttagagctcacatcgt

SEQ ID NO: 13097 - DNA, 25 bp, Rattus norvegicus
aaaggtcggaagagggctcccagca

SEQ ID NO: 13098 - DNA, 25 bp, Rattus norvegicus
aaaggtcggaagtgggctcccagca

SEQ ID NO: 13099 - DNA, 25 bp, Rattus norvegicus
aaaggtcggatgctgcaggccatca

SEQ ID NO: 13100 - DNA, 25 bp, Rattus norvegicus
aaaggtcggatggtgcaggccatca

SEQ ID NO: 13101 - DNA, 25 bp, Rattus norvegicus
aaaggtcggcacagacatccaggac

SEQ ID NO: 13102 - DNA, 25 bp, Rattus norvegicus
aaaggtcggcactgacatccaggac

SEQ ID NO: 13103 - DNA, 25 bp, Rattus norvegicus
aaaggtcgttcaaggtgctggattc

SEQ ID NO: 13104 - DNA, 25 bp, Rattus norvegicus
aaaggtcgttcatggtgctggattc

SEQ ID NO: 13105 - DNA, 25 bp, Rattus norvegicus
aaaggtcgttggctcttttgctctt

SEQ ID NO: 13106 - DNA, 25 bp, Rattus norvegicus
aaaggtcgttgggtcttttgctctt

SEQ ID NO: 13107 - DNA, 25 bp, Rattus norvegicus
aaaggtctaacactgctcatgtggg

SEQ ID NO: 13108 - DNA, 25 bp, Rattus norvegicus
aaaggtctaacagtgctcatgtggg

SEQ ID NO: 13109 - DNA, 25 bp, Rattus norvegicus
aaaggtctacaaacactgtcaagat

SEQ ID NO: 13110 - DNA, 25 bp, Rattus norvegicus
aaaggtctacaatcactgtcaagat

SEQ ID NO: 13111 - DNA, 25 bp, Rattus norvegicus
aaaggtctaggaaagcactctcaag

SEQ ID NO: 13112 - DNA, 25 bp, Rattus norvegicus
aaaggtctaggatagcactctcaag

SEQ ID NO: 13113 - DNA, 25 bp, Rattus norvegicus
aaaggtctcagcctcttagacgttg

SEQ ID NO: 13114 - DNA, 25 bp, Rattus norvegicus
aaaggtctcagcgtcttagacgttg

SEQ ID NO: 13115 - DNA, 25 bp, Rattus norvegicus
aaaggtctccagaagatgtccctgt

SEQ ID NO: 13116 - DNA, 25 bp, Rattus norvegicus
aaaggtctccagtagatgtccctgt

SEQ ID NO: 13117 - DNA, 25 bp, Rattus norvegicus
aaaggtctccttatcagctggtctt

SEQ ID NO: 13118 - DNA, 25 bp, Rattus norvegicus
aaaggtctccttttcagctggtctt

SEQ ID NO: 13119 - DNA, 25 bp, Rattus norvegicus
aaaggtctcggtacaaccagctgcc

SEQ ID NO: 13120 - DNA, 25 bp, Rattus norvegicus
aaaggtctcggttcaaccagctgcc

SEQ ID NO: 13121 - DNA, 25 bp, Rattus norvegicus
aaaggtctctgcagcaggaggcaat

SEQ ID NO: 13122 - DNA, 25 bp, Rattus norvegicus
aaaggtctctgctgcaggaggcaat

SEQ ID NO: 13123 - DNA, 25 bp, Rattus norvegicus
aaaggtctctttctctccagtaaat

SEQ ID NO: 13124 - DNA, 25 bp, Rattus norvegicus
aaaggtctctttgtctccagtaaat

SEQ ID NO: 13125 - DNA, 25 bp, Rattus norvegicus
aaaggtctgatactgggttctctta

SEQ ID NO: 13126 - DNA, 25 bp, Rattus norvegicus
aaaggtctgatagtgggttctctta

SEQ ID NO: 13127 - DNA, 25 bp, Rattus norvegicus
aaaggtctgattagctcactctaat

SEQ ID NO: 13128 - DNA, 25 bp, Rattus norvegicus
aaaggtctgattcctatcagcagga

SEQ ID NO: 13129 - DNA, 25 bp, Rattus norvegicus
aaaggtctgattgctatcagcagga

SEQ ID NO: 13130 - DNA, 25 bp, Rattus norvegicus
aaaggtctgatttgctcactctaat

SEQ ID NO: 13131 - DNA, 25 bp, Rattus norvegicus
aaaggtctgcctatatacctcagat

SEQ ID NO: 13132 - DNA, 25 bp, Rattus norvegicus
aaaggtctgcctttatacctcagat

SEQ ID NO: 13133 - DNA, 25 bp, Rattus norvegicus
aaaggtctggatattgtaggtctga

SEQ ID NO: 13134 - DNA, 25 bp, Rattus norvegicus
aaaggtctggattttgtaggtctga

SEQ ID NO: 13135 - DNA, 25 bp, Rattus norvegicus
aaaggtctggccaggttcagggcat

SEQ ID NO: 13136 - DNA, 25 bp, Rattus norvegicus
aaaggtctggcctggttcagggcat

SEQ ID NO: 13137 - DNA, 25 bp, Rattus norvegicus
aaaggtctggcgatcgttcaagatc

SEQ ID NO: 13138 - DNA, 25 bp, Rattus norvegicus
aaaggtctggcgttcgttcaagatc

SEQ ID NO: 13139 - DNA, 25 bp, Rattus norvegicus
aaaggtctggtgaaagctgcccaac

SEQ ID NO: 13140 - DNA, 25 bp, Rattus norvegicus
aaaggtctggtgtaagctgcccaac

SEQ ID NO: 13141 - DNA, 25 bp, Rattus norvegicus
aaaggtctgtgcaataccactggct

SEQ ID NO: 13142 - DNA, 25 bp, Rattus norvegicus
aaaggtctgtgctataccactggct

SEQ ID NO: 13143 - DNA, 25 bp, Rattus norvegicus
aaaggtctgttcctatggtgtcaag

SEQ ID NO: 13144 - DNA, 25 bp, Rattus norvegicus
aaaggtctgttcgtatggtgtcaag

SEQ ID NO: 13145 - DNA, 25 bp, Rattus norvegicus
aaaggtcttacacattttatactga

SEQ ID NO: 13146 - DNA, 25 bp, Rattus norvegicus
aaaggtcttacagattttatactga

SEQ ID NO: 13147 - DNA, 25 bp, Rattus norvegicus
aaaggtcttagtctgttgtgcatac

SEQ ID NO: 13148 - DNA, 25 bp, Rattus norvegicus
aaaggtcttagtgtgttgtgcatac

SEQ ID NO: 13149 - DNA, 25 bp, Rattus norvegicus
aaaggtcttcatactggtctttcct

SEQ ID NO: 13150 - DNA, 25 bp, Rattus norvegicus
aaaggtcttcattctggtctttcct

SEQ ID NO: 13151 - DNA, 25 bp, Rattus norvegicus
aaaggtcttgttagtttcctgagag

SEQ ID NO: 13152 - DNA, 25 bp, Rattus norvegicus
aaaggtcttgtttgtttcctgagag

SEQ ID NO: 13153 - DNA, 25 bp, Rattus norvegicus
aaaggtctttatcatgagccgaatt

SEQ ID NO: 13154 - DNA, 25 bp, Rattus norvegicus
aaaggtctttatgatgagccgaatt

SEQ ID NO: 13155 - DNA, 25 bp, Rattus norvegicus
aaaggtctttccattttgcttcgag

SEQ ID NO: 13156 - DNA, 25 bp, Rattus norvegicus
aaaggtctttcctttttgcttcgag

SEQ ID NO: 13157 - DNA, 25 bp, Rattus norvegicus
aaaggtgaagtcacgtgacctcaca

SEQ ID NO: 13158 - DNA, 25 bp, Rattus norvegicus
aaaggtgaagtctcgtgacctcaca

SEQ ID NO: 13159 - DNA, 25 bp, Rattus norvegicus
aaaggtgacactagtctctgctgct

SEQ ID NO: 13160 - DNA, 25 bp, Rattus norvegicus
aaaggtgacacttgtctctgctgct

SEQ ID NO: 13161 - DNA, 25 bp, Rattus norvegicus
aaaggtgacagaaccggacatccat

SEQ ID NO: 13162 - DNA, 25 bp, Rattus norvegicus
aaaggtgacagatccggacatccat

SEQ ID NO: 13163 - DNA, 25 bp, Rattus norvegicus
aaaggtgacatcctaagccctgcag

SEQ ID NO: 13164 - DNA, 25 bp, Rattus norvegicus
aaaggtgacatcgtaagccctgcag

SEQ ID NO: 13165 - DNA, 25 bp, Rattus norvegicus
aaaggtgaccatagtacccaggcca

SEQ ID NO: 13166 - DNA, 25 bp, Rattus norvegicus
aaaggtgaccattgtacccaggcca

SEQ ID NO: 13167 - DNA, 25 bp, Rattus norvegicus
aaaggtgacccgaatggtatccatc

SEQ ID NO: 13168 - DNA, 25 bp, Rattus norvegicus
aaaggtgacccgtatggtatccatc

SEQ ID NO: 13169 - DNA, 25 bp, Rattus norvegicus
aaaggtgactatcgctgcccattct

SEQ ID NO: 13170 - DNA, 25 bp, Rattus norvegicus
aaaggtgactatggctgcccattct

SEQ ID NO: 13171 - DNA, 25 bp, Rattus norvegicus
aaaggtgactccactgtaacctagc

SEQ ID NO: 13172 - DNA, 25 bp, Rattus norvegicus
aaaggtgactcctctgtaacctagc

SEQ ID NO: 13173 - DNA, 25 bp, Rattus norvegicus
aaaggtgactgtcgtccggaacttg

SEQ ID NO: 13174 - DNA, 25 bp, Rattus norvegicus
aaaggtgactgtggtccggaacttg

SEQ ID NO: 13175 - DNA, 25 bp, Rattus norvegicus
aaaggtgacttgcatcctggctgca

SEQ ID NO: 13176 - DNA, 25 bp, Rattus norvegicus
aaaggtgacttgctggatgccataa

SEQ ID NO: 13177 - DNA, 25 bp, Rattus norvegicus
aaaggtgacttggatcctggctgca

SEQ ID NO: 13178 - DNA, 25 bp, Rattus norvegicus
aaaggtgacttggtggatgccataa

SEQ ID NO: 13179 - DNA, 25 bp, Rattus norvegicus
aaaggtgagtcacacctccccaggg

SEQ ID NO: 13180 - DNA, 25 bp, Rattus norvegicus
aaaggtgagtcagacctccccaggg

SEQ ID NO: 13181 - DNA, 25 bp, Rattus norvegicus
aaaggtgagtccagctcatccagtc

SEQ ID NO: 13182 - DNA, 25 bp, Rattus norvegicus
aaaggtgagtcctgctcatccagtc

SEQ ID NO: 13183 - DNA, 25 bp, Rattus norvegicus
aaaggtgatgacagtcaccccttgt

SEQ ID NO: 13184 - DNA, 25 bp, Rattus norvegicus
aaaggtgatgactgtcaccccttgt

SEQ ID NO: 13185 - DNA, 25 bp, Rattus norvegicus
aaaggtgattttagaactctagtat

SEQ ID NO: 13186 - DNA, 25 bp, Rattus norvegicus
aaaggtgatttttgaactctagtat

SEQ ID NO: 13187 - DNA, 25 bp, Rattus norvegicus
aaaggtgcagttcagcttgcagctg

SEQ ID NO: 13188 - DNA, 25 bp, Rattus norvegicus
aaaggtgcagttgagcttgcagctg

SEQ ID NO: 13189 - DNA, 25 bp, Rattus norvegicus
aaaggtgcatcaatagagttctcgt

SEQ ID NO: 13190 - DNA, 25 bp, Rattus norvegicus
aaaggtgcatcattagagttctcgt

SEQ ID NO: 13191 - DNA, 25 bp, Rattus norvegicus
aaaggtgcattcaggaaccatggag

SEQ ID NO: 13192 - DNA, 25 bp, Rattus norvegicus
aaaggtgcattctggaaccatggag

SEQ ID NO: 13193 - DNA, 25 bp, Rattus norvegicus
aaaggtgccaagagcgacccgtcca

SEQ ID NO: 13194 - DNA, 25 bp, Rattus norvegicus
aaaggtgccaagtgcgacccgtcca

SEQ ID NO: 13195 - DNA, 25 bp, Rattus norvegicus
aaaggtgccatacccttgagataag

SEQ ID NO: 13196 - DNA, 25 bp, Rattus norvegicus
aaaggtgccatactcttcagtagtg

SEQ ID NO: 13197 - DNA, 25 bp, Rattus norvegicus
aaaggtgccatagccttgagataag

SEQ ID NO: 13198 - DNA, 25 bp, Rattus norvegicus
aaaggtgccatagtcttcagtagtg

SEQ ID NO: 13199 - DNA, 25 bp, Rattus norvegicus
aaaggtgcccacaaaggctgagccc

SEQ ID NO: 13200 - DNA, 25 bp, Rattus norvegicus
aaaggtgcccactaaggctgagccc

SEQ ID NO: 13201 - DNA, 25 bp, Rattus norvegicus
aaaggtgccgtcactttacgttctg

SEQ ID NO: 13202 - DNA, 25 bp, Rattus norvegicus
aaaggtgccgtctctttacgttctg

SEQ ID NO: 13203 - DNA, 25 bp, Rattus norvegicus
aaaggtgccgtgcacaattgatttt

SEQ ID NO: 13204 - DNA, 25 bp, Rattus norvegicus
aaaggtgccgtggacaattgatttt

SEQ ID NO: 13205 - DNA, 25 bp, Rattus norvegicus
aaaggtgcctcaccatagccagcat

SEQ ID NO: 13206 - DNA, 25 bp, Rattus norvegicus
aaaggtgcctcagcatagccagcat

SEQ ID NO: 13207 - DNA, 25 bp, Rattus norvegicus
aaaggtgcctcgcacaagtgcacgt

SEQ ID NO: 13208 - DNA, 25 bp, Rattus norvegicus
aaaggtgcctcggacaagtgcacgt

SEQ ID NO: 13209 - DNA, 25 bp, Rattus norvegicus
aaaggtgcctgcagacaacctgagt

SEQ ID NO: 13210 - DNA, 25 bp, Rattus norvegicus
aaaggtgcctgctgacaacctgagt

SEQ ID NO: 13211 - DNA, 25 bp, Rattus norvegicus
aaaggtgcctgtcgcccagaaggcc

SEQ ID NO: 13212 - DNA, 25 bp, Rattus norvegicus
aaaggtgcctgtggcccagaaggcc

SEQ ID NO: 13213 - DNA, 25 bp, Rattus norvegicus
aaaggtgcggcaactgtgacacata

SEQ ID NO: 13214 - DNA, 25 bp, Rattus norvegicus
aaaggtgcggcatctgtgacacata

SEQ ID NO: 13215 - DNA, 25 bp, Rattus norvegicus
aaaggtgctaagagcccctggctgt

SEQ ID NO: 13216 - DNA, 25 bp, Rattus norvegicus
aaaggtgctaagtgcccctggctgt

SEQ ID NO: 13217 - DNA, 25 bp, Rattus norvegicus
aaaggtgctacaactctgtgaaggg

SEQ ID NO: 13218 - DNA, 25 bp, Rattus norvegicus
aaaggtgctacatctctgtgaaggg

SEQ ID NO: 13219 - DNA, 25 bp, Rattus norvegicus
aaaggtgctcatacattcccttagg

SEQ ID NO: 13220 - DNA, 25 bp, Rattus norvegicus
aaaggtgctcattcattcccttagg

SEQ ID NO: 13221 - DNA, 25 bp, Rattus norvegicus
aaaggtgctcccaagccttttacag

SEQ ID NO: 13222 - DNA, 25 bp, Rattus norvegicus
aaaggtgctccctagccttttacag

SEQ ID NO: 13223 - DNA, 25 bp, Rattus norvegicus
aaaggtgctccgagctagacagaaa

SEQ ID NO: 13224 - DNA, 25 bp, Rattus norvegicus
aaaggtgctccgtgctagacagaaa

SEQ ID NO: 13225 - DNA, 25 bp, Rattus norvegicus
aaaggtgctgctccggcaactccat

SEQ ID NO: 13226 - DNA, 25 bp, Rattus norvegicus
aaaggtgctgctgcggcaactccat

SEQ ID NO: 13227 - DNA, 25 bp, Rattus norvegicus
aaaggtgctggtcccatacactggg

SEQ ID NO: 13228 - DNA, 25 bp, Rattus norvegicus
aaaggtgctggtgccatacactggg

SEQ ID NO: 13229 - DNA, 25 bp, Rattus norvegicus
aaaggtgctgtcagttgtcaacatg

SEQ ID NO: 13230 - DNA, 25 bp, Rattus norvegicus
aaaggtgctgtctgttgtcaacatg

SEQ ID NO: 13231 - DNA, 25 bp, Rattus norvegicus
aaaggtgcttcaaggcgaggtgatc

SEQ ID NO: 13232 - DNA, 25 bp, Rattus norvegicus
aaaggtgcttcatggcgaggtgatc

SEQ ID NO: 13233 - DNA, 25 bp, Rattus norvegicus
aaaggtgcttgcaactgagcctgac

SEQ ID NO: 13234 - DNA, 25 bp, Rattus norvegicus
aaaggtgcttgcatgtcaatgtaaa

SEQ ID NO: 13235 - DNA, 25 bp, Rattus norvegicus
aaaggtgcttgcctataaggtgtat

SEQ ID NO: 13236 - DNA, 25 bp, Rattus norvegicus
aaaggtgcttgcgtataaggtgtat

SEQ ID NO: 13237 - DNA, 25 bp, Rattus norvegicus
aaaggtgcttgctactgagcctgac

SEQ ID NO: 13238 - DNA, 25 bp, Rattus norvegicus
aaaggtgcttgcttgtcaatgtaaa

SEQ ID NO: 13239 - DNA, 25 bp, Rattus norvegicus
aaaggtgctttaaggccatcctctg

SEQ ID NO: 13240 - DNA, 25 bp, Rattus norvegicus
aaaggtgctttatggccatcctctg

SEQ ID NO: 13241 - DNA, 25 bp, Rattus norvegicus
aaaggtgcttttcgatgggccccat

SEQ ID NO: 13242 - DNA, 25 bp, Rattus norvegicus
aaaggtgcttttggatgggccccat

SEQ ID NO: 13243 - DNA, 25 bp, Rattus norvegicus
aaaggtggacacacccttatgtact

SEQ ID NO: 13244 - DNA, 25 bp, Rattus norvegicus
aaaggtggacactcccttatgtact

SEQ ID NO: 13245 - DNA, 25 bp, Rattus norvegicus
aaaggtggcattcatatttctctat

SEQ ID NO: 13246 - DNA, 25 bp, Rattus norvegicus
aaaggtggcattgatatttctctat

SEQ ID NO: 13247 - DNA, 25 bp, Rattus norvegicus
aaaggtggccaaagccttctggatg

SEQ ID NO: 13248 - DNA, 25 bp, Rattus norvegicus
aaaggtggccaatgccttctggatg

SEQ ID NO: 13249 - DNA, 25 bp, Rattus norvegicus
aaaggtggccagcttgttctgcttt

SEQ ID NO: 13250 - DNA, 25 bp, Rattus norvegicus
aaaggtggccaggttgttctgcttt

SEQ ID NO: 13251 - DNA, 25 bp, Rattus norvegicus
aaaggtggcctacagctattttcaa

SEQ ID NO: 13252 - DNA, 25 bp, Rattus norvegicus
aaaggtggcctaccaattaagagac

SEQ ID NO: 13253 - DNA, 25 bp, Rattus norvegicus
aaaggtggcctagagctattttcaa

SEQ ID NO: 13254 - DNA, 25 bp, Rattus norvegicus
aaaggtggcctagcaattaagagac

SEQ ID NO: 13255 - DNA, 25 bp, Rattus norvegicus
aaaggtggcgacatcttgacattct

SEQ ID NO: 13256 - DNA, 25 bp, Rattus norvegicus
aaaggtggcgacttcttgacattct

SEQ ID NO: 13257 - DNA, 25 bp, Rattus norvegicus
aaaggtggcttcagtttgatgagga

SEQ ID NO: 13258 - DNA, 25 bp, Rattus norvegicus
aaaggtggcttctgtttgatgagga

SEQ ID NO: 13259 - DNA, 25 bp, Rattus norvegicus
aaaggtggcttgagtttcagccctt

SEQ ID NO: 13260 - DNA, 25 bp, Rattus norvegicus
aaaggtggcttgtgtttcagccctt

SEQ ID NO: 13261 - DNA, 25 bp, Rattus norvegicus
aaaggtggtcacaccagatcctgtt

SEQ ID NO: 13262 - DNA, 25 bp, Rattus norvegicus
aaaggtggtcactccagatcctgtt

SEQ ID NO: 13263 - DNA, 25 bp, Rattus norvegicus
aaaggtggtgaacctcttggcctct

SEQ ID NO: 13264 - DNA, 25 bp, Rattus norvegicus
aaaggtggtgaagctcttggcctct

SEQ ID NO: 13265 - DNA, 25 bp, Rattus norvegicus
aaaggtggtgtgctactgcccatct

SEQ ID NO: 13266 - DNA, 25 bp, Rattus norvegicus
aaaggtggtgtggtactgcccatct

SEQ ID NO: 13267 - DNA, 25 bp, Rattus norvegicus
aaaggtgtcagcaggtgcaaggaat

SEQ ID NO: 13268 - DNA, 25 bp, Rattus norvegicus
aaaggtgtcagctggtgcaaggaat

SEQ ID NO: 13269 - DNA, 25 bp, Rattus norvegicus
aaaggtgtcatgctgacgccaagga

SEQ ID NO: 13270 - DNA, 25 bp, Rattus norvegicus
aaaggtgtcatggtgacgccaagga

SEQ ID NO: 13271 - DNA, 25 bp, Rattus norvegicus
aaaggtgtccaaatgtccacctggg

SEQ ID NO: 13272 - DNA, 25 bp, Rattus norvegicus
aaaggtgtccaattgtccacctggg

SEQ ID NO: 13273 - DNA, 25 bp, Rattus norvegicus
aaaggtgtcctcctgctctggaaaa

SEQ ID NO: 13274 - DNA, 25 bp, Rattus norvegicus
aaaggtgtcctcgtgctctggaaaa

SEQ ID NO: 13275 - DNA, 25 bp, Rattus norvegicus
aaaggtgtcctgaaagcagctgcta

SEQ ID NO: 13276 - DNA, 25 bp, Rattus norvegicus
aaaggtgtcctgtaagcagctgcta

SEQ ID NO: 13277 - DNA, 25 bp, Rattus norvegicus
aaaggtgtccttagacttacataca

SEQ ID NO: 13278 - DNA, 25 bp, Rattus norvegicus
aaaggtgtcctttgacttacataca

SEQ ID NO: 13279 - DNA, 25 bp, Rattus norvegicus
aaaggtgtctagcatcttcttcagc

SEQ ID NO: 13280 - DNA, 25 bp, Rattus norvegicus
aaaggtgtctaggatcttcttcagc

SEQ ID NO: 13281 - DNA, 25 bp, Rattus norvegicus
aaaggtgtctccatccaacttggat

SEQ ID NO: 13282 - DNA, 25 bp, Rattus norvegicus
aaaggtgtctccttccaacttggat

SEQ ID NO: 13283 - DNA, 25 bp, Rattus norvegicus
aaaggtgtctgtaccatgttcccgc

SEQ ID NO: 13284 - DNA, 25 bp, Rattus norvegicus
aaaggtgtctgttccatgttcccgc

SEQ ID NO: 13285 - DNA, 25 bp, Rattus norvegicus
aaaggtgtcttccatgccctagtct

SEQ ID NO: 13286 - DNA, 25 bp, Rattus norvegicus
aaaggtgtcttcgatgccctagtct

SEQ ID NO: 13287 - DNA, 25 bp, Rattus norvegicus
aaaggtgtctttaatccagtgagga

SEQ ID NO: 13288 - DNA, 25 bp, Rattus norvegicus
aaaggtgtctttatgtgttgccaag

SEQ ID NO: 13289 - DNA, 25 bp, Rattus norvegicus
aaaggtgtcttttatccagtgagga

SEQ ID NO: 13290 - DNA, 25 bp, Rattus norvegicus
aaaggtgtctttttgtgttgccaag

SEQ ID NO: 13291 - DNA, 25 bp, Rattus norvegicus
aaaggtgtgcacaacttcgcccagt

SEQ ID NO: 13292 - DNA, 25 bp, Rattus norvegicus
aaaggtgtgcactacttcgcccagt

SEQ ID NO: 13293 - DNA, 25 bp, Rattus norvegicus
aaaggtgtgccgcagtgttacctgc

SEQ ID NO: 13294 - DNA, 25 bp, Rattus norvegicus
aaaggtgtgccggagtgttacctgc

SEQ ID NO: 13295 - DNA, 25 bp, Rattus norvegicus
aaaggtgtgcgccacgaccatctgg

SEQ ID NO: 13296 - DNA, 25 bp, Rattus norvegicus
aaaggtgtgcgcgacgaccatctgg

SEQ ID NO: 13297 - DNA, 25 bp, Rattus norvegicus
aaaggtgtgcgtctgttgttgtttc

SEQ ID NO: 13298 - DNA, 25 bp, Rattus norvegicus
aaaggtgtgcgtgtgttgttgtttc

SEQ ID NO: 13299 - DNA, 25 bp, Rattus norvegicus
aaaggtgtgtctaaccatgaagaat

SEQ ID NO: 13300 - DNA, 25 bp, Rattus norvegicus
aaaggtgtgtcttaccatgaagaat

SEQ ID NO: 13301 - DNA, 25 bp, Rattus norvegicus
aaaggtgttaccatttctactgagg

SEQ ID NO: 13302 - DNA, 25 bp, Rattus norvegicus
aaaggtgttaccttttctactgagg

SEQ ID NO: 13303 - DNA, 25 bp, Rattus norvegicus
aaaggtgttattatgctgcccattt

SEQ ID NO: 13304 - DNA, 25 bp, Rattus norvegicus
aaaggtgttattttgctgcccattt

SEQ ID NO: 13305 - DNA, 25 bp, Rattus norvegicus
aaaggtgttcaacgtctctctggga

SEQ ID NO: 13306 - DNA, 25 bp, Rattus norvegicus
aaaggtgttcaaggtctctctggga

SEQ ID NO: 13307 - DNA, 25 bp, Rattus norvegicus
aaaggtgttcttattggacagcaga

SEQ ID NO: 13308 - DNA, 25 bp, Rattus norvegicus
aaaggtgttctttttggacagcaga

SEQ ID NO: 13309 - DNA, 25 bp, Rattus norvegicus
aaaggtgtttgacagaatgtcagct

SEQ ID NO: 13310 - DNA, 25 bp, Rattus norvegicus
aaaggtgtttgagagaatgtcagct

SEQ ID NO: 13311 - DNA, 25 bp, Rattus norvegicus
aaaggttaagcaattgtcagtcaga

SEQ ID NO: 13312 - DNA, 25 bp, Rattus norvegicus
aaaggttaagcatttgtcagtcaga

SEQ ID NO: 13313 - DNA, 25 bp, Rattus norvegicus
aaaggttaccctctctgccggatat

SEQ ID NO: 13314 - DNA, 25 bp, Rattus norvegicus
aaaggttaccctgtctgccggatat

SEQ ID NO: 13315 - DNA, 25 bp, Rattus norvegicus
aaaggttaccgtcgcatctgtggct

SEQ ID NO: 13316 - DNA, 25 bp, Rattus norvegicus
aaaggttaccgtggcatctgtggct

SEQ ID NO: 13317 - DNA, 25 bp, Rattus norvegicus
aaaggttagtgaagctccagcggct

SEQ ID NO: 13318 - DNA, 25 bp, Rattus norvegicus
aaaggttagtgatgctccagcggct

SEQ ID NO: 13319 - DNA, 25 bp, Rattus norvegicus
aaaggttcacatccctttggcttcc

SEQ ID NO: 13320 - DNA, 25 bp, Rattus norvegicus
aaaggttcacatgcctttggcttcc

SEQ ID NO: 13321 - DNA, 25 bp, Rattus norvegicus
aaaggttcatctacgactgagcccg

SEQ ID NO: 13322 - DNA, 25 bp, Rattus norvegicus
aaaggttcatcttcgactgagcccg

SEQ ID NO: 13323 - DNA, 25 bp, Rattus norvegicus
aaaggttcatggacacagtggagta

SEQ ID NO: 13324 - DNA, 25 bp, Rattus norvegicus
aaaggttcatggtcacagtggagta

SEQ ID NO: 13325 - DNA, 25 bp, Rattus norvegicus
aaaggttcctgcagctggtcaggta

SEQ ID NO: 13326 - DNA, 25 bp, Rattus norvegicus
aaaggttcctgctgctggtcaggta

SEQ ID NO: 13327 - DNA, 25 bp, Rattus norvegicus
aaaggttcctttcgtagcatctcct

SEQ ID NO: 13328 - DNA, 25 bp, Rattus norvegicus
aaaggttcctttggtagcatctcct

SEQ ID NO: 13329 - DNA, 25 bp, Rattus norvegicus
aaaggttctccaaggtgatagacaa

SEQ ID NO: 13330 - DNA, 25 bp, Rattus norvegicus
aaaggttctccatggtgatagacaa

SEQ ID NO: 13331 - DNA, 25 bp, Rattus norvegicus
aaaggttctgaacttgaccagtacg

SEQ ID NO: 13332 - DNA, 25 bp, Rattus norvegicus
aaaggttctgaagttgaccagtacg

SEQ ID NO: 13333 - DNA, 25 bp, Rattus norvegicus
aaaggttctgatccagtctgccacc

SEQ ID NO: 13334 - DNA, 25 bp, Rattus norvegicus
aaaggttctgatgcagtctgccacc

SEQ ID NO: 13335 - DNA, 25 bp, Rattus norvegicus
aaaggttctgccacgggatgcagtc

SEQ ID NO: 13336 - DNA, 25 bp, Rattus norvegicus
aaaggttctgcctcgggatgcagtc

SEQ ID NO: 13337 - DNA, 25 bp, Rattus norvegicus
aaaggttctgtcatggtctaggcgt

SEQ ID NO: 13338 - DNA, 25 bp, Rattus norvegicus
aaaggttctgtcttggtctaggcgt

SEQ ID NO: 13339 - DNA, 25 bp, Rattus norvegicus
aaaggttctttgagtatagccaaat

SEQ ID NO: 13340 - DNA, 25 bp, Rattus norvegicus
aaaggttctttgtgtatagccaaat

SEQ ID NO: 13341 - DNA, 25 bp, Rattus norvegicus
aaaggttgacatctgccattatatg

SEQ ID NO: 13342 - DNA, 25 bp, Rattus norvegicus
aaaggttgacatgtgccattatatg

SEQ ID NO: 13343 - DNA, 25 bp, Rattus norvegicus
aaaggttgacctagtaatgtacatt

SEQ ID NO: 13344 - DNA, 25 bp, Rattus norvegicus
aaaggttgaccttgtaatgtacatt

SEQ ID NO: 13345 - DNA, 25 bp, Rattus norvegicus
aaaggttgctttcgctcttctgcct

SEQ ID NO: 13346 - DNA, 25 bp, Rattus norvegicus
aaaggttgctttggctcttctgcct

SEQ ID NO: 13347 - DNA, 25 bp, Rattus norvegicus
aaaggttggcaaagccccatcatct

SEQ ID NO: 13348 - DNA, 25 bp, Rattus norvegicus
aaaggttggcaatgccccatcatct

SEQ ID NO: 13349 - DNA, 25 bp, Rattus norvegicus
aaaggttggcatcacctattttcat

SEQ ID NO: 13350 - DNA, 25 bp, Rattus norvegicus
aaaggttggcatgacctattttcat

SEQ ID NO: 13351 - DNA, 25 bp, Rattus norvegicus
aaaggttgtactcattgtatttaca

SEQ ID NO: 13352 - DNA, 25 bp, Rattus norvegicus
aaaggttgtactgattgtatttaca

SEQ ID NO: 13353 - DNA, 25 bp, Rattus norvegicus
aaaggttgtgttaggattgtcagga

SEQ ID NO: 13354 - DNA, 25 bp, Rattus norvegicus
aaaggttgtgtttggattgtcagga

SEQ ID NO: 13355 - DNA, 25 bp, Rattus norvegicus
aaaggttgtttgcatgtgattcatc

SEQ ID NO: 13356 - DNA, 25 bp, Rattus norvegicus
aaaggttgtttggatgtgattcatc

SEQ ID NO: 13357 - DNA, 25 bp, Rattus norvegicus
aaaggtttaactagtatgacagcaa

SEQ ID NO: 13358 - DNA, 25 bp, Rattus norvegicus
aaaggtttaacttgtatgacagcaa

SEQ ID NO: 13359 - DNA, 25 bp, Rattus norvegicus
aaaggtttagctcaggctccttggg

SEQ ID NO: 13360 - DNA, 25 bp, Rattus norvegicus
aaaggtttagctgaggctccttggg

SEQ ID NO: 13361 - DNA, 25 bp, Rattus norvegicus
aaaggtttccaaccgtacagcgccg

SEQ ID NO: 13362 - DNA, 25 bp, Rattus norvegicus
aaaggtttccaagcgtacagcgccg

SEQ ID NO: 13363 - DNA, 25 bp, Rattus norvegicus
aaaggtttccatcctctactgtggt

SEQ ID NO: 13364 - DNA, 25 bp, Rattus norvegicus
aaaggtttccatgctctactgtggt

SEQ ID NO: 13365 - DNA, 25 bp, Rattus norvegicus
aaaggtttcctgactgtacattgtt

SEQ ID NO: 13366 - DNA, 25 bp, Rattus norvegicus
aaaggtttcctgtctgtacattgtt

SEQ ID NO: 13367 - DNA, 25 bp, Rattus norvegicus
aaaggtttctggattcccgtcaatg

SEQ ID NO: 13368 - DNA, 25 bp, Rattus norvegicus
aaaggtttctggtttcccgtcaatg

SEQ ID NO: 13369 - DNA, 25 bp, Rattus norvegicus
aaaggtttcttgagcttgactgtca

SEQ ID NO: 13370 - DNA, 25 bp, Rattus norvegicus
aaaggtttcttgtgcttgactgtca

SEQ ID NO: 13371 - DNA, 25 bp, Rattus norvegicus
aaaggtttctttactgtgtctctcg

SEQ ID NO: 13372 - DNA, 25 bp, Rattus norvegicus
aaaggtttcttttctgtgtctctcg

SEQ ID NO: 13373 - DNA, 25 bp, Rattus norvegicus
aaaggtttgcacaatcaccacctgg

SEQ ID NO: 13374 - DNA, 25 bp, Rattus norvegicus
aaaggtttgcactatcaccacctgg

SEQ ID NO: 13375 - DNA, 25 bp, Rattus norvegicus
aaaggtttgtacagtctgagtgcac

SEQ ID NO: 13376 - DNA, 25 bp, Rattus norvegicus
aaaggtttgtactgtctgagtgcac

SEQ ID NO: 13377 - DNA, 25 bp, Rattus norvegicus
aaaggtttgtctcggctgatggctc

SEQ ID NO: 13378 - DNA, 25 bp, Rattus norvegicus
aaaggtttgtctgggctgatggctc

SEQ ID NO: 13379 - DNA, 25 bp, Rattus norvegicus
aaaggttttccccagagcaatgtga

SEQ ID NO: 13380 - DNA, 25 bp, Rattus norvegicus
aaaggttttcccgagagcaatgtga

SEQ ID NO: 13381 - DNA, 25 bp, Rattus norvegicus
aaaggttttcgacatactggccaca

SEQ ID NO: 13382 - DNA, 25 bp, Rattus norvegicus
aaaggttttcgagatactggccaca

SEQ ID NO: 13383 - DNA, 25 bp, Rattus norvegicus
aaaggttttgctaggtctcctgact

SEQ ID NO: 13384 - DNA, 25 bp, Rattus norvegicus
aaaggttttgcttggtctcctgact

SEQ ID NO: 13385 - DNA, 25 bp, Rattus norvegicus
aaagtaaatcctacctgccttagct

SEQ ID NO: 13386 - DNA, 25 bp, Rattus norvegicus
aaagtaaatccttcctgccttagct

SEQ ID NO: 13387 - DNA, 25 bp, Rattus norvegicus
aaagtaaattagcttcctcttgaag

SEQ ID NO: 13388 - DNA, 25 bp, Rattus norvegicus
aaagtaaattaggttcctcttgaag

SEQ ID NO: 13389 - DNA, 25 bp, Rattus norvegicus
aaagtaacaccaaatcctcacagcc

SEQ ID NO: 13390 - DNA, 25 bp, Rattus norvegicus
aaagtaacaccatatcctcacagcc

SEQ ID NO: 13391 - DNA, 25 bp, Rattus norvegicus
aaagtaacctgtcggcagctttctt

SEQ ID NO: 13392 - DNA, 25 bp, Rattus norvegicus
aaagtaacctgtgggcagctttctt

SEQ ID NO: 13393 - DNA, 25 bp, Rattus norvegicus
aaagtaactagtccagagaaagctg

SEQ ID NO: 13394 - DNA, 25 bp, Rattus norvegicus
aaagtaactagtgcagagaaagctg

SEQ ID NO: 13395 - DNA, 25 bp, Rattus norvegicus
aaagtaactcagcatgacagcccct

SEQ ID NO: 13396 - DNA, 25 bp, Rattus norvegicus
aaagtaactcaggatgacagcccct

SEQ ID NO: 13397 - DNA, 25 bp, Rattus norvegicus
aaagtaactccccaagcagcccata

SEQ ID NO: 13398 - DNA, 25 bp, Rattus norvegicus
aaagtaactcccgaagcagcccata

SEQ ID NO: 13399 - DNA, 25 bp, Rattus norvegicus
aaagtaactggcaaccattcgcaca

SEQ ID NO: 13400 - DNA, 25 bp, Rattus norvegicus
aaagtaactggctaccattcgcaca

SEQ ID NO: 13401 - DNA, 25 bp, Rattus norvegicus
aaagtaagccacctgctgtctgctc

SEQ ID NO: 13402 - DNA, 25 bp, Rattus norvegicus
aaagtaagccacgtgctgtctgctc

SEQ ID NO: 13403 - DNA, 25 bp, Rattus norvegicus
aaagtaagcgtcagcgcttgcggcc

SEQ ID NO: 13404 - DNA, 25 bp, Rattus norvegicus
aaagtaagcgtctgcgcttgcggcc

SEQ ID NO: 13405 - DNA, 25 bp, Rattus norvegicus
aaagtaagctatactcacatctgag

SEQ ID NO: 13406 - DNA, 25 bp, Rattus norvegicus
aaagtaagctattctcacatctgag

SEQ ID NO: 13407 - DNA, 25 bp, Rattus norvegicus
aaagtaatccaaagccatcagtgtt

SEQ ID NO: 13408 - DNA, 25 bp, Rattus norvegicus
aaagtaatccaatgccatcagtgtt

SEQ ID NO: 13409 - DNA, 25 bp, Rattus norvegicus
aaagtaatcgcaacctggtggctca

SEQ ID NO: 13410 - DNA, 25 bp, Rattus norvegicus
aaagtaatcgcatcctggtggctca

SEQ ID NO: 13411 - DNA, 25 bp, Rattus norvegicus
aaagtaatcgccctgactgttgccc

SEQ ID NO: 13412 - DNA, 25 bp, Rattus norvegicus
aaagtaatcgccgtgactgttgccc

SEQ ID NO: 13413 - DNA, 25 bp, Rattus norvegicus
aaagtaatggacacggatgaagatg

SEQ ID NO: 13414 - DNA, 25 bp, Rattus norvegicus
aaagtaatggactcggatgaagatg

SEQ ID NO: 13415 - DNA, 25 bp, Rattus norvegicus
aaagtaatgttgaccaaagctgtgt

SEQ ID NO: 13416 - DNA, 25 bp, Rattus norvegicus
aaagtaatgttgtccaaagctgtgt

SEQ ID NO: 13417 - DNA, 25 bp, Rattus norvegicus
aaagtaattaccaatgccaaaacag

SEQ ID NO: 13418 - DNA, 25 bp, Rattus norvegicus
aaagtaattacctatgccaaaacag

SEQ ID NO: 13419 - DNA, 25 bp, Rattus norvegicus
aaagtaattcttataggctgtggag

SEQ ID NO: 13420 - DNA, 25 bp, Rattus norvegicus
aaagtaattcttttaggctgtggag

SEQ ID NO: 13421 - DNA, 25 bp, Rattus norvegicus
aaagtaattgtgaccttgcctacag

SEQ ID NO: 13422 - DNA, 25 bp, Rattus norvegicus
aaagtaattgtgtccttgcctacag

SEQ ID NO: 13423 - DNA, 25 bp, Rattus norvegicus
aaagtacagcgtatgcatattcctc

SEQ ID NO: 13424 - DNA, 25 bp, Rattus norvegicus
aaagtacagcgtttgcatattcctc

SEQ ID NO: 13425 - DNA, 25 bp, Rattus norvegicus
aaagtacaggccaggtgactcttct

SEQ ID NO: 13426 - DNA, 25 bp, Rattus norvegicus
aaagtacaggcctggtgactcttct

SEQ ID NO: 13427 - DNA, 25 bp, Rattus norvegicus
aaagtacatcccacaagttcactga

SEQ ID NO: 13428 - DNA, 25 bp, Rattus norvegicus
aaagtacatccctcaagttcactga

SEQ ID NO: 13429 - DNA, 25 bp, Rattus norvegicus
aaagtaccaagacaccatgcatttt

SEQ ID NO: 13430 - DNA, 25 bp, Rattus norvegicus
aaagtaccaagagaccatgcatttt

SEQ ID NO: 13431 - DNA, 25 bp, Rattus norvegicus
aaagtaccacttacatccttgcaac

SEQ ID NO: 13432 - DNA, 25 bp, Rattus norvegicus
aaagtaccactttcatccttgcaac

SEQ ID NO: 13433 - DNA, 25 bp, Rattus norvegicus
aaagtaccaggcactaggtcggcgc

SEQ ID NO: 13434 - DNA, 25 bp, Rattus norvegicus
aaagtaccaggctctaggtcggcgc

SEQ ID NO: 13435 - DNA, 25 bp, Rattus norvegicus
aaagtaccattacccagtctgaaat

SEQ ID NO: 13436 - DNA, 25 bp, Rattus norvegicus
aaagtaccattagccagtctgaaat

SEQ ID NO: 13437 - DNA, 25 bp, Rattus norvegicus
aaagtacccacactgcgaggagaag

SEQ ID NO: 13438 - DNA, 25 bp, Rattus norvegicus
aaagtacccacagtgcgaggagaag

SEQ ID NO: 13439 - DNA, 25 bp, Rattus norvegicus
aaagtacccgtaactactgtgtcca

SEQ ID NO: 13440 - DNA, 25 bp, Rattus norvegicus
aaagtacccgtatctactgtgtcca

SEQ ID NO: 13441 - DNA, 25 bp, Rattus norvegicus
aaagtaccctcactccagtggttca

SEQ ID NO: 13442 - DNA, 25 bp, Rattus norvegicus
aaagtaccctcactgtttgcatatg

SEQ ID NO: 13443 - DNA, 25 bp, Rattus norvegicus
aaagtaccctcagtccagtggttca

SEQ ID NO: 13444 - DNA, 25 bp, Rattus norvegicus
aaagtaccctcagtgtttgcatatg

SEQ ID NO: 13445 - DNA, 25 bp, Rattus norvegicus
aaagtacctcaccttctgaatgctg

SEQ ID NO: 13446 - DNA, 25 bp, Rattus norvegicus
aaagtacctcacgttctgaatgctg

SEQ ID NO: 13447 - DNA, 25 bp, Rattus norvegicus
aaagtacctcatcggttttcactgc

SEQ ID NO: 13448 - DNA, 25 bp, Rattus norvegicus
aaagtacctcatgggttttcactgc

SEQ ID NO: 13449 - DNA, 25 bp, Rattus norvegicus
aaagtacctgagctggtgttctctt

SEQ ID NO: 13450 - DNA, 25 bp, Rattus norvegicus
aaagtacctgaggtggtgttctctt

SEQ ID NO: 13451 - DNA, 25 bp, Rattus norvegicus
aaagtacctggtactacacacagat

SEQ ID NO: 13452 - DNA, 25 bp, Rattus norvegicus
aaagtacctggttctacacacagat

SEQ ID NO: 13453 - DNA, 25 bp, Rattus norvegicus
aaagtacctgttatgccagccctgg

SEQ ID NO: 13454 - DNA, 25 bp, Rattus norvegicus
aaagtacctgttttgccagccctgg

SEQ ID NO: 13455 - DNA, 25 bp, Rattus norvegicus
aaagtacctttcaatccataccgct

SEQ ID NO: 13456 - DNA, 25 bp, Rattus norvegicus
aaagtacctttctatccataccgct

SEQ ID NO: 13457 - DNA, 25 bp, Rattus norvegicus
aaagtacgacgtccagcacttgcag

SEQ ID NO: 13458 - DNA, 25 bp, Rattus norvegicus
aaagtacgacgtgcagcacttgcag

SEQ ID NO: 13459 - DNA, 25 bp, Rattus norvegicus
aaagtacgagcactgtatgaagatc

SEQ ID NO: 13460 - DNA, 25 bp, Rattus norvegicus
aaagtacgagcagtgtatgaagatc

SEQ ID NO: 13461 - DNA, 25 bp, Rattus norvegicus
aaagtactacgacctagcccggaag

SEQ ID NO: 13462 - DNA, 25 bp, Rattus norvegicus
aaagtactacgagctagcccggaag

SEQ ID NO: 13463 - DNA, 25 bp, Rattus norvegicus
aaagtactctctacctcttcctgag

SEQ ID NO: 13464 - DNA, 25 bp, Rattus norvegicus
aaagtactctcttcctcttcctgag

SEQ ID NO: 13465 - DNA, 25 bp, Rattus norvegicus
aaagtactgactccagtttcctccc

SEQ ID NO: 13466 - DNA, 25 bp, Rattus norvegicus
aaagtactgactcttgctgctctgg

SEQ ID NO: 13467 - DNA, 25 bp, Rattus norvegicus
aaagtactgactgcagtttcctccc

SEQ ID NO: 13468 - DNA, 25 bp, Rattus norvegicus
aaagtactgactgttgctgctctgg

SEQ ID NO: 13469 - DNA, 25 bp, Rattus norvegicus
aaagtactgccaatgaggtcttagc

SEQ ID NO: 13470 - DNA, 25 bp, Rattus norvegicus
aaagtactgccattgaggtcttagc

SEQ ID NO: 13471 - DNA, 25 bp, Rattus norvegicus
aaagtacttcaactcctgtcactta

SEQ ID NO: 13472 - DNA, 25 bp, Rattus norvegicus
aaagtacttcaagtcctgtcactta

SEQ ID NO: 13473 - DNA, 25 bp, Rattus norvegicus
aaagtacttcccacttccattatga

SEQ ID NO: 13474 - DNA, 25 bp, Rattus norvegicus
aaagtacttccctcttccattatga

SEQ ID NO: 13475 - DNA, 25 bp, Rattus norvegicus
aaagtacttcctagtccagggtcag

SEQ ID NO: 13476 - DNA, 25 bp, Rattus norvegicus
aaagtacttccttgtccagggtcag

SEQ ID NO: 13477 - DNA, 25 bp, Rattus norvegicus
aaagtacttgaaaaagggctattga

SEQ ID NO: 13478 - DNA, 25 bp, Rattus norvegicus
aaagtacttgaataagggctattga

SEQ ID NO: 13479 - DNA, 25 bp, Rattus norvegicus
aaagtacttgtcctggtatcgcact

SEQ ID NO: 13480 - DNA, 25 bp, Rattus norvegicus
aaagtacttgtcgtggtatcgcact

SEQ ID NO: 13481 - DNA, 25 bp, Rattus norvegicus
aaagtacttgtgcacctggccatct

SEQ ID NO: 13482 - DNA, 25 bp, Rattus norvegicus
aaagtacttgtggacctggccatct

SEQ ID NO: 13483 - DNA, 25 bp, Rattus norvegicus
aaagtactttgtcggctatctggga

SEQ ID NO: 13484 - DNA, 25 bp, Rattus norvegicus
aaagtactttgtgggctatctggga

SEQ ID NO: 13485 - DNA, 25 bp, Rattus norvegicus
aaagtacttttaatccatatgtgat

SEQ ID NO: 13486 - DNA, 25 bp, Rattus norvegicus
aaagtacttttattccatatgtgat

SEQ ID NO: 13487 - DNA, 25 bp, Rattus norvegicus
aaagtagagcccaagctggtcttcg

SEQ ID NO: 13488 - DNA, 25 bp, Rattus norvegicus
aaagtagagccctagctggtcttcg

SEQ ID NO: 13489 - DNA, 25 bp, Rattus norvegicus
aaagtagcaagacgcgtggtgaatt

SEQ ID NO: 13490 - DNA, 25 bp, Rattus norvegicus
aaagtagcaagaggcgtggtgaatt

SEQ ID NO: 13491 - DNA, 25 bp, Rattus norvegicus
aaagtagcagctcgcattcttagtg

SEQ ID NO: 13492 - DNA, 25 bp, Rattus norvegicus
aaagtagcagctggcattcttagtg

SEQ ID NO: 13493 - DNA, 25 bp, Rattus norvegicus
aaagtagcctgtatgatattgtaac

SEQ ID NO: 13494 - DNA, 25 bp, Rattus norvegicus
aaagtagcctgtttgatattgtaac

SEQ ID NO: 13495 - DNA, 25 bp, Rattus norvegicus
aaagtagccttcactgccctgagga

SEQ ID NO: 13496 - DNA, 25 bp, Rattus norvegicus
aaagtagccttctctgccctgagga

SEQ ID NO: 13497 - DNA, 25 bp, Rattus norvegicus
aaagtagcgctaactagcccctctt

SEQ ID NO: 13498 - DNA, 25 bp, Rattus norvegicus
aaagtagcgctatctagcccctctt

SEQ ID NO: 13499 - DNA, 25 bp, Rattus norvegicus
aaagtagctgagagccgggtcctaa

SEQ ID NO: 13500 - DNA, 25 bp, Rattus norvegicus
aaagtagctgagtgccgggtcctaa

SEQ ID NO: 13501 - DNA, 25 bp, Rattus norvegicus
aaagtagcttcaacagcatgcccta

SEQ ID NO: 13502 - DNA, 25 bp, Rattus norvegicus
aaagtagcttcatcagcatgcccta

SEQ ID NO: 13503 - DNA, 25 bp, Rattus norvegicus
aaagtaggccaacccagctgtcggg

SEQ ID NO: 13504 - DNA, 25 bp, Rattus norvegicus
aaagtaggccaagccagctgtcggg

SEQ ID NO: 13505 - DNA, 25 bp, Rattus norvegicus
aaagtaggtcttatctagatagaag

SEQ ID NO: 13506 - DNA, 25 bp, Rattus norvegicus
aaagtaggtcttttctagatagaag

SEQ ID NO: 13507 - DNA, 25 bp, Rattus norvegicus
aaagtagtaagcatctgccctcttc

SEQ ID NO: 13508 - DNA, 25 bp, Rattus norvegicus
aaagtagtaagcttctgccctcttc

SEQ ID NO: 13509 - DNA, 25 bp, Rattus norvegicus
aaagtagtatctcctggtggcctat

SEQ ID NO: 13510 - DNA, 25 bp, Rattus norvegicus
aaagtagtatctgctggtggcctat

SEQ ID NO: 13511 - DNA, 25 bp, Rattus norvegicus
aaagtagtgagcactaggctccagt

SEQ ID NO: 13512 - DNA, 25 bp, Rattus norvegicus
aaagtagtgagctctaggctccagt

SEQ ID NO: 13513 - DNA, 25 bp, Rattus norvegicus
aaagtagtgctgaaaatattctgcc

SEQ ID NO: 13514 - DNA, 25 bp, Rattus norvegicus
aaagtagtgctgtaaatattctgcc

SEQ ID NO: 13515 - DNA, 25 bp, Rattus norvegicus
aaagtagttcctagcaatcacaaac

SEQ ID NO: 13516 - DNA, 25 bp, Rattus norvegicus
aaagtagttccttgcaatcacaaac

SEQ ID NO: 13517 - DNA, 25 bp, Rattus norvegicus
aaagtatactttccccactgacagt

SEQ ID NO: 13518 - DNA, 25 bp, Rattus norvegicus
aaagtatactttgcccactgacagt

SEQ ID NO: 13519 - DNA, 25 bp, Rattus norvegicus
aaagtatagaccactactcggccgc

SEQ ID NO: 13520 - DNA, 25 bp, Rattus norvegicus
aaagtatagacctctactcggccgc

SEQ ID NO: 13521 - DNA, 25 bp, Rattus norvegicus
aaagtatagctcatcctccatgaac

SEQ ID NO: 13522 - DNA, 25 bp, Rattus norvegicus
aaagtatagctcttcctccatgaac

SEQ ID NO: 13523 - DNA, 25 bp, Rattus norvegicus
aaagtatccagaaggccgtgggccc

SEQ ID NO: 13524 - DNA, 25 bp, Rattus norvegicus
aaagtatccagatggccgtgggccc

SEQ ID NO: 13525 - DNA, 25 bp, Rattus norvegicus
aaagtatccttaccttcagtgtgaa

SEQ ID NO: 13526 - DNA, 25 bp, Rattus norvegicus
aaagtatccttagcttcagtgtgaa

SEQ ID NO: 13527 - DNA, 25 bp, Rattus norvegicus
aaagtatcttcgctacccatgctct

SEQ ID NO: 13528 - DNA, 25 bp, Rattus norvegicus
aaagtatcttcggtacccatgctct

SEQ ID NO: 13529 - DNA, 25 bp, Rattus norvegicus
aaagtatctttacgcatcacccctg

SEQ ID NO: 13530 - DNA, 25 bp, Rattus norvegicus
aaagtatctttaggcatcacccctg

SEQ ID NO: 13531 - DNA, 25 bp, Rattus norvegicus
aaagtatgagccaaccagtcgtggt

SEQ ID NO: 13532 - DNA, 25 bp, Rattus norvegicus
aaagtatgagcctaccagtcgtggt

SEQ ID NO: 13533 - DNA, 25 bp, Rattus norvegicus
aaagtatgaggtcgtcctgtctccc

SEQ ID NO: 13534 - DNA, 25 bp, Rattus norvegicus
aaagtatgaggtggtcctgtctccc

SEQ ID NO: 13535 - DNA, 25 bp, Rattus norvegicus
aaagtatgccctcactacaactacc

SEQ ID NO: 13536 - DNA, 25 bp, Rattus norvegicus
aaagtatgccctgactacaactacc

SEQ ID NO: 13537 - DNA, 25 bp, Rattus norvegicus
aaagtatggaccctgaactgccacg

SEQ ID NO: 13538 - DNA, 25 bp, Rattus norvegicus
aaagtatggaccgtgaactgccacg

SEQ ID NO: 13539 - DNA, 25 bp, Rattus norvegicus
aaagtatgtattatccctgcggatg

SEQ ID NO: 13540 - DNA, 25 bp, Rattus norvegicus
aaagtatgtattttccctgcggatg

SEQ ID NO: 13541 - DNA, 25 bp, Rattus norvegicus
aaagtatgtctcagacacagcaaaa

SEQ ID NO: 13542 - DNA, 25 bp, Rattus norvegicus
aaagtatgtctctgacacagcaaaa

SEQ ID NO: 13543 - DNA, 25 bp, Rattus norvegicus
aaagtattcggaagacctacctgag

SEQ ID NO: 13544 - DNA, 25 bp, Rattus norvegicus
aaagtattcggatgacctacctgag

SEQ ID NO: 13545 - DNA, 25 bp, Rattus norvegicus
aaagtattgcacatcgcctggaact

SEQ ID NO: 13546 - DNA, 25 bp, Rattus norvegicus
aaagtattgcacttcgcctggaact

SEQ ID NO: 13547 - DNA, 25 bp, Rattus norvegicus
aaagtattgccaccttactatggtt

SEQ ID NO: 13548 - DNA, 25 bp, Rattus norvegicus
aaagtattgccagcttactatggtt

SEQ ID NO: 13549 - DNA, 25 bp, Rattus norvegicus
aaagtattgctccagctcttggttt

SEQ ID NO: 13550 - DNA, 25 bp, Rattus norvegicus
aaagtattgctcgagctcttggttt

SEQ ID NO: 13551 - DNA, 25 bp, Rattus norvegicus
aaagtattttctactacgtatgata

SEQ ID NO: 13552 - DNA, 25 bp, Rattus norvegicus
aaagtattttcttctacgtatgata

SEQ ID NO: 13553 - DNA, 25 bp, Rattus norvegicus
aaagtcaaacaaatctgcctccatt

SEQ ID NO: 13554 - DNA, 25 bp, Rattus norvegicus
aaagtcaaacaattctgcctccatt

SEQ ID NO: 13555 - DNA, 25 bp, Rattus norvegicus
aaagtcaaaccccaggaagcctatg

SEQ ID NO: 13556 - DNA, 25 bp, Rattus norvegicus
aaagtcaaacccgaggaagcctatg

SEQ ID NO: 13557 - DNA, 25 bp, Rattus norvegicus
aaagtcaaagacaggctgccctcca

SEQ ID NO: 13558 - DNA, 25 bp, Rattus norvegicus
aaagtcaaagactggctgccctcca

SEQ ID NO: 13559 - DNA, 25 bp, Rattus norvegicus
aaagtcaacaagaacatctgtgaga

SEQ ID NO: 13560 - DNA, 25 bp, Rattus norvegicus
aaagtcaacaagtacatctgtgaga

SEQ ID NO: 13561 - DNA, 25 bp, Rattus norvegicus
aaagtcaacctcatttaatcgatgg

SEQ ID NO: 13562 - DNA, 25 bp, Rattus norvegicus
aaagtcaacctcttttaatcgatgg

SEQ ID NO: 13563 - DNA, 25 bp, Rattus norvegicus
aaagtcaaccttctctctagacttc

SEQ ID NO: 13564 - DNA, 25 bp, Rattus norvegicus
aaagtcaaccttgtctctagacttc

SEQ ID NO: 13565 - DNA, 25 bp, Rattus norvegicus
aaagtcaacttcaggcctgtgtgtg

SEQ ID NO: 13566 - DNA, 25 bp, Rattus norvegicus
aaagtcaacttctggcctgtgtgtg

SEQ ID NO: 13567 - DNA, 25 bp, Rattus norvegicus
aaagtcaacttgatggtgtcctatg

SEQ ID NO: 13568 - DNA, 25 bp, Rattus norvegicus
aaagtcaacttgttggtgtcctatg

SEQ ID NO: 13569 - DNA, 25 bp, Rattus norvegicus
aaagtcaactttcctacctgacccg

SEQ ID NO: 13570 - DNA, 25 bp, Rattus norvegicus
aaagtcaactttgctacctgacccg

SEQ ID NO: 13571 - DNA, 25 bp, Rattus norvegicus
aaagtcaaggccctgtgctcagagc

SEQ ID NO: 13572 - DNA, 25 bp, Rattus norvegicus
aaagtcaaggccgtgtgctcagagc

SEQ ID NO: 13573 - DNA, 25 bp, Rattus norvegicus
aaagtcaagtttccagtctcctaaa

SEQ ID NO: 13574 - DNA, 25 bp, Rattus norvegicus
aaagtcaagtttgcagtctcctaaa

SEQ ID NO: 13575 - DNA, 25 bp, Rattus norvegicus
aaagtcaatttcaatcaagtattag

SEQ ID NO: 13576 - DNA, 25 bp, Rattus norvegicus
aaagtcaatttctatcaagtattag

SEQ ID NO: 13577 - DNA, 25 bp, Rattus norvegicus
aaagtcacaccaacaccgaagggct

SEQ ID NO: 13578 - DNA, 25 bp, Rattus norvegicus
aaagtcacaccatcaccgaagggct

SEQ ID NO: 13579 - DNA, 25 bp, Rattus norvegicus
aaagtcacacggaggcgctgcaagt

SEQ ID NO: 13580 - DNA, 25 bp, Rattus norvegicus
aaagtcacacggtggcgctgcaagt

SEQ ID NO: 13581 - DNA, 25 bp, Rattus norvegicus
aaagtcacatggacatctgcccggt

SEQ ID NO: 13582 - DNA, 25 bp, Rattus norvegicus
aaagtcacatggtcatctgcccggt

SEQ ID NO: 13583 - DNA, 25 bp, Rattus norvegicus
aaagtcaccactcgttcctagcaaa

SEQ ID NO: 13584 - DNA, 25 bp, Rattus norvegicus
aaagtcaccactggttcctagcaaa

SEQ ID NO: 13585 - DNA, 25 bp, Rattus norvegicus
aaagtcacccttaggcatgatggta

SEQ ID NO: 13586 - DNA, 25 bp, Rattus norvegicus
aaagtcaccctttggcatgatggta

SEQ ID NO: 13587 - DNA, 25 bp, Rattus norvegicus
aaagtcacctctacagagaccactg

SEQ ID NO: 13588 - DNA, 25 bp, Rattus norvegicus
aaagtcacctcttcagagaccactg

SEQ ID NO: 13589 - DNA, 25 bp, Rattus norvegicus
aaagtcaccttgacaacgactgagg

SEQ ID NO: 13590 - DNA, 25 bp, Rattus norvegicus
aaagtcaccttgatgggttctgcct

SEQ ID NO: 13591 - DNA, 25 bp, Rattus norvegicus
aaagtcaccttgtcaacgactgagg

SEQ ID NO: 13592 - DNA, 25 bp, Rattus norvegicus
aaagtcaccttgttgggttctgcct

SEQ ID NO: 13593 - DNA, 25 bp, Rattus norvegicus
aaagtcacgaggaaccaggccagga

SEQ ID NO: 13594 - DNA, 25 bp, Rattus norvegicus
aaagtcacgaggtaccaggccagga

SEQ ID NO: 13595 - DNA, 25 bp, Rattus norvegicus
aaagtcacgcttacatatgttggtt

SEQ ID NO: 13596 - DNA, 25 bp, Rattus norvegicus
aaagtcacgctttcatatgttggtt

SEQ ID NO: 13597 - DNA, 25 bp, Rattus norvegicus
aaagtcacgggcatcccagcaaagt

SEQ ID NO: 13598 - DNA, 25 bp, Rattus norvegicus
aaagtcacgggcttcccagcaaagt

SEQ ID NO: 13599 - DNA, 25 bp, Rattus norvegicus
aaagtcacggttccaacactccaag

SEQ ID NO: 13600 - DNA, 25 bp, Rattus norvegicus
aaagtcacggttgcaacactccaag

SEQ ID NO: 13601 - DNA, 25 bp, Rattus norvegicus
aaagtcactctacgcttgtgaggac

SEQ ID NO: 13602 - DNA, 25 bp, Rattus norvegicus
aaagtcactctaggcttgtgaggac

SEQ ID NO: 13603 - DNA, 25 bp, Rattus norvegicus
aaagtcacttccaacttgatctcac

SEQ ID NO: 13604 - DNA, 25 bp, Rattus norvegicus
aaagtcacttcctacttgatctcac

SEQ ID NO: 13605 - DNA, 25 bp, Rattus norvegicus
aaagtcacttgtctcctgggtttca

SEQ ID NO: 13606 - DNA, 25 bp, Rattus norvegicus
aaagtcacttgtgtcctgggtttca

SEQ ID NO: 13607 - DNA, 25 bp, Rattus norvegicus
aaagtcactttccaacttgtcatcc

SEQ ID NO: 13608 - DNA, 25 bp, Rattus norvegicus
aaagtcactttcgaacttgtcatcc

SEQ ID NO: 13609 - DNA, 25 bp, Rattus norvegicus
aaagtcagaggcatgtggcgctcta

SEQ ID NO: 13610 - DNA, 25 bp, Rattus norvegicus
aaagtcagaggcttgtggcgctcta

SEQ ID NO: 13611 - DNA, 25 bp, Rattus norvegicus
aaagtcagattacggcttatgccaa

SEQ ID NO: 13612 - DNA, 25 bp, Rattus norvegicus
aaagtcagattagggcttatgccaa

SEQ ID NO: 13613 - DNA, 25 bp, Rattus norvegicus
aaagtcagcaaactggagatcctgc

SEQ ID NO: 13614 - DNA, 25 bp, Rattus norvegicus
aaagtcagcaaagtggagatcctgc

SEQ ID NO: 13615 - DNA, 25 bp, Rattus norvegicus
aaagtcagccagacaccttgtactg

SEQ ID NO: 13616 - DNA, 25 bp, Rattus norvegicus
aaagtcagccagtcaccttgtactg

SEQ ID NO: 13617 - DNA, 25 bp, Rattus norvegicus
aaagtcagccttccgatgggcacac

SEQ ID NO: 13618 - DNA, 25 bp, Rattus norvegicus
aaagtcagccttgcgatgggcacac

SEQ ID NO: 13619 - DNA, 25 bp, Rattus norvegicus
aaagtcagcgctctgtccaactgga

SEQ ID NO: 13620 - DNA, 25 bp, Rattus norvegicus
aaagtcagcgctgtgtccaactgga

SEQ ID NO: 13621 - DNA, 25 bp, Rattus norvegicus
aaagtcagcggcatggtacttgctc

SEQ ID NO: 13622 - DNA, 25 bp, Rattus norvegicus
aaagtcagcggcttggtacttgctc

SEQ ID NO: 13623 - DNA, 25 bp, Rattus norvegicus
aaagtcagctacaagcacgcctggt

SEQ ID NO: 13624 - DNA, 25 bp, Rattus norvegicus
aaagtcagctactagcacgcctggt

SEQ ID NO: 13625 - DNA, 25 bp, Rattus norvegicus
aaagtcaggcatactctgtgctcat

SEQ ID NO: 13626 - DNA, 25 bp, Rattus norvegicus
aaagtcaggcattctctgtgctcat

SEQ ID NO: 13627 - DNA, 25 bp, Rattus norvegicus
aaagtcaggcctcatttgcacctgg

SEQ ID NO: 13628 - DNA, 25 bp, Rattus norvegicus
aaagtcaggcctgatttgcacctgg

SEQ ID NO: 13629 - DNA, 25 bp, Rattus norvegicus
aaagtcaggctgaagtgctcacgca

SEQ ID NO: 13630 - DNA, 25 bp, Rattus norvegicus
aaagtcaggctgtagtgctcacgca

SEQ ID NO: 13631 - DNA, 25 bp, Rattus norvegicus
aaagtcaggttcagctacatagtaa

SEQ ID NO: 13632 - DNA, 25 bp, Rattus norvegicus
aaagtcaggttctgctacatagtaa

SEQ ID NO: 13633 - DNA, 25 bp, Rattus norvegicus
aaagtcaggttgacaaacccagcct

SEQ ID NO: 13634 - DNA, 25 bp, Rattus norvegicus
aaagtcaggttgtcaaacccagcct

SEQ ID NO: 13635 - DNA, 25 bp, Rattus norvegicus
aaagtcagtagcactctgtttcctc

SEQ ID NO: 13636 - DNA, 25 bp, Rattus norvegicus
aaagtcagtagctctctgtttcctc

SEQ ID NO: 13637 - DNA, 25 bp, Rattus norvegicus
aaagtcagtattacccacttctgtt

SEQ ID NO: 13638 - DNA, 25 bp, Rattus norvegicus
aaagtcagtatttcccacttctgtt

SEQ ID NO: 13639 - DNA, 25 bp, Rattus norvegicus
aaagtcagtggtctttcttcctgta

SEQ ID NO: 13640 - DNA, 25 bp, Rattus norvegicus
aaagtcagtggtgtttcttcctgta

SEQ ID NO: 13641 - DNA, 25 bp, Rattus norvegicus
aaagtcagtgtcaagccaagagctt

SEQ ID NO: 13642 - DNA, 25 bp, Rattus norvegicus
aaagtcagtgtctagccaagagctt

SEQ ID NO: 13643 - DNA, 25 bp, Rattus norvegicus
aaagtcagttaccacatttcacagt

SEQ ID NO: 13644 - DNA, 25 bp, Rattus norvegicus
aaagtcagttacgacatttcacagt

SEQ ID NO: 13645 - DNA, 25 bp, Rattus norvegicus
aaagtcatatcccatgttatctaaa

SEQ ID NO: 13646 - DNA, 25 bp, Rattus norvegicus
aaagtcatatccgatgttatctaaa

SEQ ID NO: 13647 - DNA, 25 bp, Rattus norvegicus
aaagtcatcatcatcagctactcag

SEQ ID NO: 13648 - DNA, 25 bp, Rattus norvegicus
aaagtcatcatcttcagctactcag

SEQ ID NO: 13649 - DNA, 25 bp, Rattus norvegicus
aaagtcatcattctgcaggcctgca

SEQ ID NO: 13650 - DNA, 25 bp, Rattus norvegicus
aaagtcatcattgtgcaggcctgca

SEQ ID NO: 13651 - DNA, 25 bp, Rattus norvegicus
aaagtcatccgacgtcctgaggacc

SEQ ID NO: 13652 - DNA, 25 bp, Rattus norvegicus
aaagtcatccgaggtcctgaggacc

SEQ ID NO: 13653 - DNA, 25 bp, Rattus norvegicus
aaagtcatctataaaagtacaggga

SEQ ID NO: 13654 - DNA, 25 bp, Rattus norvegicus
aaagtcatctatagtcctctcttct

SEQ ID NO: 13655 - DNA, 25 bp, Rattus norvegicus
aaagtcatctattaaagtacaggga

SEQ ID NO: 13656 - DNA, 25 bp, Rattus norvegicus
aaagtcatctattgtcctctcttct

SEQ ID NO: 13657 - DNA, 25 bp, Rattus norvegicus
aaagtcatctcgcaaatcatttcct

SEQ ID NO: 13658 - DNA, 25 bp, Rattus norvegicus
aaagtcatctcggaaatcatttcct

SEQ ID NO: 13659 - DNA, 25 bp, Rattus norvegicus
aaagtcatgaaactctttggatggg

SEQ ID NO: 13660 - DNA, 25 bp, Rattus norvegicus
aaagtcatgaaagtctttggatggg

SEQ ID NO: 13661 - DNA, 25 bp, Rattus norvegicus
aaagtcatgactaaagtggcacggg

SEQ ID NO: 13662 - DNA, 25 bp, Rattus norvegicus
aaagtcatgacttaagtggcacggg

SEQ ID NO: 13663 - DNA, 25 bp, Rattus norvegicus
aaagtcatgttgcaaggtcaccccg

SEQ ID NO: 13664 - DNA, 25 bp, Rattus norvegicus
aaagtcatgttggaaggtcaccccg

SEQ ID NO: 13665 - DNA, 25 bp, Rattus norvegicus
aaagtcattgacatccgggagtgga

SEQ ID NO: 13666 - DNA, 25 bp, Rattus norvegicus
aaagtcattgacttccgggagtgga

SEQ ID NO: 13667 - DNA, 25 bp, Rattus norvegicus
aaagtcattttacctgccacctatg

SEQ ID NO: 13668 - DNA, 25 bp, Rattus norvegicus
aaagtcattttagctgccacctatg

SEQ ID NO: 13669 - DNA, 25 bp, Rattus norvegicus
aaagtccaaagcacaggctaccccg

SEQ ID NO: 13670 - DNA, 25 bp, Rattus norvegicus
aaagtccaaagctcaggctaccccg

SEQ ID NO: 13671 - DNA, 25 bp, Rattus norvegicus
aaagtccaagataccatccctggga

SEQ ID NO: 13672 - DNA, 25 bp, Rattus norvegicus
aaagtccaagattccatccctggga

SEQ ID NO: 13673 - DNA, 25 bp, Rattus norvegicus
aaagtccaatcaagtgcggctcctg

SEQ ID NO: 13674 - DNA, 25 bp, Rattus norvegicus
aaagtccaatcatgtgcggctcctg

SEQ ID NO: 13675 - DNA, 25 bp, Rattus norvegicus
aaagtccacagccacagtgactcac

SEQ ID NO: 13676 - DNA, 25 bp, Rattus norvegicus
aaagtccacagcgacagtgactcac

SEQ ID NO: 13677 - DNA, 25 bp, Rattus norvegicus
aaagtccacataaccgaggccactg

SEQ ID NO: 13678 - DNA, 25 bp, Rattus norvegicus
aaagtccacatacctctcctgtttt

SEQ ID NO: 13679 - DNA, 25 bp, Rattus norvegicus
aaagtccacatacctggtgcaactt

SEQ ID NO: 13680 - DNA, 25 bp, Rattus norvegicus
aaagtccacatagctctcctgtttt

SEQ ID NO: 13681 - DNA, 25 bp, Rattus norvegicus
aaagtccacatagctggtgcaactt

SEQ ID NO: 13682 - DNA, 25 bp, Rattus norvegicus
aaagtccacatatccgaggccactg

SEQ ID NO: 13683 - DNA, 25 bp, Rattus norvegicus
aaagtccaccgacagttactgggca

SEQ ID NO: 13684 - DNA, 25 bp, Rattus norvegicus
aaagtccaccgacgagccgattctg

SEQ ID NO: 13685 - DNA, 25 bp, Rattus norvegicus
aaagtccaccgagagttactgggca

SEQ ID NO: 13686 - DNA, 25 bp, Rattus norvegicus
aaagtccaccgaggagccgattctg

SEQ ID NO: 13687 - DNA, 25 bp, Rattus norvegicus
aaagtccacctcaaatgtcctatct

SEQ ID NO: 13688 - DNA, 25 bp, Rattus norvegicus
aaagtccacctctaatgtcctatct

SEQ ID NO: 13689 - DNA, 25 bp, Rattus norvegicus
aaagtccactaaactgtctccaact

SEQ ID NO: 13690 - DNA, 25 bp, Rattus norvegicus
aaagtccactaatctgtctccaact

SEQ ID NO: 13691 - DNA, 25 bp, Rattus norvegicus
aaagtccactgcaccttttggattg

SEQ ID NO: 13692 - DNA, 25 bp, Rattus norvegicus
aaagtccactgctccttttggattg

SEQ ID NO: 13693 - DNA, 25 bp, Rattus norvegicus
aaagtccagaatctcatgggcactg

SEQ ID NO: 13694 - DNA, 25 bp, Rattus norvegicus
aaagtccagaatgtcatgggcactg

SEQ ID NO: 13695 - DNA, 25 bp, Rattus norvegicus
aaagtccagaccaaccaggtttgca

SEQ ID NO: 13696 - DNA, 25 bp, Rattus norvegicus
aaagtccagacctaccaggtttgca

SEQ ID NO: 13697 - DNA, 25 bp, Rattus norvegicus
aaagtccatagtcattaaagtccca

SEQ ID NO: 13698 - DNA, 25 bp, Rattus norvegicus
aaagtccatagtgattaaagtccca

SEQ ID NO: 13699 - DNA, 25 bp, Rattus norvegicus
aaagtccatcatatagtgtgtacga

SEQ ID NO: 13700 - DNA, 25 bp, Rattus norvegicus
aaagtccatcatttagtgtgtacga

SEQ ID NO: 13701 - DNA, 25 bp, Rattus norvegicus
aaagtccatgtcatcataagcaatc

SEQ ID NO: 13702 - DNA, 25 bp, Rattus norvegicus
aaagtccatgtcttcataagcaatc

SEQ ID NO: 13703 - DNA, 25 bp, Rattus norvegicus
aaagtcccaagaaccccagtagatg

SEQ ID NO: 13704 - DNA, 25 bp, Rattus norvegicus
aaagtcccaagatccccagtagatg

SEQ ID NO: 13705 - DNA, 25 bp, Rattus norvegicus
aaagtcccagccagctgttagggct

SEQ ID NO: 13706 - DNA, 25 bp, Rattus norvegicus
aaagtcccagcctgctgttagggct

SEQ ID NO: 13707 - DNA, 25 bp, Rattus norvegicus
aaagtcccagctagtcagtagacat

SEQ ID NO: 13708 - DNA, 25 bp, Rattus norvegicus
aaagtcccagcttgtcagtagacat

SEQ ID NO: 13709 - DNA, 25 bp, Rattus norvegicus
aaagtcccaggactggctccaagta

SEQ ID NO: 13710 - DNA, 25 bp, Rattus norvegicus
aaagtcccaggagtggctccaagta

SEQ ID NO: 13711 - DNA, 25 bp, Rattus norvegicus
aaagtcccatgccaattggtctctt

SEQ ID NO: 13712 - DNA, 25 bp, Rattus norvegicus
aaagtcccatgcgaattggtctctt

SEQ ID NO: 13713 - DNA, 25 bp, Rattus norvegicus
aaagtccccaagatatgtattcata

SEQ ID NO: 13714 - DNA, 25 bp, Rattus norvegicus
aaagtccccaagttatgtattcata

SEQ ID NO: 13715 - DNA, 25 bp, Rattus norvegicus
aaagtccccactatagctcaaggat

SEQ ID NO: 13716 - DNA, 25 bp, Rattus norvegicus
aaagtccccactttagctcaaggat

SEQ ID NO: 13717 - DNA, 25 bp, Rattus norvegicus
aaagtccccatcattcttctttata

SEQ ID NO: 13718 - DNA, 25 bp, Rattus norvegicus
aaagtccccatctttcttctttata

SEQ ID NO: 13719 - DNA, 25 bp, Rattus norvegicus
aaagtccccttcattgatgtgactc

SEQ ID NO: 13720 - DNA, 25 bp, Rattus norvegicus
aaagtccccttctttgatgtgactc

SEQ ID NO: 13721 - DNA, 25 bp, Rattus norvegicus
aaagtcccgtatctgctgtggtaca

SEQ ID NO: 13722 - DNA, 25 bp, Rattus norvegicus
aaagtcccgtatgtgctgtggtaca

SEQ ID NO: 13723 - DNA, 25 bp, Rattus norvegicus
aaagtccctattatagtcctccatg

SEQ ID NO: 13724 - DNA, 25 bp, Rattus norvegicus
aaagtccctattttagtcctccatg

SEQ ID NO: 13725 - DNA, 25 bp, Rattus norvegicus
aaagtccctctgctatcagtgaagg

SEQ ID NO: 13726 - DNA, 25 bp, Rattus norvegicus
aaagtccctctggtatcagtgaagg

SEQ ID NO: 13727 - DNA, 25 bp, Rattus norvegicus
aaagtccctgttctccatgccaaac

SEQ ID NO: 13728 - DNA, 25 bp, Rattus norvegicus
aaagtccctgttgtccatgccaaac

SEQ ID NO: 13729 - DNA, 25 bp, Rattus norvegicus
aaagtccgactgaagattgctccct

SEQ ID NO: 13730 - DNA, 25 bp, Rattus norvegicus
aaagtccgactgtagattgctccct

SEQ ID NO: 13731 - DNA, 25 bp, Rattus norvegicus
aaagtccgagagagtgtggtttcat

SEQ ID NO: 13732 - DNA, 25 bp, Rattus norvegicus
aaagtccgagagtgtgtggtttcat

SEQ ID NO: 13733 - DNA, 25 bp, Rattus norvegicus
aaagtccgagtccagattcttcttc

SEQ ID NO: 13734 - DNA, 25 bp, Rattus norvegicus
aaagtccgagtcgagattcttcttc

SEQ ID NO: 13735 - DNA, 25 bp, Rattus norvegicus
aaagtccgatagacagatccctggc

SEQ ID NO: 13736 - DNA, 25 bp, Rattus norvegicus
aaagtccgatagtcagatccctggc

SEQ ID NO: 13737 - DNA, 25 bp, Rattus norvegicus
aaagtccgcgttaagtgcaacaccg

SEQ ID NO: 13738 - DNA, 25 bp, Rattus norvegicus
aaagtccgcgtttagtgcaacaccg

SEQ ID NO: 13739 - DNA, 25 bp, Rattus norvegicus
aaagtccgggacaacctgattagca

SEQ ID NO: 13740 - DNA, 25 bp, Rattus norvegicus
aaagtccgggactacctgattagca

SEQ ID NO: 13741 - DNA, 25 bp, Rattus norvegicus
aaagtcctaagcacagctctcaagc

SEQ ID NO: 13742 - DNA, 25 bp, Rattus norvegicus
aaagtcctaagctcagctctcaagc

SEQ ID NO: 13743 - DNA, 25 bp, Rattus norvegicus
aaagtcctattcagaagcctcgggc

SEQ ID NO: 13744 - DNA, 25 bp, Rattus norvegicus
aaagtcctattctgaagcctcgggc

SEQ ID NO: 13745 - DNA, 25 bp, Rattus norvegicus
aaagtcctcactcctggtcactgaa

SEQ ID NO: 13746 - DNA, 25 bp, Rattus norvegicus
aaagtcctcactgctggtcactgaa

SEQ ID NO: 13747 - DNA, 25 bp, Rattus norvegicus
aaagtcctcctgaaagtcacttgta

SEQ ID NO: 13748 - DNA, 25 bp, Rattus norvegicus
aaagtcctcctgtaagtcacttgta

SEQ ID NO: 13749 - DNA, 25 bp, Rattus norvegicus
aaagtcctcggccattaaaactgag

SEQ ID NO: 13750 - DNA, 25 bp, Rattus norvegicus
aaagtcctcggcgattaaaactgag

SEQ ID NO: 13751 - DNA, 25 bp, Rattus norvegicus
aaagtcctcgtgatttgcactgtga

SEQ ID NO: 13752 - DNA, 25 bp, Rattus norvegicus
aaagtcctcgtgttttgcactgtga

SEQ ID NO: 13753 - DNA, 25 bp, Rattus norvegicus
aaagtcctgacccagatgggctctc

SEQ ID NO: 13754 - DNA, 25 bp, Rattus norvegicus
aaagtcctgaccgagatgggctctc

SEQ ID NO: 13755 - DNA, 25 bp, Rattus norvegicus
aaagtcctgatgactgccagaactt

SEQ ID NO: 13756 - DNA, 25 bp, Rattus norvegicus
aaagtcctgatgatcggcgagataa

SEQ ID NO: 13757 - DNA, 25 bp, Rattus norvegicus
aaagtcctgatgtctgccagaactt

SEQ ID NO: 13758 - DNA, 25 bp, Rattus norvegicus
aaagtcctgatgttcggcgagataa

SEQ ID NO: 13759 - DNA, 25 bp, Rattus norvegicus
aaagtcctgattaccagctcatgga

SEQ ID NO: 13760 - DNA, 25 bp, Rattus norvegicus
aaagtcctgatttccagctcatgga

SEQ ID NO: 13761 - DNA, 25 bp, Rattus norvegicus
aaagtcctgcctcataagaatgaga

SEQ ID NO: 13762 - DNA, 25 bp, Rattus norvegicus
aaagtcctgcctgataagaatgaga

SEQ ID NO: 13763 - DNA, 25 bp, Rattus norvegicus
aaagtcctgcggaggcatagttgac

SEQ ID NO: 13764 - DNA, 25 bp, Rattus norvegicus
aaagtcctgcggtggcatagttgac

SEQ ID NO: 13765 - DNA, 25 bp, Rattus norvegicus
aaagtcctgcttatcttgccttagt

SEQ ID NO: 13766 - DNA, 25 bp, Rattus norvegicus
aaagtcctgcttttcttgccttagt

SEQ ID NO: 13767 - DNA, 25 bp, Rattus norvegicus
aaagtcctggcaatcgatctgaccg

SEQ ID NO: 13768 - DNA, 25 bp, Rattus norvegicus
aaagtcctggcattcgatctgaccg

SEQ ID NO: 13769 - DNA, 25 bp, Rattus norvegicus
aaagtcctggccaggtatactcaga

SEQ ID NO: 13770 - DNA, 25 bp, Rattus norvegicus
aaagtcctggcctggtatactcaga

SEQ ID NO: 13771 - DNA, 25 bp, Rattus norvegicus
aaagtcctggctatgctatgaggaa

SEQ ID NO: 13772 - DNA, 25 bp, Rattus norvegicus
aaagtcctggctttgctatgaggaa

SEQ ID NO: 13773 - DNA, 25 bp, Rattus norvegicus
aaagtccttcgacagttagcctgac

SEQ ID NO: 13774 - DNA, 25 bp, Rattus norvegicus
aaagtccttcgagagttagcctgac

SEQ ID NO: 13775 - DNA, 25 bp, Rattus norvegicus
aaagtccttgagcttctgcagctca

SEQ ID NO: 13776 - DNA, 25 bp, Rattus norvegicus
aaagtccttgaggttctgcagctca

SEQ ID NO: 13777 - DNA, 25 bp, Rattus norvegicus
aaagtccttgggagcatcctagtag

SEQ ID NO: 13778 - DNA, 25 bp, Rattus norvegicus
aaagtccttgggtgcatcctagtag

SEQ ID NO: 13779 - DNA, 25 bp, Rattus norvegicus
aaagtccttttaacacatttttctg

SEQ ID NO: 13780 - DNA, 25 bp, Rattus norvegicus
aaagtccttttatcacatttttctg

SEQ ID NO: 13781 - DNA, 25 bp, Rattus norvegicus
aaagtcgacactactaaggcctgga

SEQ ID NO: 13782 - DNA, 25 bp, Rattus norvegicus
aaagtcgacacttctaaggcctgga

SEQ ID NO: 13783 - DNA, 25 bp, Rattus norvegicus
aaagtcgaccctcaatgcgggacct

SEQ ID NO: 13784 - DNA, 25 bp, Rattus norvegicus
aaagtcgaccctgaatgcgggacct

SEQ ID NO: 13785 - DNA, 25 bp, Rattus norvegicus
aaagtcgactgtagagagcgcatca

SEQ ID NO: 13786 - DNA, 25 bp, Rattus norvegicus
aaagtcgactgttgagagcgcatca

SEQ ID NO: 13787 - DNA, 25 bp, Rattus norvegicus
aaagtcgactttctgagttgcccag

SEQ ID NO: 13788 - DNA, 25 bp, Rattus norvegicus
aaagtcgactttgtgagttgcccag

SEQ ID NO: 13789 - DNA, 25 bp, Rattus norvegicus
aaagtcgaggttatggcagcttcag

SEQ ID NO: 13790 - DNA, 25 bp, Rattus norvegicus
aaagtcgaggttttggcagcttcag

SEQ ID NO: 13791 - DNA, 25 bp, Rattus norvegicus
aaagtcgatcgactgttttggcgtt

SEQ ID NO: 13792 - DNA, 25 bp, Rattus norvegicus
aaagtcgatcgagtgttttggcgtt

SEQ ID NO: 13793 - DNA, 25 bp, Rattus norvegicus
aaagtcgcatatcccaaggcaacaa

SEQ ID NO: 13794 - DNA, 25 bp, Rattus norvegicus
aaagtcgcatatgccaaggcaacaa

SEQ ID NO: 13795 - DNA, 25 bp, Rattus norvegicus
aaagtcgccaagatgaacatccctc

SEQ ID NO: 13796 - DNA, 25 bp, Rattus norvegicus
aaagtcgccaagttgaacatccctc

SEQ ID NO: 13797 - DNA, 25 bp, Rattus norvegicus
aaagtcgcgcttacaacctgtcatt

SEQ ID NO: 13798 - DNA, 25 bp, Rattus norvegicus
aaagtcgcgctttcaacctgtcatt

SEQ ID NO: 13799 - DNA, 25 bp, Rattus norvegicus
aaagtcgctgctatgagcggctctc

SEQ ID NO: 13800 - DNA, 25 bp, Rattus norvegicus
aaagtcgctgctttgagcggctctc

SEQ ID NO: 13801 - DNA, 25 bp, Rattus norvegicus
aaagtcgctggtattgagccgcggc

SEQ ID NO: 13802 - DNA, 25 bp, Rattus norvegicus
aaagtcgctggttttgagccgcggc

SEQ ID NO: 13803 - DNA, 25 bp, Rattus norvegicus
aaagtcgcttctctcatggagctca

SEQ ID NO: 13804 - DNA, 25 bp, Rattus norvegicus
aaagtcgcttctgtcatggagctca

SEQ ID NO: 13805 - DNA, 25 bp, Rattus norvegicus
aaagtcggagggatgcagcaccata

SEQ ID NO: 13806 - DNA, 25 bp, Rattus norvegicus
aaagtcggagggttgcagcaccata

SEQ ID NO: 13807 - DNA, 25 bp, Rattus norvegicus
aaagtcggcgtgatagtgctgacac

SEQ ID NO: 13808 - DNA, 25 bp, Rattus norvegicus
aaagtcggcgtgttagtgctgacac

SEQ ID NO: 13809 - DNA, 25 bp, Rattus norvegicus
aaagtcggctctctgagacgggtca

SEQ ID NO: 13810 - DNA, 25 bp, Rattus norvegicus
aaagtcggctctgtgagacgggtca

SEQ ID NO: 13811 - DNA, 25 bp, Rattus norvegicus
aaagtcgggccacctgtctgtcact

SEQ ID NO: 13812 - DNA, 25 bp, Rattus norvegicus
aaagtcgggccagctgtctgtcact

SEQ ID NO: 13813 - DNA, 25 bp, Rattus norvegicus
aaagtcggttccctctgatggcatc

SEQ ID NO: 13814 - DNA, 25 bp, Rattus norvegicus
aaagtcggttccgtctgatggcatc

SEQ ID NO: 13815 - DNA, 25 bp, Rattus norvegicus
aaagtcgtcactctcactctctggg

SEQ ID NO: 13816 - DNA, 25 bp, Rattus norvegicus
aaagtcgtcactgtcactctctggg

SEQ ID NO: 13817 - DNA, 25 bp, Rattus norvegicus
aaagtcgtctgtcatcttgtggtcc

SEQ ID NO: 13818 - DNA, 25 bp, Rattus norvegicus
aaagtcgtctgtgatcttgtggtcc

SEQ ID NO: 13819 - DNA, 25 bp, Rattus norvegicus
aaagtcgtcttgcagggcctatgtg

SEQ ID NO: 13820 - DNA, 25 bp, Rattus norvegicus
aaagtcgtcttggagggcctatgtg

SEQ ID NO: 13821 - DNA, 25 bp, Rattus norvegicus
aaagtcgtgaccatccatcctggag

SEQ ID NO: 13822 - DNA, 25 bp, Rattus norvegicus
aaagtcgtgaccttccatcctggag

SEQ ID NO: 13823 - DNA, 25 bp, Rattus norvegicus
aaagtcgtgtcgattcattcaccag

SEQ ID NO: 13824 - DNA, 25 bp, Rattus norvegicus
aaagtcgtgtcgtttcattcaccag

SEQ ID NO: 13825 - DNA, 25 bp, Rattus norvegicus
aaagtcgtgtctcttgttgttgaat

SEQ ID NO: 13826 - DNA, 25 bp, Rattus norvegicus
aaagtcgtgtctgttgttgttgaat

SEQ ID NO: 13827 - DNA, 25 bp, Rattus norvegicus
aaagtctacacactggctatctctg

SEQ ID NO: 13828 - DNA, 25 bp, Rattus norvegicus
aaagtctacacagtggctatctctg

SEQ ID NO: 13829 - DNA, 25 bp, Rattus norvegicus
aaagtctacatcctcactcacagcg

SEQ ID NO: 13830 - DNA, 25 bp, Rattus norvegicus
aaagtctacatcgtcactcacagcg

SEQ ID NO: 13831 - DNA, 25 bp, Rattus norvegicus
aaagtctagtacctgtgacccatga

SEQ ID NO: 13832 - DNA, 25 bp, Rattus norvegicus
aaagtctagtacgtgtgacccatga

SEQ ID NO: 13833 - DNA, 25 bp, Rattus norvegicus
aaagtctcagtacctggcaggtgga

SEQ ID NO: 13834 - DNA, 25 bp, Rattus norvegicus
aaagtctcagtagctggcaggtgga

SEQ ID NO: 13835 - DNA, 25 bp, Rattus norvegicus
aaagtctcagttccctagacaggta

SEQ ID NO: 13836 - DNA, 25 bp, Rattus norvegicus
aaagtctcagttgcctagacaggta

SEQ ID NO: 13837 - DNA, 25 bp, Rattus norvegicus
aaagtctcccacatggaagctcgta

SEQ ID NO: 13838 - DNA, 25 bp, Rattus norvegicus
aaagtctcccacttggaagctcgta

SEQ ID NO: 13839 - DNA, 25 bp, Rattus norvegicus
aaagtctcccggctttgccggatga

SEQ ID NO: 13840 - DNA, 25 bp, Rattus norvegicus
aaagtctcccgggtttgccggatga

SEQ ID NO: 13841 - DNA, 25 bp, Rattus norvegicus
aaagtctcctctagcttgatactaa

SEQ ID NO: 13842 - DNA, 25 bp, Rattus norvegicus
aaagtctcctcttgcttgatactaa

SEQ ID NO: 13843 - DNA, 25 bp, Rattus norvegicus
aaagtctcctttcgcgatgacgtca

SEQ ID NO: 13844 - DNA, 25 bp, Rattus norvegicus
aaagtctcctttggcgatgacgtca

SEQ ID NO: 13845 - DNA, 25 bp, Rattus norvegicus
aaagtctcgatcctctcactcaagg

SEQ ID NO: 13846 - DNA, 25 bp, Rattus norvegicus
aaagtctcgatcgtctcactcaagg

SEQ ID NO: 13847 - DNA, 25 bp, Rattus norvegicus
aaagtctctaatcattgtgcacccc

SEQ ID NO: 13848 - DNA, 25 bp, Rattus norvegicus
aaagtctctaatgattgtgcacccc

SEQ ID NO: 13849 - DNA, 25 bp, Rattus norvegicus
aaagtctctacgcaaagcacggccg

SEQ ID NO: 13850 - DNA, 25 bp, Rattus norvegicus
aaagtctctacggaaagcacggccg

SEQ ID NO: 13851 - DNA, 25 bp, Rattus norvegicus
aaagtctctctgactttgaccaaag

SEQ ID NO: 13852 - DNA, 25 bp, Rattus norvegicus
aaagtctctctgatcgtgtcaataa

SEQ ID NO: 13853 - DNA, 25 bp, Rattus norvegicus
aaagtctctctgtctttgaccaaag

SEQ ID NO: 13854 - DNA, 25 bp, Rattus norvegicus
aaagtctctctgttcgtgtcaataa

SEQ ID NO: 13855 - DNA, 25 bp, Rattus norvegicus
aaagtctctggactcaatcaactct

SEQ ID NO: 13856 - DNA, 25 bp, Rattus norvegicus
aaagtctctggagtcaatcaactct

SEQ ID NO: 13857 - DNA, 25 bp, Rattus norvegicus
aaagtctcttacctccatcaaacct

SEQ ID NO: 13858 - DNA, 25 bp, Rattus norvegicus
aaagtctcttacgtccatcaaacct

SEQ ID NO: 13859 - DNA, 25 bp, Rattus norvegicus
aaagtctgaacacaccggcaggtgc

SEQ ID NO: 13860 - DNA, 25 bp, Rattus norvegicus
aaagtctgaacagaccggcaggtgc

SEQ ID NO: 13861 - DNA, 25 bp, Rattus norvegicus
aaagtctgaagcagctcacaggccg

SEQ ID NO: 13862 - DNA, 25 bp, Rattus norvegicus
aaagtctgaagctgctcacaggccg

SEQ ID NO: 13863 - DNA, 25 bp, Rattus norvegicus
aaagtctgcactcacatttcctcgt

SEQ ID NO: 13864 - DNA, 25 bp, Rattus norvegicus
aaagtctgcactgacatttcctcgt

SEQ ID NO: 13865 - DNA, 25 bp, Rattus norvegicus
aaagtctgcattacattcctcgata

SEQ ID NO: 13866 - DNA, 25 bp, Rattus norvegicus
aaagtctgcatttcattcctcgata

SEQ ID NO: 13867 - DNA, 25 bp, Rattus norvegicus
aaagtctgccatcctgtttgtttag

SEQ ID NO: 13868 - DNA, 25 bp, Rattus norvegicus
aaagtctgccatgctgtttgtttag

SEQ ID NO: 13869 - DNA, 25 bp, Rattus norvegicus
aaagtctgccccaaatgtcagtctg

SEQ ID NO: 13870 - DNA, 25 bp, Rattus norvegicus
aaagtctgcccctaatgtcagtctg

SEQ ID NO: 13871 - DNA, 25 bp, Rattus norvegicus
aaagtctgcggcatagttcagagta

SEQ ID NO: 13872 - DNA, 25 bp, Rattus norvegicus
aaagtctgcggcttagttcagagta

SEQ ID NO: 13873 - DNA, 25 bp, Rattus norvegicus
aaagtctgctacatatctgtatgta

SEQ ID NO: 13874 - DNA, 25 bp, Rattus norvegicus
aaagtctgctacttatctgtatgta

SEQ ID NO: 13875 - DNA, 25 bp, Rattus norvegicus
aaagtctgctcaaacgcaacactgt

SEQ ID NO: 13876 - DNA, 25 bp, Rattus norvegicus
aaagtctgctcatacgcaacactgt

SEQ ID NO: 13877 - DNA, 25 bp, Rattus norvegicus
aaagtctgctccagcactcgaagga

SEQ ID NO: 13878 - DNA, 25 bp, Rattus norvegicus
aaagtctgctcctgcactcgaagga

SEQ ID NO: 13879 - DNA, 25 bp, Rattus norvegicus
aaagtctggaacactccttctggcc

SEQ ID NO: 13880 - DNA, 25 bp, Rattus norvegicus
aaagtctggaactctccttctggcc

SEQ ID NO: 13881 - DNA, 25 bp, Rattus norvegicus
aaagtctggccaccggactttgcct

SEQ ID NO: 13882 - DNA, 25 bp, Rattus norvegicus
aaagtctggccagcggactttgcct

SEQ ID NO: 13883 - DNA, 25 bp, Rattus norvegicus
aaagtctggtgtcataccgataggt

SEQ ID NO: 13884 - DNA, 25 bp, Rattus norvegicus
aaagtctggtgtgataccgataggt

SEQ ID NO: 13885 - DNA, 25 bp, Rattus norvegicus
aaagtctgtcacagatgctctgtcg

SEQ ID NO: 13886 - DNA, 25 bp, Rattus norvegicus
aaagtctgtcactgatgctctgtcg

SEQ ID NO: 13887 - DNA, 25 bp, Rattus norvegicus
aaagtctgtcatatcctacttggcc

SEQ ID NO: 13888 - DNA, 25 bp, Rattus norvegicus
aaagtctgtcatttcctacttggcc

SEQ ID NO: 13889 - DNA, 25 bp, Rattus norvegicus
aaagtctgtcttagtttcctatgag

SEQ ID NO: 13890 - DNA, 25 bp, Rattus norvegicus
aaagtctgtcttatgctaggcacat

SEQ ID NO: 13891 - DNA, 25 bp, Rattus norvegicus
aaagtctgtctttgtttcctatgag

SEQ ID NO: 13892 - DNA, 25 bp, Rattus norvegicus
aaagtctgtcttttgctaggcacat

SEQ ID NO: 13893 - DNA, 25 bp, Rattus norvegicus
aaagtctgttctctatttcaaagga

SEQ ID NO: 13894 - DNA, 25 bp, Rattus norvegicus
aaagtctgttctgtatttcaaagga

SEQ ID NO: 13895 - DNA, 25 bp, Rattus norvegicus
aaagtctgttgtctttccgatccca

SEQ ID NO: 13896 - DNA, 25 bp, Rattus norvegicus
aaagtctgttgtgtttccgatccca

SEQ ID NO: 13897 - DNA, 25 bp, Rattus norvegicus
aaagtctgtttcctgggcttctaat

SEQ ID NO: 13898 - DNA, 25 bp, Rattus norvegicus
aaagtctgtttcgtgggcttctaat

SEQ ID NO: 13899 - DNA, 25 bp, Rattus norvegicus
aaagtctgtttgcttctgagtgttg

SEQ ID NO: 13900 - DNA, 25 bp, Rattus norvegicus
aaagtctgtttggttctgagtgttg

SEQ ID NO: 13901 - DNA, 25 bp, Rattus norvegicus
aaagtcttaagtctcgagtcctcag

SEQ ID NO: 13902 - DNA, 25 bp, Rattus norvegicus
aaagtcttaagtgtcgagtcctcag

SEQ ID NO: 13903 - DNA, 25 bp, Rattus norvegicus
aaagtcttagtgaaagccctcagga

SEQ ID NO: 13904 - DNA, 25 bp, Rattus norvegicus
aaagtcttagtgtaagccctcagga

SEQ ID NO: 13905 - DNA, 25 bp, Rattus norvegicus
aaagtcttcagcatggttctgttta

SEQ ID NO: 13906 - DNA, 25 bp, Rattus norvegicus
aaagtcttcagcttggttctgttta

SEQ ID NO: 13907 - DNA, 25 bp, Rattus norvegicus
aaagtcttcattctggttaaagcca

SEQ ID NO: 13908 - DNA, 25 bp, Rattus norvegicus
aaagtcttcattgtggttaaagcca

SEQ ID NO: 13909 - DNA, 25 bp, Rattus norvegicus
aaagtcttccacaagatggcgccca

SEQ ID NO: 13910 - DNA, 25 bp, Rattus norvegicus
aaagtcttccactagatggcgccca

SEQ ID NO: 13911 - DNA, 25 bp, Rattus norvegicus
aaagtcttccccaccataagatgta

SEQ ID NO: 13912 - DNA, 25 bp, Rattus norvegicus
aaagtcttcccctccataagatgta

SEQ ID NO: 13913 - DNA, 25 bp, Rattus norvegicus
aaagtcttcggccttcatggagaca

SEQ ID NO: 13914 - DNA, 25 bp, Rattus norvegicus
aaagtcttcggcgttcatggagaca

SEQ ID NO: 13915 - DNA, 25 bp, Rattus norvegicus
aaagtcttcgttactggcataatta

SEQ ID NO: 13916 - DNA, 25 bp, Rattus norvegicus
aaagtcttcgtttctggcataatta

SEQ ID NO: 13917 - DNA, 25 bp, Rattus norvegicus
aaagtcttctgtcccattgagttca

SEQ ID NO: 13918 - DNA, 25 bp, Rattus norvegicus
aaagtcttctgtgccattgagttca

SEQ ID NO: 13919 - DNA, 25 bp, Rattus norvegicus
aaagtcttgactcaggtggatccta

SEQ ID NO: 13920 - DNA, 25 bp, Rattus norvegicus
aaagtcttgactgaggtggatccta

SEQ ID NO: 13921 - DNA, 25 bp, Rattus norvegicus
aaagtcttgcagatcttctgccttt

SEQ ID NO: 13922 - DNA, 25 bp, Rattus norvegicus
aaagtcttgcagttcttctgccttt

SEQ ID NO: 13923 - DNA, 25 bp, Rattus norvegicus
aaagtcttggcacatcgtatttatg

SEQ ID NO: 13924 - DNA, 25 bp, Rattus norvegicus
aaagtcttggcagatcgtatttatg

SEQ ID NO: 13925 - DNA, 25 bp, Rattus norvegicus
aaagtcttgtccaagctggttttga

SEQ ID NO: 13926 - DNA, 25 bp, Rattus norvegicus
aaagtcttgtcctagctggttttga

SEQ ID NO: 13927 - DNA, 25 bp, Rattus norvegicus
aaagtcttgtctctgcatgaatcca

SEQ ID NO: 13928 - DNA, 25 bp, Rattus norvegicus
aaagtcttgtctgtgcatgaatcca

SEQ ID NO: 13929 - DNA, 25 bp, Rattus norvegicus
aaagtctttagtccatctgtagcag

SEQ ID NO: 13930 - DNA, 25 bp, Rattus norvegicus
aaagtctttagtgcatctgtagcag

SEQ ID NO: 13931 - DNA, 25 bp, Rattus norvegicus
aaagtctttcccagttgcactctat

SEQ ID NO: 13932 - DNA, 25 bp, Rattus norvegicus
aaagtctttccctgttgcactctat

SEQ ID NO: 13933 - DNA, 25 bp, Rattus norvegicus
aaagtctttccgatctggaggtgac

SEQ ID NO: 13934 - DNA, 25 bp, Rattus norvegicus
aaagtctttccgttctggaggtgac

SEQ ID NO: 13935 - DNA, 25 bp, Rattus norvegicus
aaagtctttcgtaatgtagctgcat

SEQ ID NO: 13936 - DNA, 25 bp, Rattus norvegicus
aaagtctttcgttatgtagctgcat

SEQ ID NO: 13937 - DNA, 25 bp, Rattus norvegicus
aaagtgaacatcagacctgtcattc

SEQ ID NO: 13938 - DNA, 25 bp, Rattus norvegicus
aaagtgaacatctgacctgtcattc

SEQ ID NO: 13939 - DNA, 25 bp, Rattus norvegicus
aaagtgaacccaccttgtcttacct

SEQ ID NO: 13940 - DNA, 25 bp, Rattus norvegicus
aaagtgaacccagcttgtcttacct

SEQ ID NO: 13941 - DNA, 25 bp, Rattus norvegicus
aaagtgaacttcacagaccctgccc

SEQ ID NO: 13942 - DNA, 25 bp, Rattus norvegicus
aaagtgaacttctcagaccctgccc

SEQ ID NO: 13943 - DNA, 25 bp, Rattus norvegicus
aaagtgaagagtcacctcatcccct

SEQ ID NO: 13944 - DNA, 25 bp, Rattus norvegicus
aaagtgaagagtgacctcatcccct

SEQ ID NO: 13945 - DNA, 25 bp, Rattus norvegicus
aaagtgaagcaaccccgcagcccga

SEQ ID NO: 13946 - DNA, 25 bp, Rattus norvegicus
aaagtgaagcaagcccgcagcccga

SEQ ID NO: 13947 - DNA, 25 bp, Rattus norvegicus
aaagtgaagcggcttcaaggctaga

SEQ ID NO: 13948 - DNA, 25 bp, Rattus norvegicus
aaagtgaagcgggttcaaggctaga

SEQ ID NO: 13949 - DNA, 25 bp, Rattus norvegicus
aaagtgaagttccattagtgccctg

SEQ ID NO: 13950 - DNA, 25 bp, Rattus norvegicus
aaagtgaagttcgattagtgccctg

SEQ ID NO: 13951 - DNA, 25 bp, Rattus norvegicus
aaagtgaattaactaccccatgcca

SEQ ID NO: 13952 - DNA, 25 bp, Rattus norvegicus
aaagtgaattaagtaccccatgcca

SEQ ID NO: 13953 - DNA, 25 bp, Rattus norvegicus
aaagtgaattctctatcgccgtggc

SEQ ID NO: 13954 - DNA, 25 bp, Rattus norvegicus
aaagtgaattctgtatcgccgtggc

SEQ ID NO: 13955 - DNA, 25 bp, Rattus norvegicus
aaagtgacaaccatgtccctcgaac

SEQ ID NO: 13956 - DNA, 25 bp, Rattus norvegicus
aaagtgacaaccttgtccctcgaac

SEQ ID NO: 13957 - DNA, 25 bp, Rattus norvegicus
aaagtgacacacacatcctctcagt

SEQ ID NO: 13958 - DNA, 25 bp, Rattus norvegicus
aaagtgacacactcatcctctcagt

SEQ ID NO: 13959 - DNA, 25 bp, Rattus norvegicus
aaagtgacacatacttcccagaaat

SEQ ID NO: 13960 - DNA, 25 bp, Rattus norvegicus
aaagtgacacattcttcccagaaat

SEQ ID NO: 13961 - DNA, 25 bp, Rattus norvegicus
aaagtgacactacaccctgcctctt

SEQ ID NO: 13962 - DNA, 25 bp, Rattus norvegicus
aaagtgacactagaccctgcctctt

SEQ ID NO: 13963 - DNA, 25 bp, Rattus norvegicus
aaagtgacatccagtctcccccttt

SEQ ID NO: 13964 - DNA, 25 bp, Rattus norvegicus
aaagtgacatcctgtctcccccttt

SEQ ID NO: 13965 - DNA, 25 bp, Rattus norvegicus
aaagtgacatgtataccctgcgttt

SEQ ID NO: 13966 - DNA, 25 bp, Rattus norvegicus
aaagtgacatgtttaccctgcgttt

SEQ ID NO: 13967 - DNA, 25 bp, Rattus norvegicus
aaagtgacatttatcttagaacatc

SEQ ID NO: 13968 - DNA, 25 bp, Rattus norvegicus
aaagtgacatttttcttagaacatc

SEQ ID NO: 13969 - DNA, 25 bp, Rattus norvegicus
aaagtgaccaggaagaactccacca

SEQ ID NO: 13970 - DNA, 25 bp, Rattus norvegicus
aaagtgaccaggtagaactccacca

SEQ ID NO: 13971 - DNA, 25 bp, Rattus norvegicus
aaagtgaccattcagcagttccagt

SEQ ID NO: 13972 - DNA, 25 bp, Rattus norvegicus
aaagtgaccattgagcagttccagt

SEQ ID NO: 13973 - DNA, 25 bp, Rattus norvegicus
aaagtgactaggagactctgggctg

SEQ ID NO: 13974 - DNA, 25 bp, Rattus norvegicus
aaagtgactaggtgactctgggctg

SEQ ID NO: 13975 - DNA, 25 bp, Rattus norvegicus
aaagtgactcacacgtcttgaatcc

SEQ ID NO: 13976 - DNA, 25 bp, Rattus norvegicus
aaagtgactcactcgtcttgaatcc

SEQ ID NO: 13977 - DNA, 25 bp, Rattus norvegicus
aaagtgagaaggaagcagctagcaa

SEQ ID NO: 13978 - DNA, 25 bp, Rattus norvegicus
aaagtgagaaggtagcagctagcaa

SEQ ID NO: 13979 - DNA, 25 bp, Rattus norvegicus
aaagtgagacagcagctgcccaggc

SEQ ID NO: 13980 - DNA, 25 bp, Rattus norvegicus
aaagtgagacaggagctgcccaggc

SEQ ID NO: 13981 - DNA, 25 bp, Rattus norvegicus
aaagtgagagccctgtccgtactag

SEQ ID NO: 13982 - DNA, 25 bp, Rattus norvegicus
aaagtgagagccgtgtccgtactag

SEQ ID NO: 13983 - DNA, 25 bp, Rattus norvegicus
aaagtgagagctcgctgagccccaa

SEQ ID NO: 13984 - DNA, 25 bp, Rattus norvegicus
aaagtgagagctggctgagccccaa

SEQ ID NO: 13985 - DNA, 25 bp, Rattus norvegicus
aaagtgagcaaaacacagcccttgc

SEQ ID NO: 13986 - DNA, 25 bp, Rattus norvegicus
aaagtgagcaaatcacagcccttgc

SEQ ID NO: 13987 - DNA, 25 bp, Rattus norvegicus
aaagtgagccacaccctcaggtcac

SEQ ID NO: 13988 - DNA, 25 bp, Rattus norvegicus
aaagtgagccactccctcaggtcac

SEQ ID NO: 13989 - DNA, 25 bp, Rattus norvegicus
aaagtgagcttgatcatccacctct

SEQ ID NO: 13990 - DNA, 25 bp, Rattus norvegicus
aaagtgagcttgttcatccacctct

SEQ ID NO: 13991 - DNA, 25 bp, Rattus norvegicus
aaagtgaggccaagcgcctggccat

SEQ ID NO: 13992 - DNA, 25 bp, Rattus norvegicus
aaagtgaggccatgcgcctggccat

SEQ ID NO: 13993 - DNA, 25 bp, Rattus norvegicus
aaagtgaggctactgtcagccttgt

SEQ ID NO: 13994 - DNA, 25 bp, Rattus norvegicus
aaagtgaggctagtgtcagccttgt

SEQ ID NO: 13995 - DNA, 25 bp, Rattus norvegicus
aaagtgaggcttatctacgtttgag

SEQ ID NO: 13996 - DNA, 25 bp, Rattus norvegicus
aaagtgaggcttcctaaccctgtag

SEQ ID NO: 13997 - DNA, 25 bp, Rattus norvegicus
aaagtgaggcttgctaaccctgtag

SEQ ID NO: 13998 - DNA, 25 bp, Rattus norvegicus
aaagtgaggcttttctacgtttgag

SEQ ID NO: 13999 - DNA, 25 bp, Rattus norvegicus
aaagtgagtaagagtgtcatggcgt

SEQ ID NO: 14000 - DNA, 25 bp, Rattus norvegicus
aaagtgagtaagtgtgtcatggcgt

SEQ ID NO: 14001 - DNA, 25 bp, Rattus norvegicus
aaagtgagtccacaacaaccagggc

SEQ ID NO: 14002 - DNA, 25 bp, Rattus norvegicus
aaagtgagtccagaacaaccagggc

SEQ ID NO: 14003 - DNA, 25 bp, Rattus norvegicus
aaagtgagttttccgcgatgtgtta

SEQ ID NO: 14004 - DNA, 25 bp, Rattus norvegicus
aaagtgagttttgcgcgatgtgtta

SEQ ID NO: 14005 - DNA, 25 bp, Rattus norvegicus
aaagtgatgagacccaccccagcag

SEQ ID NO: 14006 - DNA, 25 bp, Rattus norvegicus
aaagtgatgagagccaccccagcag

SEQ ID NO: 14007 - DNA, 25 bp, Rattus norvegicus
aaagtgatgctacgccacagagcac

SEQ ID NO: 14008 - DNA, 25 bp, Rattus norvegicus
aaagtgatgctaggccacagagcac

SEQ ID NO: 14009 - DNA, 25 bp, Rattus norvegicus
aaagtgatgctgactgcgagtgcct

SEQ ID NO: 14010 - DNA, 25 bp, Rattus norvegicus
aaagtgatgctgtctgcgagtgcct

SEQ ID NO: 14011 - DNA, 25 bp, Rattus norvegicus
aaagtgatggccactggttctacca

SEQ ID NO: 14012 - DNA, 25 bp, Rattus norvegicus
aaagtgatggcctctggttctacca

SEQ ID NO: 14013 - DNA, 25 bp, Rattus norvegicus
aaagtgcaaacaattcgtcccaaag

SEQ ID NO: 14014 - DNA, 25 bp, Rattus norvegicus
aaagtgcaaacatttcgtcccaaag

SEQ ID NO: 14015 - DNA, 25 bp, Rattus norvegicus
aaagtgcacactactgtaacccagg

SEQ ID NO: 14016 - DNA, 25 bp, Rattus norvegicus
aaagtgcacacttctgtaacccagg

SEQ ID NO: 14017 - DNA, 25 bp, Rattus norvegicus
aaagtgcacatcacaaagttttaaa

SEQ ID NO: 14018 - DNA, 25 bp, Rattus norvegicus
aaagtgcacatctcaaagttttaaa

SEQ ID NO: 14019 - DNA, 25 bp, Rattus norvegicus
aaagtgcaccatcgcagcatgcctt

SEQ ID NO: 14020 - DNA, 25 bp, Rattus norvegicus
aaagtgcaccatggcagcatgcctt

SEQ ID NO: 14021 - DNA, 25 bp, Rattus norvegicus
aaagtgcacggacgctgggttctct

SEQ ID NO: 14022 - DNA, 25 bp, Rattus norvegicus
aaagtgcacggaggctgggttctct

SEQ ID NO: 14023 - DNA, 25 bp, Rattus norvegicus
aaagtgcagccacctgctgagaact

SEQ ID NO: 14024 - DNA, 25 bp, Rattus norvegicus
aaagtgcagccagctgctgagaact

SEQ ID NO: 14025 - DNA, 25 bp, Rattus norvegicus
aaagtgcagctaatgtggtactagt

SEQ ID NO: 14026 - DNA, 25 bp, Rattus norvegicus
aaagtgcagctattgtggtactagt

SEQ ID NO: 14027 - DNA, 25 bp, Rattus norvegicus
aaagtgcagcttcaccaggcctctt

SEQ ID NO: 14028 - DNA, 25 bp, Rattus norvegicus
aaagtgcagcttgaccaggcctctt

SEQ ID NO: 14029 - DNA, 25 bp, Rattus norvegicus
aaagtgcagttgaacgcgaagttcg

SEQ ID NO: 14030 - DNA, 25 bp, Rattus norvegicus
aaagtgcagttgtacgcgaagttcg

SEQ ID NO: 14031 - DNA, 25 bp, Rattus norvegicus
aaagtgcatcgacgtctgctgtggc

SEQ ID NO: 14032 - DNA, 25 bp, Rattus norvegicus
aaagtgcatcgaggtctgctgtggc

SEQ ID NO: 14033 - DNA, 25 bp, Rattus norvegicus
aaagtgcatgccatgtaagcctgag

SEQ ID NO: 14034 - DNA, 25 bp, Rattus norvegicus
aaagtgcatgccttgtaagcctgag

SEQ ID NO: 14035 - DNA, 25 bp, Rattus norvegicus
aaagtgccaacgagctggctgtgca

SEQ ID NO: 14036 - DNA, 25 bp, Rattus norvegicus
aaagtgccaacgtgctggctgtgca

SEQ ID NO: 14037 - DNA, 25 bp, Rattus norvegicus
aaagtgccaaggctagtgtgtatca

SEQ ID NO: 14038 - DNA, 25 bp, Rattus norvegicus
aaagtgccaagggtagtgtgtatca

SEQ ID NO: 14039 - DNA, 25 bp, Rattus norvegicus
aaagtgccactaactacaatcccat

SEQ ID NO: 14040 - DNA, 25 bp, Rattus norvegicus
aaagtgccactatctacaatcccat

SEQ ID NO: 14041 - DNA, 25 bp, Rattus norvegicus
aaagtgccacttccctattctagta

SEQ ID NO: 14042 - DNA, 25 bp, Rattus norvegicus
aaagtgccacttgcctattctagta

SEQ ID NO: 14043 - DNA, 25 bp, Rattus norvegicus
aaagtgccatgcattaaccccagag

SEQ ID NO: 14044 - DNA, 25 bp, Rattus norvegicus
aaagtgccatgctttaaccccagag

SEQ ID NO: 14045 - DNA, 25 bp, Rattus norvegicus
aaagtgccattcactcttgtaaaat

SEQ ID NO: 14046 - DNA, 25 bp, Rattus norvegicus
aaagtgccattctctcttgtaaaat

SEQ ID NO: 14047 - DNA, 25 bp, Rattus norvegicus
aaagtgccccccaaagagcacagca

SEQ ID NO: 14048 - DNA, 25 bp, Rattus norvegicus
aaagtgcccccctaagagcacagca

SEQ ID NO: 14049 - DNA, 25 bp, Rattus norvegicus
aaagtgcccgagagcttacaaccag

SEQ ID NO: 14050 - DNA, 25 bp, Rattus norvegicus
aaagtgcccgagtgcttacaaccag

SEQ ID NO: 14051 - DNA, 25 bp, Rattus norvegicus
aaagtgcccgtgattatcattcctg

SEQ ID NO: 14052 - DNA, 25 bp, Rattus norvegicus
aaagtgcccgtgtttatcattcctg

SEQ ID NO: 14053 - DNA, 25 bp, Rattus norvegicus
aaagtgccgagtccaacaggctcct

SEQ ID NO: 14054 - DNA, 25 bp, Rattus norvegicus
aaagtgccgagtgcaacaggctcct

SEQ ID NO: 14055 - DNA, 25 bp, Rattus norvegicus
aaagtgccgtttataatgcgttcag

SEQ ID NO: 14056 - DNA, 25 bp, Rattus norvegicus
aaagtgccgtttttaatgcgttcag

SEQ ID NO: 14057 - DNA, 25 bp, Rattus norvegicus
aaagtgcctctgacacatggttatt

SEQ ID NO: 14058 - DNA, 25 bp, Rattus norvegicus
aaagtgcctctgtcacatggttatt

SEQ ID NO: 14059 - DNA, 25 bp, Rattus norvegicus
aaagtgcctgaaactcgcagccgtg

SEQ ID NO: 14060 - DNA, 25 bp, Rattus norvegicus
aaagtgcctgaatctcgcagccgtg

SEQ ID NO: 14061 - DNA, 25 bp, Rattus norvegicus
aaagtgcctgacattgatttgtgtt

SEQ ID NO: 14062 - DNA, 25 bp, Rattus norvegicus
aaagtgcctgactttgatttgtgtt

SEQ ID NO: 14063 - DNA, 25 bp, Rattus norvegicus
aaagtgcctgctctttcagcaccga

SEQ ID NO: 14064 - DNA, 25 bp, Rattus norvegicus
aaagtgcctgctgtttcagcaccga

SEQ ID NO: 14065 - DNA, 25 bp, Rattus norvegicus
aaagtgccttagcacagggtcccgg

SEQ ID NO: 14066 - DNA, 25 bp, Rattus norvegicus
aaagtgccttaggacagggtcccgg

SEQ ID NO: 14067 - DNA, 25 bp, Rattus norvegicus
aaagtgcctttgaatcagaaatata

SEQ ID NO: 14068 - DNA, 25 bp, Rattus norvegicus
aaagtgcctttgtatcagaaatata

SEQ ID NO: 14069 - DNA, 25 bp, Rattus norvegicus
aaagtgcgaggcctcatcgatacct

SEQ ID NO: 14070 - DNA, 25 bp, Rattus norvegicus
aaagtgcgaggcgtcatcgatacct

SEQ ID NO: 14071 - DNA, 25 bp, Rattus norvegicus
aaagtgcgccctcgtgagagccaag

SEQ ID NO: 14072 - DNA, 25 bp, Rattus norvegicus
aaagtgcgccctggtgagagccaag

SEQ ID NO: 14073 - DNA, 25 bp, Rattus norvegicus
aaagtgcgcctaatccgaggcggct

SEQ ID NO: 14074 - DNA, 25 bp, Rattus norvegicus
aaagtgcgcctattccgaggcggct

SEQ ID NO: 14075 - DNA, 25 bp, Rattus norvegicus
aaagtgcgctctacgtacttcatac

SEQ ID NO: 14076 - DNA, 25 bp, Rattus norvegicus
aaagtgcgctcttcgtacttcatac

SEQ ID NO: 14077 - DNA, 25 bp, Rattus norvegicus
aaagtgcggagcctcctgtaatctt

SEQ ID NO: 14078 - DNA, 25 bp, Rattus norvegicus
aaagtgcggagcgtcctgtaatctt

SEQ ID NO: 14079 - DNA, 25 bp, Rattus norvegicus
aaagtgctatccaacatcagtgtca

SEQ ID NO: 14080 - DNA, 25 bp, Rattus norvegicus
aaagtgctatcctacatcagtgtca

SEQ ID NO: 14081 - DNA, 25 bp, Rattus norvegicus
aaagtgctattcatgggccaggtat

SEQ ID NO: 14082 - DNA, 25 bp, Rattus norvegicus
aaagtgctattcttgggccaggtat

SEQ ID NO: 14083 - DNA, 25 bp, Rattus norvegicus
aaagtgctcacaagctgctccagaa

SEQ ID NO: 14084 - DNA, 25 bp, Rattus norvegicus
aaagtgctcacatgctgctccagaa

SEQ ID NO: 14085 - DNA, 25 bp, Rattus norvegicus
aaagtgctcagaagccccagttgtg

SEQ ID NO: 14086 - DNA, 25 bp, Rattus norvegicus
aaagtgctcagatgccccagttgtg

SEQ ID NO: 14087 - DNA, 25 bp, Rattus norvegicus
aaagtgctcattccttctctgcaga

SEQ ID NO: 14088 - DNA, 25 bp, Rattus norvegicus
aaagtgctcattgcttctctgcaga

SEQ ID NO: 14089 - DNA, 25 bp, Rattus norvegicus
aaagtgctcctgcattgtttttctc

SEQ ID NO: 14090 - DNA, 25 bp, Rattus norvegicus
aaagtgctcctggattgtttttctc

SEQ ID NO: 14091 - DNA, 25 bp, Rattus norvegicus
aaagtgctctctattaactggcaag

SEQ ID NO: 14092 - DNA, 25 bp, Rattus norvegicus
aaagtgctctcttttaactggcaag

SEQ ID NO: 14093 - DNA, 25 bp, Rattus norvegicus
aaagtgctctgccagtgaaccagtc

SEQ ID NO: 14094 - DNA, 25 bp, Rattus norvegicus
aaagtgctctgcgagtgaaccagtc

SEQ ID NO: 14095 - DNA, 25 bp, Rattus norvegicus
aaagtgctgaacctcctgttgcgtg

SEQ ID NO: 14096 - DNA, 25 bp, Rattus norvegicus
aaagtgctgaacgtcctgttgcgtg

SEQ ID NO: 14097 - DNA, 25 bp, Rattus norvegicus
aaagtgctgacgactctaggttcgg

SEQ ID NO: 14098 - DNA, 25 bp, Rattus norvegicus
aaagtgctgacgtctctaggttcgg

SEQ ID NO: 14099 - DNA, 25 bp, Rattus norvegicus
aaagtgctgataatagagaggcccc

SEQ ID NO: 14100 - DNA, 25 bp, Rattus norvegicus
aaagtgctgatattagagaggcccc

SEQ ID NO: 14101 - DNA, 25 bp, Rattus norvegicus
aaagtgctgcagattagatacctct

SEQ ID NO: 14102 - DNA, 25 bp, Rattus norvegicus
aaagtgctgcagtttagatacctct

SEQ ID NO: 14103 - DNA, 25 bp, Rattus norvegicus
aaagtgctgtgaagtgtctgtatgt

SEQ ID NO: 14104 - DNA, 25 bp, Rattus norvegicus
aaagtgctgtgatgtgtctgtatgt

SEQ ID NO: 14105 - DNA, 25 bp, Rattus norvegicus
aaagtgctgtttaagcagtgcacaa

SEQ ID NO: 14106 - DNA, 25 bp, Rattus norvegicus
aaagtgctgttttagcagtgcacaa

SEQ ID NO: 14107 - DNA, 25 bp, Rattus norvegicus
aaagtgcttgctatgcaagtctgaa

SEQ ID NO: 14108 - DNA, 25 bp, Rattus norvegicus
aaagtgcttgctttgcaagtctgaa

SEQ ID NO: 14109 - DNA, 25 bp, Rattus norvegicus
aaagtgcttgtgatcatctgaccga

SEQ ID NO: 14110 - DNA, 25 bp, Rattus norvegicus
aaagtgcttgtgttcatctgaccga

SEQ ID NO: 14111 - DNA, 25 bp, Rattus norvegicus
aaagtgctttccatgcgagttgtga

SEQ ID NO: 14112 - DNA, 25 bp, Rattus norvegicus
aaagtgctttccttgcgagttgtga

SEQ ID NO: 14113 - DNA, 25 bp, Rattus norvegicus
aaagtgcttttacttgcctgtgagg

SEQ ID NO: 14114 - DNA, 25 bp, Rattus norvegicus
aaagtgcttttagttgcctgtgagg

SEQ ID NO: 14115 - DNA, 25 bp, Rattus norvegicus
aaagtgcttttcatactgtaatctt

SEQ ID NO: 14116 - DNA, 25 bp, Rattus norvegicus
aaagtgcttttcttactgtaatctt

SEQ ID NO: 14117 - DNA, 25 bp, Rattus norvegicus
aaagtgcttttgaacggagtgccgt

SEQ ID NO: 14118 - DNA, 25 bp, Rattus norvegicus
aaagtgcttttgtacggagtgccgt

SEQ ID NO: 14119 - DNA, 25 bp, Rattus norvegicus
aaagtggaaccacctcagagccttc

SEQ ID NO: 14120 - DNA, 25 bp, Rattus norvegicus
aaagtggaaccagctcagagccttc

SEQ ID NO: 14121 - DNA, 25 bp, Rattus norvegicus
aaagtggaacctctgtctgaatctc

SEQ ID NO: 14122 - DNA, 25 bp, Rattus norvegicus
aaagtggaacctgtgtctgaatctc

SEQ ID NO: 14123 - DNA, 25 bp, Rattus norvegicus
aaagtggaacggactgggccagcct

SEQ ID NO: 14124 - DNA, 25 bp, Rattus norvegicus
aaagtggaacggtctgggccagcct

SEQ ID NO: 14125 - DNA, 25 bp, Rattus norvegicus
aaagtggaccctagtatagcttcag

SEQ ID NO: 14126 - DNA, 25 bp, Rattus norvegicus
aaagtggacccttgtatagcttcag

SEQ ID NO: 14127 - DNA, 25 bp, Rattus norvegicus
aaagtggaccgtacagctgcttatg

SEQ ID NO: 14128 - DNA, 25 bp, Rattus norvegicus
aaagtggaccgttcagctgcttatg

SEQ ID NO: 14129 - DNA, 25 bp, Rattus norvegicus
aaagtggacgctcctatggccggcc

SEQ ID NO: 14130 - DNA, 25 bp, Rattus norvegicus
aaagtggacgctgctatggccggcc

SEQ ID NO: 14131 - DNA, 25 bp, Rattus norvegicus
aaagtggagctcaactgtccttcct

SEQ ID NO: 14132 - DNA, 25 bp, Rattus norvegicus
aaagtggagctcagacattagtgtc

SEQ ID NO: 14133 - DNA, 25 bp, Rattus norvegicus
aaagtggagctctactgtccttcct

SEQ ID NO: 14134 - DNA, 25 bp, Rattus norvegicus
aaagtggagctctgacattagtgtc

SEQ ID NO: 14135 - DNA, 25 bp, Rattus norvegicus
aaagtggagctgagtgtcttacgtc

SEQ ID NO: 14136 - DNA, 25 bp, Rattus norvegicus
aaagtggagctgcttcttagcgcca

SEQ ID NO: 14137 - DNA, 25 bp, Rattus norvegicus
aaagtggagctggttcttagcgcca

SEQ ID NO: 14138 - DNA, 25 bp, Rattus norvegicus
aaagtggagctgtgtgtcttacgtc

SEQ ID NO: 14139 - DNA, 25 bp, Rattus norvegicus
aaagtggaggatcgctctctaccca

SEQ ID NO: 14140 - DNA, 25 bp, Rattus norvegicus
aaagtggaggatggctctctaccca

SEQ ID NO: 14141 - DNA, 25 bp, Rattus norvegicus
aaagtggaggcactgttggcccacc

SEQ ID NO: 14142 - DNA, 25 bp, Rattus norvegicus
aaagtggaggcagtgttggcccacc

SEQ ID NO: 14143 - DNA, 25 bp, Rattus norvegicus
aaagtggagtgaaactcccgccgca

SEQ ID NO: 14144 - DNA, 25 bp, Rattus norvegicus
aaagtggagtgatactcccgccgca

SEQ ID NO: 14145 - DNA, 25 bp, Rattus norvegicus
aaagtggagttgatgctgccaaaga

SEQ ID NO: 14146 - DNA, 25 bp, Rattus norvegicus
aaagtggagttgttgctgccaaaga

SEQ ID NO: 14147 - DNA, 25 bp, Rattus norvegicus
aaagtggatccaaaccccagtgtgc

SEQ ID NO: 14148 - DNA, 25 bp, Rattus norvegicus
aaagtggatccataccccagtgtgc

SEQ ID NO: 14149 - DNA, 25 bp, Rattus norvegicus
aaagtggatcttctacatgttcaat

SEQ ID NO: 14150 - DNA, 25 bp, Rattus norvegicus
aaagtggatcttgtacatgttcaat

SEQ ID NO: 14151 - DNA, 25 bp, Rattus norvegicus
aaagtggatgttaccagcagggccg

SEQ ID NO: 14152 - DNA, 25 bp, Rattus norvegicus
aaagtggatgtttccagcagggccg

SEQ ID NO: 14153 - DNA, 25 bp, Rattus norvegicus
aaagtggcagttctatgttcttctc

SEQ ID NO: 14154 - DNA, 25 bp, Rattus norvegicus
aaagtggcagttgtatgttcttctc

SEQ ID NO: 14155 - DNA, 25 bp, Rattus norvegicus
aaagtggcatacatgagtgtcccag

SEQ ID NO: 14156 - DNA, 25 bp, Rattus norvegicus
aaagtggcatacttgagtgtcccag

SEQ ID NO: 14157 - DNA, 25 bp, Rattus norvegicus
aaagtggccattagcctttggttct

SEQ ID NO: 14158 - DNA, 25 bp, Rattus norvegicus
aaagtggccatttgcctttggttct

SEQ ID NO: 14159 - DNA, 25 bp, Rattus norvegicus
aaagtggcccatcagctagttccca

SEQ ID NO: 14160 - DNA, 25 bp, Rattus norvegicus
aaagtggcccatgagctagttccca

SEQ ID NO: 14161 - DNA, 25 bp, Rattus norvegicus
aaagtggccctactctaataataat

SEQ ID NO: 14162 - DNA, 25 bp, Rattus norvegicus
aaagtggccctagtctaataataat

SEQ ID NO: 14163 - DNA, 25 bp, Rattus norvegicus
aaagtggccggaattaacctgctca

SEQ ID NO: 14164 - DNA, 25 bp, Rattus norvegicus
aaagtggccggatttaacctgctca

SEQ ID NO: 14165 - DNA, 25 bp, Rattus norvegicus
aaagtggcctcaaaaggcaccgaat

SEQ ID NO: 14166 - DNA, 25 bp, Rattus norvegicus
aaagtggcctcataaggcaccgaat

SEQ ID NO: 14167 - DNA, 25 bp, Rattus norvegicus
aaagtggcctctagctcccagggag

SEQ ID NO: 14168 - DNA, 25 bp, Rattus norvegicus
aaagtggcctcttgctcccagggag

SEQ ID NO: 14169 - DNA, 25 bp, Rattus norvegicus
aaagtggcggagcttcttgccaaca

SEQ ID NO: 14170 - DNA, 25 bp, Rattus norvegicus
aaagtggcggaggttcttgccaaca

SEQ ID NO: 14171 - DNA, 25 bp, Rattus norvegicus
aaagtggctgcactctgaagtccca

SEQ ID NO: 14172 - DNA, 25 bp, Rattus norvegicus
aaagtggctgcagtctgaagtccca

SEQ ID NO: 14173 - DNA, 25 bp, Rattus norvegicus
aaagtggcttcaactgatcctcctg

SEQ ID NO: 14174 - DNA, 25 bp, Rattus norvegicus
aaagtggcttcatctgatcctcctg

SEQ ID NO: 14175 - DNA, 25 bp, Rattus norvegicus
aaagtggctttcagctttcaaaaat

SEQ ID NO: 14176 - DNA, 25 bp, Rattus norvegicus
aaagtggctttctgctttcaaaaat

SEQ ID NO: 14177 - DNA, 25 bp, Rattus norvegicus
aaagtggctttgacgacagtgcgtt

SEQ ID NO: 14178 - DNA, 25 bp, Rattus norvegicus
aaagtggctttgtcgacagtgcgtt

SEQ ID NO: 14179 - DNA, 25 bp, Rattus norvegicus
aaagtgggacccatctgttctgtca

SEQ ID NO: 14180 - DNA, 25 bp, Rattus norvegicus
aaagtgggacccttctgttctgtca

SEQ ID NO: 14181 - DNA, 25 bp, Rattus norvegicus
aaagtgggcacaccagcgtattcgt

SEQ ID NO: 14182 - DNA, 25 bp, Rattus norvegicus
aaagtgggcacagcagcgtattcgt

SEQ ID NO: 14183 - DNA, 25 bp, Rattus norvegicus
aaagtgggcgcactttcctacagga

SEQ ID NO: 14184 - DNA, 25 bp, Rattus norvegicus
aaagtgggcgcagtttcctacagga

SEQ ID NO: 14185 - DNA, 25 bp, Rattus norvegicus
aaagtgggtctgacttagccctgaa

SEQ ID NO: 14186 - DNA, 25 bp, Rattus norvegicus
aaagtgggtctgtcttagccctgaa

SEQ ID NO: 14187 - DNA, 25 bp, Rattus norvegicus
aaagtgggtttccatctcacacgat

SEQ ID NO: 14188 - DNA, 25 bp, Rattus norvegicus
aaagtgggtttcgatctcacacgat

SEQ ID NO: 14189 - DNA, 25 bp, Rattus norvegicus
aaagtggtagacctggagccccaga

SEQ ID NO: 14190 - DNA, 25 bp, Rattus norvegicus
aaagtggtagacgtggagccccaga

SEQ ID NO: 14191 - DNA, 25 bp, Rattus norvegicus
aaagtggtagagcacctgccgcatg

SEQ ID NO: 14192 - DNA, 25 bp, Rattus norvegicus
aaagtggtagaggacctgccgcatg

SEQ ID NO: 14193 - DNA, 25 bp, Rattus norvegicus
aaagtggtatccaagtcctgcaggc

SEQ ID NO: 14194 - DNA, 25 bp, Rattus norvegicus
aaagtggtatcctagtcctgcaggc

SEQ ID NO: 14195 - DNA, 25 bp, Rattus norvegicus
aaagtggtcagtcaaagccaggcat

SEQ ID NO: 14196 - DNA, 25 bp, Rattus norvegicus
aaagtggtcagtgaaagccaggcat

SEQ ID NO: 14197 - DNA, 25 bp, Rattus norvegicus
aaagtggtctgacagcctgcctccc

SEQ ID NO: 14198 - DNA, 25 bp, Rattus norvegicus
aaagtggtctgagagcctgcctccc

SEQ ID NO: 14199 - DNA, 25 bp, Rattus norvegicus
aaagtggtgaagattttcagctgag

SEQ ID NO: 14200 - DNA, 25 bp, Rattus norvegicus
aaagtggtgaagtttttcagctgag

SEQ ID NO: 14201 - DNA, 25 bp, Rattus norvegicus
aaagtggtgcttccagccaacctga

SEQ ID NO: 14202 - DNA, 25 bp, Rattus norvegicus
aaagtggtgcttgcagccaacctga

SEQ ID NO: 14203 - DNA, 25 bp, Rattus norvegicus
aaagtggtggtcatccaggcatggt

SEQ ID NO: 14204 - DNA, 25 bp, Rattus norvegicus
aaagtggtggtcttccaggcatggt

SEQ ID NO: 14205 - DNA, 25 bp, Rattus norvegicus
aaagtggtgtctcctaggatcctct

SEQ ID NO: 14206 - DNA, 25 bp, Rattus norvegicus
aaagtggtgtctgctaggatcctct

SEQ ID NO: 14207 - DNA, 25 bp, Rattus norvegicus
aaagtggttgagatgtagccctcga

SEQ ID NO: 14208 - DNA, 25 bp, Rattus norvegicus
aaagtggttgagttgtagccctcga

SEQ ID NO: 14209 - DNA, 25 bp, Rattus norvegicus
aaagtggttgccatcctaagcatat

SEQ ID NO: 14210 - DNA, 25 bp, Rattus norvegicus
aaagtggttgccttcctaagcatat

SEQ ID NO: 14211 - DNA, 25 bp, Rattus norvegicus
aaagtggttggaacaagctgccaga

SEQ ID NO: 14212 - DNA, 25 bp, Rattus norvegicus
aaagtggttggatcaagctgccaga

SEQ ID NO: 14213 - DNA, 25 bp, Rattus norvegicus
aaagtggtttccaacccacgtgcag

SEQ ID NO: 14214 - DNA, 25 bp, Rattus norvegicus
aaagtggtttcctacccacgtgcag

SEQ ID NO: 14215 - DNA, 25 bp, Rattus norvegicus
aaagtgtaacagcttcgcctgggaa

SEQ ID NO: 14216 - DNA, 25 bp, Rattus norvegicus
aaagtgtaacaggttcgcctgggaa

SEQ ID NO: 14217 - DNA, 25 bp, Rattus norvegicus
aaagtgtaatgtcagcttcccctta

SEQ ID NO: 14218 - DNA, 25 bp, Rattus norvegicus
aaagtgtaatgtgagcttcccctta

SEQ ID NO: 14219 - DNA, 25 bp, Rattus norvegicus
aaagtgtacatcagctgtccctaaa

SEQ ID NO: 14220 - DNA, 25 bp, Rattus norvegicus
aaagtgtacatcatcatgcccaaca

SEQ ID NO: 14221 - DNA, 25 bp, Rattus norvegicus
aaagtgtacatctgctgtccctaaa

SEQ ID NO: 14222 - DNA, 25 bp, Rattus norvegicus
aaagtgtacatcttcatgcccaaca

SEQ ID NO: 14223 - DNA, 25 bp, Rattus norvegicus
aaagtgtacctgaagtgcatactag

SEQ ID NO: 14224 - DNA, 25 bp, Rattus norvegicus
aaagtgtacctgtagtgcatactag

SEQ ID NO: 14225 - DNA, 25 bp, Rattus norvegicus
aaagtgtagtgcatcacccgggcag

SEQ ID NO: 14226 - DNA, 25 bp, Rattus norvegicus
aaagtgtagtgcttcacccgggcag

SEQ ID NO: 14227 - DNA, 25 bp, Rattus norvegicus
aaagtgtatcgaccacctcactgag

SEQ ID NO: 14228 - DNA, 25 bp, Rattus norvegicus
aaagtgtatcgagcacctcactgag

SEQ ID NO: 14229 - DNA, 25 bp, Rattus norvegicus
aaagtgtatcttatggctctatcag

SEQ ID NO: 14230 - DNA, 25 bp, Rattus norvegicus
aaagtgtatcttttggctctatcag

SEQ ID NO: 14231 - DNA, 25 bp, Rattus norvegicus
aaagtgtcaacgaccagccatctgg

SEQ ID NO: 14232 - DNA, 25 bp, Rattus norvegicus
aaagtgtcaacgtccagccatctgg

SEQ ID NO: 14233 - DNA, 25 bp, Rattus norvegicus
aaagtgtcaaggagtgtacatccat

SEQ ID NO: 14234 - DNA, 25 bp, Rattus norvegicus
aaagtgtcaaggtgtgtacatccat

SEQ ID NO: 14235 - DNA, 25 bp, Rattus norvegicus
aaagtgtcactcaccagagcgagct

SEQ ID NO: 14236 - DNA, 25 bp, Rattus norvegicus
aaagtgtcactctccagagcgagct

SEQ ID NO: 14237 - DNA, 25 bp, Rattus norvegicus
aaagtgtcagtcagcttgttgcgca

SEQ ID NO: 14238 - DNA, 25 bp, Rattus norvegicus
aaagtgtcagtctgcttgttgcgca

SEQ ID NO: 14239 - DNA, 25 bp, Rattus norvegicus
aaagtgtccatgatgtagctgggtt

SEQ ID NO: 14240 - DNA, 25 bp, Rattus norvegicus
aaagtgtccatgttgtagctgggtt

SEQ ID NO: 14241 - DNA, 25 bp, Rattus norvegicus
aaagtgtccccgaattgcgctttct

SEQ ID NO: 14242 - DNA, 25 bp, Rattus norvegicus
aaagtgtccccgtattgcgctttct

SEQ ID NO: 14243 - DNA, 25 bp, Rattus norvegicus
aaagtgtccctgagccaagccagag

SEQ ID NO: 14244 - DNA, 25 bp, Rattus norvegicus
aaagtgtccctgtgccaagccagag

SEQ ID NO: 14245 - DNA, 25 bp, Rattus norvegicus
aaagtgtcccttagcctagtgaaga

SEQ ID NO: 14246 - DNA, 25 bp, Rattus norvegicus
aaagtgtcccttcccattagtatgg

SEQ ID NO: 14247 - DNA, 25 bp, Rattus norvegicus
aaagtgtcccttgccattagtatgg

SEQ ID NO: 14248 - DNA, 25 bp, Rattus norvegicus
aaagtgtccctttgcctagtgaaga

SEQ ID NO: 14249 - DNA, 25 bp, Rattus norvegicus
aaagtgtccgcgatctctttagaag

SEQ ID NO: 14250 - DNA, 25 bp, Rattus norvegicus
aaagtgtccgcgttctctttagaag

SEQ ID NO: 14251 - DNA, 25 bp, Rattus norvegicus
aaagtgtcctcacacattgtctagc

SEQ ID NO: 14252 - DNA, 25 bp, Rattus norvegicus
aaagtgtcctcagacattgtctagc

SEQ ID NO: 14253 - DNA, 25 bp, Rattus norvegicus
aaagtgtcctctcctctggagaatt

SEQ ID NO: 14254 - DNA, 25 bp, Rattus norvegicus
aaagtgtcctctgctctggagaatt

SEQ ID NO: 14255 - DNA, 25 bp, Rattus norvegicus
aaagtgtctcagaaaacctggccat

SEQ ID NO: 14256 - DNA, 25 bp, Rattus norvegicus
aaagtgtctcagtaaacctggccat

SEQ ID NO: 14257 - DNA, 25 bp, Rattus norvegicus
aaagtgtctctaatttgtggttcat

SEQ ID NO: 14258 - DNA, 25 bp, Rattus norvegicus
aaagtgtctctattttgtggttcat

SEQ ID NO: 14259 - DNA, 25 bp, Rattus norvegicus
aaagtgtctgcacagacagccttcc

SEQ ID NO: 14260 - DNA, 25 bp, Rattus norvegicus
aaagtgtctgcagagacagccttcc

SEQ ID NO: 14261 - DNA, 25 bp, Rattus norvegicus
aaagtgtctgccctttagagccttc

SEQ ID NO: 14262 - DNA, 25 bp, Rattus norvegicus
aaagtgtctgccgtttagagccttc

SEQ ID NO: 14263 - DNA, 25 bp, Rattus norvegicus
aaagtgtcttgtatctcccacaggc

SEQ ID NO: 14264 - DNA, 25 bp, Rattus norvegicus
aaagtgtcttgtttctcccacaggc

SEQ ID NO: 14265 - DNA, 25 bp, Rattus norvegicus
aaagtgtgaagcattgtgtaacagc

SEQ ID NO: 14266 - DNA, 25 bp, Rattus norvegicus
aaagtgtgaagctttgtgtaacagc

SEQ ID NO: 14267 - DNA, 25 bp, Rattus norvegicus
aaagtgtgcaccacagtgtctttca

SEQ ID NO: 14268 - DNA, 25 bp, Rattus norvegicus
aaagtgtgcacctcagtgtctttca

SEQ ID NO: 14269 - DNA, 25 bp, Rattus norvegicus
aaagtgtgcgtcaaccacaggacca

SEQ ID NO: 14270 - DNA, 25 bp, Rattus norvegicus
aaagtgtgcgtctaccacaggacca

SEQ ID NO: 14271 - DNA, 25 bp, Rattus norvegicus
aaagtgtgctacagctttatctggg

SEQ ID NO: 14272 - DNA, 25 bp, Rattus norvegicus
aaagtgtgctactgctttatctggg

SEQ ID NO: 14273 - DNA, 25 bp, Rattus norvegicus
aaagtgtgctgtcagtattttgcct

SEQ ID NO: 14274 - DNA, 25 bp, Rattus norvegicus
aaagtgtgctgtgagtattttgcct

SEQ ID NO: 14275 - DNA, 25 bp, Rattus norvegicus
aaagtgtgctttcccgcacacactg

SEQ ID NO: 14276 - DNA, 25 bp, Rattus norvegicus
aaagtgtgctttgccgcacacactg

SEQ ID NO: 14277 - DNA, 25 bp, Rattus norvegicus
aaagtgtggaacacctgtggccctg

SEQ ID NO: 14278 - DNA, 25 bp, Rattus norvegicus
aaagtgtggaactcctgtggccctg

SEQ ID NO: 14279 - DNA, 25 bp, Rattus norvegicus
aaagtgtggatcagcagccacgcgc

SEQ ID NO: 14280 - DNA, 25 bp, Rattus norvegicus
aaagtgtggatctgcagccacgcgc

SEQ ID NO: 14281 - DNA, 25 bp, Rattus norvegicus
aaagtgtggcctcgcttttgtcttc

SEQ ID NO: 14282 - DNA, 25 bp, Rattus norvegicus
aaagtgtggcctggcttttgtcttc

SEQ ID NO: 14283 - DNA, 25 bp, Rattus norvegicus
aaagtgtgggacacaccacttgacc

SEQ ID NO: 14284 - DNA, 25 bp, Rattus norvegicus
aaagtgtgggactcaccacttgacc

SEQ ID NO: 14285 - DNA, 25 bp, Rattus norvegicus
aaagtgtgtatcagacgcgtgggaa

SEQ ID NO: 14286 - DNA, 25 bp, Rattus norvegicus
aaagtgtgtatctgacgcgtgggaa

SEQ ID NO: 14287 - DNA, 25 bp, Rattus norvegicus
aaagtgtgttggctcgcagccacag

SEQ ID NO: 14288 - DNA, 25 bp, Rattus norvegicus
aaagtgtgttgggtcgcagccacag

SEQ ID NO: 14289 - DNA, 25 bp, Rattus norvegicus
aaagtgttacctcatgggaccctga

SEQ ID NO: 14290 - DNA, 25 bp, Rattus norvegicus
aaagtgttacctgatgggaccctga

SEQ ID NO: 14291 - DNA, 25 bp, Rattus norvegicus
aaagtgttagcaacttgttactcaa

SEQ ID NO: 14292 - DNA, 25 bp, Rattus norvegicus
aaagtgttagcatcttgttactcaa

SEQ ID NO: 14293 - DNA, 25 bp, Rattus norvegicus
aaagtgttcaggacatgatccagag

SEQ ID NO: 14294 - DNA, 25 bp, Rattus norvegicus
aaagtgttcaggtcatgatccagag

SEQ ID NO: 14295 - DNA, 25 bp, Rattus norvegicus
aaagtgttccagactgtatggtttt

SEQ ID NO: 14296 - DNA, 25 bp, Rattus norvegicus
aaagtgttccagtctgtatggtttt

SEQ ID NO: 14297 - DNA, 25 bp, Rattus norvegicus
aaagtgttctatatcccagttcata

SEQ ID NO: 14298 - DNA, 25 bp, Rattus norvegicus
aaagtgttctatttcccagttcata

SEQ ID NO: 14299 - DNA, 25 bp, Rattus norvegicus
aaagtgttcttgatgtatccagcat

SEQ ID NO: 14300 - DNA, 25 bp, Rattus norvegicus
aaagtgttcttgttgtatccagcat

SEQ ID NO: 14301 - DNA, 25 bp, Rattus norvegicus
aaagtgttgactctgccgtaggtgc

SEQ ID NO: 14302 - DNA, 25 bp, Rattus norvegicus
aaagtgttgactgtgccgtaggtgc

SEQ ID NO: 14303 - DNA, 25 bp, Rattus norvegicus
aaagtgttgcccagtagccgcaggc

SEQ ID NO: 14304 - DNA, 25 bp, Rattus norvegicus
aaagtgttgccctgtagccgcaggc

SEQ ID NO: 14305 - DNA, 25 bp, Rattus norvegicus
aaagtgtttagcatgccatttccgt

SEQ ID NO: 14306 - DNA, 25 bp, Rattus norvegicus
aaagtgtttagcttgccatttccgt

SEQ ID NO: 14307 - DNA, 25 bp, Rattus norvegicus
aaagtgtttcagaggctcgctgttc

SEQ ID NO: 14308 - DNA, 25 bp, Rattus norvegicus
aaagtgtttcagtggctcgctgttc

SEQ ID NO: 14309 - DNA, 25 bp, Rattus norvegicus
aaagtgtttctcacgcaggaggtga

SEQ ID NO: 14310 - DNA, 25 bp, Rattus norvegicus
aaagtgtttctctcgcaggaggtga

SEQ ID NO: 14311 - DNA, 25 bp, Rattus norvegicus
aaagtgtttctgctcctgatgtcaa

SEQ ID NO: 14312 - DNA, 25 bp, Rattus norvegicus
aaagtgtttctggtcctgatgtcaa

SEQ ID NO: 14313 - DNA, 25 bp, Rattus norvegicus
aaagtgtttgccattctttcactct

SEQ ID NO: 14314 - DNA, 25 bp, Rattus norvegicus
aaagtgtttgcctttctttcactct

SEQ ID NO: 14315 - DNA, 25 bp, Rattus norvegicus
aaagtgtttgtgatctgtatagtga

SEQ ID NO: 14316 - DNA, 25 bp, Rattus norvegicus
aaagtgtttgtgttctgtatagtga

SEQ ID NO: 14317 - DNA, 25 bp, Rattus norvegicus
aaagtgttttctagggctatgccca

SEQ ID NO: 14318 - DNA, 25 bp, Rattus norvegicus
aaagtgttttcttgggctatgccca

SEQ ID NO: 14319 - DNA, 25 bp, Rattus norvegicus
aaagtgtttttgaccctgagcagtc

SEQ ID NO: 14320 - DNA, 25 bp, Rattus norvegicus
aaagtgtttttgtccctgagcagtc

SEQ ID NO: 14321 - DNA, 25 bp, Rattus norvegicus
aaagttaaaagcaaggtatcctcat

SEQ ID NO: 14322 - DNA, 25 bp, Rattus norvegicus
aaagttaaaagctaggtatcctcat

SEQ ID NO: 14323 - DNA, 25 bp, Rattus norvegicus
aaagttaactatccccagagaccct

SEQ ID NO: 14324 - DNA, 25 bp, Rattus norvegicus
aaagttaactatgcccagagaccct

SEQ ID NO: 14325 - DNA, 25 bp, Rattus norvegicus
aaagttaagaaaacggcaaggccag

SEQ ID NO: 14326 - DNA, 25 bp, Rattus norvegicus
aaagttaagaaatcggcaaggccag

SEQ ID NO: 14327 - DNA, 25 bp, Rattus norvegicus
aaagttacagcaattcacaggcatt

SEQ ID NO: 14328 - DNA, 25 bp, Rattus norvegicus
aaagttacagcatttcacaggcatt

SEQ ID NO: 14329 - DNA, 25 bp, Rattus norvegicus
aaagttacagcgcactggcacaagg

SEQ ID NO: 14330 - DNA, 25 bp, Rattus norvegicus
aaagttacagcggactggcacaagg

SEQ ID NO: 14331 - DNA, 25 bp, Rattus norvegicus
aaagttacatgtctctaatcccggc

SEQ ID NO: 14332 - DNA, 25 bp, Rattus norvegicus
aaagttacatgtgtctaatcccggc

SEQ ID NO: 14333 - DNA, 25 bp, Rattus norvegicus
aaagttaccaaaagcttcatggtga

SEQ ID NO: 14334 - DNA, 25 bp, Rattus norvegicus
aaagttaccaaatgcttcatggtga

SEQ ID NO: 14335 - DNA, 25 bp, Rattus norvegicus
aaagttaccagtatgaggctgctct

SEQ ID NO: 14336 - DNA, 25 bp, Rattus norvegicus
aaagttaccagtttgaggctgctct

SEQ ID NO: 14337 - DNA, 25 bp, Rattus norvegicus
aaagttactactaggattcctatgt

SEQ ID NO: 14338 - DNA, 25 bp, Rattus norvegicus
aaagttactacttggattcctatgt

SEQ ID NO: 14339 - DNA, 25 bp, Rattus norvegicus
aaagttactattaggtgggcatgtc

SEQ ID NO: 14340 - DNA, 25 bp, Rattus norvegicus
aaagttactatttggtgggcatgtc

SEQ ID NO: 14341 - DNA, 25 bp, Rattus norvegicus
aaagttactcttcctatgctgtctg

SEQ ID NO: 14342 - DNA, 25 bp, Rattus norvegicus
aaagttactcttgctatgctgtctg

SEQ ID NO: 14343 - DNA, 25 bp, Rattus norvegicus
aaagttactgacattgccgtgcggt

SEQ ID NO: 14344 - DNA, 25 bp, Rattus norvegicus
aaagttactgactttgccgtgcggt

SEQ ID NO: 14345 - DNA, 25 bp, Rattus norvegicus
aaagttactgagatcccggagagca

SEQ ID NO: 14346 - DNA, 25 bp, Rattus norvegicus
aaagttactgagttcccggagagca

SEQ ID NO: 14347 - DNA, 25 bp, Rattus norvegicus
aaagttacttttaactgccagcaga

SEQ ID NO: 14348 - DNA, 25 bp, Rattus norvegicus
aaagttactttttactgccagcaga

SEQ ID NO: 14349 - DNA, 25 bp, Rattus norvegicus
aaagttagatctcttctgcgcccaa

SEQ ID NO: 14350 - DNA, 25 bp, Rattus norvegicus
aaagttagatctgttctgcgcccaa

SEQ ID NO: 14351 - DNA, 25 bp, Rattus norvegicus
aaagttagcaaacgcacccatgtga

SEQ ID NO: 14352 - DNA, 25 bp, Rattus norvegicus
aaagttagcaaaggcacccatgtga

SEQ ID NO: 14353 - DNA, 25 bp, Rattus norvegicus
aaagttagcagccttcttctcattg

SEQ ID NO: 14354 - DNA, 25 bp, Rattus norvegicus
aaagttagcagcgttcttctcattg

SEQ ID NO: 14355 - DNA, 25 bp, Rattus norvegicus
aaagttagcctgcacttgacagcaa

SEQ ID NO: 14356 - DNA, 25 bp, Rattus norvegicus
aaagttagcctggacttgacagcaa

SEQ ID NO: 14357 - DNA, 25 bp, Rattus norvegicus
aaagttagtgctctcggcttgtgaa

SEQ ID NO: 14358 - DNA, 25 bp, Rattus norvegicus
aaagttagtgctgtcggcttgtgaa

SEQ ID NO: 14359 - DNA, 25 bp, Rattus norvegicus
aaagttataattctgggctagctca

SEQ ID NO: 14360 - DNA, 25 bp, Rattus norvegicus
aaagttataattgtgggctagctca

SEQ ID NO: 14361 - DNA, 25 bp, Rattus norvegicus
aaagttatcttcctgctgagccatc

SEQ ID NO: 14362 - DNA, 25 bp, Rattus norvegicus
aaagttatcttcgtgctgagccatc

SEQ ID NO: 14363 - DNA, 25 bp, Rattus norvegicus
aaagttatgggcacagtgcatggga

SEQ ID NO: 14364 - DNA, 25 bp, Rattus norvegicus
aaagttatgggctcagtgcatggga

SEQ ID NO: 14365 - DNA, 25 bp, Rattus norvegicus
aaagttatgtatctcccattcccag

SEQ ID NO: 14366 - DNA, 25 bp, Rattus norvegicus
aaagttatgtatgtcccattcccag

SEQ ID NO: 14367 - DNA, 25 bp, Rattus norvegicus
aaagttcaaggtccgctgtagcagg

SEQ ID NO: 14368 - DNA, 25 bp, Rattus norvegicus
aaagttcaaggtgcgctgtagcagg

SEQ ID NO: 14369 - DNA, 25 bp, Rattus norvegicus
aaagttcaatatactcgtgtaccag

SEQ ID NO: 14370 - DNA, 25 bp, Rattus norvegicus
aaagttcaatattctcgtgtaccag

SEQ ID NO: 14371 - DNA, 25 bp, Rattus norvegicus
aaagttcacctcatgggtctgacag

SEQ ID NO: 14372 - DNA, 25 bp, Rattus norvegicus
aaagttcacctcttgggtctgacag

SEQ ID NO: 14373 - DNA, 25 bp, Rattus norvegicus
aaagttcacggcatagaagggctcg

SEQ ID NO: 14374 - DNA, 25 bp, Rattus norvegicus
aaagttcacggcttagaagggctcg

SEQ ID NO: 14375 - DNA, 25 bp, Rattus norvegicus
aaagttcagaagactactcaggtga

SEQ ID NO: 14376 - DNA, 25 bp, Rattus norvegicus
aaagttcagaagtctactcaggtga

SEQ ID NO: 14377 - DNA, 25 bp, Rattus norvegicus
aaagttcagagcaggtctcagggca

SEQ ID NO: 14378 - DNA, 25 bp, Rattus norvegicus
aaagttcagagctggtctcagggca

SEQ ID NO: 14379 - DNA, 25 bp, Rattus norvegicus
aaagttcagatcaagctgggtgttt

SEQ ID NO: 14380 - DNA, 25 bp, Rattus norvegicus
aaagttcagatctagctgggtgttt

SEQ ID NO: 14381 - DNA, 25 bp, Rattus norvegicus
aaagttcagtgtcggctcagcggca

SEQ ID NO: 14382 - DNA, 25 bp, Rattus norvegicus
aaagttcagtgtgggctcagcggca

SEQ ID NO: 14383 - DNA, 25 bp, Rattus norvegicus
aaagttcagttcatgtccaattgga

SEQ ID NO: 14384 - DNA, 25 bp, Rattus norvegicus
aaagttcagttcttgtccaattgga

SEQ ID NO: 14385 - DNA, 25 bp, Rattus norvegicus
aaagttcataccattctcacacgtg

SEQ ID NO: 14386 - DNA, 25 bp, Rattus norvegicus
aaagttcatacctttctcacacgtg

SEQ ID NO: 14387 - DNA, 25 bp, Rattus norvegicus
aaagttcatcacaagttcacacata

SEQ ID NO: 14388 - DNA, 25 bp, Rattus norvegicus
aaagttcatcactagttcacacata

SEQ ID NO: 14389 - DNA, 25 bp, Rattus norvegicus
aaagttcatctgcacccatcagagt

SEQ ID NO: 14390 - DNA, 25 bp, Rattus norvegicus
aaagttcatctggacccatcagagt

SEQ ID NO: 14391 - DNA, 25 bp, Rattus norvegicus
aaagttcatggtagcagcgaaccga

SEQ ID NO: 14392 - DNA, 25 bp, Rattus norvegicus
aaagttcatggttgcagcgaaccga

SEQ ID NO: 14393 - DNA, 25 bp, Rattus norvegicus
aaagttcatgtacaccagggccaat

SEQ ID NO: 14394 - DNA, 25 bp, Rattus norvegicus
aaagttcatgtagaccagggccaat

SEQ ID NO: 14395 - DNA, 25 bp, Rattus norvegicus
aaagttcattctacggctttcactt

SEQ ID NO: 14396 - DNA, 25 bp, Rattus norvegicus
aaagttcattcttcggctttcactt

SEQ ID NO: 14397 - DNA, 25 bp, Rattus norvegicus
aaagttccaacaaattctcacatga

SEQ ID NO: 14398 - DNA, 25 bp, Rattus norvegicus
aaagttccaacatattctcacatga

SEQ ID NO: 14399 - DNA, 25 bp, Rattus norvegicus
aaagttccagatcttagccaggcaa

SEQ ID NO: 14400 - DNA, 25 bp, Rattus norvegicus
aaagttccagatgttagccaggcaa

SEQ ID NO: 14401 - DNA, 25 bp, Rattus norvegicus
aaagttccagcaatttatgtgtaaa

SEQ ID NO: 14402 - DNA, 25 bp, Rattus norvegicus
aaagttccagcattttatgtgtaaa

SEQ ID NO: 14403 - DNA, 25 bp, Rattus norvegicus
aaagttccaggcaccttaacagtat

SEQ ID NO: 14404 - DNA, 25 bp, Rattus norvegicus
aaagttccaggctccttaacagtat

SEQ ID NO: 14405 - DNA, 25 bp, Rattus norvegicus
aaagttcccgaacaactgtgcatgc

SEQ ID NO: 14406 - DNA, 25 bp, Rattus norvegicus
aaagttcccgaagaactgtgcatgc

SEQ ID NO: 14407 - DNA, 25 bp, Rattus norvegicus
aaagttcccggccagaatctgatta

SEQ ID NO: 14408 - DNA, 25 bp, Rattus norvegicus
aaagttcccggcgagaatctgatta

SEQ ID NO: 14409 - DNA, 25 bp, Rattus norvegicus
aaagttccgcagagacttgtctcgg

SEQ ID NO: 14410 - DNA, 25 bp, Rattus norvegicus
aaagttccgcagtgacttgtctcgg

SEQ ID NO: 14411 - DNA, 25 bp, Rattus norvegicus
aaagttcctcaacttctgggctgtg

SEQ ID NO: 14412 - DNA, 25 bp, Rattus norvegicus
aaagttcctcaagttctgggctgtg

SEQ ID NO: 14413 - DNA, 25 bp, Rattus norvegicus
aaagttcgaggtacaacctgcccat

SEQ ID NO: 14414 - DNA, 25 bp, Rattus norvegicus
aaagttcgaggttcaacctgcccat

SEQ ID NO: 14415 - DNA, 25 bp, Rattus norvegicus
aaagttcgccaaaatgcattcacat

SEQ ID NO: 14416 - DNA, 25 bp, Rattus norvegicus
aaagttcgccaatatgcattcacat

SEQ ID NO: 14417 - DNA, 25 bp, Rattus norvegicus
aaagttcgcgtgacttggactaatc

SEQ ID NO: 14418 - DNA, 25 bp, Rattus norvegicus
aaagttcgcgtgtcttggactaatc

SEQ ID NO: 14419 - DNA, 25 bp, Rattus norvegicus
aaagttcgttttccatgattgcatc

SEQ ID NO: 14420 - DNA, 25 bp, Rattus norvegicus
aaagttcgttttgcatgattgcatc

SEQ ID NO: 14421 - DNA, 25 bp, Rattus norvegicus
aaagttctagtgacatgggcagcaa

SEQ ID NO: 14422 - DNA, 25 bp, Rattus norvegicus
aaagttctagtgtcatgggcagcaa

SEQ ID NO: 14423 - DNA, 25 bp, Rattus norvegicus
aaagttctatcacctaccaacaagc

SEQ ID NO: 14424 - DNA, 25 bp, Rattus norvegicus
aaagttctatcagctaccaacaagc

SEQ ID NO: 14425 - DNA, 25 bp, Rattus norvegicus
aaagttctcagtctgggcctcagag

SEQ ID NO: 14426 - DNA, 25 bp, Rattus norvegicus
aaagttctcagtgtgggcctcagag

SEQ ID NO: 14427 - DNA, 25 bp, Rattus norvegicus
aaagttctccaactgctgcatactt

SEQ ID NO: 14428 - DNA, 25 bp, Rattus norvegicus
aaagttctccaagtgctgcatactt

SEQ ID NO: 14429 - DNA, 25 bp, Rattus norvegicus
aaagttctcggcagcttttgggaag

SEQ ID NO: 14430 - DNA, 25 bp, Rattus norvegicus
aaagttctcggctgcttttgggaag

SEQ ID NO: 14431 - DNA, 25 bp, Rattus norvegicus
aaagttctgacgctgtttacatgtt

SEQ ID NO: 14432 - DNA, 25 bp, Rattus norvegicus
aaagttctgacggtgtttacatgtt

SEQ ID NO: 14433 - DNA, 25 bp, Rattus norvegicus
aaagttctgaggaccaaagtttgct

SEQ ID NO: 14434 - DNA, 25 bp, Rattus norvegicus
aaagttctgaggtccaaagtttgct

SEQ ID NO: 14435 - DNA, 25 bp, Rattus norvegicus
aaagttctgatgatgcctctgtatg

SEQ ID NO: 14436 - DNA, 25 bp, Rattus norvegicus
aaagttctgatgttgcctctgtatg

SEQ ID NO: 14437 - DNA, 25 bp, Rattus norvegicus
aaagttctgctccagagccaaggct

SEQ ID NO: 14438 - DNA, 25 bp, Rattus norvegicus
aaagttctgctcgagagccaaggct

SEQ ID NO: 14439 - DNA, 25 bp, Rattus norvegicus
aaagttctgcttcacaagtccccat

SEQ ID NO: 14440 - DNA, 25 bp, Rattus norvegicus
aaagttctgcttcaggacagcctct

SEQ ID NO: 14441 - DNA, 25 bp, Rattus norvegicus
aaagttctgcttgacaagtccccat

SEQ ID NO: 14442 - DNA, 25 bp, Rattus norvegicus
aaagttctgcttgaggacagcctct

SEQ ID NO: 14443 - DNA, 25 bp, Rattus norvegicus
aaagttctggctcagagggacatat

SEQ ID NO: 14444 - DNA, 25 bp, Rattus norvegicus
aaagttctggctgagagggacatat

SEQ ID NO: 14445 - DNA, 25 bp, Rattus norvegicus
aaagttctggttctgctccgaggca

SEQ ID NO: 14446 - DNA, 25 bp, Rattus norvegicus
aaagttctggttgtgctccgaggca

SEQ ID NO: 14447 - DNA, 25 bp, Rattus norvegicus
aaagttctgtcaaccacaggcacag

SEQ ID NO: 14448 - DNA, 25 bp, Rattus norvegicus
aaagttctgtcatccacaggcacag

SEQ ID NO: 14449 - DNA, 25 bp, Rattus norvegicus
aaagttcttactcggatgagatcta

SEQ ID NO: 14450 - DNA, 25 bp, Rattus norvegicus
aaagttcttactgggatgagatcta

SEQ ID NO: 14451 - DNA, 25 bp, Rattus norvegicus
aaagttcttattacactgtgtgtgt

SEQ ID NO: 14452 - DNA, 25 bp, Rattus norvegicus
aaagttcttatttcactgtgtgtgt

SEQ ID NO: 14453 - DNA, 25 bp, Rattus norvegicus
aaagttcttcacacaggttctgtgg

SEQ ID NO: 14454 - DNA, 25 bp, Rattus norvegicus
aaagttcttcactcaggttctgtgg

SEQ ID NO: 14455 - DNA, 25 bp, Rattus norvegicus
aaagttcttccacgcttcagatcaa

SEQ ID NO: 14456 - DNA, 25 bp, Rattus norvegicus
aaagttcttccaggcttcagatcaa

SEQ ID NO: 14457 - DNA, 25 bp, Rattus norvegicus
aaagttcttcccatgatctcttaag

SEQ ID NO: 14458 - DNA, 25 bp, Rattus norvegicus
aaagttcttcccttgatctcttaag

SEQ ID NO: 14459 - DNA, 25 bp, Rattus norvegicus
aaagttcttcgaattgatcccactc

SEQ ID NO: 14460 - DNA, 25 bp, Rattus norvegicus
aaagttcttcgatttgatcccactc

SEQ ID NO: 14461 - DNA, 25 bp, Rattus norvegicus
aaagttcttcttatgctttgacaca

SEQ ID NO: 14462 - DNA, 25 bp, Rattus norvegicus
aaagttcttcttttgctttgacaca

SEQ ID NO: 14463 - DNA, 25 bp, Rattus norvegicus
aaagttcttgctctgggatgtatcc

SEQ ID NO: 14464 - DNA, 25 bp, Rattus norvegicus
aaagttcttgctgtgggatgtatcc

SEQ ID NO: 14465 - DNA, 25 bp, Rattus norvegicus
aaagttcttgtactctctatgccaa

SEQ ID NO: 14466 - DNA, 25 bp, Rattus norvegicus
aaagttcttgtagtctctatgccaa

SEQ ID NO: 14467 - DNA, 25 bp, Rattus norvegicus
aaagttctttacatccagcttccag

SEQ ID NO: 14468 - DNA, 25 bp, Rattus norvegicus
aaagttctttacttccagcttccag

SEQ ID NO: 14469 - DNA, 25 bp, Rattus norvegicus
aaagttctttagagctggtaataag

SEQ ID NO: 14470 - DNA, 25 bp, Rattus norvegicus
aaagttctttagtgctggtaataag

SEQ ID NO: 14471 - DNA, 25 bp, Rattus norvegicus
aaagttctttgacagcgcttgcacg

SEQ ID NO: 14472 - DNA, 25 bp, Rattus norvegicus
aaagttctttgagagcgcttgcacg

SEQ ID NO: 14473 - DNA, 25 bp, Rattus norvegicus
aaagttctttgccattcctacaagc

SEQ ID NO: 14474 - DNA, 25 bp, Rattus norvegicus
aaagttctttgcgattcctacaagc

SEQ ID NO: 14475 - DNA, 25 bp, Rattus norvegicus
aaagttgaagtacccagaatgccct

SEQ ID NO: 14476 - DNA, 25 bp, Rattus norvegicus
aaagttgaagtagccagaatgccct

SEQ ID NO: 14477 - DNA, 25 bp, Rattus norvegicus
aaagttgacaaaactgtcgggatga

SEQ ID NO: 14478 - DNA, 25 bp, Rattus norvegicus
aaagttgacaaatctgtcgggatga

SEQ ID NO: 14479 - DNA, 25 bp, Rattus norvegicus
aaagttgaccatccttccacgacca

SEQ ID NO: 14480 - DNA, 25 bp, Rattus norvegicus
aaagttgaccatgcttccacgacca

SEQ ID NO: 14481 - DNA, 25 bp, Rattus norvegicus
aaagttgaccggattccaggccctg

SEQ ID NO: 14482 - DNA, 25 bp, Rattus norvegicus
aaagttgaccggtttccaggccctg

SEQ ID NO: 14483 - DNA, 25 bp, Rattus norvegicus
aaagttgacggccagcttgagctgc

SEQ ID NO: 14484 - DNA, 25 bp, Rattus norvegicus
aaagttgacggcgagcttgagctgc

SEQ ID NO: 14485 - DNA, 25 bp, Rattus norvegicus
aaagttgactatcttccggatgttg

SEQ ID NO: 14486 - DNA, 25 bp, Rattus norvegicus
aaagttgactatgttccggatgttg

SEQ ID NO: 14487 - DNA, 25 bp, Rattus norvegicus
aaagttgagggtatcccagcagcca

SEQ ID NO: 14488 - DNA, 25 bp, Rattus norvegicus
aaagttgagggtttcccagcagcca

SEQ ID NO: 14489 - DNA, 25 bp, Rattus norvegicus
aaagttgagtttcttaccctggatg

SEQ ID NO: 14490 - DNA, 25 bp, Rattus norvegicus
aaagttgagtttgttaccctggatg

SEQ ID NO: 14491 - DNA, 25 bp, Rattus norvegicus
aaagttgatgcaaacccgtggcttg

SEQ ID NO: 14492 - DNA, 25 bp, Rattus norvegicus
aaagttgatgcatacccgtggcttg

SEQ ID NO: 14493 - DNA, 25 bp, Rattus norvegicus
aaagttgcacttcatgaggctatag

SEQ ID NO: 14494 - DNA, 25 bp, Rattus norvegicus
aaagttgcacttgatgaggctatag

SEQ ID NO: 14495 - DNA, 25 bp, Rattus norvegicus
aaagttgcagacatgggttcatcct

SEQ ID NO: 14496 - DNA, 25 bp, Rattus norvegicus
aaagttgcagacttgggttcatcct

SEQ ID NO: 14497 - DNA, 25 bp, Rattus norvegicus
aaagttgcagccctttcttcaaaag

SEQ ID NO: 14498 - DNA, 25 bp, Rattus norvegicus
aaagttgcagccgtttcttcaaaag

SEQ ID NO: 14499 - DNA, 25 bp, Rattus norvegicus
aaagttgcagctccgggtagcgcct

SEQ ID NO: 14500 - DNA, 25 bp, Rattus norvegicus
aaagttgcagctgcgggtagcgcct

SEQ ID NO: 14501 - DNA, 25 bp, Rattus norvegicus
aaagttgccaacctcgacgggctag

SEQ ID NO: 14502 - DNA, 25 bp, Rattus norvegicus
aaagttgccaacgtcgacgggctag

SEQ ID NO: 14503 - DNA, 25 bp, Rattus norvegicus
aaagttgccaataccttgtctgagt

SEQ ID NO: 14504 - DNA, 25 bp, Rattus norvegicus
aaagttgccaattccttgtctgagt

SEQ ID NO: 14505 - DNA, 25 bp, Rattus norvegicus
aaagttgccgagaattcatccaccg

SEQ ID NO: 14506 - DNA, 25 bp, Rattus norvegicus
aaagttgccgagtattcatccaccg

SEQ ID NO: 14507 - DNA, 25 bp, Rattus norvegicus
aaagttgcctctcaggtggtcaccc

SEQ ID NO: 14508 - DNA, 25 bp, Rattus norvegicus
aaagttgcctctgaggtggtcaccc

SEQ ID NO: 14509 - DNA, 25 bp, Rattus norvegicus
aaagttgcctggaatgtcatttgtt

SEQ ID NO: 14510 - DNA, 25 bp, Rattus norvegicus
aaagttgcctggtatgtcatttgtt

SEQ ID NO: 14511 - DNA, 25 bp, Rattus norvegicus
aaagttgcgaacagacggcacctac

SEQ ID NO: 14512 - DNA, 25 bp, Rattus norvegicus
aaagttgcgaactgacggcacctac

SEQ ID NO: 14513 - DNA, 25 bp, Rattus norvegicus
aaagttgctaagaccttgggcttct

SEQ ID NO: 14514 - DNA, 25 bp, Rattus norvegicus
aaagttgctaagtccttgggcttct

SEQ ID NO: 14515 - DNA, 25 bp, Rattus norvegicus
aaagttgctagtactgcttgaccaa

SEQ ID NO: 14516 - DNA, 25 bp, Rattus norvegicus
aaagttgctagttctgcttgaccaa

SEQ ID NO: 14517 - DNA, 25 bp, Rattus norvegicus
aaagttgctcagattcagaatgcat

SEQ ID NO: 14518 - DNA, 25 bp, Rattus norvegicus
aaagttgctcagtttcagaatgcat

SEQ ID NO: 14519 - DNA, 25 bp, Rattus norvegicus
aaagttgctccaccataccacaaag

SEQ ID NO: 14520 - DNA, 25 bp, Rattus norvegicus
aaagttgctccagcataccacaaag

SEQ ID NO: 14521 - DNA, 25 bp, Rattus norvegicus
aaagttgctcccatctgcgtgaaca

SEQ ID NO: 14522 - DNA, 25 bp, Rattus norvegicus
aaagttgctcccttctgcgtgaaca

SEQ ID NO: 14523 - DNA, 25 bp, Rattus norvegicus
aaagttgctcttaggcctagctttt

SEQ ID NO: 14524 - DNA, 25 bp, Rattus norvegicus
aaagttgctctttggcctagctttt

SEQ ID NO: 14525 - DNA, 25 bp, Rattus norvegicus
aaagttgctgcacgctccgaggaac

SEQ ID NO: 14526 - DNA, 25 bp, Rattus norvegicus
aaagttgctgcaggctccgaggaac

SEQ ID NO: 14527 - DNA, 25 bp, Rattus norvegicus
aaagttgctgctacagtgtccggtt

SEQ ID NO: 14528 - DNA, 25 bp, Rattus norvegicus
aaagttgctgcttcagtgtccggtt

SEQ ID NO: 14529 - DNA, 25 bp, Rattus norvegicus
aaagttgctgtaattacttccataa

SEQ ID NO: 14530 - DNA, 25 bp, Rattus norvegicus
aaagttgctgtatttacttccataa

SEQ ID NO: 14531 - DNA, 25 bp, Rattus norvegicus
aaagttgcttatatactgcatatta

SEQ ID NO: 14532 - DNA, 25 bp, Rattus norvegicus
aaagttgcttatttactgcatatta

SEQ ID NO: 14533 - DNA, 25 bp, Rattus norvegicus
aaagttgcttgtatccgcagtgata

SEQ ID NO: 14534 - DNA, 25 bp, Rattus norvegicus
aaagttgcttgtttccgcagtgata

SEQ ID NO: 14535 - DNA, 25 bp, Rattus norvegicus
aaagttggaaacagtggcacatatc

SEQ ID NO: 14536 - DNA, 25 bp, Rattus norvegicus
aaagttggaaactgtggcacatatc

SEQ ID NO: 14537 - DNA, 25 bp, Rattus norvegicus
aaagttggaattacctggacaacag

SEQ ID NO: 14538 - DNA, 25 bp, Rattus norvegicus
aaagttggaatttcctggacaacag

SEQ ID NO: 14539 - DNA, 25 bp, Rattus norvegicus
aaagttggacatacctgatttgaac

SEQ ID NO: 14540 - DNA, 25 bp, Rattus norvegicus
aaagttggacattcctgatttgaac

SEQ ID NO: 14541 - DNA, 25 bp, Rattus norvegicus
aaagttggatgtcgcagtgcacctg

SEQ ID NO: 14542 - DNA, 25 bp, Rattus norvegicus
aaagttggatgtggcagtgcacctg

SEQ ID NO: 14543 - DNA, 25 bp, Rattus norvegicus
aaagttggcaaactcaagtaatcca

SEQ ID NO: 14544 - DNA, 25 bp, Rattus norvegicus
aaagttggcaaagtcaagtaatcca

SEQ ID NO: 14545 - DNA, 25 bp, Rattus norvegicus
aaagttggcaagctgcagctccatc

SEQ ID NO: 14546 - DNA, 25 bp, Rattus norvegicus
aaagttggcaaggtgcagctccatc

SEQ ID NO: 14547 - DNA, 25 bp, Rattus norvegicus
aaagttggcatcattttgtaacctt

SEQ ID NO: 14548 - DNA, 25 bp, Rattus norvegicus
aaagttggcatctttttgtaacctt

SEQ ID NO: 14549 - DNA, 25 bp, Rattus norvegicus
aaagttggccctctcccagtactgg

SEQ ID NO: 14550 - DNA, 25 bp, Rattus norvegicus
aaagttggccctgtcccagtactgg

SEQ ID NO: 14551 - DNA, 25 bp, Rattus norvegicus
aaagttggctcactgtataggaaga

SEQ ID NO: 14552 - DNA, 25 bp, Rattus norvegicus
aaagttggctcagtgtataggaaga

SEQ ID NO: 14553 - DNA, 25 bp, Rattus norvegicus
aaagttggcttgactcatcataccc

SEQ ID NO: 14554 - DNA, 25 bp, Rattus norvegicus
aaagttggcttgtctcatcataccc

SEQ ID NO: 14555 - DNA, 25 bp, Rattus norvegicus
aaagttggttcacctccacatcgta

SEQ ID NO: 14556 - DNA, 25 bp, Rattus norvegicus
aaagttggttcagctccacatcgta

SEQ ID NO: 14557 - DNA, 25 bp, Rattus norvegicus
aaagttgtacatacagaccctgtgc

SEQ ID NO: 14558 - DNA, 25 bp, Rattus norvegicus
aaagttgtacattcagaccctgtgc

SEQ ID NO: 14559 - DNA, 25 bp, Rattus norvegicus
aaagttgtatgccttaccacccaag

SEQ ID NO: 14560 - DNA, 25 bp, Rattus norvegicus
aaagttgtatgcgttaccacccaag

SEQ ID NO: 14561 - DNA, 25 bp, Rattus norvegicus
aaagttgtatgtattgtagcctcat

SEQ ID NO: 14562 - DNA, 25 bp, Rattus norvegicus
aaagttgtatgttttgtagcctcat

SEQ ID NO: 14563 - DNA, 25 bp, Rattus norvegicus
aaagttgtcattcctttgtaacata

SEQ ID NO: 14564 - DNA, 25 bp, Rattus norvegicus
aaagttgtcattgctttgtaacata

SEQ ID NO: 14565 - DNA, 25 bp, Rattus norvegicus
aaagttgtccacagacctctatgtg

SEQ ID NO: 14566 - DNA, 25 bp, Rattus norvegicus
aaagttgtccactgacctctatgtg

SEQ ID NO: 14567 - DNA, 25 bp, Rattus norvegicus
aaagttgtcctgcaggaggccctgc

SEQ ID NO: 14568 - DNA, 25 bp, Rattus norvegicus
aaagttgtcctggaggaggccctgc

SEQ ID NO: 14569 - DNA, 25 bp, Rattus norvegicus
aaagttgtccttcagcttccaaaat

SEQ ID NO: 14570 - DNA, 25 bp, Rattus norvegicus
aaagttgtccttgagcttccaaaat

SEQ ID NO: 14571 - DNA, 25 bp, Rattus norvegicus
aaagttgtcttcaggcaggcataag

SEQ ID NO: 14572 - DNA, 25 bp, Rattus norvegicus
aaagttgtcttctggcaggcataag

SEQ ID NO: 14573 - DNA, 25 bp, Rattus norvegicus
aaagttgtcttgaacacagcctgtt

SEQ ID NO: 14574 - DNA, 25 bp, Rattus norvegicus
aaagttgtcttgtacacagcctgtt

SEQ ID NO: 14575 - DNA, 25 bp, Rattus norvegicus
aaagttgtgcctaaaatagggcatt

SEQ ID NO: 14576 - DNA, 25 bp, Rattus norvegicus
aaagttgtgccttaaatagggcatt

SEQ ID NO: 14577 - DNA, 25 bp, Rattus norvegicus
aaagttgtgcttagatctggctgac

SEQ ID NO: 14578 - DNA, 25 bp, Rattus norvegicus
aaagttgtgctttgatctggctgac

SEQ ID NO: 14579 - DNA, 25 bp, Rattus norvegicus
aaagttgtgtaccaccactgctgcc

SEQ ID NO: 14580 - DNA, 25 bp, Rattus norvegicus
aaagttgtgtacgaccactgctgcc

SEQ ID NO: 14581 - DNA, 25 bp, Rattus norvegicus
aaagttgtgtcaatgggccaggcta

SEQ ID NO: 14582 - DNA, 25 bp, Rattus norvegicus
aaagttgtgtcattgggccaggcta

SEQ ID NO: 14583 - DNA, 25 bp, Rattus norvegicus
aaagttgttaagacgtccatctggc

SEQ ID NO: 14584 - DNA, 25 bp, Rattus norvegicus
aaagttgttaagtcgtccatctggc

SEQ ID NO: 14585 - DNA, 25 bp, Rattus norvegicus
aaagttgttatcagcatgtgtgtac

SEQ ID NO: 14586 - DNA, 25 bp, Rattus norvegicus
aaagttgttatctgcatgtgtgtac

SEQ ID NO: 14587 - DNA, 25 bp, Rattus norvegicus
aaagttgttggcaggtacaccggat

SEQ ID NO: 14588 - DNA, 25 bp, Rattus norvegicus
aaagttgttggctggtacaccggat

SEQ ID NO: 14589 - DNA, 25 bp, Rattus norvegicus
aaagttgtttatacttcaggcctca

SEQ ID NO: 14590 - DNA, 25 bp, Rattus norvegicus
aaagttgtttattcttcaggcctca

SEQ ID NO: 14591 - DNA, 25 bp, Rattus norvegicus
aaagttgtttccagcctctcagctg

SEQ ID NO: 14592 - DNA, 25 bp, Rattus norvegicus
aaagttgtttcctgcctctcagctg

SEQ ID NO: 14593 - DNA, 25 bp, Rattus norvegicus
aaagttgtttctctcctccacttca

SEQ ID NO: 14594 - DNA, 25 bp, Rattus norvegicus
aaagttgtttctgtcctccacttca

SEQ ID NO: 14595 - DNA, 25 bp, Rattus norvegicus
aaagttgttttacctctcctcctga

SEQ ID NO: 14596 - DNA, 25 bp, Rattus norvegicus
aaagttgttttagctctcctcctga

SEQ ID NO: 14597 - DNA, 25 bp, Rattus norvegicus
aaagtttaccatcatttacctgcaa

SEQ ID NO: 14598 - DNA, 25 bp, Rattus norvegicus
aaagtttaccatgatttacctgcaa

SEQ ID NO: 14599 - DNA, 25 bp, Rattus norvegicus
aaagtttactcacatttcggctctc

SEQ ID NO: 14600 - DNA, 25 bp, Rattus norvegicus
aaagtttactcagatttcggctctc

SEQ ID NO: 14601 - DNA, 25 bp, Rattus norvegicus
aaagtttactccaatgtgttgatga

SEQ ID NO: 14602 - DNA, 25 bp, Rattus norvegicus
aaagtttactcctatgtgttgatga

SEQ ID NO: 14603 - DNA, 25 bp, Rattus norvegicus
aaagtttatctaccccacagttctg

SEQ ID NO: 14604 - DNA, 25 bp, Rattus norvegicus
aaagtttatctagcccacagttctg

SEQ ID NO: 14605 - DNA, 25 bp, Rattus norvegicus
aaagtttatgctcggcacctttcca

SEQ ID NO: 14606 - DNA, 25 bp, Rattus norvegicus
aaagtttatgctgggcacctttcca

SEQ ID NO: 14607 - DNA, 25 bp, Rattus norvegicus
aaagtttattgtctgtgggcgtact

SEQ ID NO: 14608 - DNA, 25 bp, Rattus norvegicus
aaagtttattgtgtgtgggcgtact

SEQ ID NO: 14609 - DNA, 25 bp, Rattus norvegicus
aaagtttcacgtcttcgccaatcac

SEQ ID NO: 14610 - DNA, 25 bp, Rattus norvegicus
aaagtttcacgtcttggtgcctttg

SEQ ID NO: 14611 - DNA, 25 bp, Rattus norvegicus
aaagtttcacgtgttcgccaatcac

SEQ ID NO: 14612 - DNA, 25 bp, Rattus norvegicus
aaagtttcacgtgttggtgcctttg

SEQ ID NO: 14613 - DNA, 25 bp, Rattus norvegicus
aaagtttcagtaaagtcacccccag

SEQ ID NO: 14614 - DNA, 25 bp, Rattus norvegicus
aaagtttcagtatagtcacccccag

SEQ ID NO: 14615 - DNA, 25 bp, Rattus norvegicus
aaagtttccaagagttaggtcactg

SEQ ID NO: 14616 - DNA, 25 bp, Rattus norvegicus
aaagtttccaagtgttaggtcactg

SEQ ID NO: 14617 - DNA, 25 bp, Rattus norvegicus
aaagtttccctcaccagtatggtag

SEQ ID NO: 14618 - DNA, 25 bp, Rattus norvegicus
aaagtttccctctccagtatggtag

SEQ ID NO: 14619 - DNA, 25 bp, Rattus norvegicus
aaagtttcctctctgtgaggctcgg

SEQ ID NO: 14620 - DNA, 25 bp, Rattus norvegicus
aaagtttcctctgtgtgaggctcgg

SEQ ID NO: 14621 - DNA, 25 bp, Rattus norvegicus
aaagtttcctgtcggagccttgtca

SEQ ID NO: 14622 - DNA, 25 bp, Rattus norvegicus
aaagtttcctgtgggagccttgtca

SEQ ID NO: 14623 - DNA, 25 bp, Rattus norvegicus
aaagtttctcacaatgtatgttata

SEQ ID NO: 14624 - DNA, 25 bp, Rattus norvegicus
aaagtttctcactatgtatgttata

SEQ ID NO: 14625 - DNA, 25 bp, Rattus norvegicus
aaagtttctctaacagccaagcctc

SEQ ID NO: 14626 - DNA, 25 bp, Rattus norvegicus
aaagtttctctatcagccaagcctc

SEQ ID NO: 14627 - DNA, 25 bp, Rattus norvegicus
aaagtttctgatatccttctgcgcc

SEQ ID NO: 14628 - DNA, 25 bp, Rattus norvegicus
aaagtttctgatttccttctgcgcc

SEQ ID NO: 14629 - DNA, 25 bp, Rattus norvegicus
aaagtttctgcacagccacctcatt

SEQ ID NO: 14630 - DNA, 25 bp, Rattus norvegicus
aaagtttctgcagagccacctcatt

SEQ ID NO: 14631 - DNA, 25 bp, Rattus norvegicus
aaagtttcttgacatccagtgctct

SEQ ID NO: 14632 - DNA, 25 bp, Rattus norvegicus
aaagtttcttgagatccagtgctct

SEQ ID NO: 14633 - DNA, 25 bp, Rattus norvegicus
aaagtttctttgattcttgtcagat

SEQ ID NO: 14634 - DNA, 25 bp, Rattus norvegicus
aaagtttctttgtttcttgtcagat

SEQ ID NO: 14635 - DNA, 25 bp, Rattus norvegicus
aaagtttgatgcacagttctggtgc

SEQ ID NO: 14636 - DNA, 25 bp, Rattus norvegicus
aaagtttgatgctcagttctggtgc

SEQ ID NO: 14637 - DNA, 25 bp, Rattus norvegicus
aaagtttgcagcagcctactgcagg

SEQ ID NO: 14638 - DNA, 25 bp, Rattus norvegicus
aaagtttgcagctgcctactgcagg

SEQ ID NO: 14639 - DNA, 25 bp, Rattus norvegicus
aaagtttgccatatactccagtaag

SEQ ID NO: 14640 - DNA, 25 bp, Rattus norvegicus
aaagtttgccatttactccagtaag

SEQ ID NO: 14641 - DNA, 25 bp, Rattus norvegicus
aaagtttgcctcaggagtgcttgcc

SEQ ID NO: 14642 - DNA, 25 bp, Rattus norvegicus
aaagtttgcctctggagtgcttgcc

SEQ ID NO: 14643 - DNA, 25 bp, Rattus norvegicus
aaagtttgctctctgccagccaaag

SEQ ID NO: 14644 - DNA, 25 bp, Rattus norvegicus
aaagtttgctctgtgccagccaaag

SEQ ID NO: 14645 - DNA, 25 bp, Rattus norvegicus
aaagtttgggaaccgagttgtcagt

SEQ ID NO: 14646 - DNA, 25 bp, Rattus norvegicus
aaagtttgggaagcgagttgtcagt

SEQ ID NO: 14647 - DNA, 25 bp, Rattus norvegicus
aaagtttggtcccattctctgtaag

SEQ ID NO: 14648 - DNA, 25 bp, Rattus norvegicus
aaagtttggtccgattctctgtaag

SEQ ID NO: 14649 - DNA, 25 bp, Rattus norvegicus
aaagttttccccatcttgttgcaat

SEQ ID NO: 14650 - DNA, 25 bp, Rattus norvegicus
aaagttttccccttcttgttgcaat

SEQ ID NO: 14651 - DNA, 25 bp, Rattus norvegicus
aaagttttcctcacagtttctctgt

SEQ ID NO: 14652 - DNA, 25 bp, Rattus norvegicus
aaagttttcctctcagtttctctgt

SEQ ID NO: 14653 - DNA, 25 bp, Rattus norvegicus
aaagttttcgccagacatgtcttca

SEQ ID NO: 14654 - DNA, 25 bp, Rattus norvegicus
aaagttttcgcctgacatgtcttca

SEQ ID NO: 14655 - DNA, 25 bp, Rattus norvegicus
aaagttttggcaatacacacgagag

SEQ ID NO: 14656 - DNA, 25 bp, Rattus norvegicus
aaagttttggcattacacacgagag

SEQ ID NO: 14657 - DNA, 25 bp, Rattus norvegicus
aaagtttttatacagcctcaaattg

SEQ ID NO: 14658 - DNA, 25 bp, Rattus norvegicus
aaagtttttatagagcctcaaattg

SEQ ID NO: 14659 - DNA, 25 bp, Rattus norvegicus
aaagtttttgtcagaagggctagag

SEQ ID NO: 14660 - DNA, 25 bp, Rattus norvegicus
aaagtttttgtctgaagggctagag

SEQ ID NO: 14661 - DNA, 25 bp, Rattus norvegicus
aaataaaaccacactgttgctccac

SEQ ID NO: 14662 - DNA, 25 bp, Rattus norvegicus
aaataaaaccactctgttgctccac

SEQ ID NO: 14663 - DNA, 25 bp, Rattus norvegicus
aaataaaactcccacagcacagccg

SEQ ID NO: 14664 - DNA, 25 bp, Rattus norvegicus
aaataaaactccgacagcacagccg

SEQ ID NO: 14665 - DNA, 25 bp, Rattus norvegicus
aaataaaagcccatctcgacgttga

SEQ ID NO: 14666 - DNA, 25 bp, Rattus norvegicus
aaataaaagcccttctcgacgttga

SEQ ID NO: 14667 - DNA, 25 bp, Rattus norvegicus
aaataaaagcttagccatctctgat

SEQ ID NO: 14668 - DNA, 25 bp, Rattus norvegicus
aaataaaagctttgccatctctgat

SEQ ID NO: 14669 - DNA, 25 bp, Rattus norvegicus
aaataaaatattcgcaaggccctgg

SEQ ID NO: 14670 - DNA, 25 bp, Rattus norvegicus
aaataaaatattggcaaggccctgg

SEQ ID NO: 14671 - DNA, 25 bp, Rattus norvegicus
aaataaacatacaagcatcgcggaa

SEQ ID NO: 14672 - DNA, 25 bp, Rattus norvegicus
aaataaacatactagcatcgcggaa

SEQ ID NO: 14673 - DNA, 25 bp, Rattus norvegicus
aaataaacatcgcttcttcccacgg

SEQ ID NO: 14674 - DNA, 25 bp, Rattus norvegicus
aaataaacatcggttcttcccacgg

SEQ ID NO: 14675 - DNA, 25 bp, Rattus norvegicus
aaataaactcacagcgctcttttcc

SEQ ID NO: 14676 - DNA, 25 bp, Rattus norvegicus
aaataaactcactgcgctcttttcc

SEQ ID NO: 14677 - DNA, 25 bp, Rattus norvegicus
aaataaactctgagctcatccaaag

SEQ ID NO: 14678 - DNA, 25 bp, Rattus norvegicus
aaataaactctgtgctcatccaaag

SEQ ID NO: 14679 - DNA, 25 bp, Rattus norvegicus
aaataaactgccactgacccaaaat

SEQ ID NO: 14680 - DNA, 25 bp, Rattus norvegicus
aaataaactgcctctgacccaaaat

SEQ ID NO: 14681 - DNA, 25 bp, Rattus norvegicus
aaataaagaacacctccacgcctct

SEQ ID NO: 14682 - DNA, 25 bp, Rattus norvegicus
aaataaagaacagctccacgcctct

SEQ ID NO: 14683 - DNA, 25 bp, Rattus norvegicus
aaataaaggattacgtgtgccaaga

SEQ ID NO: 14684 - DNA, 25 bp, Rattus norvegicus
aaataaaggatttcgtgtgccaaga

SEQ ID NO: 14685 - DNA, 25 bp, Rattus norvegicus
aaataaaggcaacctactgtgctgc

SEQ ID NO: 14686 - DNA, 25 bp, Rattus norvegicus
aaataaaggcaagctactgtgctgc

SEQ ID NO: 14687 - DNA, 25 bp, Rattus norvegicus
aaataaaggcagatccctccgatga

SEQ ID NO: 14688 - DNA, 25 bp, Rattus norvegicus
aaataaaggcagttccctccgatga

SEQ ID NO: 14689 - DNA, 25 bp, Rattus norvegicus
aaataaagtcttcctagcccagcga

SEQ ID NO: 14690 - DNA, 25 bp, Rattus norvegicus
aaataaagtcttgctagcccagcga

SEQ ID NO: 14691 - DNA, 25 bp, Rattus norvegicus
aaataaagtgccactccgggcttct

SEQ ID NO: 14692 - DNA, 25 bp, Rattus norvegicus
aaataaagtgcctctccgggcttct

SEQ ID NO: 14693 - DNA, 25 bp, Rattus norvegicus
aaataaatacgcctttgtgttggag

SEQ ID NO: 14694 - DNA, 25 bp, Rattus norvegicus
aaataaatacgcgtttgtgttggag

SEQ ID NO: 14695 - DNA, 25 bp, Rattus norvegicus
aaataaatcgtgagcctgccttttt

SEQ ID NO: 14696 - DNA, 25 bp, Rattus norvegicus
aaataaatcgtgtgcctgccttttt

SEQ ID NO: 14697 - DNA, 25 bp, Rattus norvegicus
aaataaatcttccttcatgtgaaat

SEQ ID NO: 14698 - DNA, 25 bp, Rattus norvegicus
aaataaatcttcgttcatgtgaaat

SEQ ID NO: 14699 - DNA, 25 bp, Rattus norvegicus
aaataaatcttgctgtcttgtggac

SEQ ID NO: 14700 - DNA, 25 bp, Rattus norvegicus
aaataaatcttggtgtcttgtggac

SEQ ID NO: 14701 - DNA, 25 bp, Rattus norvegicus
aaataaatgtgtagcctcttccgga

SEQ ID NO: 14702 - DNA, 25 bp, Rattus norvegicus
aaataaatgtgttgcctcttccgga

SEQ ID NO: 14703 - DNA, 25 bp, Rattus norvegicus
aaataaattcccaaatgtctccagc

SEQ ID NO: 14704 - DNA, 25 bp, Rattus norvegicus
aaataaattccctaatgtctccagc

SEQ ID NO: 14705 - DNA, 25 bp, Rattus norvegicus
aaataaattctcagcccgtatgccc

SEQ ID NO: 14706 - DNA, 25 bp, Rattus norvegicus
aaataaattctctgcccgtatgccc

SEQ ID NO: 14707 - DNA, 25 bp, Rattus norvegicus
aaataaattgctacttctccctgct

SEQ ID NO: 14708 - DNA, 25 bp, Rattus norvegicus
aaataaattgcttcttctccctgct

SEQ ID NO: 14709 - DNA, 25 bp, Rattus norvegicus
aaataacaatgcatcctgtgctctt

SEQ ID NO: 14710 - DNA, 25 bp, Rattus norvegicus
aaataacaatgcttcctgtgctctt

SEQ ID NO: 14711 - DNA, 25 bp, Rattus norvegicus
aaataacacttgcttcaccttagaa

SEQ ID NO: 14712 - DNA, 25 bp, Rattus norvegicus
aaataacacttggttcaccttagaa

SEQ ID NO: 14713 - DNA, 25 bp, Rattus norvegicus
aaataaccagctctgccaagggctt

SEQ ID NO: 14714 - DNA, 25 bp, Rattus norvegicus
aaataaccagctgtgccaagggctt

SEQ ID NO: 14715 - DNA, 25 bp, Rattus norvegicus
aaataacccacgcagaccagtgaat

SEQ ID NO: 14716 - DNA, 25 bp, Rattus norvegicus
aaataacccacggagaccagtgaat

SEQ ID NO: 14717 - DNA, 25 bp, Rattus norvegicus
aaataacccatacccatcatcactg

SEQ ID NO: 14718 - DNA, 25 bp, Rattus norvegicus
aaataacccatagccatcatcactg

SEQ ID NO: 14719 - DNA, 25 bp, Rattus norvegicus
aaataaccctgaccatggtgatttg

SEQ ID NO: 14720 - DNA, 25 bp, Rattus norvegicus
aaataaccctgacctctagaggagc

SEQ ID NO: 14721 - DNA, 25 bp, Rattus norvegicus
aaataaccctgagcatggtgatttg

SEQ ID NO: 14722 - DNA, 25 bp, Rattus norvegicus
aaataaccctgagctctagaggagc

SEQ ID NO: 14723 - DNA, 25 bp, Rattus norvegicus
aaataacccttacatatgtgtataa

SEQ ID NO: 14724 - DNA, 25 bp, Rattus norvegicus
aaataacccttagatatgtgtataa

SEQ ID NO: 14725 - DNA, 25 bp, Rattus norvegicus
aaataaccgtctcactgtcccaact

SEQ ID NO: 14726 - DNA, 25 bp, Rattus norvegicus
aaataaccgtctgactgtcccaact

SEQ ID NO: 14727 - DNA, 25 bp, Rattus norvegicus
aaataacctttcaccatttgcaatg

SEQ ID NO: 14728 - DNA, 25 bp, Rattus norvegicus
aaataacctttctccatttgcaatg

SEQ ID NO: 14729 - DNA, 25 bp, Rattus norvegicus
aaataacctttgacgaatgctcggg

SEQ ID NO: 14730 - DNA, 25 bp, Rattus norvegicus
aaataacctttgtcgaatgctcggg

SEQ ID NO: 14731 - DNA, 25 bp, Rattus norvegicus
aaataacgctgaacaacctttgtag

SEQ ID NO: 14732 - DNA, 25 bp, Rattus norvegicus
aaataacgctgatcaacctttgtag

SEQ ID NO: 14733 - DNA, 25 bp, Rattus norvegicus
aaataacgtccccagtttctgagcg

SEQ ID NO: 14734 - DNA, 25 bp, Rattus norvegicus
aaataacgtcccgagtttctgagcg

SEQ ID NO: 14735 - DNA, 25 bp, Rattus norvegicus
aaataactaccaaccaagatctcta

SEQ ID NO: 14736 - DNA, 25 bp, Rattus norvegicus
aaataactaccatccaagatctcta

SEQ ID NO: 14737 - DNA, 25 bp, Rattus norvegicus
aaataactcatcctgtccactacac

SEQ ID NO: 14738 - DNA, 25 bp, Rattus norvegicus
aaataactcatcgtgtccactacac

SEQ ID NO: 14739 - DNA, 25 bp, Rattus norvegicus
aaataactctccctattcaggttgc

SEQ ID NO: 14740 - DNA, 25 bp, Rattus norvegicus
aaataactctccgtattcaggttgc

SEQ ID NO: 14741 - DNA, 25 bp, Rattus norvegicus
aaataactggcaccatctacccttt

SEQ ID NO: 14742 - DNA, 25 bp, Rattus norvegicus
aaataactggcagcatctacccttt

SEQ ID NO: 14743 - DNA, 25 bp, Rattus norvegicus
aaataactggccacttctatgcttg

SEQ ID NO: 14744 - DNA, 25 bp, Rattus norvegicus
aaataactggcctcttctatgcttg

SEQ ID NO: 14745 - DNA, 25 bp, Rattus norvegicus
aaataactggtacctcaatcaataa

SEQ ID NO: 14746 - DNA, 25 bp, Rattus norvegicus
aaataactggtagctcaatcaataa

SEQ ID NO: 14747 - DNA, 25 bp, Rattus norvegicus
aaataacttcagctgtgttcgtgat

SEQ ID NO: 14748 - DNA, 25 bp, Rattus norvegicus
aaataacttcaggtgtgttcgtgat

SEQ ID NO: 14749 - DNA, 25 bp, Rattus norvegicus
aaataacttctgcttatgccctggc

SEQ ID NO: 14750 - DNA, 25 bp, Rattus norvegicus
aaataacttctggttatgccctggc

SEQ ID NO: 14751 - DNA, 25 bp, Rattus norvegicus
aaataagaacctatctctgtgtggg

SEQ ID NO: 14752 - DNA, 25 bp, Rattus norvegicus
aaataagaacctttctctgtgtggg

SEQ ID NO: 14753 - DNA, 25 bp, Rattus norvegicus
aaataagacattccacctcccacaa

SEQ ID NO: 14754 - DNA, 25 bp, Rattus norvegicus
aaataagacattgcacctcccacaa

SEQ ID NO: 14755 - DNA, 25 bp, Rattus norvegicus
aaataagagggactgccagcccctt

SEQ ID NO: 14756 - DNA, 25 bp, Rattus norvegicus
aaataagagggagtgccagcccctt

SEQ ID NO: 14757 - DNA, 25 bp, Rattus norvegicus
aaataagattgaaccctgggcctgg

SEQ ID NO: 14758 - DNA, 25 bp, Rattus norvegicus
aaataagattgatccctgggcctgg

SEQ ID NO: 14759 - DNA, 25 bp, Rattus norvegicus
aaataagcatcaattgggcctcatg

SEQ ID NO: 14760 - DNA, 25 bp, Rattus norvegicus
aaataagcatcatttgggcctcatg

SEQ ID NO: 14761 - DNA, 25 bp, Rattus norvegicus
aaataagcccgcatgtctaggtctg

SEQ ID NO: 14762 - DNA, 25 bp, Rattus norvegicus
aaataagcccgcttgtctaggtctg

SEQ ID NO: 14763 - DNA, 25 bp, Rattus norvegicus
aaataagcccggaggcattttccag

SEQ ID NO: 14764 - DNA, 25 bp, Rattus norvegicus
aaataagcccggtggcattttccag

SEQ ID NO: 14765 - DNA, 25 bp, Rattus norvegicus
aaataagctaggcatggcggtaccc

SEQ ID NO: 14766 - DNA, 25 bp, Rattus norvegicus
aaataagctagggatggcggtaccc

SEQ ID NO: 14767 - DNA, 25 bp, Rattus norvegicus
aaataagctcacagcagttctcccg

SEQ ID NO: 14768 - DNA, 25 bp, Rattus norvegicus
aaataagctcactgcagttctcccg

SEQ ID NO: 14769 - DNA, 25 bp, Rattus norvegicus
aaataagctgtgctgccttaccagt

SEQ ID NO: 14770 - DNA, 25 bp, Rattus norvegicus
aaataagctgtggtgccttaccagt

SEQ ID NO: 14771 - DNA, 25 bp, Rattus norvegicus
aaataaggagacatgcctcgcccat

SEQ ID NO: 14772 - DNA, 25 bp, Rattus norvegicus
aaataaggagacttgcctcgcccat

SEQ ID NO: 14773 - DNA, 25 bp, Rattus norvegicus
aaataaggctccctcaagtgatgtt

SEQ ID NO: 14774 - DNA, 25 bp, Rattus norvegicus
aaataaggctccgtcaagtgatgtt

SEQ ID NO: 14775 - DNA, 25 bp, Rattus norvegicus
aaataaggtctcagtctcgggactc

SEQ ID NO: 14776 - DNA, 25 bp, Rattus norvegicus
aaataaggtctctgtctcgggactc

SEQ ID NO: 14777 - DNA, 25 bp, Rattus norvegicus
aaataaggtgctccagcctgctaac

SEQ ID NO: 14778 - DNA, 25 bp, Rattus norvegicus
aaataaggtgctgcagcctgctaac

SEQ ID NO: 14779 - DNA, 25 bp, Rattus norvegicus
aaataagtacggccgcctctctggc

SEQ ID NO: 14780 - DNA, 25 bp, Rattus norvegicus
aaataagtacgggcgcctctctggc

SEQ ID NO: 14781 - DNA, 25 bp, Rattus norvegicus
aaataagtctatcggcataccaccc

SEQ ID NO: 14782 - DNA, 25 bp, Rattus norvegicus
aaataagtctatgggcataccaccc

SEQ ID NO: 14783 - DNA, 25 bp, Rattus norvegicus
aaataagtcttcaccaacagcgaga

SEQ ID NO: 14784 - DNA, 25 bp, Rattus norvegicus
aaataagtcttctccaacagcgaga

SEQ ID NO: 14785 - DNA, 25 bp, Rattus norvegicus
aaataagtgcagatctcctgctgcc

SEQ ID NO: 14786 - DNA, 25 bp, Rattus norvegicus
aaataagtgcagttctcctgctgcc

SEQ ID NO: 14787 - DNA, 25 bp, Rattus norvegicus
aaataatactgactgcctccaatgt

SEQ ID NO: 14788 - DNA, 25 bp, Rattus norvegicus
aaataatactgagtgcctccaatgt

SEQ ID NO: 14789 - DNA, 25 bp, Rattus norvegicus
aaataatagtgcaactccctccaga

SEQ ID NO: 14790 - DNA, 25 bp, Rattus norvegicus
aaataatagtgctactccctccaga

SEQ ID NO: 14791 - DNA, 25 bp, Rattus norvegicus
aaataatcacctctcattcctttta

SEQ ID NO: 14792 - DNA, 25 bp, Rattus norvegicus
aaataatcacctgtcattcctttta

SEQ ID NO: 14793 - DNA, 25 bp, Rattus norvegicus
aaataatcactcatctgtagcctcc

SEQ ID NO: 14794 - DNA, 25 bp, Rattus norvegicus
aaataatcactcttctgtagcctcc

SEQ ID NO: 14795 - DNA, 25 bp, Rattus norvegicus
aaataatccgttagctatgcctcca

SEQ ID NO: 14796 - DNA, 25 bp, Rattus norvegicus
aaataatccgtttgctatgcctcca

SEQ ID NO: 14797 - DNA, 25 bp, Rattus norvegicus
aaataatccttcagttttggctttg

SEQ ID NO: 14798 - DNA, 25 bp, Rattus norvegicus
aaataatccttctgttttggctttg

SEQ ID NO: 14799 - DNA, 25 bp, Rattus norvegicus
aaataatccttgactacttttctgg

SEQ ID NO: 14800 - DNA, 25 bp, Rattus norvegicus
aaataatccttgtctacttttctgg

SEQ ID NO: 14801 - DNA, 25 bp, Rattus norvegicus
aaataatcgccgctggcactggagc

SEQ ID NO: 14802 - DNA, 25 bp, Rattus norvegicus
aaataatcgccggtggcactggagc

SEQ ID NO: 14803 - DNA, 25 bp, Rattus norvegicus
aaataatcttccatcatcacgactc

SEQ ID NO: 14804 - DNA, 25 bp, Rattus norvegicus
aaataatcttccttcatcacgactc

SEQ ID NO: 14805 - DNA, 25 bp, Rattus norvegicus
aaataatgacccactgctcttgtct

SEQ ID NO: 14806 - DNA, 25 bp, Rattus norvegicus
aaataatgaccctctgctcttgtct

SEQ ID NO: 14807 - DNA, 25 bp, Rattus norvegicus
aaataattgcacacgcctgacggaa

SEQ ID NO: 14808 - DNA, 25 bp, Rattus norvegicus
aaataattgcactcgcctgacggaa

SEQ ID NO: 14809 - DNA, 25 bp, Rattus norvegicus
aaataatttcttcttggcctgccct

SEQ ID NO: 14810 - DNA, 25 bp, Rattus norvegicus
aaataatttcttgttggcctgccct

SEQ ID NO: 14811 - DNA, 25 bp, Rattus norvegicus
aaataattttgcacattgtttttgg

SEQ ID NO: 14812 - DNA, 25 bp, Rattus norvegicus
aaataattttgctcattgtttttgg

SEQ ID NO: 14813 - DNA, 25 bp, Rattus norvegicus
aaataattttttcttcactgctgaa

SEQ ID NO: 14814 - DNA, 25 bp, Rattus norvegicus
aaataattttttgttcactgctgaa

SEQ ID NO: 14815 - DNA, 25 bp, Rattus norvegicus
aaatacaaagagcatggcgggcatg

SEQ ID NO: 14816 - DNA, 25 bp, Rattus norvegicus
aaatacaaagaggatggcgggcatg

SEQ ID NO: 14817 - DNA, 25 bp, Rattus norvegicus
aaatacaacactcaccatctacttg

SEQ ID NO: 14818 - DNA, 25 bp, Rattus norvegicus
aaatacaacactgaccatctacttg

SEQ ID NO: 14819 - DNA, 25 bp, Rattus norvegicus
aaatacaacatcatttgcaccccta

SEQ ID NO: 14820 - DNA, 25 bp, Rattus norvegicus
aaatacaacatccatgggacaggaa

SEQ ID NO: 14821 - DNA, 25 bp, Rattus norvegicus
aaatacaacatcgatgggacaggaa

SEQ ID NO: 14822 - DNA, 25 bp, Rattus norvegicus
aaatacaacatcttttgcaccccta

SEQ ID NO: 14823 - DNA, 25 bp, Rattus norvegicus
aaatacaacgttagggtcagtgatg

SEQ ID NO: 14824 - DNA, 25 bp, Rattus norvegicus
aaatacaacgtttgggtcagtgatg

SEQ ID NO: 14825 - DNA, 25 bp, Rattus norvegicus
aaatacaatggaccacgcgctgcct

SEQ ID NO: 14826 - DNA, 25 bp, Rattus norvegicus
aaatacaatggagcacgcgctgcct

SEQ ID NO: 14827 - DNA, 25 bp, Rattus norvegicus
aaatacacatctctatccgatcagg

SEQ ID NO: 14828 - DNA, 25 bp, Rattus norvegicus
aaatacacatctgtatccgatcagg

SEQ ID NO: 14829 - DNA, 25 bp, Rattus norvegicus
aaatacacctgcctgggtgagcgca

SEQ ID NO: 14830 - DNA, 25 bp, Rattus norvegicus
aaatacacctgcgtgggtgagcgca

SEQ ID NO: 14831 - DNA, 25 bp, Rattus norvegicus
aaatacactatgcagccaggctcca

SEQ ID NO: 14832 - DNA, 25 bp, Rattus norvegicus
aaatacactatggagccaggctcca

SEQ ID NO: 14833 - DNA, 25 bp, Rattus norvegicus
aaatacactgtcaggcctgacttgc

SEQ ID NO: 14834 - DNA, 25 bp, Rattus norvegicus
aaatacactgtctggcctgacttgc

SEQ ID NO: 14835 - DNA, 25 bp, Rattus norvegicus
aaatacagactgattgtttaccaga

SEQ ID NO: 14836 - DNA, 25 bp, Rattus norvegicus
aaatacagactgtttgtttaccaga

SEQ ID NO: 14837 - DNA, 25 bp, Rattus norvegicus
aaatacagagacctgtttccttcta

SEQ ID NO: 14838 - DNA, 25 bp, Rattus norvegicus
aaatacagagacgtgtttccttcta

SEQ ID NO: 14839 - DNA, 25 bp, Rattus norvegicus
aaatacagccccatgagcgtgttga

SEQ ID NO: 14840 - DNA, 25 bp, Rattus norvegicus
aaatacagccccttgagcgtgttga

SEQ ID NO: 14841 - DNA, 25 bp, Rattus norvegicus
aaatacagccgtcctcatggcagct

SEQ ID NO: 14842 - DNA, 25 bp, Rattus norvegicus
aaatacagccgtgctcatggcagct

SEQ ID NO: 14843 - DNA, 25 bp, Rattus norvegicus
aaatacaggcttcacaagtcacgtg

SEQ ID NO: 14844 - DNA, 25 bp, Rattus norvegicus
aaatacaggcttgacaagtcacgtg

SEQ ID NO: 14845 - DNA, 25 bp, Rattus norvegicus
aaatacagggttcggatgaggctca

SEQ ID NO: 14846 - DNA, 25 bp, Rattus norvegicus
aaatacagggttgggatgaggctca

SEQ ID NO: 14847 - DNA, 25 bp, Rattus norvegicus
aaatacaggtagctgctgaacccct

SEQ ID NO: 14848 - DNA, 25 bp, Rattus norvegicus
aaatacaggtaggtgctgaacccct

SEQ ID NO: 14849 - DNA, 25 bp, Rattus norvegicus
aaatacaggtcacggccttgaggca

SEQ ID NO: 14850 - DNA, 25 bp, Rattus norvegicus
aaatacaggtcagggccttgaggca

SEQ ID NO: 14851 - DNA, 25 bp, Rattus norvegicus
aaatacaggtgtatccgtgtgctcc

SEQ ID NO: 14852 - DNA, 25 bp, Rattus norvegicus
aaatacaggtgtattgtctcttcaa

SEQ ID NO: 14853 - DNA, 25 bp, Rattus norvegicus
aaatacaggtgtttccgtgtgctcc

SEQ ID NO: 14854 - DNA, 25 bp, Rattus norvegicus
aaatacaggtgttttgtctcttcaa

SEQ ID NO: 14855 - DNA, 25 bp, Rattus norvegicus
aaatacagtcaacaggcccaccaag

SEQ ID NO: 14856 - DNA, 25 bp, Rattus norvegicus
aaatacagtcaagaggcccaccaag

SEQ ID NO: 14857 - DNA, 25 bp, Rattus norvegicus
aaatacagtcataggagacccaccc

SEQ ID NO: 14858 - DNA, 25 bp, Rattus norvegicus
aaatacagtcattggagacccaccc

SEQ ID NO: 14859 - DNA, 25 bp, Rattus norvegicus
aaatacagtggtcctgctctatcca

SEQ ID NO: 14860 - DNA, 25 bp, Rattus norvegicus
aaatacagtggtgctgctctatcca

SEQ ID NO: 14861 - DNA, 25 bp, Rattus norvegicus
aaatacagtttccaggtctagacct

SEQ ID NO: 14862 - DNA, 25 bp, Rattus norvegicus
aaatacagtttcgaggtctagacct

SEQ ID NO: 14863 - DNA, 25 bp, Rattus norvegicus
aaatacatccatatgtggttggtca

SEQ ID NO: 14864 - DNA, 25 bp, Rattus norvegicus
aaatacatccatcccagtggctctt

SEQ ID NO: 14865 - DNA, 25 bp, Rattus norvegicus
aaatacatccatgccagtggctctt

SEQ ID NO: 14866 - DNA, 25 bp, Rattus norvegicus
aaatacatccatttgtggttggtca

SEQ ID NO: 14867 - DNA, 25 bp, Rattus norvegicus
aaatacatccttaggtcacagttat

SEQ ID NO: 14868 - DNA, 25 bp, Rattus norvegicus
aaatacatcctttggtcacagttat

SEQ ID NO: 14869 - DNA, 25 bp, Rattus norvegicus
aaatacatcttcatctgcagtttga

SEQ ID NO: 14870 - DNA, 25 bp, Rattus norvegicus
aaatacatcttcttctgcagtttga

SEQ ID NO: 14871 - DNA, 25 bp, Rattus norvegicus
aaatacatgcctagcttgctgggat

SEQ ID NO: 14872 - DNA, 25 bp, Rattus norvegicus
aaatacatgccttgcttgctgggat

SEQ ID NO: 14873 - DNA, 25 bp, Rattus norvegicus
aaatacatggacagccagtgccctg

SEQ ID NO: 14874 - DNA, 25 bp, Rattus norvegicus
aaatacatggactgccagtgccctg

SEQ ID NO: 14875 - DNA, 25 bp, Rattus norvegicus
aaatacatgggcactggtcccgtgg

SEQ ID NO: 14876 - DNA, 25 bp, Rattus norvegicus
aaatacatgggctctggtcccgtgg

SEQ ID NO: 14877 - DNA, 25 bp, Rattus norvegicus
aaatacatttacagaacttgggcta

SEQ ID NO: 14878 - DNA, 25 bp, Rattus norvegicus
aaatacatttactgaacttgggcta

SEQ ID NO: 14879 - DNA, 25 bp, Rattus norvegicus
aaatacatttccatgctctatgcat

SEQ ID NO: 14880 - DNA, 25 bp, Rattus norvegicus
aaatacatttccttgctctatgcat

SEQ ID NO: 14881 - DNA, 25 bp, Rattus norvegicus
aaataccactgccaccactgaagga

SEQ ID NO: 14882 - DNA, 25 bp, Rattus norvegicus
aaataccactgcgaccactgaagga

SEQ ID NO: 14883 - DNA, 25 bp, Rattus norvegicus
aaataccagattcgctaccgcgtgg

SEQ ID NO: 14884 - DNA, 25 bp, Rattus norvegicus
aaataccagattggctaccgcgtgg

SEQ ID NO: 14885 - DNA, 25 bp, Rattus norvegicus
aaataccagcctaaactatgcagcc

SEQ ID NO: 14886 - DNA, 25 bp, Rattus norvegicus
aaataccagccttaactatgcagcc

SEQ ID NO: 14887 - DNA, 25 bp, Rattus norvegicus
aaataccagcttaggggctctattc

SEQ ID NO: 14888 - DNA, 25 bp, Rattus norvegicus
aaataccagctttggggctctattc

SEQ ID NO: 14889 - DNA, 25 bp, Rattus norvegicus
aaataccattggaccttctgctgtg

SEQ ID NO: 14890 - DNA, 25 bp, Rattus norvegicus
aaataccattggtccttctgctgtg

SEQ ID NO: 14891 - DNA, 25 bp, Rattus norvegicus
aaatacccaaggatgcgcgtgcaca

SEQ ID NO: 14892 - DNA, 25 bp, Rattus norvegicus
aaatacccaaggttgcgcgtgcaca

SEQ ID NO: 14893 - DNA, 25 bp, Rattus norvegicus
aaatacccacgtacaggcgtatcct

SEQ ID NO: 14894 - DNA, 25 bp, Rattus norvegicus
aaatacccacgttcaggcgtatcct

SEQ ID NO: 14895 - DNA, 25 bp, Rattus norvegicus
aaatacccacttcaggccagcaatg

SEQ ID NO: 14896 - DNA, 25 bp, Rattus norvegicus
aaatacccacttgaggccagcaatg

SEQ ID NO: 14897 - DNA, 25 bp, Rattus norvegicus
aaatacccagggaccaggagtcaga

SEQ ID NO: 14898 - DNA, 25 bp, Rattus norvegicus
aaatacccagggtccaggagtcaga

SEQ ID NO: 14899 - DNA, 25 bp, Rattus norvegicus
aaatacccattaagctctcctaagg

SEQ ID NO: 14900 - DNA, 25 bp, Rattus norvegicus
aaatacccattatgctctcctaagg

SEQ ID NO: 14901 - DNA, 25 bp, Rattus norvegicus
aaatacccctaaatccagttcatgg

SEQ ID NO: 14902 - DNA, 25 bp, Rattus norvegicus
aaatacccctaattccagttcatgg

SEQ ID NO: 14903 - DNA, 25 bp, Rattus norvegicus
aaataccctgccagcaggtaccaaa

SEQ ID NO: 14904 - DNA, 25 bp, Rattus norvegicus
aaataccctgcctgcaggtaccaaa

SEQ ID NO: 14905 - DNA, 25 bp, Rattus norvegicus
aaataccctggcactgatgaactgt

SEQ ID NO: 14906 - DNA, 25 bp, Rattus norvegicus
aaataccctggctctgatgaactgt

SEQ ID NO: 14907 - DNA, 25 bp, Rattus norvegicus
aaataccctttcaacatgtgccaac

SEQ ID NO: 14908 - DNA, 25 bp, Rattus norvegicus
aaataccctttctacatgtgccaac

SEQ ID NO: 14909 - DNA, 25 bp, Rattus norvegicus
aaataccgaagactgtgctcccaaa

SEQ ID NO: 14910 - DNA, 25 bp, Rattus norvegicus
aaataccgaagagtgtgctcccaaa

SEQ ID NO: 14911 - DNA, 25 bp, Rattus norvegicus
aaataccggtaccttgcttgcttga

SEQ ID NO: 14912 - DNA, 25 bp, Rattus norvegicus
aaataccggtacgttgcttgcttga

SEQ ID NO: 14913 - DNA, 25 bp, Rattus norvegicus
aaatacctctatagtgggccacgtt

SEQ ID NO: 14914 - DNA, 25 bp, Rattus norvegicus
aaatacctctattgtgggccacgtt

SEQ ID NO: 14915 - DNA, 25 bp, Rattus norvegicus
aaatacctggcacctttgtgcaatt

SEQ ID NO: 14916 - DNA, 25 bp, Rattus norvegicus
aaatacctggcagctttgtgcaatt

SEQ ID NO: 14917 - DNA, 25 bp, Rattus norvegicus
aaatacctggtgacggtctcagagg

SEQ ID NO: 14918 - DNA, 25 bp, Rattus norvegicus
aaatacctggtgtcggtctcagagg

SEQ ID NO: 14919 - DNA, 25 bp, Rattus norvegicus
aaataccttagtagctggcctatcc

SEQ ID NO: 14920 - DNA, 25 bp, Rattus norvegicus
aaataccttagttgctggcctatcc

SEQ ID NO: 14921 - DNA, 25 bp, Rattus norvegicus
aaataccttggactggtgcctgcca

SEQ ID NO: 14922 - DNA, 25 bp, Rattus norvegicus
aaataccttggagtggtgcctgcca

SEQ ID NO: 14923 - DNA, 25 bp, Rattus norvegicus
aaatacctttctactttgtatgaag

SEQ ID NO: 14924 - DNA, 25 bp, Rattus norvegicus
aaatacctttcttctttgtatgaag

SEQ ID NO: 14925 - DNA, 25 bp, Rattus norvegicus
aaatacgagaaccacctggccctgc

SEQ ID NO: 14926 - DNA, 25 bp, Rattus norvegicus
aaatacgagaacgacctggccctgc

SEQ ID NO: 14927 - DNA, 25 bp, Rattus norvegicus
aaatacgaggccaccgtgagccgga

SEQ ID NO: 14928 - DNA, 25 bp, Rattus norvegicus
aaatacgaggcctccgtgagccgga

SEQ ID NO: 14929 - DNA, 25 bp, Rattus norvegicus
aaatacgctcccactgagtagtgga

SEQ ID NO: 14930 - DNA, 25 bp, Rattus norvegicus
aaatacgctccctctgagtagtgga

SEQ ID NO: 14931 - DNA, 25 bp, Rattus norvegicus
aaatacgctctcagagtccggcact

SEQ ID NO: 14932 - DNA, 25 bp, Rattus norvegicus
aaatacgctctctgagtccggcact

SEQ ID NO: 14933 - DNA, 25 bp, Rattus norvegicus
aaatacgctgttccagtgactccat

SEQ ID NO: 14934 - DNA, 25 bp, Rattus norvegicus
aaatacgctgttgcagtgactccat

SEQ ID NO: 14935 - DNA, 25 bp, Rattus norvegicus
aaatacggcatgactatgtgtgtgc

SEQ ID NO: 14936 - DNA, 25 bp, Rattus norvegicus
aaatacggcatgtctatgtgtgtgc

SEQ ID NO: 14937 - DNA, 25 bp, Rattus norvegicus
aaatacggtctcaaggtagaacagg

SEQ ID NO: 14938 - DNA, 25 bp, Rattus norvegicus
aaatacggtctctaggtagaacagg

SEQ ID NO: 14939 - DNA, 25 bp, Rattus norvegicus
aaatacggtttaaatgtccaggcaa

SEQ ID NO: 14940 - DNA, 25 bp, Rattus norvegicus
aaatacggtttatatgtccaggcaa

SEQ ID NO: 14941 - DNA, 25 bp, Rattus norvegicus
aaatactaccctcgcttctactatt

SEQ ID NO: 14942 - DNA, 25 bp, Rattus norvegicus
aaatactaccctggcttctactatt

SEQ ID NO: 14943 - DNA, 25 bp, Rattus norvegicus
aaatactacctgactgtgttcaact

SEQ ID NO: 14944 - DNA, 25 bp, Rattus norvegicus
aaatactacctgtctgtgttcaact

SEQ ID NO: 14945 - DNA, 25 bp, Rattus norvegicus
aaatactcactgacctttccagttg

SEQ ID NO: 14946 - DNA, 25 bp, Rattus norvegicus
aaatactcactgtcctttccagttg

SEQ ID NO: 14947 - DNA, 25 bp, Rattus norvegicus
aaatactcagccattcagactttgg

SEQ ID NO: 14948 - DNA, 25 bp, Rattus norvegicus
aaatactcagcctttcagactttgg

SEQ ID NO: 14949 - DNA, 25 bp, Rattus norvegicus
aaatactcaggaacctgccacgcat

SEQ ID NO: 14950 - DNA, 25 bp, Rattus norvegicus
aaatactcaggatcctgccacgcat

SEQ ID NO: 14951 - DNA, 25 bp, Rattus norvegicus
aaatactcagtacctacctaggtca

SEQ ID NO: 14952 - DNA, 25 bp, Rattus norvegicus
aaatactcagtagctacctaggtca

SEQ ID NO: 14953 - DNA, 25 bp, Rattus norvegicus
aaatactcagttcccttacctcatg

SEQ ID NO: 14954 - DNA, 25 bp, Rattus norvegicus
aaatactcagttgccttacctcatg

SEQ ID NO: 14955 - DNA, 25 bp, Rattus norvegicus
aaatactcatctctcttttactaag

SEQ ID NO: 14956 - DNA, 25 bp, Rattus norvegicus
aaatactcatctgtcttttactaag

SEQ ID NO: 14957 - DNA, 25 bp, Rattus norvegicus
aaatactcatggattcactctgtcc

SEQ ID NO: 14958 - DNA, 25 bp, Rattus norvegicus
aaatactcatggtttcactctgtcc

SEQ ID NO: 14959 - DNA, 25 bp, Rattus norvegicus
aaatactccgaacttggcaaccaag

SEQ ID NO: 14960 - DNA, 25 bp, Rattus norvegicus
aaatactccgaagttggcaaccaag

SEQ ID NO: 14961 - DNA, 25 bp, Rattus norvegicus
aaatactctcaaacccgtgtacaat

SEQ ID NO: 14962 - DNA, 25 bp, Rattus norvegicus
aaatactctcaatcccgtgtacaat

SEQ ID NO: 14963 - DNA, 25 bp, Rattus norvegicus
aaatactctcagacttttgtagaag

SEQ ID NO: 14964 - DNA, 25 bp, Rattus norvegicus
aaatactctcagtcttttgtagaag

SEQ ID NO: 14965 - DNA, 25 bp, Rattus norvegicus
aaatactctgctacttaagctccca

SEQ ID NO: 14966 - DNA, 25 bp, Rattus norvegicus
aaatactctgctacttggttggaat

SEQ ID NO: 14967 - DNA, 25 bp, Rattus norvegicus
aaatactctgcttcttaagctccca

SEQ ID NO: 14968 - DNA, 25 bp, Rattus norvegicus
aaatactctgcttcttggttggaat

SEQ ID NO: 14969 - DNA, 25 bp, Rattus norvegicus
aaatactctgttagaccttcaaagt

SEQ ID NO: 14970 - DNA, 25 bp, Rattus norvegicus
aaatactctgttccacctaacaggc

SEQ ID NO: 14971 - DNA, 25 bp, Rattus norvegicus
aaatactctgttgcacctaacaggc

SEQ ID NO: 14972 - DNA, 25 bp, Rattus norvegicus
aaatactctgtttgaccttcaaagt

SEQ ID NO: 14973 - DNA, 25 bp, Rattus norvegicus
aaatactcttacctggcctttgaga

SEQ ID NO: 14974 - DNA, 25 bp, Rattus norvegicus
aaatactcttacgtggcctttgaga

SEQ ID NO: 14975 - DNA, 25 bp, Rattus norvegicus
aaatactgcaggcactttcgccaaa

SEQ ID NO: 14976 - DNA, 25 bp, Rattus norvegicus
aaatactgcagggactttcgccaaa

SEQ ID NO: 14977 - DNA, 25 bp, Rattus norvegicus
aaatactgcattacttttgcgtgta

SEQ ID NO: 14978 - DNA, 25 bp, Rattus norvegicus
aaatactgcatttcttttgcgtgta

SEQ ID NO: 14979 - DNA, 25 bp, Rattus norvegicus
aaatactgccataagcttctttctc

SEQ ID NO: 14980 - DNA, 25 bp, Rattus norvegicus
aaatactgccattagcttctttctc

SEQ ID NO: 14981 - DNA, 25 bp, Rattus norvegicus
aaatactgctctaagtacttactgt

SEQ ID NO: 14982 - DNA, 25 bp, Rattus norvegicus
aaatactgctcttagtacttactgt

SEQ ID NO: 14983 - DNA, 25 bp, Rattus norvegicus
aaatactgctgcacacagccagtga

SEQ ID NO: 14984 - DNA, 25 bp, Rattus norvegicus
aaatactgctgctcacagccagtga

SEQ ID NO: 14985 - DNA, 25 bp, Rattus norvegicus
aaatactggcacaccgtggctgggt

SEQ ID NO: 14986 - DNA, 25 bp, Rattus norvegicus
aaatactggcactccgtggctgggt

SEQ ID NO: 14987 - DNA, 25 bp, Rattus norvegicus
aaatactgtagcattcctgtgctca

SEQ ID NO: 14988 - DNA, 25 bp, Rattus norvegicus
aaatactgtagctttcctgtgctca

SEQ ID NO: 14989 - DNA, 25 bp, Rattus norvegicus
aaatactgtgtgagccttagggttc

SEQ ID NO: 14990 - DNA, 25 bp, Rattus norvegicus
aaatactgtgtgtgccttagggttc

SEQ ID NO: 14991 - DNA, 25 bp, Rattus norvegicus
aaatactgttggctctttttcacgc

SEQ ID NO: 14992 - DNA, 25 bp, Rattus norvegicus
aaatactgttgggtctttttcacgc

SEQ ID NO: 14993 - DNA, 25 bp, Rattus norvegicus
aaatacttattgagaggcagggcct

SEQ ID NO: 14994 - DNA, 25 bp, Rattus norvegicus
aaatacttattgtgaggcagggcct

SEQ ID NO: 14995 - DNA, 25 bp, Rattus norvegicus
aaatacttcctgctgactaggcgag

SEQ ID NO: 14996 - DNA, 25 bp, Rattus norvegicus
aaatacttcctggtgactaggcgag

SEQ ID NO: 14997 - DNA, 25 bp, Rattus norvegicus
aaatacttctctctgtggcatgaac

SEQ ID NO: 14998 - DNA, 25 bp, Rattus norvegicus
aaatacttctctgtgtggcatgaac

SEQ ID NO: 14999 - DNA, 25 bp, Rattus norvegicus
aaatacttgtaaatggcggcagcac

SEQ ID NO: 15000 - DNA, 25 bp, Rattus norvegicus
aaatacttgtaattggcggcagcac

SEQ ID NO: 15001 - DNA, 25 bp, Rattus norvegicus
aaatagaaacccagcggctgggcgc

SEQ ID NO: 15002 - DNA, 25 bp, Rattus norvegicus
aaatagaaaccctgcggctgggcgc

SEQ ID NO: 15003 - DNA, 25 bp, Rattus norvegicus
aaatagaaatctccctaaaaggcag

SEQ ID NO: 15004 - DNA, 25 bp, Rattus norvegicus
aaatagaaatctgcctaaaaggcag

SEQ ID NO: 15005 - DNA, 25 bp, Rattus norvegicus
aaatagaacagccatcgcactccta

SEQ ID NO: 15006 - DNA, 25 bp, Rattus norvegicus
aaatagaacagcgatcgcactccta

SEQ ID NO: 15007 - DNA, 25 bp, Rattus norvegicus
aaatagaacatcagttgcactgaca

SEQ ID NO: 15008 - DNA, 25 bp, Rattus norvegicus
aaatagaacatctgttgcactgaca

SEQ ID NO: 15009 - DNA, 25 bp, Rattus norvegicus
aaatagaaccctacagcatgtcctg

SEQ ID NO: 15010 - DNA, 25 bp, Rattus norvegicus
aaatagaacccttcagcatgtcctg

SEQ ID NO: 15011 - DNA, 25 bp, Rattus norvegicus
aaatagaagctccttgtaccccaga

SEQ ID NO: 15012 - DNA, 25 bp, Rattus norvegicus
aaatagaagctcgttgtaccccaga

SEQ ID NO: 15013 - DNA, 25 bp, Rattus norvegicus
aaatagaagtgacccctgtccagca

SEQ ID NO: 15014 - DNA, 25 bp, Rattus norvegicus
aaatagaagtgagccctgtccagca

SEQ ID NO: 15015 - DNA, 25 bp, Rattus norvegicus
aaatagaatcctacaagcactcttg

SEQ ID NO: 15016 - DNA, 25 bp, Rattus norvegicus
aaatagaatccttcaagcactcttg

SEQ ID NO: 15017 - DNA, 25 bp, Rattus norvegicus
aaatagagagcgcagcctgatccct

SEQ ID NO: 15018 - DNA, 25 bp, Rattus norvegicus
aaatagagagcggagcctgatccct

SEQ ID NO: 15019 - DNA, 25 bp, Rattus norvegicus
aaatagagcacacgccagcttcctt

SEQ ID NO: 15020 - DNA, 25 bp, Rattus norvegicus
aaatagagcacaggccagcttcctt

SEQ ID NO: 15021 - DNA, 25 bp, Rattus norvegicus
aaatagagcatcatgattttcagtg

SEQ ID NO: 15022 - DNA, 25 bp, Rattus norvegicus
aaatagagcatcttgattttcagtg

SEQ ID NO: 15023 - DNA, 25 bp, Rattus norvegicus
aaatagaggcctccactcatgtctg

SEQ ID NO: 15024 - DNA, 25 bp, Rattus norvegicus
aaatagaggcctgcactcatgtctg

SEQ ID NO: 15025 - DNA, 25 bp, Rattus norvegicus
aaatagaggcttacccgagagtgtg

SEQ ID NO: 15026 - DNA, 25 bp, Rattus norvegicus
aaatagaggctttcccgagagtgtg

SEQ ID NO: 15027 - DNA, 25 bp, Rattus norvegicus
aaatagaggtccctgtcttcattag

SEQ ID NO: 15028 - DNA, 25 bp, Rattus norvegicus
aaatagaggtccgtgtcttcattag

SEQ ID NO: 15029 - DNA, 25 bp, Rattus norvegicus
aaatagagtgataccattatataaa

SEQ ID NO: 15030 - DNA, 25 bp, Rattus norvegicus
aaatagagtgattccattatataaa

SEQ ID NO: 15031 - DNA, 25 bp, Rattus norvegicus
aaatagatcaccacagcattctcag

SEQ ID NO: 15032 - DNA, 25 bp, Rattus norvegicus
aaatagatcacctcagcattctcag

SEQ ID NO: 15033 - DNA, 25 bp, Rattus norvegicus
aaatagatcataacccctttgcaaa

SEQ ID NO: 15034 - DNA, 25 bp, Rattus norvegicus
aaatagatcatatcccctttgcaaa

SEQ ID NO: 15035 - DNA, 25 bp, Rattus norvegicus
aaatagatgaccattcacgactgaa

SEQ ID NO: 15036 - DNA, 25 bp, Rattus norvegicus
aaatagatgacctttcacgactgaa

SEQ ID NO: 15037 - DNA, 25 bp, Rattus norvegicus
aaatagattaggagggcacccacag

SEQ ID NO: 15038 - DNA, 25 bp, Rattus norvegicus
aaatagattaggtgggcacccacag

SEQ ID NO: 15039 - DNA, 25 bp, Rattus norvegicus
aaatagatttcgctcctgtttctcg

SEQ ID NO: 15040 - DNA, 25 bp, Rattus norvegicus
aaatagatttcggtcctgtttctcg

SEQ ID NO: 15041 - DNA, 25 bp, Rattus norvegicus
aaatagcaccatactattgcctcca

SEQ ID NO: 15042 - DNA, 25 bp, Rattus norvegicus
aaatagcaccattctattgcctcca

SEQ ID NO: 15043 - DNA, 25 bp, Rattus norvegicus
aaatagcagccaatctgtcagaccc

SEQ ID NO: 15044 - DNA, 25 bp, Rattus norvegicus
aaatagcagccattctgtcagaccc

SEQ ID NO: 15045 - DNA, 25 bp, Rattus norvegicus
aaatagcattccacccctatgtgta

SEQ ID NO: 15046 - DNA, 25 bp, Rattus norvegicus
aaatagcattcctcccctatgtgta

SEQ ID NO: 15047 - DNA, 25 bp, Rattus norvegicus
aaatagccaggcacatctacaggag

SEQ ID NO: 15048 - DNA, 25 bp, Rattus norvegicus
aaatagccaggctcatctacaggag

SEQ ID NO: 15049 - DNA, 25 bp, Rattus norvegicus
aaatagccctatactctgcttgaac

SEQ ID NO: 15050 - DNA, 25 bp, Rattus norvegicus
aaatagccctattctctgcttgaac

SEQ ID NO: 15051 - DNA, 25 bp, Rattus norvegicus
aaatagcccttgacatccttggttg

SEQ ID NO: 15052 - DNA, 25 bp, Rattus norvegicus
aaatagcccttgcatcagtacggga

SEQ ID NO: 15053 - DNA, 25 bp, Rattus norvegicus
aaatagcccttggatcagtacggga

SEQ ID NO: 15054 - DNA, 25 bp, Rattus norvegicus
aaatagcccttgtcatccttggttg

SEQ ID NO: 15055 - DNA, 25 bp, Rattus norvegicus
aaatagccgctcacttaggctcatg

SEQ ID NO: 15056 - DNA, 25 bp, Rattus norvegicus
aaatagccgctctcttaggctcatg

SEQ ID NO: 15057 - DNA, 25 bp, Rattus norvegicus
aaatagcctcctcttaacagtcttt

SEQ ID NO: 15058 - DNA, 25 bp, Rattus norvegicus
aaatagcctcctgttaacagtcttt

SEQ ID NO: 15059 - DNA, 25 bp, Rattus norvegicus
aaatagcctcttcccagatatcgtg

SEQ ID NO: 15060 - DNA, 25 bp, Rattus norvegicus
aaatagcctcttgccagatatcgtg

SEQ ID NO: 15061 - DNA, 25 bp, Rattus norvegicus
aaatagccttgaacattgtcctcca

SEQ ID NO: 15062 - DNA, 25 bp, Rattus norvegicus
aaatagccttgatcattgtcctcca

SEQ ID NO: 15063 - DNA, 25 bp, Rattus norvegicus
aaatagcgagaaattaacctctgcc

SEQ ID NO: 15064 - DNA, 25 bp, Rattus norvegicus
aaatagcgagaatttaacctctgcc

SEQ ID NO: 15065 - DNA, 25 bp, Rattus norvegicus
aaatagcgcagaccgggagccattc

SEQ ID NO: 15066 - DNA, 25 bp, Rattus norvegicus
aaatagcgcagagcgggagccattc

SEQ ID NO: 15067 - DNA, 25 bp, Rattus norvegicus
aaatagcgcttgctcagatcctggg

SEQ ID NO: 15068 - DNA, 25 bp, Rattus norvegicus
aaatagcgcttggtcagatcctggg

SEQ ID NO: 15069 - DNA, 25 bp, Rattus norvegicus
aaatagcggcagaggaggctcacga

SEQ ID NO: 15070 - DNA, 25 bp, Rattus norvegicus
aaatagcggcagtggaggctcacga

SEQ ID NO: 15071 - DNA, 25 bp, Rattus norvegicus
aaatagctaagccatcagactccca

SEQ ID NO: 15072 - DNA, 25 bp, Rattus norvegicus
aaatagctaagcgatcagactccca

SEQ ID NO: 15073 - DNA, 25 bp, Rattus norvegicus
aaatagctactaactgtctgatgag

SEQ ID NO: 15074 - DNA, 25 bp, Rattus norvegicus
aaatagctactatctgtctgatgag

SEQ ID NO: 15075 - DNA, 25 bp, Rattus norvegicus
aaatagctagttattgtgcacacac

SEQ ID NO: 15076 - DNA, 25 bp, Rattus norvegicus
aaatagctagtttttgtgcacacac

SEQ ID NO: 15077 - DNA, 25 bp, Rattus norvegicus
aaatagctatgccttgtacctctta

SEQ ID NO: 15078 - DNA, 25 bp, Rattus norvegicus
aaatagctatgcgttgtacctctta

SEQ ID NO: 15079 - DNA, 25 bp, Rattus norvegicus
aaatagctccggattactatggact

SEQ ID NO: 15080 - DNA, 25 bp, Rattus norvegicus
aaatagctccggtttactatggact

SEQ ID NO: 15081 - DNA, 25 bp, Rattus norvegicus
aaatagctctggaggcagtggcgta

SEQ ID NO: 15082 - DNA, 25 bp, Rattus norvegicus
aaatagctctggctctttctagcca

SEQ ID NO: 15083 - DNA, 25 bp, Rattus norvegicus
aaatagctctgggtctttctagcca

SEQ ID NO: 15084 - DNA, 25 bp, Rattus norvegicus
aaatagctctggtggcagtggcgta

SEQ ID NO: 15085 - DNA, 25 bp, Rattus norvegicus
aaatagctctttctgttcactataa

SEQ ID NO: 15086 - DNA, 25 bp, Rattus norvegicus
aaatagctctttctttgcaaccctc

SEQ ID NO: 15087 - DNA, 25 bp, Rattus norvegicus
aaatagctctttgtgttcactataa

SEQ ID NO: 15088 - DNA, 25 bp, Rattus norvegicus
aaatagctctttgtttgcaaccctc

SEQ ID NO: 15089 - DNA, 25 bp, Rattus norvegicus
aaatagctgctgctcggaggtccct

SEQ ID NO: 15090 - DNA, 25 bp, Rattus norvegicus
aaatagctgctggtcggaggtccct

SEQ ID NO: 15091 - DNA, 25 bp, Rattus norvegicus
aaatagctgtgcactgggcagccag

SEQ ID NO: 15092 - DNA, 25 bp, Rattus norvegicus
aaatagctgtgctctgggcagccag

SEQ ID NO: 15093 - DNA, 25 bp, Rattus norvegicus
aaatagctgtgtaggaccttacttt

SEQ ID NO: 15094 - DNA, 25 bp, Rattus norvegicus
aaatagctgtgttggaccttacttt

SEQ ID NO: 15095 - DNA, 25 bp, Rattus norvegicus
aaatagcttaataagtaggaccaga

SEQ ID NO: 15096 - DNA, 25 bp, Rattus norvegicus
aaatagcttaattagtaggaccaga

SEQ ID NO: 15097 - DNA, 25 bp, Rattus norvegicus
aaatagcttccaattctagtctaaa

SEQ ID NO: 15098 - DNA, 25 bp, Rattus norvegicus
aaatagcttccatttctagtctaaa

SEQ ID NO: 15099 - DNA, 25 bp, Rattus norvegicus
aaatagcttctccaagcccctgaaa

SEQ ID NO: 15100 - DNA, 25 bp, Rattus norvegicus
aaatagcttctcgaagcccctgaaa

SEQ ID NO: 15101 - DNA, 25 bp, Rattus norvegicus
aaatagcttgtcacagcgggtaagg

SEQ ID NO: 15102 - DNA, 25 bp, Rattus norvegicus
aaatagcttgtctcagcgggtaagg

SEQ ID NO: 15103 - DNA, 25 bp, Rattus norvegicus
aaataggaactaagccggcggagtc

SEQ ID NO: 15104 - DNA, 25 bp, Rattus norvegicus
aaataggaactatgccggcggagtc

SEQ ID NO: 15105 - DNA, 25 bp, Rattus norvegicus
aaataggacctcaacattacccact

SEQ ID NO: 15106 - DNA, 25 bp, Rattus norvegicus
aaataggacctctacattacccact

SEQ ID NO: 15107 - DNA, 25 bp, Rattus norvegicus
aaataggcacgtcctgggatctcct

SEQ ID NO: 15108 - DNA, 25 bp, Rattus norvegicus
aaataggcacgtgctgggatctcct

SEQ ID NO: 15109 - DNA, 25 bp, Rattus norvegicus
aaataggcagccaaactcgacctcc

SEQ ID NO: 15110 - DNA, 25 bp, Rattus norvegicus
aaataggcagcctaactcgacctcc

SEQ ID NO: 15111 - DNA, 25 bp, Rattus norvegicus
aaataggcatctctgttagccattt

SEQ ID NO: 15112 - DNA, 25 bp, Rattus norvegicus
aaataggcatctgtgttagccattt

SEQ ID NO: 15113 - DNA, 25 bp, Rattus norvegicus
aaataggctattcggctgtcagatc

SEQ ID NO: 15114 - DNA, 25 bp, Rattus norvegicus
aaataggctattgggctgtcagatc

SEQ ID NO: 15115 - DNA, 25 bp, Rattus norvegicus
aaatagggaccgattggccacctgt

SEQ ID NO: 15116 - DNA, 25 bp, Rattus norvegicus
aaatagggaccgtttggccacctgt

SEQ ID NO: 15117 - DNA, 25 bp, Rattus norvegicus
aaatagggacttagcttaggccaag

SEQ ID NO: 15118 - DNA, 25 bp, Rattus norvegicus
aaatagggactttgcttaggccaag

SEQ ID NO: 15119 - DNA, 25 bp, Rattus norvegicus
aaatagggcaacattaaagaacatt

SEQ ID NO: 15120 - DNA, 25 bp, Rattus norvegicus
aaatagggcaactttaaagaacatt

SEQ ID NO: 15121 - DNA, 25 bp, Rattus norvegicus
aaatagggcaccctcaagcctgggc

SEQ ID NO: 15122 - DNA, 25 bp, Rattus norvegicus
aaatagggcaccgtcaagcctgggc

SEQ ID NO: 15123 - DNA, 25 bp, Rattus norvegicus
aaatagggcctcagccagctaagag

SEQ ID NO: 15124 - DNA, 25 bp, Rattus norvegicus
aaatagggcctctgccagctaagag

SEQ ID NO: 15125 - DNA, 25 bp, Rattus norvegicus
aaatagggctgtacgcaatgtggtt

SEQ ID NO: 15126 - DNA, 25 bp, Rattus norvegicus
aaatagggctgttcgcaatgtggtt

SEQ ID NO: 15127 - DNA, 25 bp, Rattus norvegicus
aaatagggtcttcaatggtgtaaat

SEQ ID NO: 15128 - DNA, 25 bp, Rattus norvegicus
aaatagggtcttgaatggtgtaaat

SEQ ID NO: 15129 - DNA, 25 bp, Rattus norvegicus
aaataggtctctaggtagccctcga

SEQ ID NO: 15130 - DNA, 25 bp, Rattus norvegicus
aaataggtctctcggaatctgatgc

SEQ ID NO: 15131 - DNA, 25 bp, Rattus norvegicus
aaataggtctctgggaatctgatgc

SEQ ID NO: 15132 - DNA, 25 bp, Rattus norvegicus
aaataggtctcttggtagccctcga

SEQ ID NO: 15133 - DNA, 25 bp, Rattus norvegicus
aaataggtgcctaggccaagctgct

SEQ ID NO: 15134 - DNA, 25 bp, Rattus norvegicus
aaataggtgccttggccaagctgct

SEQ ID NO: 15135 - DNA, 25 bp, Rattus norvegicus
aaataggtggatccccattccagtg

SEQ ID NO: 15136 - DNA, 25 bp, Rattus norvegicus
aaataggtggatgcccattccagtg

SEQ ID NO: 15137 - DNA, 25 bp, Rattus norvegicus
aaatagtacttgaaactcagctgac

SEQ ID NO: 15138 - DNA, 25 bp, Rattus norvegicus
aaatagtacttgtaactcagctgac

SEQ ID NO: 15139 - DNA, 25 bp, Rattus norvegicus
aaatagtagactcattgcctaacat

SEQ ID NO: 15140 - DNA, 25 bp, Rattus norvegicus
aaatagtagactgattgcctaacat

SEQ ID NO: 15141 - DNA, 25 bp, Rattus norvegicus
aaatagtatctgctcctctcagcag

SEQ ID NO: 15142 - DNA, 25 bp, Rattus norvegicus
aaatagtatctggtcctctcagcag

SEQ ID NO: 15143 - DNA, 25 bp, Rattus norvegicus
aaatagtccaagctggccacagact

SEQ ID NO: 15144 - DNA, 25 bp, Rattus norvegicus
aaatagtccaaggtggccacagact

SEQ ID NO: 15145 - DNA, 25 bp, Rattus norvegicus
aaatagtccaggctgacgtctgcta

SEQ ID NO: 15146 - DNA, 25 bp, Rattus norvegicus
aaatagtccaggctgactgccttca

SEQ ID NO: 15147 - DNA, 25 bp, Rattus norvegicus
aaatagtccagggtgacgtctgcta

SEQ ID NO: 15148 - DNA, 25 bp, Rattus norvegicus
aaatagtccagggtgactgccttca

SEQ ID NO: 15149 - DNA, 25 bp, Rattus norvegicus
aaatagtctcttattctgcctcatg

SEQ ID NO: 15150 - DNA, 25 bp, Rattus norvegicus
aaatagtctctttttctgcctcatg

SEQ ID NO: 15151 - DNA, 25 bp, Rattus norvegicus
aaatagtctgctagctttttctgta

SEQ ID NO: 15152 - DNA, 25 bp, Rattus norvegicus
aaatagtctgcttgctttttctgta

SEQ ID NO: 15153 - DNA, 25 bp, Rattus norvegicus
aaatagtgcctgattcttagattac

SEQ ID NO: 15154 - DNA, 25 bp, Rattus norvegicus
aaatagtgcctgtttcttagattac

SEQ ID NO: 15155 - DNA, 25 bp, Rattus norvegicus
aaatagtgtaccctcttcttctcaa

SEQ ID NO: 15156 - DNA, 25 bp, Rattus norvegicus
aaatagtgtaccgtcttcttctcaa

SEQ ID NO: 15157 - DNA, 25 bp, Rattus norvegicus
aaatagtgtaggacccttcttgctt

SEQ ID NO: 15158 - DNA, 25 bp, Rattus norvegicus
aaatagtgtaggtcccttcttgctt

SEQ ID NO: 15159 - DNA, 25 bp, Rattus norvegicus
aaatagtgtattcctgtctggcttt

SEQ ID NO: 15160 - DNA, 25 bp, Rattus norvegicus
aaatagtgtattgctgtctggcttt

SEQ ID NO: 15161 - DNA, 25 bp, Rattus norvegicus
aaatagtgtcttactacctgtcaga

SEQ ID NO: 15162 - DNA, 25 bp, Rattus norvegicus
aaatagtgtctttctacctgtcaga

SEQ ID NO: 15163 - DNA, 25 bp, Rattus norvegicus
aaatagtgtgggacggttgctactt

SEQ ID NO: 15164 - DNA, 25 bp, Rattus norvegicus
aaatagtgtgggtcggttgctactt

SEQ ID NO: 15165 - DNA, 25 bp, Rattus norvegicus
aaatagtgtgtgagcgcgtcttctg

SEQ ID NO: 15166 - DNA, 25 bp, Rattus norvegicus
aaatagtgtgtgtgcgcgtcttctg

SEQ ID NO: 15167 - DNA, 25 bp, Rattus norvegicus
aaatagttcactcttgagcatttgc

SEQ ID NO: 15168 - DNA, 25 bp, Rattus norvegicus
aaatagttcactgttgagcatttgc

SEQ ID NO: 15169 - DNA, 25 bp, Rattus norvegicus
aaatagttccaaagagtcctgtttc

SEQ ID NO: 15170 - DNA, 25 bp, Rattus norvegicus
aaatagttccaatgagtcctgtttc

SEQ ID NO: 15171 - DNA, 25 bp, Rattus norvegicus
aaatagttccacattctgccttagg

SEQ ID NO: 15172 - DNA, 25 bp, Rattus norvegicus
aaatagttccactttctgccttagg

SEQ ID NO: 15173 - DNA, 25 bp, Rattus norvegicus
aaatagttctggaagcctgtttgac

SEQ ID NO: 15174 - DNA, 25 bp, Rattus norvegicus
aaatagttctggtagcctgtttgac

SEQ ID NO: 15175 - DNA, 25 bp, Rattus norvegicus
aaatagttgcctatgtagctcttca

SEQ ID NO: 15176 - DNA, 25 bp, Rattus norvegicus
aaatagttgcctttgtagctcttca

SEQ ID NO: 15177 - DNA, 25 bp, Rattus norvegicus
aaatagttgtcacttttccacctgg

SEQ ID NO: 15178 - DNA, 25 bp, Rattus norvegicus
aaatagttgtcagttttccacctgg

SEQ ID NO: 15179 - DNA, 25 bp, Rattus norvegicus
aaatagttgtgccagtcctcatcga

SEQ ID NO: 15180 - DNA, 25 bp, Rattus norvegicus
aaatagttgtgcgagtcctcatcga

SEQ ID NO: 15181 - DNA, 25 bp, Rattus norvegicus
aaatagttttgtcgtcctcctctgc

SEQ ID NO: 15182 - DNA, 25 bp, Rattus norvegicus
aaatagttttgtggtcctcctctgc

SEQ ID NO: 15183 - DNA, 25 bp, Rattus norvegicus
aaatataactttccccagatggctc

SEQ ID NO: 15184 - DNA, 25 bp, Rattus norvegicus
aaatataactttgcccagatggctc

SEQ ID NO: 15185 - DNA, 25 bp, Rattus norvegicus
aaatatacacatccactaaagcaag

SEQ ID NO: 15186 - DNA, 25 bp, Rattus norvegicus
aaatatacacatgcactaaagcaag

SEQ ID NO: 15187 - DNA, 25 bp, Rattus norvegicus
aaatatacgggacgcagaccaggct

SEQ ID NO: 15188 - DNA, 25 bp, Rattus norvegicus
aaatatacgggaggcagaccaggct

SEQ ID NO: 15189 - DNA, 25 bp, Rattus norvegicus
aaatatagacagacacccacaaggt

SEQ ID NO: 15190 - DNA, 25 bp, Rattus norvegicus
aaatatagacagtcacccacaaggt

SEQ ID NO: 15191 - DNA, 25 bp, Rattus norvegicus
aaatatagcctccattcttaggtgg

SEQ ID NO: 15192 - DNA, 25 bp, Rattus norvegicus
aaatatagcctcgattcttaggtgg

SEQ ID NO: 15193 - DNA, 25 bp, Rattus norvegicus
aaatatagccttacagtgctgtatt

SEQ ID NO: 15194 - DNA, 25 bp, Rattus norvegicus
aaatatagcctttcagtgctgtatt

SEQ ID NO: 15195 - DNA, 25 bp, Rattus norvegicus
aaatatagtaccatcaacaatccag

SEQ ID NO: 15196 - DNA, 25 bp, Rattus norvegicus
aaatatagtaccttcaacaatccag

SEQ ID NO: 15197 - DNA, 25 bp, Rattus norvegicus
aaatatagtcatctcccaggcttgt

SEQ ID NO: 15198 - DNA, 25 bp, Rattus norvegicus
aaatatagtcatgtcccaggcttgt

SEQ ID NO: 15199 - DNA, 25 bp, Rattus norvegicus
aaatatatacctccattcccttatc

SEQ ID NO: 15200 - DNA, 25 bp, Rattus norvegicus
aaatatatacctgcattcccttatc

SEQ ID NO: 15201 - DNA, 25 bp, Rattus norvegicus
aaatatatacgtcctcaccctgcag

SEQ ID NO: 15202 - DNA, 25 bp, Rattus norvegicus
aaatatatacgtgctcaccctgcag

SEQ ID NO: 15203 - DNA, 25 bp, Rattus norvegicus
aaatatatccagatcgcttgcagag

SEQ ID NO: 15204 - DNA, 25 bp, Rattus norvegicus
aaatatatccagttcgcttgcagag

SEQ ID NO: 15205 - DNA, 25 bp, Rattus norvegicus
aaatatatccatagcctttccggtt

SEQ ID NO: 15206 - DNA, 25 bp, Rattus norvegicus
aaatatatccattgcctttccggtt

SEQ ID NO: 15207 - DNA, 25 bp, Rattus norvegicus
aaatatattcacatgtagcccaggc

SEQ ID NO: 15208 - DNA, 25 bp, Rattus norvegicus
aaatatattcacttgtagcccaggc

SEQ ID NO: 15209 - DNA, 25 bp, Rattus norvegicus
aaatatattgccagcttctcagttg

SEQ ID NO: 15210 - DNA, 25 bp, Rattus norvegicus
aaatatattgcctgcttctcagttg

SEQ ID NO: 15211 - DNA, 25 bp, Rattus norvegicus
aaatatatttgtctctgcgtgtgta

SEQ ID NO: 15212 - DNA, 25 bp, Rattus norvegicus
aaatatatttgtgtctgcgtgtgta

SEQ ID NO: 15213 - DNA, 25 bp, Rattus norvegicus
aaatatcaaacactgctttctcctc

SEQ ID NO: 15214 - DNA, 25 bp, Rattus norvegicus
aaatatcaaacagtgctttctcctc

SEQ ID NO: 15215 - DNA, 25 bp, Rattus norvegicus
aaatatcaagctctattcctttccc

SEQ ID NO: 15216 - DNA, 25 bp, Rattus norvegicus
aaatatcaagctgtattcctttccc

SEQ ID NO: 15217 - DNA, 25 bp, Rattus norvegicus
aaatatcaatccctcgtttcttctg

SEQ ID NO: 15218 - DNA, 25 bp, Rattus norvegicus
aaatatcaatccgtcgtttcttctg

SEQ ID NO: 15219 - DNA, 25 bp, Rattus norvegicus
aaatatcaattgacttcctggttaa

SEQ ID NO: 15220 - DNA, 25 bp, Rattus norvegicus
aaatatcaattgtcttcctggttaa

SEQ ID NO: 15221 - DNA, 25 bp, Rattus norvegicus
aaatatcaccccagagattcttcca

SEQ ID NO: 15222 - DNA, 25 bp, Rattus norvegicus
aaatatcacccctgagattcttcca

SEQ ID NO: 15223 - DNA, 25 bp, Rattus norvegicus
aaatatcagtccaccaccagtctgg

SEQ ID NO: 15224 - DNA, 25 bp, Rattus norvegicus
aaatatcagtcctccaccagtctgg

SEQ ID NO: 15225 - DNA, 25 bp, Rattus norvegicus
aaatatcatgtgacccggcttaacg

SEQ ID NO: 15226 - DNA, 25 bp, Rattus norvegicus
aaatatcatgtgaccgggtttaaca

SEQ ID NO: 15227 - DNA, 25 bp, Rattus norvegicus
aaatatcatgtgtcccggcttaacg

SEQ ID NO: 15228 - DNA, 25 bp, Rattus norvegicus
aaatatcatgtgtccgggtttaaca

SEQ ID NO: 15229 - DNA, 25 bp, Rattus norvegicus
aaatatcattgaattcgaccaaaaa

SEQ ID NO: 15230 - DNA, 25 bp, Rattus norvegicus
aaatatcattgatttcgaccaaaaa

SEQ ID NO: 15231 - DNA, 25 bp, Rattus norvegicus
aaatatccaaccagtccgatacaac

SEQ ID NO: 15232 - DNA, 25 bp, Rattus norvegicus
aaatatccaacctgtccgatacaac

SEQ ID NO: 15233 - DNA, 25 bp, Rattus norvegicus
aaatatccagatccagtgaactgcc

SEQ ID NO: 15234 - DNA, 25 bp, Rattus norvegicus
aaatatccagatgcagtgaactgcc

SEQ ID NO: 15235 - DNA, 25 bp, Rattus norvegicus
aaatatccaggcaccatgacagtct

SEQ ID NO: 15236 - DNA, 25 bp, Rattus norvegicus
aaatatccaggctccatgacagtct

SEQ ID NO: 15237 - DNA, 25 bp, Rattus norvegicus
aaatatcccattatccaagccaagc

SEQ ID NO: 15238 - DNA, 25 bp, Rattus norvegicus
aaatatcccattttccaagccaagc

SEQ ID NO: 15239 - DNA, 25 bp, Rattus norvegicus
aaatatccggtaagtgactcctgtg

SEQ ID NO: 15240 - DNA, 25 bp, Rattus norvegicus
aaatatccggtatgtgactcctgtg

SEQ ID NO: 15241 - DNA, 25 bp, Rattus norvegicus
aaatatcctcaaaccctttcacagg

SEQ ID NO: 15242 - DNA, 25 bp, Rattus norvegicus
aaatatcctcaatccctttcacagg

SEQ ID NO: 15243 - DNA, 25 bp, Rattus norvegicus
aaatatcctgacactgaggtctggt

SEQ ID NO: 15244 - DNA, 25 bp, Rattus norvegicus
aaatatcctgacatcaagggtccta

SEQ ID NO: 15245 - DNA, 25 bp, Rattus norvegicus
aaatatcctgactctgaggtctggt

SEQ ID NO: 15246 - DNA, 25 bp, Rattus norvegicus
aaatatcctgacttcaagggtccta

SEQ ID NO: 15247 - DNA, 25 bp, Rattus norvegicus
aaatatcgaccaagctctaaggaca

SEQ ID NO: 15248 - DNA, 25 bp, Rattus norvegicus
aaatatcgaccatgctctaaggaca

SEQ ID NO: 15249 - DNA, 25 bp, Rattus norvegicus
aaatatcggcggcatcttcattgtt

SEQ ID NO: 15250 - DNA, 25 bp, Rattus norvegicus
aaatatcggcgggatcttcattgtt

SEQ ID NO: 15251 - DNA, 25 bp, Rattus norvegicus
aaatatcgtggtacccggctcgcag

SEQ ID NO: 15252 - DNA, 25 bp, Rattus norvegicus
aaatatcgtggttcccggctcgcag

SEQ ID NO: 15253 - DNA, 25 bp, Rattus norvegicus
aaatatctatctctttgtcctccgt

SEQ ID NO: 15254 - DNA, 25 bp, Rattus norvegicus
aaatatctatctgtttgtcctccgt

SEQ ID NO: 15255 - DNA, 25 bp, Rattus norvegicus
aaatatctatggactcatcgctccc

SEQ ID NO: 15256 - DNA, 25 bp, Rattus norvegicus
aaatatctatggtctcatcgctccc

SEQ ID NO: 15257 - DNA, 25 bp, Rattus norvegicus
aaatatctcctcctctgtgatcaac

SEQ ID NO: 15258 - DNA, 25 bp, Rattus norvegicus
aaatatctcctcgtctgtgatcaac

SEQ ID NO: 15259 - DNA, 25 bp, Rattus norvegicus
aaatatctctacatgttgctgttta

SEQ ID NO: 15260 - DNA, 25 bp, Rattus norvegicus
aaatatctctacttgttgctgttta

SEQ ID NO: 15261 - DNA, 25 bp, Rattus norvegicus
aaatatctgataacggatccctgtg

SEQ ID NO: 15262 - DNA, 25 bp, Rattus norvegicus
aaatatctgatatcggatccctgtg

SEQ ID NO: 15263 - DNA, 25 bp, Rattus norvegicus
aaatatctggtcattgatgactgga

SEQ ID NO: 15264 - DNA, 25 bp, Rattus norvegicus
aaatatctggtctttgatgactgga

SEQ ID NO: 15265 - DNA, 25 bp, Rattus norvegicus
aaatatctgtatacaccaagcccca

SEQ ID NO: 15266 - DNA, 25 bp, Rattus norvegicus
aaatatctgtattcaccaagcccca

SEQ ID NO: 15267 - DNA, 25 bp, Rattus norvegicus
aaatatcttcagactctcttcaatc

SEQ ID NO: 15268 - DNA, 25 bp, Rattus norvegicus
aaatatcttcagtctctcttcaatc

SEQ ID NO: 15269 - DNA, 25 bp, Rattus norvegicus
aaatatcttctgatacaaacaggaa

SEQ ID NO: 15270 - DNA, 25 bp, Rattus norvegicus
aaatatcttctgttacaaacaggaa

SEQ ID NO: 15271 - DNA, 25 bp, Rattus norvegicus
aaatatcttgtccttcatctgaatg

SEQ ID NO: 15272 - DNA, 25 bp, Rattus norvegicus
aaatatcttgtcgttcatctgaatg

SEQ ID NO: 15273 - DNA, 25 bp, Rattus norvegicus
aaatatctttatagccacctgctcc

SEQ ID NO: 15274 - DNA, 25 bp, Rattus norvegicus
aaatatctttatattcctcaaagag

SEQ ID NO: 15275 - DNA, 25 bp, Rattus norvegicus
aaatatctttattgccacctgctcc

SEQ ID NO: 15276 - DNA, 25 bp, Rattus norvegicus
aaatatctttattttcctcaaagag

SEQ ID NO: 15277 - DNA, 25 bp, Rattus norvegicus
aaatatgatcacatctgaacctgct

SEQ ID NO: 15278 - DNA, 25 bp, Rattus norvegicus
aaatatgatcacttctgaacctgct

SEQ ID NO: 15279 - DNA, 25 bp, Rattus norvegicus
aaatatgatcctcctctcaagtgaa

SEQ ID NO: 15280 - DNA, 25 bp, Rattus norvegicus
aaatatgatcctgctctcaagtgaa

SEQ ID NO: 15281 - DNA, 25 bp, Rattus norvegicus
aaatatgattctcatcgtcacccca

SEQ ID NO: 15282 - DNA, 25 bp, Rattus norvegicus
aaatatgattctgatcgtcacccca

SEQ ID NO: 15283 - DNA, 25 bp, Rattus norvegicus
aaatatgcaaacactacccatcctc

SEQ ID NO: 15284 - DNA, 25 bp, Rattus norvegicus
aaatatgcaaactctacccatcctc

SEQ ID NO: 15285 - DNA, 25 bp, Rattus norvegicus
aaatatgccacacttgcctcaacat

SEQ ID NO: 15286 - DNA, 25 bp, Rattus norvegicus
aaatatgccacagttgcctcaacat

SEQ ID NO: 15287 - DNA, 25 bp, Rattus norvegicus
aaatatgccattctctttcagctgt

SEQ ID NO: 15288 - DNA, 25 bp, Rattus norvegicus
aaatatgccattgtctttcagctgt

SEQ ID NO: 15289 - DNA, 25 bp, Rattus norvegicus
aaatatgcggcactgaactaggatt

SEQ ID NO: 15290 - DNA, 25 bp, Rattus norvegicus
aaatatgcggcagtgaactaggatt

SEQ ID NO: 15291 - DNA, 25 bp, Rattus norvegicus
aaatatgctagacccatttcaccaa

SEQ ID NO: 15292 - DNA, 25 bp, Rattus norvegicus
aaatatgctagagccatttcaccaa

SEQ ID NO: 15293 - DNA, 25 bp, Rattus norvegicus
aaatatgctcaccatgcaactgcat

SEQ ID NO: 15294 - DNA, 25 bp, Rattus norvegicus
aaatatgctcacgatgcaactgcat

SEQ ID NO: 15295 - DNA, 25 bp, Rattus norvegicus
aaatatgctcgtattctctttccag

SEQ ID NO: 15296 - DNA, 25 bp, Rattus norvegicus
aaatatgctcgttttctctttccag

SEQ ID NO: 15297 - DNA, 25 bp, Rattus norvegicus
aaatatgctctcaagagtcctctag

SEQ ID NO: 15298 - DNA, 25 bp, Rattus norvegicus
aaatatgctctctagagtcctctag

SEQ ID NO: 15299 - DNA, 25 bp, Rattus norvegicus
aaatatgctctgactggtacagcgt

SEQ ID NO: 15300 - DNA, 25 bp, Rattus norvegicus
aaatatgctctgtctggtacagcgt

SEQ ID NO: 15301 - DNA, 25 bp, Rattus norvegicus
aaatatgctgcgaaggtcaaaccca

SEQ ID NO: 15302 - DNA, 25 bp, Rattus norvegicus
aaatatgctgcgtaggtcaaaccca

SEQ ID NO: 15303 - DNA, 25 bp, Rattus norvegicus
aaatatgctgtgcaacgtcccttca

SEQ ID NO: 15304 - DNA, 25 bp, Rattus norvegicus
aaatatgctgtggaacgtcccttca

SEQ ID NO: 15305 - DNA, 25 bp, Rattus norvegicus
aaatatgcttttactggtcccaagt

SEQ ID NO: 15306 - DNA, 25 bp, Rattus norvegicus
aaatatgctttttctggtcccaagt

SEQ ID NO: 15307 - DNA, 25 bp, Rattus norvegicus
aaatatggaagcaccttggttgcat

SEQ ID NO: 15308 - DNA, 25 bp, Rattus norvegicus
aaatatggaagctccttggttgcat

SEQ ID NO: 15309 - DNA, 25 bp, Rattus norvegicus
aaatatggccacaacatctgtccac

SEQ ID NO: 15310 - DNA, 25 bp, Rattus norvegicus
aaatatggccactacatctgtccac

SEQ ID NO: 15311 - DNA, 25 bp, Rattus norvegicus
aaatatggcctcacaggtacaccac

SEQ ID NO: 15312 - DNA, 25 bp, Rattus norvegicus
aaatatggcctctcaggtacaccac

SEQ ID NO: 15313 - DNA, 25 bp, Rattus norvegicus
aaatatggctgtcttgctgctcaag

SEQ ID NO: 15314 - DNA, 25 bp, Rattus norvegicus
aaatatggctgtgttgctgctcaag

SEQ ID NO: 15315 - DNA, 25 bp, Rattus norvegicus
aaatatgggcctaatccgatctgaa

SEQ ID NO: 15316 - DNA, 25 bp, Rattus norvegicus
aaatatgggccttatccgatctgaa

SEQ ID NO: 15317 - DNA, 25 bp, Rattus norvegicus
aaatatggtaccctcatctacacta

SEQ ID NO: 15318 - DNA, 25 bp, Rattus norvegicus
aaatatggtaccgtcatctacacta

SEQ ID NO: 15319 - DNA, 25 bp, Rattus norvegicus
aaatatggtctcatctcttctctac

SEQ ID NO: 15320 - DNA, 25 bp, Rattus norvegicus
aaatatggtctcttctcttctctac

SEQ ID NO: 15321 - DNA, 25 bp, Rattus norvegicus
aaatatggtttgactcttccaagag

SEQ ID NO: 15322 - DNA, 25 bp, Rattus norvegicus
aaatatggtttgtctcttccaagag

SEQ ID NO: 15323 - DNA, 25 bp, Rattus norvegicus
aaatatgtacttatccttggagctt

SEQ ID NO: 15324 - DNA, 25 bp, Rattus norvegicus
aaatatgtacttttccttggagctt

SEQ ID NO: 15325 - DNA, 25 bp, Rattus norvegicus
aaatatgtattcctcaatgatctta

SEQ ID NO: 15326 - DNA, 25 bp, Rattus norvegicus
aaatatgtattcgtcaatgatctta

SEQ ID NO: 15327 - DNA, 25 bp, Rattus norvegicus
aaatatgtcaggctcttggagtaag

SEQ ID NO: 15328 - DNA, 25 bp, Rattus norvegicus
aaatatgtcagggtcttggagtaag

SEQ ID NO: 15329 - DNA, 25 bp, Rattus norvegicus
aaatatgtccttatgagttttgctt

SEQ ID NO: 15330 - DNA, 25 bp, Rattus norvegicus
aaatatgtccttttgagttttgctt

SEQ ID NO: 15331 - DNA, 25 bp, Rattus norvegicus
aaatatgtctaaagtccatcagtgt

SEQ ID NO: 15332 - DNA, 25 bp, Rattus norvegicus
aaatatgtctaatgtccatcagtgt

SEQ ID NO: 15333 - DNA, 25 bp, Rattus norvegicus
aaatatgtcttcactcctgatggaa

SEQ ID NO: 15334 - DNA, 25 bp, Rattus norvegicus
aaatatgtcttctctcctgatggaa

SEQ ID NO: 15335 - DNA, 25 bp, Rattus norvegicus
aaatatgtgttcagggtctgaactc

SEQ ID NO: 15336 - DNA, 25 bp, Rattus norvegicus
aaatatgtgttctgggtctgaactc

SEQ ID NO: 15337 - DNA, 25 bp, Rattus norvegicus
aaatatgttagacccacctttctgt

SEQ ID NO: 15338 - DNA, 25 bp, Rattus norvegicus
aaatatgttagagccacctttctgt

SEQ ID NO: 15339 - DNA, 25 bp, Rattus norvegicus
aaatatgttcgcactccagcaactg

SEQ ID NO: 15340 - DNA, 25 bp, Rattus norvegicus
aaatatgttcgctctccagcaactg

SEQ ID NO: 15341 - DNA, 25 bp, Rattus norvegicus
aaatatgttttcagcctgaggtact

SEQ ID NO: 15342 - DNA, 25 bp, Rattus norvegicus
aaatatgttttctgcctgaggtact

SEQ ID NO: 15343 - DNA, 25 bp, Rattus norvegicus
aaatattacatcatcctggcacata

SEQ ID NO: 15344 - DNA, 25 bp, Rattus norvegicus
aaatattacatcttcctggcacata

SEQ ID NO: 15345 - DNA, 25 bp, Rattus norvegicus
aaatattactccagctttgaaagct

SEQ ID NO: 15346 - DNA, 25 bp, Rattus norvegicus
aaatattactcctgctttgaaagct

SEQ ID NO: 15347 - DNA, 25 bp, Rattus norvegicus
aaatattaggaaactctgggtgctt

SEQ ID NO: 15348 - DNA, 25 bp, Rattus norvegicus
aaatattaggaatctctgggtgctt

SEQ ID NO: 15349 - DNA, 25 bp, Rattus norvegicus
aaatattatgctctccctgtggtag

SEQ ID NO: 15350 - DNA, 25 bp, Rattus norvegicus
aaatattatgctgtccctgtggtag

SEQ ID NO: 15351 - DNA, 25 bp, Rattus norvegicus
aaatattcaaatccccgagaccatg

SEQ ID NO: 15352 - DNA, 25 bp, Rattus norvegicus
aaatattcaaatgcccgagaccatg

SEQ ID NO: 15353 - DNA, 25 bp, Rattus norvegicus
aaatattcaagacccagctcaagca

SEQ ID NO: 15354 - DNA, 25 bp, Rattus norvegicus
aaatattcaagagccagctcaagca

SEQ ID NO: 15355 - DNA, 25 bp, Rattus norvegicus
aaatattcacaccaagcatggattt

SEQ ID NO: 15356 - DNA, 25 bp, Rattus norvegicus
aaatattcacacgaagcatggattt

SEQ ID NO: 15357 - DNA, 25 bp, Rattus norvegicus
aaatattcaggccactgtccttgca

SEQ ID NO: 15358 - DNA, 25 bp, Rattus norvegicus
aaatattcaggcgactgtccttgca

SEQ ID NO: 15359 - DNA, 25 bp, Rattus norvegicus
aaatattcatacactcctcttcaca

SEQ ID NO: 15360 - DNA, 25 bp, Rattus norvegicus
aaatattcatactctcctcttcaca

SEQ ID NO: 15361 - DNA, 25 bp, Rattus norvegicus
aaatattcatgcctgtccaacactt

SEQ ID NO: 15362 - DNA, 25 bp, Rattus norvegicus
aaatattcatgcgtgtccaacactt

SEQ ID NO: 15363 - DNA, 25 bp, Rattus norvegicus
aaatattcccatatctggagcacag

SEQ ID NO: 15364 - DNA, 25 bp, Rattus norvegicus
aaatattcccatttctggagcacag

SEQ ID NO: 15365 - DNA, 25 bp, Rattus norvegicus
aaatattcctacagccattctctaa

SEQ ID NO: 15366 - DNA, 25 bp, Rattus norvegicus
aaatattcctactgccattctctaa

SEQ ID NO: 15367 - DNA, 25 bp, Rattus norvegicus
aaatattcggccatactgggctgtt

SEQ ID NO: 15368 - DNA, 25 bp, Rattus norvegicus
aaatattcggccttactgggctgtt

SEQ ID NO: 15369 - DNA, 25 bp, Rattus norvegicus
aaatattctctcagtagccgtggac

SEQ ID NO: 15370 - DNA, 25 bp, Rattus norvegicus
aaatattctctctgtagccgtggac

SEQ ID NO: 15371 - DNA, 25 bp, Rattus norvegicus
aaatattctgatactcccgggaggt

SEQ ID NO: 15372 - DNA, 25 bp, Rattus norvegicus
aaatattctgattctcccgggaggt

SEQ ID NO: 15373 - DNA, 25 bp, Rattus norvegicus
aaatattctgtcaggatcggcggct

SEQ ID NO: 15374 - DNA, 25 bp, Rattus norvegicus
aaatattctgtctggatcggcggct

SEQ ID NO: 15375 - DNA, 25 bp, Rattus norvegicus
aaatattcttttacctaactctcag

SEQ ID NO: 15376 - DNA, 25 bp, Rattus norvegicus
aaatattctttttcctaactctcag

SEQ ID NO: 15377 - DNA, 25 bp, Rattus norvegicus
aaatattgaactctttcataactgg

SEQ ID NO: 15378 - DNA, 25 bp, Rattus norvegicus
aaatattgaactgtttcataactgg

SEQ ID NO: 15379 - DNA, 25 bp, Rattus norvegicus
aaatattgacctacttctaactggg

SEQ ID NO: 15380 - DNA, 25 bp, Rattus norvegicus
aaatattgaccttcttctaactggg

SEQ ID NO: 15381 - DNA, 25 bp, Rattus norvegicus
aaatattgctggagaatttctgtaa

SEQ ID NO: 15382 - DNA, 25 bp, Rattus norvegicus
aaatattgctggtgaatttctgtaa

SEQ ID NO: 15383 - DNA, 25 bp, Rattus norvegicus
aaatattgcttgacagatccttcca

SEQ ID NO: 15384 - DNA, 25 bp, Rattus norvegicus
aaatattgcttgtcagatccttcca

SEQ ID NO: 15385 - DNA, 25 bp, Rattus norvegicus
aaatattgtattcctgtccttgggt

SEQ ID NO: 15386 - DNA, 25 bp, Rattus norvegicus
aaatattgtattgctgtccttgggt

SEQ ID NO: 15387 - DNA, 25 bp, Rattus norvegicus
aaatattgttagatgctggttctca

SEQ ID NO: 15388 - DNA, 25 bp, Rattus norvegicus
aaatattgttagttgctggttctca

SEQ ID NO: 15389 - DNA, 25 bp, Rattus norvegicus
aaatatttcactcggcttcactgtt

SEQ ID NO: 15390 - DNA, 25 bp, Rattus norvegicus
aaatatttcactgggcttcactgtt

SEQ ID NO: 15391 - DNA, 25 bp, Rattus norvegicus
aaatatttcatgctgttccgggaca

SEQ ID NO: 15392 - DNA, 25 bp, Rattus norvegicus
aaatatttcatggtgttccgggaca

SEQ ID NO: 15393 - DNA, 25 bp, Rattus norvegicus
aaatatttcctaagttcttatcaca

SEQ ID NO: 15394 - DNA, 25 bp, Rattus norvegicus
aaatatttcctatgttcttatcaca

SEQ ID NO: 15395 - DNA, 25 bp, Rattus norvegicus
aaatatttctcgacagtaccctttg

SEQ ID NO: 15396 - DNA, 25 bp, Rattus norvegicus
aaatatttctcgtcagtaccctttg

SEQ ID NO: 15397 - DNA, 25 bp, Rattus norvegicus
aaatatttctttcttcactgacttt

SEQ ID NO: 15398 - DNA, 25 bp, Rattus norvegicus
aaatatttctttgttcactgacttt

SEQ ID NO: 15399 - DNA, 25 bp, Rattus norvegicus
aaatatttggttcacttcaacaaga

SEQ ID NO: 15400 - DNA, 25 bp, Rattus norvegicus
aaatatttggttgacttcaacaaga

SEQ ID NO: 15401 - DNA, 25 bp, Rattus norvegicus
aaatatttgtgcctccatgctccat

SEQ ID NO: 15402 - DNA, 25 bp, Rattus norvegicus
aaatatttgtgcgtccatgctccat

SEQ ID NO: 15403 - DNA, 25 bp, Rattus norvegicus
aaatatttgtgtacacctcctctga

SEQ ID NO: 15404 - DNA, 25 bp, Rattus norvegicus
aaatatttgtgttcacctcctctga

SEQ ID NO: 15405 - DNA, 25 bp, Rattus norvegicus
aaatattttccaacgcaagtcctgc

SEQ ID NO: 15406 - DNA, 25 bp, Rattus norvegicus
aaatattttccatcgcaagtcctgc

SEQ ID NO: 15407 - DNA, 25 bp, Rattus norvegicus
aaatcaaaaggcaccagcacccgat

SEQ ID NO: 15408 - DNA, 25 bp, Rattus norvegicus
aaatcaaaaggctccagcacccgat

SEQ ID NO: 15409 - DNA, 25 bp, Rattus norvegicus
aaatcaaaccttaatcggcatcaga

SEQ ID NO: 15410 - DNA, 25 bp, Rattus norvegicus
aaatcaaacctttatcggcatcaga

SEQ ID NO: 15411 - DNA, 25 bp, Rattus norvegicus
aaatcaaagcccaaatcactccagt

SEQ ID NO: 15412 - DNA, 25 bp, Rattus norvegicus
aaatcaaagccctaatcactccagt

SEQ ID NO: 15413 - DNA, 25 bp, Rattus norvegicus
aaatcaaagctgaccacaggcccct

SEQ ID NO: 15414 - DNA, 25 bp, Rattus norvegicus
aaatcaaagctgtccacaggcccct

SEQ ID NO: 15415 - DNA, 25 bp, Rattus norvegicus
aaatcaaagtagacccacatgcaaa

SEQ ID NO: 15416 - DNA, 25 bp, Rattus norvegicus
aaatcaaagtagtcccacatgcaaa

SEQ ID NO: 15417 - DNA, 25 bp, Rattus norvegicus
aaatcaaagtttcttctatggctta

SEQ ID NO: 15418 - DNA, 25 bp, Rattus norvegicus
aaatcaaagtttgttctatggctta

SEQ ID NO: 15419 - DNA, 25 bp, Rattus norvegicus
aaatcaaatcttaccttccatcttc

SEQ ID NO: 15420 - DNA, 25 bp, Rattus norvegicus
aaatcaaatcttcctgcgatcagag

SEQ ID NO: 15421 - DNA, 25 bp, Rattus norvegicus
aaatcaaatcttgctgcgatcagag

SEQ ID NO: 15422 - DNA, 25 bp, Rattus norvegicus
aaatcaaatctttccttccatcttc

SEQ ID NO: 15423 - DNA, 25 bp, Rattus norvegicus
aaatcaacaatgacagcgccatgct

SEQ ID NO: 15424 - DNA, 25 bp, Rattus norvegicus
aaatcaacaatgtcagcgccatgct

SEQ ID NO: 15425 - DNA, 25 bp, Rattus norvegicus
aaatcaacagtcaccatggacagag

SEQ ID NO: 15426 - DNA, 25 bp, Rattus norvegicus
aaatcaacagtctccatggacagag

SEQ ID NO: 15427 - DNA, 25 bp, Rattus norvegicus
aaatcaaccaggacaatgaccaagg

SEQ ID NO: 15428 - DNA, 25 bp, Rattus norvegicus
aaatcaaccaggtcaatgaccaagg

SEQ ID NO: 15429 - DNA, 25 bp, Rattus norvegicus
aaatcaactctgctgtagctccact

SEQ ID NO: 15430 - DNA, 25 bp, Rattus norvegicus
aaatcaactctggtgtagctccact

SEQ ID NO: 15431 - DNA, 25 bp, Rattus norvegicus
aaatcaactggtattctggaagcat

SEQ ID NO: 15432 - DNA, 25 bp, Rattus norvegicus
aaatcaactggttttctggaagcat

SEQ ID NO: 15433 - DNA, 25 bp, Rattus norvegicus
aaatcaacttgccatttcaactgaa

SEQ ID NO: 15434 - DNA, 25 bp, Rattus norvegicus
aaatcaacttgcgatttcaactgaa

SEQ ID NO: 15435 - DNA, 25 bp, Rattus norvegicus
aaatcaagccagctcagctcagagc

SEQ ID NO: 15436 - DNA, 25 bp, Rattus norvegicus
aaatcaagccaggtcagctcagagc

SEQ ID NO: 15437 - DNA, 25 bp, Rattus norvegicus
aaatcaagcctcaggatgggtcatt

SEQ ID NO: 15438 - DNA, 25 bp, Rattus norvegicus
aaatcaagcctctggatgggtcatt

SEQ ID NO: 15439 - DNA, 25 bp, Rattus norvegicus
aaatcaagcctgacacattgccgac

SEQ ID NO: 15440 - DNA, 25 bp, Rattus norvegicus
aaatcaagcctgtcacattgccgac

SEQ ID NO: 15441 - DNA, 25 bp, Rattus norvegicus
aaatcaagcgttctcgactgccaca

SEQ ID NO: 15442 - DNA, 25 bp, Rattus norvegicus
aaatcaagcgttgtcgactgccaca

SEQ ID NO: 15443 - DNA, 25 bp, Rattus norvegicus
aaatcaagtctgctgcttcgctttg

SEQ ID NO: 15444 - DNA, 25 bp, Rattus norvegicus
aaatcaagtctggtgcttcgctttg

SEQ ID NO: 15445 - DNA, 25 bp, Rattus norvegicus
aaatcaatccctcccgtacttattt

SEQ ID NO: 15446 - DNA, 25 bp, Rattus norvegicus
aaatcaatccctgccgtacttattt

SEQ ID NO: 15447 - DNA, 25 bp, Rattus norvegicus
aaatcaatctggcagttcctcagga

SEQ ID NO: 15448 - DNA, 25 bp, Rattus norvegicus
aaatcaatctgggagttcctcagga

SEQ ID NO: 15449 - DNA, 25 bp, Rattus norvegicus
aaatcaatgaatcgtggcttacact

SEQ ID NO: 15450 - DNA, 25 bp, Rattus norvegicus
aaatcaatgaatggtggcttacact

SEQ ID NO: 15451 - DNA, 25 bp, Rattus norvegicus
aaatcaatgcctcttttgcacccag

SEQ ID NO: 15452 - DNA, 25 bp, Rattus norvegicus
aaatcaatgcctgttttgcacccag

SEQ ID NO: 15453 - DNA, 25 bp, Rattus norvegicus
aaatcaatgctgagcctcaaggctg

SEQ ID NO: 15454 - DNA, 25 bp, Rattus norvegicus
aaatcaatgctgtgcctcaaggctg

SEQ ID NO: 15455 - DNA, 25 bp, Rattus norvegicus
aaatcaatggctatccttactctct

SEQ ID NO: 15456 - DNA, 25 bp, Rattus norvegicus
aaatcaatggctttccttactctct

SEQ ID NO: 15457 - DNA, 25 bp, Rattus norvegicus
aaatcaattgacagctgacaacttt

SEQ ID NO: 15458 - DNA, 25 bp, Rattus norvegicus
aaatcaattgactgctgacaacttt

SEQ ID NO: 15459 - DNA, 25 bp, Rattus norvegicus
aaatcacaaattaccaccatccgtt

SEQ ID NO: 15460 - DNA, 25 bp, Rattus norvegicus
aaatcacaaattattggcagtgttt

SEQ ID NO: 15461 - DNA, 25 bp, Rattus norvegicus
aaatcacaaatttccaccatccgtt

SEQ ID NO: 15462 - DNA, 25 bp, Rattus norvegicus
aaatcacaaatttttggcagtgttt

SEQ ID NO: 15463 - DNA, 25 bp, Rattus norvegicus
aaatcacaactcattgcttcttgcc

SEQ ID NO: 15464 - DNA, 25 bp, Rattus norvegicus
aaatcacaactctttgcttcttgcc

SEQ ID NO: 15465 - DNA, 25 bp, Rattus norvegicus
aaatcacaccagagcctagagatgg

SEQ ID NO: 15466 - DNA, 25 bp, Rattus norvegicus
aaatcacaccagtgcctagagatgg

SEQ ID NO: 15467 - DNA, 25 bp, Rattus norvegicus
aaatcacacggtaccaaagctgtaa

SEQ ID NO: 15468 - DNA, 25 bp, Rattus norvegicus
aaatcacacggttccaaagctgtaa

SEQ ID NO: 15469 - DNA, 25 bp, Rattus norvegicus
aaatcacatattagagttacattac

SEQ ID NO: 15470 - DNA, 25 bp, Rattus norvegicus
aaatcacatatttgagttacattac

SEQ ID NO: 15471 - DNA, 25 bp, Rattus norvegicus
aaatcacatgccctgggattatccc

SEQ ID NO: 15472 - DNA, 25 bp, Rattus norvegicus
aaatcacatgccgtgggattatccc

SEQ ID NO: 15473 - DNA, 25 bp, Rattus norvegicus
aaatcacattaactacctccacaga

SEQ ID NO: 15474 - DNA, 25 bp, Rattus norvegicus
aaatcacattaagtacctccacaga

SEQ ID NO: 15475 - DNA, 25 bp, Rattus norvegicus
aaatcaccacttatgcaagcttttt

SEQ ID NO: 15476 - DNA, 25 bp, Rattus norvegicus
aaatcaccacttttgcaagcttttt

SEQ ID NO: 15477 - DNA, 25 bp, Rattus norvegicus
aaatcaccagctacattatccaggg

SEQ ID NO: 15478 - DNA, 25 bp, Rattus norvegicus
aaatcaccagctatgcattggagaa

SEQ ID NO: 15479 - DNA, 25 bp, Rattus norvegicus
aaatcaccagcttcattatccaggg

SEQ ID NO: 15480 - DNA, 25 bp, Rattus norvegicus
aaatcaccagctttgcattggagaa

SEQ ID NO: 15481 - DNA, 25 bp, Rattus norvegicus
aaatcaccatgtagccctcctaaat

SEQ ID NO: 15482 - DNA, 25 bp, Rattus norvegicus
aaatcaccatgttgccctcctaaat

SEQ ID NO: 15483 - DNA, 25 bp, Rattus norvegicus
aaatcacccaatatttagcaccagg

SEQ ID NO: 15484 - DNA, 25 bp, Rattus norvegicus
aaatcacccaatttttagcaccagg

SEQ ID NO: 15485 - DNA, 25 bp, Rattus norvegicus
aaatcaccccagatgacaggaaagt

SEQ ID NO: 15486 - DNA, 25 bp, Rattus norvegicus
aaatcaccccagttgacaggaaagt

SEQ ID NO: 15487 - DNA, 25 bp, Rattus norvegicus
aaatcaccctggacacctcgtcaag

SEQ ID NO: 15488 - DNA, 25 bp, Rattus norvegicus
aaatcaccctggtcacctcgtcaag

SEQ ID NO: 15489 - DNA, 25 bp, Rattus norvegicus
aaatcacccttgcacctgaacatac

SEQ ID NO: 15490 - DNA, 25 bp, Rattus norvegicus
aaatcacccttggacctgaacatac

SEQ ID NO: 15491 - DNA, 25 bp, Rattus norvegicus
aaatcaccctttctgctggataaga

SEQ ID NO: 15492 - DNA, 25 bp, Rattus norvegicus
aaatcaccctttgtgctggataaga

SEQ ID NO: 15493 - DNA, 25 bp, Rattus norvegicus
aaatcaccgacaacttactcacaag

SEQ ID NO: 15494 - DNA, 25 bp, Rattus norvegicus
aaatcaccgacatcttactcacaag

SEQ ID NO: 15495 - DNA, 25 bp, Rattus norvegicus
aaatcaccgcttcagttagaccagg

SEQ ID NO: 15496 - DNA, 25 bp, Rattus norvegicus
aaatcaccgcttgagttagaccagg

SEQ ID NO: 15497 - DNA, 25 bp, Rattus norvegicus
aaatcacctctcctttgctgttttg

SEQ ID NO: 15498 - DNA, 25 bp, Rattus norvegicus
aaatcacctctcgtttgctgttttg

SEQ ID NO: 15499 - DNA, 25 bp, Rattus norvegicus
aaatcacctctgcagggcacgtgac

SEQ ID NO: 15500 - DNA, 25 bp, Rattus norvegicus
aaatcacctctggagggcacgtgac

SEQ ID NO: 15501 - DNA, 25 bp, Rattus norvegicus
aaatcacctggaagacgagcctctg

SEQ ID NO: 15502 - DNA, 25 bp, Rattus norvegicus
aaatcacctggatgacgagcctctg

SEQ ID NO: 15503 - DNA, 25 bp, Rattus norvegicus
aaatcacgatctagggacctgcctg

SEQ ID NO: 15504 - DNA, 25 bp, Rattus norvegicus
aaatcacgatcttgggacctgcctg

SEQ ID NO: 15505 - DNA, 25 bp, Rattus norvegicus
aaatcacgctgaagcccgggcactg

SEQ ID NO: 15506 - DNA, 25 bp, Rattus norvegicus
aaatcacgctgatgcccgggcactg

SEQ ID NO: 15507 - DNA, 25 bp, Rattus norvegicus
aaatcacggaggcagacagtgtata

SEQ ID NO: 15508 - DNA, 25 bp, Rattus norvegicus
aaatcacggagggagacagtgtata

SEQ ID NO: 15509 - DNA, 25 bp, Rattus norvegicus
aaatcactaaacactttgcatgctg

SEQ ID NO: 15510 - DNA, 25 bp, Rattus norvegicus
aaatcactaaactctttgcatgctg

SEQ ID NO: 15511 - DNA, 25 bp, Rattus norvegicus
aaatcactcacacccacaaagtctt

SEQ ID NO: 15512 - DNA, 25 bp, Rattus norvegicus
aaatcactcacagccacaaagtctt

SEQ ID NO: 15513 - DNA, 25 bp, Rattus norvegicus
aaatcactcagactgtctcttctca

SEQ ID NO: 15514 - DNA, 25 bp, Rattus norvegicus
aaatcactcagagtgtctcttctca

SEQ ID NO: 15515 - DNA, 25 bp, Rattus norvegicus
aaatcactctatcagacgcttgtct

SEQ ID NO: 15516 - DNA, 25 bp, Rattus norvegicus
aaatcactctatgagacgcttgtct

SEQ ID NO: 15517 - DNA, 25 bp, Rattus norvegicus
aaatcactgctgaactttggttctt

SEQ ID NO: 15518 - DNA, 25 bp, Rattus norvegicus
aaatcactgctgtactttggttctt

SEQ ID NO: 15519 - DNA, 25 bp, Rattus norvegicus
aaatcactggatacctttgagcatc

SEQ ID NO: 15520 - DNA, 25 bp, Rattus norvegicus
aaatcactggatcatggcggcagca

SEQ ID NO: 15521 - DNA, 25 bp, Rattus norvegicus
aaatcactggatgatggcggcagca

SEQ ID NO: 15522 - DNA, 25 bp, Rattus norvegicus
aaatcactggattcctttgagcatc

SEQ ID NO: 15523 - DNA, 25 bp, Rattus norvegicus
aaatcactggtcacatgggcctgca

SEQ ID NO: 15524 - DNA, 25 bp, Rattus norvegicus
aaatcactggtctcatgggcctgca

SEQ ID NO: 15525 - DNA, 25 bp, Rattus norvegicus
aaatcactgtaacctctttactaat

SEQ ID NO: 15526 - DNA, 25 bp, Rattus norvegicus
aaatcactgtaagctctttactaat

SEQ ID NO: 15527 - DNA, 25 bp, Rattus norvegicus
aaatcactgtcaatttctagggcag

SEQ ID NO: 15528 - DNA, 25 bp, Rattus norvegicus
aaatcactgtcattttctagggcag

SEQ ID NO: 15529 - DNA, 25 bp, Rattus norvegicus
aaatcacttctccttggtctggaaa

SEQ ID NO: 15530 - DNA, 25 bp, Rattus norvegicus
aaatcacttctcgttggtctggaaa

SEQ ID NO: 15531 - DNA, 25 bp, Rattus norvegicus
aaatcacttgctccttttggagagg

SEQ ID NO: 15532 - DNA, 25 bp, Rattus norvegicus
aaatcacttgctgcttttggagagg

SEQ ID NO: 15533 - DNA, 25 bp, Rattus norvegicus
aaatcagaaactccctctgctacgt

SEQ ID NO: 15534 - DNA, 25 bp, Rattus norvegicus
aaatcagaaactgcctctgctacgt

SEQ ID NO: 15535 - DNA, 25 bp, Rattus norvegicus
aaatcagaatccatccatggccgtt

SEQ ID NO: 15536 - DNA, 25 bp, Rattus norvegicus
aaatcagaatccttccatggccgtt

SEQ ID NO: 15537 - DNA, 25 bp, Rattus norvegicus
aaatcagaatggctctctttgaccc

SEQ ID NO: 15538 - DNA, 25 bp, Rattus norvegicus
aaatcagaatgggtctctttgaccc

SEQ ID NO: 15539 - DNA, 25 bp, Rattus norvegicus
aaatcagaccaaactcactttcctg

SEQ ID NO: 15540 - DNA, 25 bp, Rattus norvegicus
aaatcagaccaatctcactttcctg

SEQ ID NO: 15541 - DNA, 25 bp, Rattus norvegicus
aaatcagaccgcaggtgggacagta

SEQ ID NO: 15542 - DNA, 25 bp, Rattus norvegicus
aaatcagaccgctggtgggacagta

SEQ ID NO: 15543 - DNA, 25 bp, Rattus norvegicus
aaatcagacctcacttccgaatgta

SEQ ID NO: 15544 - DNA, 25 bp, Rattus norvegicus
aaatcagacctctcttccgaatgta

SEQ ID NO: 15545 - DNA, 25 bp, Rattus norvegicus
aaatcagacctgacacaacgcggac

SEQ ID NO: 15546 - DNA, 25 bp, Rattus norvegicus
aaatcagacctgtcacaacgcggac

SEQ ID NO: 15547 - DNA, 25 bp, Rattus norvegicus
aaatcagactgcactggccttcatg

SEQ ID NO: 15548 - DNA, 25 bp, Rattus norvegicus
aaatcagactgctctggccttcatg

SEQ ID NO: 15549 - DNA, 25 bp, Rattus norvegicus
aaatcagactttctttgtccaggat

SEQ ID NO: 15550 - DNA, 25 bp, Rattus norvegicus
aaatcagactttgtttgtccaggat

SEQ ID NO: 15551 - DNA, 25 bp, Rattus norvegicus
aaatcagagactcctacgcacagct

SEQ ID NO: 15552 - DNA, 25 bp, Rattus norvegicus
aaatcagagactgctacgcacagct

SEQ ID NO: 15553 - DNA, 25 bp, Rattus norvegicus
aaatcagagagcagggacaccatta

SEQ ID NO: 15554 - DNA, 25 bp, Rattus norvegicus
aaatcagagagctgggacaccatta

SEQ ID NO: 15555 - DNA, 25 bp, Rattus norvegicus
aaatcagagattcccacttctcctg

SEQ ID NO: 15556 - DNA, 25 bp, Rattus norvegicus
aaatcagagattgccacttctcctg

SEQ ID NO: 15557 - DNA, 25 bp, Rattus norvegicus
aaatcagagttacacgtggtggcac

SEQ ID NO: 15558 - DNA, 25 bp, Rattus norvegicus
aaatcagagttagacgtggtggcac

SEQ ID NO: 15559 - DNA, 25 bp, Rattus norvegicus
aaatcagatgttcgttccctccatg

SEQ ID NO: 15560 - DNA, 25 bp, Rattus norvegicus
aaatcagatgttggttccctccatg

SEQ ID NO: 15561 - DNA, 25 bp, Rattus norvegicus
aaatcagattctagtttgagacaag

SEQ ID NO: 15562 - DNA, 25 bp, Rattus norvegicus
aaatcagattcttgtttgagacaag

SEQ ID NO: 15563 - DNA, 25 bp, Rattus norvegicus
aaatcagcactgcatgacagcctac

SEQ ID NO: 15564 - DNA, 25 bp, Rattus norvegicus
aaatcagcactggatgacagcctac

SEQ ID NO: 15565 - DNA, 25 bp, Rattus norvegicus
aaatcagcagcactttgtaatttcc

SEQ ID NO: 15566 - DNA, 25 bp, Rattus norvegicus
aaatcagcagcagtttgtaatttcc

SEQ ID NO: 15567 - DNA, 25 bp, Rattus norvegicus
aaatcagcagctctttagcccaatt

SEQ ID NO: 15568 - DNA, 25 bp, Rattus norvegicus
aaatcagcagctgtttagcccaatt

SEQ ID NO: 15569 - DNA, 25 bp, Rattus norvegicus
aaatcagcagtcctagctcctctgg

SEQ ID NO: 15570 - DNA, 25 bp, Rattus norvegicus
aaatcagcagtcgtagctcctctgg

SEQ ID NO: 15571 - DNA, 25 bp, Rattus norvegicus
aaatcagcatgcctgtgcgcttctt

SEQ ID NO: 15572 - DNA, 25 bp, Rattus norvegicus
aaatcagcatgcgtgtgcgcttctt

SEQ ID NO: 15573 - DNA, 25 bp, Rattus norvegicus
aaatcagccaccctctggactatat

SEQ ID NO: 15574 - DNA, 25 bp, Rattus norvegicus
aaatcagccaccgtctggactatat

SEQ ID NO: 15575 - DNA, 25 bp, Rattus norvegicus
aaatcagccatcagcctgcagagac

SEQ ID NO: 15576 - DNA, 25 bp, Rattus norvegicus
aaatcagccatctgcctgcagagac

SEQ ID NO: 15577 - DNA, 25 bp, Rattus norvegicus
aaatcagcctagaaagcgttgccat

SEQ ID NO: 15578 - DNA, 25 bp, Rattus norvegicus
aaatcagcctagagtcaatgtttgg

SEQ ID NO: 15579 - DNA, 25 bp, Rattus norvegicus
aaatcagcctagatcgtcgtgttgt

SEQ ID NO: 15580 - DNA, 25 bp, Rattus norvegicus
aaatcagcctagtaagcgttgccat

SEQ ID NO: 15581 - DNA, 25 bp, Rattus norvegicus
aaatcagcctagtgtcaatgtttgg

SEQ ID NO: 15582 - DNA, 25 bp, Rattus norvegicus
aaatcagcctagttcgtcgtgttgt

SEQ ID NO: 15583 - DNA, 25 bp, Rattus norvegicus
aaatcagcctctatatttatcataa

SEQ ID NO: 15584 - DNA, 25 bp, Rattus norvegicus
aaatcagcctctttatttatcataa

SEQ ID NO: 15585 - DNA, 25 bp, Rattus norvegicus
aaatcagcctgccatcttctggttt

SEQ ID NO: 15586 - DNA, 25 bp, Rattus norvegicus
aaatcagcctgcgatcttctggttt

SEQ ID NO: 15587 - DNA, 25 bp, Rattus norvegicus
aaatcagccttccaaacattcacta

SEQ ID NO: 15588 - DNA, 25 bp, Rattus norvegicus
aaatcagccttcgaaacattcacta

SEQ ID NO: 15589 - DNA, 25 bp, Rattus norvegicus
aaatcagcgacccatttttcaggga

SEQ ID NO: 15590 - DNA, 25 bp, Rattus norvegicus
aaatcagcgaccgatttttcaggga

SEQ ID NO: 15591 - DNA, 25 bp, Rattus norvegicus
aaatcagcgctgactccaggatgga

SEQ ID NO: 15592 - DNA, 25 bp, Rattus norvegicus
aaatcagcgctgtctccaggatgga

SEQ ID NO: 15593 - DNA, 25 bp, Rattus norvegicus
aaatcagctcctagtaaaatagaac

SEQ ID NO: 15594 - DNA, 25 bp, Rattus norvegicus
aaatcagctccttgtaaaatagaac

SEQ ID NO: 15595 - DNA, 25 bp, Rattus norvegicus
aaatcagctgcaatgacaacttcgt

SEQ ID NO: 15596 - DNA, 25 bp, Rattus norvegicus
aaatcagctgcattgacaacttcgt

SEQ ID NO: 15597 - DNA, 25 bp, Rattus norvegicus
aaatcaggaaatccaaacagcgatt

SEQ ID NO: 15598 - DNA, 25 bp, Rattus norvegicus
aaatcaggaaatgcaaacagcgatt

SEQ ID NO: 15599 - DNA, 25 bp, Rattus norvegicus
aaatcaggaagacgaccagcgggct

SEQ ID NO: 15600 - DNA, 25 bp, Rattus norvegicus
aaatcaggaagaggaccagcgggct

SEQ ID NO: 15601 - DNA, 25 bp, Rattus norvegicus
aaatcaggagctaagtggttcaaca

SEQ ID NO: 15602 - DNA, 25 bp, Rattus norvegicus
aaatcaggagcttagtggttcaaca

SEQ ID NO: 15603 - DNA, 25 bp, Rattus norvegicus
aaatcaggatttacccagacgcctc

SEQ ID NO: 15604 - DNA, 25 bp, Rattus norvegicus
aaatcaggattttcccagacgcctc

SEQ ID NO: 15605 - DNA, 25 bp, Rattus norvegicus
aaatcaggcacaacctctcggaagt

SEQ ID NO: 15606 - DNA, 25 bp, Rattus norvegicus
aaatcaggcacatcctctcggaagt

SEQ ID NO: 15607 - DNA, 25 bp, Rattus norvegicus
aaatcaggcagtaatcaagttcagg

SEQ ID NO: 15608 - DNA, 25 bp, Rattus norvegicus
aaatcaggcagttatcaagttcagg

SEQ ID NO: 15609 - DNA, 25 bp, Rattus norvegicus
aaatcaggcgtgcacatgaacacat

SEQ ID NO: 15610 - DNA, 25 bp, Rattus norvegicus
aaatcaggcgtggacatgaacacat

SEQ ID NO: 15611 - DNA, 25 bp, Rattus norvegicus
aaatcaggctgtcgccgcttctgca

SEQ ID NO: 15612 - DNA, 25 bp, Rattus norvegicus
aaatcaggctgtggccgcttctgca

SEQ ID NO: 15613 - DNA, 25 bp, Rattus norvegicus
aaatcagggatgagtgctcttcccc

SEQ ID NO: 15614 - DNA, 25 bp, Rattus norvegicus
aaatcagggatgtgtgctcttcccc

SEQ ID NO: 15615 - DNA, 25 bp, Rattus norvegicus
aaatcagggcacaaggactttgaaa

SEQ ID NO: 15616 - DNA, 25 bp, Rattus norvegicus
aaatcagggcactaggactttgaaa

SEQ ID NO: 15617 - DNA, 25 bp, Rattus norvegicus
aaatcagggcatcgatctgtcacct

SEQ ID NO: 15618 - DNA, 25 bp, Rattus norvegicus
aaatcagggcatggatctgtcacct

SEQ ID NO: 15619 - DNA, 25 bp, Rattus norvegicus
aaatcagggctccaacaagtccatt

SEQ ID NO: 15620 - DNA, 25 bp, Rattus norvegicus
aaatcagggctcgaacaagtccatt

SEQ ID NO: 15621 - DNA, 25 bp, Rattus norvegicus
aaatcagggcttccggcttattttt

SEQ ID NO: 15622 - DNA, 25 bp, Rattus norvegicus
aaatcagggcttgcggcttattttt

SEQ ID NO: 15623 - DNA, 25 bp, Rattus norvegicus
aaatcaggtataccacacacctgca

SEQ ID NO: 15624 - DNA, 25 bp, Rattus norvegicus
aaatcaggtatagcacacacctgca

SEQ ID NO: 15625 - DNA, 25 bp, Rattus norvegicus
aaatcagtaacacagcttaacgagc

SEQ ID NO: 15626 - DNA, 25 bp, Rattus norvegicus
aaatcagtaacagagcttaacgagc

SEQ ID NO: 15627 - DNA, 25 bp, Rattus norvegicus
aaatcagtcagaagggtactgcatc

SEQ ID NO: 15628 - DNA, 25 bp, Rattus norvegicus
aaatcagtcagatgggtactgcatc

SEQ ID NO: 15629 - DNA, 25 bp, Rattus norvegicus
aaatcagtcatgctccacagggtgt

SEQ ID NO: 15630 - DNA, 25 bp, Rattus norvegicus
aaatcagtcatggtccacagggtgt

SEQ ID NO: 15631 - DNA, 25 bp, Rattus norvegicus
aaatcagtccaaccctccttagagc

SEQ ID NO: 15632 - DNA, 25 bp, Rattus norvegicus
aaatcagtccaagcctccttagagc

SEQ ID NO: 15633 - DNA, 25 bp, Rattus norvegicus
aaatcagtcctaattttgtggctgt

SEQ ID NO: 15634 - DNA, 25 bp, Rattus norvegicus
aaatcagtcctatttttgtggctgt

SEQ ID NO: 15635 - DNA, 25 bp, Rattus norvegicus
aaatcagtcttcaaattctaagtgg

SEQ ID NO: 15636 - DNA, 25 bp, Rattus norvegicus
aaatcagtcttctaattctaagtgg

SEQ ID NO: 15637 - DNA, 25 bp, Rattus norvegicus
aaatcagtgaatcctcggtgtgtgg

SEQ ID NO: 15638 - DNA, 25 bp, Rattus norvegicus
aaatcagtgaatgctcggtgtgtgg

SEQ ID NO: 15639 - DNA, 25 bp, Rattus norvegicus
aaatcagtgacccatggtcctctat

SEQ ID NO: 15640 - DNA, 25 bp, Rattus norvegicus
aaatcagtgaccgatggtcctctat

SEQ ID NO: 15641 - DNA, 25 bp, Rattus norvegicus
aaatcagtgccccagacaagctgct

SEQ ID NO: 15642 - DNA, 25 bp, Rattus norvegicus
aaatcagtgcccctccagaggagct

SEQ ID NO: 15643 - DNA, 25 bp, Rattus norvegicus
aaatcagtgcccgagacaagctgct

SEQ ID NO: 15644 - DNA, 25 bp, Rattus norvegicus
aaatcagtgcccgtccagaggagct

SEQ ID NO: 15645 - DNA, 25 bp, Rattus norvegicus
aaatcagtgctcatacttcctgtac

SEQ ID NO: 15646 - DNA, 25 bp, Rattus norvegicus
aaatcagtgctcttacttcctgtac

SEQ ID NO: 15647 - DNA, 25 bp, Rattus norvegicus
aaatcagtgctgaggctcaaagaca

SEQ ID NO: 15648 - DNA, 25 bp, Rattus norvegicus
aaatcagtgctgtggctcaaagaca

SEQ ID NO: 15649 - DNA, 25 bp, Rattus norvegicus
aaatcagtggacatgtcctggcatg

SEQ ID NO: 15650 - DNA, 25 bp, Rattus norvegicus
aaatcagtggacttgtcctggcatg

SEQ ID NO: 15651 - DNA, 25 bp, Rattus norvegicus
aaatcagtgtttctggaccttccta

SEQ ID NO: 15652 - DNA, 25 bp, Rattus norvegicus
aaatcagtgtttgtggaccttccta

SEQ ID NO: 15653 - DNA, 25 bp, Rattus norvegicus
aaatcagttcacattcatctttttt

SEQ ID NO: 15654 - DNA, 25 bp, Rattus norvegicus
aaatcagttcactttcatctttttt

SEQ ID NO: 15655 - DNA, 25 bp, Rattus norvegicus
aaatcagttcccactgaaagtgtga

SEQ ID NO: 15656 - DNA, 25 bp, Rattus norvegicus
aaatcagttccctctgaaagtgtga

SEQ ID NO: 15657 - DNA, 25 bp, Rattus norvegicus
aaatcagttgacatgcaccttgcat

SEQ ID NO: 15658 - DNA, 25 bp, Rattus norvegicus
aaatcagttgacttgcaccttgcat

SEQ ID NO: 15659 - DNA, 25 bp, Rattus norvegicus
aaatcagttgtactccctcccactg

SEQ ID NO: 15660 - DNA, 25 bp, Rattus norvegicus
aaatcagttgtagtccctcccactg

SEQ ID NO: 15661 - DNA, 25 bp, Rattus norvegicus
aaatcagttgttcgattatccttat

SEQ ID NO: 15662 - DNA, 25 bp, Rattus norvegicus
aaatcagttgttggattatccttat

SEQ ID NO: 15663 - DNA, 25 bp, Rattus norvegicus
aaatcagtttatatggtggccccat

SEQ ID NO: 15664 - DNA, 25 bp, Rattus norvegicus
aaatcagtttatttggtggccccat

SEQ ID NO: 15665 - DNA, 25 bp, Rattus norvegicus
aaatcataaaagagtacaccctggg

SEQ ID NO: 15666 - DNA, 25 bp, Rattus norvegicus
aaatcataaaagtgtacaccctggg

SEQ ID NO: 15667 - DNA, 25 bp, Rattus norvegicus
aaatcatacctcctgagcttgctat

SEQ ID NO: 15668 - DNA, 25 bp, Rattus norvegicus
aaatcatacctcgtgagcttgctat

SEQ ID NO: 15669 - DNA, 25 bp, Rattus norvegicus
aaatcatagtcacctgtcgggaaca

SEQ ID NO: 15670 - DNA, 25 bp, Rattus norvegicus
aaatcatagtcagctgtcgggaaca

SEQ ID NO: 15671 - DNA, 25 bp, Rattus norvegicus
aaatcatcagcacagaactgcgtgt

SEQ ID NO: 15672 - DNA, 25 bp, Rattus norvegicus
aaatcatcagcagagaactgcgtgt

SEQ ID NO: 15673 - DNA, 25 bp, Rattus norvegicus
aaatcatcagctataacgacagcat

SEQ ID NO: 15674 - DNA, 25 bp, Rattus norvegicus
aaatcatcagctttaacgacagcat

SEQ ID NO: 15675 - DNA, 25 bp, Rattus norvegicus
aaatcatcaggaagctgccactgtg

SEQ ID NO: 15676 - DNA, 25 bp, Rattus norvegicus
aaatcatcaggatgctgccactgtg

SEQ ID NO: 15677 - DNA, 25 bp, Rattus norvegicus
aaatcatcatgtcttctgatctgac

SEQ ID NO: 15678 - DNA, 25 bp, Rattus norvegicus
aaatcatcatgtgttctgatctgac

SEQ ID NO: 15679 - DNA, 25 bp, Rattus norvegicus
aaatcatcatttccctttttgtcct

SEQ ID NO: 15680 - DNA, 25 bp, Rattus norvegicus
aaatcatcatttgcctttttgtcct

SEQ ID NO: 15681 - DNA, 25 bp, Rattus norvegicus
aaatcatccctgagctgtctcaaca

SEQ ID NO: 15682 - DNA, 25 bp, Rattus norvegicus
aaatcatccctgtgctgtctcaaca

SEQ ID NO: 15683 - DNA, 25 bp, Rattus norvegicus
aaatcatccgatactcacagcgatt

SEQ ID NO: 15684 - DNA, 25 bp, Rattus norvegicus
aaatcatccgattctcacagcgatt

SEQ ID NO: 15685 - DNA, 25 bp, Rattus norvegicus
aaatcatcctgcacgagttggagaa

SEQ ID NO: 15686 - DNA, 25 bp, Rattus norvegicus
aaatcatcctgctcgagttggagaa

SEQ ID NO: 15687 - DNA, 25 bp, Rattus norvegicus
aaatcatctaacattcccacatggg

SEQ ID NO: 15688 - DNA, 25 bp, Rattus norvegicus
aaatcatctaactttcccacatggg

SEQ ID NO: 15689 - DNA, 25 bp, Rattus norvegicus
aaatcatctattcacacctgtccca

SEQ ID NO: 15690 - DNA, 25 bp, Rattus norvegicus
aaatcatctattccaagactcccag

SEQ ID NO: 15691 - DNA, 25 bp, Rattus norvegicus
aaatcatctattgacacctgtccca

SEQ ID NO: 15692 - DNA, 25 bp, Rattus norvegicus
aaatcatctattgcaagactcccag

SEQ ID NO: 15693 - DNA, 25 bp, Rattus norvegicus
aaatcatctcacactgaccaacatg

SEQ ID NO: 15694 - DNA, 25 bp, Rattus norvegicus
aaatcatctcactctgaccaacatg

SEQ ID NO: 15695 - DNA, 25 bp, Rattus norvegicus
aaatcatctcgtcgattctcggtgc

SEQ ID NO: 15696 - DNA, 25 bp, Rattus norvegicus
aaatcatctcgtggattctcggtgc

SEQ ID NO: 15697 - DNA, 25 bp, Rattus norvegicus
aaatcatctctacagtgaccacata

SEQ ID NO: 15698 - DNA, 25 bp, Rattus norvegicus
aaatcatctctagagtgaccacata

SEQ ID NO: 15699 - DNA, 25 bp, Rattus norvegicus
aaatcatctctgaactgagaactaa

SEQ ID NO: 15700 - DNA, 25 bp, Rattus norvegicus
aaatcatctctgtactgagaactaa

SEQ ID NO: 15701 - DNA, 25 bp, Rattus norvegicus
aaatcatgctgacttggctcctgaa

SEQ ID NO: 15702 - DNA, 25 bp, Rattus norvegicus
aaatcatgctgagttggctcctgaa

SEQ ID NO: 15703 - DNA, 25 bp, Rattus norvegicus
aaatcatggatgcatgtgcaggcat

SEQ ID NO: 15704 - DNA, 25 bp, Rattus norvegicus
aaatcatggatggatgtgcaggcat

SEQ ID NO: 15705 - DNA, 25 bp, Rattus norvegicus
aaatcatggtgcatcctccgggcgg

SEQ ID NO: 15706 - DNA, 25 bp, Rattus norvegicus
aaatcatggtgcttcctccgggcgg

SEQ ID NO: 15707 - DNA, 25 bp, Rattus norvegicus
aaatcatgtacaactccaagcggag

SEQ ID NO: 15708 - DNA, 25 bp, Rattus norvegicus
aaatcatgtacatctccaagcggag

SEQ ID NO: 15709 - DNA, 25 bp, Rattus norvegicus
aaatcatgtgaactgggtgcctggc

SEQ ID NO: 15710 - DNA, 25 bp, Rattus norvegicus
aaatcatgtgaagtgggtgcctggc

SEQ ID NO: 15711 - DNA, 25 bp, Rattus norvegicus
aaatcatgtgaccagcttctctcaa

SEQ ID NO: 15712 - DNA, 25 bp, Rattus norvegicus
aaatcatgtgacgagcttctctcaa

SEQ ID NO: 15713 - DNA, 25 bp, Rattus norvegicus
aaatcatgtggtctcgctcacctca

SEQ ID NO: 15714 - DNA, 25 bp, Rattus norvegicus
aaatcatgtggtgtcgctcacctca

SEQ ID NO: 15715 - DNA, 25 bp, Rattus norvegicus
aaatcatgtttgaagctataacccc

SEQ ID NO: 15716 - DNA, 25 bp, Rattus norvegicus
aaatcatgtttgtagctataacccc

SEQ ID NO: 15717 - DNA, 25 bp, Rattus norvegicus
aaatcattacttatattccttcttg

SEQ ID NO: 15718 - DNA, 25 bp, Rattus norvegicus
aaatcattacttttattccttcttg

SEQ ID NO: 15719 - DNA, 25 bp, Rattus norvegicus
aaatcattcagcaagagcagtttca

SEQ ID NO: 15720 - DNA, 25 bp, Rattus norvegicus
aaatcattcagctagagcagtttca

SEQ ID NO: 15721 - DNA, 25 bp, Rattus norvegicus
aaatcattccctcccgtattcatat

SEQ ID NO: 15722 - DNA, 25 bp, Rattus norvegicus
aaatcattccctgccgtattcatat

SEQ ID NO: 15723 - DNA, 25 bp, Rattus norvegicus
aaatcattgcttatgttcagatggt

SEQ ID NO: 15724 - DNA, 25 bp, Rattus norvegicus
aaatcattgcttttgttcagatggt

SEQ ID NO: 15725 - DNA, 25 bp, Rattus norvegicus
aaatcattgtacacagcagctgggt

SEQ ID NO: 15726 - DNA, 25 bp, Rattus norvegicus
aaatcattgtactcagcagctgggt

SEQ ID NO: 15727 - DNA, 25 bp, Rattus norvegicus
aaatcattgtagaccaagactgctg

SEQ ID NO: 15728 - DNA, 25 bp, Rattus norvegicus
aaatcattgtagtccaagactgctg

SEQ ID NO: 15729 - DNA, 25 bp, Rattus norvegicus
aaatcattgtgtcccgatcgtggat

SEQ ID NO: 15730 - DNA, 25 bp, Rattus norvegicus
aaatcattgtgtgccgatcgtggat

SEQ ID NO: 15731 - DNA, 25 bp, Rattus norvegicus
aaatcatttaacaacacctcactcc

SEQ ID NO: 15732 - DNA, 25 bp, Rattus norvegicus
aaatcatttaactacacctcactcc

SEQ ID NO: 15733 - DNA, 25 bp, Rattus norvegicus
aaatcatttagccactctcagactc

SEQ ID NO: 15734 - DNA, 25 bp, Rattus norvegicus
aaatcatttagcgactctcagactc

SEQ ID NO: 15735 - DNA, 25 bp, Rattus norvegicus
aaatcatttataccactgaacatta

SEQ ID NO: 15736 - DNA, 25 bp, Rattus norvegicus
aaatcatttatagcactgaacatta

SEQ ID NO: 15737 - DNA, 25 bp, Rattus norvegicus
aaatcatttcttaagtctgttggag

SEQ ID NO: 15738 - DNA, 25 bp, Rattus norvegicus
aaatcatttcttcagtccttactga

SEQ ID NO: 15739 - DNA, 25 bp, Rattus norvegicus
aaatcatttcttgagtccttactga

SEQ ID NO: 15740 - DNA, 25 bp, Rattus norvegicus
aaatcatttctttagtctgttggag

SEQ ID NO: 15741 - DNA, 25 bp, Rattus norvegicus
aaatcatttgttccttgtaagttac

SEQ ID NO: 15742 - DNA, 25 bp, Rattus norvegicus
aaatcatttgttgcttgtaagttac

SEQ ID NO: 15743 - DNA, 25 bp, Rattus norvegicus
aaatccaaaagcattctagtctaag

SEQ ID NO: 15744 - DNA, 25 bp, Rattus norvegicus
aaatccaaaagctttctagtctaag

SEQ ID NO: 15745 - DNA, 25 bp, Rattus norvegicus
aaatccaaacacaaggccaggagga

SEQ ID NO: 15746 - DNA, 25 bp, Rattus norvegicus
aaatccaaacactaggccaggagga

SEQ ID NO: 15747 - DNA, 25 bp, Rattus norvegicus
aaatccaacccgacaggtctctcgg

SEQ ID NO: 15748 - DNA, 25 bp, Rattus norvegicus
aaatccaacccgtcaggtctctcgg

SEQ ID NO: 15749 - DNA, 25 bp, Rattus norvegicus
aaatccaactcaaagacctctcgac

SEQ ID NO: 15750 - DNA, 25 bp, Rattus norvegicus
aaatccaactcatagacctctcgac

SEQ ID NO: 15751 - DNA, 25 bp, Rattus norvegicus
aaatccaagaacaagcgggtcccag

SEQ ID NO: 15752 - DNA, 25 bp, Rattus norvegicus
aaatccaagaactagcgggtcccag

SEQ ID NO: 15753 - DNA, 25 bp, Rattus norvegicus
aaatccaagaagcaccttcccaagg

SEQ ID NO: 15754 - DNA, 25 bp, Rattus norvegicus
aaatccaagaaggaccttcccaagg

SEQ ID NO: 15755 - DNA, 25 bp, Rattus norvegicus
aaatccaagactcctaccatgaagg

SEQ ID NO: 15756 - DNA, 25 bp, Rattus norvegicus
aaatccaagactgctaccatgaagg

SEQ ID NO: 15757 - DNA, 25 bp, Rattus norvegicus
aaatccaagagcatcgtgacgctgg

SEQ ID NO: 15758 - DNA, 25 bp, Rattus norvegicus
aaatccaagagcttcgtgacgctgg

SEQ ID NO: 15759 - DNA, 25 bp, Rattus norvegicus
aaatccaagcatcaaggcatctctt

SEQ ID NO: 15760 - DNA, 25 bp, Rattus norvegicus
aaatccaagcatgaaggcatctctt

SEQ ID NO: 15761 - DNA, 25 bp, Rattus norvegicus
aaatccaaggaaagtgctgacccct

SEQ ID NO: 15762 - DNA, 25 bp, Rattus norvegicus
aaatccaaggaatgtgctgacccct

SEQ ID NO: 15763 - DNA, 25 bp, Rattus norvegicus
aaatccaatgcccaaggtcaccatg

SEQ ID NO: 15764 - DNA, 25 bp, Rattus norvegicus
aaatccaatgccgaaggtcaccatg

SEQ ID NO: 15765 - DNA, 25 bp, Rattus norvegicus
aaatccacaatgaatttggtgtcat

SEQ ID NO: 15766 - DNA, 25 bp, Rattus norvegicus
aaatccacaatgtatttggtgtcat

SEQ ID NO: 15767 - DNA, 25 bp, Rattus norvegicus
aaatccacaccaaataaacaagagc

SEQ ID NO: 15768 - DNA, 25 bp, Rattus norvegicus
aaatccacaccatataaacaagagc

SEQ ID NO: 15769 - DNA, 25 bp, Rattus norvegicus
aaatccaccagaacccagaggcaga

SEQ ID NO: 15770 - DNA, 25 bp, Rattus norvegicus
aaatccaccagatcccagaggcaga

SEQ ID NO: 15771 - DNA, 25 bp, Rattus norvegicus
aaatccaccttaatggtcatgttgg

SEQ ID NO: 15772 - DNA, 25 bp, Rattus norvegicus
aaatccaccttattggtcatgttgg

SEQ ID NO: 15773 - DNA, 25 bp, Rattus norvegicus
aaatccacgactaccagagatcctg

SEQ ID NO: 15774 - DNA, 25 bp, Rattus norvegicus
aaatccacgacttccagagatcctg

SEQ ID NO: 15775 - DNA, 25 bp, Rattus norvegicus
aaatccacgtttagtcagctttctc

SEQ ID NO: 15776 - DNA, 25 bp, Rattus norvegicus
aaatccacgttttgtcagctttctc

SEQ ID NO: 15777 - DNA, 25 bp, Rattus norvegicus
aaatccactgtgctctgagacatgc

SEQ ID NO: 15778 - DNA, 25 bp, Rattus norvegicus
aaatccactgtggtctgagacatgc

SEQ ID NO: 15779 - DNA, 25 bp, Rattus norvegicus
aaatccacttggatccgtgtcgtct

SEQ ID NO: 15780 - DNA, 25 bp, Rattus norvegicus
aaatccacttggttccgtgtcgtct

SEQ ID NO: 15781 - DNA, 25 bp, Rattus norvegicus
aaatccagaagcaatttgttttcat

SEQ ID NO: 15782 - DNA, 25 bp, Rattus norvegicus
aaatccagaagctatttgttttcat

SEQ ID NO: 15783 - DNA, 25 bp, Rattus norvegicus
aaatccagaataactcctatcccag

SEQ ID NO: 15784 - DNA, 25 bp, Rattus norvegicus
aaatccagaatatctcctatcccag

SEQ ID NO: 15785 - DNA, 25 bp, Rattus norvegicus
aaatccagatggctgctttcttcct

SEQ ID NO: 15786 - DNA, 25 bp, Rattus norvegicus
aaatccagatgggtgctttcttcct

SEQ ID NO: 15787 - DNA, 25 bp, Rattus norvegicus
aaatccagattcattttcttgcagc

SEQ ID NO: 15788 - DNA, 25 bp, Rattus norvegicus
aaatccagattctttttcttgcagc

SEQ ID NO: 15789 - DNA, 25 bp, Rattus norvegicus
aaatccagcgttaccagttcacttt

SEQ ID NO: 15790 - DNA, 25 bp, Rattus norvegicus
aaatccagcgtttccagttcacttt

SEQ ID NO: 15791 - DNA, 25 bp, Rattus norvegicus
aaatccagctatatgcagccagcat

SEQ ID NO: 15792 - DNA, 25 bp, Rattus norvegicus
aaatccagctatttgcagccagcat

SEQ ID NO: 15793 - DNA, 25 bp, Rattus norvegicus
aaatccagctgacgccatgttcaga

SEQ ID NO: 15794 - DNA, 25 bp, Rattus norvegicus
aaatccagctgaggccatgttcaga

SEQ ID NO: 15795 - DNA, 25 bp, Rattus norvegicus
aaatccaggaagctctcaagtcccg

SEQ ID NO: 15796 - DNA, 25 bp, Rattus norvegicus
aaatccaggaaggtctcaagtcccg

SEQ ID NO: 15797 - DNA, 25 bp, Rattus norvegicus
aaatccaggataccctctgccatag

SEQ ID NO: 15798 - DNA, 25 bp, Rattus norvegicus
aaatccaggatagcctctgccatag

SEQ ID NO: 15799 - DNA, 25 bp, Rattus norvegicus
aaatccaggatgctctgtcaccaat

SEQ ID NO: 15800 - DNA, 25 bp, Rattus norvegicus
aaatccaggatggtctgtcaccaat

SEQ ID NO: 15801 - DNA, 25 bp, Rattus norvegicus
aaatccagtccactggcagctggga

SEQ ID NO: 15802 - DNA, 25 bp, Rattus norvegicus
aaatccagtccagtggcagctggga

SEQ ID NO: 15803 - DNA, 25 bp, Rattus norvegicus
aaatccagtgctacttctcagtgta

SEQ ID NO: 15804 - DNA, 25 bp, Rattus norvegicus
aaatccagtgcttcttctcagtgta

SEQ ID NO: 15805 - DNA, 25 bp, Rattus norvegicus
aaatccagtgtcatctacatgcata

SEQ ID NO: 15806 - DNA, 25 bp, Rattus norvegicus
aaatccagtgtcttctacatgcata

SEQ ID NO: 15807 - DNA, 25 bp, Rattus norvegicus
aaatccagttatagccactgtctgg

SEQ ID NO: 15808 - DNA, 25 bp, Rattus norvegicus
aaatccagttattgccactgtctgg

SEQ ID NO: 15809 - DNA, 25 bp, Rattus norvegicus
aaatccagtttaagccaattctatg

SEQ ID NO: 15810 - DNA, 25 bp, Rattus norvegicus
aaatccagtttatgccaattctatg

SEQ ID NO: 15811 - DNA, 25 bp, Rattus norvegicus
aaatccataaacatgtatctgtcta

SEQ ID NO: 15812 - DNA, 25 bp, Rattus norvegicus
aaatccataaacttgtatctgtcta

SEQ ID NO: 15813 - DNA, 25 bp, Rattus norvegicus
aaatccataagcatccagcttcgtc

SEQ ID NO: 15814 - DNA, 25 bp, Rattus norvegicus
aaatccataagcttccagcttcgtc

SEQ ID NO: 15815 - DNA, 25 bp, Rattus norvegicus
aaatccatcattacatatgcactgt

SEQ ID NO: 15816 - DNA, 25 bp, Rattus norvegicus
aaatccatcattacatccatcaagc

SEQ ID NO: 15817 - DNA, 25 bp, Rattus norvegicus
aaatccatcatttcatatgcactgt

SEQ ID NO: 15818 - DNA, 25 bp, Rattus norvegicus
aaatccatcatttcatccatcaagc

SEQ ID NO: 15819 - DNA, 25 bp, Rattus norvegicus
aaatccatccacctacagttcaaga

SEQ ID NO: 15820 - DNA, 25 bp, Rattus norvegicus
aaatccatccacgtacagttcaaga

SEQ ID NO: 15821 - DNA, 25 bp, Rattus norvegicus
aaatccatcgtccagggaacacccg

SEQ ID NO: 15822 - DNA, 25 bp, Rattus norvegicus
aaatccatcgtcgagggaacacccg

SEQ ID NO: 15823 - DNA, 25 bp, Rattus norvegicus
aaatccatctgcacgggagattctg

SEQ ID NO: 15824 - DNA, 25 bp, Rattus norvegicus
aaatccatctgctcgggagattctg

SEQ ID NO: 15825 - DNA, 25 bp, Rattus norvegicus
aaatccatcttaattcaagtcatca

SEQ ID NO: 15826 - DNA, 25 bp, Rattus norvegicus
aaatccatcttatttcaagtcatca

SEQ ID NO: 15827 - DNA, 25 bp, Rattus norvegicus
aaatccatctttatcctgggatgct

SEQ ID NO: 15828 - DNA, 25 bp, Rattus norvegicus
aaatccatctttttcctgggatgct

SEQ ID NO: 15829 - DNA, 25 bp, Rattus norvegicus
aaatccatgcctatagagtctgtat

SEQ ID NO: 15830 - DNA, 25 bp, Rattus norvegicus
aaatccatgcctttagagtctgtat

SEQ ID NO: 15831 - DNA, 25 bp, Rattus norvegicus
aaatccatgctgagctgcaccagga

SEQ ID NO: 15832 - DNA, 25 bp, Rattus norvegicus
aaatccatgctgtgctgcaccagga

SEQ ID NO: 15833 - DNA, 25 bp, Rattus norvegicus
aaatccatgtgcctataatctgcag

SEQ ID NO: 15834 - DNA, 25 bp, Rattus norvegicus
aaatccatgtgcgtataatctgcag

SEQ ID NO: 15835 - DNA, 25 bp, Rattus norvegicus
aaatccattcttatatgtctagggc

SEQ ID NO: 15836 - DNA, 25 bp, Rattus norvegicus
aaatccattcttttatgtctagggc

SEQ ID NO: 15837 - DNA, 25 bp, Rattus norvegicus
aaatcccaaggaatctgtgcactgg

SEQ ID NO: 15838 - DNA, 25 bp, Rattus norvegicus
aaatcccaaggattctgtgcactgg

SEQ ID NO: 15839 - DNA, 25 bp, Rattus norvegicus
aaatcccaagttcgcataacctgat

SEQ ID NO: 15840 - DNA, 25 bp, Rattus norvegicus
aaatcccaagttggcataacctgat

SEQ ID NO: 15841 - DNA, 25 bp, Rattus norvegicus
aaatcccacaggctgctggtattgg

SEQ ID NO: 15842 - DNA, 25 bp, Rattus norvegicus
aaatcccacagggtgctggtattgg

SEQ ID NO: 15843 - DNA, 25 bp, Rattus norvegicus
aaatcccacattactttttgtccag

SEQ ID NO: 15844 - DNA, 25 bp, Rattus norvegicus
aaatcccacatttctttttgtccag

SEQ ID NO: 15845 - DNA, 25 bp, Rattus norvegicus
aaatcccaccttcaataagtgattg

SEQ ID NO: 15846 - DNA, 25 bp, Rattus norvegicus
aaatcccaccttgaataagtgattg

SEQ ID NO: 15847 - DNA, 25 bp, Rattus norvegicus
aaatcccagatcacaagctggccat

SEQ ID NO: 15848 - DNA, 25 bp, Rattus norvegicus
aaatcccagatctcaagctggccat

SEQ ID NO: 15849 - DNA, 25 bp, Rattus norvegicus
aaatcccatcagactattgctatat

SEQ ID NO: 15850 - DNA, 25 bp, Rattus norvegicus
aaatcccatcagtctattgctatat

SEQ ID NO: 15851 - DNA, 25 bp, Rattus norvegicus
aaatcccatggaacgcaagcagcag

SEQ ID NO: 15852 - DNA, 25 bp, Rattus norvegicus
aaatcccatggatcgcaagcagcag

SEQ ID NO: 15853 - DNA, 25 bp, Rattus norvegicus
aaatcccattatacaaagttgccta

SEQ ID NO: 15854 - DNA, 25 bp, Rattus norvegicus
aaatcccattattcaaagttgccta

SEQ ID NO: 15855 - DNA, 25 bp, Rattus norvegicus
aaatcccattcaaagttctctcaga

SEQ ID NO: 15856 - DNA, 25 bp, Rattus norvegicus
aaatcccattcatagttctctcaga

SEQ ID NO: 15857 - DNA, 25 bp, Rattus norvegicus
aaatcccattgtcacctaactctga

SEQ ID NO: 15858 - DNA, 25 bp, Rattus norvegicus
aaatcccattgtgacctaactctga

SEQ ID NO: 15859 - DNA, 25 bp, Rattus norvegicus
aaatccccacttctgtatttgctga

SEQ ID NO: 15860 - DNA, 25 bp, Rattus norvegicus
aaatccccacttgtgtatttgctga

SEQ ID NO: 15861 - DNA, 25 bp, Rattus norvegicus
aaatccccagccacaatgtctacag

SEQ ID NO: 15862 - DNA, 25 bp, Rattus norvegicus
aaatccccagcctcaatgtctacag

SEQ ID NO: 15863 - DNA, 25 bp, Rattus norvegicus
aaatccccaggacgaatctcagtct

SEQ ID NO: 15864 - DNA, 25 bp, Rattus norvegicus
aaatccccaggaggaatctcagtct

SEQ ID NO: 15865 - DNA, 25 bp, Rattus norvegicus
aaatccccagggaatgctctgcatt

SEQ ID NO: 15866 - DNA, 25 bp, Rattus norvegicus
aaatccccagggtatgctctgcatt

SEQ ID NO: 15867 - DNA, 25 bp, Rattus norvegicus
aaatccccagtcctgttatcttggt

SEQ ID NO: 15868 - DNA, 25 bp, Rattus norvegicus
aaatccccagtcgtgttatcttggt

SEQ ID NO: 15869 - DNA, 25 bp, Rattus norvegicus
aaatcccctcctaaatcggagctat

SEQ ID NO: 15870 - DNA, 25 bp, Rattus norvegicus
aaatcccctccttaatcggagctat

SEQ ID NO: 15871 - DNA, 25 bp, Rattus norvegicus
aaatcccctgggacaatgataccca

SEQ ID NO: 15872 - DNA, 25 bp, Rattus norvegicus
aaatcccctgggtcaatgataccca

SEQ ID NO: 15873 - DNA, 25 bp, Rattus norvegicus
aaatcccctttgcaggtcctggatt

SEQ ID NO: 15874 - DNA, 25 bp, Rattus norvegicus
aaatcccctttggaggtcctggatt

SEQ ID NO: 15875 - DNA, 25 bp, Rattus norvegicus
aaatcccgactgatgatccctgcta

SEQ ID NO: 15876 - DNA, 25 bp, Rattus norvegicus
aaatcccgactgttgatccctgcta

SEQ ID NO: 15877 - DNA, 25 bp, Rattus norvegicus
aaatcccgatttatcacatcctcaa

SEQ ID NO: 15878 - DNA, 25 bp, Rattus norvegicus
aaatcccgatttttcacatcctcaa

SEQ ID NO: 15879 - DNA, 25 bp, Rattus norvegicus
aaatcccgctgaagcatgtggttgc

SEQ ID NO: 15880 - DNA, 25 bp, Rattus norvegicus
aaatcccgctgatgcatgtggttgc

SEQ ID NO: 15881 - DNA, 25 bp, Rattus norvegicus
aaatcccggccaagatcattttcga

SEQ ID NO: 15882 - DNA, 25 bp, Rattus norvegicus
aaatcccggccatgatcattttcga

SEQ ID NO: 15883 - DNA, 25 bp, Rattus norvegicus
aaatcccgggaaatgtatcaacaca

SEQ ID NO: 15884 - DNA, 25 bp, Rattus norvegicus
aaatcccgggaattgtatcaacaca

SEQ ID NO: 15885 - DNA, 25 bp, Rattus norvegicus
aaatcccgggacagtattgctgagg

SEQ ID NO: 15886 - DNA, 25 bp, Rattus norvegicus
aaatcccgggactgtattgctgagg

SEQ ID NO: 15887 - DNA, 25 bp, Rattus norvegicus
aaatcccgtaatccaaatgctgcac

SEQ ID NO: 15888 - DNA, 25 bp, Rattus norvegicus
aaatcccgtaatgcaaatgctgcac

SEQ ID NO: 15889 - DNA, 25 bp, Rattus norvegicus
aaatccctagacatgttcacaacgg

SEQ ID NO: 15890 - DNA, 25 bp, Rattus norvegicus
aaatccctagacttgttcacaacgg

SEQ ID NO: 15891 - DNA, 25 bp, Rattus norvegicus
aaatccctagttattccaaatgcca

SEQ ID NO: 15892 - DNA, 25 bp, Rattus norvegicus
aaatccctagtttttccaaatgcca

SEQ ID NO: 15893 - DNA, 25 bp, Rattus norvegicus
aaatccctcaccctagctttgatgg

SEQ ID NO: 15894 - DNA, 25 bp, Rattus norvegicus
aaatccctcaccgtagctttgatgg

SEQ ID NO: 15895 - DNA, 25 bp, Rattus norvegicus
aaatccctcagaatcagcgtcccag

SEQ ID NO: 15896 - DNA, 25 bp, Rattus norvegicus
aaatccctcagattcagcgtcccag

SEQ ID NO: 15897 - DNA, 25 bp, Rattus norvegicus
aaatccctcccgagagcaggacgat

SEQ ID NO: 15898 - DNA, 25 bp, Rattus norvegicus
aaatccctcccgtgagcaggacgat

SEQ ID NO: 15899 - DNA, 25 bp, Rattus norvegicus
aaatccctcgatctggctgtggtgg

SEQ ID NO: 15900 - DNA, 25 bp, Rattus norvegicus
aaatccctcgatgtggctgtggtgg

SEQ ID NO: 15901 - DNA, 25 bp, Rattus norvegicus
aaatccctctatctggatctctact

SEQ ID NO: 15902 - DNA, 25 bp, Rattus norvegicus
aaatccctctatgtggatctctact

SEQ ID NO: 15903 - DNA, 25 bp, Rattus norvegicus
aaatccctcttgatattggctctct

SEQ ID NO: 15904 - DNA, 25 bp, Rattus norvegicus
aaatccctcttgttattggctctct

SEQ ID NO: 15905 - DNA, 25 bp, Rattus norvegicus
aaatccctgagtagcttttgatcaa

SEQ ID NO: 15906 - DNA, 25 bp, Rattus norvegicus
aaatccctgagtccacaaagtcttg

SEQ ID NO: 15907 - DNA, 25 bp, Rattus norvegicus
aaatccctgagtgcacaaagtcttg

SEQ ID NO: 15908 - DNA, 25 bp, Rattus norvegicus
aaatccctgagttgcttttgatcaa

SEQ ID NO: 15909 - DNA, 25 bp, Rattus norvegicus
aaatccctgccactggaaaaccagt

SEQ ID NO: 15910 - DNA, 25 bp, Rattus norvegicus
aaatccctgccagtggaaaaccagt

SEQ ID NO: 15911 - DNA, 25 bp, Rattus norvegicus
aaatccctgcttaccactgatgttt

SEQ ID NO: 15912 - DNA, 25 bp, Rattus norvegicus
aaatccctgctttccactgatgttt

SEQ ID NO: 15913 - DNA, 25 bp, Rattus norvegicus
aaatccctggatagaagcgcaaagc

SEQ ID NO: 15914 - DNA, 25 bp, Rattus norvegicus
aaatccctggattgaagcgcaaagc

SEQ ID NO: 15915 - DNA, 25 bp, Rattus norvegicus
aaatccctggcaattcctcctgatg

SEQ ID NO: 15916 - DNA, 25 bp, Rattus norvegicus
aaatccctggcatttcctcctgatg

SEQ ID NO: 15917 - DNA, 25 bp, Rattus norvegicus
aaatccctgttcatcgtaagcactt

SEQ ID NO: 15918 - DNA, 25 bp, Rattus norvegicus
aaatccctgttcattctgtagcata

SEQ ID NO: 15919 - DNA, 25 bp, Rattus norvegicus
aaatccctgttcttcgtaagcactt

SEQ ID NO: 15920 - DNA, 25 bp, Rattus norvegicus
aaatccctgttctttctgtagcata

SEQ ID NO: 15921 - DNA, 25 bp, Rattus norvegicus
aaatccctgtttatctgtttgagca

SEQ ID NO: 15922 - DNA, 25 bp, Rattus norvegicus
aaatccctgtttttctgtttgagca

SEQ ID NO: 15923 - DNA, 25 bp, Rattus norvegicus
aaatcccttaagcacactggacacc

SEQ ID NO: 15924 - DNA, 25 bp, Rattus norvegicus
aaatcccttaaggacactggacacc

SEQ ID NO: 15925 - DNA, 25 bp, Rattus norvegicus
aaatcccttgaaatctactacctct

SEQ ID NO: 15926 - DNA, 25 bp, Rattus norvegicus
aaatcccttgaattctactacctct

SEQ ID NO: 15927 - DNA, 25 bp, Rattus norvegicus
aaatcccttttgcttcttgtgtgta

SEQ ID NO: 15928 - DNA, 25 bp, Rattus norvegicus
aaatcccttttggttcttgtgtgta

SEQ ID NO: 15929 - DNA, 25 bp, Rattus norvegicus
aaatccgaacgtctgtctccagtca

SEQ ID NO: 15930 - DNA, 25 bp, Rattus norvegicus
aaatccgaacgtgtgtctccagtca

SEQ ID NO: 15931 - DNA, 25 bp, Rattus norvegicus
aaatccgatcctatatggtttcctt

SEQ ID NO: 15932 - DNA, 25 bp, Rattus norvegicus
aaatccgatcctttatggtttcctt

SEQ ID NO: 15933 - DNA, 25 bp, Rattus norvegicus
aaatccgcatctatatccctgaata

SEQ ID NO: 15934 - DNA, 25 bp, Rattus norvegicus
aaatccgcatctttatccctgaata

SEQ ID NO: 15935 - DNA, 25 bp, Rattus norvegicus
aaatccgccgtacctgcgagcgcga

SEQ ID NO: 15936 - DNA, 25 bp, Rattus norvegicus
aaatccgccgtagctgcgagcgcga

SEQ ID NO: 15937 - DNA, 25 bp, Rattus norvegicus
aaatccggcaggagagcatgccctt

SEQ ID NO: 15938 - DNA, 25 bp, Rattus norvegicus
aaatccggcaggtgagcatgccctt

SEQ ID NO: 15939 - DNA, 25 bp, Rattus norvegicus
aaatccggtcatatctcactcagat

SEQ ID NO: 15940 - DNA, 25 bp, Rattus norvegicus
aaatccggtcatttctcactcagat

SEQ ID NO: 15941 - DNA, 25 bp, Rattus norvegicus
aaatccggtggtaatgtgtagtcct

SEQ ID NO: 15942 - DNA, 25 bp, Rattus norvegicus
aaatccggtggttatgtgtagtcct

SEQ ID NO: 15943 - DNA, 25 bp, Rattus norvegicus
aaatccgtcaaacatcatagcaaga

SEQ ID NO: 15944 - DNA, 25 bp, Rattus norvegicus
aaatccgtcaaagatcatagcaaga

SEQ ID NO: 15945 - DNA, 25 bp, Rattus norvegicus
aaatccgtgagcctatgtggagcat

SEQ ID NO: 15946 - DNA, 25 bp, Rattus norvegicus
aaatccgtgagcgtatgtggagcat

SEQ ID NO: 15947 - DNA, 25 bp, Rattus norvegicus
aaatccgtgcatatgtgtccgaacg

SEQ ID NO: 15948 - DNA, 25 bp, Rattus norvegicus
aaatccgtgcatttgtgtccgaacg

SEQ ID NO: 15949 - DNA, 25 bp, Rattus norvegicus
aaatccgtgtctatcctttttgtgt

SEQ ID NO: 15950 - DNA, 25 bp, Rattus norvegicus
aaatccgtgtctttcctttttgtgt

SEQ ID NO: 15951 - DNA, 25 bp, Rattus norvegicus
aaatccgttcagaagaagccaccag

SEQ ID NO: 15952 - DNA, 25 bp, Rattus norvegicus
aaatccgttcagtagaagccaccag

SEQ ID NO: 15953 - DNA, 25 bp, Rattus norvegicus
aaatccgtttccactgagccaaagt

SEQ ID NO: 15954 - DNA, 25 bp, Rattus norvegicus
aaatccgtttcctctgagccaaagt

SEQ ID NO: 15955 - DNA, 25 bp, Rattus norvegicus
aaatccgttttccatgcttactctt

SEQ ID NO: 15956 - DNA, 25 bp, Rattus norvegicus
aaatccgttttcgatgcttactctt

SEQ ID NO: 15957 - DNA, 25 bp, Rattus norvegicus
aaatcctaacgaactgactgcccac

SEQ ID NO: 15958 - DNA, 25 bp, Rattus norvegicus
aaatcctaacgatctgactgcccac

SEQ ID NO: 15959 - DNA, 25 bp, Rattus norvegicus
aaatcctaagctcagttgtggttct

SEQ ID NO: 15960 - DNA, 25 bp, Rattus norvegicus
aaatcctaagctgagttgtggttct

SEQ ID NO: 15961 - DNA, 25 bp, Rattus norvegicus
aaatcctaccctacaatgcatgggc

SEQ ID NO: 15962 - DNA, 25 bp, Rattus norvegicus
aaatcctacccttcaatgcatgggc

SEQ ID NO: 15963 - DNA, 25 bp, Rattus norvegicus
aaatcctagagccagctgagactga

SEQ ID NO: 15964 - DNA, 25 bp, Rattus norvegicus
aaatcctagagcgagctgagactga

SEQ ID NO: 15965 - DNA, 25 bp, Rattus norvegicus
aaatcctagcctcatacgttatagt

SEQ ID NO: 15966 - DNA, 25 bp, Rattus norvegicus
aaatcctagcctgatacgttatagt

SEQ ID NO: 15967 - DNA, 25 bp, Rattus norvegicus
aaatcctagtttacagtccatgccc

SEQ ID NO: 15968 - DNA, 25 bp, Rattus norvegicus
aaatcctagtttctgttgcaccttg

SEQ ID NO: 15969 - DNA, 25 bp, Rattus norvegicus
aaatcctagtttgtgttgcaccttg

SEQ ID NO: 15970 - DNA, 25 bp, Rattus norvegicus
aaatcctagttttcagtccatgccc

SEQ ID NO: 15971 - DNA, 25 bp, Rattus norvegicus
aaatcctatgtgattcaattgtgac

SEQ ID NO: 15972 - DNA, 25 bp, Rattus norvegicus
aaatcctatgtgtttcaattgtgac

SEQ ID NO: 15973 - DNA, 25 bp, Rattus norvegicus
aaatcctattttctctcaccatttt

SEQ ID NO: 15974 - DNA, 25 bp, Rattus norvegicus
aaatcctattttgtctcaccatttt

SEQ ID NO: 15975 - DNA, 25 bp, Rattus norvegicus
aaatcctcaacaccccggaccagga

SEQ ID NO: 15976 - DNA, 25 bp, Rattus norvegicus
aaatcctcaacagcccggaccagga

SEQ ID NO: 15977 - DNA, 25 bp, Rattus norvegicus
aaatcctcactgcagttgaagagcc

SEQ ID NO: 15978 - DNA, 25 bp, Rattus norvegicus
aaatcctcactggagttgaagagcc

SEQ ID NO: 15979 - DNA, 25 bp, Rattus norvegicus
aaatcctcagctctcacaaggcagg

SEQ ID NO: 15980 - DNA, 25 bp, Rattus norvegicus
aaatcctcagctgtcacaaggcagg

SEQ ID NO: 15981 - DNA, 25 bp, Rattus norvegicus
aaatcctcaggtccctgattaccct

SEQ ID NO: 15982 - DNA, 25 bp, Rattus norvegicus
aaatcctcaggtgcctgattaccct

SEQ ID NO: 15983 - DNA, 25 bp, Rattus norvegicus
aaatcctcagttcatctggcttttc

SEQ ID NO: 15984 - DNA, 25 bp, Rattus norvegicus
aaatcctcagttgatctggcttttc

SEQ ID NO: 15985 - DNA, 25 bp, Rattus norvegicus
aaatcctcatctcctagttcatata

SEQ ID NO: 15986 - DNA, 25 bp, Rattus norvegicus
aaatcctcatctgctagttcatata

SEQ ID NO: 15987 - DNA, 25 bp, Rattus norvegicus
aaatcctccatgacctgattatact

SEQ ID NO: 15988 - DNA, 25 bp, Rattus norvegicus
aaatcctccatgtcctgattatact

SEQ ID NO: 15989 - DNA, 25 bp, Rattus norvegicus
aaatcctcccatactgtttgcaatg

SEQ ID NO: 15990 - DNA, 25 bp, Rattus norvegicus
aaatcctcccattctgtttgcaatg

SEQ ID NO: 15991 - DNA, 25 bp, Rattus norvegicus
aaatcctcctcgaaaacggatccat

SEQ ID NO: 15992 - DNA, 25 bp, Rattus norvegicus
aaatcctcctcgtaaacggatccat

SEQ ID NO: 15993 - DNA, 25 bp, Rattus norvegicus
aaatcctcctgactactctacatgg

SEQ ID NO: 15994 - DNA, 25 bp, Rattus norvegicus
aaatcctcctgagtactctacatgg

SEQ ID NO: 15995 - DNA, 25 bp, Rattus norvegicus
aaatcctcctgcagaatgagaactt

SEQ ID NO: 15996 - DNA, 25 bp, Rattus norvegicus
aaatcctcctgctgaatgagaactt

SEQ ID NO: 15997 - DNA, 25 bp, Rattus norvegicus
aaatcctcctgtaagatgggctctc

SEQ ID NO: 15998 - DNA, 25 bp, Rattus norvegicus
aaatcctcctgttagatgggctctc

SEQ ID NO: 15999 - DNA, 25 bp, Rattus norvegicus
aaatcctccttgctttcaatcatga

SEQ ID NO: 16000 - DNA, 25 bp, Rattus norvegicus
aaatcctccttggtttcaatcatga

SEQ ID NO: 16001 - DNA, 25 bp, Rattus norvegicus
aaatcctcgcatctaaccttggtac

SEQ ID NO: 16002 - DNA, 25 bp, Rattus norvegicus
aaatcctcgcatgtaaccttggtac

SEQ ID NO: 16003 - DNA, 25 bp, Rattus norvegicus
aaatcctctaccacgtgtatgtgac

SEQ ID NO: 16004 - DNA, 25 bp, Rattus norvegicus
aaatcctctacctcgtgtatgtgac

SEQ ID NO: 16005 - DNA, 25 bp, Rattus norvegicus
aaatcctctcgtcctgtgtttgact

SEQ ID NO: 16006 - DNA, 25 bp, Rattus norvegicus
aaatcctctcgtgctgtgtttgact

SEQ ID NO: 16007 - DNA, 25 bp, Rattus norvegicus
aaatcctctgttcaccaggtggtct

SEQ ID NO: 16008 - DNA, 25 bp, Rattus norvegicus
aaatcctctgttgaccaggtggtct

SEQ ID NO: 16009 - DNA, 25 bp, Rattus norvegicus
aaatcctctttccagatgatgctat

SEQ ID NO: 16010 - DNA, 25 bp, Rattus norvegicus
aaatcctctttcgagatgatgctat

SEQ ID NO: 16011 - DNA, 25 bp, Rattus norvegicus
aaatcctcttttcgtctgagaagtc

SEQ ID NO: 16012 - DNA, 25 bp, Rattus norvegicus
aaatcctcttttggtctgagaagtc

SEQ ID NO: 16013 - DNA, 25 bp, Rattus norvegicus
aaatcctgaagacagttcactgggt

SEQ ID NO: 16014 - DNA, 25 bp, Rattus norvegicus
aaatcctgaagagagttcactgggt

SEQ ID NO: 16015 - DNA, 25 bp, Rattus norvegicus
aaatcctgacccaggatatctcaac

SEQ ID NO: 16016 - DNA, 25 bp, Rattus norvegicus
aaatcctgaccccttttcttctgct

SEQ ID NO: 16017 - DNA, 25 bp, Rattus norvegicus
aaatcctgacccgttttcttctgct

SEQ ID NO: 16018 - DNA, 25 bp, Rattus norvegicus
aaatcctgaccctggatatctcaac

SEQ ID NO: 16019 - DNA, 25 bp, Rattus norvegicus
aaatcctgactcaaaacccttgtgt

SEQ ID NO: 16020 - DNA, 25 bp, Rattus norvegicus
aaatcctgactctaaacccttgtgt

SEQ ID NO: 16021 - DNA, 25 bp, Rattus norvegicus
aaatcctgagcgatgtgcagctgat

SEQ ID NO: 16022 - DNA, 25 bp, Rattus norvegicus
aaatcctgagcgttgtgcagctgat

SEQ ID NO: 16023 - DNA, 25 bp, Rattus norvegicus
aaatcctgagctaggctctgacaca

SEQ ID NO: 16024 - DNA, 25 bp, Rattus norvegicus
aaatcctgagcttggctctgacaca

SEQ ID NO: 16025 - DNA, 25 bp, Rattus norvegicus
aaatcctgccaaatcctttatcggg

SEQ ID NO: 16026 - DNA, 25 bp, Rattus norvegicus
aaatcctgccaattcctttatcggg

SEQ ID NO: 16027 - DNA, 25 bp, Rattus norvegicus
aaatcctgcccactgtgagcacgga

SEQ ID NO: 16028 - DNA, 25 bp, Rattus norvegicus
aaatcctgcccagtgtgagcacgga

SEQ ID NO: 16029 - DNA, 25 bp, Rattus norvegicus
aaatcctgctcaattcagacttgta

SEQ ID NO: 16030 - DNA, 25 bp, Rattus norvegicus
aaatcctgctcatttcagacttgta

SEQ ID NO: 16031 - DNA, 25 bp, Rattus norvegicus
aaatcctgctggactgatgcaagcc

SEQ ID NO: 16032 - DNA, 25 bp, Rattus norvegicus
aaatcctgctggtctgatgcaagcc

SEQ ID NO: 16033 - DNA, 25 bp, Rattus norvegicus
aaatcctgcttgctgaaacaacttg

SEQ ID NO: 16034 - DNA, 25 bp, Rattus norvegicus
aaatcctgcttgctggtcttgtgaa

SEQ ID NO: 16035 - DNA, 25 bp, Rattus norvegicus
aaatcctgcttggtgaaacaacttg

SEQ ID NO: 16036 - DNA, 25 bp, Rattus norvegicus
aaatcctgcttggtggtcttgtgaa

SEQ ID NO: 16037 - DNA, 25 bp, Rattus norvegicus
aaatcctggagcatgcggctaatgc

SEQ ID NO: 16038 - DNA, 25 bp, Rattus norvegicus
aaatcctggagcttgcggctaatgc

SEQ ID NO: 16039 - DNA, 25 bp, Rattus norvegicus
aaatcctggatcattatatctatga

SEQ ID NO: 16040 - DNA, 25 bp, Rattus norvegicus
aaatcctggatctttatatctatga

SEQ ID NO: 16041 - DNA, 25 bp, Rattus norvegicus
aaatcctggattctttacctctgtt

SEQ ID NO: 16042 - DNA, 25 bp, Rattus norvegicus
aaatcctggattgtttacctctgtt

SEQ ID NO: 16043 - DNA, 25 bp, Rattus norvegicus
aaatcctgggacaaagaactctcta

SEQ ID NO: 16044 - DNA, 25 bp, Rattus norvegicus
aaatcctgggactaagaactctcta

SEQ ID NO: 16045 - DNA, 25 bp, Rattus norvegicus
aaatcctgggtaacattgtttccta

SEQ ID NO: 16046 - DNA, 25 bp, Rattus norvegicus
aaatcctgggtatcattgtttccta

SEQ ID NO: 16047 - DNA, 25 bp, Rattus norvegicus
aaatcctgggttccattctgtgcat

SEQ ID NO: 16048 - DNA, 25 bp, Rattus norvegicus
aaatcctgggttgcattctgtgcat

SEQ ID NO: 16049 - DNA, 25 bp, Rattus norvegicus
aaatcctggtggaagtcgcaggccc

SEQ ID NO: 16050 - DNA, 25 bp, Rattus norvegicus
aaatcctggtggtagtcgcaggccc

SEQ ID NO: 16051 - DNA, 25 bp, Rattus norvegicus
aaatcctgtaaactgcggtcccaag

SEQ ID NO: 16052 - DNA, 25 bp, Rattus norvegicus
aaatcctgtaaagtgcggtcccaag

SEQ ID NO: 16053 - DNA, 25 bp, Rattus norvegicus
aaatcctgtatcagctgtggtggct

SEQ ID NO: 16054 - DNA, 25 bp, Rattus norvegicus
aaatcctgtatctgctgtggtggct

SEQ ID NO: 16055 - DNA, 25 bp, Rattus norvegicus
aaatcctgtgctcaagtgctggctg

SEQ ID NO: 16056 - DNA, 25 bp, Rattus norvegicus
aaatcctgtgctgaagtgctggctg

SEQ ID NO: 16057 - DNA, 25 bp, Rattus norvegicus
aaatcctgttccatgagatactgaa

SEQ ID NO: 16058 - DNA, 25 bp, Rattus norvegicus
aaatcctgttccttgagatactgaa

SEQ ID NO: 16059 - DNA, 25 bp, Rattus norvegicus
aaatcctgttttctggactgcctgg

SEQ ID NO: 16060 - DNA, 25 bp, Rattus norvegicus
aaatcctgttttgtggactgcctgg

SEQ ID NO: 16061 - DNA, 25 bp, Rattus norvegicus
aaatccttaggaactgggagcgaca

SEQ ID NO: 16062 - DNA, 25 bp, Rattus norvegicus
aaatccttaggatctgggagcgaca

SEQ ID NO: 16063 - DNA, 25 bp, Rattus norvegicus
aaatccttagggaacagtgcttata

SEQ ID NO: 16064 - DNA, 25 bp, Rattus norvegicus
aaatccttagggtacagtgcttata

SEQ ID NO: 16065 - DNA, 25 bp, Rattus norvegicus
aaatccttatgtagaccgggctgcc

SEQ ID NO: 16066 - DNA, 25 bp, Rattus norvegicus
aaatccttatgttgaccgggctgcc

SEQ ID NO: 16067 - DNA, 25 bp, Rattus norvegicus
aaatccttcaaactatggtatcact

SEQ ID NO: 16068 - DNA, 25 bp, Rattus norvegicus
aaatccttcaaagtatggtatcact

SEQ ID NO: 16069 - DNA, 25 bp, Rattus norvegicus
aaatccttcagacttcttccgcaga

SEQ ID NO: 16070 - DNA, 25 bp, Rattus norvegicus
aaatccttcagagttcttccgcaga

SEQ ID NO: 16071 - DNA, 25 bp, Rattus norvegicus
aaatccttcagtaggttgctcttgt

SEQ ID NO: 16072 - DNA, 25 bp, Rattus norvegicus
aaatccttcagttggttgctcttgt

SEQ ID NO: 16073 - DNA, 25 bp, Rattus norvegicus
aaatccttcccacgctttagcagaa

SEQ ID NO: 16074 - DNA, 25 bp, Rattus norvegicus
aaatccttcccaggctttagcagaa

SEQ ID NO: 16075 - DNA, 25 bp, Rattus norvegicus
aaatccttcttcacagataacactg

SEQ ID NO: 16076 - DNA, 25 bp, Rattus norvegicus
aaatccttcttctcagataacactg

SEQ ID NO: 16077 - DNA, 25 bp, Rattus norvegicus
aaatccttgaacacagctgaaacct

SEQ ID NO: 16078 - DNA, 25 bp, Rattus norvegicus
aaatccttgaactcagctgaaacct

SEQ ID NO: 16079 - DNA, 25 bp, Rattus norvegicus
aaatccttgcacaaaggaggctggg

SEQ ID NO: 16080 - DNA, 25 bp, Rattus norvegicus
aaatccttgcactaaggaggctggg

SEQ ID NO: 16081 - DNA, 25 bp, Rattus norvegicus
aaatccttgccaatggagggagcct

SEQ ID NO: 16082 - DNA, 25 bp, Rattus norvegicus
aaatccttgccattggagggagcct

SEQ ID NO: 16083 - DNA, 25 bp, Rattus norvegicus
aaatccttggcacggctcattgagc

SEQ ID NO: 16084 - DNA, 25 bp, Rattus norvegicus
aaatccttggcagggctcattgagc

SEQ ID NO: 16085 - DNA, 25 bp, Rattus norvegicus
aaatccttgtccagtgatcagcaca

SEQ ID NO: 16086 - DNA, 25 bp, Rattus norvegicus
aaatccttgtcctgtgatcagcaca

SEQ ID NO: 16087 - DNA, 25 bp, Rattus norvegicus
aaatccttgtctctcgtgctcctag

SEQ ID NO: 16088 - DNA, 25 bp, Rattus norvegicus
aaatccttgtctgtcgtgctcctag

SEQ ID NO: 16089 - DNA, 25 bp, Rattus norvegicus
aaatcctttaacagtttcgctctgt

SEQ ID NO: 16090 - DNA, 25 bp, Rattus norvegicus
aaatcctttaactgtttcgctctgt

SEQ ID NO: 16091 - DNA, 25 bp, Rattus norvegicus
aaatcctttggaaaacttgagttag

SEQ ID NO: 16092 - DNA, 25 bp, Rattus norvegicus
aaatcctttggataacttgagttag

SEQ ID NO: 16093 - DNA, 25 bp, Rattus norvegicus
aaatcctttgggatatccactgcct

SEQ ID NO: 16094 - DNA, 25 bp, Rattus norvegicus
aaatcctttgggttatccactgcct

SEQ ID NO: 16095 - DNA, 25 bp, Rattus norvegicus
aaatcctttgtccttttactgcatc

SEQ ID NO: 16096 - DNA, 25 bp, Rattus norvegicus
aaatcctttgtcgttttactgcatc

SEQ ID NO: 16097 - DNA, 25 bp, Rattus norvegicus
aaatccttttcgactgtgaattcta

SEQ ID NO: 16098 - DNA, 25 bp, Rattus norvegicus
aaatccttttcgtctgtgaattcta

SEQ ID NO: 16099 - DNA, 25 bp, Rattus norvegicus
aaatccttttctactcaagttgctt

SEQ ID NO: 16100 - DNA, 25 bp, Rattus norvegicus
aaatccttttcttctcaagttgctt

SEQ ID NO: 16101 - DNA, 25 bp, Rattus norvegicus
aaatccttttggagtttctctgaag

SEQ ID NO: 16102 - DNA, 25 bp, Rattus norvegicus
aaatccttttggtgtttctctgaag

SEQ ID NO: 16103 - DNA, 25 bp, Rattus norvegicus
aaatcctttttgctgaggctacccg

SEQ ID NO: 16104 - DNA, 25 bp, Rattus norvegicus
aaatcctttttggtgaggctacccg

SEQ ID NO: 16105 - DNA, 25 bp, Rattus norvegicus
aaatcgaaccccaaaactcaatgct

SEQ ID NO: 16106 - DNA, 25 bp, Rattus norvegicus
aaatcgaacccctaaactcaatgct

SEQ ID NO: 16107 - DNA, 25 bp, Rattus norvegicus
aaatcgacgttactttccatggcct

SEQ ID NO: 16108 - DNA, 25 bp, Rattus norvegicus
aaatcgacgttagtttccatggcct

SEQ ID NO: 16109 - DNA, 25 bp, Rattus norvegicus
aaatcgagagggatccacctcaaat

SEQ ID NO: 16110 - DNA, 25 bp, Rattus norvegicus
aaatcgagagggttccacctcaaat

SEQ ID NO: 16111 - DNA, 25 bp, Rattus norvegicus
aaatcgagcctaagcctgtaatggt

SEQ ID NO: 16112 - DNA, 25 bp, Rattus norvegicus
aaatcgagcctatgcctgtaatggt

SEQ ID NO: 16113 - DNA, 25 bp, Rattus norvegicus
aaatcgagcgctacttcagtgaagt

SEQ ID NO: 16114 - DNA, 25 bp, Rattus norvegicus
aaatcgagcgcttcttcagtgaagt

SEQ ID NO: 16115 - DNA, 25 bp, Rattus norvegicus
aaatcgaggtacctgggcactcaga

SEQ ID NO: 16116 - DNA, 25 bp, Rattus norvegicus
aaatcgaggtacgtgggcactcaga

SEQ ID NO: 16117 - DNA, 25 bp, Rattus norvegicus
aaatcgagtttgcaagcagacagct

SEQ ID NO: 16118 - DNA, 25 bp, Rattus norvegicus
aaatcgagtttggaagcagacagct

SEQ ID NO: 16119 - DNA, 25 bp, Rattus norvegicus
aaatcgatgatcagctttataaagt

SEQ ID NO: 16120 - DNA, 25 bp, Rattus norvegicus
aaatcgatgatctgctttataaagt

SEQ ID NO: 16121 - DNA, 25 bp, Rattus norvegicus
aaatcgatgttcagtgagggtcacc

SEQ ID NO: 16122 - DNA, 25 bp, Rattus norvegicus
aaatcgatgttctgtgagggtcacc

SEQ ID NO: 16123 - DNA, 25 bp, Rattus norvegicus
aaatcgattggcatggcttccatac

SEQ ID NO: 16124 - DNA, 25 bp, Rattus norvegicus
aaatcgattggcttggcttccatac

SEQ ID NO: 16125 - DNA, 25 bp, Rattus norvegicus
aaatcgcagagcaagcgaccccgga

SEQ ID NO: 16126 - DNA, 25 bp, Rattus norvegicus
aaatcgcagagctagcgaccccgga

SEQ ID NO: 16127 - DNA, 25 bp, Rattus norvegicus
aaatcgcagcgtaccgctgtctcgt

SEQ ID NO: 16128 - DNA, 25 bp, Rattus norvegicus
aaatcgcagcgttccgctgtctcgt

SEQ ID NO: 16129 - DNA, 25 bp, Rattus norvegicus
aaatcgcagctgatgaaggacccgc

SEQ ID NO: 16130 - DNA, 25 bp, Rattus norvegicus
aaatcgcagctgttgaaggacccgc

SEQ ID NO: 16131 - DNA, 25 bp, Rattus norvegicus
aaatcgcagcttacatgttcacggc

SEQ ID NO: 16132 - DNA, 25 bp, Rattus norvegicus
aaatcgcagctttcatgttcacggc

SEQ ID NO: 16133 - DNA, 25 bp, Rattus norvegicus
aaatcgcaggctactgagacctttc

SEQ ID NO: 16134 - DNA, 25 bp, Rattus norvegicus
aaatcgcaggcttctgagacctttc

SEQ ID NO: 16135 - DNA, 25 bp, Rattus norvegicus
aaatcgcatcgaccctagaacctga

SEQ ID NO: 16136 - DNA, 25 bp, Rattus norvegicus
aaatcgcatcgagcctagaacctga

SEQ ID NO: 16137 - DNA, 25 bp, Rattus norvegicus
aaatcgcatcttaagactgcactca

SEQ ID NO: 16138 - DNA, 25 bp, Rattus norvegicus
aaatcgcatctttagactgcactca

SEQ ID NO: 16139 - DNA, 25 bp, Rattus norvegicus
aaatcgcatgctcttaggtcttctc

SEQ ID NO: 16140 - DNA, 25 bp, Rattus norvegicus
aaatcgcatgctgttaggtcttctc

SEQ ID NO: 16141 - DNA, 25 bp, Rattus norvegicus
aaatcgccgttgatgcccctgaaag

SEQ ID NO: 16142 - DNA, 25 bp, Rattus norvegicus
aaatcgccgttgttgcccctgaaag

SEQ ID NO: 16143 - DNA, 25 bp, Rattus norvegicus
aaatcgcctcttagcttggaactga

SEQ ID NO: 16144 - DNA, 25 bp, Rattus norvegicus
aaatcgcctctttgcttggaactga

SEQ ID NO: 16145 - DNA, 25 bp, Rattus norvegicus
aaatcgcgtttgatatctgactctc

SEQ ID NO: 16146 - DNA, 25 bp, Rattus norvegicus
aaatcgcgtttgttatctgactctc

SEQ ID NO: 16147 - DNA, 25 bp, Rattus norvegicus
aaatcgctaacaactgctccgaatc

SEQ ID NO: 16148 - DNA, 25 bp, Rattus norvegicus
aaatcgctaacatctgctccgaatc

SEQ ID NO: 16149 - DNA, 25 bp, Rattus norvegicus
aaatcgctggtgcatataacacatg

SEQ ID NO: 16150 - DNA, 25 bp, Rattus norvegicus
aaatcgctggtggatataacacatg

SEQ ID NO: 16151 - DNA, 25 bp, Rattus norvegicus
aaatcgctgtgtagctgtcaggacc

SEQ ID NO: 16152 - DNA, 25 bp, Rattus norvegicus
aaatcgctgtgttgctgtcaggacc

SEQ ID NO: 16153 - DNA, 25 bp, Rattus norvegicus
aaatcggaagttcttatctgtgaaa

SEQ ID NO: 16154 - DNA, 25 bp, Rattus norvegicus
aaatcggaagttgttatctgtgaaa

SEQ ID NO: 16155 - DNA, 25 bp, Rattus norvegicus
aaatcggacattctactctttcaca

SEQ ID NO: 16156 - DNA, 25 bp, Rattus norvegicus
aaatcggacattgtactctttcaca

SEQ ID NO: 16157 - DNA, 25 bp, Rattus norvegicus
aaatcggagtaactgtttgtgacag

SEQ ID NO: 16158 - DNA, 25 bp, Rattus norvegicus
aaatcggagtaagtgtttgtgacag

SEQ ID NO: 16159 - DNA, 25 bp, Rattus norvegicus
aaatcggcaggtaagctctgcgcta

SEQ ID NO: 16160 - DNA, 25 bp, Rattus norvegicus
aaatcggcaggttagctctgcgcta

SEQ ID NO: 16161 - DNA, 25 bp, Rattus norvegicus
aaatcggcagtcaggctgcgtggtt

SEQ ID NO: 16162 - DNA, 25 bp, Rattus norvegicus
aaatcggcagtctggctgcgtggtt

SEQ ID NO: 16163 - DNA, 25 bp, Rattus norvegicus
aaatcggccagcagtttcgaacatt

SEQ ID NO: 16164 - DNA, 25 bp, Rattus norvegicus
aaatcggccagctgtttcgaacatt

SEQ ID NO: 16165 - DNA, 25 bp, Rattus norvegicus
aaatcggccttcaacagtggtgcgg

SEQ ID NO: 16166 - DNA, 25 bp, Rattus norvegicus
aaatcggccttctacagtggtgcgg

SEQ ID NO: 16167 - DNA, 25 bp, Rattus norvegicus
aaatcggctactaagtctgctgcgg

SEQ ID NO: 16168 - DNA, 25 bp, Rattus norvegicus
aaatcggctacttagtctgctgcgg

SEQ ID NO: 16169 - DNA, 25 bp, Rattus norvegicus
aaatcgggctagctctctatgtcca

SEQ ID NO: 16170 - DNA, 25 bp, Rattus norvegicus
aaatcgggctaggtctctatgtcca

SEQ ID NO: 16171 - DNA, 25 bp, Rattus norvegicus
aaatcggtacttcgtcacctgtcct

SEQ ID NO: 16172 - DNA, 25 bp, Rattus norvegicus
aaatcggtacttggtcacctgtcct

SEQ ID NO: 16173 - DNA, 25 bp, Rattus norvegicus
aaatcggtatttctctctcagcagc

SEQ ID NO: 16174 - DNA, 25 bp, Rattus norvegicus
aaatcggtatttgtctctcagcagc

SEQ ID NO: 16175 - DNA, 25 bp, Rattus norvegicus
aaatcggtcaaaccagtgccaggcc

SEQ ID NO: 16176 - DNA, 25 bp, Rattus norvegicus
aaatcggtcaaagcagtgccaggcc

SEQ ID NO: 16177 - DNA, 25 bp, Rattus norvegicus
aaatcggtcttgactggtggtggca

SEQ ID NO: 16178 - DNA, 25 bp, Rattus norvegicus
aaatcggtcttgtctggtggtggca

SEQ ID NO: 16179 - DNA, 25 bp, Rattus norvegicus
aaatcggtgtgcctttacctaggct

SEQ ID NO: 16180 - DNA, 25 bp, Rattus norvegicus
aaatcggtgtgcgtttacctaggct

SEQ ID NO: 16181 - DNA, 25 bp, Rattus norvegicus
aaatcgtaactaccttatcctgaag

SEQ ID NO: 16182 - DNA, 25 bp, Rattus norvegicus
aaatcgtaactagcttatcctgaag

SEQ ID NO: 16183 - DNA, 25 bp, Rattus norvegicus
aaatcgtacatgcacttttctttga

SEQ ID NO: 16184 - DNA, 25 bp, Rattus norvegicus
aaatcgtacatggacttttctttga

SEQ ID NO: 16185 - DNA, 25 bp, Rattus norvegicus
aaatcgtcaggccatactggcggtc

SEQ ID NO: 16186 - DNA, 25 bp, Rattus norvegicus
aaatcgtcaggcgatactggcggtc

SEQ ID NO: 16187 - DNA, 25 bp, Rattus norvegicus
aaatcgtccacacgcaggtttctgg

SEQ ID NO: 16188 - DNA, 25 bp, Rattus norvegicus
aaatcgtccacaggcaggtttctgg

SEQ ID NO: 16189 - DNA, 25 bp, Rattus norvegicus
aaatcgtcggcgctgttcttcggga

SEQ ID NO: 16190 - DNA, 25 bp, Rattus norvegicus
aaatcgtcggcggtgttcttcggga

SEQ ID NO: 16191 - DNA, 25 bp, Rattus norvegicus
aaatcgtctgcgactatattgcctt

SEQ ID NO: 16192 - DNA, 25 bp, Rattus norvegicus
aaatcgtctgcgtctatattgcctt

SEQ ID NO: 16193 - DNA, 25 bp, Rattus norvegicus
aaatcgtgaaacacagccgccctgt

SEQ ID NO: 16194 - DNA, 25 bp, Rattus norvegicus
aaatcgtgaaactcagccgccctgt

SEQ ID NO: 16195 - DNA, 25 bp, Rattus norvegicus
aaatcgtgtcatcctgaggtccaga

SEQ ID NO: 16196 - DNA, 25 bp, Rattus norvegicus
aaatcgtgtcatgctgaggtccaga

SEQ ID NO: 16197 - DNA, 25 bp, Rattus norvegicus
aaatcgttcagcattgacagttaag

SEQ ID NO: 16198 - DNA, 25 bp, Rattus norvegicus
aaatcgttcagctttgacagttaag

SEQ ID NO: 16199 - DNA, 25 bp, Rattus norvegicus
aaatcgttcttcagcctattctttg

SEQ ID NO: 16200 - DNA, 25 bp, Rattus norvegicus
aaatcgttcttctgcctattctttg

SEQ ID NO: 16201 - DNA, 25 bp, Rattus norvegicus
aaatcgtttatgcagcttggcgcgg

SEQ ID NO: 16202 - DNA, 25 bp, Rattus norvegicus
aaatcgtttatggagcttggcgcgg

SEQ ID NO: 16203 - DNA, 25 bp, Rattus norvegicus
aaatcgtttcttaactctgctagag

SEQ ID NO: 16204 - DNA, 25 bp, Rattus norvegicus
aaatcgtttctttactctgctagag

SEQ ID NO: 16205 - DNA, 25 bp, Rattus norvegicus
aaatctaaaaatcacttggcacttt

SEQ ID NO: 16206 - DNA, 25 bp, Rattus norvegicus
aaatctaaaaatgacttggcacttt

SEQ ID NO: 16207 - DNA, 25 bp, Rattus norvegicus
aaatctaaagataccctccgagcct

SEQ ID NO: 16208 - DNA, 25 bp, Rattus norvegicus
aaatctaaagattccctccgagcct

SEQ ID NO: 16209 - DNA, 25 bp, Rattus norvegicus
aaatctaaatataccttcccacgca

SEQ ID NO: 16210 - DNA, 25 bp, Rattus norvegicus
aaatctaaatattccttcccacgca

SEQ ID NO: 16211 - DNA, 25 bp, Rattus norvegicus
aaatctaaccagagcccatcactgc

SEQ ID NO: 16212 - DNA, 25 bp, Rattus norvegicus
aaatctaaccagtgcccatcactgc

SEQ ID NO: 16213 - DNA, 25 bp, Rattus norvegicus
aaatctaaccgcacaagtgtttaag

SEQ ID NO: 16214 - DNA, 25 bp, Rattus norvegicus
aaatctaaccgctcaagtgtttaag

SEQ ID NO: 16215 - DNA, 25 bp, Rattus norvegicus
aaatctaagctcaggaagcgccctg

SEQ ID NO: 16216 - DNA, 25 bp, Rattus norvegicus
aaatctaagctctggaagcgccctg

SEQ ID NO: 16217 - DNA, 25 bp, Rattus norvegicus
aaatctaatattatgtctgtggaat

SEQ ID NO: 16218 - DNA, 25 bp, Rattus norvegicus
aaatctaatattttgtctgtggaat

SEQ ID NO: 16219 - DNA, 25 bp, Rattus norvegicus
aaatctaatctccaggtttcagtga

SEQ ID NO: 16220 - DNA, 25 bp, Rattus norvegicus
aaatctaatctcgaggtttcagtga

SEQ ID NO: 16221 - DNA, 25 bp, Rattus norvegicus
aaatctaatcttctgactgtcttca

SEQ ID NO: 16222 - DNA, 25 bp, Rattus norvegicus
aaatctaatcttgtgactgtcttca

SEQ ID NO: 16223 - DNA, 25 bp, Rattus norvegicus
aaatctacaaatcctttcctctcag

SEQ ID NO: 16224 - DNA, 25 bp, Rattus norvegicus
aaatctacaaatgctttcctctcag

SEQ ID NO: 16225 - DNA, 25 bp, Rattus norvegicus
aaatctacaggcatctttacatcat

SEQ ID NO: 16226 - DNA, 25 bp, Rattus norvegicus
aaatctacaggcttctttacatcat

SEQ ID NO: 16227 - DNA, 25 bp, Rattus norvegicus
aaatctacatctatactgtcctcac

SEQ ID NO: 16228 - DNA, 25 bp, Rattus norvegicus
aaatctacatctttactgtcctcac

SEQ ID NO: 16229 - DNA, 25 bp, Rattus norvegicus
aaatctacctgcattgtctagccgt

SEQ ID NO: 16230 - DNA, 25 bp, Rattus norvegicus
aaatctacctgctttgtctagccgt

SEQ ID NO: 16231 - DNA, 25 bp, Rattus norvegicus
aaatctacgagtaccagggctgtca

SEQ ID NO: 16232 - DNA, 25 bp, Rattus norvegicus
aaatctacgagttccagggctgtca

SEQ ID NO: 16233 - DNA, 25 bp, Rattus norvegicus
aaatctactcagcttaacggaaatg

SEQ ID NO: 16234 - DNA, 25 bp, Rattus norvegicus
aaatctactcaggttaacggaaatg

SEQ ID NO: 16235 - DNA, 25 bp, Rattus norvegicus
aaatctactcccagaacaagtgtga

SEQ ID NO: 16236 - DNA, 25 bp, Rattus norvegicus
aaatctactccctgaacaagtgtga

SEQ ID NO: 16237 - DNA, 25 bp, Rattus norvegicus
aaatctactgccagtcatgcgaagc

SEQ ID NO: 16238 - DNA, 25 bp, Rattus norvegicus
aaatctactgcctgtcatgcgaagc

SEQ ID NO: 16239 - DNA, 25 bp, Rattus norvegicus
aaatctactgtcaaacaacctgata

SEQ ID NO: 16240 - DNA, 25 bp, Rattus norvegicus
aaatctactgtctaacaacctgata

SEQ ID NO: 16241 - DNA, 25 bp, Rattus norvegicus
aaatctagactactggttcttccca

SEQ ID NO: 16242 - DNA, 25 bp, Rattus norvegicus
aaatctagactagtggttcttccca

SEQ ID NO: 16243 - DNA, 25 bp, Rattus norvegicus
aaatctagactgcttgacccaccca

SEQ ID NO: 16244 - DNA, 25 bp, Rattus norvegicus
aaatctagactggttgacccaccca

SEQ ID NO: 16245 - DNA, 25 bp, Rattus norvegicus
aaatctagcactcctgtgtacctcg

SEQ ID NO: 16246 - DNA, 25 bp, Rattus norvegicus
aaatctagcactgctgtgtacctcg

SEQ ID NO: 16247 - DNA, 25 bp, Rattus norvegicus
aaatctagcccactctactctgtag

SEQ ID NO: 16248 - DNA, 25 bp, Rattus norvegicus
aaatctagcccagtctactctgtag

SEQ ID NO: 16249 - DNA, 25 bp, Rattus norvegicus
aaatctaggcgcacttttcctcgtt

SEQ ID NO: 16250 - DNA, 25 bp, Rattus norvegicus
aaatctaggcgctcttttcctcgtt

SEQ ID NO: 16251 - DNA, 25 bp, Rattus norvegicus
aaatctaggctgaagctcggggctc

SEQ ID NO: 16252 - DNA, 25 bp, Rattus norvegicus
aaatctaggctgtagctcggggctc

SEQ ID NO: 16253 - DNA, 25 bp, Rattus norvegicus
aaatctagggtaccaatgtgaccaa

SEQ ID NO: 16254 - DNA, 25 bp, Rattus norvegicus
aaatctagggtagcaatgtgaccaa

SEQ ID NO: 16255 - DNA, 25 bp, Rattus norvegicus
aaatctagggtcatggtacctgtga

SEQ ID NO: 16256 - DNA, 25 bp, Rattus norvegicus
aaatctagggtcttggtacctgtga

SEQ ID NO: 16257 - DNA, 25 bp, Rattus norvegicus
aaatctaggttcattccagtccaag

SEQ ID NO: 16258 - DNA, 25 bp, Rattus norvegicus
aaatctaggttctttccagtccaag

SEQ ID NO: 16259 - DNA, 25 bp, Rattus norvegicus
aaatctagtctcacgtgttggagaa

SEQ ID NO: 16260 - DNA, 25 bp, Rattus norvegicus
aaatctagtctctcgtgttggagaa

SEQ ID NO: 16261 - DNA, 25 bp, Rattus norvegicus
aaatctatctggctcttctatgaaa

SEQ ID NO: 16262 - DNA, 25 bp, Rattus norvegicus
aaatctatctgggtcttctatgaaa

SEQ ID NO: 16263 - DNA, 25 bp, Rattus norvegicus
aaatctatgacactgggctcactgc

SEQ ID NO: 16264 - DNA, 25 bp, Rattus norvegicus
aaatctatgacagtgggctcactgc

SEQ ID NO: 16265 - DNA, 25 bp, Rattus norvegicus
aaatctatgttgaaggcttggccct

SEQ ID NO: 16266 - DNA, 25 bp, Rattus norvegicus
aaatctatgttgtaggcttggccct

SEQ ID NO: 16267 - DNA, 25 bp, Rattus norvegicus
aaatctattagtactcaacgtcata

SEQ ID NO: 16268 - DNA, 25 bp, Rattus norvegicus
aaatctattagtactgaacgggata

SEQ ID NO: 16269 - DNA, 25 bp, Rattus norvegicus
aaatctattagttctcaacgtcata

SEQ ID NO: 16270 - DNA, 25 bp, Rattus norvegicus
aaatctattagttctgaacgggata

SEQ ID NO: 16271 - DNA, 25 bp, Rattus norvegicus
aaatctatttctctctgggtgggct

SEQ ID NO: 16272 - DNA, 25 bp, Rattus norvegicus
aaatctatttctgtctgggtgggct

SEQ ID NO: 16273 - DNA, 25 bp, Rattus norvegicus
aaatctatttgcacttctttctgta

SEQ ID NO: 16274 - DNA, 25 bp, Rattus norvegicus
aaatctatttgctcttctttctgta

SEQ ID NO: 16275 - DNA, 25 bp, Rattus norvegicus
aaatctcaaactcggcactctttcg

SEQ ID NO: 16276 - DNA, 25 bp, Rattus norvegicus
aaatctcaaactgggcactctttcg

SEQ ID NO: 16277 - DNA, 25 bp, Rattus norvegicus
aaatctcaagtcctcgctggacaaa

SEQ ID NO: 16278 - DNA, 25 bp, Rattus norvegicus
aaatctcaagtcgtcgctggacaaa

SEQ ID NO: 16279 - DNA, 25 bp, Rattus norvegicus
aaatctcacaataccaaggttcaag

SEQ ID NO: 16280 - DNA, 25 bp, Rattus norvegicus
aaatctcacaattccaaggttcaag

SEQ ID NO: 16281 - DNA, 25 bp, Rattus norvegicus
aaatctcacatgcttgtatcggata

SEQ ID NO: 16282 - DNA, 25 bp, Rattus norvegicus
aaatctcacatggttgtatcggata

SEQ ID NO: 16283 - DNA, 25 bp, Rattus norvegicus
aaatctcaccatcccacaatgattg

SEQ ID NO: 16284 - DNA, 25 bp, Rattus norvegicus
aaatctcaccatgccacaatgattg

SEQ ID NO: 16285 - DNA, 25 bp, Rattus norvegicus
aaatctcacgggaggctcactttgg

SEQ ID NO: 16286 - DNA, 25 bp, Rattus norvegicus
aaatctcacgggtggctcactttgg

SEQ ID NO: 16287 - DNA, 25 bp, Rattus norvegicus
aaatctcactatctactgtatgggc

SEQ ID NO: 16288 - DNA, 25 bp, Rattus norvegicus
aaatctcactatgtactgtatgggc

SEQ ID NO: 16289 - DNA, 25 bp, Rattus norvegicus
aaatctcactctaccaacaatgtct

SEQ ID NO: 16290 - DNA, 25 bp, Rattus norvegicus
aaatctcactcttccaacaatgtct

SEQ ID NO: 16291 - DNA, 25 bp, Rattus norvegicus
aaatctcacttgctggctctggctg

SEQ ID NO: 16292 - DNA, 25 bp, Rattus norvegicus
aaatctcacttggtggctctggctg

SEQ ID NO: 16293 - DNA, 25 bp, Rattus norvegicus
aaatctcagactaatcctgctacag

SEQ ID NO: 16294 - DNA, 25 bp, Rattus norvegicus
aaatctcagacttatcctgctacag

SEQ ID NO: 16295 - DNA, 25 bp, Rattus norvegicus
aaatctcagatcagcccagcttggc

SEQ ID NO: 16296 - DNA, 25 bp, Rattus norvegicus
aaatctcagatctgcccagcttggc

SEQ ID NO: 16297 - DNA, 25 bp, Rattus norvegicus
aaatctcagcacacagcggcagaag

SEQ ID NO: 16298 - DNA, 25 bp, Rattus norvegicus
aaatctcagcactcagcggcagaag

SEQ ID NO: 16299 - DNA, 25 bp, Rattus norvegicus
aaatctcaggacctgtttgtctaaa

SEQ ID NO: 16300 - DNA, 25 bp, Rattus norvegicus
aaatctcaggacgtgtttgtctaaa

SEQ ID NO: 16301 - DNA, 25 bp, Rattus norvegicus
aaatctcaggcactcgagaacgcaa

SEQ ID NO: 16302 - DNA, 25 bp, Rattus norvegicus
aaatctcaggcagtcgagaacgcaa

SEQ ID NO: 16303 - DNA, 25 bp, Rattus norvegicus
aaatctcaggccaccatgctcgtat

SEQ ID NO: 16304 - DNA, 25 bp, Rattus norvegicus
aaatctcaggccagcagagcaacac

SEQ ID NO: 16305 - DNA, 25 bp, Rattus norvegicus
aaatctcaggcctccatgctcgtat

SEQ ID NO: 16306 - DNA, 25 bp, Rattus norvegicus
aaatctcaggcctgcagagcaacac

SEQ ID NO: 16307 - DNA, 25 bp, Rattus norvegicus
aaatctcaggttctatgcacagaac

SEQ ID NO: 16308 - DNA, 25 bp, Rattus norvegicus
aaatctcaggttgtatgcacagaac

SEQ ID NO: 16309 - DNA, 25 bp, Rattus norvegicus
aaatctcagtacatgaaggctccat

SEQ ID NO: 16310 - DNA, 25 bp, Rattus norvegicus
aaatctcagtacttgaaggctccat

SEQ ID NO: 16311 - DNA, 25 bp, Rattus norvegicus
aaatctcataaacaccagcttcctg

SEQ ID NO: 16312 - DNA, 25 bp, Rattus norvegicus
aaatctcataaagaccagcttcctg

SEQ ID NO: 16313 - DNA, 25 bp, Rattus norvegicus
aaatctcataccaatgccctttgga

SEQ ID NO: 16314 - DNA, 25 bp, Rattus norvegicus
aaatctcatacctatgccctttgga

SEQ ID NO: 16315 - DNA, 25 bp, Rattus norvegicus
aaatctcatgaacgtttttcctgaa

SEQ ID NO: 16316 - DNA, 25 bp, Rattus norvegicus
aaatctcatgaaggtttttcctgaa

SEQ ID NO: 16317 - DNA, 25 bp, Rattus norvegicus
aaatctcatggccattcacatcact

SEQ ID NO: 16318 - DNA, 25 bp, Rattus norvegicus
aaatctcatggcgattcacatcact

SEQ ID NO: 16319 - DNA, 25 bp, Rattus norvegicus
aaatctcatgtcctgtgacttcctg

SEQ ID NO: 16320 - DNA, 25 bp, Rattus norvegicus
aaatctcatgtcgtgtgacttcctg

SEQ ID NO: 16321 - DNA, 25 bp, Rattus norvegicus
aaatctccactaaggtctctgttac

SEQ ID NO: 16322 - DNA, 25 bp, Rattus norvegicus
aaatctccactatggtctctgttac

SEQ ID NO: 16323 - DNA, 25 bp, Rattus norvegicus
aaatctccactccatgtaactactt

SEQ ID NO: 16324 - DNA, 25 bp, Rattus norvegicus
aaatctccactcgatgtaactactt

SEQ ID NO: 16325 - DNA, 25 bp, Rattus norvegicus
aaatctccacttaattccattcata

SEQ ID NO: 16326 - DNA, 25 bp, Rattus norvegicus
aaatctccactttattccattcata

SEQ ID NO: 16327 - DNA, 25 bp, Rattus norvegicus
aaatctccagagctaccattgaaat

SEQ ID NO: 16328 - DNA, 25 bp, Rattus norvegicus
aaatctccagaggtaccattgaaat

SEQ ID NO: 16329 - DNA, 25 bp, Rattus norvegicus
aaatctccagcaactgtggatcgcc

SEQ ID NO: 16330 - DNA, 25 bp, Rattus norvegicus
aaatctccagcatctgtggatcgcc

SEQ ID NO: 16331 - DNA, 25 bp, Rattus norvegicus
aaatctccagctcccgctgatgagg

SEQ ID NO: 16332 - DNA, 25 bp, Rattus norvegicus
aaatctccagctgccgctgatgagg

SEQ ID NO: 16333 - DNA, 25 bp, Rattus norvegicus
aaatctccagtcagatcctgggcag

SEQ ID NO: 16334 - DNA, 25 bp, Rattus norvegicus
aaatctccagtctgatcctgggcag

SEQ ID NO: 16335 - DNA, 25 bp, Rattus norvegicus
aaatctccatagagaccagcaggag

SEQ ID NO: 16336 - DNA, 25 bp, Rattus norvegicus
aaatctccatagtgaccagcaggag

SEQ ID NO: 16337 - DNA, 25 bp, Rattus norvegicus
aaatctccatcaatatcatctcgac

SEQ ID NO: 16338 - DNA, 25 bp, Rattus norvegicus
aaatctccatcattatcatctcgac

SEQ ID NO: 16339 - DNA, 25 bp, Rattus norvegicus
aaatctccatttccttgttgggcag

SEQ ID NO: 16340 - DNA, 25 bp, Rattus norvegicus
aaatctccatttgcttgttgggcag

SEQ ID NO: 16341 - DNA, 25 bp, Rattus norvegicus
aaatctcccagaagcattcatgagg

SEQ ID NO: 16342 - DNA, 25 bp, Rattus norvegicus
aaatctcccagatgcattcatgagg

SEQ ID NO: 16343 - DNA, 25 bp, Rattus norvegicus
aaatctccgaaactgtccactgacg

SEQ ID NO: 16344 - DNA, 25 bp, Rattus norvegicus
aaatctccgaaagtgtccactgacg

SEQ ID NO: 16345 - DNA, 25 bp, Rattus norvegicus
aaatctcctgggataactatggatg

SEQ ID NO: 16346 - DNA, 25 bp, Rattus norvegicus
aaatctcctgggttaactatggatg

SEQ ID NO: 16347 - DNA, 25 bp, Rattus norvegicus
aaatctcgctgactgtggtttgtac

SEQ ID NO: 16348 - DNA, 25 bp, Rattus norvegicus
aaatctcgctgagtgtggtttgtac

SEQ ID NO: 16349 - DNA, 25 bp, Rattus norvegicus
aaatctctagttcttgctttttatg

SEQ ID NO: 16350 - DNA, 25 bp, Rattus norvegicus
aaatctctagttgttgctttttatg

SEQ ID NO: 16351 - DNA, 25 bp, Rattus norvegicus
aaatctctcaataaaggcctcctgc

SEQ ID NO: 16352 - DNA, 25 bp, Rattus norvegicus
aaatctctcaattaaggcctcctgc

SEQ ID NO: 16353 - DNA, 25 bp, Rattus norvegicus
aaatctctcagaatcaagctgttat

SEQ ID NO: 16354 - DNA, 25 bp, Rattus norvegicus
aaatctctcagattcaagctgttat

SEQ ID NO: 16355 - DNA, 25 bp, Rattus norvegicus
aaatctctcatgaatctgaaggctt

SEQ ID NO: 16356 - DNA, 25 bp, Rattus norvegicus
aaatctctcatgtatctgaaggctt

SEQ ID NO: 16357 - DNA, 25 bp, Rattus norvegicus
aaatctctccatcgagcgtcttcat

SEQ ID NO: 16358 - DNA, 25 bp, Rattus norvegicus
aaatctctccatggagcgtcttcat

SEQ ID NO: 16359 - DNA, 25 bp, Rattus norvegicus
aaatctctctcaacatgacacagcc

SEQ ID NO: 16360 - DNA, 25 bp, Rattus norvegicus
aaatctctctcacctctaaatattc

SEQ ID NO: 16361 - DNA, 25 bp, Rattus norvegicus
aaatctctctcagctctaaatattc

SEQ ID NO: 16362 - DNA, 25 bp, Rattus norvegicus
aaatctctctcatcatgacacagcc

SEQ ID NO: 16363 - DNA, 25 bp, Rattus norvegicus
aaatctctctgacgatgccacagta

SEQ ID NO: 16364 - DNA, 25 bp, Rattus norvegicus
aaatctctctgaggatgccacagta

SEQ ID NO: 16365 - DNA, 25 bp, Rattus norvegicus
aaatctctctggctgctttgggaag

SEQ ID NO: 16366 - DNA, 25 bp, Rattus norvegicus
aaatctctctgggtgctttgggaag

SEQ ID NO: 16367 - DNA, 25 bp, Rattus norvegicus
aaatctctgatcaacactccagact

SEQ ID NO: 16368 - DNA, 25 bp, Rattus norvegicus
aaatctctgatctacactccagact

SEQ ID NO: 16369 - DNA, 25 bp, Rattus norvegicus
aaatctctgcgtaggtagaagacca

SEQ ID NO: 16370 - DNA, 25 bp, Rattus norvegicus
aaatctctgcgttggtagaagacca

SEQ ID NO: 16371 - DNA, 25 bp, Rattus norvegicus
aaatctctggccctaaaccgtgctc

SEQ ID NO: 16372 - DNA, 25 bp, Rattus norvegicus
aaatctctggccgtaaaccgtgctc

SEQ ID NO: 16373 - DNA, 25 bp, Rattus norvegicus
aaatctctgtagagtgtttcaagga

SEQ ID NO: 16374 - DNA, 25 bp, Rattus norvegicus
aaatctctgtagtgtgtttcaagga

SEQ ID NO: 16375 - DNA, 25 bp, Rattus norvegicus
aaatctctgttacaataccagcccc

SEQ ID NO: 16376 - DNA, 25 bp, Rattus norvegicus
aaatctctgttagaataccagcccc

SEQ ID NO: 16377 - DNA, 25 bp, Rattus norvegicus
aaatctcttatgacagcccttttag

SEQ ID NO: 16378 - DNA, 25 bp, Rattus norvegicus
aaatctcttatgtcagcccttttag

SEQ ID NO: 16379 - DNA, 25 bp, Rattus norvegicus
aaatctcttcacagccagcatggaa

SEQ ID NO: 16380 - DNA, 25 bp, Rattus norvegicus
aaatctcttcactgccagcatggaa

SEQ ID NO: 16381 - DNA, 25 bp, Rattus norvegicus
aaatctcttcagcttttcaactgtt

SEQ ID NO: 16382 - DNA, 25 bp, Rattus norvegicus
aaatctcttcaggttttcaactgtt

SEQ ID NO: 16383 - DNA, 25 bp, Rattus norvegicus
aaatctcttgctaggcatcgtgaca

SEQ ID NO: 16384 - DNA, 25 bp, Rattus norvegicus
aaatctcttgctatagcctcctaaa

SEQ ID NO: 16385 - DNA, 25 bp, Rattus norvegicus
aaatctcttgcttggcatcgtgaca

SEQ ID NO: 16386 - DNA, 25 bp, Rattus norvegicus
aaatctcttgctttagcctcctaaa

SEQ ID NO: 16387 - DNA, 25 bp, Rattus norvegicus
aaatctcttgtacggctaagcttag

SEQ ID NO: 16388 - DNA, 25 bp, Rattus norvegicus
aaatctcttgtagggctaagcttag

SEQ ID NO: 16389 - DNA, 25 bp, Rattus norvegicus
aaatctcttgtgaggttttaatatc

SEQ ID NO: 16390 - DNA, 25 bp, Rattus norvegicus
aaatctcttgtgtggttttaatatc

SEQ ID NO: 16391 - DNA, 25 bp, Rattus norvegicus
aaatctctttccagattacttaaag

SEQ ID NO: 16392 - DNA, 25 bp, Rattus norvegicus
aaatctctttcctgattacttaaag

SEQ ID NO: 16393 - DNA, 25 bp, Rattus norvegicus
aaatctcttttaaaagccttcaggg

SEQ ID NO: 16394 - DNA, 25 bp, Rattus norvegicus
aaatctcttttataagccttcaggg

SEQ ID NO: 16395 - DNA, 25 bp, Rattus norvegicus
aaatctgaaatgaatcttgctaagt

SEQ ID NO: 16396 - DNA, 25 bp, Rattus norvegicus
aaatctgaaatgtatcttgctaagt

SEQ ID NO: 16397 - DNA, 25 bp, Rattus norvegicus
aaatctgaagtgacgttgctctgtg

SEQ ID NO: 16398 - DNA, 25 bp, Rattus norvegicus
aaatctgaagtgtcgttgctctgtg

SEQ ID NO: 16399 - DNA, 25 bp, Rattus norvegicus
aaatctgaattactgtctgccctgg

SEQ ID NO: 16400 - DNA, 25 bp, Rattus norvegicus
aaatctgaattagtgtctgccctgg

SEQ ID NO: 16401 - DNA, 25 bp, Rattus norvegicus
aaatctgacatcaccgttctgaatt

SEQ ID NO: 16402 - DNA, 25 bp, Rattus norvegicus
aaatctgacatctccgttctgaatt

SEQ ID NO: 16403 - DNA, 25 bp, Rattus norvegicus
aaatctgacattcttccttgggttg

SEQ ID NO: 16404 - DNA, 25 bp, Rattus norvegicus
aaatctgacattgttccttgggttg

SEQ ID NO: 16405 - DNA, 25 bp, Rattus norvegicus
aaatctgaccagagccaaggcacag

SEQ ID NO: 16406 - DNA, 25 bp, Rattus norvegicus
aaatctgaccagtgccaaggcacag

SEQ ID NO: 16407 - DNA, 25 bp, Rattus norvegicus
aaatctgactacacagctttccaca

SEQ ID NO: 16408 - DNA, 25 bp, Rattus norvegicus
aaatctgactactcagctttccaca

SEQ ID NO: 16409 - DNA, 25 bp, Rattus norvegicus
aaatctgactccaggtcttgaaaaa

SEQ ID NO: 16410 - DNA, 25 bp, Rattus norvegicus
aaatctgactcctggtcttgaaaaa

SEQ ID NO: 16411 - DNA, 25 bp, Rattus norvegicus
aaatctgacttgaacctgactcgag

SEQ ID NO: 16412 - DNA, 25 bp, Rattus norvegicus
aaatctgacttgtacctgactcgag

SEQ ID NO: 16413 - DNA, 25 bp, Rattus norvegicus
aaatctgagcatcgcagttctacca

SEQ ID NO: 16414 - DNA, 25 bp, Rattus norvegicus
aaatctgagcatggcagttctacca

SEQ ID NO: 16415 - DNA, 25 bp, Rattus norvegicus
aaatctgagcctacgtctgctttct

SEQ ID NO: 16416 - DNA, 25 bp, Rattus norvegicus
aaatctgagccttcgtctgctttct

SEQ ID NO: 16417 - DNA, 25 bp, Rattus norvegicus
aaatctgaggctagctctgtcttta

SEQ ID NO: 16418 - DNA, 25 bp, Rattus norvegicus
aaatctgaggcttgctctgtcttta

SEQ ID NO: 16419 - DNA, 25 bp, Rattus norvegicus
aaatctgagtcaatccctggttaag

SEQ ID NO: 16420 - DNA, 25 bp, Rattus norvegicus
aaatctgagtcattccctggttaag

SEQ ID NO: 16421 - DNA, 25 bp, Rattus norvegicus
aaatctgagtctctgctaatgagct

SEQ ID NO: 16422 - DNA, 25 bp, Rattus norvegicus
aaatctgagtctgtgctaatgagct

SEQ ID NO: 16423 - DNA, 25 bp, Rattus norvegicus
aaatctgatgataccctgctttgtg

SEQ ID NO: 16424 - DNA, 25 bp, Rattus norvegicus
aaatctgatgattccctgctttgtg

SEQ ID NO: 16425 - DNA, 25 bp, Rattus norvegicus
aaatctgattaaaggctgctcggag

SEQ ID NO: 16426 - DNA, 25 bp, Rattus norvegicus
aaatctgattaatggctgctcggag

SEQ ID NO: 16427 - DNA, 25 bp, Rattus norvegicus
aaatctgattctcgttagtcttttt

SEQ ID NO: 16428 - DNA, 25 bp, Rattus norvegicus
aaatctgattctggttagtcttttt

SEQ ID NO: 16429 - DNA, 25 bp, Rattus norvegicus
aaatctgcaacaactctgaactctg

SEQ ID NO: 16430 - DNA, 25 bp, Rattus norvegicus
aaatctgcaacatctctgaactctg

SEQ ID NO: 16431 - DNA, 25 bp, Rattus norvegicus
aaatctgcaatacggctgcttccat

SEQ ID NO: 16432 - DNA, 25 bp, Rattus norvegicus
aaatctgcaatagggctgcttccat

SEQ ID NO: 16433 - DNA, 25 bp, Rattus norvegicus
aaatctgcagatactgtgaggcaca

SEQ ID NO: 16434 - DNA, 25 bp, Rattus norvegicus
aaatctgcagattctgtgaggcaca

SEQ ID NO: 16435 - DNA, 25 bp, Rattus norvegicus
aaatctgcagccatctttgtcattg

SEQ ID NO: 16436 - DNA, 25 bp, Rattus norvegicus
aaatctgcagccttctttgtcattg

SEQ ID NO: 16437 - DNA, 25 bp, Rattus norvegicus
aaatctgccatgcttgcttttttct

SEQ ID NO: 16438 - DNA, 25 bp, Rattus norvegicus
aaatctgccatggttgcttttttct

SEQ ID NO: 16439 - DNA, 25 bp, Rattus norvegicus
aaatctgccctgcagtagagtaccc

SEQ ID NO: 16440 - DNA, 25 bp, Rattus norvegicus
aaatctgccctggagtagagtaccc

SEQ ID NO: 16441 - DNA, 25 bp, Rattus norvegicus
aaatctgcctacaaccaccggataa

SEQ ID NO: 16442 - DNA, 25 bp, Rattus norvegicus
aaatctgcctactaccaccggataa

SEQ ID NO: 16443 - DNA, 25 bp, Rattus norvegicus
aaatctgcctctctaggattgggat

SEQ ID NO: 16444 - DNA, 25 bp, Rattus norvegicus
aaatctgcctctgtaggattgggat

SEQ ID NO: 16445 - DNA, 25 bp, Rattus norvegicus
aaatctgcctgtatctcatactgaa

SEQ ID NO: 16446 - DNA, 25 bp, Rattus norvegicus
aaatctgcctgtttctcatactgaa

SEQ ID NO: 16447 - DNA, 25 bp, Rattus norvegicus
aaatctgcgctgaataaagagctta

SEQ ID NO: 16448 - DNA, 25 bp, Rattus norvegicus
aaatctgcgctgtataaagagctta

SEQ ID NO: 16449 - DNA, 25 bp, Rattus norvegicus
aaatctgctctaagccccaaaaatg

SEQ ID NO: 16450 - DNA, 25 bp, Rattus norvegicus
aaatctgctctatgccccaaaaatg

SEQ ID NO: 16451 - DNA, 25 bp, Rattus norvegicus
aaatctgctgatcgaacggaactga

SEQ ID NO: 16452 - DNA, 25 bp, Rattus norvegicus
aaatctgctgatggaacggaactga

SEQ ID NO: 16453 - DNA, 25 bp, Rattus norvegicus
aaatctgctgtcatctgtggagtta

SEQ ID NO: 16454 - DNA, 25 bp, Rattus norvegicus
aaatctgctgtcttctgtggagtta

SEQ ID NO: 16455 - DNA, 25 bp, Rattus norvegicus
aaatctgcttctatgagctgtagaa

SEQ ID NO: 16456 - DNA, 25 bp, Rattus norvegicus
aaatctgcttctttgagctgtagaa

SEQ ID NO: 16457 - DNA, 25 bp, Rattus norvegicus
aaatctgcttgtaatgcaatgctgg

SEQ ID NO: 16458 - DNA, 25 bp, Rattus norvegicus
aaatctgcttgttatgcaatgctgg

SEQ ID NO: 16459 - DNA, 25 bp, Rattus norvegicus
aaatctgctttgactcagggcccag

SEQ ID NO: 16460 - DNA, 25 bp, Rattus norvegicus
aaatctgctttgtctcagggcccag

SEQ ID NO: 16461 - DNA, 25 bp, Rattus norvegicus
aaatctgcttttctggtttaccatt

SEQ ID NO: 16462 - DNA, 25 bp, Rattus norvegicus
aaatctgcttttgtggtttaccatt

SEQ ID NO: 16463 - DNA, 25 bp, Rattus norvegicus
aaatctggacccaaatctatgcaag

SEQ ID NO: 16464 - DNA, 25 bp, Rattus norvegicus
aaatctggaccctaatctatgcaag

SEQ ID NO: 16465 - DNA, 25 bp, Rattus norvegicus
aaatctggagatcttttcgccgagt

SEQ ID NO: 16466 - DNA, 25 bp, Rattus norvegicus
aaatctggagatgttttcgccgagt

SEQ ID NO: 16467 - DNA, 25 bp, Rattus norvegicus
aaatctggagtgcagcttcgccctc

SEQ ID NO: 16468 - DNA, 25 bp, Rattus norvegicus
aaatctggagtggagcttcgccctc

SEQ ID NO: 16469 - DNA, 25 bp, Rattus norvegicus
aaatctggatcacgtctatgaccgg

SEQ ID NO: 16470 - DNA, 25 bp, Rattus norvegicus
aaatctggatcaggtctatgaccgg

SEQ ID NO: 16471 - DNA, 25 bp, Rattus norvegicus
aaatctgggcaaattgaaacaatcc

SEQ ID NO: 16472 - DNA, 25 bp, Rattus norvegicus
aaatctgggcaatttgaaacaatcc

SEQ ID NO: 16473 - DNA, 25 bp, Rattus norvegicus
aaatctgggtggatgagccatgtgt

SEQ ID NO: 16474 - DNA, 25 bp, Rattus norvegicus
aaatctgggtggttgagccatgtgt

SEQ ID NO: 16475 - DNA, 25 bp, Rattus norvegicus
aaatctggtgacaggctttttcttc

SEQ ID NO: 16476 - DNA, 25 bp, Rattus norvegicus
aaatctggtgactggctttttcttc

SEQ ID NO: 16477 - DNA, 25 bp, Rattus norvegicus
aaatctggttcaatgtttcggctcc

SEQ ID NO: 16478 - DNA, 25 bp, Rattus norvegicus
aaatctggttcattgtttcggctcc

SEQ ID NO: 16479 - DNA, 25 bp, Rattus norvegicus
aaatctggtttcattctcttggatg

SEQ ID NO: 16480 - DNA, 25 bp, Rattus norvegicus
aaatctggtttctttctcttggatg

SEQ ID NO: 16481 - DNA, 25 bp, Rattus norvegicus
aaatctggttttagcttttcatctc

SEQ ID NO: 16482 - DNA, 25 bp, Rattus norvegicus
aaatctggtttttgcttttcatctc

SEQ ID NO: 16483 - DNA, 25 bp, Rattus norvegicus
aaatctgtacgacataccccagcca

SEQ ID NO: 16484 - DNA, 25 bp, Rattus norvegicus
aaatctgtacgagataccccagcca

SEQ ID NO: 16485 - DNA, 25 bp, Rattus norvegicus
aaatctgtagccacccaggaaaagg

SEQ ID NO: 16486 - DNA, 25 bp, Rattus norvegicus
aaatctgtagcctcccaggaaaagg

SEQ ID NO: 16487 - DNA, 25 bp, Rattus norvegicus
aaatctgtatttcgaaaaacctgca

SEQ ID NO: 16488 - DNA, 25 bp, Rattus norvegicus
aaatctgtatttggaaaaacctgca

SEQ ID NO: 16489 - DNA, 25 bp, Rattus norvegicus
aaatctgtcacaccgtttttcacgt

SEQ ID NO: 16490 - DNA, 25 bp, Rattus norvegicus
aaatctgtcacactctggtgtcagg

SEQ ID NO: 16491 - DNA, 25 bp, Rattus norvegicus
aaatctgtcacagcgtttttcacgt

SEQ ID NO: 16492 - DNA, 25 bp, Rattus norvegicus
aaatctgtcacagtctggtgtcagg

SEQ ID NO: 16493 - DNA, 25 bp, Rattus norvegicus
aaatctgtcagtatctttctaatgg

SEQ ID NO: 16494 - DNA, 25 bp, Rattus norvegicus
aaatctgtcagtttctttctaatgg

SEQ ID NO: 16495 - DNA, 25 bp, Rattus norvegicus
aaatctgtccatcttggcttggtga

SEQ ID NO: 16496 - DNA, 25 bp, Rattus norvegicus
aaatctgtccatgttggcttggtga

SEQ ID NO: 16497 - DNA, 25 bp, Rattus norvegicus
aaatctgtcccaaacgtccactatc

SEQ ID NO: 16498 - DNA, 25 bp, Rattus norvegicus
aaatctgtcccactgtatcttcctg

SEQ ID NO: 16499 - DNA, 25 bp, Rattus norvegicus
aaatctgtcccagtgtatcttcctg

SEQ ID NO: 16500 - DNA, 25 bp, Rattus norvegicus
aaatctgtcccatacgtccactatc

SEQ ID NO: 16501 - DNA, 25 bp, Rattus norvegicus
aaatctgtcctgaggcatgcaaaag

SEQ ID NO: 16502 - DNA, 25 bp, Rattus norvegicus
aaatctgtcctgatggtaacccagt

SEQ ID NO: 16503 - DNA, 25 bp, Rattus norvegicus
aaatctgtcctgtggcatgcaaaag

SEQ ID NO: 16504 - DNA, 25 bp, Rattus norvegicus
aaatctgtcctgttggtaacccagt

SEQ ID NO: 16505 - DNA, 25 bp, Rattus norvegicus
aaatctgtctgaaactatgcctata

SEQ ID NO: 16506 - DNA, 25 bp, Rattus norvegicus
aaatctgtctgatactatgcctata

SEQ ID NO: 16507 - DNA, 25 bp, Rattus norvegicus
aaatctgtctggcagtgtttcccta

SEQ ID NO: 16508 - DNA, 25 bp, Rattus norvegicus
aaatctgtctgggagtgtttcccta

SEQ ID NO: 16509 - DNA, 25 bp, Rattus norvegicus
aaatctgtctgtacagagtgtgcaa

SEQ ID NO: 16510 - DNA, 25 bp, Rattus norvegicus
aaatctgtctgttcagagtgtgcaa

SEQ ID NO: 16511 - DNA, 25 bp, Rattus norvegicus
aaatctgtcttgaggcctgagctgc

SEQ ID NO: 16512 - DNA, 25 bp, Rattus norvegicus
aaatctgtcttgtggcctgagctgc

SEQ ID NO: 16513 - DNA, 25 bp, Rattus norvegicus
aaatctgtctttcgctttgtcttca

SEQ ID NO: 16514 - DNA, 25 bp, Rattus norvegicus
aaatctgtctttggctttgtcttca

SEQ ID NO: 16515 - DNA, 25 bp, Rattus norvegicus
aaatctgtggtgagcgcattcttca

SEQ ID NO: 16516 - DNA, 25 bp, Rattus norvegicus
aaatctgtggtgtgcgcattcttca

SEQ ID NO: 16517 - DNA, 25 bp, Rattus norvegicus
aaatctgtgtacatcatgggctgtc

SEQ ID NO: 16518 - DNA, 25 bp, Rattus norvegicus
aaatctgtgtacttcatgggctgtc

SEQ ID NO: 16519 - DNA, 25 bp, Rattus norvegicus
aaatctgtgtgaaccatttgcatgg

SEQ ID NO: 16520 - DNA, 25 bp, Rattus norvegicus
aaatctgtgtgacccaaggtgaggt

SEQ ID NO: 16521 - DNA, 25 bp, Rattus norvegicus
aaatctgtgtgagccaaggtgaggt

SEQ ID NO: 16522 - DNA, 25 bp, Rattus norvegicus
aaatctgtgtgatccatttgcatgg

SEQ ID NO: 16523 - DNA, 25 bp, Rattus norvegicus
aaatctgtgtggatcaatgtagtgt

SEQ ID NO: 16524 - DNA, 25 bp, Rattus norvegicus
aaatctgtgtggttcaatgtagtgt

SEQ ID NO: 16525 - DNA, 25 bp, Rattus norvegicus
aaatctgtgttcctaattggcaaat

SEQ ID NO: 16526 - DNA, 25 bp, Rattus norvegicus
aaatctgtgttcgtaattggcaaat

SEQ ID NO: 16527 - DNA, 25 bp, Rattus norvegicus
aaatctgtgtttccaatctctctct

SEQ ID NO: 16528 - DNA, 25 bp, Rattus norvegicus
aaatctgtgtttgcaatctctctct

SEQ ID NO: 16529 - DNA, 25 bp, Rattus norvegicus
aaatctgttactatctgatcacccc

SEQ ID NO: 16530 - DNA, 25 bp, Rattus norvegicus
aaatctgttactttctgatcacccc

SEQ ID NO: 16531 - DNA, 25 bp, Rattus norvegicus
aaatctgttcgtcctgtgtcgctga

SEQ ID NO: 16532 - DNA, 25 bp, Rattus norvegicus
aaatctgttcgtgctgtgtcgctga

SEQ ID NO: 16533 - DNA, 25 bp, Rattus norvegicus
aaatctgttctactcactggtcaac

SEQ ID NO: 16534 - DNA, 25 bp, Rattus norvegicus
aaatctgttctagtcactggtcaac

SEQ ID NO: 16535 - DNA, 25 bp, Rattus norvegicus
aaatctgttgcaaagaccctcttga

SEQ ID NO: 16536 - DNA, 25 bp, Rattus norvegicus
aaatctgttgcatagaccctcttga

SEQ ID NO: 16537 - DNA, 25 bp, Rattus norvegicus
aaatctgttgccaaggacctgggtc

SEQ ID NO: 16538 - DNA, 25 bp, Rattus norvegicus
aaatctgttgcctaggacctgggtc

SEQ ID NO: 16539 - DNA, 25 bp, Rattus norvegicus
aaatctgttgctagtagcagggcaa

SEQ ID NO: 16540 - DNA, 25 bp, Rattus norvegicus
aaatctgttgctcggaaaagtaacg

SEQ ID NO: 16541 - DNA, 25 bp, Rattus norvegicus
aaatctgttgctgggaaaagtaacg

SEQ ID NO: 16542 - DNA, 25 bp, Rattus norvegicus
aaatctgttgcttgtagcagggcaa

SEQ ID NO: 16543 - DNA, 25 bp, Rattus norvegicus
aaatctgttgttattactgtggagt

SEQ ID NO: 16544 - DNA, 25 bp, Rattus norvegicus
aaatctgttgtttttactgtggagt

SEQ ID NO: 16545 - DNA, 25 bp, Rattus norvegicus
aaatctgtttagacacttacccact

SEQ ID NO: 16546 - DNA, 25 bp, Rattus norvegicus
aaatctgtttagagcctctttgtat

SEQ ID NO: 16547 - DNA, 25 bp, Rattus norvegicus
aaatctgtttagtcacttacccact

SEQ ID NO: 16548 - DNA, 25 bp, Rattus norvegicus
aaatctgtttagtgcctctttgtat

SEQ ID NO: 16549 - DNA, 25 bp, Rattus norvegicus
aaatctgttttaatgtgtccacaac

SEQ ID NO: 16550 - DNA, 25 bp, Rattus norvegicus
aaatctgttttattgtgtccacaac

SEQ ID NO: 16551 - DNA, 25 bp, Rattus norvegicus
aaatctgttttgactcctctaatgt

SEQ ID NO: 16552 - DNA, 25 bp, Rattus norvegicus
aaatctgttttgtctcctctaatgt

SEQ ID NO: 16553 - DNA, 25 bp, Rattus norvegicus
aaatctgtttttcctggtttgtgtg

SEQ ID NO: 16554 - DNA, 25 bp, Rattus norvegicus
aaatctgtttttgctggtttgtgtg

SEQ ID NO: 16555 - DNA, 25 bp, Rattus norvegicus
aaatcttaaccactaccacagttca

SEQ ID NO: 16556 - DNA, 25 bp, Rattus norvegicus
aaatcttaaccagtaccacagttca

SEQ ID NO: 16557 - DNA, 25 bp, Rattus norvegicus
aaatcttacccacctgtctaagcgc

SEQ ID NO: 16558 - DNA, 25 bp, Rattus norvegicus
aaatcttacccacctttggtttgct

SEQ ID NO: 16559 - DNA, 25 bp, Rattus norvegicus
aaatcttacccagctgtctaagcgc

SEQ ID NO: 16560 - DNA, 25 bp, Rattus norvegicus
aaatcttacccagctttggtttgct

SEQ ID NO: 16561 - DNA, 25 bp, Rattus norvegicus
aaatcttactttctccgtgacgatg

SEQ ID NO: 16562 - DNA, 25 bp, Rattus norvegicus
aaatcttactttgtccgtgacgatg

SEQ ID NO: 16563 - DNA, 25 bp, Rattus norvegicus
aaatcttagttcatgcctgtgggat

SEQ ID NO: 16564 - DNA, 25 bp, Rattus norvegicus
aaatcttagttcttgcctgtgggat

SEQ ID NO: 16565 - DNA, 25 bp, Rattus norvegicus
aaatcttcaactctgttgcctgtta

SEQ ID NO: 16566 - DNA, 25 bp, Rattus norvegicus
aaatcttcaactgtgttgcctgtta

SEQ ID NO: 16567 - DNA, 25 bp, Rattus norvegicus
aaatcttcccttaacgtagcaggct

SEQ ID NO: 16568 - DNA, 25 bp, Rattus norvegicus
aaatcttccctttacgtagcaggct

SEQ ID NO: 16569 - DNA, 25 bp, Rattus norvegicus
aaatcttccgtacagccggctgtgg

SEQ ID NO: 16570 - DNA, 25 bp, Rattus norvegicus
aaatcttccgtagagccggctgtgg

SEQ ID NO: 16571 - DNA, 25 bp, Rattus norvegicus
aaatcttcctatctaatcttccagt

SEQ ID NO: 16572 - DNA, 25 bp, Rattus norvegicus
aaatcttcctatgtaatcttccagt

SEQ ID NO: 16573 - DNA, 25 bp, Rattus norvegicus
aaatcttccttaaagtagcacctta

SEQ ID NO: 16574 - DNA, 25 bp, Rattus norvegicus
aaatcttccttatagtagcacctta

SEQ ID NO: 16575 - DNA, 25 bp, Rattus norvegicus
aaatcttcggtactttcctgctaat

SEQ ID NO: 16576 - DNA, 25 bp, Rattus norvegicus
aaatcttcggtagtttcctgctaat

SEQ ID NO: 16577 - DNA, 25 bp, Rattus norvegicus
aaatcttcgtgcaaactggactcct

SEQ ID NO: 16578 - DNA, 25 bp, Rattus norvegicus
aaatcttcgtgctaactggactcct

SEQ ID NO: 16579 - DNA, 25 bp, Rattus norvegicus
aaatcttctagaactacttcaccca

SEQ ID NO: 16580 - DNA, 25 bp, Rattus norvegicus
aaatcttctagatctacttcaccca

SEQ ID NO: 16581 - DNA, 25 bp, Rattus norvegicus
aaatcttctatccttgtcttttgaa

SEQ ID NO: 16582 - DNA, 25 bp, Rattus norvegicus
aaatcttctatcgttgtcttttgaa

SEQ ID NO: 16583 - DNA, 25 bp, Rattus norvegicus
aaatcttctatgctgttgactccaa

SEQ ID NO: 16584 - DNA, 25 bp, Rattus norvegicus
aaatcttctatggtgttgactccaa

SEQ ID NO: 16585 - DNA, 25 bp, Rattus norvegicus
aaatcttctctcaggaaattgactt

SEQ ID NO: 16586 - DNA, 25 bp, Rattus norvegicus
aaatcttctctcagtgccttaagtc

SEQ ID NO: 16587 - DNA, 25 bp, Rattus norvegicus
aaatcttctctctggaaattgactt

SEQ ID NO: 16588 - DNA, 25 bp, Rattus norvegicus
aaatcttctctctgtgccttaagtc

SEQ ID NO: 16589 - DNA, 25 bp, Rattus norvegicus
aaatcttcttgacctgttccttaaa

SEQ ID NO: 16590 - DNA, 25 bp, Rattus norvegicus
aaatcttcttgagctgttccttaaa

SEQ ID NO: 16591 - DNA, 25 bp, Rattus norvegicus
aaatcttgcactctattctgttaaa

SEQ ID NO: 16592 - DNA, 25 bp, Rattus norvegicus
aaatcttgcactgtattctgttaaa

SEQ ID NO: 16593 - DNA, 25 bp, Rattus norvegicus
aaatcttgcgttatgcttatactta

SEQ ID NO: 16594 - DNA, 25 bp, Rattus norvegicus
aaatcttgcgttttgcttatactta

SEQ ID NO: 16595 - DNA, 25 bp, Rattus norvegicus
aaatcttggaagactttctgaacaa

SEQ ID NO: 16596 - DNA, 25 bp, Rattus norvegicus
aaatcttggaagtctttctgaacaa

SEQ ID NO: 16597 - DNA, 25 bp, Rattus norvegicus
aaatcttggctccagatcttcaata

SEQ ID NO: 16598 - DNA, 25 bp, Rattus norvegicus
aaatcttggctcgagatcttcaata

SEQ ID NO: 16599 - DNA, 25 bp, Rattus norvegicus
aaatcttgggagctgaagcaggact

SEQ ID NO: 16600 - DNA, 25 bp, Rattus norvegicus
aaatcttgggaggtgaagcaggact

SEQ ID NO: 16601 - DNA, 25 bp, Rattus norvegicus
aaatcttggtgtaccgcttcagaaa

SEQ ID NO: 16602 - DNA, 25 bp, Rattus norvegicus
aaatcttggtgttccgcttcagaaa

SEQ ID NO: 16603 - DNA, 25 bp, Rattus norvegicus
aaatcttggttcatgctgcacagga

SEQ ID NO: 16604 - DNA, 25 bp, Rattus norvegicus
aaatcttggttcttgctgcacagga

SEQ ID NO: 16605 - DNA, 25 bp, Rattus norvegicus
aaatcttgtcgtccagggtttatga

SEQ ID NO: 16606 - DNA, 25 bp, Rattus norvegicus
aaatcttgtcgtgcagggtttatga

SEQ ID NO: 16607 - DNA, 25 bp, Rattus norvegicus
aaatcttgtctcctgtgagctctca

SEQ ID NO: 16608 - DNA, 25 bp, Rattus norvegicus
aaatcttgtctcgtgtgagctctca

SEQ ID NO: 16609 - DNA, 25 bp, Rattus norvegicus
aaatcttgtggcagctcagaaggga

SEQ ID NO: 16610 - DNA, 25 bp, Rattus norvegicus
aaatcttgtggctgctcagaaggga

SEQ ID NO: 16611 - DNA, 25 bp, Rattus norvegicus
aaatcttgtttccagccacacattt

SEQ ID NO: 16612 - DNA, 25 bp, Rattus norvegicus
aaatcttgtttcgagccacacattt

SEQ ID NO: 16613 - DNA, 25 bp, Rattus norvegicus
aaatctttacatacgtgggttcagg

SEQ ID NO: 16614 - DNA, 25 bp, Rattus norvegicus
aaatctttacattcgtgggttcagg

SEQ ID NO: 16615 - DNA, 25 bp, Rattus norvegicus
aaatctttcatccatacctgtgcat

SEQ ID NO: 16616 - DNA, 25 bp, Rattus norvegicus
aaatctttcatcgatacctgtgcat

SEQ ID NO: 16617 - DNA, 25 bp, Rattus norvegicus
aaatctttccagctgccagtggaga

SEQ ID NO: 16618 - DNA, 25 bp, Rattus norvegicus
aaatctttccaggtgccagtggaga

SEQ ID NO: 16619 - DNA, 25 bp, Rattus norvegicus
aaatctttcccaatcctgtcaacac

SEQ ID NO: 16620 - DNA, 25 bp, Rattus norvegicus
aaatctttcccattcctgtcaacac

SEQ ID NO: 16621 - DNA, 25 bp, Rattus norvegicus
aaatctttctaaactgctatgcttg

SEQ ID NO: 16622 - DNA, 25 bp, Rattus norvegicus
aaatctttctaatctgctatgcttg

SEQ ID NO: 16623 - DNA, 25 bp, Rattus norvegicus
aaatctttgcagcatcaaggctcaa

SEQ ID NO: 16624 - DNA, 25 bp, Rattus norvegicus
aaatctttgcaggatcaaggctcaa

SEQ ID NO: 16625 - DNA, 25 bp, Rattus norvegicus
aaatctttggatatgcaagtgtaaa

SEQ ID NO: 16626 - DNA, 25 bp, Rattus norvegicus
aaatctttggatttgcaagtgtaaa

SEQ ID NO: 16627 - DNA, 25 bp, Rattus norvegicus
aaatctttgttaccttcgctgtgaa

SEQ ID NO: 16628 - DNA, 25 bp, Rattus norvegicus
aaatctttgttagcttcgctgtgaa

SEQ ID NO: 16629 - DNA, 25 bp, Rattus norvegicus
aaatctttgttcatgtctggatgta

SEQ ID NO: 16630 - DNA, 25 bp, Rattus norvegicus
aaatctttgttcttgtctggatgta

SEQ ID NO: 16631 - DNA, 25 bp, Rattus norvegicus
aaatcttttaccaggtctgtgtaca

SEQ ID NO: 16632 - DNA, 25 bp, Rattus norvegicus
aaatcttttacctggtctgtgtaca

SEQ ID NO: 16633 - DNA, 25 bp, Rattus norvegicus
aaatcttttgtgatccctgcatcaa

SEQ ID NO: 16634 - DNA, 25 bp, Rattus norvegicus
aaatcttttgtgttccctgcatcaa

SEQ ID NO: 16635 - DNA, 25 bp, Rattus norvegicus
aaatgaaaactcacagctgtcccca

SEQ ID NO: 16636 - DNA, 25 bp, Rattus norvegicus
aaatgaaaactctcagctgtcccca

SEQ ID NO: 16637 - DNA, 25 bp, Rattus norvegicus
aaatgaaaagcacccctcctgcgaa

SEQ ID NO: 16638 - DNA, 25 bp, Rattus norvegicus
aaatgaaaagcagccctcctgcgaa

SEQ ID NO: 16639 - DNA, 25 bp, Rattus norvegicus
aaatgaaaatttaatcctgctggga

SEQ ID NO: 16640 - DNA, 25 bp, Rattus norvegicus
aaatgaaaattttatcctgctggga

SEQ ID NO: 16641 - DNA, 25 bp, Rattus norvegicus
aaatgaaacacactggcctcctacc

SEQ ID NO: 16642 - DNA, 25 bp, Rattus norvegicus
aaatgaaacacagtggcctcctacc

SEQ ID NO: 16643 - DNA, 25 bp, Rattus norvegicus
aaatgaaaccgcacacagtgaatga

SEQ ID NO: 16644 - DNA, 25 bp, Rattus norvegicus
aaatgaaaccgctcacagtgaatga

SEQ ID NO: 16645 - DNA, 25 bp, Rattus norvegicus
aaatgaaaccgtccatctagtctgc

SEQ ID NO: 16646 - DNA, 25 bp, Rattus norvegicus
aaatgaaaccgtgcatctagtctgc

SEQ ID NO: 16647 - DNA, 25 bp, Rattus norvegicus
aaatgaaagcgcctctcattccttc

SEQ ID NO: 16648 - DNA, 25 bp, Rattus norvegicus
aaatgaaagcgcgtctcattccttc

SEQ ID NO: 16649 - DNA, 25 bp, Rattus norvegicus
aaatgaaagctcagaggccccttct

SEQ ID NO: 16650 - DNA, 25 bp, Rattus norvegicus
aaatgaaagctctgaggccccttct

SEQ ID NO: 16651 - DNA, 25 bp, Rattus norvegicus
aaatgaaaggccatgtgcctgccct

SEQ ID NO: 16652 - DNA, 25 bp, Rattus norvegicus
aaatgaaaggccttgtgcctgccct

SEQ ID NO: 16653 - DNA, 25 bp, Rattus norvegicus
aaatgaaatgctcttccgactgctg

SEQ ID NO: 16654 - DNA, 25 bp, Rattus norvegicus
aaatgaaatgctgttccgactgctg

SEQ ID NO: 16655 - DNA, 25 bp, Rattus norvegicus
aaatgaacactccactatcacttcc

SEQ ID NO: 16656 - DNA, 25 bp, Rattus norvegicus
aaatgaacactcgactatcacttcc

SEQ ID NO: 16657 - DNA, 25 bp, Rattus norvegicus
aaatgaacaggacccacaggaggcc

SEQ ID NO: 16658 - DNA, 25 bp, Rattus norvegicus
aaatgaacaggagccacaggaggcc

SEQ ID NO: 16659 - DNA, 25 bp, Rattus norvegicus
aaatgaacatgtagaccagtgagat

SEQ ID NO: 16660 - DNA, 25 bp, Rattus norvegicus
aaatgaacatgttgaccagtgagat

SEQ ID NO: 16661 - DNA, 25 bp, Rattus norvegicus
aaatgaaccgatatctagggtcaga

SEQ ID NO: 16662 - DNA, 25 bp, Rattus norvegicus
aaatgaaccgatttctagggtcaga

SEQ ID NO: 16663 - DNA, 25 bp, Rattus norvegicus
aaatgaacctcactctggagccgga

SEQ ID NO: 16664 - DNA, 25 bp, Rattus norvegicus
aaatgaacctcagtctggagccgga

SEQ ID NO: 16665 - DNA, 25 bp, Rattus norvegicus
aaatgaaccttgaatctcggaggat

SEQ ID NO: 16666 - DNA, 25 bp, Rattus norvegicus
aaatgaaccttgtatctcggaggat

SEQ ID NO: 16667 - DNA, 25 bp, Rattus norvegicus
aaatgaactaacatctcctcggctg

SEQ ID NO: 16668 - DNA, 25 bp, Rattus norvegicus
aaatgaactaacttctcctcggctg

SEQ ID NO: 16669 - DNA, 25 bp, Rattus norvegicus
aaatgaactacccagcatctaggcc

SEQ ID NO: 16670 - DNA, 25 bp, Rattus norvegicus
aaatgaactaccgagcatctaggcc

SEQ ID NO: 16671 - DNA, 25 bp, Rattus norvegicus
aaatgaactcacactggtcttcacc

SEQ ID NO: 16672 - DNA, 25 bp, Rattus norvegicus
aaatgaactcactctggtcttcacc

SEQ ID NO: 16673 - DNA, 25 bp, Rattus norvegicus
aaatgaactcggagctctgcagcgt

SEQ ID NO: 16674 - DNA, 25 bp, Rattus norvegicus
aaatgaactcggctgttccgcttgc

SEQ ID NO: 16675 - DNA, 25 bp, Rattus norvegicus
aaatgaactcgggtgttccgcttgc

SEQ ID NO: 16676 - DNA, 25 bp, Rattus norvegicus
aaatgaactcggtgctctgcagcgt

SEQ ID NO: 16677 - DNA, 25 bp, Rattus norvegicus
aaatgaactctgaccgcttcacata

SEQ ID NO: 16678 - DNA, 25 bp, Rattus norvegicus
aaatgaactctgtccgcttcacata

SEQ ID NO: 16679 - DNA, 25 bp, Rattus norvegicus
aaatgaacttttccccagtcaccct

SEQ ID NO: 16680 - DNA, 25 bp, Rattus norvegicus
aaatgaacttttgcccagtcaccct

SEQ ID NO: 16681 - DNA, 25 bp, Rattus norvegicus
aaatgaagcaccagttcggaaaaga

SEQ ID NO: 16682 - DNA, 25 bp, Rattus norvegicus
aaatgaagcacctgttcggaaaaga

SEQ ID NO: 16683 - DNA, 25 bp, Rattus norvegicus
aaatgaagcgttcaggcacctcagc

SEQ ID NO: 16684 - DNA, 25 bp, Rattus norvegicus
aaatgaagcgttgaggcacctcagc

SEQ ID NO: 16685 - DNA, 25 bp, Rattus norvegicus
aaatgaagctacaccaactgcagct

SEQ ID NO: 16686 - DNA, 25 bp, Rattus norvegicus
aaatgaagctactccaactgcagct

SEQ ID NO: 16687 - DNA, 25 bp, Rattus norvegicus
aaatgaagctatcacaggacctctt

SEQ ID NO: 16688 - DNA, 25 bp, Rattus norvegicus
aaatgaagctatgacaggacctctt

SEQ ID NO: 16689 - DNA, 25 bp, Rattus norvegicus
aaatgaagctctctttcggtcaagc

SEQ ID NO: 16690 - DNA, 25 bp, Rattus norvegicus
aaatgaagctctgtttcggtcaagc

SEQ ID NO: 16691 - DNA, 25 bp, Rattus norvegicus
aaatgaagcttcagccctttggtat

SEQ ID NO: 16692 - DNA, 25 bp, Rattus norvegicus
aaatgaagcttctgccctttggtat

SEQ ID NO: 16693 - DNA, 25 bp, Rattus norvegicus
aaatgaagctttacccacactcctg

SEQ ID NO: 16694 - DNA, 25 bp, Rattus norvegicus
aaatgaagcttttcccacactcctg

SEQ ID NO: 16695 - DNA, 25 bp, Rattus norvegicus
aaatgaaggcgaagagccatcacaa

SEQ ID NO: 16696 - DNA, 25 bp, Rattus norvegicus
aaatgaaggcgatgagccatcacaa

SEQ ID NO: 16697 - DNA, 25 bp, Rattus norvegicus
aaatgaaggctcacctgcagcccag

SEQ ID NO: 16698 - DNA, 25 bp, Rattus norvegicus
aaatgaaggctctcctgcagcccag

SEQ ID NO: 16699 - DNA, 25 bp, Rattus norvegicus
aaatgaagggcaagaatgggccagc

SEQ ID NO: 16700 - DNA, 25 bp, Rattus norvegicus
aaatgaagggcatgaatgggccagc

SEQ ID NO: 16701 - DNA, 25 bp, Rattus norvegicus
aaatgaaggtgtctggtccatagct

SEQ ID NO: 16702 - DNA, 25 bp, Rattus norvegicus
aaatgaaggtgtgtggtccatagct

SEQ ID NO: 16703 - DNA, 25 bp, Rattus norvegicus
aaatgaagtcatatgggcagttccc

SEQ ID NO: 16704 - DNA, 25 bp, Rattus norvegicus
aaatgaagtcatttgggcagttccc

SEQ ID NO: 16705 - DNA, 25 bp, Rattus norvegicus
aaatgaagtcccacttatcctcgaa

SEQ ID NO: 16706 - DNA, 25 bp, Rattus norvegicus
aaatgaagtccctcttatcctcgaa

SEQ ID NO: 16707 - DNA, 25 bp, Rattus norvegicus
aaatgaagtgtcactgtccccgagt

SEQ ID NO: 16708 - DNA, 25 bp, Rattus norvegicus
aaatgaagtgtctctgtccccgagt

SEQ ID NO: 16709 - DNA, 25 bp, Rattus norvegicus
aaatgaagttccagtggcccatggg

SEQ ID NO: 16710 - DNA, 25 bp, Rattus norvegicus
aaatgaagttcctgtggcccatggg

SEQ ID NO: 16711 - DNA, 25 bp, Rattus norvegicus
aaatgaataaagactcccagctccc

SEQ ID NO: 16712 - DNA, 25 bp, Rattus norvegicus
aaatgaataaagtctcccagctccc

SEQ ID NO: 16713 - DNA, 25 bp, Rattus norvegicus
aaatgaatcccaccctcagcatgat

SEQ ID NO: 16714 - DNA, 25 bp, Rattus norvegicus
aaatgaatcccagcctcagcatgat

SEQ ID NO: 16715 - DNA, 25 bp, Rattus norvegicus
aaatgaatctacaccttacgtttgt

SEQ ID NO: 16716 - DNA, 25 bp, Rattus norvegicus
aaatgaatctactccttacgtttgt

SEQ ID NO: 16717 - DNA, 25 bp, Rattus norvegicus
aaatgaatgcataggccctggtaac

SEQ ID NO: 16718 - DNA, 25 bp, Rattus norvegicus
aaatgaatgcatattcctgccccat

SEQ ID NO: 16719 - DNA, 25 bp, Rattus norvegicus
aaatgaatgcattggccctggtaac

SEQ ID NO: 16720 - DNA, 25 bp, Rattus norvegicus
aaatgaatgcattttcctgccccat

SEQ ID NO: 16721 - DNA, 25 bp, Rattus norvegicus
aaatgaatgcgtctttgctgtctcc

SEQ ID NO: 16722 - DNA, 25 bp, Rattus norvegicus
aaatgaatgcgtgtttgctgtctcc

SEQ ID NO: 16723 - DNA, 25 bp, Rattus norvegicus
aaatgaatgctaccacgtgcctgcg

SEQ ID NO: 16724 - DNA, 25 bp, Rattus norvegicus
aaatgaatgctagcacgtgcctgcg

SEQ ID NO: 16725 - DNA, 25 bp, Rattus norvegicus
aaatgaattcttcgcctctcagact

SEQ ID NO: 16726 - DNA, 25 bp, Rattus norvegicus
aaatgaattcttggcctctcagact

SEQ ID NO: 16727 - DNA, 25 bp, Rattus norvegicus
aaatgaatttctccttctctgtatt

SEQ ID NO: 16728 - DNA, 25 bp, Rattus norvegicus
aaatgaatttctgcttctctgtatt

SEQ ID NO: 16729 - DNA, 25 bp, Rattus norvegicus
aaatgaattttccatctctgggtaa

SEQ ID NO: 16730 - DNA, 25 bp, Rattus norvegicus
aaatgaattttcgatctctgggtaa

SEQ ID NO: 16731 - DNA, 25 bp, Rattus norvegicus
aaatgacaaactacttaatctactt

SEQ ID NO: 16732 - DNA, 25 bp, Rattus norvegicus
aaatgacaaacttcttaatctactt

SEQ ID NO: 16733 - DNA, 25 bp, Rattus norvegicus
aaatgacaaccgacagctacttctg

SEQ ID NO: 16734 - DNA, 25 bp, Rattus norvegicus
aaatgacaaccgtcagctacttctg

SEQ ID NO: 16735 - DNA, 25 bp, Rattus norvegicus
aaatgacaacgcatcgtcctttacc

SEQ ID NO: 16736 - DNA, 25 bp, Rattus norvegicus
aaatgacaacgcttcgtcctttacc

SEQ ID NO: 16737 - DNA, 25 bp, Rattus norvegicus
aaatgacaactcattccaggctccg

SEQ ID NO: 16738 - DNA, 25 bp, Rattus norvegicus
aaatgacaactctttccaggctccg

SEQ ID NO: 16739 - DNA, 25 bp, Rattus norvegicus
aaatgacaagtcacccgatttcctg

SEQ ID NO: 16740 - DNA, 25 bp, Rattus norvegicus
aaatgacaagtctcccgatttcctg

SEQ ID NO: 16741 - DNA, 25 bp, Rattus norvegicus
aaatgacaatcaatgtttatgacct

SEQ ID NO: 16742 - DNA, 25 bp, Rattus norvegicus
aaatgacaatcattgtttatgacct

SEQ ID NO: 16743 - DNA, 25 bp, Rattus norvegicus
aaatgacacaccactctgaaaagcc

SEQ ID NO: 16744 - DNA, 25 bp, Rattus norvegicus
aaatgacacacctctctgaaaagcc

SEQ ID NO: 16745 - DNA, 25 bp, Rattus norvegicus
aaatgacacattatccgtgggaatc

SEQ ID NO: 16746 - DNA, 25 bp, Rattus norvegicus
aaatgacacattttccgtgggaatc

SEQ ID NO: 16747 - DNA, 25 bp, Rattus norvegicus
aaatgacaccatagctaggagcctg

SEQ ID NO: 16748 - DNA, 25 bp, Rattus norvegicus
aaatgacaccattgctaggagcctg

SEQ ID NO: 16749 - DNA, 25 bp, Rattus norvegicus
aaatgacaccggcactcacctaaat

SEQ ID NO: 16750 - DNA, 25 bp, Rattus norvegicus
aaatgacaccgggactcacctaaat

SEQ ID NO: 16751 - DNA, 25 bp, Rattus norvegicus
aaatgacacctacatgttccctttt

SEQ ID NO: 16752 - DNA, 25 bp, Rattus norvegicus
aaatgacacctagatgttccctttt

SEQ ID NO: 16753 - DNA, 25 bp, Rattus norvegicus
aaatgacacgcaccaggcggtcaga

SEQ ID NO: 16754 - DNA, 25 bp, Rattus norvegicus
aaatgacacgcagcaggcggtcaga

SEQ ID NO: 16755 - DNA, 25 bp, Rattus norvegicus
aaatgacactcaccatttcctactt

SEQ ID NO: 16756 - DNA, 25 bp, Rattus norvegicus
aaatgacactcagcatttcctactt

SEQ ID NO: 16757 - DNA, 25 bp, Rattus norvegicus
aaatgacactctcggctttatgctt

SEQ ID NO: 16758 - DNA, 25 bp, Rattus norvegicus
aaatgacactctgggctttatgctt

SEQ ID NO: 16759 - DNA, 25 bp, Rattus norvegicus
aaatgacactgtccaccttaggata

SEQ ID NO: 16760 - DNA, 25 bp, Rattus norvegicus
aaatgacactgtgcaccttaggata

SEQ ID NO: 16761 - DNA, 25 bp, Rattus norvegicus
aaatgacagcaaagcccagcaggct

SEQ ID NO: 16762 - DNA, 25 bp, Rattus norvegicus
aaatgacagcaatgcccagcaggct

SEQ ID NO: 16763 - DNA, 25 bp, Rattus norvegicus
aaatgacagcccctggagacgccga

SEQ ID NO: 16764 - DNA, 25 bp, Rattus norvegicus
aaatgacagcccgtggagacgccga

SEQ ID NO: 16765 - DNA, 25 bp, Rattus norvegicus
aaatgacagcttctaaggcagtgaa

SEQ ID NO: 16766 - DNA, 25 bp, Rattus norvegicus
aaatgacagcttgtaaggcagtgaa

SEQ ID NO: 16767 - DNA, 25 bp, Rattus norvegicus
aaatgacaggcacccagatccagca

SEQ ID NO: 16768 - DNA, 25 bp, Rattus norvegicus
aaatgacaggcagccagatccagca

SEQ ID NO: 16769 - DNA, 25 bp, Rattus norvegicus
aaatgacagtagatggcctccactc

SEQ ID NO: 16770 - DNA, 25 bp, Rattus norvegicus
aaatgacagtagttggcctccactc

SEQ ID NO: 16771 - DNA, 25 bp, Rattus norvegicus
aaatgacatcagaaatgcctgtgtt

SEQ ID NO: 16772 - DNA, 25 bp, Rattus norvegicus
aaatgacatcagtaatgcctgtgtt

SEQ ID NO: 16773 - DNA, 25 bp, Rattus norvegicus
aaatgacatccaaggcaccattccc

SEQ ID NO: 16774 - DNA, 25 bp, Rattus norvegicus
aaatgacatccatggcaccattccc

SEQ ID NO: 16775 - DNA, 25 bp, Rattus norvegicus
aaatgacatgcgagctctggagaac

SEQ ID NO: 16776 - DNA, 25 bp, Rattus norvegicus
aaatgacatgcgtgctctggagaac

SEQ ID NO: 16777 - DNA, 25 bp, Rattus norvegicus
aaatgaccaattaaccactctcggg

SEQ ID NO: 16778 - DNA, 25 bp, Rattus norvegicus
aaatgaccaatttaccactctcggg

SEQ ID NO: 16779 - DNA, 25 bp, Rattus norvegicus
aaatgaccacatatttagggcaaaa

SEQ ID NO: 16780 - DNA, 25 bp, Rattus norvegicus
aaatgaccacatttttagggcaaaa

SEQ ID NO: 16781 - DNA, 25 bp, Rattus norvegicus
aaatgaccactcatcgagtctaagg

SEQ ID NO: 16782 - DNA, 25 bp, Rattus norvegicus
aaatgaccactcttcgagtctaagg

SEQ ID NO: 16783 - DNA, 25 bp, Rattus norvegicus
aaatgaccagatccagcctaagttt

SEQ ID NO: 16784 - DNA, 25 bp, Rattus norvegicus
aaatgaccagatgcagcctaagttt

SEQ ID NO: 16785 - DNA, 25 bp, Rattus norvegicus
aaatgaccagggattacctcagtgg

SEQ ID NO: 16786 - DNA, 25 bp, Rattus norvegicus
aaatgaccagggtttacctcagtgg

SEQ ID NO: 16787 - DNA, 25 bp, Rattus norvegicus
aaatgacccacaatgctctggagaa

SEQ ID NO: 16788 - DNA, 25 bp, Rattus norvegicus
aaatgacccacattgctctggagaa

SEQ ID NO: 16789 - DNA, 25 bp, Rattus norvegicus
aaatgacccagacctgttgccagtc

SEQ ID NO: 16790 - DNA, 25 bp, Rattus norvegicus
aaatgacccagagctgttgccagtc

SEQ ID NO: 16791 - DNA, 25 bp, Rattus norvegicus
aaatgacccagtagttccattatgg

SEQ ID NO: 16792 - DNA, 25 bp, Rattus norvegicus
aaatgacccagttgttccattatgg

SEQ ID NO: 16793 - DNA, 25 bp, Rattus norvegicus
aaatgaccccttacatgtgttgatg

SEQ ID NO: 16794 - DNA, 25 bp, Rattus norvegicus
aaatgacccctttcatgtgttgatg

SEQ ID NO: 16795 - DNA, 25 bp, Rattus norvegicus
aaatgaccctcaaagcacgcaaaac

SEQ ID NO: 16796 - DNA, 25 bp, Rattus norvegicus
aaatgaccctcatagcacgcaaaac

SEQ ID NO: 16797 - DNA, 25 bp, Rattus norvegicus
aaatgacccttgaatccacccaaag

SEQ ID NO: 16798 - DNA, 25 bp, Rattus norvegicus
aaatgacccttgtatccacccaaag

SEQ ID NO: 16799 - DNA, 25 bp, Rattus norvegicus
aaatgaccgcctaggcacacacagg

SEQ ID NO: 16800 - DNA, 25 bp, Rattus norvegicus
aaatgaccgccttggcacacacagg

SEQ ID NO: 16801 - DNA, 25 bp, Rattus norvegicus
aaatgaccgtgcagctggagaccca

SEQ ID NO: 16802 - DNA, 25 bp, Rattus norvegicus
aaatgaccgtgctgctggagaccca

SEQ ID NO: 16803 - DNA, 25 bp, Rattus norvegicus
aaatgaccgtttcttataccagcca

SEQ ID NO: 16804 - DNA, 25 bp, Rattus norvegicus
aaatgaccgtttgttataccagcca

SEQ ID NO: 16805 - DNA, 25 bp, Rattus norvegicus
aaatgacctaagacctctaattcga

SEQ ID NO: 16806 - DNA, 25 bp, Rattus norvegicus
aaatgacctaagtcctctaattcga

SEQ ID NO: 16807 - DNA, 25 bp, Rattus norvegicus
aaatgacctattacaccagctctaa

SEQ ID NO: 16808 - DNA, 25 bp, Rattus norvegicus
aaatgacctatttcaccagctctaa

SEQ ID NO: 16809 - DNA, 25 bp, Rattus norvegicus
aaatgacctgccctgatgtagttaa

SEQ ID NO: 16810 - DNA, 25 bp, Rattus norvegicus
aaatgacctgccgtgatgtagttaa

SEQ ID NO: 16811 - DNA, 25 bp, Rattus norvegicus
aaatgacctgtgaacctcagacctt

SEQ ID NO: 16812 - DNA, 25 bp, Rattus norvegicus
aaatgacctgtgtacctcagacctt

SEQ ID NO: 16813 - DNA, 25 bp, Rattus norvegicus
aaatgaccttgtcctgattttcagt

SEQ ID NO: 16814 - DNA, 25 bp, Rattus norvegicus
aaatgaccttgtgctgattttcagt

SEQ ID NO: 16815 - DNA, 25 bp, Rattus norvegicus
aaatgacgaacaaggtcccgcggac

SEQ ID NO: 16816 - DNA, 25 bp, Rattus norvegicus
aaatgacgaacatggtcccgcggac

SEQ ID NO: 16817 - DNA, 25 bp, Rattus norvegicus
aaatgacgccttcggcctgggaaag

SEQ ID NO: 16818 - DNA, 25 bp, Rattus norvegicus
aaatgacgccttgggcctgggaaag

SEQ ID NO: 16819 - DNA, 25 bp, Rattus norvegicus
aaatgacgtcatcggcagaacttag

SEQ ID NO: 16820 - DNA, 25 bp, Rattus norvegicus
aaatgacgtcatgggcagaacttag

SEQ ID NO: 16821 - DNA, 25 bp, Rattus norvegicus
aaatgacgtctcaggctttggctgc

SEQ ID NO: 16822 - DNA, 25 bp, Rattus norvegicus
aaatgacgtctctggctttggctgc

SEQ ID NO: 16823 - DNA, 25 bp, Rattus norvegicus
aaatgactaattagtgctttttctg

SEQ ID NO: 16824 - DNA, 25 bp, Rattus norvegicus
aaatgactaatttgtgctttttctg

SEQ ID NO: 16825 - DNA, 25 bp, Rattus norvegicus
aaatgactacaaaggaactgaagac

SEQ ID NO: 16826 - DNA, 25 bp, Rattus norvegicus
aaatgactacaatggaactgaagac

SEQ ID NO: 16827 - DNA, 25 bp, Rattus norvegicus
aaatgactagttagtttccttgtgt

SEQ ID NO: 16828 - DNA, 25 bp, Rattus norvegicus
aaatgactagtttgtttccttgtgt

SEQ ID NO: 16829 - DNA, 25 bp, Rattus norvegicus
aaatgactcaacactgatccaggcg

SEQ ID NO: 16830 - DNA, 25 bp, Rattus norvegicus
aaatgactcaactctgatccaggcg

SEQ ID NO: 16831 - DNA, 25 bp, Rattus norvegicus
aaatgactcactaccttatccagag

SEQ ID NO: 16832 - DNA, 25 bp, Rattus norvegicus
aaatgactcacttccttatccagag

SEQ ID NO: 16833 - DNA, 25 bp, Rattus norvegicus
aaatgactcagaatctcttcccctc

SEQ ID NO: 16834 - DNA, 25 bp, Rattus norvegicus
aaatgactcagattctcttcccctc

SEQ ID NO: 16835 - DNA, 25 bp, Rattus norvegicus
aaatgactcatacctgtcgcctaag

SEQ ID NO: 16836 - DNA, 25 bp, Rattus norvegicus
aaatgactcatagctgtcgcctaag

SEQ ID NO: 16837 - DNA, 25 bp, Rattus norvegicus
aaatgactcatcaatctggttactt

SEQ ID NO: 16838 - DNA, 25 bp, Rattus norvegicus
aaatgactcatctatctggttactt

SEQ ID NO: 16839 - DNA, 25 bp, Rattus norvegicus
aaatgactcattcatgccttgatta

SEQ ID NO: 16840 - DNA, 25 bp, Rattus norvegicus
aaatgactcattgatgccttgatta

SEQ ID NO: 16841 - DNA, 25 bp, Rattus norvegicus
aaatgactccacagatgcttccaag

SEQ ID NO: 16842 - DNA, 25 bp, Rattus norvegicus
aaatgactccactgatgcttccaag

SEQ ID NO: 16843 - DNA, 25 bp, Rattus norvegicus
aaatgactcctgaaactctctagaa

SEQ ID NO: 16844 - DNA, 25 bp, Rattus norvegicus
aaatgactcctgactctgtgttggc

SEQ ID NO: 16845 - DNA, 25 bp, Rattus norvegicus
aaatgactcctgtaactctctagaa

SEQ ID NO: 16846 - DNA, 25 bp, Rattus norvegicus
aaatgactcctgtctctgtgttggc

SEQ ID NO: 16847 - DNA, 25 bp, Rattus norvegicus
aaatgactgcagagcctgacagccc

SEQ ID NO: 16848 - DNA, 25 bp, Rattus norvegicus
aaatgactgcagtgcctgacagccc

SEQ ID NO: 16849 - DNA, 25 bp, Rattus norvegicus
aaatgactgctaagcctcttacctt

SEQ ID NO: 16850 - DNA, 25 bp, Rattus norvegicus
aaatgactgctatgcctcttacctt

SEQ ID NO: 16851 - DNA, 25 bp, Rattus norvegicus
aaatgactggtcacagaaactgaat

SEQ ID NO: 16852 - DNA, 25 bp, Rattus norvegicus
aaatgactggtctcagaaactgaat

SEQ ID NO: 16853 - DNA, 25 bp, Rattus norvegicus
aaatgactgtacatattctcctgcc

SEQ ID NO: 16854 - DNA, 25 bp, Rattus norvegicus
aaatgactgtacttattctcctgcc

SEQ ID NO: 16855 - DNA, 25 bp, Rattus norvegicus
aaatgactgtcgctcccgtgcatgg

SEQ ID NO: 16856 - DNA, 25 bp, Rattus norvegicus
aaatgactgtcggtcccgtgcatgg

SEQ ID NO: 16857 - DNA, 25 bp, Rattus norvegicus
aaatgactgtgcaatggccttcacc

SEQ ID NO: 16858 - DNA, 25 bp, Rattus norvegicus
aaatgactgtgctatggccttcacc

SEQ ID NO: 16859 - DNA, 25 bp, Rattus norvegicus
aaatgactgtttccctattctcatg

SEQ ID NO: 16860 - DNA, 25 bp, Rattus norvegicus
aaatgactgtttgcctattctcatg

SEQ ID NO: 16861 - DNA, 25 bp, Rattus norvegicus
aaatgacttcaacttggcagggaac

SEQ ID NO: 16862 - DNA, 25 bp, Rattus norvegicus
aaatgacttcaagttggcagggaac

SEQ ID NO: 16863 - DNA, 25 bp, Rattus norvegicus
aaatgacttcacaagcagttatgct

SEQ ID NO: 16864 - DNA, 25 bp, Rattus norvegicus
aaatgacttcacatccgggtcatca

SEQ ID NO: 16865 - DNA, 25 bp, Rattus norvegicus
aaatgacttcactagcagttatgct

SEQ ID NO: 16866 - DNA, 25 bp, Rattus norvegicus
aaatgacttcacttccgggtcatca

SEQ ID NO: 16867 - DNA, 25 bp, Rattus norvegicus
aaatgacttcagatacctccatacg

SEQ ID NO: 16868 - DNA, 25 bp, Rattus norvegicus
aaatgacttcagttacctccatacg

SEQ ID NO: 16869 - DNA, 25 bp, Rattus norvegicus
aaatgacttcctaacttcgcttgaa

SEQ ID NO: 16870 - DNA, 25 bp, Rattus norvegicus
aaatgacttccttacttcgcttgaa

SEQ ID NO: 16871 - DNA, 25 bp, Rattus norvegicus
aaatgacttctgcagcgcgtttgac

SEQ ID NO: 16872 - DNA, 25 bp, Rattus norvegicus
aaatgacttctggagcgcgtttgac

SEQ ID NO: 16873 - DNA, 25 bp, Rattus norvegicus
aaatgacttgtgattctcagcccgt

SEQ ID NO: 16874 - DNA, 25 bp, Rattus norvegicus
aaatgacttgtgtttctcagcccgt

SEQ ID NO: 16875 - DNA, 25 bp, Rattus norvegicus
aaatgacttgttatactttctgata

SEQ ID NO: 16876 - DNA, 25 bp, Rattus norvegicus
aaatgacttgttttactttctgata

SEQ ID NO: 16877 - DNA, 25 bp, Rattus norvegicus
aaatgactttctcgtcacatcccac

SEQ ID NO: 16878 - DNA, 25 bp, Rattus norvegicus
aaatgactttctggtcacatcccac

SEQ ID NO: 16879 - DNA, 25 bp, Rattus norvegicus
aaatgagaaacactcccctgtgtcg

SEQ ID NO: 16880 - DNA, 25 bp, Rattus norvegicus
aaatgagaaacagtcccctgtgtcg

SEQ ID NO: 16881 - DNA, 25 bp, Rattus norvegicus
aaatgagaacctcggcacagccatg

SEQ ID NO: 16882 - DNA, 25 bp, Rattus norvegicus
aaatgagaacctgggcacagccatg

SEQ ID NO: 16883 - DNA, 25 bp, Rattus norvegicus
aaatgagaattcaacccctgcaact

SEQ ID NO: 16884 - DNA, 25 bp, Rattus norvegicus
aaatgagaattctacccctgcaact

SEQ ID NO: 16885 - DNA, 25 bp, Rattus norvegicus
aaatgagacactcacaccaagggct

SEQ ID NO: 16886 - DNA, 25 bp, Rattus norvegicus
aaatgagacactgacaccaagggct

SEQ ID NO: 16887 - DNA, 25 bp, Rattus norvegicus
aaatgagacagacaatcccagcact

SEQ ID NO: 16888 - DNA, 25 bp, Rattus norvegicus
aaatgagacagagaatcccagcact

SEQ ID NO: 16889 - DNA, 25 bp, Rattus norvegicus
aaatgagacccaaagccagcggcct

SEQ ID NO: 16890 - DNA, 25 bp, Rattus norvegicus
aaatgagacccatagccagcggcct

SEQ ID NO: 16891 - DNA, 25 bp, Rattus norvegicus
aaatgagacctcagatatcaccaca

SEQ ID NO: 16892 - DNA, 25 bp, Rattus norvegicus
aaatgagacctctgatatcaccaca

SEQ ID NO: 16893 - DNA, 25 bp, Rattus norvegicus
aaatgagactctctttccagctctt

SEQ ID NO: 16894 - DNA, 25 bp, Rattus norvegicus
aaatgagactctgtttccagctctt

SEQ ID NO: 16895 - DNA, 25 bp, Rattus norvegicus
aaatgagagaacaccttgctcgaaa

SEQ ID NO: 16896 - DNA, 25 bp, Rattus norvegicus
aaatgagagaactccttgctcgaaa

SEQ ID NO: 16897 - DNA, 25 bp, Rattus norvegicus
aaatgagagaagaccgttgggcaac

SEQ ID NO: 16898 - DNA, 25 bp, Rattus norvegicus
aaatgagagaagtccgttgggcaac

SEQ ID NO: 16899 - DNA, 25 bp, Rattus norvegicus
aaatgagagcgcagacgccgcgctg

SEQ ID NO: 16900 - DNA, 25 bp, Rattus norvegicus
aaatgagagcgctgacgccgcgctg

SEQ ID NO: 16901 - DNA, 25 bp, Rattus norvegicus
aaatgagagtaaaccctcccagcag

SEQ ID NO: 16902 - DNA, 25 bp, Rattus norvegicus
aaatgagagtaatccctcccagcag

SEQ ID NO: 16903 - DNA, 25 bp, Rattus norvegicus
aaatgagatcctcacaccgtgtacc

SEQ ID NO: 16904 - DNA, 25 bp, Rattus norvegicus
aaatgagatcctgacaccgtgtacc

SEQ ID NO: 16905 - DNA, 25 bp, Rattus norvegicus
aaatgagatgctcgactgccctgct

SEQ ID NO: 16906 - DNA, 25 bp, Rattus norvegicus
aaatgagatgctggactgccctgct

SEQ ID NO: 16907 - DNA, 25 bp, Rattus norvegicus
aaatgagcactaaggccttcccaag

SEQ ID NO: 16908 - DNA, 25 bp, Rattus norvegicus
aaatgagcactatggccttcccaag

SEQ ID NO: 16909 - DNA, 25 bp, Rattus norvegicus
aaatgagcagctcccaagagtcgct

SEQ ID NO: 16910 - DNA, 25 bp, Rattus norvegicus
aaatgagcagctgccaagagtcgct

SEQ ID NO: 16911 - DNA, 25 bp, Rattus norvegicus
aaatgagcagtcattctgaggtaag

SEQ ID NO: 16912 - DNA, 25 bp, Rattus norvegicus
aaatgagcagtctttctgaggtaag

SEQ ID NO: 16913 - DNA, 25 bp, Rattus norvegicus
aaatgagccagcacatgtctcctct

SEQ ID NO: 16914 - DNA, 25 bp, Rattus norvegicus
aaatgagccagctcatgtctcctct

SEQ ID NO: 16915 - DNA, 25 bp, Rattus norvegicus
aaatgagcccgactctgcctagagg

SEQ ID NO: 16916 - DNA, 25 bp, Rattus norvegicus
aaatgagcccgagtctgcctagagg

SEQ ID NO: 16917 - DNA, 25 bp, Rattus norvegicus
aaatgagcccgtagagttggtgaca

SEQ ID NO: 16918 - DNA, 25 bp, Rattus norvegicus
aaatgagcccgttgagttggtgaca

SEQ ID NO: 16919 - DNA, 25 bp, Rattus norvegicus
aaatgagccgccagcacgcctgttc

SEQ ID NO: 16920 - DNA, 25 bp, Rattus norvegicus
aaatgagccgcctgcacgcctgttc

SEQ ID NO: 16921 - DNA, 25 bp, Rattus norvegicus
aaatgagccgcgactccaagtgcat

SEQ ID NO: 16922 - DNA, 25 bp, Rattus norvegicus
aaatgagccgcgtctccaagtgcat

SEQ ID NO: 16923 - DNA, 25 bp, Rattus norvegicus
aaatgagcctaaagttctgtgaata

SEQ ID NO: 16924 - DNA, 25 bp, Rattus norvegicus
aaatgagcctaatgttctgtgaata

SEQ ID NO: 16925 - DNA, 25 bp, Rattus norvegicus
aaatgagcctcacgatgtggttggt

SEQ ID NO: 16926 - DNA, 25 bp, Rattus norvegicus
aaatgagcctcaggatgtggttggt

SEQ ID NO: 16927 - DNA, 25 bp, Rattus norvegicus
aaatgagctcatagcccactgtcaa

SEQ ID NO: 16928 - DNA, 25 bp, Rattus norvegicus
aaatgagctcattgcccactgtcaa

SEQ ID NO: 16929 - DNA, 25 bp, Rattus norvegicus
aaatgagctccaaccaaggcatagg

SEQ ID NO: 16930 - DNA, 25 bp, Rattus norvegicus
aaatgagctccatccaaggcatagg

SEQ ID NO: 16931 - DNA, 25 bp, Rattus norvegicus
aaatgagctcctatgaacagccctt

SEQ ID NO: 16932 - DNA, 25 bp, Rattus norvegicus
aaatgagctcctttgaacagccctt

SEQ ID NO: 16933 - DNA, 25 bp, Rattus norvegicus
aaatgagctgctctagtaactctag

SEQ ID NO: 16934 - DNA, 25 bp, Rattus norvegicus
aaatgagctgctgtagtaactctag

SEQ ID NO: 16935 - DNA, 25 bp, Rattus norvegicus
aaatgaggacgaccagaacagcccc

SEQ ID NO: 16936 - DNA, 25 bp, Rattus norvegicus
aaatgaggacgagcagaacagcccc

SEQ ID NO: 16937 - DNA, 25 bp, Rattus norvegicus
aaatgaggcactaacttggctgagc

SEQ ID NO: 16938 - DNA, 25 bp, Rattus norvegicus
aaatgaggcacttacttggctgagc

SEQ ID NO: 16939 - DNA, 25 bp, Rattus norvegicus
aaatgaggcagtccttacctgttgc

SEQ ID NO: 16940 - DNA, 25 bp, Rattus norvegicus
aaatgaggcagtgcttacctgttgc

SEQ ID NO: 16941 - DNA, 25 bp, Rattus norvegicus
aaatgaggctccagaatcactcctg

SEQ ID NO: 16942 - DNA, 25 bp, Rattus norvegicus
aaatgaggctcctgaatcactcctg

SEQ ID NO: 16943 - DNA, 25 bp, Rattus norvegicus
aaatgaggcttcagggagccgcgca

SEQ ID NO: 16944 - DNA, 25 bp, Rattus norvegicus
aaatgaggcttctgggagccgcgca

SEQ ID NO: 16945 - DNA, 25 bp, Rattus norvegicus
aaatgagggctaaccattgccagaa

SEQ ID NO: 16946 - DNA, 25 bp, Rattus norvegicus
aaatgagggctatccattgccagaa

SEQ ID NO: 16947 - DNA, 25 bp, Rattus norvegicus
aaatgagggcttagaccccagtgca

SEQ ID NO: 16948 - DNA, 25 bp, Rattus norvegicus
aaatgagggctttgaccccagtgca

SEQ ID NO: 16949 - DNA, 25 bp, Rattus norvegicus
aaatgagggtgcagattgtccgaga

SEQ ID NO: 16950 - DNA, 25 bp, Rattus norvegicus
aaatgagggtgctgattgtccgaga

SEQ ID NO: 16951 - DNA, 25 bp, Rattus norvegicus
aaatgaggtggtcctactctgatga

SEQ ID NO: 16952 - DNA, 25 bp, Rattus norvegicus
aaatgaggtggtgctactctgatga

SEQ ID NO: 16953 - DNA, 25 bp, Rattus norvegicus
aaatgagtacctacagcggcttatt

SEQ ID NO: 16954 - DNA, 25 bp, Rattus norvegicus
aaatgagtaccttcagcggcttatt

SEQ ID NO: 16955 - DNA, 25 bp, Rattus norvegicus
aaatgagtcacacgcctcacaggcc

SEQ ID NO: 16956 - DNA, 25 bp, Rattus norvegicus
aaatgagtcacaggcctcacaggcc

SEQ ID NO: 16957 - DNA, 25 bp, Rattus norvegicus
aaatgagtcaccctcctcagctcta

SEQ ID NO: 16958 - DNA, 25 bp, Rattus norvegicus
aaatgagtcaccgtcctcagctcta

SEQ ID NO: 16959 - DNA, 25 bp, Rattus norvegicus
aaatgagtcccacggccaactctaa

SEQ ID NO: 16960 - DNA, 25 bp, Rattus norvegicus
aaatgagtcccagggccaactctaa

SEQ ID NO: 16961 - DNA, 25 bp, Rattus norvegicus
aaatgagtccggacctgtcaggcag

SEQ ID NO: 16962 - DNA, 25 bp, Rattus norvegicus
aaatgagtccggtcctgtcaggcag

SEQ ID NO: 16963 - DNA, 25 bp, Rattus norvegicus
aaatgagtcctcagctggtaaccct

SEQ ID NO: 16964 - DNA, 25 bp, Rattus norvegicus
aaatgagtcctctgctggtaaccct

SEQ ID NO: 16965 - DNA, 25 bp, Rattus norvegicus
aaatgagtccttccctgtgattcta

SEQ ID NO: 16966 - DNA, 25 bp, Rattus norvegicus
aaatgagtccttgcctgtgattcta

SEQ ID NO: 16967 - DNA, 25 bp, Rattus norvegicus
aaatgagtctacagccaccatgcag

SEQ ID NO: 16968 - DNA, 25 bp, Rattus norvegicus
aaatgagtctactgccaccatgcag

SEQ ID NO: 16969 - DNA, 25 bp, Rattus norvegicus
aaatgagtctcccagtccacttaga

SEQ ID NO: 16970 - DNA, 25 bp, Rattus norvegicus
aaatgagtctccgagtccacttaga

SEQ ID NO: 16971 - DNA, 25 bp, Rattus norvegicus
aaatgagtgacccacatctccatga

SEQ ID NO: 16972 - DNA, 25 bp, Rattus norvegicus
aaatgagtgaccgacatctccatga

SEQ ID NO: 16973 - DNA, 25 bp, Rattus norvegicus
aaatgagtgccacttctacgctggt

SEQ ID NO: 16974 - DNA, 25 bp, Rattus norvegicus
aaatgagtgccagttctacgctggt

SEQ ID NO: 16975 - DNA, 25 bp, Rattus norvegicus
aaatgagtggcaccagcgttcctct

SEQ ID NO: 16976 - DNA, 25 bp, Rattus norvegicus
aaatgagtggcagcagcgttcctct

SEQ ID NO: 16977 - DNA, 25 bp, Rattus norvegicus
aaatgagtgtgcacctgaggactgt

SEQ ID NO: 16978 - DNA, 25 bp, Rattus norvegicus
aaatgagtgtgctcctgaggactgt

SEQ ID NO: 16979 - DNA, 25 bp, Rattus norvegicus
aaatgagtttgtcctttccttgaga

SEQ ID NO: 16980 - DNA, 25 bp, Rattus norvegicus
aaatgagtttgtgctttccttgaga

SEQ ID NO: 16981 - DNA, 25 bp, Rattus norvegicus
aaatgataagtaatatggcgcccag

SEQ ID NO: 16982 - DNA, 25 bp, Rattus norvegicus
aaatgataagtattatggcgcccag

SEQ ID NO: 16983 - DNA, 25 bp, Rattus norvegicus
aaatgatacgccatcagttctcctc

SEQ ID NO: 16984 - DNA, 25 bp, Rattus norvegicus
aaatgatacgccttcagttctcctc

SEQ ID NO: 16985 - DNA, 25 bp, Rattus norvegicus
aaatgatactataggctgtggcagc

SEQ ID NO: 16986 - DNA, 25 bp, Rattus norvegicus
aaatgatactattggctgtggcagc

SEQ ID NO: 16987 - DNA, 25 bp, Rattus norvegicus
aaatgatacttacctctccagtgct

SEQ ID NO: 16988 - DNA, 25 bp, Rattus norvegicus
aaatgatacttagctctccagtgct

SEQ ID NO: 16989 - DNA, 25 bp, Rattus norvegicus
aaatgatcacatatgggaactgtaa

SEQ ID NO: 16990 - DNA, 25 bp, Rattus norvegicus
aaatgatcacatttgggaactgtaa

SEQ ID NO: 16991 - DNA, 25 bp, Rattus norvegicus
aaatgatccaagatttttgcccaaa

SEQ ID NO: 16992 - DNA, 25 bp, Rattus norvegicus
aaatgatccaagttttttgcccaaa

SEQ ID NO: 16993 - DNA, 25 bp, Rattus norvegicus
aaatgatcccagagtccagtggccc

SEQ ID NO: 16994 - DNA, 25 bp, Rattus norvegicus
aaatgatcccagtgtccagtggccc

SEQ ID NO: 16995 - DNA, 25 bp, Rattus norvegicus
aaatgatcctgtagttttttgtcgt

SEQ ID NO: 16996 - DNA, 25 bp, Rattus norvegicus
aaatgatcctgttgttttttgtcgt

SEQ ID NO: 16997 - DNA, 25 bp, Rattus norvegicus
aaatgatctctacctgctattacag

SEQ ID NO: 16998 - DNA, 25 bp, Rattus norvegicus
aaatgatctctagctgctattacag

SEQ ID NO: 16999 - DNA, 25 bp, Rattus norvegicus
aaatgatctgacattactcttgtag

SEQ ID NO: 17000 - DNA, 25 bp, Rattus norvegicus
aaatgatctgactttactcttgtag

SEQ ID NO: 17001 - DNA, 25 bp, Rattus norvegicus
aaatgatcttcaaacccactcgtgt

SEQ ID NO: 17002 - DNA, 25 bp, Rattus norvegicus
aaatgatcttcatacccactcgtgt

SEQ ID NO: 17003 - DNA, 25 bp, Rattus norvegicus
aaatgatgactgagctacccttggt

SEQ ID NO: 17004 - DNA, 25 bp, Rattus norvegicus
aaatgatgactgtgctacccttggt

SEQ ID NO: 17005 - DNA, 25 bp, Rattus norvegicus
aaatgatgcataaacctttcccaga

SEQ ID NO: 17006 - DNA, 25 bp, Rattus norvegicus
aaatgatgcatatacctttcccaga

SEQ ID NO: 17007 - DNA, 25 bp, Rattus norvegicus
aaatgatgccaccaggcctcaggac

SEQ ID NO: 17008 - DNA, 25 bp, Rattus norvegicus
aaatgatgccacgaggcctcaggac

SEQ ID NO: 17009 - DNA, 25 bp, Rattus norvegicus
aaatgatgcctaagatagccatgta

SEQ ID NO: 17010 - DNA, 25 bp, Rattus norvegicus
aaatgatgcctatgatagccatgta

SEQ ID NO: 17011 - DNA, 25 bp, Rattus norvegicus
aaatgatgccttccagtcttcaaga

SEQ ID NO: 17012 - DNA, 25 bp, Rattus norvegicus
aaatgatgccttgcagtcttcaaga

SEQ ID NO: 17013 - DNA, 25 bp, Rattus norvegicus
aaatgatgctccagcagaccaccta

SEQ ID NO: 17014 - DNA, 25 bp, Rattus norvegicus
aaatgatgctcctgcagaccaccta

SEQ ID NO: 17015 - DNA, 25 bp, Rattus norvegicus
aaatgatgggcccttccaaagctgc

SEQ ID NO: 17016 - DNA, 25 bp, Rattus norvegicus
aaatgatgggccgttccaaagctgc

SEQ ID NO: 17017 - DNA, 25 bp, Rattus norvegicus
aaatgatggtctctcttcacacagt

SEQ ID NO: 17018 - DNA, 25 bp, Rattus norvegicus
aaatgatggtctgtcttcacacagt

SEQ ID NO: 17019 - DNA, 25 bp, Rattus norvegicus
aaatgatgtaagacggctgtgtcct

SEQ ID NO: 17020 - DNA, 25 bp, Rattus norvegicus
aaatgatgtaagtcggctgtgtcct

SEQ ID NO: 17021 - DNA, 25 bp, Rattus norvegicus
aaatgatgtccacctgcccatctgt

SEQ ID NO: 17022 - DNA, 25 bp, Rattus norvegicus
aaatgatgtccagctgcccatctgt

SEQ ID NO: 17023 - DNA, 25 bp, Rattus norvegicus
aaatgatgtccccttgccaggtaga

SEQ ID NO: 17024 - DNA, 25 bp, Rattus norvegicus
aaatgatgtcccgttgccaggtaga

SEQ ID NO: 17025 - DNA, 25 bp, Rattus norvegicus
aaatgatgttgtagtcccagggcac

SEQ ID NO: 17026 - DNA, 25 bp, Rattus norvegicus
aaatgatgttgttgtcccagggcac

SEQ ID NO: 17027 - DNA, 25 bp, Rattus norvegicus
aaatgatgttttctcatggccagaa

SEQ ID NO: 17028 - DNA, 25 bp, Rattus norvegicus
aaatgatgttttgtcatggccagaa

SEQ ID NO: 17029 - DNA, 25 bp, Rattus norvegicus
aaatgattacagcttcatctggttg

SEQ ID NO: 17030 - DNA, 25 bp, Rattus norvegicus
aaatgattacaggttcatctggttg

SEQ ID NO: 17031 - DNA, 25 bp, Rattus norvegicus
aaatgattatacagtgactgactta

SEQ ID NO: 17032 - DNA, 25 bp, Rattus norvegicus
aaatgattatactgtgactgactta

SEQ ID NO: 17033 - DNA, 25 bp, Rattus norvegicus
aaatgattcactcctcacctgagta

SEQ ID NO: 17034 - DNA, 25 bp, Rattus norvegicus
aaatgattcactgctcacctgagta

SEQ ID NO: 17035 - DNA, 25 bp, Rattus norvegicus
aaatgattcctcacatcaagcctgg

SEQ ID NO: 17036 - DNA, 25 bp, Rattus norvegicus
aaatgattcctctcatcaagcctgg

SEQ ID NO: 17037 - DNA, 25 bp, Rattus norvegicus
aaatgattcgaaatctgctctgcct

SEQ ID NO: 17038 - DNA, 25 bp, Rattus norvegicus
aaatgattcgaattctgctctgcct

SEQ ID NO: 17039 - DNA, 25 bp, Rattus norvegicus
aaatgattctagattgccagctaat

SEQ ID NO: 17040 - DNA, 25 bp, Rattus norvegicus
aaatgattctagtttgccagctaat

SEQ ID NO: 17041 - DNA, 25 bp, Rattus norvegicus
aaatgattcttcagctaaggccctt

SEQ ID NO: 17042 - DNA, 25 bp, Rattus norvegicus
aaatgattcttctgctaaggccctt

SEQ ID NO: 17043 - DNA, 25 bp, Rattus norvegicus
aaatgattctttctgggactggagt

SEQ ID NO: 17044 - DNA, 25 bp, Rattus norvegicus
aaatgattctttgtgggactggagt

SEQ ID NO: 17045 - DNA, 25 bp, Rattus norvegicus
aaatgatttcagctgggcatccaaa

SEQ ID NO: 17046 - DNA, 25 bp, Rattus norvegicus
aaatgatttcaggtgggcatccaaa

SEQ ID NO: 17047 - DNA, 25 bp, Rattus norvegicus
aaatgatttctcatcgcacttgtgt

SEQ ID NO: 17048 - DNA, 25 bp, Rattus norvegicus
aaatgatttctcttcgcacttgtgt

SEQ ID NO: 17049 - DNA, 25 bp, Rattus norvegicus
aaatgatttcttaggctttgtttga

SEQ ID NO: 17050 - DNA, 25 bp, Rattus norvegicus
aaatgatttctttggctttgtttga

SEQ ID NO: 17051 - DNA, 25 bp, Rattus norvegicus
aaatgatttgctcgctccactttgc

SEQ ID NO: 17052 - DNA, 25 bp, Rattus norvegicus
aaatgatttgctggctccactttgc

SEQ ID NO: 17053 - DNA, 25 bp, Rattus norvegicus
aaatgatttgtcattgggtactagc

SEQ ID NO: 17054 - DNA, 25 bp, Rattus norvegicus
aaatgatttgtctttgggtactagc

SEQ ID NO: 17055 - DNA, 25 bp, Rattus norvegicus
aaatgattttccagcatacttcagc

SEQ ID NO: 17056 - DNA, 25 bp, Rattus norvegicus
aaatgattttcctgcatacttcagc

SEQ ID NO: 17057 - DNA, 25 bp, Rattus norvegicus
aaatgattttgaccctaaattgata

SEQ ID NO: 17058 - DNA, 25 bp, Rattus norvegicus
aaatgattttgagcctaaattgata

SEQ ID NO: 17059 - DNA, 25 bp, Rattus norvegicus
aaatgcaaaactctctctctctttt

SEQ ID NO: 17060 - DNA, 25 bp, Rattus norvegicus
aaatgcaaaactgtctctctctttt

SEQ ID NO: 17061 - DNA, 25 bp, Rattus norvegicus
aaatgcaacctgatgaccctgcagt

SEQ ID NO: 17062 - DNA, 25 bp, Rattus norvegicus
aaatgcaacctgttgaccctgcagt

SEQ ID NO: 17063 - DNA, 25 bp, Rattus norvegicus
aaatgcaacgacaggaatatgttca

SEQ ID NO: 17064 - DNA, 25 bp, Rattus norvegicus
aaatgcaacgactggaatatgttca

SEQ ID NO: 17065 - DNA, 25 bp, Rattus norvegicus
aaatgcaactatacagtactctcaa

SEQ ID NO: 17066 - DNA, 25 bp, Rattus norvegicus
aaatgcaactattcagtactctcaa

SEQ ID NO: 17067 - DNA, 25 bp, Rattus norvegicus
aaatgcaactgaaactctgtttcca

SEQ ID NO: 17068 - DNA, 25 bp, Rattus norvegicus
aaatgcaactgatactctgtttcca

SEQ ID NO: 17069 - DNA, 25 bp, Rattus norvegicus
aaatgcaagaggcaccaacaccctt

SEQ ID NO: 17070 - DNA, 25 bp, Rattus norvegicus
aaatgcaagagggaccaacaccctt

SEQ ID NO: 17071 - DNA, 25 bp, Rattus norvegicus
aaatgcaagatcctggccttactac

SEQ ID NO: 17072 - DNA, 25 bp, Rattus norvegicus
aaatgcaagatcgtggccttactac

SEQ ID NO: 17073 - DNA, 25 bp, Rattus norvegicus
aaatgcaagctgcactgaggcccca

SEQ ID NO: 17074 - DNA, 25 bp, Rattus norvegicus
aaatgcaagctggactgaggcccca

SEQ ID NO: 17075 - DNA, 25 bp, Rattus norvegicus
aaatgcaagggacgctgccagcaat

SEQ ID NO: 17076 - DNA, 25 bp, Rattus norvegicus
aaatgcaagggaggctgccagcaat

SEQ ID NO: 17077 - DNA, 25 bp, Rattus norvegicus
aaatgcaagttcagtggcacccaca

SEQ ID NO: 17078 - DNA, 25 bp, Rattus norvegicus
aaatgcaagttctgtggcacccaca

SEQ ID NO: 17079 - DNA, 25 bp, Rattus norvegicus
aaatgcaatacccttttcttctcaa

SEQ ID NO: 17080 - DNA, 25 bp, Rattus norvegicus
aaatgcaataccgttttcttctcaa

SEQ ID NO: 17081 - DNA, 25 bp, Rattus norvegicus
aaatgcaatctgacatcactgatgt

SEQ ID NO: 17082 - DNA, 25 bp, Rattus norvegicus
aaatgcaatctgtcatcactgatgt

SEQ ID NO: 17083 - DNA, 25 bp, Rattus norvegicus
aaatgcaatgccaagtcacagggaa

SEQ ID NO: 17084 - DNA, 25 bp, Rattus norvegicus
aaatgcaatgcctagtcacagggaa

SEQ ID NO: 17085 - DNA, 25 bp, Rattus norvegicus
aaatgcacaccgatgtgtctcggtt

SEQ ID NO: 17086 - DNA, 25 bp, Rattus norvegicus
aaatgcacaccgttgtgtctcggtt

SEQ ID NO: 17087 - DNA, 25 bp, Rattus norvegicus
aaatgcacaggtccgagtctagtcc

SEQ ID NO: 17088 - DNA, 25 bp, Rattus norvegicus
aaatgcacaggtgcgagtctagtcc

SEQ ID NO: 17089 - DNA, 25 bp, Rattus norvegicus
aaatgcacatgcacccacagagaaa

SEQ ID NO: 17090 - DNA, 25 bp, Rattus norvegicus
aaatgcacatgctcccacagagaaa

SEQ ID NO: 17091 - DNA, 25 bp, Rattus norvegicus
aaatgcacccagcaagcttgtgaaa

SEQ ID NO: 17092 - DNA, 25 bp, Rattus norvegicus
aaatgcacccaggaagcttgtgaaa

SEQ ID NO: 17093 - DNA, 25 bp, Rattus norvegicus
aaatgcaccctgagctgtaggccaa

SEQ ID NO: 17094 - DNA, 25 bp, Rattus norvegicus
aaatgcaccctgtgctgtaggccaa

SEQ ID NO: 17095 - DNA, 25 bp, Rattus norvegicus
aaatgcacctttcacattgtcccca

SEQ ID NO: 17096 - DNA, 25 bp, Rattus norvegicus
aaatgcacctttgacattgtcccca

SEQ ID NO: 17097 - DNA, 25 bp, Rattus norvegicus
aaatgcactaacagaccttcagcct

SEQ ID NO: 17098 - DNA, 25 bp, Rattus norvegicus
aaatgcactaactgaccttcagcct

SEQ ID NO: 17099 - DNA, 25 bp, Rattus norvegicus
aaatgcactcctcgatgatcctgga

SEQ ID NO: 17100 - DNA, 25 bp, Rattus norvegicus
aaatgcactcctggatgatcctgga

SEQ ID NO: 17101 - DNA, 25 bp, Rattus norvegicus
aaatgcactgacacaaggacttggc

SEQ ID NO: 17102 - DNA, 25 bp, Rattus norvegicus
aaatgcactgactcaaggacttggc

SEQ ID NO: 17103 - DNA, 25 bp, Rattus norvegicus
aaatgcactgtgaagattccagtat

SEQ ID NO: 17104 - DNA, 25 bp, Rattus norvegicus
aaatgcactgtgaatgtggttcaag

SEQ ID NO: 17105 - DNA, 25 bp, Rattus norvegicus
aaatgcactgtgtagattccagtat

SEQ ID NO: 17106 - DNA, 25 bp, Rattus norvegicus
aaatgcactgtgtatgtggttcaag

SEQ ID NO: 17107 - DNA, 25 bp, Rattus norvegicus
aaatgcagacagcacctggatttct

SEQ ID NO: 17108 - DNA, 25 bp, Rattus norvegicus
aaatgcagacaggacctggatttct

SEQ ID NO: 17109 - DNA, 25 bp, Rattus norvegicus
aaatgcagacggagaacctgggcgt

SEQ ID NO: 17110 - DNA, 25 bp, Rattus norvegicus
aaatgcagacggtgaacctgggcgt

SEQ ID NO: 17111 - DNA, 25 bp, Rattus norvegicus
aaatgcagagccatggcatgctttg

SEQ ID NO: 17112 - DNA, 25 bp, Rattus norvegicus
aaatgcagagccttggcatgctttg

SEQ ID NO: 17113 - DNA, 25 bp, Rattus norvegicus
aaatgcagcatcaaattcgacaaat

SEQ ID NO: 17114 - DNA, 25 bp, Rattus norvegicus
aaatgcagcatctaattcgacaaat

SEQ ID NO: 17115 - DNA, 25 bp, Rattus norvegicus
aaatgcagccataaagactgtctgt

SEQ ID NO: 17116 - DNA, 25 bp, Rattus norvegicus
aaatgcagccattaagactgtctgt

SEQ ID NO: 17117 - DNA, 25 bp, Rattus norvegicus
aaatgcagcctccacatcagcagat

SEQ ID NO: 17118 - DNA, 25 bp, Rattus norvegicus
aaatgcagcctcgacatcagcagat

SEQ ID NO: 17119 - DNA, 25 bp, Rattus norvegicus
aaatgcagctaaccggtgttttaga

SEQ ID NO: 17120 - DNA, 25 bp, Rattus norvegicus
aaatgcagctaagcggtgttttaga

SEQ ID NO: 17121 - DNA, 25 bp, Rattus norvegicus
aaatgcagctctaggcctgaggtca

SEQ ID NO: 17122 - DNA, 25 bp, Rattus norvegicus
aaatgcagctcttggcctgaggtca

SEQ ID NO: 17123 - DNA, 25 bp, Rattus norvegicus
aaatgcagctttcttcttattccct

SEQ ID NO: 17124 - DNA, 25 bp, Rattus norvegicus
aaatgcagctttgttcttattccct

SEQ ID NO: 17125 - DNA, 25 bp, Rattus norvegicus
aaatgcaggaaacttcttctccaaa

SEQ ID NO: 17126 - DNA, 25 bp, Rattus norvegicus
aaatgcaggaaagttcttctccaaa

SEQ ID NO: 17127 - DNA, 25 bp, Rattus norvegicus
aaatgcagtctgatccgtgtctgat

SEQ ID NO: 17128 - DNA, 25 bp, Rattus norvegicus
aaatgcagtctgttccgtgtctgat

SEQ ID NO: 17129 - DNA, 25 bp, Rattus norvegicus
aaatgcagtcttcctggtttgacag

SEQ ID NO: 17130 - DNA, 25 bp, Rattus norvegicus
aaatgcagtcttgctggtttgacag

SEQ ID NO: 17131 - DNA, 25 bp, Rattus norvegicus
aaatgcatatatcctatcatagcca

SEQ ID NO: 17132 - DNA, 25 bp, Rattus norvegicus
aaatgcatatatgctatcatagcca

SEQ ID NO: 17133 - DNA, 25 bp, Rattus norvegicus
aaatgcatcagaactttgccagcaa

SEQ ID NO: 17134 - DNA, 25 bp, Rattus norvegicus
aaatgcatcagatctttgccagcaa

SEQ ID NO: 17135 - DNA, 25 bp, Rattus norvegicus
aaatgcatccttcgtgctcaagcca

SEQ ID NO: 17136 - DNA, 25 bp, Rattus norvegicus
aaatgcatccttggtgctcaagcca

SEQ ID NO: 17137 - DNA, 25 bp, Rattus norvegicus
aaatgcatgcttataggattatact

SEQ ID NO: 17138 - DNA, 25 bp, Rattus norvegicus
aaatgcatgcttttaggattatact

SEQ ID NO: 17139 - DNA, 25 bp, Rattus norvegicus
aaatgcatggcaaatcctttaaacc

SEQ ID NO: 17140 - DNA, 25 bp, Rattus norvegicus
aaatgcatggcatatcctttaaacc

SEQ ID NO: 17141 - DNA, 25 bp, Rattus norvegicus
aaatgcattgcactcttggagaaat

SEQ ID NO: 17142 - DNA, 25 bp, Rattus norvegicus
aaatgcattgcagtcttggagaaat

SEQ ID NO: 17143 - DNA, 25 bp, Rattus norvegicus
aaatgcattgtaaggatttgccaca

SEQ ID NO: 17144 - DNA, 25 bp, Rattus norvegicus
aaatgcattgtatggatttgccaca

SEQ ID NO: 17145 - DNA, 25 bp, Rattus norvegicus
aaatgccaaaaaccgtgcttctaga

SEQ ID NO: 17146 - DNA, 25 bp, Rattus norvegicus
aaatgccaaaaagcgtgcttctaga

SEQ ID NO: 17147 - DNA, 25 bp, Rattus norvegicus
aaatgccaaaaccatgaccacgtcc

SEQ ID NO: 17148 - DNA, 25 bp, Rattus norvegicus
aaatgccaaaacgatgaccacgtcc

SEQ ID NO: 17149 - DNA, 25 bp, Rattus norvegicus
aaatgccaaatcactaggtgctaag

SEQ ID NO: 17150 - DNA, 25 bp, Rattus norvegicus
aaatgccaaatctctaggtgctaag

SEQ ID NO: 17151 - DNA, 25 bp, Rattus norvegicus
aaatgccaagataatgcgtccagat

SEQ ID NO: 17152 - DNA, 25 bp, Rattus norvegicus
aaatgccaagattatgcgtccagat

SEQ ID NO: 17153 - DNA, 25 bp, Rattus norvegicus
aaatgccaagccataatcgcctaac

SEQ ID NO: 17154 - DNA, 25 bp, Rattus norvegicus
aaatgccaagccctgggtcatgcct

SEQ ID NO: 17155 - DNA, 25 bp, Rattus norvegicus
aaatgccaagccgtgggtcatgcct

SEQ ID NO: 17156 - DNA, 25 bp, Rattus norvegicus
aaatgccaagccttaatcgcctaac

SEQ ID NO: 17157 - DNA, 25 bp, Rattus norvegicus
aaatgccaagtactgacctctgctc

SEQ ID NO: 17158 - DNA, 25 bp, Rattus norvegicus
aaatgccaagtagtgacctctgctc

SEQ ID NO: 17159 - DNA, 25 bp, Rattus norvegicus
aaatgccaataactttgtgcctaaa

SEQ ID NO: 17160 - DNA, 25 bp, Rattus norvegicus
aaatgccaataagtttgtgcctaaa

SEQ ID NO: 17161 - DNA, 25 bp, Rattus norvegicus
aaatgccaatcacatgtttgtggaa

SEQ ID NO: 17162 - DNA, 25 bp, Rattus norvegicus
aaatgccaatcagatgtttgtggaa

SEQ ID NO: 17163 - DNA, 25 bp, Rattus norvegicus
aaatgccaattcaggccaccggagg

SEQ ID NO: 17164 - DNA, 25 bp, Rattus norvegicus
aaatgccaattctggccaccggagg

SEQ ID NO: 17165 - DNA, 25 bp, Rattus norvegicus
aaatgccaccctaccttagtgaagc

SEQ ID NO: 17166 - DNA, 25 bp, Rattus norvegicus
aaatgccacccttccttagtgaagc

SEQ ID NO: 17167 - DNA, 25 bp, Rattus norvegicus
aaatgccaccgtccgatggaaaaca

SEQ ID NO: 17168 - DNA, 25 bp, Rattus norvegicus
aaatgccaccgtgcgatggaaaaca

SEQ ID NO: 17169 - DNA, 25 bp, Rattus norvegicus
aaatgccaccttcattcaggcgaat

SEQ ID NO: 17170 - DNA, 25 bp, Rattus norvegicus
aaatgccaccttgattcaggcgaat

SEQ ID NO: 17171 - DNA, 25 bp, Rattus norvegicus
aaatgccactcacagtgctgttgat

SEQ ID NO: 17172 - DNA, 25 bp, Rattus norvegicus
aaatgccactcagagtgctgttgat

SEQ ID NO: 17173 - DNA, 25 bp, Rattus norvegicus
aaatgccactttatcagagatgatt

SEQ ID NO: 17174 - DNA, 25 bp, Rattus norvegicus
aaatgccactttctatcttcaataa

SEQ ID NO: 17175 - DNA, 25 bp, Rattus norvegicus
aaatgccactttgtatcttcaataa

SEQ ID NO: 17176 - DNA, 25 bp, Rattus norvegicus
aaatgccactttttcagagatgatt

SEQ ID NO: 17177 - DNA, 25 bp, Rattus norvegicus
aaatgccagaatatcaaccaggcgg

SEQ ID NO: 17178 - DNA, 25 bp, Rattus norvegicus
aaatgccagaatttcaaccaggcgg

SEQ ID NO: 17179 - DNA, 25 bp, Rattus norvegicus
aaatgccagtatctgttgctcctct

SEQ ID NO: 17180 - DNA, 25 bp, Rattus norvegicus
aaatgccagtatgtgttgctcctct

SEQ ID NO: 17181 - DNA, 25 bp, Rattus norvegicus
aaatgccagtctcctttgtttgttt

SEQ ID NO: 17182 - DNA, 25 bp, Rattus norvegicus
aaatgccagtctgctttgtttgttt

SEQ ID NO: 17183 - DNA, 25 bp, Rattus norvegicus
aaatgccagttacagatgatgacaa

SEQ ID NO: 17184 - DNA, 25 bp, Rattus norvegicus
aaatgccagttagagatgatgacaa

SEQ ID NO: 17185 - DNA, 25 bp, Rattus norvegicus
aaatgccagttcagcgttctgtggg

SEQ ID NO: 17186 - DNA, 25 bp, Rattus norvegicus
aaatgccagttctgcgttctgtggg

SEQ ID NO: 17187 - DNA, 25 bp, Rattus norvegicus
aaatgccagtttctaacacctccct

SEQ ID NO: 17188 - DNA, 25 bp, Rattus norvegicus
aaatgccagtttgtaacacctccct

SEQ ID NO: 17189 - DNA, 25 bp, Rattus norvegicus
aaatgccatagtacagtcagcttga

SEQ ID NO: 17190 - DNA, 25 bp, Rattus norvegicus
aaatgccatagttcagtcagcttga

SEQ ID NO: 17191 - DNA, 25 bp, Rattus norvegicus
aaatgccatcgaaatgcagccagga

SEQ ID NO: 17192 - DNA, 25 bp, Rattus norvegicus
aaatgccatcgatatgcagccagga

SEQ ID NO: 17193 - DNA, 25 bp, Rattus norvegicus
aaatgccatcgcagtcagtgtgacc

SEQ ID NO: 17194 - DNA, 25 bp, Rattus norvegicus
aaatgccatcgctgtcagtgtgacc

SEQ ID NO: 17195 - DNA, 25 bp, Rattus norvegicus
aaatgccatctcatgcaaatttata

SEQ ID NO: 17196 - DNA, 25 bp, Rattus norvegicus
aaatgccatctcttgcaaatttata

SEQ ID NO: 17197 - DNA, 25 bp, Rattus norvegicus
aaatgccatgaacacctatgtggaa

SEQ ID NO: 17198 - DNA, 25 bp, Rattus norvegicus
aaatgccatgaagacctatgtggaa

SEQ ID NO: 17199 - DNA, 25 bp, Rattus norvegicus
aaatgccatgctcgacttgtgcaca

SEQ ID NO: 17200 - DNA, 25 bp, Rattus norvegicus
aaatgccatgctggacttgtgcaca

SEQ ID NO: 17201 - DNA, 25 bp, Rattus norvegicus
aaatgccatggcatgatgttccgac

SEQ ID NO: 17202 - DNA, 25 bp, Rattus norvegicus
aaatgccatggcttgatgttccgac

SEQ ID NO: 17203 - DNA, 25 bp, Rattus norvegicus
aaatgccattacagctcttttaggg

SEQ ID NO: 17204 - DNA, 25 bp, Rattus norvegicus
aaatgccattactgctcttttaggg

SEQ ID NO: 17205 - DNA, 25 bp, Rattus norvegicus
aaatgccattcaactgctggtctgt

SEQ ID NO: 17206 - DNA, 25 bp, Rattus norvegicus
aaatgccattcatctgctggtctgt

SEQ ID NO: 17207 - DNA, 25 bp, Rattus norvegicus
aaatgccattcccagtgagtgatag

SEQ ID NO: 17208 - DNA, 25 bp, Rattus norvegicus
aaatgccattccgagtgagtgatag

SEQ ID NO: 17209 - DNA, 25 bp, Rattus norvegicus
aaatgcccaggtctaccatgtgcca

SEQ ID NO: 17210 - DNA, 25 bp, Rattus norvegicus
aaatgcccaggtgtaccatgtgcca

SEQ ID NO: 17211 - DNA, 25 bp, Rattus norvegicus
aaatgcccatttcatctgtgacaag

SEQ ID NO: 17212 - DNA, 25 bp, Rattus norvegicus
aaatgcccatttgatctgtgacaag

SEQ ID NO: 17213 - DNA, 25 bp, Rattus norvegicus
aaatgccccaacacaggcgggagaa

SEQ ID NO: 17214 - DNA, 25 bp, Rattus norvegicus
aaatgccccaactcaggcgggagaa

SEQ ID NO: 17215 - DNA, 25 bp, Rattus norvegicus
aaatgccccgtaagttggcacgtct

SEQ ID NO: 17216 - DNA, 25 bp, Rattus norvegicus
aaatgccccgtatgttggcacgtct

SEQ ID NO: 17217 - DNA, 25 bp, Rattus norvegicus
aaatgcccctatatctgatgatgtc

SEQ ID NO: 17218 - DNA, 25 bp, Rattus norvegicus
aaatgcccctatttctgatgatgtc

SEQ ID NO: 17219 - DNA, 25 bp, Rattus norvegicus
aaatgccccttcactggtaatgtct

SEQ ID NO: 17220 - DNA, 25 bp, Rattus norvegicus
aaatgccccttctctggtaatgtct

SEQ ID NO: 17221 - DNA, 25 bp, Rattus norvegicus
aaatgcccgaatctctgccattcta

SEQ ID NO: 17222 - DNA, 25 bp, Rattus norvegicus
aaatgcccgaatgtctgccattcta

SEQ ID NO: 17223 - DNA, 25 bp, Rattus norvegicus
aaatgcccggcaactgtgcgtgtga

SEQ ID NO: 17224 - DNA, 25 bp, Rattus norvegicus
aaatgcccggcatctgtgcgtgtga

SEQ ID NO: 17225 - DNA, 25 bp, Rattus norvegicus
aaatgcccggttccttgctgatctg

SEQ ID NO: 17226 - DNA, 25 bp, Rattus norvegicus
aaatgcccggttgcttgctgatctg

SEQ ID NO: 17227 - DNA, 25 bp, Rattus norvegicus
aaatgcccgtccaatagagtgtctg

SEQ ID NO: 17228 - DNA, 25 bp, Rattus norvegicus
aaatgcccgtcctatagagtgtctg

SEQ ID NO: 17229 - DNA, 25 bp, Rattus norvegicus
aaatgcccgtgtctgacttcagttg

SEQ ID NO: 17230 - DNA, 25 bp, Rattus norvegicus
aaatgcccgtgtgtgacttcagttg

SEQ ID NO: 17231 - DNA, 25 bp, Rattus norvegicus
aaatgccctcacagtgtagtgcact

SEQ ID NO: 17232 - DNA, 25 bp, Rattus norvegicus
aaatgccctcactgtgtagtgcact

SEQ ID NO: 17233 - DNA, 25 bp, Rattus norvegicus
aaatgccctcgcatagctttattct

SEQ ID NO: 17234 - DNA, 25 bp, Rattus norvegicus
aaatgccctcgcttagctttattct

SEQ ID NO: 17235 - DNA, 25 bp, Rattus norvegicus
aaatgccctctgacccagggatggg

SEQ ID NO: 17236 - DNA, 25 bp, Rattus norvegicus
aaatgccctctgtcccagggatggg

SEQ ID NO: 17237 - DNA, 25 bp, Rattus norvegicus
aaatgccggagccacgaaagccagc

SEQ ID NO: 17238 - DNA, 25 bp, Rattus norvegicus
aaatgccggagcgacgaaagccagc

SEQ ID NO: 17239 - DNA, 25 bp, Rattus norvegicus
aaatgcctaattctactatgtgtac

SEQ ID NO: 17240 - DNA, 25 bp, Rattus norvegicus
aaatgcctaattgtactatgtgtac

SEQ ID NO: 17241 - DNA, 25 bp, Rattus norvegicus
aaatgcctacttccaagtcttgctt

SEQ ID NO: 17242 - DNA, 25 bp, Rattus norvegicus
aaatgcctacttgcaagtcttgctt

SEQ ID NO: 17243 - DNA, 25 bp, Rattus norvegicus
aaatgcctagttagactcagttcat

SEQ ID NO: 17244 - DNA, 25 bp, Rattus norvegicus
aaatgcctagtttgactcagttcat

SEQ ID NO: 17245 - DNA, 25 bp, Rattus norvegicus
aaatgcctcaccatggtcccaagga

SEQ ID NO: 17246 - DNA, 25 bp, Rattus norvegicus
aaatgcctcaccttggtcccaagga

SEQ ID NO: 17247 - DNA, 25 bp, Rattus norvegicus
aaatgcctcatgcttgtcgggtttc

SEQ ID NO: 17248 - DNA, 25 bp, Rattus norvegicus
aaatgcctcatggttgtcgggtttc

SEQ ID NO: 17249 - DNA, 25 bp, Rattus norvegicus
aaatgcctccaaagtcaaggccata

SEQ ID NO: 17250 - DNA, 25 bp, Rattus norvegicus
aaatgcctccaatgtcaaggccata

SEQ ID NO: 17251 - DNA, 25 bp, Rattus norvegicus
aaatgcctccctaaatgttgtgccc

SEQ ID NO: 17252 - DNA, 25 bp, Rattus norvegicus
aaatgcctcccttaatgttgtgccc

SEQ ID NO: 17253 - DNA, 25 bp, Rattus norvegicus
aaatgcctcctgaccatgtgaaggt

SEQ ID NO: 17254 - DNA, 25 bp, Rattus norvegicus
aaatgcctcctgtccatgtgaaggt

SEQ ID NO: 17255 - DNA, 25 bp, Rattus norvegicus
aaatgcctctaaagatgtagttgtt

SEQ ID NO: 17256 - DNA, 25 bp, Rattus norvegicus
aaatgcctctaatgatgtagttgtt

SEQ ID NO: 17257 - DNA, 25 bp, Rattus norvegicus
aaatgcctctgactgtctgacccag

SEQ ID NO: 17258 - DNA, 25 bp, Rattus norvegicus
aaatgcctctgagtgtctgacccag

SEQ ID NO: 17259 - DNA, 25 bp, Rattus norvegicus
aaatgcctgacaactgcacttccag

SEQ ID NO: 17260 - DNA, 25 bp, Rattus norvegicus
aaatgcctgacatctgcacttccag

SEQ ID NO: 17261 - DNA, 25 bp, Rattus norvegicus
aaatgcctgactcctgctgggcctt

SEQ ID NO: 17262 - DNA, 25 bp, Rattus norvegicus
aaatgcctgactgctgctgggcctt

SEQ ID NO: 17263 - DNA, 25 bp, Rattus norvegicus
aaatgcctgaggaagttctgctgcg

SEQ ID NO: 17264 - DNA, 25 bp, Rattus norvegicus
aaatgcctgaggtagttctgctgcg

SEQ ID NO: 17265 - DNA, 25 bp, Rattus norvegicus
aaatgcctgagtctgttatgccaaa

SEQ ID NO: 17266 - DNA, 25 bp, Rattus norvegicus
aaatgcctgagtgtgttatgccaaa

SEQ ID NO: 17267 - DNA, 25 bp, Rattus norvegicus
aaatgcctgcccagtgtagtgggag

SEQ ID NO: 17268 - DNA, 25 bp, Rattus norvegicus
aaatgcctgcccctgcagctcggag

SEQ ID NO: 17269 - DNA, 25 bp, Rattus norvegicus
aaatgcctgcccgtgcagctcggag

SEQ ID NO: 17270 - DNA, 25 bp, Rattus norvegicus
aaatgcctgccctgtgtagtgggag

SEQ ID NO: 17271 - DNA, 25 bp, Rattus norvegicus
aaatgcctgcgtcatgctcgggctt

SEQ ID NO: 17272 - DNA, 25 bp, Rattus norvegicus
aaatgcctgcgtgatgctcgggctt

SEQ ID NO: 17273 - DNA, 25 bp, Rattus norvegicus
aaatgcctgctgatgtaaatgtctg

SEQ ID NO: 17274 - DNA, 25 bp, Rattus norvegicus
aaatgcctgctgttgtaaatgtctg

SEQ ID NO: 17275 - DNA, 25 bp, Rattus norvegicus
aaatgcctggaacacagggcccctt

SEQ ID NO: 17276 - DNA, 25 bp, Rattus norvegicus
aaatgcctggaagacagggcccctt

SEQ ID NO: 17277 - DNA, 25 bp, Rattus norvegicus
aaatgcctggccagcatcaaactgg

SEQ ID NO: 17278 - DNA, 25 bp, Rattus norvegicus
aaatgcctggcctgcatcaaactgg

SEQ ID NO: 17279 - DNA, 25 bp, Rattus norvegicus
aaatgcctggttagccatagatctg

SEQ ID NO: 17280 - DNA, 25 bp, Rattus norvegicus
aaatgcctggtttgccatagatctg

SEQ ID NO: 17281 - DNA, 25 bp, Rattus norvegicus
aaatgcctgtatccctttttctggt

SEQ ID NO: 17282 - DNA, 25 bp, Rattus norvegicus
aaatgcctgtatgcctttttctggt

SEQ ID NO: 17283 - DNA, 25 bp, Rattus norvegicus
aaatgccttaagcagactctgtctc

SEQ ID NO: 17284 - DNA, 25 bp, Rattus norvegicus
aaatgccttaaggagactctgtctc

SEQ ID NO: 17285 - DNA, 25 bp, Rattus norvegicus
aaatgccttcaaagatggcctgaaa

SEQ ID NO: 17286 - DNA, 25 bp, Rattus norvegicus
aaatgccttcaatgatggcctgaaa

SEQ ID NO: 17287 - DNA, 25 bp, Rattus norvegicus
aaatgccttgtgctgctgatacctt

SEQ ID NO: 17288 - DNA, 25 bp, Rattus norvegicus
aaatgccttgtggtgctgatacctt

SEQ ID NO: 17289 - DNA, 25 bp, Rattus norvegicus
aaatgccttgttacctttactattg

SEQ ID NO: 17290 - DNA, 25 bp, Rattus norvegicus
aaatgccttgtttcctttactattg

SEQ ID NO: 17291 - DNA, 25 bp, Rattus norvegicus
aaatgcctttagactctggcttccc

SEQ ID NO: 17292 - DNA, 25 bp, Rattus norvegicus
aaatgcctttagtctctggcttccc

SEQ ID NO: 17293 - DNA, 25 bp, Rattus norvegicus
aaatgcctttccatatttaggataa

SEQ ID NO: 17294 - DNA, 25 bp, Rattus norvegicus
aaatgcctttccttatttaggataa

SEQ ID NO: 17295 - DNA, 25 bp, Rattus norvegicus
aaatgccttttaaacacgactcgag

SEQ ID NO: 17296 - DNA, 25 bp, Rattus norvegicus
aaatgccttttatacacgactcgag

SEQ ID NO: 17297 - DNA, 25 bp, Rattus norvegicus
aaatgccttttcacagggccagtga

SEQ ID NO: 17298 - DNA, 25 bp, Rattus norvegicus
aaatgccttttctcagggccagtga

SEQ ID NO: 17299 - DNA, 25 bp, Rattus norvegicus
aaatgcgaagccaccagtttctggg

SEQ ID NO: 17300 - DNA, 25 bp, Rattus norvegicus
aaatgcgaagcctccagtttctggg

SEQ ID NO: 17301 - DNA, 25 bp, Rattus norvegicus
aaatgcgaggtaagtgcccacttct

SEQ ID NO: 17302 - DNA, 25 bp, Rattus norvegicus
aaatgcgaggtatgtgcccacttct

SEQ ID NO: 17303 - DNA, 25 bp, Rattus norvegicus
aaatgcgatggtacaacagctcgcc

SEQ ID NO: 17304 - DNA, 25 bp, Rattus norvegicus
aaatgcgatggttcaacagctcgcc

SEQ ID NO: 17305 - DNA, 25 bp, Rattus norvegicus
aaatgcgcagggatttaatgcacag

SEQ ID NO: 17306 - DNA, 25 bp, Rattus norvegicus
aaatgcgcagggttttaatgcacag

SEQ ID NO: 17307 - DNA, 25 bp, Rattus norvegicus
aaatgcgctcacctgacacttggta

SEQ ID NO: 17308 - DNA, 25 bp, Rattus norvegicus
aaatgcgctcacgtgacacttggta

SEQ ID NO: 17309 - DNA, 25 bp, Rattus norvegicus
aaatgcgcttatagctgggcttgct

SEQ ID NO: 17310 - DNA, 25 bp, Rattus norvegicus
aaatgcgcttattgctgggcttgct

SEQ ID NO: 17311 - DNA, 25 bp, Rattus norvegicus
aaatgcggaattacagtcttttagc

SEQ ID NO: 17312 - DNA, 25 bp, Rattus norvegicus
aaatgcggaatttcagtcttttagc

SEQ ID NO: 17313 - DNA, 25 bp, Rattus norvegicus
aaatgcggcagcattctgtgattcc

SEQ ID NO: 17314 - DNA, 25 bp, Rattus norvegicus
aaatgcggcagctttctgtgattcc

SEQ ID NO: 17315 - DNA, 25 bp, Rattus norvegicus
aaatgcggccataagctttgctcct

SEQ ID NO: 17316 - DNA, 25 bp, Rattus norvegicus
aaatgcggccattagctttgctcct

SEQ ID NO: 17317 - DNA, 25 bp, Rattus norvegicus
aaatgcggcctgagtctgactgtac

SEQ ID NO: 17318 - DNA, 25 bp, Rattus norvegicus
aaatgcggcctgtgtctgactgtac

SEQ ID NO: 17319 - DNA, 25 bp, Rattus norvegicus
aaatgcggcgagatcagcgagcgaa

SEQ ID NO: 17320 - DNA, 25 bp, Rattus norvegicus
aaatgcggcgagttcagcgagcgaa

SEQ ID NO: 17321 - DNA, 25 bp, Rattus norvegicus
aaatgcggctgcctttgaagtcctt

SEQ ID NO: 17322 - DNA, 25 bp, Rattus norvegicus
aaatgcggctgcgtttgaagtcctt

SEQ ID NO: 17323 - DNA, 25 bp, Rattus norvegicus
aaatgcgggcctatcatcgattctt

SEQ ID NO: 17324 - DNA, 25 bp, Rattus norvegicus
aaatgcgggcctttcatcgattctt

SEQ ID NO: 17325 - DNA, 25 bp, Rattus norvegicus
aaatgcgtacgtacttccaccttat

SEQ ID NO: 17326 - DNA, 25 bp, Rattus norvegicus
aaatgcgtacgttcttccaccttat

SEQ ID NO: 17327 - DNA, 25 bp, Rattus norvegicus
aaatgcgtctatcatcctttcaaaa

SEQ ID NO: 17328 - DNA, 25 bp, Rattus norvegicus
aaatgcgtctatgatcctttcaaaa

SEQ ID NO: 17329 - DNA, 25 bp, Rattus norvegicus
aaatgcgtgaataggcggctttgtt

SEQ ID NO: 17330 - DNA, 25 bp, Rattus norvegicus
aaatgcgtgaattggcggctttgtt

SEQ ID NO: 17331 - DNA, 25 bp, Rattus norvegicus
aaatgcgtggtactttcgctgacaa

SEQ ID NO: 17332 - DNA, 25 bp, Rattus norvegicus
aaatgcgtggtagtttcgctgacaa

SEQ ID NO: 17333 - DNA, 25 bp, Rattus norvegicus
aaatgcgttcccaaactggcaagtt

SEQ ID NO: 17334 - DNA, 25 bp, Rattus norvegicus
aaatgcgttccctaactggcaagtt

SEQ ID NO: 17335 - DNA, 25 bp, Rattus norvegicus
aaatgcgttctcaggccaaaggctc

SEQ ID NO: 17336 - DNA, 25 bp, Rattus norvegicus
aaatgcgttctctggccaaaggctc

SEQ ID NO: 17337 - DNA, 25 bp, Rattus norvegicus
aaatgcgttgtaaaatattgccaaa

SEQ ID NO: 17338 - DNA, 25 bp, Rattus norvegicus
aaatgcgttgtataatattgccaaa

SEQ ID NO: 17339 - DNA, 25 bp, Rattus norvegicus
aaatgctaattaccagttccagtgt

SEQ ID NO: 17340 - DNA, 25 bp, Rattus norvegicus
aaatgctaattagcagttccagtgt

SEQ ID NO: 17341 - DNA, 25 bp, Rattus norvegicus
aaatgctacttcagctttctagtta

SEQ ID NO: 17342 - DNA, 25 bp, Rattus norvegicus
aaatgctacttctgctttctagtta

SEQ ID NO: 17343 - DNA, 25 bp, Rattus norvegicus
aaatgctactttacagagccttcca

SEQ ID NO: 17344 - DNA, 25 bp, Rattus norvegicus
aaatgctacttttcagagccttcca

SEQ ID NO: 17345 - DNA, 25 bp, Rattus norvegicus
aaatgctagcgtcttcactgtcgcc

SEQ ID NO: 17346 - DNA, 25 bp, Rattus norvegicus
aaatgctagcgtgttcactgtcgcc

SEQ ID NO: 17347 - DNA, 25 bp, Rattus norvegicus
aaatgctaggatcccgtattcaccc

SEQ ID NO: 17348 - DNA, 25 bp, Rattus norvegicus
aaatgctaggatgccgtattcaccc

SEQ ID NO: 17349 - DNA, 25 bp, Rattus norvegicus
aaatgctagtcacaaagccacggat

SEQ ID NO: 17350 - DNA, 25 bp, Rattus norvegicus
aaatgctagtcagaaagccacggat

SEQ ID NO: 17351 - DNA, 25 bp, Rattus norvegicus
aaatgctagttgcactgctctgtta

SEQ ID NO: 17352 - DNA, 25 bp, Rattus norvegicus
aaatgctagttggactgctctgtta

SEQ ID NO: 17353 - DNA, 25 bp, Rattus norvegicus
aaatgctatattctggttccattaa

SEQ ID NO: 17354 - DNA, 25 bp, Rattus norvegicus
aaatgctatattgtggttccattaa

SEQ ID NO: 17355 - DNA, 25 bp, Rattus norvegicus
aaatgctatcaacctgggccctgag

SEQ ID NO: 17356 - DNA, 25 bp, Rattus norvegicus
aaatgctatcaagctgggccctgag

SEQ ID NO: 17357 - DNA, 25 bp, Rattus norvegicus
aaatgctatgtcagttccctacact

SEQ ID NO: 17358 - DNA, 25 bp, Rattus norvegicus
aaatgctatgtctgttccctacact

SEQ ID NO: 17359 - DNA, 25 bp, Rattus norvegicus
aaatgctatttcctttcttaccttg

SEQ ID NO: 17360 - DNA, 25 bp, Rattus norvegicus
aaatgctatttcgtttcttaccttg

SEQ ID NO: 17361 - DNA, 25 bp, Rattus norvegicus
aaatgctcaatcaaacacccactaa

SEQ ID NO: 17362 - DNA, 25 bp, Rattus norvegicus
aaatgctcaatctaacacccactaa

SEQ ID NO: 17363 - DNA, 25 bp, Rattus norvegicus
aaatgctcacccaagtgtcttcaaa

SEQ ID NO: 17364 - DNA, 25 bp, Rattus norvegicus
aaatgctcaccctagtgtcttcaaa

SEQ ID NO: 17365 - DNA, 25 bp, Rattus norvegicus
aaatgctcactcaccccgaaagaga

SEQ ID NO: 17366 - DNA, 25 bp, Rattus norvegicus
aaatgctcactctccccgaaagaga

SEQ ID NO: 17367 - DNA, 25 bp, Rattus norvegicus
aaatgctccattagctctaaaagat

SEQ ID NO: 17368 - DNA, 25 bp, Rattus norvegicus
aaatgctccatttgctctaaaagat

SEQ ID NO: 17369 - DNA, 25 bp, Rattus norvegicus
aaatgctcccatagtgaattataaa

SEQ ID NO: 17370 - DNA, 25 bp, Rattus norvegicus
aaatgctcccattgtgaattataaa

SEQ ID NO: 17371 - DNA, 25 bp, Rattus norvegicus
aaatgctcctagacatgtgctctgt

SEQ ID NO: 17372 - DNA, 25 bp, Rattus norvegicus
aaatgctcctagtcatgtgctctgt

SEQ ID NO: 17373 - DNA, 25 bp, Rattus norvegicus
aaatgctcgaccaggtcgccgcgaa

SEQ ID NO: 17374 - DNA, 25 bp, Rattus norvegicus
aaatgctcgacctggtcgccgcgaa

SEQ ID NO: 17375 - DNA, 25 bp, Rattus norvegicus
aaatgctcgtgacttcagatgggaa

SEQ ID NO: 17376 - DNA, 25 bp, Rattus norvegicus
aaatgctcgtgagttcagatgggaa

SEQ ID NO: 17377 - DNA, 25 bp, Rattus norvegicus
aaatgctcgtttagctattgcgtct

SEQ ID NO: 17378 - DNA, 25 bp, Rattus norvegicus
aaatgctcgttttgctattgcgtct

SEQ ID NO: 17379 - DNA, 25 bp, Rattus norvegicus
aaatgctctaatcttttatgactga

SEQ ID NO: 17380 - DNA, 25 bp, Rattus norvegicus
aaatgctctaatgttttatgactga

SEQ ID NO: 17381 - DNA, 25 bp, Rattus norvegicus
aaatgctctattaaggcttcctgga

SEQ ID NO: 17382 - DNA, 25 bp, Rattus norvegicus
aaatgctctattacttctctattgt

SEQ ID NO: 17383 - DNA, 25 bp, Rattus norvegicus
aaatgctctatttaggcttcctgga

SEQ ID NO: 17384 - DNA, 25 bp, Rattus norvegicus
aaatgctctatttcttctctattgt

SEQ ID NO: 17385 - DNA, 25 bp, Rattus norvegicus
aaatgctctccaacgttgttcctaa

SEQ ID NO: 17386 - DNA, 25 bp, Rattus norvegicus
aaatgctctccatcgttgttcctaa

SEQ ID NO: 17387 - DNA, 25 bp, Rattus norvegicus
aaatgctctctacctctggttggag

SEQ ID NO: 17388 - DNA, 25 bp, Rattus norvegicus
aaatgctctctagctctggttggag

SEQ ID NO: 17389 - DNA, 25 bp, Rattus norvegicus
aaatgctctgacatttgccaagatg

SEQ ID NO: 17390 - DNA, 25 bp, Rattus norvegicus
aaatgctctgacttttgccaagatg

SEQ ID NO: 17391 - DNA, 25 bp, Rattus norvegicus
aaatgctctgatatccaatgagtcc

SEQ ID NO: 17392 - DNA, 25 bp, Rattus norvegicus
aaatgctctgatttccaatgagtcc

SEQ ID NO: 17393 - DNA, 25 bp, Rattus norvegicus
aaatgctctgggatttttgtcctcc

SEQ ID NO: 17394 - DNA, 25 bp, Rattus norvegicus
aaatgctctgggttttttgtcctcc

SEQ ID NO: 17395 - DNA, 25 bp, Rattus norvegicus
aaatgctctttgatctgtgtgccgc

SEQ ID NO: 17396 - DNA, 25 bp, Rattus norvegicus
aaatgctctttgttctgtgtgccgc

SEQ ID NO: 17397 - DNA, 25 bp, Rattus norvegicus
aaatgctgaaacctctactccgtat

SEQ ID NO: 17398 - DNA, 25 bp, Rattus norvegicus
aaatgctgaaacgtctactccgtat

SEQ ID NO: 17399 - DNA, 25 bp, Rattus norvegicus
aaatgctgaatactattaacattgt

SEQ ID NO: 17400 - DNA, 25 bp, Rattus norvegicus
aaatgctgaatagtattaacattgt

SEQ ID NO: 17401 - DNA, 25 bp, Rattus norvegicus
aaatgctgactcacagccctagata

SEQ ID NO: 17402 - DNA, 25 bp, Rattus norvegicus
aaatgctgactctcagccctagata

SEQ ID NO: 17403 - DNA, 25 bp, Rattus norvegicus
aaatgctgagttccctggaggccca

SEQ ID NO: 17404 - DNA, 25 bp, Rattus norvegicus
aaatgctgagttgcctggaggccca

SEQ ID NO: 17405 - DNA, 25 bp, Rattus norvegicus
aaatgctgatggctcgaagggcaca

SEQ ID NO: 17406 - DNA, 25 bp, Rattus norvegicus
aaatgctgatgggtcgaagggcaca

SEQ ID NO: 17407 - DNA, 25 bp, Rattus norvegicus
aaatgctgcactcttgattctttca

SEQ ID NO: 17408 - DNA, 25 bp, Rattus norvegicus
aaatgctgcactgttgattctttca

SEQ ID NO: 17409 - DNA, 25 bp, Rattus norvegicus
aaatgctgcagactttttgagttcc

SEQ ID NO: 17410 - DNA, 25 bp, Rattus norvegicus
aaatgctgcagagtttttgagttcc

SEQ ID NO: 17411 - DNA, 25 bp, Rattus norvegicus
aaatgctgcatcatgtaaactaata

SEQ ID NO: 17412 - DNA, 25 bp, Rattus norvegicus
aaatgctgcatcttgtaaactaata

SEQ ID NO: 17413 - DNA, 25 bp, Rattus norvegicus
aaatgctgcattaacttttaaccaa

SEQ ID NO: 17414 - DNA, 25 bp, Rattus norvegicus
aaatgctgcatttacttttaaccaa

SEQ ID NO: 17415 - DNA, 25 bp, Rattus norvegicus
aaatgctgccatatttgacccctga

SEQ ID NO: 17416 - DNA, 25 bp, Rattus norvegicus
aaatgctgccatttttgacccctga

SEQ ID NO: 17417 - DNA, 25 bp, Rattus norvegicus
aaatgctgccctccctgtgtttggg

SEQ ID NO: 17418 - DNA, 25 bp, Rattus norvegicus
aaatgctgccctgcctgtgtttggg

SEQ ID NO: 17419 - DNA, 25 bp, Rattus norvegicus
aaatgctgctatcgtggtgcacacc

SEQ ID NO: 17420 - DNA, 25 bp, Rattus norvegicus
aaatgctgctatggtggtgcacacc

SEQ ID NO: 17421 - DNA, 25 bp, Rattus norvegicus
aaatgctgctccaagagggcctcag

SEQ ID NO: 17422 - DNA, 25 bp, Rattus norvegicus
aaatgctgctccaagttacttaata

SEQ ID NO: 17423 - DNA, 25 bp, Rattus norvegicus
aaatgctgctcctagagggcctcag

SEQ ID NO: 17424 - DNA, 25 bp, Rattus norvegicus
aaatgctgctcctagttacttaata

SEQ ID NO: 17425 - DNA, 25 bp, Rattus norvegicus
aaatgctgctgcattcatctgttta

SEQ ID NO: 17426 - DNA, 25 bp, Rattus norvegicus
aaatgctgctgctttcatctgttta

SEQ ID NO: 17427 - DNA, 25 bp, Rattus norvegicus
aaatgctgctgtctatttctgtgca

SEQ ID NO: 17428 - DNA, 25 bp, Rattus norvegicus
aaatgctgctgtgtatttctgtgca

SEQ ID NO: 17429 - DNA, 25 bp, Rattus norvegicus
aaatgctgcttgattgcggcctgaa

SEQ ID NO: 17430 - DNA, 25 bp, Rattus norvegicus
aaatgctgcttgtttgcggcctgaa

SEQ ID NO: 17431 - DNA, 25 bp, Rattus norvegicus
aaatgctgctttcttcaacatggag

SEQ ID NO: 17432 - DNA, 25 bp, Rattus norvegicus
aaatgctgctttgttcaacatggag

SEQ ID NO: 17433 - DNA, 25 bp, Rattus norvegicus
aaatgctggagaatgaccctcaaaa

SEQ ID NO: 17434 - DNA, 25 bp, Rattus norvegicus
aaatgctggagattgaccctcaaaa

SEQ ID NO: 17435 - DNA, 25 bp, Rattus norvegicus
aaatgctggagtcacagccagtcct

SEQ ID NO: 17436 - DNA, 25 bp, Rattus norvegicus
aaatgctggagtgacagccagtcct

SEQ ID NO: 17437 - DNA, 25 bp, Rattus norvegicus
aaatgctggattattaacgctgaga

SEQ ID NO: 17438 - DNA, 25 bp, Rattus norvegicus
aaatgctggatttttaacgctgaga

SEQ ID NO: 17439 - DNA, 25 bp, Rattus norvegicus
aaatgctggcagaaccttggctttg

SEQ ID NO: 17440 - DNA, 25 bp, Rattus norvegicus
aaatgctggcagtaccttggctttg

SEQ ID NO: 17441 - DNA, 25 bp, Rattus norvegicus
aaatgctggcgcacacgtaagcaaa

SEQ ID NO: 17442 - DNA, 25 bp, Rattus norvegicus
aaatgctggcgctcacgtaagcaaa

SEQ ID NO: 17443 - DNA, 25 bp, Rattus norvegicus
aaatgctggcttaagtgcgtgtatt

SEQ ID NO: 17444 - DNA, 25 bp, Rattus norvegicus
aaatgctggctttagtgcgtgtatt

SEQ ID NO: 17445 - DNA, 25 bp, Rattus norvegicus
aaatgctgggccaacaggtgtgcgc

SEQ ID NO: 17446 - DNA, 25 bp, Rattus norvegicus
aaatgctgggcctacaggtgtgcgc

SEQ ID NO: 17447 - DNA, 25 bp, Rattus norvegicus
aaatgctgggtgatcacttggagaa

SEQ ID NO: 17448 - DNA, 25 bp, Rattus norvegicus
aaatgctgggtgttcacttggagaa

SEQ ID NO: 17449 - DNA, 25 bp, Rattus norvegicus
aaatgctgggttcttctgtggattc

SEQ ID NO: 17450 - DNA, 25 bp, Rattus norvegicus
aaatgctgggttgttctgtggattc

SEQ ID NO: 17451 - DNA, 25 bp, Rattus norvegicus
aaatgctggtcaaaacggagcccca

SEQ ID NO: 17452 - DNA, 25 bp, Rattus norvegicus
aaatgctggtcataacggagcccca

SEQ ID NO: 17453 - DNA, 25 bp, Rattus norvegicus
aaatgctggttcatgggttgatcaa

SEQ ID NO: 17454 - DNA, 25 bp, Rattus norvegicus
aaatgctggttcttgggttgatcaa

SEQ ID NO: 17455 - DNA, 25 bp, Rattus norvegicus
aaatgctggtttcttggttgttgtt

SEQ ID NO: 17456 - DNA, 25 bp, Rattus norvegicus
aaatgctggtttgttggttgttgtt

SEQ ID NO: 17457 - DNA, 25 bp, Rattus norvegicus
aaatgctgtaatacgtaggcgttaa

SEQ ID NO: 17458 - DNA, 25 bp, Rattus norvegicus
aaatgctgtaattcgtaggcgttaa

SEQ ID NO: 17459 - DNA, 25 bp, Rattus norvegicus
aaatgctgtaccatgcgaattgtca

SEQ ID NO: 17460 - DNA, 25 bp, Rattus norvegicus
aaatgctgtaccttgcgaattgtca

SEQ ID NO: 17461 - DNA, 25 bp, Rattus norvegicus
aaatgctgtagaccgcctgaaggac

SEQ ID NO: 17462 - DNA, 25 bp, Rattus norvegicus
aaatgctgtagagcgcctgaaggac

SEQ ID NO: 17463 - DNA, 25 bp, Rattus norvegicus
aaatgctgtcagattgtgctcacat

SEQ ID NO: 17464 - DNA, 25 bp, Rattus norvegicus
aaatgctgtcagtttgtgctcacat

SEQ ID NO: 17465 - DNA, 25 bp, Rattus norvegicus
aaatgctgtccacgctgtgcaggct

SEQ ID NO: 17466 - DNA, 25 bp, Rattus norvegicus
aaatgctgtccaggctgtgcaggct

SEQ ID NO: 17467 - DNA, 25 bp, Rattus norvegicus
aaatgctgtcctctgatggcgtcta

SEQ ID NO: 17468 - DNA, 25 bp, Rattus norvegicus
aaatgctgtcctgtgatggcgtcta

SEQ ID NO: 17469 - DNA, 25 bp, Rattus norvegicus
aaatgctgtctgattctttaccgat

SEQ ID NO: 17470 - DNA, 25 bp, Rattus norvegicus
aaatgctgtctgtttctttaccgat

SEQ ID NO: 17471 - DNA, 25 bp, Rattus norvegicus
aaatgctgtcttcaagagtgaccag

SEQ ID NO: 17472 - DNA, 25 bp, Rattus norvegicus
aaatgctgtcttgaagagtgaccag

SEQ ID NO: 17473 - DNA, 25 bp, Rattus norvegicus
aaatgctgtgccctgtttcttgacc

SEQ ID NO: 17474 - DNA, 25 bp, Rattus norvegicus
aaatgctgtgccgtgtttcttgacc

SEQ ID NO: 17475 - DNA, 25 bp, Rattus norvegicus
aaatgctgtgctcagctacatcccc

SEQ ID NO: 17476 - DNA, 25 bp, Rattus norvegicus
aaatgctgtgctgagctacatcccc

SEQ ID NO: 17477 - DNA, 25 bp, Rattus norvegicus
aaatgctgtttactttgtgctggat

SEQ ID NO: 17478 - DNA, 25 bp, Rattus norvegicus
aaatgctgtttagtttgtgctggat

SEQ ID NO: 17479 - DNA, 25 bp, Rattus norvegicus
aaatgctgtttcctttgttccccat

SEQ ID NO: 17480 - DNA, 25 bp, Rattus norvegicus
aaatgctgtttcgtttgttccccat

SEQ ID NO: 17481 - DNA, 25 bp, Rattus norvegicus
aaatgcttaaagagacagtagtttc

SEQ ID NO: 17482 - DNA, 25 bp, Rattus norvegicus
aaatgcttaaagtgacagtagtttc

SEQ ID NO: 17483 - DNA, 25 bp, Rattus norvegicus
aaatgcttagatacactttgggtgg

SEQ ID NO: 17484 - DNA, 25 bp, Rattus norvegicus
aaatgcttagattcactttgggtgg

SEQ ID NO: 17485 - DNA, 25 bp, Rattus norvegicus
aaatgcttatctaggacactccttt

SEQ ID NO: 17486 - DNA, 25 bp, Rattus norvegicus
aaatgcttatcttggacactccttt

SEQ ID NO: 17487 - DNA, 25 bp, Rattus norvegicus
aaatgcttatttaggacagtcagag

SEQ ID NO: 17488 - DNA, 25 bp, Rattus norvegicus
aaatgcttattttggacagtcagag

SEQ ID NO: 17489 - DNA, 25 bp, Rattus norvegicus
aaatgcttcaagaacactcaagctg

SEQ ID NO: 17490 - DNA, 25 bp, Rattus norvegicus
aaatgcttcaagagccctacagatt

SEQ ID NO: 17491 - DNA, 25 bp, Rattus norvegicus
aaatgcttcaagtacactcaagctg

SEQ ID NO: 17492 - DNA, 25 bp, Rattus norvegicus
aaatgcttcaagtgccctacagatt

SEQ ID NO: 17493 - DNA, 25 bp, Rattus norvegicus
aaatgcttcataattctttcacaga

SEQ ID NO: 17494 - DNA, 25 bp, Rattus norvegicus
aaatgcttcatatttctttcacaga

SEQ ID NO: 17495 - DNA, 25 bp, Rattus norvegicus
aaatgcttcggccaatgcttccttc

SEQ ID NO: 17496 - DNA, 25 bp, Rattus norvegicus
aaatgcttcggcgaatgcttccttc

SEQ ID NO: 17497 - DNA, 25 bp, Rattus norvegicus
aaatgcttctagaccaagaggcaca

SEQ ID NO: 17498 - DNA, 25 bp, Rattus norvegicus
aaatgcttctagtccaagaggcaca

SEQ ID NO: 17499 - DNA, 25 bp, Rattus norvegicus
aaatgcttgactcctatctcttctg

SEQ ID NO: 17500 - DNA, 25 bp, Rattus norvegicus
aaatgcttgactgctatctcttctg

SEQ ID NO: 17501 - DNA, 25 bp, Rattus norvegicus
aaatgcttgatgaactctagactag

SEQ ID NO: 17502 - DNA, 25 bp, Rattus norvegicus
aaatgcttgatgtactctagactag

SEQ ID NO: 17503 - DNA, 25 bp, Rattus norvegicus
aaatgcttgcagatcttaacgccaa

SEQ ID NO: 17504 - DNA, 25 bp, Rattus norvegicus
aaatgcttgcagttcttaacgccaa

SEQ ID NO: 17505 - DNA, 25 bp, Rattus norvegicus
aaatgcttgccacccaagcgtgaga

SEQ ID NO: 17506 - DNA, 25 bp, Rattus norvegicus
aaatgcttgccacctcacctgaagg

SEQ ID NO: 17507 - DNA, 25 bp, Rattus norvegicus
aaatgcttgccagccaagcgtgaga

SEQ ID NO: 17508 - DNA, 25 bp, Rattus norvegicus
aaatgcttgccagctcacctgaagg

SEQ ID NO: 17509 - DNA, 25 bp, Rattus norvegicus
aaatgcttgccgaatatcggacccc

SEQ ID NO: 17510 - DNA, 25 bp, Rattus norvegicus
aaatgcttgccgtatatcggacccc

SEQ ID NO: 17511 - DNA, 25 bp, Rattus norvegicus
aaatgcttgctaatgagtcacgtgg

SEQ ID NO: 17512 - DNA, 25 bp, Rattus norvegicus
aaatgcttgctattgagtcacgtgg

SEQ ID NO: 17513 - DNA, 25 bp, Rattus norvegicus
aaatgcttgctgacctcgccgagga

SEQ ID NO: 17514 - DNA, 25 bp, Rattus norvegicus
aaatgcttgctgtcctcgccgagga

SEQ ID NO: 17515 - DNA, 25 bp, Rattus norvegicus
aaatgcttggcactctttggcccag

SEQ ID NO: 17516 - DNA, 25 bp, Rattus norvegicus
aaatgcttggcagtctttggcccag

SEQ ID NO: 17517 - DNA, 25 bp, Rattus norvegicus
aaatgcttggtcacagcagctccag

SEQ ID NO: 17518 - DNA, 25 bp, Rattus norvegicus
aaatgcttggtctcagcagctccag

SEQ ID NO: 17519 - DNA, 25 bp, Rattus norvegicus
aaatgcttgtagctcttcctttttc

SEQ ID NO: 17520 - DNA, 25 bp, Rattus norvegicus
aaatgcttgtaggtcttcctttttc

SEQ ID NO: 17521 - DNA, 25 bp, Rattus norvegicus
aaatgcttgtttagtatcttttgag

SEQ ID NO: 17522 - DNA, 25 bp, Rattus norvegicus
aaatgcttgttttgtatcttttgag

SEQ ID NO: 17523 - DNA, 25 bp, Rattus norvegicus
aaatgctttcacaattggacacaga

SEQ ID NO: 17524 - DNA, 25 bp, Rattus norvegicus
aaatgctttcactattggacacaga

SEQ ID NO: 17525 - DNA, 25 bp, Rattus norvegicus
aaatgctttcccaatcgaggtttct

SEQ ID NO: 17526 - DNA, 25 bp, Rattus norvegicus
aaatgctttccctatcgaggtttct

SEQ ID NO: 17527 - DNA, 25 bp, Rattus norvegicus
aaatgctttctgcacagtctgctac

SEQ ID NO: 17528 - DNA, 25 bp, Rattus norvegicus
aaatgctttctggacagtctgctac

SEQ ID NO: 17529 - DNA, 25 bp, Rattus norvegicus
aaatgctttcttctcctgggtaaag

SEQ ID NO: 17530 - DNA, 25 bp, Rattus norvegicus
aaatgctttcttgtcctgggtaaag

SEQ ID NO: 17531 - DNA, 25 bp, Rattus norvegicus
aaatgctttgcacagtcacgtcctg

SEQ ID NO: 17532 - DNA, 25 bp, Rattus norvegicus
aaatgctttgcagagtcacgtcctg

SEQ ID NO: 17533 - DNA, 25 bp, Rattus norvegicus
aaatgctttgccatacatgtccaag

SEQ ID NO: 17534 - DNA, 25 bp, Rattus norvegicus
aaatgctttgccttacatgtccaag

SEQ ID NO: 17535 - DNA, 25 bp, Rattus norvegicus
aaatgctttgctctttgcaccacta

SEQ ID NO: 17536 - DNA, 25 bp, Rattus norvegicus
aaatgctttgctgtttgcaccacta

SEQ ID NO: 17537 - DNA, 25 bp, Rattus norvegicus
aaatgctttggtctttgtctgtaac

SEQ ID NO: 17538 - DNA, 25 bp, Rattus norvegicus
aaatgctttggtgtttgtctgtaac

SEQ ID NO: 17539 - DNA, 25 bp, Rattus norvegicus
aaatgctttgtcaatacatcaccat

SEQ ID NO: 17540 - DNA, 25 bp, Rattus norvegicus
aaatgctttgtctatacatcaccat

SEQ ID NO: 17541 - DNA, 25 bp, Rattus norvegicus
aaatgcttttggaatctctttagat

SEQ ID NO: 17542 - DNA, 25 bp, Rattus norvegicus
aaatgcttttggtatctctttagat

SEQ ID NO: 17543 - DNA, 25 bp, Rattus norvegicus
aaatggaaaatgctctgatgttcag

SEQ ID NO: 17544 - DNA, 25 bp, Rattus norvegicus
aaatggaaaatggtctgatgttcag

SEQ ID NO: 17545 - DNA, 25 bp, Rattus norvegicus
aaatggaaagctctcaaaatcacag

SEQ ID NO: 17546 - DNA, 25 bp, Rattus norvegicus
aaatggaaagctgtcaaaatcacag

SEQ ID NO: 17547 - DNA, 25 bp, Rattus norvegicus
aaatggaactacatgcgcccctgag

SEQ ID NO: 17548 - DNA, 25 bp, Rattus norvegicus
aaatggaactacttgcgcccctgag

SEQ ID NO: 17549 - DNA, 25 bp, Rattus norvegicus
aaatggaactcacagcctgccgact

SEQ ID NO: 17550 - DNA, 25 bp, Rattus norvegicus
aaatggaactcagagcctgccgact

SEQ ID NO: 17551 - DNA, 25 bp, Rattus norvegicus
aaatggaagacgatccccgtgtggc

SEQ ID NO: 17552 - DNA, 25 bp, Rattus norvegicus
aaatggaagacgttccccgtgtggc

SEQ ID NO: 17553 - DNA, 25 bp, Rattus norvegicus
aaatggaagagtccccgtgctgaga

SEQ ID NO: 17554 - DNA, 25 bp, Rattus norvegicus
aaatggaagagtgcccgtgctgaga

SEQ ID NO: 17555 - DNA, 25 bp, Rattus norvegicus
aaatggaagctgaccgccaagccag

SEQ ID NO: 17556 - DNA, 25 bp, Rattus norvegicus
aaatggaagctgtccgccaagccag

SEQ ID NO: 17557 - DNA, 25 bp, Rattus norvegicus
aaatggaaggccctgtacaccaatc

SEQ ID NO: 17558 - DNA, 25 bp, Rattus norvegicus
aaatggaaggccgtgtacaccaatc

SEQ ID NO: 17559 - DNA, 25 bp, Rattus norvegicus
aaatggaatcaaaggcaacactacc

SEQ ID NO: 17560 - DNA, 25 bp, Rattus norvegicus
aaatggaatcaatggcaacactacc

SEQ ID NO: 17561 - DNA, 25 bp, Rattus norvegicus
aaatggaatcatatgcagcctcatg

SEQ ID NO: 17562 - DNA, 25 bp, Rattus norvegicus
aaatggaatcatttgcagcctcatg

SEQ ID NO: 17563 - DNA, 25 bp, Rattus norvegicus
aaatggaatgcgcacccagcaagct

SEQ ID NO: 17564 - DNA, 25 bp, Rattus norvegicus
aaatggaatgcggacccagcaagct

SEQ ID NO: 17565 - DNA, 25 bp, Rattus norvegicus
aaatggacaagaccccagtccgtgc

SEQ ID NO: 17566 - DNA, 25 bp, Rattus norvegicus
aaatggacaagagcccagtccgtgc

SEQ ID NO: 17567 - DNA, 25 bp, Rattus norvegicus
aaatggacaaggactgactcagcgt

SEQ ID NO: 17568 - DNA, 25 bp, Rattus norvegicus
aaatggacaaggtctgactcagcgt

SEQ ID NO: 17569 - DNA, 25 bp, Rattus norvegicus
aaatggacatgtctaccctgcaggg

SEQ ID NO: 17570 - DNA, 25 bp, Rattus norvegicus
aaatggacatgtgtaccctgcaggg

SEQ ID NO: 17571 - DNA, 25 bp, Rattus norvegicus
aaatggaccctgcttcaggttgttc

SEQ ID NO: 17572 - DNA, 25 bp, Rattus norvegicus
aaatggaccctggttcaggttgttc

SEQ ID NO: 17573 - DNA, 25 bp, Rattus norvegicus
aaatggacctcaccaagtacaccgg

SEQ ID NO: 17574 - DNA, 25 bp, Rattus norvegicus
aaatggacctcagcaagtacaccgg

SEQ ID NO: 17575 - DNA, 25 bp, Rattus norvegicus
aaatggacgacaacaggccctgctg

SEQ ID NO: 17576 - DNA, 25 bp, Rattus norvegicus
aaatggacgacatcaggccctgctg

SEQ ID NO: 17577 - DNA, 25 bp, Rattus norvegicus
aaatggacgatcattcaaatgttat

SEQ ID NO: 17578 - DNA, 25 bp, Rattus norvegicus
aaatggacgatctttcaaatgttat

SEQ ID NO: 17579 - DNA, 25 bp, Rattus norvegicus
aaatggactccaagatgtcgatttg

SEQ ID NO: 17580 - DNA, 25 bp, Rattus norvegicus
aaatggactccaatgtcttactcct

SEQ ID NO: 17581 - DNA, 25 bp, Rattus norvegicus
aaatggactccatgatgtcgatttg

SEQ ID NO: 17582 - DNA, 25 bp, Rattus norvegicus
aaatggactccattgtcttactcct

SEQ ID NO: 17583 - DNA, 25 bp, Rattus norvegicus
aaatggactcctaactgaagtatat

SEQ ID NO: 17584 - DNA, 25 bp, Rattus norvegicus
aaatggactccttactgaagtatat

SEQ ID NO: 17585 - DNA, 25 bp, Rattus norvegicus
aaatggactgacactgttatcccgg

SEQ ID NO: 17586 - DNA, 25 bp, Rattus norvegicus
aaatggactgactctgttatcccgg

SEQ ID NO: 17587 - DNA, 25 bp, Rattus norvegicus
aaatggactgccagccttgatgagc

SEQ ID NO: 17588 - DNA, 25 bp, Rattus norvegicus
aaatggactgcctgccttgatgagc

SEQ ID NO: 17589 - DNA, 25 bp, Rattus norvegicus
aaatggactggaacttccacaccat

SEQ ID NO: 17590 - DNA, 25 bp, Rattus norvegicus
aaatggactggatcttccacaccat

SEQ ID NO: 17591 - DNA, 25 bp, Rattus norvegicus
aaatggacttctcgcatcaggcatt

SEQ ID NO: 17592 - DNA, 25 bp, Rattus norvegicus
aaatggacttctggcatcaggcatt

SEQ ID NO: 17593 - DNA, 25 bp, Rattus norvegicus
aaatggacttgcatcttgtgtttga

SEQ ID NO: 17594 - DNA, 25 bp, Rattus norvegicus
aaatggacttgcttcttgtgtttga

SEQ ID NO: 17595 - DNA, 25 bp, Rattus norvegicus
aaatggacttttcttccagctttgt

SEQ ID NO: 17596 - DNA, 25 bp, Rattus norvegicus
aaatggacttttgttccagctttgt

SEQ ID NO: 17597 - DNA, 25 bp, Rattus norvegicus
aaatggagaaccagcctgtcttggc

SEQ ID NO: 17598 - DNA, 25 bp, Rattus norvegicus
aaatggagaacctgcctgtcttggc

SEQ ID NO: 17599 - DNA, 25 bp, Rattus norvegicus
aaatggagatgtaaagattttcctg

SEQ ID NO: 17600 - DNA, 25 bp, Rattus norvegicus
aaatggagatgttaagattttcctg

SEQ ID NO: 17601 - DNA, 25 bp, Rattus norvegicus
aaatggagcaatatggtcccagctt

SEQ ID NO: 17602 - DNA, 25 bp, Rattus norvegicus
aaatggagcaatttggtcccagctt

SEQ ID NO: 17603 - DNA, 25 bp, Rattus norvegicus
aaatggagcactagttttctcagga

SEQ ID NO: 17604 - DNA, 25 bp, Rattus norvegicus
aaatggagcacttgttttctcagga

SEQ ID NO: 17605 - DNA, 25 bp, Rattus norvegicus
aaatggagcagaactcagaacggga

SEQ ID NO: 17606 - DNA, 25 bp, Rattus norvegicus
aaatggagcagatctcagaacggga

SEQ ID NO: 17607 - DNA, 25 bp, Rattus norvegicus
aaatggagccagctgggacctaaaa

SEQ ID NO: 17608 - DNA, 25 bp, Rattus norvegicus
aaatggagccaggtgggacctaaaa

SEQ ID NO: 17609 - DNA, 25 bp, Rattus norvegicus
aaatggagcccaattgtctcagcca

SEQ ID NO: 17610 - DNA, 25 bp, Rattus norvegicus
aaatggagcccatttgtctcagcca

SEQ ID NO: 17611 - DNA, 25 bp, Rattus norvegicus
aaatggagctccaggaatccctcga

SEQ ID NO: 17612 - DNA, 25 bp, Rattus norvegicus
aaatggagctcctggaatccctcga

SEQ ID NO: 17613 - DNA, 25 bp, Rattus norvegicus
aaatggagctgcatatgtctgccct

SEQ ID NO: 17614 - DNA, 25 bp, Rattus norvegicus
aaatggagctgcttatgtctgccct

SEQ ID NO: 17615 - DNA, 25 bp, Rattus norvegicus
aaatggaggattctgtctccgctcc

SEQ ID NO: 17616 - DNA, 25 bp, Rattus norvegicus
aaatggaggattgtgtctccgctcc

SEQ ID NO: 17617 - DNA, 25 bp, Rattus norvegicus
aaatggagggtcaggccgtgactca

SEQ ID NO: 17618 - DNA, 25 bp, Rattus norvegicus
aaatggagggtctggccgtgactca

SEQ ID NO: 17619 - DNA, 25 bp, Rattus norvegicus
aaatggatcccacgtctttaagtct

SEQ ID NO: 17620 - DNA, 25 bp, Rattus norvegicus
aaatggatcccaggtctttaagtct

SEQ ID NO: 17621 - DNA, 25 bp, Rattus norvegicus
aaatggatctgcaggtgggctagac

SEQ ID NO: 17622 - DNA, 25 bp, Rattus norvegicus
aaatggatctgctggtgggctagac

SEQ ID NO: 17623 - DNA, 25 bp, Rattus norvegicus
aaatggatgggtactgccggtccct

SEQ ID NO: 17624 - DNA, 25 bp, Rattus norvegicus
aaatggatgggttctgccggtccct

SEQ ID NO: 17625 - DNA, 25 bp, Rattus norvegicus
aaatggatgtgcctcactttcagct

SEQ ID NO: 17626 - DNA, 25 bp, Rattus norvegicus
aaatggatgtgcgtcactttcagct

SEQ ID NO: 17627 - DNA, 25 bp, Rattus norvegicus
aaatggattactccctagctgagcc

SEQ ID NO: 17628 - DNA, 25 bp, Rattus norvegicus
aaatggattactgcctagctgagcc

SEQ ID NO: 17629 - DNA, 25 bp, Rattus norvegicus
aaatggattcacacagcaggtcttc

SEQ ID NO: 17630 - DNA, 25 bp, Rattus norvegicus
aaatggattcactcagcaggtcttc

SEQ ID NO: 17631 - DNA, 25 bp, Rattus norvegicus
aaatggattccacctgacattcagc

SEQ ID NO: 17632 - DNA, 25 bp, Rattus norvegicus
aaatggattccagctgacattcagc

SEQ ID NO: 17633 - DNA, 25 bp, Rattus norvegicus
aaatggattgttcttgcctcgtggt

SEQ ID NO: 17634 - DNA, 25 bp, Rattus norvegicus
aaatggattgttgttgcctcgtggt

SEQ ID NO: 17635 - DNA, 25 bp, Rattus norvegicus
aaatggatttccattctatgtataa

SEQ ID NO: 17636 - DNA, 25 bp, Rattus norvegicus
aaatggatttcctttctatgtataa

SEQ ID NO: 17637 - DNA, 25 bp, Rattus norvegicus
aaatggcaaatcctacttactcaat

SEQ ID NO: 17638 - DNA, 25 bp, Rattus norvegicus
aaatggcaaatcgtacttactcaat

SEQ ID NO: 17639 - DNA, 25 bp, Rattus norvegicus
aaatggcaacttaactggccctgga

SEQ ID NO: 17640 - DNA, 25 bp, Rattus norvegicus
aaatggcaactttactggccctgga

SEQ ID NO: 17641 - DNA, 25 bp, Rattus norvegicus
aaatggcaagttccagccttgtctt

SEQ ID NO: 17642 - DNA, 25 bp, Rattus norvegicus
aaatggcaagttgcagccttgtctt

SEQ ID NO: 17643 - DNA, 25 bp, Rattus norvegicus
aaatggcaatctcccactaagtgtg

SEQ ID NO: 17644 - DNA, 25 bp, Rattus norvegicus
aaatggcaatctgccactaagtgtg

SEQ ID NO: 17645 - DNA, 25 bp, Rattus norvegicus
aaatggcaattaccgttcatagcaa

SEQ ID NO: 17646 - DNA, 25 bp, Rattus norvegicus
aaatggcaattagcgttcatagcaa

SEQ ID NO: 17647 - DNA, 25 bp, Rattus norvegicus
aaatggcacacaatgagccactgcc

SEQ ID NO: 17648 - DNA, 25 bp, Rattus norvegicus
aaatggcacacattgagccactgcc

SEQ ID NO: 17649 - DNA, 25 bp, Rattus norvegicus
aaatggcaccctcgagagagagcac

SEQ ID NO: 17650 - DNA, 25 bp, Rattus norvegicus
aaatggcaccctggagagagagcac

SEQ ID NO: 17651 - DNA, 25 bp, Rattus norvegicus
aaatggcaccttagaaccaataaga

SEQ ID NO: 17652 - DNA, 25 bp, Rattus norvegicus
aaatggcaccttagagccatcctct

SEQ ID NO: 17653 - DNA, 25 bp, Rattus norvegicus
aaatggcacctttgaaccaataaga

SEQ ID NO: 17654 - DNA, 25 bp, Rattus norvegicus
aaatggcacctttgagccatcctct

SEQ ID NO: 17655 - DNA, 25 bp, Rattus norvegicus
aaatggcactttctctgtggacttt

SEQ ID NO: 17656 - DNA, 25 bp, Rattus norvegicus
aaatggcactttgtctgtggacttt

SEQ ID NO: 17657 - DNA, 25 bp, Rattus norvegicus
aaatggcagacgatattgatattga

SEQ ID NO: 17658 - DNA, 25 bp, Rattus norvegicus
aaatggcagacgttattgatattga

SEQ ID NO: 17659 - DNA, 25 bp, Rattus norvegicus
aaatggcagattcggttcatcgtgt

SEQ ID NO: 17660 - DNA, 25 bp, Rattus norvegicus
aaatggcagattgggttcatcgtgt

SEQ ID NO: 17661 - DNA, 25 bp, Rattus norvegicus
aaatggcagccacacagtcaagtgt

SEQ ID NO: 17662 - DNA, 25 bp, Rattus norvegicus
aaatggcagccagacagtcaagtgt

SEQ ID NO: 17663 - DNA, 25 bp, Rattus norvegicus
aaatggcagcccagtttagtctcca

SEQ ID NO: 17664 - DNA, 25 bp, Rattus norvegicus
aaatggcagccctgtttagtctcca

SEQ ID NO: 17665 - DNA, 25 bp, Rattus norvegicus
aaatggcaggcacttgaaaatgggt

SEQ ID NO: 17666 - DNA, 25 bp, Rattus norvegicus
aaatggcaggcagttgaaaatgggt

SEQ ID NO: 17667 - DNA, 25 bp, Rattus norvegicus
aaatggcagggtagtggcactcgca

SEQ ID NO: 17668 - DNA, 25 bp, Rattus norvegicus
aaatggcagggttgtggcactcgca

SEQ ID NO: 17669 - DNA, 25 bp, Rattus norvegicus
aaatggcataacctctcctgtcaat

SEQ ID NO: 17670 - DNA, 25 bp, Rattus norvegicus
aaatggcataacgtctcctgtcaat

SEQ ID NO: 17671 - DNA, 25 bp, Rattus norvegicus
aaatggcatgtgacccttctatgtt

SEQ ID NO: 17672 - DNA, 25 bp, Rattus norvegicus
aaatggcatgtgatggcctgcaagt

SEQ ID NO: 17673 - DNA, 25 bp, Rattus norvegicus
aaatggcatgtgatgtctctcccaa

SEQ ID NO: 17674 - DNA, 25 bp, Rattus norvegicus
aaatggcatgtgtcccttctatgtt

SEQ ID NO: 17675 - DNA, 25 bp, Rattus norvegicus
aaatggcatgtgttggcctgcaagt

SEQ ID NO: 17676 - DNA, 25 bp, Rattus norvegicus
aaatggcatgtgttgtctctcccaa

SEQ ID NO: 17677 - DNA, 25 bp, Rattus norvegicus
aaatggcattgacttttcttccttt

SEQ ID NO: 17678 - DNA, 25 bp, Rattus norvegicus
aaatggcattgagttttcttccttt

SEQ ID NO: 17679 - DNA, 25 bp, Rattus norvegicus
aaatggcatttgcttgtggccccat

SEQ ID NO: 17680 - DNA, 25 bp, Rattus norvegicus
aaatggcatttggttgtggccccat

SEQ ID NO: 17681 - DNA, 25 bp, Rattus norvegicus
aaatggccaaatctgaccttcaagg

SEQ ID NO: 17682 - DNA, 25 bp, Rattus norvegicus
aaatggccaaatgtgaccttcaagg

SEQ ID NO: 17683 - DNA, 25 bp, Rattus norvegicus
aaatggccaagcaatgcggttatat

SEQ ID NO: 17684 - DNA, 25 bp, Rattus norvegicus
aaatggccaagctatgcggttatat

SEQ ID NO: 17685 - DNA, 25 bp, Rattus norvegicus
aaatggccaagtctctgtcaaggag

SEQ ID NO: 17686 - DNA, 25 bp, Rattus norvegicus
aaatggccaagtgtctgtcaaggag

SEQ ID NO: 17687 - DNA, 25 bp, Rattus norvegicus
aaatggccaccacgagttctttgca

SEQ ID NO: 17688 - DNA, 25 bp, Rattus norvegicus
aaatggccaccaggagttctttgca

SEQ ID NO: 17689 - DNA, 25 bp, Rattus norvegicus
aaatggccagaaatattacggaggg

SEQ ID NO: 17690 - DNA, 25 bp, Rattus norvegicus
aaatggccagaattattacggaggg

SEQ ID NO: 17691 - DNA, 25 bp, Rattus norvegicus
aaatggccagacaacggtcaccagc

SEQ ID NO: 17692 - DNA, 25 bp, Rattus norvegicus
aaatggccagactacggtcaccagc

SEQ ID NO: 17693 - DNA, 25 bp, Rattus norvegicus
aaatggccagataaccttcgtgatt

SEQ ID NO: 17694 - DNA, 25 bp, Rattus norvegicus
aaatggccagattaccttcgtgatt

SEQ ID NO: 17695 - DNA, 25 bp, Rattus norvegicus
aaatggccatgcctttgtctagacc

SEQ ID NO: 17696 - DNA, 25 bp, Rattus norvegicus
aaatggccatgcgtttgtctagacc

SEQ ID NO: 17697 - DNA, 25 bp, Rattus norvegicus
aaatggcccaagctgtcatctttca

SEQ ID NO: 17698 - DNA, 25 bp, Rattus norvegicus
aaatggcccaaggtgtcatctttca

SEQ ID NO: 17699 - DNA, 25 bp, Rattus norvegicus
aaatggcccagcagtcaagagcact

SEQ ID NO: 17700 - DNA, 25 bp, Rattus norvegicus
aaatggcccagctgtcaagagcact

SEQ ID NO: 17701 - DNA, 25 bp, Rattus norvegicus
aaatggccccatatttctgattctg

SEQ ID NO: 17702 - DNA, 25 bp, Rattus norvegicus
aaatggccccatttttctgattctg

SEQ ID NO: 17703 - DNA, 25 bp, Rattus norvegicus
aaatggcccgctccggcaagtgtag

SEQ ID NO: 17704 - DNA, 25 bp, Rattus norvegicus
aaatggcccgctgcggcaagtgtag

SEQ ID NO: 17705 - DNA, 25 bp, Rattus norvegicus
aaatggccgtgtacgtcagtttgac

SEQ ID NO: 17706 - DNA, 25 bp, Rattus norvegicus
aaatggccgtgttcgtcagtttgac

SEQ ID NO: 17707 - DNA, 25 bp, Rattus norvegicus
aaatggcctctaatttttcttacat

SEQ ID NO: 17708 - DNA, 25 bp, Rattus norvegicus
aaatggcctctattttttcttacat

SEQ ID NO: 17709 - DNA, 25 bp, Rattus norvegicus
aaatggcctcttccttgtctggtaa

SEQ ID NO: 17710 - DNA, 25 bp, Rattus norvegicus
aaatggcctcttgcttgtctggtaa

SEQ ID NO: 17711 - DNA, 25 bp, Rattus norvegicus
aaatggcctgtgagtagcctgagcc

SEQ ID NO: 17712 - DNA, 25 bp, Rattus norvegicus
aaatggcctgtgtgtagcctgagcc

SEQ ID NO: 17713 - DNA, 25 bp, Rattus norvegicus
aaatggccttagcagatcaacacag

SEQ ID NO: 17714 - DNA, 25 bp, Rattus norvegicus
aaatggccttaggagatcaacacag

SEQ ID NO: 17715 - DNA, 25 bp, Rattus norvegicus
aaatggcgatgtctttattcctctc

SEQ ID NO: 17716 - DNA, 25 bp, Rattus norvegicus
aaatggcgatgtgtttattcctctc

SEQ ID NO: 17717 - DNA, 25 bp, Rattus norvegicus
aaatggcgtcgtagtttgcatcgct

SEQ ID NO: 17718 - DNA, 25 bp, Rattus norvegicus
aaatggcgtcgttgtttgcatcgct

SEQ ID NO: 17719 - DNA, 25 bp, Rattus norvegicus
aaatggcgtctcctatatgaagaac

SEQ ID NO: 17720 - DNA, 25 bp, Rattus norvegicus
aaatggcgtctcgtatatgaagaac

SEQ ID NO: 17721 - DNA, 25 bp, Rattus norvegicus
aaatggctatccacatggaccacaa

SEQ ID NO: 17722 - DNA, 25 bp, Rattus norvegicus
aaatggctatcctcatggaccacaa

SEQ ID NO: 17723 - DNA, 25 bp, Rattus norvegicus
aaatggctattgctgtcctttgctg

SEQ ID NO: 17724 - DNA, 25 bp, Rattus norvegicus
aaatggctattggtgtcctttgctg

SEQ ID NO: 17725 - DNA, 25 bp, Rattus norvegicus
aaatggctcatcaatctatcaaaat

SEQ ID NO: 17726 - DNA, 25 bp, Rattus norvegicus
aaatggctcatctatctatcaaaat

SEQ ID NO: 17727 - DNA, 25 bp, Rattus norvegicus
aaatggctcctacaggtttgggaag

SEQ ID NO: 17728 - DNA, 25 bp, Rattus norvegicus
aaatggctcctagaggtttgggaag

SEQ ID NO: 17729 - DNA, 25 bp, Rattus norvegicus
aaatggctcctgacactttctctag

SEQ ID NO: 17730 - DNA, 25 bp, Rattus norvegicus
aaatggctcctgtcactttctctag

SEQ ID NO: 17731 - DNA, 25 bp, Rattus norvegicus
aaatggctccttcgacaggccagga

SEQ ID NO: 17732 - DNA, 25 bp, Rattus norvegicus
aaatggctccttggacaggccagga

SEQ ID NO: 17733 - DNA, 25 bp, Rattus norvegicus
aaatggctcgctcttcttgaatatg

SEQ ID NO: 17734 - DNA, 25 bp, Rattus norvegicus
aaatggctcgctgttcttgaatatg

SEQ ID NO: 17735 - DNA, 25 bp, Rattus norvegicus
aaatggctctataacccaaatccct

SEQ ID NO: 17736 - DNA, 25 bp, Rattus norvegicus
aaatggctctattacccaaatccct

SEQ ID NO: 17737 - DNA, 25 bp, Rattus norvegicus
aaatggctgaggagttacgctcgct

SEQ ID NO: 17738 - DNA, 25 bp, Rattus norvegicus
aaatggctgaggtgttacgctcgct

SEQ ID NO: 17739 - DNA, 25 bp, Rattus norvegicus
aaatggctgcatagtggaaactaac

SEQ ID NO: 17740 - DNA, 25 bp, Rattus norvegicus
aaatggctgcattgtggaaactaac

SEQ ID NO: 17741 - DNA, 25 bp, Rattus norvegicus
aaatggctgccaagctggagcgttt

SEQ ID NO: 17742 - DNA, 25 bp, Rattus norvegicus
aaatggctgccatgctggagcgttt

SEQ ID NO: 17743 - DNA, 25 bp, Rattus norvegicus
aaatggctgcctatgctaaatgtaa

SEQ ID NO: 17744 - DNA, 25 bp, Rattus norvegicus
aaatggctgcctcagaggtctccta

SEQ ID NO: 17745 - DNA, 25 bp, Rattus norvegicus
aaatggctgcctgagaggtctccta

SEQ ID NO: 17746 - DNA, 25 bp, Rattus norvegicus
aaatggctgcctttgctaaatgtaa

SEQ ID NO: 17747 - DNA, 25 bp, Rattus norvegicus
aaatggctgttcagtgtcatcatga

SEQ ID NO: 17748 - DNA, 25 bp, Rattus norvegicus
aaatggctgttctgtgtcatcatga

SEQ ID NO: 17749 - DNA, 25 bp, Rattus norvegicus
aaatggctgtttacccaccatagcg

SEQ ID NO: 17750 - DNA, 25 bp, Rattus norvegicus
aaatggctgtttagtgcttattgtg

SEQ ID NO: 17751 - DNA, 25 bp, Rattus norvegicus
aaatggctgtttatgcgtgtggtca

SEQ ID NO: 17752 - DNA, 25 bp, Rattus norvegicus
aaatggctgttttcccaccatagcg

SEQ ID NO: 17753 - DNA, 25 bp, Rattus norvegicus
aaatggctgttttgtgcttattgtg

SEQ ID NO: 17754 - DNA, 25 bp, Rattus norvegicus
aaatggctgtttttgcgtgtggtca

SEQ ID NO: 17755 - DNA, 25 bp, Rattus norvegicus
aaatggcttatgaatatgcagatga

SEQ ID NO: 17756 - DNA, 25 bp, Rattus norvegicus
aaatggcttatgtatatgcagatga

SEQ ID NO: 17757 - DNA, 25 bp, Rattus norvegicus
aaatggcttcccaagagcacactta

SEQ ID NO: 17758 - DNA, 25 bp, Rattus norvegicus
aaatggcttccctagagcacactta

SEQ ID NO: 17759 - DNA, 25 bp, Rattus norvegicus
aaatggcttcctatggaccaagcta

SEQ ID NO: 17760 - DNA, 25 bp, Rattus norvegicus
aaatggcttcctttggaccaagcta

SEQ ID NO: 17761 - DNA, 25 bp, Rattus norvegicus
aaatggcttctcaaggacgggaact

SEQ ID NO: 17762 - DNA, 25 bp, Rattus norvegicus
aaatggcttctctaggacgggaact

SEQ ID NO: 17763 - DNA, 25 bp, Rattus norvegicus
aaatggcttggacgacattgtccct

SEQ ID NO: 17764 - DNA, 25 bp, Rattus norvegicus
aaatggcttggaggacattgtccct

SEQ ID NO: 17765 - DNA, 25 bp, Rattus norvegicus
aaatggctttatactaccaaagtca

SEQ ID NO: 17766 - DNA, 25 bp, Rattus norvegicus
aaatggctttattctaccaaagtca

SEQ ID NO: 17767 - DNA, 25 bp, Rattus norvegicus
aaatggctttccactaacttcaaag

SEQ ID NO: 17768 - DNA, 25 bp, Rattus norvegicus
aaatggctttcctctaacttcaaag

SEQ ID NO: 17769 - DNA, 25 bp, Rattus norvegicus
aaatggctttgtaggactgcatcta

SEQ ID NO: 17770 - DNA, 25 bp, Rattus norvegicus
aaatggctttgttggactgcatcta

SEQ ID NO: 17771 - DNA, 25 bp, Rattus norvegicus
aaatgggaaagtcatggccgttcta

SEQ ID NO: 17772 - DNA, 25 bp, Rattus norvegicus
aaatgggaaagtgatggccgttcta

SEQ ID NO: 17773 - DNA, 25 bp, Rattus norvegicus
aaatgggaagccaacctgggtctgc

SEQ ID NO: 17774 - DNA, 25 bp, Rattus norvegicus
aaatgggaagcctacctgggtctgc

SEQ ID NO: 17775 - DNA, 25 bp, Rattus norvegicus
aaatgggacgtgcagattgatctca

SEQ ID NO: 17776 - DNA, 25 bp, Rattus norvegicus
aaatgggacgtggagattgatctca

SEQ ID NO: 17777 - DNA, 25 bp, Rattus norvegicus
aaatgggacttgcttgagctgcccg

SEQ ID NO: 17778 - DNA, 25 bp, Rattus norvegicus
aaatgggacttggttgagctgcccg

SEQ ID NO: 17779 - DNA, 25 bp, Rattus norvegicus
aaatgggagcccagtctctgaaatt

SEQ ID NO: 17780 - DNA, 25 bp, Rattus norvegicus
aaatgggagccctgtctctgaaatt

SEQ ID NO: 17781 - DNA, 25 bp, Rattus norvegicus
aaatgggagtgaatgcttgccagtg

SEQ ID NO: 17782 - DNA, 25 bp, Rattus norvegicus
aaatgggagtgattgcttgccagtg

SEQ ID NO: 17783 - DNA, 25 bp, Rattus norvegicus
aaatgggcaataattcctgctctca

SEQ ID NO: 17784 - DNA, 25 bp, Rattus norvegicus
aaatgggcaatatttcctgctctca

SEQ ID NO: 17785 - DNA, 25 bp, Rattus norvegicus
aaatgggcacgcaatcagttttctt

SEQ ID NO: 17786 - DNA, 25 bp, Rattus norvegicus
aaatgggcacgctatcagttttctt

SEQ ID NO: 17787 - DNA, 25 bp, Rattus norvegicus
aaatgggcagatcctgctgcgcatc

SEQ ID NO: 17788 - DNA, 25 bp, Rattus norvegicus
aaatgggcagatgctgctgcgcatc

SEQ ID NO: 17789 - DNA, 25 bp, Rattus norvegicus
aaatgggcatgcactctcagaacac

SEQ ID NO: 17790 - DNA, 25 bp, Rattus norvegicus
aaatgggcatgctctctcagaacac

SEQ ID NO: 17791 - DNA, 25 bp, Rattus norvegicus
aaatgggcatgtaaagtgggctacc

SEQ ID NO: 17792 - DNA, 25 bp, Rattus norvegicus
aaatgggcatgttaagtgggctacc

SEQ ID NO: 17793 - DNA, 25 bp, Rattus norvegicus
aaatgggcattcactttggcatcca

SEQ ID NO: 17794 - DNA, 25 bp, Rattus norvegicus
aaatgggcattctctttggcatcca

SEQ ID NO: 17795 - DNA, 25 bp, Rattus norvegicus
aaatgggccagcacgtgtagtactc

SEQ ID NO: 17796 - DNA, 25 bp, Rattus norvegicus
aaatgggccagctcgtgtagtactc

SEQ ID NO: 17797 - DNA, 25 bp, Rattus norvegicus
aaatgggcccttccgagctagttct

SEQ ID NO: 17798 - DNA, 25 bp, Rattus norvegicus
aaatgggcccttgcgagctagttct

SEQ ID NO: 17799 - DNA, 25 bp, Rattus norvegicus
aaatgggcggaaccactcctgttct

SEQ ID NO: 17800 - DNA, 25 bp, Rattus norvegicus
aaatgggcggaagcactcctgttct

SEQ ID NO: 17801 - DNA, 25 bp, Rattus norvegicus
aaatgggctgcacaggacacccagt

SEQ ID NO: 17802 - DNA, 25 bp, Rattus norvegicus
aaatgggctgcagaggacacccagt

SEQ ID NO: 17803 - DNA, 25 bp, Rattus norvegicus
aaatgggtacagctcacagatcaga

SEQ ID NO: 17804 - DNA, 25 bp, Rattus norvegicus
aaatgggtacaggtcacagatcaga

SEQ ID NO: 17805 - DNA, 25 bp, Rattus norvegicus
aaatgggtccaacaatcctctctct

SEQ ID NO: 17806 - DNA, 25 bp, Rattus norvegicus
aaatgggtccaagaatcctctctct

SEQ ID NO: 17807 - DNA, 25 bp, Rattus norvegicus
aaatgggtgattcttctctgtctca

SEQ ID NO: 17808 - DNA, 25 bp, Rattus norvegicus
aaatgggtgattgttctctgtctca

SEQ ID NO: 17809 - DNA, 25 bp, Rattus norvegicus
aaatgggtgcacattactgtttgaa

SEQ ID NO: 17810 - DNA, 25 bp, Rattus norvegicus
aaatgggtgcactttactgtttgaa

SEQ ID NO: 17811 - DNA, 25 bp, Rattus norvegicus
aaatgggtgcgcaacattggccgaa

SEQ ID NO: 17812 - DNA, 25 bp, Rattus norvegicus
aaatgggtgcgctacattggccgaa

SEQ ID NO: 17813 - DNA, 25 bp, Rattus norvegicus
aaatggtaccacagacttattgctg

SEQ ID NO: 17814 - DNA, 25 bp, Rattus norvegicus
aaatggtaccactgacttattgctg

SEQ ID NO: 17815 - DNA, 25 bp, Rattus norvegicus
aaatggtagataagtctccctgact

SEQ ID NO: 17816 - DNA, 25 bp, Rattus norvegicus
aaatggtagatatgtctccctgact

SEQ ID NO: 17817 - DNA, 25 bp, Rattus norvegicus
aaatggtagccccttccatggctta

SEQ ID NO: 17818 - DNA, 25 bp, Rattus norvegicus
aaatggtagcccgttccatggctta

SEQ ID NO: 17819 - DNA, 25 bp, Rattus norvegicus
aaatggtcacatatcgtgcttctca

SEQ ID NO: 17820 - DNA, 25 bp, Rattus norvegicus
aaatggtcacatttcgtgcttctca

SEQ ID NO: 17821 - DNA, 25 bp, Rattus norvegicus
aaatggtcactactgagtgccctca

SEQ ID NO: 17822 - DNA, 25 bp, Rattus norvegicus
aaatggtcactagtgagtgccctca

SEQ ID NO: 17823 - DNA, 25 bp, Rattus norvegicus
aaatggtcagacactgcctttcatg

SEQ ID NO: 17824 - DNA, 25 bp, Rattus norvegicus
aaatggtcagactctgcctttcatg

SEQ ID NO: 17825 - DNA, 25 bp, Rattus norvegicus
aaatggtcatttctgtcatgtcccc

SEQ ID NO: 17826 - DNA, 25 bp, Rattus norvegicus
aaatggtcatttgtgtcatgtcccc

SEQ ID NO: 17827 - DNA, 25 bp, Rattus norvegicus
aaatggtcccaaactacccatggct

SEQ ID NO: 17828 - DNA, 25 bp, Rattus norvegicus
aaatggtcccaatctacccatggct

SEQ ID NO: 17829 - DNA, 25 bp, Rattus norvegicus
aaatggtcccctatgaattttatga

SEQ ID NO: 17830 - DNA, 25 bp, Rattus norvegicus
aaatggtcccctttgaattttatga

SEQ ID NO: 17831 - DNA, 25 bp, Rattus norvegicus
aaatggtccctgctcctgagtgaca

SEQ ID NO: 17832 - DNA, 25 bp, Rattus norvegicus
aaatggtccctggtcctgagtgaca

SEQ ID NO: 17833 - DNA, 25 bp, Rattus norvegicus
aaatggtcctagcagggtctctcta

SEQ ID NO: 17834 - DNA, 25 bp, Rattus norvegicus
aaatggtcctaggagggtctctcta

SEQ ID NO: 17835 - DNA, 25 bp, Rattus norvegicus
aaatggtcctggcatgccacgtgct

SEQ ID NO: 17836 - DNA, 25 bp, Rattus norvegicus
aaatggtcctgggatgccacgtgct

SEQ ID NO: 17837 - DNA, 25 bp, Rattus norvegicus
aaatggtcgaaaaggctctgctcac

SEQ ID NO: 17838 - DNA, 25 bp, Rattus norvegicus
aaatggtcgaaatggctctgctcac

SEQ ID NO: 17839 - DNA, 25 bp, Rattus norvegicus
aaatggtcgatcaacctcccataaa

SEQ ID NO: 17840 - DNA, 25 bp, Rattus norvegicus
aaatggtcgatctacctcccataaa

SEQ ID NO: 17841 - DNA, 25 bp, Rattus norvegicus
aaatggtcgatgactgtgtttggcg

SEQ ID NO: 17842 - DNA, 25 bp, Rattus norvegicus
aaatggtcgatgattgccacgtgca

SEQ ID NO: 17843 - DNA, 25 bp, Rattus norvegicus
aaatggtcgatgtctgtgtttggcg

SEQ ID NO: 17844 - DNA, 25 bp, Rattus norvegicus
aaatggtcgatgtttgccacgtgca

SEQ ID NO: 17845 - DNA, 25 bp, Rattus norvegicus
aaatggtctactccaaaatcgatca

SEQ ID NO: 17846 - DNA, 25 bp, Rattus norvegicus
aaatggtctactgcaaaatcgatca

SEQ ID NO: 17847 - DNA, 25 bp, Rattus norvegicus
aaatggtctgcgcagttggccttct

SEQ ID NO: 17848 - DNA, 25 bp, Rattus norvegicus
aaatggtctgcggagttggccttct

SEQ ID NO: 17849 - DNA, 25 bp, Rattus norvegicus
aaatggtctggtagtgctagacaga

SEQ ID NO: 17850 - DNA, 25 bp, Rattus norvegicus
aaatggtctggttgtgctagacaga

SEQ ID NO: 17851 - DNA, 25 bp, Rattus norvegicus
aaatggtgaacaactccaactccca

SEQ ID NO: 17852 - DNA, 25 bp, Rattus norvegicus
aaatggtgaacatctccaactccca

SEQ ID NO: 17853 - DNA, 25 bp, Rattus norvegicus
aaatggtgacatatcccactataaa

SEQ ID NO: 17854 - DNA, 25 bp, Rattus norvegicus
aaatggtgacatttcccactataaa

SEQ ID NO: 17855 - DNA, 25 bp, Rattus norvegicus
aaatggtgacgaatccctcatgtac

SEQ ID NO: 17856 - DNA, 25 bp, Rattus norvegicus
aaatggtgacgattccctcatgtac

SEQ ID NO: 17857 - DNA, 25 bp, Rattus norvegicus
aaatggtgcaccaatctcccagggt

SEQ ID NO: 17858 - DNA, 25 bp, Rattus norvegicus
aaatggtgcacctatctcccagggt

SEQ ID NO: 17859 - DNA, 25 bp, Rattus norvegicus
aaatggtggatcaaggctctggtga

SEQ ID NO: 17860 - DNA, 25 bp, Rattus norvegicus
aaatggtggatctaggctctggtga

SEQ ID NO: 17861 - DNA, 25 bp, Rattus norvegicus
aaatggtggcagagtctccagacct

SEQ ID NO: 17862 - DNA, 25 bp, Rattus norvegicus
aaatggtggcagtgtctccagacct

SEQ ID NO: 17863 - DNA, 25 bp, Rattus norvegicus
aaatggtggctgacctctctggtgg

SEQ ID NO: 17864 - DNA, 25 bp, Rattus norvegicus
aaatggtggctgtcctctctggtgg

SEQ ID NO: 17865 - DNA, 25 bp, Rattus norvegicus
aaatggtggtacactcctgtcatcc

SEQ ID NO: 17866 - DNA, 25 bp, Rattus norvegicus
aaatggtggtactctcctgtcatcc

SEQ ID NO: 17867 - DNA, 25 bp, Rattus norvegicus
aaatggtggtatcaagccctctccc

SEQ ID NO: 17868 - DNA, 25 bp, Rattus norvegicus
aaatggtggtatgaagccctctccc

SEQ ID NO: 17869 - DNA, 25 bp, Rattus norvegicus
aaatggtggtgaagcctacctcaca

SEQ ID NO: 17870 - DNA, 25 bp, Rattus norvegicus
aaatggtggtgatgcctacctcaca

SEQ ID NO: 17871 - DNA, 25 bp, Rattus norvegicus
aaatggtgtccgacttacgtactag

SEQ ID NO: 17872 - DNA, 25 bp, Rattus norvegicus
aaatggtgtccgtcttacgtactag

SEQ ID NO: 17873 - DNA, 25 bp, Rattus norvegicus
aaatggtgtctgataggcctgcctg

SEQ ID NO: 17874 - DNA, 25 bp, Rattus norvegicus
aaatggtgtctgttaggcctgcctg

SEQ ID NO: 17875 - DNA, 25 bp, Rattus norvegicus
aaatggtgtgttatcttgccttagg

SEQ ID NO: 17876 - DNA, 25 bp, Rattus norvegicus
aaatggtgtgttttcttgccttagg

SEQ ID NO: 17877 - DNA, 25 bp, Rattus norvegicus
aaatggtgttgtctacttccgtgca

SEQ ID NO: 17878 - DNA, 25 bp, Rattus norvegicus
aaatggtgttgtgtacttccgtgca

SEQ ID NO: 17879 - DNA, 25 bp, Rattus norvegicus
aaatggtgtttccttcctgcgaaca

SEQ ID NO: 17880 - DNA, 25 bp, Rattus norvegicus
aaatggtgtttcgttcctgcgaaca

SEQ ID NO: 17881 - DNA, 25 bp, Rattus norvegicus
aaatggttagtcctcagctgtgcta

SEQ ID NO: 17882 - DNA, 25 bp, Rattus norvegicus
aaatggttagtcgtcagctgtgcta

SEQ ID NO: 17883 - DNA, 25 bp, Rattus norvegicus
aaatggttcggccactttggagaag

SEQ ID NO: 17884 - DNA, 25 bp, Rattus norvegicus
aaatggttcggcgactttggagaag

SEQ ID NO: 17885 - DNA, 25 bp, Rattus norvegicus
aaatggttctcaatgttccctctgt

SEQ ID NO: 17886 - DNA, 25 bp, Rattus norvegicus
aaatggttctcattgttccctctgt

SEQ ID NO: 17887 - DNA, 25 bp, Rattus norvegicus
aaatggttctccagagggcgctgca

SEQ ID NO: 17888 - DNA, 25 bp, Rattus norvegicus
aaatggttctcctgagggcgctgca

SEQ ID NO: 17889 - DNA, 25 bp, Rattus norvegicus
aaatggttgcaccaattcactttgt

SEQ ID NO: 17890 - DNA, 25 bp, Rattus norvegicus
aaatggttgcacgaattcactttgt

SEQ ID NO: 17891 - DNA, 25 bp, Rattus norvegicus
aaatggttgtatatgctgatctgta

SEQ ID NO: 17892 - DNA, 25 bp, Rattus norvegicus
aaatggttgtatttgctgatctgta

SEQ ID NO: 17893 - DNA, 25 bp, Rattus norvegicus
aaatggtttattacactcacagtac

SEQ ID NO: 17894 - DNA, 25 bp, Rattus norvegicus
aaatggtttatttcactcacagtac

SEQ ID NO: 17895 - DNA, 25 bp, Rattus norvegicus
aaatggtttcctacatgaatttatt

SEQ ID NO: 17896 - DNA, 25 bp, Rattus norvegicus
aaatggtttccttcatgaatttatt

SEQ ID NO: 17897 - DNA, 25 bp, Rattus norvegicus
aaatggtttgtcatctgctgatcct

SEQ ID NO: 17898 - DNA, 25 bp, Rattus norvegicus
aaatggtttgtcttctgctgatcct

SEQ ID NO: 17899 - DNA, 25 bp, Rattus norvegicus
aaatggttttcccttctgctagaga

SEQ ID NO: 17900 - DNA, 25 bp, Rattus norvegicus
aaatggttttccgttctgctagaga

SEQ ID NO: 17901 - DNA, 25 bp, Rattus norvegicus
aaatggttttgcaaatggacacatg

SEQ ID NO: 17902 - DNA, 25 bp, Rattus norvegicus
aaatggttttgctaatggacacatg

SEQ ID NO: 17903 - DNA, 25 bp, Rattus norvegicus
aaatgtaagacgaccctcacatcct

SEQ ID NO: 17904 - DNA, 25 bp, Rattus norvegicus
aaatgtaagacgtccctcacatcct

SEQ ID NO: 17905 - DNA, 25 bp, Rattus norvegicus
aaatgtaagccaccgtaagagcagt

SEQ ID NO: 17906 - DNA, 25 bp, Rattus norvegicus
aaatgtaagccagcgtaagagcagt

SEQ ID NO: 17907 - DNA, 25 bp, Rattus norvegicus
aaatgtaaggacagctgccagccaa

SEQ ID NO: 17908 - DNA, 25 bp, Rattus norvegicus
aaatgtaaggactgctgccagccaa

SEQ ID NO: 17909 - DNA, 25 bp, Rattus norvegicus
aaatgtaatgacatccagggtatct

SEQ ID NO: 17910 - DNA, 25 bp, Rattus norvegicus
aaatgtaatgacttccagggtatct

SEQ ID NO: 17911 - DNA, 25 bp, Rattus norvegicus
aaatgtaattgcactccctttgtgc

SEQ ID NO: 17912 - DNA, 25 bp, Rattus norvegicus
aaatgtaattgctctccctttgtgc

SEQ ID NO: 17913 - DNA, 25 bp, Rattus norvegicus
aaatgtacaccgagctgcatgcttg

SEQ ID NO: 17914 - DNA, 25 bp, Rattus norvegicus
aaatgtacaccgtgctgcatgcttg

SEQ ID NO: 17915 - DNA, 25 bp, Rattus norvegicus
aaatgtacacttctgtatggttctg

SEQ ID NO: 17916 - DNA, 25 bp, Rattus norvegicus
aaatgtacacttgtgtatggttctg

SEQ ID NO: 17917 - DNA, 25 bp, Rattus norvegicus
aaatgtacataacgctctgtgctgg

SEQ ID NO: 17918 - DNA, 25 bp, Rattus norvegicus
aaatgtacataaggctctgtgctgg

SEQ ID NO: 17919 - DNA, 25 bp, Rattus norvegicus
aaatgtacatcgagggtgtcctgct

SEQ ID NO: 17920 - DNA, 25 bp, Rattus norvegicus
aaatgtacatcgtgggtgtcctgct

SEQ ID NO: 17921 - DNA, 25 bp, Rattus norvegicus
aaatgtacctgtcgtggtttgcata

SEQ ID NO: 17922 - DNA, 25 bp, Rattus norvegicus
aaatgtacctgtggtggtttgcata

SEQ ID NO: 17923 - DNA, 25 bp, Rattus norvegicus
aaatgtaccttgctatctctcttgg

SEQ ID NO: 17924 - DNA, 25 bp, Rattus norvegicus
aaatgtaccttggtatctctcttgg

SEQ ID NO: 17925 - DNA, 25 bp, Rattus norvegicus
aaatgtacgattatcacttgtgaac

SEQ ID NO: 17926 - DNA, 25 bp, Rattus norvegicus
aaatgtacgattttcacttgtgaac

SEQ ID NO: 17927 - DNA, 25 bp, Rattus norvegicus
aaatgtacgctgaagacacgagagt

SEQ ID NO: 17928 - DNA, 25 bp, Rattus norvegicus
aaatgtacgctgtagacacgagagt

SEQ ID NO: 17929 - DNA, 25 bp, Rattus norvegicus
aaatgtacgtgtcttgctgtcgtcc

SEQ ID NO: 17930 - DNA, 25 bp, Rattus norvegicus
aaatgtacgtgtgttgctgtcgtcc

SEQ ID NO: 17931 - DNA, 25 bp, Rattus norvegicus
aaatgtactactaatattctggata

SEQ ID NO: 17932 - DNA, 25 bp, Rattus norvegicus
aaatgtactacttatattctggata

SEQ ID NO: 17933 - DNA, 25 bp, Rattus norvegicus
aaatgtactagtcggctgcagagat

SEQ ID NO: 17934 - DNA, 25 bp, Rattus norvegicus
aaatgtactagtgggctgcagagat

SEQ ID NO: 17935 - DNA, 25 bp, Rattus norvegicus
aaatgtactgaaaggcttgtgtggg

SEQ ID NO: 17936 - DNA, 25 bp, Rattus norvegicus
aaatgtactgaatggcttgtgtggg

SEQ ID NO: 17937 - DNA, 25 bp, Rattus norvegicus
aaatgtactgttatcaagaggactt

SEQ ID NO: 17938 - DNA, 25 bp, Rattus norvegicus
aaatgtactgttttcaagaggactt

SEQ ID NO: 17939 - DNA, 25 bp, Rattus norvegicus
aaatgtacttaactcatctcacctt

SEQ ID NO: 17940 - DNA, 25 bp, Rattus norvegicus
aaatgtacttaagtcatctcacctt

SEQ ID NO: 17941 - DNA, 25 bp, Rattus norvegicus
aaatgtacttgcactagctttttta

SEQ ID NO: 17942 - DNA, 25 bp, Rattus norvegicus
aaatgtacttgctctagctttttta

SEQ ID NO: 17943 - DNA, 25 bp, Rattus norvegicus
aaatgtagaacactttctccctcac

SEQ ID NO: 17944 - DNA, 25 bp, Rattus norvegicus
aaatgtagaacagtttctccctcac

SEQ ID NO: 17945 - DNA, 25 bp, Rattus norvegicus
aaatgtagatcccagcttgtgcaac

SEQ ID NO: 17946 - DNA, 25 bp, Rattus norvegicus
aaatgtagatccgagcttgtgcaac

SEQ ID NO: 17947 - DNA, 25 bp, Rattus norvegicus
aaatgtagcaggactcttcagccct

SEQ ID NO: 17948 - DNA, 25 bp, Rattus norvegicus
aaatgtagcaggtctcttcagccct

SEQ ID NO: 17949 - DNA, 25 bp, Rattus norvegicus
aaatgtagccacattttccagctaa

SEQ ID NO: 17950 - DNA, 25 bp, Rattus norvegicus
aaatgtagccactttttccagctaa

SEQ ID NO: 17951 - DNA, 25 bp, Rattus norvegicus
aaatgtagccctctatggtgggcga

SEQ ID NO: 17952 - DNA, 25 bp, Rattus norvegicus
aaatgtagccctgtatggtgggcga

SEQ ID NO: 17953 - DNA, 25 bp, Rattus norvegicus
aaatgtaggactatgtgcatgctag

SEQ ID NO: 17954 - DNA, 25 bp, Rattus norvegicus
aaatgtaggactttgtgcatgctag

SEQ ID NO: 17955 - DNA, 25 bp, Rattus norvegicus
aaatgtaggcgtaaattgatataaa

SEQ ID NO: 17956 - DNA, 25 bp, Rattus norvegicus
aaatgtaggcgttaattgatataaa

SEQ ID NO: 17957 - DNA, 25 bp, Rattus norvegicus
aaatgtagttggattctccctgtaa

SEQ ID NO: 17958 - DNA, 25 bp, Rattus norvegicus
aaatgtagttggtttctccctgtaa

SEQ ID NO: 17959 - DNA, 25 bp, Rattus norvegicus
aaatgtatatgcatcttcccagcca

SEQ ID NO: 17960 - DNA, 25 bp, Rattus norvegicus
aaatgtatatgcttcttcccagcca

SEQ ID NO: 17961 - DNA, 25 bp, Rattus norvegicus
aaatgtatcacaccaagggccactc

SEQ ID NO: 17962 - DNA, 25 bp, Rattus norvegicus
aaatgtatcacagcaagggccactc

SEQ ID NO: 17963 - DNA, 25 bp, Rattus norvegicus
aaatgtatccagatgtggttgtgca

SEQ ID NO: 17964 - DNA, 25 bp, Rattus norvegicus
aaatgtatccagttgtggttgtgca

SEQ ID NO: 17965 - DNA, 25 bp, Rattus norvegicus
aaatgtatctttatactctgtgact

SEQ ID NO: 17966 - DNA, 25 bp, Rattus norvegicus
aaatgtatctttcggcatgagtcac

SEQ ID NO: 17967 - DNA, 25 bp, Rattus norvegicus
aaatgtatctttgggcatgagtcac

SEQ ID NO: 17968 - DNA, 25 bp, Rattus norvegicus
aaatgtatctttttactctgtgact

SEQ ID NO: 17969 - DNA, 25 bp, Rattus norvegicus
aaatgtatgaggactttgtgctgaa

SEQ ID NO: 17970 - DNA, 25 bp, Rattus norvegicus
aaatgtatgaggtctttgtgctgaa

SEQ ID NO: 17971 - DNA, 25 bp, Rattus norvegicus
aaatgtatgcctcctccaagttcgt

SEQ ID NO: 17972 - DNA, 25 bp, Rattus norvegicus
aaatgtatgcctcggatgccttctt

SEQ ID NO: 17973 - DNA, 25 bp, Rattus norvegicus
aaatgtatgcctgctccaagttcgt

SEQ ID NO: 17974 - DNA, 25 bp, Rattus norvegicus
aaatgtatgcctgggatgccttctt

SEQ ID NO: 17975 - DNA, 25 bp, Rattus norvegicus
aaatgtatggaaacggcctcccact

SEQ ID NO: 17976 - DNA, 25 bp, Rattus norvegicus
aaatgtatggaatcggcctcccact

SEQ ID NO: 17977 - DNA, 25 bp, Rattus norvegicus
aaatgtatgtatcttctgttgaatc

SEQ ID NO: 17978 - DNA, 25 bp, Rattus norvegicus
aaatgtatgtatgttctgttgaatc

SEQ ID NO: 17979 - DNA, 25 bp, Rattus norvegicus
aaatgtattgctcgctacatggcag

SEQ ID NO: 17980 - DNA, 25 bp, Rattus norvegicus
aaatgtattgctggctacatggcag

SEQ ID NO: 17981 - DNA, 25 bp, Rattus norvegicus
aaatgtcaagatacgtaccacccgt

SEQ ID NO: 17982 - DNA, 25 bp, Rattus norvegicus
aaatgtcaagattcgtaccacccgt

SEQ ID NO: 17983 - DNA, 25 bp, Rattus norvegicus
aaatgtcaaggtcaccacgtccatc

SEQ ID NO: 17984 - DNA, 25 bp, Rattus norvegicus
aaatgtcaaggtgaccacgtccatc

SEQ ID NO: 17985 - DNA, 25 bp, Rattus norvegicus
aaatgtcaattaccaccctgggcct

SEQ ID NO: 17986 - DNA, 25 bp, Rattus norvegicus
aaatgtcaattagcaccctgggcct

SEQ ID NO: 17987 - DNA, 25 bp, Rattus norvegicus
aaatgtcacagtcagagccacacca

SEQ ID NO: 17988 - DNA, 25 bp, Rattus norvegicus
aaatgtcacagtccttcctgaatca

SEQ ID NO: 17989 - DNA, 25 bp, Rattus norvegicus
aaatgtcacagtgagagccacacca

SEQ ID NO: 17990 - DNA, 25 bp, Rattus norvegicus
aaatgtcacagtgcttcctgaatca

SEQ ID NO: 17991 - DNA, 25 bp, Rattus norvegicus
aaatgtcacatcatcagtcctaatg

SEQ ID NO: 17992 - DNA, 25 bp, Rattus norvegicus
aaatgtcacatcttcagtcctaatg

SEQ ID NO: 17993 - DNA, 25 bp, Rattus norvegicus
aaatgtcacccactggccttgggaa

SEQ ID NO: 17994 - DNA, 25 bp, Rattus norvegicus
aaatgtcacccagtggccttgggaa

SEQ ID NO: 17995 - DNA, 25 bp, Rattus norvegicus
aaatgtcaccctatggagagctcag

SEQ ID NO: 17996 - DNA, 25 bp, Rattus norvegicus
aaatgtcaccctttggagagctcag

SEQ ID NO: 17997 - DNA, 25 bp, Rattus norvegicus
aaatgtcaccgtctatgttacagat

SEQ ID NO: 17998 - DNA, 25 bp, Rattus norvegicus
aaatgtcaccgtgtatgttacagat

SEQ ID NO: 17999 - DNA, 25 bp, Rattus norvegicus
aaatgtcacctgcaaaatgggcatt

SEQ ID NO: 18000 - DNA, 25 bp, Rattus norvegicus
aaatgtcacctggaaaatgggcatt

SEQ ID NO: 18001 - DNA, 25 bp, Rattus norvegicus
aaatgtcacgttacatgcttcctcc

SEQ ID NO: 18002 - DNA, 25 bp, Rattus norvegicus
aaatgtcacgtttcatgcttcctcc

SEQ ID NO: 18003 - DNA, 25 bp, Rattus norvegicus
aaatgtcactgcagtggaaatgacc

SEQ ID NO: 18004 - DNA, 25 bp, Rattus norvegicus
aaatgtcactgctgtggaaatgacc

SEQ ID NO: 18005 - DNA, 25 bp, Rattus norvegicus
aaatgtcatcctatgtgaacacagc

SEQ ID NO: 18006 - DNA, 25 bp, Rattus norvegicus
aaatgtcatcctttgtgaacacagc

SEQ ID NO: 18007 - DNA, 25 bp, Rattus norvegicus
aaatgtcatctcaagtcaagtcact

SEQ ID NO: 18008 - DNA, 25 bp, Rattus norvegicus
aaatgtcatctctagtcaagtcact

SEQ ID NO: 18009 - DNA, 25 bp, Rattus norvegicus
aaatgtcattctatttctcttcgaa

SEQ ID NO: 18010 - DNA, 25 bp, Rattus norvegicus
aaatgtcattctttttctcttcgaa

SEQ ID NO: 18011 - DNA, 25 bp, Rattus norvegicus
aaatgtcattgaccgactccaggaa

SEQ ID NO: 18012 - DNA, 25 bp, Rattus norvegicus
aaatgtcattgagcgactccaggaa

SEQ ID NO: 18013 - DNA, 25 bp, Rattus norvegicus
aaatgtccaaagactgatcgcccag

SEQ ID NO: 18014 - DNA, 25 bp, Rattus norvegicus
aaatgtccaaagtctgatcgcccag

SEQ ID NO: 18015 - DNA, 25 bp, Rattus norvegicus
aaatgtccaacaacggctgcttagc

SEQ ID NO: 18016 - DNA, 25 bp, Rattus norvegicus
aaatgtccaacatcggctgcttagc

SEQ ID NO: 18017 - DNA, 25 bp, Rattus norvegicus
aaatgtccacctagcatgccatgag

SEQ ID NO: 18018 - DNA, 25 bp, Rattus norvegicus
aaatgtccacctctacttgaggccg

SEQ ID NO: 18019 - DNA, 25 bp, Rattus norvegicus
aaatgtccacctgtacttgaggccg

SEQ ID NO: 18020 - DNA, 25 bp, Rattus norvegicus
aaatgtccaccttgcatgccatgag

SEQ ID NO: 18021 - DNA, 25 bp, Rattus norvegicus
aaatgtccagtaccatgacgcccag

SEQ ID NO: 18022 - DNA, 25 bp, Rattus norvegicus
aaatgtccagtagcatgacgcccag

SEQ ID NO: 18023 - DNA, 25 bp, Rattus norvegicus
aaatgtccatgtattgaggcagtga

SEQ ID NO: 18024 - DNA, 25 bp, Rattus norvegicus
aaatgtccatgttttgaggcagtga

SEQ ID NO: 18025 - DNA, 25 bp, Rattus norvegicus
aaatgtccattgcaaagccatggta

SEQ ID NO: 18026 - DNA, 25 bp, Rattus norvegicus
aaatgtccattggaaagccatggta

SEQ ID NO: 18027 - DNA, 25 bp, Rattus norvegicus
aaatgtccatttccagtgctacaaa

SEQ ID NO: 18028 - DNA, 25 bp, Rattus norvegicus
aaatgtccatttgcagtgctacaaa

SEQ ID NO: 18029 - DNA, 25 bp, Rattus norvegicus
aaatgtcccactaaaatgatgtaat

SEQ ID NO: 18030 - DNA, 25 bp, Rattus norvegicus
aaatgtcccacttaaatgatgtaat

SEQ ID NO: 18031 - DNA, 25 bp, Rattus norvegicus
aaatgtccccatccctaaatcctga

SEQ ID NO: 18032 - DNA, 25 bp, Rattus norvegicus
aaatgtccccatgcctaaatcctga

SEQ ID NO: 18033 - DNA, 25 bp, Rattus norvegicus
aaatgtcccctgaggttccttactg

SEQ ID NO: 18034 - DNA, 25 bp, Rattus norvegicus
aaatgtcccctgtggttccttactg

SEQ ID NO: 18035 - DNA, 25 bp, Rattus norvegicus
aaatgtcccgatactgctggttcta

SEQ ID NO: 18036 - DNA, 25 bp, Rattus norvegicus
aaatgtcccgattctgctggttcta

SEQ ID NO: 18037 - DNA, 25 bp, Rattus norvegicus
aaatgtccctaaccaattcctaatt

SEQ ID NO: 18038 - DNA, 25 bp, Rattus norvegicus
aaatgtccctaagcaattcctaatt

SEQ ID NO: 18039 - DNA, 25 bp, Rattus norvegicus
aaatgtccctcactgagagtcctat

SEQ ID NO: 18040 - DNA, 25 bp, Rattus norvegicus
aaatgtccctcagtgagagtcctat

SEQ ID NO: 18041 - DNA, 25 bp, Rattus norvegicus
aaatgtccgcatacacagatgtggg

SEQ ID NO: 18042 - DNA, 25 bp, Rattus norvegicus
aaatgtccgcattcacagatgtggg

SEQ ID NO: 18043 - DNA, 25 bp, Rattus norvegicus
aaatgtccggagcacatgtgacctt

SEQ ID NO: 18044 - DNA, 25 bp, Rattus norvegicus
aaatgtccggaggacatgtgacctt

SEQ ID NO: 18045 - DNA, 25 bp, Rattus norvegicus
aaatgtccgggcagcagtcttgtac

SEQ ID NO: 18046 - DNA, 25 bp, Rattus norvegicus
aaatgtccgggctgcagtcttgtac

SEQ ID NO: 18047 - DNA, 25 bp, Rattus norvegicus
aaatgtcctacacacaccgtagcga

SEQ ID NO: 18048 - DNA, 25 bp, Rattus norvegicus
aaatgtcctacagacaccgtagcga

SEQ ID NO: 18049 - DNA, 25 bp, Rattus norvegicus
aaatgtcctagcagccacagtgaaa

SEQ ID NO: 18050 - DNA, 25 bp, Rattus norvegicus
aaatgtcctagctgccacagtgaaa

SEQ ID NO: 18051 - DNA, 25 bp, Rattus norvegicus
aaatgtcctatcactgttacacaaa

SEQ ID NO: 18052 - DNA, 25 bp, Rattus norvegicus
aaatgtcctatctctgttacacaaa

SEQ ID NO: 18053 - DNA, 25 bp, Rattus norvegicus
aaatgtcctgcaagctttccatgtt

SEQ ID NO: 18054 - DNA, 25 bp, Rattus norvegicus
aaatgtcctgcatgctttccatgtt

SEQ ID NO: 18055 - DNA, 25 bp, Rattus norvegicus
aaatgtcctgtgatttctggtgcat

SEQ ID NO: 18056 - DNA, 25 bp, Rattus norvegicus
aaatgtcctgtgttttctggtgcat

SEQ ID NO: 18057 - DNA, 25 bp, Rattus norvegicus
aaatgtccttgcacgtcattctctt

SEQ ID NO: 18058 - DNA, 25 bp, Rattus norvegicus
aaatgtccttgctcgtcattctctt

SEQ ID NO: 18059 - DNA, 25 bp, Rattus norvegicus
aaatgtcctttgagactccggtttg

SEQ ID NO: 18060 - DNA, 25 bp, Rattus norvegicus
aaatgtcctttgcaggaaggagata

SEQ ID NO: 18061 - DNA, 25 bp, Rattus norvegicus
aaatgtcctttggaggaaggagata

SEQ ID NO: 18062 - DNA, 25 bp, Rattus norvegicus
aaatgtcctttgtgactccggtttg

SEQ ID NO: 18063 - DNA, 25 bp, Rattus norvegicus
aaatgtcgccttctgggctgatttc

SEQ ID NO: 18064 - DNA, 25 bp, Rattus norvegicus
aaatgtcgccttgtgggctgatttc

SEQ ID NO: 18065 - DNA, 25 bp, Rattus norvegicus
aaatgtcgctctcctgacaaggaaa

SEQ ID NO: 18066 - DNA, 25 bp, Rattus norvegicus
aaatgtcgctctgctgacaaggaaa

SEQ ID NO: 18067 - DNA, 25 bp, Rattus norvegicus
aaatgtcgctggctagtttctgccc

SEQ ID NO: 18068 - DNA, 25 bp, Rattus norvegicus
aaatgtcgctgggtagtttctgccc

SEQ ID NO: 18069 - DNA, 25 bp, Rattus norvegicus
aaatgtcggactagctgttttaagc

SEQ ID NO: 18070 - DNA, 25 bp, Rattus norvegicus
aaatgtcggacttgctgttttaagc

SEQ ID NO: 18071 - DNA, 25 bp, Rattus norvegicus
aaatgtcggcgtcgtgctgttcaat

SEQ ID NO: 18072 - DNA, 25 bp, Rattus norvegicus
aaatgtcggcgtggtgctgttcaat

SEQ ID NO: 18073 - DNA, 25 bp, Rattus norvegicus
aaatgtcgtcttagagcctagtacc

SEQ ID NO: 18074 - DNA, 25 bp, Rattus norvegicus
aaatgtcgtctttgagcctagtacc

SEQ ID NO: 18075 - DNA, 25 bp, Rattus norvegicus
aaatgtcgtgtgactctgaaaatcc

SEQ ID NO: 18076 - DNA, 25 bp, Rattus norvegicus
aaatgtcgtgtgaggtgctcttgtc

SEQ ID NO: 18077 - DNA, 25 bp, Rattus norvegicus
aaatgtcgtgtgtctctgaaaatcc

SEQ ID NO: 18078 - DNA, 25 bp, Rattus norvegicus
aaatgtcgtgtgtggtgctcttgtc

SEQ ID NO: 18079 - DNA, 25 bp, Rattus norvegicus
aaatgtcgtttcagtctacagacta

SEQ ID NO: 18080 - DNA, 25 bp, Rattus norvegicus
aaatgtcgtttctgtctacagacta

SEQ ID NO: 18081 - DNA, 25 bp, Rattus norvegicus
aaatgtctacaacaaccaacttttg

SEQ ID NO: 18082 - DNA, 25 bp, Rattus norvegicus
aaatgtctacaagaaccaacttttg

SEQ ID NO: 18083 - DNA, 25 bp, Rattus norvegicus
aaatgtctacggaaagcccacctgg

SEQ ID NO: 18084 - DNA, 25 bp, Rattus norvegicus
aaatgtctacggtaagcccacctgg

SEQ ID NO: 18085 - DNA, 25 bp, Rattus norvegicus
aaatgtctatagatcctgcctgtca

SEQ ID NO: 18086 - DNA, 25 bp, Rattus norvegicus
aaatgtctatagttcctgcctgtca

SEQ ID NO: 18087 - DNA, 25 bp, Rattus norvegicus
aaatgtctatgcagttacacccaga

SEQ ID NO: 18088 - DNA, 25 bp, Rattus norvegicus
aaatgtctatgctgttacacccaga

SEQ ID NO: 18089 - DNA, 25 bp, Rattus norvegicus
aaatgtctatggagcagaaactgct

SEQ ID NO: 18090 - DNA, 25 bp, Rattus norvegicus
aaatgtctatggtgcagaaactgct

SEQ ID NO: 18091 - DNA, 25 bp, Rattus norvegicus
aaatgtctcatcctaggtattactt

SEQ ID NO: 18092 - DNA, 25 bp, Rattus norvegicus
aaatgtctcatcgtaggtattactt

SEQ ID NO: 18093 - DNA, 25 bp, Rattus norvegicus
aaatgtctccagagtttcttccagg

SEQ ID NO: 18094 - DNA, 25 bp, Rattus norvegicus
aaatgtctccagtgtttcttccagg

SEQ ID NO: 18095 - DNA, 25 bp, Rattus norvegicus
aaatgtctccatctccttcatctgg

SEQ ID NO: 18096 - DNA, 25 bp, Rattus norvegicus
aaatgtctccatgtccttcatctgg

SEQ ID NO: 18097 - DNA, 25 bp, Rattus norvegicus
aaatgtctccctagcacagtaaagc

SEQ ID NO: 18098 - DNA, 25 bp, Rattus norvegicus
aaatgtctcccttgcacagtaaagc

SEQ ID NO: 18099 - DNA, 25 bp, Rattus norvegicus
aaatgtctccgaaaatttattgata

SEQ ID NO: 18100 - DNA, 25 bp, Rattus norvegicus
aaatgtctccgataatttattgata

SEQ ID NO: 18101 - DNA, 25 bp, Rattus norvegicus
aaatgtctcctgagtcacattctgg

SEQ ID NO: 18102 - DNA, 25 bp, Rattus norvegicus
aaatgtctcctgtgtcacattctgg

SEQ ID NO: 18103 - DNA, 25 bp, Rattus norvegicus
aaatgtctccttccctgacaaacac

SEQ ID NO: 18104 - DNA, 25 bp, Rattus norvegicus
aaatgtctccttctcaattccactg

SEQ ID NO: 18105 - DNA, 25 bp, Rattus norvegicus
aaatgtctccttgcctgacaaacac

SEQ ID NO: 18106 - DNA, 25 bp, Rattus norvegicus
aaatgtctccttgtcaattccactg

SEQ ID NO: 18107 - DNA, 25 bp, Rattus norvegicus
aaatgtctcgagcattcttcccata

SEQ ID NO: 18108 - DNA, 25 bp, Rattus norvegicus
aaatgtctcgaggattcttcccata

SEQ ID NO: 18109 - DNA, 25 bp, Rattus norvegicus
aaatgtctcggtcactacgcaaagc

SEQ ID NO: 18110 - DNA, 25 bp, Rattus norvegicus
aaatgtctcggtgactacgcaaagc

SEQ ID NO: 18111 - DNA, 25 bp, Rattus norvegicus
aaatgtctctcaaaaagcctgcctg

SEQ ID NO: 18112 - DNA, 25 bp, Rattus norvegicus
aaatgtctctcataaagcctgcctg

SEQ ID NO: 18113 - DNA, 25 bp, Rattus norvegicus
aaatgtctctggctattgcaagtga

SEQ ID NO: 18114 - DNA, 25 bp, Rattus norvegicus
aaatgtctctgggtattgcaagtga

SEQ ID NO: 18115 - DNA, 25 bp, Rattus norvegicus
aaatgtctcttaaactttctgggat

SEQ ID NO: 18116 - DNA, 25 bp, Rattus norvegicus
aaatgtctcttaagtgtcagggaac

SEQ ID NO: 18117 - DNA, 25 bp, Rattus norvegicus
aaatgtctcttatactttctgggat

SEQ ID NO: 18118 - DNA, 25 bp, Rattus norvegicus
aaatgtctcttatgtgtcagggaac

SEQ ID NO: 18119 - DNA, 25 bp, Rattus norvegicus
aaatgtctctttctctagcaagtgt

SEQ ID NO: 18120 - DNA, 25 bp, Rattus norvegicus
aaatgtctctttgtctagcaagtgt

SEQ ID NO: 18121 - DNA, 25 bp, Rattus norvegicus
aaatgtctgatgagtttctttccca

SEQ ID NO: 18122 - DNA, 25 bp, Rattus norvegicus
aaatgtctgatgtgtttctttccca

SEQ ID NO: 18123 - DNA, 25 bp, Rattus norvegicus
aaatgtctgctgctgcttatgcgcc

SEQ ID NO: 18124 - DNA, 25 bp, Rattus norvegicus
aaatgtctgctggtgcttatgcgcc

SEQ ID NO: 18125 - DNA, 25 bp, Rattus norvegicus
aaatgtctgcttctggtttgtacct

SEQ ID NO: 18126 - DNA, 25 bp, Rattus norvegicus
aaatgtctgcttgtggtttgtacct

SEQ ID NO: 18127 - DNA, 25 bp, Rattus norvegicus
aaatgtctggctaattgcttcctgt

SEQ ID NO: 18128 - DNA, 25 bp, Rattus norvegicus
aaatgtctggcttattgcttcctgt

SEQ ID NO: 18129 - DNA, 25 bp, Rattus norvegicus
aaatgtctggtaaggctgttgatca

SEQ ID NO: 18130 - DNA, 25 bp, Rattus norvegicus
aaatgtctggtatggctgttgatca

SEQ ID NO: 18131 - DNA, 25 bp, Rattus norvegicus
aaatgtctgtatagctctttcccag

SEQ ID NO: 18132 - DNA, 25 bp, Rattus norvegicus
aaatgtctgtatagttgccaccctg

SEQ ID NO: 18133 - DNA, 25 bp, Rattus norvegicus
aaatgtctgtattgctctttcccag

SEQ ID NO: 18134 - DNA, 25 bp, Rattus norvegicus
aaatgtctgtattgttgccaccctg

SEQ ID NO: 18135 - DNA, 25 bp, Rattus norvegicus
aaatgtctgtctatgcgcatggact

SEQ ID NO: 18136 - DNA, 25 bp, Rattus norvegicus
aaatgtctgtctttgcgcatggact

SEQ ID NO: 18137 - DNA, 25 bp, Rattus norvegicus
aaatgtctgtgcaccgagtcatcaa

SEQ ID NO: 18138 - DNA, 25 bp, Rattus norvegicus
aaatgtctgtgctccgagtcatcaa

SEQ ID NO: 18139 - DNA, 25 bp, Rattus norvegicus
aaatgtctgtgtctttagaacatac

SEQ ID NO: 18140 - DNA, 25 bp, Rattus norvegicus
aaatgtctgtgtgtttagaacatac

SEQ ID NO: 18141 - DNA, 25 bp, Rattus norvegicus
aaatgtctgttccatgaccttctgg

SEQ ID NO: 18142 - DNA, 25 bp, Rattus norvegicus
aaatgtctgttcgatgaccttctgg

SEQ ID NO: 18143 - DNA, 25 bp, Rattus norvegicus
aaatgtctgtttctctttcatggcc

SEQ ID NO: 18144 - DNA, 25 bp, Rattus norvegicus
aaatgtctgtttgtctttcatggcc

SEQ ID NO: 18145 - DNA, 25 bp, Rattus norvegicus
aaatgtcttcacatttgtatttgat

SEQ ID NO: 18146 - DNA, 25 bp, Rattus norvegicus
aaatgtcttcacttttgtatttgat

SEQ ID NO: 18147 - DNA, 25 bp, Rattus norvegicus
aaatgtcttcatatctaagccttaa

SEQ ID NO: 18148 - DNA, 25 bp, Rattus norvegicus
aaatgtcttcatttctaagccttaa

SEQ ID NO: 18149 - DNA, 25 bp, Rattus norvegicus
aaatgtcttgacaggcaggcccagg

SEQ ID NO: 18150 - DNA, 25 bp, Rattus norvegicus
aaatgtcttgactggcaggcccagg

SEQ ID NO: 18151 - DNA, 25 bp, Rattus norvegicus
aaatgtcttgtcacagttttagtct

SEQ ID NO: 18152 - DNA, 25 bp, Rattus norvegicus
aaatgtcttgtctcagttttagtct

SEQ ID NO: 18153 - DNA, 25 bp, Rattus norvegicus
aaatgtctttggctatacaactaaa

SEQ ID NO: 18154 - DNA, 25 bp, Rattus norvegicus
aaatgtctttgggtatacaactaaa

SEQ ID NO: 18155 - DNA, 25 bp, Rattus norvegicus
aaatgtctttgtccagggcattccg

SEQ ID NO: 18156 - DNA, 25 bp, Rattus norvegicus
aaatgtctttgtgcagggcattccg

SEQ ID NO: 18157 - DNA, 25 bp, Rattus norvegicus
aaatgtgaagccacagcggtgcctg

SEQ ID NO: 18158 - DNA, 25 bp, Rattus norvegicus
aaatgtgaagccactggctggctcc

SEQ ID NO: 18159 - DNA, 25 bp, Rattus norvegicus
aaatgtgaagcctcagcggtgcctg

SEQ ID NO: 18160 - DNA, 25 bp, Rattus norvegicus
aaatgtgaagcctctggctggctcc

SEQ ID NO: 18161 - DNA, 25 bp, Rattus norvegicus
aaatgtgacaacacgggctcagttc

SEQ ID NO: 18162 - DNA, 25 bp, Rattus norvegicus
aaatgtgacaactcgggctcagttc

SEQ ID NO: 18163 - DNA, 25 bp, Rattus norvegicus
aaatgtgacactagaccctgaactg

SEQ ID NO: 18164 - DNA, 25 bp, Rattus norvegicus
aaatgtgacactagtcttcccagtt

SEQ ID NO: 18165 - DNA, 25 bp, Rattus norvegicus
aaatgtgacacttgaccctgaactg

SEQ ID NO: 18166 - DNA, 25 bp, Rattus norvegicus
aaatgtgacacttgtcttcccagtt

SEQ ID NO: 18167 - DNA, 25 bp, Rattus norvegicus
aaatgtgaccagacccagttcaggt

SEQ ID NO: 18168 - DNA, 25 bp, Rattus norvegicus
aaatgtgaccagtcccagttcaggt

SEQ ID NO: 18169 - DNA, 25 bp, Rattus norvegicus
aaatgtgaccctcgccatggtaaat

SEQ ID NO: 18170 - DNA, 25 bp, Rattus norvegicus
aaatgtgaccctggccatggtaaat

SEQ ID NO: 18171 - DNA, 25 bp, Rattus norvegicus
aaatgtgacctacagtccgtgcttg

SEQ ID NO: 18172 - DNA, 25 bp, Rattus norvegicus
aaatgtgacctagagtccgtgcttg

SEQ ID NO: 18173 - DNA, 25 bp, Rattus norvegicus
aaatgtgacctgatcttcaagcttc

SEQ ID NO: 18174 - DNA, 25 bp, Rattus norvegicus
aaatgtgacctgttcttcaagcttc

SEQ ID NO: 18175 - DNA, 25 bp, Rattus norvegicus
aaatgtgacgttcctacctctgaga

SEQ ID NO: 18176 - DNA, 25 bp, Rattus norvegicus
aaatgtgacgttgctacctctgaga

SEQ ID NO: 18177 - DNA, 25 bp, Rattus norvegicus
aaatgtgacttgatctgactgcagt

SEQ ID NO: 18178 - DNA, 25 bp, Rattus norvegicus
aaatgtgacttgttctgactgcagt

SEQ ID NO: 18179 - DNA, 25 bp, Rattus norvegicus
aaatgtgagcgtcttctgctggccc

SEQ ID NO: 18180 - DNA, 25 bp, Rattus norvegicus
aaatgtgagcgtgttctgctggccc

SEQ ID NO: 18181 - DNA, 25 bp, Rattus norvegicus
aaatgtgaggttcttccctcttcag

SEQ ID NO: 18182 - DNA, 25 bp, Rattus norvegicus
aaatgtgaggttgttccctcttcag

SEQ ID NO: 18183 - DNA, 25 bp, Rattus norvegicus
aaatgtgagtttatgagttcttgtg

SEQ ID NO: 18184 - DNA, 25 bp, Rattus norvegicus
aaatgtgagtttttgagttcttgtg

SEQ ID NO: 18185 - DNA, 25 bp, Rattus norvegicus
aaatgtgatgccacagtctatgggt

SEQ ID NO: 18186 - DNA, 25 bp, Rattus norvegicus
aaatgtgatgcctcagtctatgggt

SEQ ID NO: 18187 - DNA, 25 bp, Rattus norvegicus
aaatgtgatgtaatccaggccctaa

SEQ ID NO: 18188 - DNA, 25 bp, Rattus norvegicus
aaatgtgatgtattccaggccctaa

SEQ ID NO: 18189 - DNA, 25 bp, Rattus norvegicus
aaatgtgattttcctccctttcagg

SEQ ID NO: 18190 - DNA, 25 bp, Rattus norvegicus
aaatgtgattttgctccctttcagg

SEQ ID NO: 18191 - DNA, 25 bp, Rattus norvegicus
aaatgtgcaaacactcaatccgacg

SEQ ID NO: 18192 - DNA, 25 bp, Rattus norvegicus
aaatgtgcaaactctcaatccgacg

SEQ ID NO: 18193 - DNA, 25 bp, Rattus norvegicus
aaatgtgcacatcaacactatattt

SEQ ID NO: 18194 - DNA, 25 bp, Rattus norvegicus
aaatgtgcacatgaacactatattt

SEQ ID NO: 18195 - DNA, 25 bp, Rattus norvegicus
aaatgtgcaccaacctccgatggcc

SEQ ID NO: 18196 - DNA, 25 bp, Rattus norvegicus
aaatgtgcaccatcctccgatggcc

SEQ ID NO: 18197 - DNA, 25 bp, Rattus norvegicus
aaatgtgcactacttcttgggccat

SEQ ID NO: 18198 - DNA, 25 bp, Rattus norvegicus
aaatgtgcactagttcttgggccat

SEQ ID NO: 18199 - DNA, 25 bp, Rattus norvegicus
aaatgtgcaggcctggctctctgaa

SEQ ID NO: 18200 - DNA, 25 bp, Rattus norvegicus
aaatgtgcaggcgtggctctctgaa

SEQ ID NO: 18201 - DNA, 25 bp, Rattus norvegicus
aaatgtgcagtgaccctagtgccca

SEQ ID NO: 18202 - DNA, 25 bp, Rattus norvegicus
aaatgtgcagtgtccctagtgccca

SEQ ID NO: 18203 - DNA, 25 bp, Rattus norvegicus
aaatgtgcatttactgactgtatag

SEQ ID NO: 18204 - DNA, 25 bp, Rattus norvegicus
aaatgtgcattttctgactgtatag

SEQ ID NO: 18205 - DNA, 25 bp, Rattus norvegicus
aaatgtgccaaacatcatcaaacat

SEQ ID NO: 18206 - DNA, 25 bp, Rattus norvegicus
aaatgtgccaaagatcatcaaacat

SEQ ID NO: 18207 - DNA, 25 bp, Rattus norvegicus
aaatgtgccacacagtggcttatgt

SEQ ID NO: 18208 - DNA, 25 bp, Rattus norvegicus
aaatgtgccacagagtggcttatgt

SEQ ID NO: 18209 - DNA, 25 bp, Rattus norvegicus
aaatgtgccactagtttggtgcctc

SEQ ID NO: 18210 - DNA, 25 bp, Rattus norvegicus
aaatgtgccactcggattctcctgg

SEQ ID NO: 18211 - DNA, 25 bp, Rattus norvegicus
aaatgtgccactgggattctcctgg

SEQ ID NO: 18212 - DNA, 25 bp, Rattus norvegicus
aaatgtgccacttgtttggtgcctc

SEQ ID NO: 18213 - DNA, 25 bp, Rattus norvegicus
aaatgtgcccctatagcaattggaa

SEQ ID NO: 18214 - DNA, 25 bp, Rattus norvegicus
aaatgtgcccctttagcaattggaa

SEQ ID NO: 18215 - DNA, 25 bp, Rattus norvegicus
aaatgtgccctgctgcttcaaacct

SEQ ID NO: 18216 - DNA, 25 bp, Rattus norvegicus
aaatgtgccctggtgcttcaaacct

SEQ ID NO: 18217 - DNA, 25 bp, Rattus norvegicus
aaatgtgcctataggtgtctaaact

SEQ ID NO: 18218 - DNA, 25 bp, Rattus norvegicus
aaatgtgcctattggtgtctaaact

SEQ ID NO: 18219 - DNA, 25 bp, Rattus norvegicus
aaatgtgcctgccaccgaggctgat

SEQ ID NO: 18220 - DNA, 25 bp, Rattus norvegicus
aaatgtgcctgcgaccgaggctgat

SEQ ID NO: 18221 - DNA, 25 bp, Rattus norvegicus
aaatgtgccttcaccttagctgttt

SEQ ID NO: 18222 - DNA, 25 bp, Rattus norvegicus
aaatgtgccttctccttagctgttt

SEQ ID NO: 18223 - DNA, 25 bp, Rattus norvegicus
aaatgtgcgctaattctgtaactag

SEQ ID NO: 18224 - DNA, 25 bp, Rattus norvegicus
aaatgtgcgctatttctgtaactag

SEQ ID NO: 18225 - DNA, 25 bp, Rattus norvegicus
aaatgtgcgtcacagtgtgcgtgcc

SEQ ID NO: 18226 - DNA, 25 bp, Rattus norvegicus
aaatgtgcgtcagagtgtgcgtgcc

SEQ ID NO: 18227 - DNA, 25 bp, Rattus norvegicus
aaatgtgcgtggatctgaccgctgc

SEQ ID NO: 18228 - DNA, 25 bp, Rattus norvegicus
aaatgtgcgtggttctgaccgctgc

SEQ ID NO: 18229 - DNA, 25 bp, Rattus norvegicus
aaatgtgctacaacacaggaaccta

SEQ ID NO: 18230 - DNA, 25 bp, Rattus norvegicus
aaatgtgctacatcacaggaaccta

SEQ ID NO: 18231 - DNA, 25 bp, Rattus norvegicus
aaatgtgctatgcagccaggctaac

SEQ ID NO: 18232 - DNA, 25 bp, Rattus norvegicus
aaatgtgctatggagccaggctaac

SEQ ID NO: 18233 - DNA, 25 bp, Rattus norvegicus
aaatgtgctctgatcctgagctgta

SEQ ID NO: 18234 - DNA, 25 bp, Rattus norvegicus
aaatgtgctctgcaacctgacacac

SEQ ID NO: 18235 - DNA, 25 bp, Rattus norvegicus
aaatgtgctctggaacctgacacac

SEQ ID NO: 18236 - DNA, 25 bp, Rattus norvegicus
aaatgtgctctgttcctgagctgta

SEQ ID NO: 18237 - DNA, 25 bp, Rattus norvegicus
aaatgtgctggaactcaggagtcag

SEQ ID NO: 18238 - DNA, 25 bp, Rattus norvegicus
aaatgtgctggatctcaggagtcag

SEQ ID NO: 18239 - DNA, 25 bp, Rattus norvegicus
aaatgtgctgtaccggcctgtggcc

SEQ ID NO: 18240 - DNA, 25 bp, Rattus norvegicus
aaatgtgctgtagcggcctgtggcc

SEQ ID NO: 18241 - DNA, 25 bp, Rattus norvegicus
aaatgtgcttccaccaaccagagga

SEQ ID NO: 18242 - DNA, 25 bp, Rattus norvegicus
aaatgtgcttcctccaaccagagga

SEQ ID NO: 18243 - DNA, 25 bp, Rattus norvegicus
aaatgtgcttgcagtgatttttcac

SEQ ID NO: 18244 - DNA, 25 bp, Rattus norvegicus
aaatgtgcttgctgtgatttttcac

SEQ ID NO: 18245 - DNA, 25 bp, Rattus norvegicus
aaatgtggaagcctctatgccctgc

SEQ ID NO: 18246 - DNA, 25 bp, Rattus norvegicus
aaatgtggaagcgtctatgccctgc

SEQ ID NO: 18247 - DNA, 25 bp, Rattus norvegicus
aaatgtggaagtctactccccagca

SEQ ID NO: 18248 - DNA, 25 bp, Rattus norvegicus
aaatgtggaagtcttcagaaaccca

SEQ ID NO: 18249 - DNA, 25 bp, Rattus norvegicus
aaatgtggaagtgtactccccagca

SEQ ID NO: 18250 - DNA, 25 bp, Rattus norvegicus
aaatgtggaagtgttcagaaaccca

SEQ ID NO: 18251 - DNA, 25 bp, Rattus norvegicus
aaatgtggacaaacccttctgggcc

SEQ ID NO: 18252 - DNA, 25 bp, Rattus norvegicus
aaatgtggacaatcccttctgggcc

SEQ ID NO: 18253 - DNA, 25 bp, Rattus norvegicus
aaatgtggacacatacgcaggataa

SEQ ID NO: 18254 - DNA, 25 bp, Rattus norvegicus
aaatgtggacacttacgcaggataa

SEQ ID NO: 18255 - DNA, 25 bp, Rattus norvegicus
aaatgtggacatcttccgtgttcct

SEQ ID NO: 18256 - DNA, 25 bp, Rattus norvegicus
aaatgtggacatgttccgtgttcct

SEQ ID NO: 18257 - DNA, 25 bp, Rattus norvegicus
aaatgtggacctagcttttcagaga

SEQ ID NO: 18258 - DNA, 25 bp, Rattus norvegicus
aaatgtggaccttgcttttcagaga

SEQ ID NO: 18259 - DNA, 25 bp, Rattus norvegicus
aaatgtggaggcagccattcagaga

SEQ ID NO: 18260 - DNA, 25 bp, Rattus norvegicus
aaatgtggaggctgccattcagaga

SEQ ID NO: 18261 - DNA, 25 bp, Rattus norvegicus
aaatgtggagtgctgtagtcttcac

SEQ ID NO: 18262 - DNA, 25 bp, Rattus norvegicus
aaatgtggagtggtgtagtcttcac

SEQ ID NO: 18263 - DNA, 25 bp, Rattus norvegicus
aaatgtggatgtagctcatgcgcct

SEQ ID NO: 18264 - DNA, 25 bp, Rattus norvegicus
aaatgtggatgttgctcatgcgcct

SEQ ID NO: 18265 - DNA, 25 bp, Rattus norvegicus
aaatgtggccaacatacagatgctg

SEQ ID NO: 18266 - DNA, 25 bp, Rattus norvegicus
aaatgtggccaagatacagatgctg

SEQ ID NO: 18267 - DNA, 25 bp, Rattus norvegicus
aaatgtggccctcttggattcttgc

SEQ ID NO: 18268 - DNA, 25 bp, Rattus norvegicus
aaatgtggccctgttggattcttgc

SEQ ID NO: 18269 - DNA, 25 bp, Rattus norvegicus
aaatgtggctttatctgctgattac

SEQ ID NO: 18270 - DNA, 25 bp, Rattus norvegicus
aaatgtggctttttctgctgattac

SEQ ID NO: 18271 - DNA, 25 bp, Rattus norvegicus
aaatgtgggacaccagaccctggcc

SEQ ID NO: 18272 - DNA, 25 bp, Rattus norvegicus
aaatgtgggacagcagaccctggcc

SEQ ID NO: 18273 - DNA, 25 bp, Rattus norvegicus
aaatgtgggcaccttcagagtgtcc

SEQ ID NO: 18274 - DNA, 25 bp, Rattus norvegicus
aaatgtgggcacgttcagagtgtcc

SEQ ID NO: 18275 - DNA, 25 bp, Rattus norvegicus
aaatgtgggcccctaaggtcctgat

SEQ ID NO: 18276 - DNA, 25 bp, Rattus norvegicus
aaatgtgggcccgtaaggtcctgat

SEQ ID NO: 18277 - DNA, 25 bp, Rattus norvegicus
aaatgtggtaacagataatcggtct

SEQ ID NO: 18278 - DNA, 25 bp, Rattus norvegicus
aaatgtggtaactgataatcggtct

SEQ ID NO: 18279 - DNA, 25 bp, Rattus norvegicus
aaatgtggtattaccgtgtcactat

SEQ ID NO: 18280 - DNA, 25 bp, Rattus norvegicus
aaatgtggtatttccgtgtcactat

SEQ ID NO: 18281 - DNA, 25 bp, Rattus norvegicus
aaatgtggtctgactccttctatct

SEQ ID NO: 18282 - DNA, 25 bp, Rattus norvegicus
aaatgtggtctgtctccttctatct

SEQ ID NO: 18283 - DNA, 25 bp, Rattus norvegicus
aaatgtggtggcagcacacctgtaa

SEQ ID NO: 18284 - DNA, 25 bp, Rattus norvegicus
aaatgtggtggctgcacacctgtaa

SEQ ID NO: 18285 - DNA, 25 bp, Rattus norvegicus
aaatgtggtgttaccttctatactt

SEQ ID NO: 18286 - DNA, 25 bp, Rattus norvegicus
aaatgtggtgtttccttctatactt

SEQ ID NO: 18287 - DNA, 25 bp, Rattus norvegicus
aaatgtggtttcatgtgacttggaa

SEQ ID NO: 18288 - DNA, 25 bp, Rattus norvegicus
aaatgtggtttcttgtgacttggaa

SEQ ID NO: 18289 - DNA, 25 bp, Rattus norvegicus
aaatgtgtacaaccccttcccgaga

SEQ ID NO: 18290 - DNA, 25 bp, Rattus norvegicus
aaatgtgtacaagcccttcccgaga

SEQ ID NO: 18291 - DNA, 25 bp, Rattus norvegicus
aaatgtgtagctatctatttcatgc

SEQ ID NO: 18292 - DNA, 25 bp, Rattus norvegicus
aaatgtgtagctttctatttcatgc

SEQ ID NO: 18293 - DNA, 25 bp, Rattus norvegicus
aaatgtgtatgtcttcttgtaaagg

SEQ ID NO: 18294 - DNA, 25 bp, Rattus norvegicus
aaatgtgtatgtgttcttgtaaagg

SEQ ID NO: 18295 - DNA, 25 bp, Rattus norvegicus
aaatgtgtcactagattcggaccta

SEQ ID NO: 18296 - DNA, 25 bp, Rattus norvegicus
aaatgtgtcacttgattcggaccta

SEQ ID NO: 18297 - DNA, 25 bp, Rattus norvegicus
aaatgtgtcagtcttcagcactcca

SEQ ID NO: 18298 - DNA, 25 bp, Rattus norvegicus
aaatgtgtcagtgttcagcactcca

SEQ ID NO: 18299 - DNA, 25 bp, Rattus norvegicus
aaatgtgtcataagtgccacccttc

SEQ ID NO: 18300 - DNA, 25 bp, Rattus norvegicus
aaatgtgtcatatgtgccacccttc

SEQ ID NO: 18301 - DNA, 25 bp, Rattus norvegicus
aaatgtgtccatatccttagcccga

SEQ ID NO: 18302 - DNA, 25 bp, Rattus norvegicus
aaatgtgtccatccttgtactcggg

SEQ ID NO: 18303 - DNA, 25 bp, Rattus norvegicus
aaatgtgtccatgcttgtactcggg

SEQ ID NO: 18304 - DNA, 25 bp, Rattus norvegicus
aaatgtgtccatttccttagcccga

SEQ ID NO: 18305 - DNA, 25 bp, Rattus norvegicus
aaatgtgtcctccatagctttcttg

SEQ ID NO: 18306 - DNA, 25 bp, Rattus norvegicus
aaatgtgtcctcgatagctttcttg

SEQ ID NO: 18307 - DNA, 25 bp, Rattus norvegicus
aaatgtgtcctgattggccatgact

SEQ ID NO: 18308 - DNA, 25 bp, Rattus norvegicus
aaatgtgtcctgtttggccatgact

SEQ ID NO: 18309 - DNA, 25 bp, Rattus norvegicus
aaatgtgtctctatccaggtgtgct

SEQ ID NO: 18310 - DNA, 25 bp, Rattus norvegicus
aaatgtgtctctcgctcaaacagtg

SEQ ID NO: 18311 - DNA, 25 bp, Rattus norvegicus
aaatgtgtctctggctcaaacagtg

SEQ ID NO: 18312 - DNA, 25 bp, Rattus norvegicus
aaatgtgtctctttccaggtgtgct

SEQ ID NO: 18313 - DNA, 25 bp, Rattus norvegicus
aaatgtgtgaatacctgtgtcctaa

SEQ ID NO: 18314 - DNA, 25 bp, Rattus norvegicus
aaatgtgtgaattcctgtgtcctaa

SEQ ID NO: 18315 - DNA, 25 bp, Rattus norvegicus
aaatgtgtgatcagtcactgcccct

SEQ ID NO: 18316 - DNA, 25 bp, Rattus norvegicus
aaatgtgtgatctgtcactgcccct

SEQ ID NO: 18317 - DNA, 25 bp, Rattus norvegicus
aaatgtgtgccaagctgggtgacag

SEQ ID NO: 18318 - DNA, 25 bp, Rattus norvegicus
aaatgtgtgccatgctgggtgacag

SEQ ID NO: 18319 - DNA, 25 bp, Rattus norvegicus
aaatgtgtgcttcggtgtgtagacc

SEQ ID NO: 18320 - DNA, 25 bp, Rattus norvegicus
aaatgtgtgcttcttgctcaactgt

SEQ ID NO: 18321 - DNA, 25 bp, Rattus norvegicus
aaatgtgtgcttgggtgtgtagacc

SEQ ID NO: 18322 - DNA, 25 bp, Rattus norvegicus
aaatgtgtgcttgttgctcaactgt

SEQ ID NO: 18323 - DNA, 25 bp, Rattus norvegicus
aaatgtgtggacagactcccagaga

SEQ ID NO: 18324 - DNA, 25 bp, Rattus norvegicus
aaatgtgtggactgactcccagaga

SEQ ID NO: 18325 - DNA, 25 bp, Rattus norvegicus
aaatgtgtgggtctctcatgctttc

SEQ ID NO: 18326 - DNA, 25 bp, Rattus norvegicus
aaatgtgtgggtgtctcatgctttc

SEQ ID NO: 18327 - DNA, 25 bp, Rattus norvegicus
aaatgtgtggttattccatcccatt

SEQ ID NO: 18328 - DNA, 25 bp, Rattus norvegicus
aaatgtgtggttccacccttgtgat

SEQ ID NO: 18329 - DNA, 25 bp, Rattus norvegicus
aaatgtgtggttgcacccttgtgat

SEQ ID NO: 18330 - DNA, 25 bp, Rattus norvegicus
aaatgtgtggtttttccatcccatt

SEQ ID NO: 18331 - DNA, 25 bp, Rattus norvegicus
aaatgtgtgtcacccactgttagct

SEQ ID NO: 18332 - DNA, 25 bp, Rattus norvegicus
aaatgtgtgtcacctctttgcggag

SEQ ID NO: 18333 - DNA, 25 bp, Rattus norvegicus
aaatgtgtgtcagccactgttagct

SEQ ID NO: 18334 - DNA, 25 bp, Rattus norvegicus
aaatgtgtgtcagctctttgcggag

SEQ ID NO: 18335 - DNA, 25 bp, Rattus norvegicus
aaatgtgtgtccaaccatgatgcct

SEQ ID NO: 18336 - DNA, 25 bp, Rattus norvegicus
aaatgtgtgtcctaccatgatgcct

SEQ ID NO: 18337 - DNA, 25 bp, Rattus norvegicus
aaatgtgtgtgccacttgggttctg

SEQ ID NO: 18338 - DNA, 25 bp, Rattus norvegicus
aaatgtgtgtgcgacttgggttctg

SEQ ID NO: 18339 - DNA, 25 bp, Rattus norvegicus
aaatgtgttagcatcaaaatgggtc

SEQ ID NO: 18340 - DNA, 25 bp, Rattus norvegicus
aaatgtgttagcttcaaaatgggtc

SEQ ID NO: 18341 - DNA, 25 bp, Rattus norvegicus
aaatgtgttagtactctcgtgtcag

SEQ ID NO: 18342 - DNA, 25 bp, Rattus norvegicus
aaatgtgttagttctctcgtgtcag

SEQ ID NO: 18343 - DNA, 25 bp, Rattus norvegicus
aaatgtgttcatcacgttaccggag

SEQ ID NO: 18344 - DNA, 25 bp, Rattus norvegicus
aaatgtgttcatgacgttaccggag

SEQ ID NO: 18345 - DNA, 25 bp, Rattus norvegicus
aaatgtgttcccagctgggttctgc

SEQ ID NO: 18346 - DNA, 25 bp, Rattus norvegicus
aaatgtgttccctgctgggttctgc

SEQ ID NO: 18347 - DNA, 25 bp, Rattus norvegicus
aaatgtgttctcatgttcctagtat

SEQ ID NO: 18348 - DNA, 25 bp, Rattus norvegicus
aaatgtgttctcttgttcctagtat

SEQ ID NO: 18349 - DNA, 25 bp, Rattus norvegicus
aaatgtgttgccacgaatccacgga

SEQ ID NO: 18350 - DNA, 25 bp, Rattus norvegicus
aaatgtgttgcctcgaatccacgga

SEQ ID NO: 18351 - DNA, 25 bp, Rattus norvegicus
aaatgtgttgctccatatccttctc

SEQ ID NO: 18352 - DNA, 25 bp, Rattus norvegicus
aaatgtgttgctgcatatccttctc

SEQ ID NO: 18353 - DNA, 25 bp, Rattus norvegicus
aaatgtgtttagctttccagctgtc

SEQ ID NO: 18354 - DNA, 25 bp, Rattus norvegicus
aaatgtgtttaggtttccagctgtc

SEQ ID NO: 18355 - DNA, 25 bp, Rattus norvegicus
aaatgtgtttccatagcatcacgga

SEQ ID NO: 18356 - DNA, 25 bp, Rattus norvegicus
aaatgtgtttccttagcatcacgga

SEQ ID NO: 18357 - DNA, 25 bp, Rattus norvegicus
aaatgtgtttcgatttcgtgtctgc

SEQ ID NO: 18358 - DNA, 25 bp, Rattus norvegicus
aaatgtgtttcgttttcgtgtctgc

SEQ ID NO: 18359 - DNA, 25 bp, Rattus norvegicus
aaatgtgtttctctactgcaaagtg

SEQ ID NO: 18360 - DNA, 25 bp, Rattus norvegicus
aaatgtgtttctgtactgcaaagtg

SEQ ID NO: 18361 - DNA, 25 bp, Rattus norvegicus
aaatgttaagcaaacctggccagga

SEQ ID NO: 18362 - DNA, 25 bp, Rattus norvegicus
aaatgttaagcatacctggccagga

SEQ ID NO: 18363 - DNA, 25 bp, Rattus norvegicus
aaatgttaatgaagctcctaaacct

SEQ ID NO: 18364 - DNA, 25 bp, Rattus norvegicus
aaatgttaatgatgctcctaaacct

SEQ ID NO: 18365 - DNA, 25 bp, Rattus norvegicus
aaatgttacacacttcttgaaggct

SEQ ID NO: 18366 - DNA, 25 bp, Rattus norvegicus
aaatgttacacagttcttgaaggct

SEQ ID NO: 18367 - DNA, 25 bp, Rattus norvegicus
aaatgttacagtcctttggttgcag

SEQ ID NO: 18368 - DNA, 25 bp, Rattus norvegicus
aaatgttacagtgctttggttgcag

SEQ ID NO: 18369 - DNA, 25 bp, Rattus norvegicus
aaatgttaccatctcgtagcacgaa

SEQ ID NO: 18370 - DNA, 25 bp, Rattus norvegicus
aaatgttaccatgtcgtagcacgaa

SEQ ID NO: 18371 - DNA, 25 bp, Rattus norvegicus
aaatgttactccaacttctaaaatg

SEQ ID NO: 18372 - DNA, 25 bp, Rattus norvegicus
aaatgttactcctacttctaaaatg

SEQ ID NO: 18373 - DNA, 25 bp, Rattus norvegicus
aaatgttacttcattggtaccaaca

SEQ ID NO: 18374 - DNA, 25 bp, Rattus norvegicus
aaatgttacttctttggtaccaaca

SEQ ID NO: 18375 - DNA, 25 bp, Rattus norvegicus
aaatgttagctaactttcttttgtt

SEQ ID NO: 18376 - DNA, 25 bp, Rattus norvegicus
aaatgttagctatctttcttttgtt

SEQ ID NO: 18377 - DNA, 25 bp, Rattus norvegicus
aaatgttagtaaactcaccccaagc

SEQ ID NO: 18378 - DNA, 25 bp, Rattus norvegicus
aaatgttagtaatctcaccccaagc

SEQ ID NO: 18379 - DNA, 25 bp, Rattus norvegicus
aaatgttatgctaaccccagcaata

SEQ ID NO: 18380 - DNA, 25 bp, Rattus norvegicus
aaatgttatgcttaccccagcaata

SEQ ID NO: 18381 - DNA, 25 bp, Rattus norvegicus
aaatgttatggaatcacagcagcat

SEQ ID NO: 18382 - DNA, 25 bp, Rattus norvegicus
aaatgttatggattcacagcagcat

SEQ ID NO: 18383 - DNA, 25 bp, Rattus norvegicus
aaatgttatgtcaataccacgaaaa

SEQ ID NO: 18384 - DNA, 25 bp, Rattus norvegicus
aaatgttatgtctataccacgaaaa

SEQ ID NO: 18385 - DNA, 25 bp, Rattus norvegicus
aaatgttcaagtactaatgattagc

SEQ ID NO: 18386 - DNA, 25 bp, Rattus norvegicus
aaatgttcaagttctaatgattagc

SEQ ID NO: 18387 - DNA, 25 bp, Rattus norvegicus
aaatgttccagcagtgtgcggtaac

SEQ ID NO: 18388 - DNA, 25 bp, Rattus norvegicus
aaatgttccagctgtgtgcggtaac

SEQ ID NO: 18389 - DNA, 25 bp, Rattus norvegicus
aaatgttccctaccactgtttgctt

SEQ ID NO: 18390 - DNA, 25 bp, Rattus norvegicus
aaatgttccctagcactgtttgctt

SEQ ID NO: 18391 - DNA, 25 bp, Rattus norvegicus
aaatgttccctgacaatgtttgtaa

SEQ ID NO: 18392 - DNA, 25 bp, Rattus norvegicus
aaatgttccctgtcaatgtttgtaa

SEQ ID NO: 18393 - DNA, 25 bp, Rattus norvegicus
aaatgttccgagcacaggcttcaac

SEQ ID NO: 18394 - DNA, 25 bp, Rattus norvegicus
aaatgttccgaggacaggcttcaac

SEQ ID NO: 18395 - DNA, 25 bp, Rattus norvegicus
aaatgttcctatcctgtccacagta

SEQ ID NO: 18396 - DNA, 25 bp, Rattus norvegicus
aaatgttcctatcttgtcctctgtc

SEQ ID NO: 18397 - DNA, 25 bp, Rattus norvegicus
aaatgttcctatgctgtccacagta

SEQ ID NO: 18398 - DNA, 25 bp, Rattus norvegicus
aaatgttcctatgttgtcctctgtc

SEQ ID NO: 18399 - DNA, 25 bp, Rattus norvegicus
aaatgttcctgaagtcatcctctca

SEQ ID NO: 18400 - DNA, 25 bp, Rattus norvegicus
aaatgttcctgatgtcatcctctca

SEQ ID NO: 18401 - DNA, 25 bp, Rattus norvegicus
aaatgttcctggatttctgtttctt

SEQ ID NO: 18402 - DNA, 25 bp, Rattus norvegicus
aaatgttcctggttttctgtttctt

SEQ ID NO: 18403 - DNA, 25 bp, Rattus norvegicus
aaatgttccttcactcatcatgtta

SEQ ID NO: 18404 - DNA, 25 bp, Rattus norvegicus
aaatgttccttctctcatcatgtta

SEQ ID NO: 18405 - DNA, 25 bp, Rattus norvegicus
aaatgttcctttactaatcctcaga

SEQ ID NO: 18406 - DNA, 25 bp, Rattus norvegicus
aaatgttccttttctaatcctcaga

SEQ ID NO: 18407 - DNA, 25 bp, Rattus norvegicus
aaatgttcggtaccttacactgcaa

SEQ ID NO: 18408 - DNA, 25 bp, Rattus norvegicus
aaatgttcggtagcttacactgcaa

SEQ ID NO: 18409 - DNA, 25 bp, Rattus norvegicus
aaatgttcgtcccatgtatcaatat

SEQ ID NO: 18410 - DNA, 25 bp, Rattus norvegicus
aaatgttcgtccgatgtatcaatat

SEQ ID NO: 18411 - DNA, 25 bp, Rattus norvegicus
aaatgttctaacatgccctgtcagc

SEQ ID NO: 18412 - DNA, 25 bp, Rattus norvegicus
aaatgttctaacttgccctgtcagc

SEQ ID NO: 18413 - DNA, 25 bp, Rattus norvegicus
aaatgttctagcactgttactggag

SEQ ID NO: 18414 - DNA, 25 bp, Rattus norvegicus
aaatgttctagctctgttactggag

SEQ ID NO: 18415 - DNA, 25 bp, Rattus norvegicus
aaatgttctcagaatcctgccaggg

SEQ ID NO: 18416 - DNA, 25 bp, Rattus norvegicus
aaatgttctcagtatcctgccaggg

SEQ ID NO: 18417 - DNA, 25 bp, Rattus norvegicus
aaatgttctcctagaacccagagcc

SEQ ID NO: 18418 - DNA, 25 bp, Rattus norvegicus
aaatgttctccttgaacccagagcc

SEQ ID NO: 18419 - DNA, 25 bp, Rattus norvegicus
aaatgttctctgcttgctaccaaag

SEQ ID NO: 18420 - DNA, 25 bp, Rattus norvegicus
aaatgttctctggttgctaccaaag

SEQ ID NO: 18421 - DNA, 25 bp, Rattus norvegicus
aaatgttctgaccttctgacagggc

SEQ ID NO: 18422 - DNA, 25 bp, Rattus norvegicus
aaatgttctgacgttctgacagggc

SEQ ID NO: 18423 - DNA, 25 bp, Rattus norvegicus
aaatgttctgagatggtcttctctt

SEQ ID NO: 18424 - DNA, 25 bp, Rattus norvegicus
aaatgttctgagttggtcttctctt

SEQ ID NO: 18425 - DNA, 25 bp, Rattus norvegicus
aaatgttctgatccctcatcttcac

SEQ ID NO: 18426 - DNA, 25 bp, Rattus norvegicus
aaatgttctgatctctgtatacccc

SEQ ID NO: 18427 - DNA, 25 bp, Rattus norvegicus
aaatgttctgatgcctcatcttcac

SEQ ID NO: 18428 - DNA, 25 bp, Rattus norvegicus
aaatgttctgatgtctgtatacccc

SEQ ID NO: 18429 - DNA, 25 bp, Rattus norvegicus
aaatgttctgctagcccctgtataa

SEQ ID NO: 18430 - DNA, 25 bp, Rattus norvegicus
aaatgttctgcttgcccctgtataa

SEQ ID NO: 18431 - DNA, 25 bp, Rattus norvegicus
aaatgttcttcacatcctcatggtc

SEQ ID NO: 18432 - DNA, 25 bp, Rattus norvegicus
aaatgttcttcagatcctcatggtc

SEQ ID NO: 18433 - DNA, 25 bp, Rattus norvegicus
aaatgttctttcaatctctgacctc

SEQ ID NO: 18434 - DNA, 25 bp, Rattus norvegicus
aaatgttctttctatctctgacctc

SEQ ID NO: 18435 - DNA, 25 bp, Rattus norvegicus
aaatgttcttttctagacaggctaa

SEQ ID NO: 18436 - DNA, 25 bp, Rattus norvegicus
aaatgttcttttgtagacaggctaa

SEQ ID NO: 18437 - DNA, 25 bp, Rattus norvegicus
aaatgttgacttcacctgtctcttt

SEQ ID NO: 18438 - DNA, 25 bp, Rattus norvegicus
aaatgttgacttgacctgtctcttt

SEQ ID NO: 18439 - DNA, 25 bp, Rattus norvegicus
aaatgttgagaactaccgaagtagg

SEQ ID NO: 18440 - DNA, 25 bp, Rattus norvegicus
aaatgttgagaagtaccgaagtagg

SEQ ID NO: 18441 - DNA, 25 bp, Rattus norvegicus
aaatgttgaggcctacttcccaaag

SEQ ID NO: 18442 - DNA, 25 bp, Rattus norvegicus
aaatgttgaggcgtacttcccaaag

SEQ ID NO: 18443 - DNA, 25 bp, Rattus norvegicus
aaatgttgatcaccacatcccatct

SEQ ID NO: 18444 - DNA, 25 bp, Rattus norvegicus
aaatgttgatcaccccaattccagg

SEQ ID NO: 18445 - DNA, 25 bp, Rattus norvegicus
aaatgttgatcagcacatcccatct

SEQ ID NO: 18446 - DNA, 25 bp, Rattus norvegicus
aaatgttgatcagcccaattccagg

SEQ ID NO: 18447 - DNA, 25 bp, Rattus norvegicus
aaatgttgatgacggtctcgctgcc

SEQ ID NO: 18448 - DNA, 25 bp, Rattus norvegicus
aaatgttgatgagggtctcgctgcc

SEQ ID NO: 18449 - DNA, 25 bp, Rattus norvegicus
aaatgttgcaaacccctgagactcc

SEQ ID NO: 18450 - DNA, 25 bp, Rattus norvegicus
aaatgttgcaaagccctgagactcc

SEQ ID NO: 18451 - DNA, 25 bp, Rattus norvegicus
aaatgttgcactaggtctgaagaac

SEQ ID NO: 18452 - DNA, 25 bp, Rattus norvegicus
aaatgttgcacttggtctgaagaac

SEQ ID NO: 18453 - DNA, 25 bp, Rattus norvegicus
aaatgttgcagtcgaagccctggga

SEQ ID NO: 18454 - DNA, 25 bp, Rattus norvegicus
aaatgttgcagtggaagccctggga

SEQ ID NO: 18455 - DNA, 25 bp, Rattus norvegicus
aaatgttgccagaccctctctaaac

SEQ ID NO: 18456 - DNA, 25 bp, Rattus norvegicus
aaatgttgccagtccctctctaaac

SEQ ID NO: 18457 - DNA, 25 bp, Rattus norvegicus
aaatgttgccataaatactctctat

SEQ ID NO: 18458 - DNA, 25 bp, Rattus norvegicus
aaatgttgccattaatactctctat

SEQ ID NO: 18459 - DNA, 25 bp, Rattus norvegicus
aaatgttgccccatgagagttcgta

SEQ ID NO: 18460 - DNA, 25 bp, Rattus norvegicus
aaatgttgccccttgagagttcgta

SEQ ID NO: 18461 - DNA, 25 bp, Rattus norvegicus
aaatgttgcctaactgaacagaagg

SEQ ID NO: 18462 - DNA, 25 bp, Rattus norvegicus
aaatgttgcctatctgaacagaagg

SEQ ID NO: 18463 - DNA, 25 bp, Rattus norvegicus
aaatgttgcctgaacgggctgctga

SEQ ID NO: 18464 - DNA, 25 bp, Rattus norvegicus
aaatgttgcctgtacgggctgctga

SEQ ID NO: 18465 - DNA, 25 bp, Rattus norvegicus
aaatgttgctgtaatttgcccatac

SEQ ID NO: 18466 - DNA, 25 bp, Rattus norvegicus
aaatgttgctgttatttgcccatac

SEQ ID NO: 18467 - DNA, 25 bp, Rattus norvegicus
aaatgttgctttacctttgtgttgc

SEQ ID NO: 18468 - DNA, 25 bp, Rattus norvegicus
aaatgttgcttttcctttgtgttgc

SEQ ID NO: 18469 - DNA, 25 bp, Rattus norvegicus
aaatgttggatgaactctgctttgc

SEQ ID NO: 18470 - DNA, 25 bp, Rattus norvegicus
aaatgttggatgtactctgctttgc

SEQ ID NO: 18471 - DNA, 25 bp, Rattus norvegicus
aaatgttggattatgctgtgtcaga

SEQ ID NO: 18472 - DNA, 25 bp, Rattus norvegicus
aaatgttggattttgctgtgtcaga

SEQ ID NO: 18473 - DNA, 25 bp, Rattus norvegicus
aaatgttggcatcaaagctcttccc

SEQ ID NO: 18474 - DNA, 25 bp, Rattus norvegicus
aaatgttggcatgaaagctcttccc

SEQ ID NO: 18475 - DNA, 25 bp, Rattus norvegicus
aaatgttgtatcattcctgaattct

SEQ ID NO: 18476 - DNA, 25 bp, Rattus norvegicus
aaatgttgtatctttcctgaattct

SEQ ID NO: 18477 - DNA, 25 bp, Rattus norvegicus
aaatgttgtatgagagtgcatctca

SEQ ID NO: 18478 - DNA, 25 bp, Rattus norvegicus
aaatgttgtatgtgagtgcatctca

SEQ ID NO: 18479 - DNA, 25 bp, Rattus norvegicus
aaatgttgtcaacccaacggagtga

SEQ ID NO: 18480 - DNA, 25 bp, Rattus norvegicus
aaatgttgtcaagccaacggagtga

SEQ ID NO: 18481 - DNA, 25 bp, Rattus norvegicus
aaatgttgtcccagtactaagagtt

SEQ ID NO: 18482 - DNA, 25 bp, Rattus norvegicus
aaatgttgtccctgtactaagagtt

SEQ ID NO: 18483 - DNA, 25 bp, Rattus norvegicus
aaatgttgtcctacatgtgtacaat

SEQ ID NO: 18484 - DNA, 25 bp, Rattus norvegicus
aaatgttgtccttcatgtgtacaat

SEQ ID NO: 18485 - DNA, 25 bp, Rattus norvegicus
aaatgttgtgctacccatcagcagc

SEQ ID NO: 18486 - DNA, 25 bp, Rattus norvegicus
aaatgttgtgcttcccatcagcagc

SEQ ID NO: 18487 - DNA, 25 bp, Rattus norvegicus
aaatgttgttttccacgctgttgta

SEQ ID NO: 18488 - DNA, 25 bp, Rattus norvegicus
aaatgttgttttgcacgctgttgta

SEQ ID NO: 18489 - DNA, 25 bp, Rattus norvegicus
aaatgtttaagcactgtgcctaccc

SEQ ID NO: 18490 - DNA, 25 bp, Rattus norvegicus
aaatgtttaagctctgtgcctaccc

SEQ ID NO: 18491 - DNA, 25 bp, Rattus norvegicus
aaatgtttaattagcctggcggact

SEQ ID NO: 18492 - DNA, 25 bp, Rattus norvegicus
aaatgtttaatttgcctggcggact

SEQ ID NO: 18493 - DNA, 25 bp, Rattus norvegicus
aaatgtttacatctttcttccaaag

SEQ ID NO: 18494 - DNA, 25 bp, Rattus norvegicus
aaatgtttacatgtttcttccaaag

SEQ ID NO: 18495 - DNA, 25 bp, Rattus norvegicus
aaatgtttacttctctctttcactg

SEQ ID NO: 18496 - DNA, 25 bp, Rattus norvegicus
aaatgtttacttgtctctttcactg

SEQ ID NO: 18497 - DNA, 25 bp, Rattus norvegicus
aaatgtttagctctctctgtgctac

SEQ ID NO: 18498 - DNA, 25 bp, Rattus norvegicus
aaatgtttagctgtctctgtgctac

SEQ ID NO: 18499 - DNA, 25 bp, Rattus norvegicus
aaatgtttatccaggtttctctaag

SEQ ID NO: 18500 - DNA, 25 bp, Rattus norvegicus
aaatgtttatcctggtttctctaag

SEQ ID NO: 18501 - DNA, 25 bp, Rattus norvegicus
aaatgtttcacaacctgaacctcag

SEQ ID NO: 18502 - DNA, 25 bp, Rattus norvegicus
aaatgtttcacatcctgaacctcag

SEQ ID NO: 18503 - DNA, 25 bp, Rattus norvegicus
aaatgtttcagcctcttgcttggga

SEQ ID NO: 18504 - DNA, 25 bp, Rattus norvegicus
aaatgtttcagcgtcttgcttggga

SEQ ID NO: 18505 - DNA, 25 bp, Rattus norvegicus
aaatgtttcattactggccaggaag

SEQ ID NO: 18506 - DNA, 25 bp, Rattus norvegicus
aaatgtttcatttctggccaggaag

SEQ ID NO: 18507 - DNA, 25 bp, Rattus norvegicus
aaatgtttccagatgcctttagttt

SEQ ID NO: 18508 - DNA, 25 bp, Rattus norvegicus
aaatgtttccagttgcctttagttt

SEQ ID NO: 18509 - DNA, 25 bp, Rattus norvegicus
aaatgtttccatattcccatgacat

SEQ ID NO: 18510 - DNA, 25 bp, Rattus norvegicus
aaatgtttccattttcccatgacat

SEQ ID NO: 18511 - DNA, 25 bp, Rattus norvegicus
aaatgtttcctcctgttgaagcctg

SEQ ID NO: 18512 - DNA, 25 bp, Rattus norvegicus
aaatgtttcctcgtgttgaagcctg

SEQ ID NO: 18513 - DNA, 25 bp, Rattus norvegicus
aaatgtttctgtcccttttcatgtc

SEQ ID NO: 18514 - DNA, 25 bp, Rattus norvegicus
aaatgtttctgtgccttttcatgtc

SEQ ID NO: 18515 - DNA, 25 bp, Rattus norvegicus
aaatgtttcttcctgtggacaccgt

SEQ ID NO: 18516 - DNA, 25 bp, Rattus norvegicus
aaatgtttcttcgtgtggacaccgt

SEQ ID NO: 18517 - DNA, 25 bp, Rattus norvegicus
aaatgtttctttctaattgctgact

SEQ ID NO: 18518 - DNA, 25 bp, Rattus norvegicus
aaatgtttctttgtaattgctgact

SEQ ID NO: 18519 - DNA, 25 bp, Rattus norvegicus
aaatgtttgatcacaccacccagtg

SEQ ID NO: 18520 - DNA, 25 bp, Rattus norvegicus
aaatgtttgatctcaccacccagtg

SEQ ID NO: 18521 - DNA, 25 bp, Rattus norvegicus
aaatgtttgcatccttaccctgaga

SEQ ID NO: 18522 - DNA, 25 bp, Rattus norvegicus
aaatgtttgcatgcttaccctgaga

SEQ ID NO: 18523 - DNA, 25 bp, Rattus norvegicus
aaatgtttgctcaccaagttcttcc

SEQ ID NO: 18524 - DNA, 25 bp, Rattus norvegicus
aaatgtttgctcatctttactcaga

SEQ ID NO: 18525 - DNA, 25 bp, Rattus norvegicus
aaatgtttgctctccaagttcttcc

SEQ ID NO: 18526 - DNA, 25 bp, Rattus norvegicus
aaatgtttgctcttctttactcaga

SEQ ID NO: 18527 - DNA, 25 bp, Rattus norvegicus
aaatgtttgctgaactggtctggaa

SEQ ID NO: 18528 - DNA, 25 bp, Rattus norvegicus
aaatgtttgctgtactggtctggaa

SEQ ID NO: 18529 - DNA, 25 bp, Rattus norvegicus
aaatgtttgcttatgtctctcgaga

SEQ ID NO: 18530 - DNA, 25 bp, Rattus norvegicus
aaatgtttgcttcttctctagggtg

SEQ ID NO: 18531 - DNA, 25 bp, Rattus norvegicus
aaatgtttgcttgttctctagggtg

SEQ ID NO: 18532 - DNA, 25 bp, Rattus norvegicus
aaatgtttgcttttgtctctcgaga

SEQ ID NO: 18533 - DNA, 25 bp, Rattus norvegicus
aaatgtttgtttactgccatgcaat

SEQ ID NO: 18534 - DNA, 25 bp, Rattus norvegicus
aaatgtttgttttctgccatgcaat

SEQ ID NO: 18535 - DNA, 25 bp, Rattus norvegicus
aaatgttttaccacactgttggaca

SEQ ID NO: 18536 - DNA, 25 bp, Rattus norvegicus
aaatgttttacctcactgttggaca

SEQ ID NO: 18537 - DNA, 25 bp, Rattus norvegicus
aaatgttttagtctgtctctcaatg

SEQ ID NO: 18538 - DNA, 25 bp, Rattus norvegicus
aaatgttttagtgtgtctctcaatg

SEQ ID NO: 18539 - DNA, 25 bp, Rattus norvegicus
aaatgttttataaatcggcgtgatc

SEQ ID NO: 18540 - DNA, 25 bp, Rattus norvegicus
aaatgttttatatatcggcgtgatc

SEQ ID NO: 18541 - DNA, 25 bp, Rattus norvegicus
aaatgttttccacctgtgtgttttg

SEQ ID NO: 18542 - DNA, 25 bp, Rattus norvegicus
aaatgttttccagctgtgtgttttg

SEQ ID NO: 18543 - DNA, 25 bp, Rattus norvegicus
aaatgttttctacagtgccactcag

SEQ ID NO: 18544 - DNA, 25 bp, Rattus norvegicus
aaatgttttctagagtgccactcag

SEQ ID NO: 18545 - DNA, 25 bp, Rattus norvegicus
aaatgttttctcagtctccaaactc

SEQ ID NO: 18546 - DNA, 25 bp, Rattus norvegicus
aaatgttttctctgtctccaaactc

SEQ ID NO: 18547 - DNA, 25 bp, Rattus norvegicus
aaatgttttcttagcccttcatatg

SEQ ID NO: 18548 - DNA, 25 bp, Rattus norvegicus
aaatgttttctttgcccttcatatg

SEQ ID NO: 18549 - DNA, 25 bp, Rattus norvegicus
aaatgttttggaaagcacttcagat

SEQ ID NO: 18550 - DNA, 25 bp, Rattus norvegicus
aaatgttttggaatgaatgccctgg

SEQ ID NO: 18551 - DNA, 25 bp, Rattus norvegicus
aaatgttttggatagcacttcagat

SEQ ID NO: 18552 - DNA, 25 bp, Rattus norvegicus
aaatgttttggattgaatgccctgg

SEQ ID NO: 18553 - DNA, 25 bp, Rattus norvegicus
aaatgttttggcctctccttgacac

SEQ ID NO: 18554 - DNA, 25 bp, Rattus norvegicus
aaatgttttggcgtctccttgacac

SEQ ID NO: 18555 - DNA, 25 bp, Rattus norvegicus
aaatgttttgttccagtctgttaag

SEQ ID NO: 18556 - DNA, 25 bp, Rattus norvegicus
aaatgttttgttgcagtctgttaag

SEQ ID NO: 18557 - DNA, 25 bp, Rattus norvegicus
aaatgtttttatctagctgctgcta

SEQ ID NO: 18558 - DNA, 25 bp, Rattus norvegicus
aaatgtttttatgtagctgctgcta

SEQ ID NO: 18559 - DNA, 25 bp, Rattus norvegicus
aaatgtttttctacctgttgctgca

SEQ ID NO: 18560 - DNA, 25 bp, Rattus norvegicus
aaatgtttttcttcctgttgctgca

SEQ ID NO: 18561 - DNA, 25 bp, Rattus norvegicus
aaattaaaatccagtctgtgaaaga

SEQ ID NO: 18562 - DNA, 25 bp, Rattus norvegicus
aaattaaaatcctgtctgtgaaaga

SEQ ID NO: 18563 - DNA, 25 bp, Rattus norvegicus
aaattaaacagcctgtcccctcaga

SEQ ID NO: 18564 - DNA, 25 bp, Rattus norvegicus
aaattaaacagcgtgtcccctcaga

SEQ ID NO: 18565 - DNA, 25 bp, Rattus norvegicus
aaattaaactgaactctcccttggc

SEQ ID NO: 18566 - DNA, 25 bp, Rattus norvegicus
aaattaaactgatctctcccttggc

SEQ ID NO: 18567 - DNA, 25 bp, Rattus norvegicus
aaattaacaggcaagctggccccgc

SEQ ID NO: 18568 - DNA, 25 bp, Rattus norvegicus
aaattaacaggctagctggccccgc

SEQ ID NO: 18569 - DNA, 25 bp, Rattus norvegicus
aaattaacagtgatccgagcagcag

SEQ ID NO: 18570 - DNA, 25 bp, Rattus norvegicus
aaattaacagtgttccgagcagcag

SEQ ID NO: 18571 - DNA, 25 bp, Rattus norvegicus
aaattaacccttctgttgctctgta

SEQ ID NO: 18572 - DNA, 25 bp, Rattus norvegicus
aaattaacccttgtgttgctctgta

SEQ ID NO: 18573 - DNA, 25 bp, Rattus norvegicus
aaattaacctctactttctgtggca

SEQ ID NO: 18574 - DNA, 25 bp, Rattus norvegicus
aaattaacctcttctttctgtggca

SEQ ID NO: 18575 - DNA, 25 bp, Rattus norvegicus
aaattaagaccccagcaagtaccag

SEQ ID NO: 18576 - DNA, 25 bp, Rattus norvegicus
aaattaagacccgagcaagtaccag

SEQ ID NO: 18577 - DNA, 25 bp, Rattus norvegicus
aaattaagcagacccggcattggcg

SEQ ID NO: 18578 - DNA, 25 bp, Rattus norvegicus
aaattaagcagagccggcattggcg

SEQ ID NO: 18579 - DNA, 25 bp, Rattus norvegicus
aaattaagccggaatgcccactctg

SEQ ID NO: 18580 - DNA, 25 bp, Rattus norvegicus
aaattaagccggtatgcccactctg

SEQ ID NO: 18581 - DNA, 25 bp, Rattus norvegicus
aaattaatctgcagccatgcataat

SEQ ID NO: 18582 - DNA, 25 bp, Rattus norvegicus
aaattaatctgctgccatgcataat

SEQ ID NO: 18583 - DNA, 25 bp, Rattus norvegicus
aaattaatgcacctgtcatgggaat

SEQ ID NO: 18584 - DNA, 25 bp, Rattus norvegicus
aaattaatgcacgtgtcatgggaat

SEQ ID NO: 18585 - DNA, 25 bp, Rattus norvegicus
aaattaattcccaggacacagtgat

SEQ ID NO: 18586 - DNA, 25 bp, Rattus norvegicus
aaattaattccctggacacagtgat

SEQ ID NO: 18587 - DNA, 25 bp, Rattus norvegicus
aaattacactctacaaccatactca

SEQ ID NO: 18588 - DNA, 25 bp, Rattus norvegicus
aaattacactcttcaaccatactca

SEQ ID NO: 18589 - DNA, 25 bp, Rattus norvegicus
aaattacagcatccctgcctttcga

SEQ ID NO: 18590 - DNA, 25 bp, Rattus norvegicus
aaattacagcatgcctgcctttcga

SEQ ID NO: 18591 - DNA, 25 bp, Rattus norvegicus
aaattacaggttccactctcctgga

SEQ ID NO: 18592 - DNA, 25 bp, Rattus norvegicus
aaattacaggttgcactctcctgga

SEQ ID NO: 18593 - DNA, 25 bp, Rattus norvegicus
aaattaccaagaatcccactcccat

SEQ ID NO: 18594 - DNA, 25 bp, Rattus norvegicus
aaattaccaagattcccactcccat

SEQ ID NO: 18595 - DNA, 25 bp, Rattus norvegicus
aaattacccattcagtacccattgc

SEQ ID NO: 18596 - DNA, 25 bp, Rattus norvegicus
aaattacccattgagtacccattgc

SEQ ID NO: 18597 - DNA, 25 bp, Rattus norvegicus
aaattacctatcatatctctcacac

SEQ ID NO: 18598 - DNA, 25 bp, Rattus norvegicus
aaattacctatcttatctctcacac

SEQ ID NO: 18599 - DNA, 25 bp, Rattus norvegicus
aaattacctgcccatttgactggac

SEQ ID NO: 18600 - DNA, 25 bp, Rattus norvegicus
aaattacctgccgatttgactggac

SEQ ID NO: 18601 - DNA, 25 bp, Rattus norvegicus
aaattacgctcaattcagacctggg

SEQ ID NO: 18602 - DNA, 25 bp, Rattus norvegicus
aaattacgctcatttcagacctggg

SEQ ID NO: 18603 - DNA, 25 bp, Rattus norvegicus
aaattacgttatagagaatacttag

SEQ ID NO: 18604 - DNA, 25 bp, Rattus norvegicus
aaattacgttattgagaatacttag

SEQ ID NO: 18605 - DNA, 25 bp, Rattus norvegicus
aaattactaatgacctctctgtctc

SEQ ID NO: 18606 - DNA, 25 bp, Rattus norvegicus
aaattactaatgtcctctctgtctc

SEQ ID NO: 18607 - DNA, 25 bp, Rattus norvegicus
aaattactctgcacccaggtggttg

SEQ ID NO: 18608 - DNA, 25 bp, Rattus norvegicus
aaattactctgctcccaggtggttg

SEQ ID NO: 18609 - DNA, 25 bp, Rattus norvegicus
aaattactctggagctaggcacggt

SEQ ID NO: 18610 - DNA, 25 bp, Rattus norvegicus
aaattactctggtgctaggcacggt

SEQ ID NO: 18611 - DNA, 25 bp, Rattus norvegicus
aaattactcttcatacagtgcatag

SEQ ID NO: 18612 - DNA, 25 bp, Rattus norvegicus
aaattactcttcttacagtgcatag

SEQ ID NO: 18613 - DNA, 25 bp, Rattus norvegicus
aaattactgaacagactgacgccaa

SEQ ID NO: 18614 - DNA, 25 bp, Rattus norvegicus
aaattactgaactgactgacgccaa

SEQ ID NO: 18615 - DNA, 25 bp, Rattus norvegicus
aaattactgattcgcctgttttctt

SEQ ID NO: 18616 - DNA, 25 bp, Rattus norvegicus
aaattactgattggcctgttttctt

SEQ ID NO: 18617 - DNA, 25 bp, Rattus norvegicus
aaattactgtcgagggctgcgcttt

SEQ ID NO: 18618 - DNA, 25 bp, Rattus norvegicus
aaattactgtcgtgggctgcgcttt

SEQ ID NO: 18619 - DNA, 25 bp, Rattus norvegicus
aaattacttttgatgcatgtcatgg

SEQ ID NO: 18620 - DNA, 25 bp, Rattus norvegicus
aaattacttttgttgcatgtcatgg

SEQ ID NO: 18621 - DNA, 25 bp, Rattus norvegicus
aaattagaacctctgctagcaactg

SEQ ID NO: 18622 - DNA, 25 bp, Rattus norvegicus
aaattagaacctgtgctagcaactg

SEQ ID NO: 18623 - DNA, 25 bp, Rattus norvegicus
aaattagacaacatcctgtccctgc

SEQ ID NO: 18624 - DNA, 25 bp, Rattus norvegicus
aaattagacaacttcctgtccctgc

SEQ ID NO: 18625 - DNA, 25 bp, Rattus norvegicus
aaattagacctgctgtgtaagacca

SEQ ID NO: 18626 - DNA, 25 bp, Rattus norvegicus
aaattagacctggtgtgtaagacca

SEQ ID NO: 18627 - DNA, 25 bp, Rattus norvegicus
aaattagcacctcactgacagcttg

SEQ ID NO: 18628 - DNA, 25 bp, Rattus norvegicus
aaattagcacctgactgacagcttg

SEQ ID NO: 18629 - DNA, 25 bp, Rattus norvegicus
aaattagccaggagtcccacatgct

SEQ ID NO: 18630 - DNA, 25 bp, Rattus norvegicus
aaattagccaggtgtcccacatgct

SEQ ID NO: 18631 - DNA, 25 bp, Rattus norvegicus
aaattagctactacatccccatgga

SEQ ID NO: 18632 - DNA, 25 bp, Rattus norvegicus
aaattagctactccacctctgacaa

SEQ ID NO: 18633 - DNA, 25 bp, Rattus norvegicus
aaattagctactgcacctctgacaa

SEQ ID NO: 18634 - DNA, 25 bp, Rattus norvegicus
aaattagctacttcatccccatgga

SEQ ID NO: 18635 - DNA, 25 bp, Rattus norvegicus
aaattaggacccacacggatgtaga

SEQ ID NO: 18636 - DNA, 25 bp, Rattus norvegicus
aaattaggaccctcacggatgtaga

SEQ ID NO: 18637 - DNA, 25 bp, Rattus norvegicus
aaattaggtagtccctggtgtctct

SEQ ID NO: 18638 - DNA, 25 bp, Rattus norvegicus
aaattaggtagtgcctggtgtctct

SEQ ID NO: 18639 - DNA, 25 bp, Rattus norvegicus
aaattaggtctgagcagctgctgta

SEQ ID NO: 18640 - DNA, 25 bp, Rattus norvegicus
aaattaggtctgtgcagctgctgta

SEQ ID NO: 18641 - DNA, 25 bp, Rattus norvegicus
aaattagtccttctgaatcccatct

SEQ ID NO: 18642 - DNA, 25 bp, Rattus norvegicus
aaattagtccttgtgaatcccatct

SEQ ID NO: 18643 - DNA, 25 bp, Rattus norvegicus
aaattagtcttaatcctaaatggat

SEQ ID NO: 18644 - DNA, 25 bp, Rattus norvegicus
aaattagtcttattcctaaatggat

SEQ ID NO: 18645 - DNA, 25 bp, Rattus norvegicus
aaattagtggcccatcaaaccacat

SEQ ID NO: 18646 - DNA, 25 bp, Rattus norvegicus
aaattagtggccgatcaaaccacat

SEQ ID NO: 18647 - DNA, 25 bp, Rattus norvegicus
aaattagtggctccctccgagtgaa

SEQ ID NO: 18648 - DNA, 25 bp, Rattus norvegicus
aaattagtggctgcctccgagtgaa

SEQ ID NO: 18649 - DNA, 25 bp, Rattus norvegicus
aaattataccctaaatcctctgctc

SEQ ID NO: 18650 - DNA, 25 bp, Rattus norvegicus
aaattatacccttaatcctctgctc

SEQ ID NO: 18651 - DNA, 25 bp, Rattus norvegicus
aaattatattcaactgacagtggag

SEQ ID NO: 18652 - DNA, 25 bp, Rattus norvegicus
aaattatattcatctgacagtggag

SEQ ID NO: 18653 - DNA, 25 bp, Rattus norvegicus
aaattatcaccacactgactgtctc

SEQ ID NO: 18654 - DNA, 25 bp, Rattus norvegicus
aaattatcaccagactgactgtctc

SEQ ID NO: 18655 - DNA, 25 bp, Rattus norvegicus
aaattatccatgaagtcgttactat

SEQ ID NO: 18656 - DNA, 25 bp, Rattus norvegicus
aaattatccatgcatacctgtcacg

SEQ ID NO: 18657 - DNA, 25 bp, Rattus norvegicus
aaattatccatgctggtactggtga

SEQ ID NO: 18658 - DNA, 25 bp, Rattus norvegicus
aaattatccatggatacctgtcacg

SEQ ID NO: 18659 - DNA, 25 bp, Rattus norvegicus
aaattatccatggtggtactggtga

SEQ ID NO: 18660 - DNA, 25 bp, Rattus norvegicus
aaattatccatgtagtcgttactat

SEQ ID NO: 18661 - DNA, 25 bp, Rattus norvegicus
aaattatcccacacaaaagacttga

SEQ ID NO: 18662 - DNA, 25 bp, Rattus norvegicus
aaattatcccactcaaaagacttga

SEQ ID NO: 18663 - DNA, 25 bp, Rattus norvegicus
aaattatcctgcattctctatggcc

SEQ ID NO: 18664 - DNA, 25 bp, Rattus norvegicus
aaattatcctgctttctctatggcc

SEQ ID NO: 18665 - DNA, 25 bp, Rattus norvegicus
aaattatctcccacacaggactctg

SEQ ID NO: 18666 - DNA, 25 bp, Rattus norvegicus
aaattatctccctcacaggactctg

SEQ ID NO: 18667 - DNA, 25 bp, Rattus norvegicus
aaattatcttaaccactctaaccat

SEQ ID NO: 18668 - DNA, 25 bp, Rattus norvegicus
aaattatcttaagcactctaaccat

SEQ ID NO: 18669 - DNA, 25 bp, Rattus norvegicus
aaattatgccgtcgcgaggttgttt

SEQ ID NO: 18670 - DNA, 25 bp, Rattus norvegicus
aaattatgccgtggcgaggttgttt

SEQ ID NO: 18671 - DNA, 25 bp, Rattus norvegicus
aaattatgcctgattgtttcctcct

SEQ ID NO: 18672 - DNA, 25 bp, Rattus norvegicus
aaattatgcctgtttgtttcctcct

SEQ ID NO: 18673 - DNA, 25 bp, Rattus norvegicus
aaattatgctttatgtgggacagga

SEQ ID NO: 18674 - DNA, 25 bp, Rattus norvegicus
aaattatgctttttgtgggacagga

SEQ ID NO: 18675 - DNA, 25 bp, Rattus norvegicus
aaattatggcaccagatggctacgc

SEQ ID NO: 18676 - DNA, 25 bp, Rattus norvegicus
aaattatggcacgagatggctacgc

SEQ ID NO: 18677 - DNA, 25 bp, Rattus norvegicus
aaattatgggccctgctccatgggc

SEQ ID NO: 18678 - DNA, 25 bp, Rattus norvegicus
aaattatgggccgtgctccatgggc

SEQ ID NO: 18679 - DNA, 25 bp, Rattus norvegicus
aaattatggtcaatccctgcatgcc

SEQ ID NO: 18680 - DNA, 25 bp, Rattus norvegicus
aaattatggtcattccctgcatgcc

SEQ ID NO: 18681 - DNA, 25 bp, Rattus norvegicus
aaattatggtgcacagtttgcctct

SEQ ID NO: 18682 - DNA, 25 bp, Rattus norvegicus
aaattatggtgctcagtttgcctct

SEQ ID NO: 18683 - DNA, 25 bp, Rattus norvegicus
aaattatgtatcacagcccagccaa

SEQ ID NO: 18684 - DNA, 25 bp, Rattus norvegicus
aaattatgtatctcagcccagccaa

SEQ ID NO: 18685 - DNA, 25 bp, Rattus norvegicus
aaattattatggaggaagtggttat

SEQ ID NO: 18686 - DNA, 25 bp, Rattus norvegicus
aaattattatggtggaagtggttat

SEQ ID NO: 18687 - DNA, 25 bp, Rattus norvegicus
aaattattcctcattgtcgttgaag

SEQ ID NO: 18688 - DNA, 25 bp, Rattus norvegicus
aaattattcctctttgtcgttgaag

SEQ ID NO: 18689 - DNA, 25 bp, Rattus norvegicus
aaattattgctactgctgtgcggcc

SEQ ID NO: 18690 - DNA, 25 bp, Rattus norvegicus
aaattattgctagtgctgtgcggcc

SEQ ID NO: 18691 - DNA, 25 bp, Rattus norvegicus
aaattattgtgtcatggtgccaaag

SEQ ID NO: 18692 - DNA, 25 bp, Rattus norvegicus
aaattattgtgtgatggtgccaaag

SEQ ID NO: 18693 - DNA, 25 bp, Rattus norvegicus
aaattatttcggctctgcaacgtcg

SEQ ID NO: 18694 - DNA, 25 bp, Rattus norvegicus
aaattatttcgggtctgcaacgtcg

SEQ ID NO: 18695 - DNA, 25 bp, Rattus norvegicus
aaattatttctacagggcgtctaag

SEQ ID NO: 18696 - DNA, 25 bp, Rattus norvegicus
aaattatttctagagggcgtctaag

SEQ ID NO: 18697 - DNA, 25 bp, Rattus norvegicus
aaattattttgtacagccttctgtc

SEQ ID NO: 18698 - DNA, 25 bp, Rattus norvegicus
aaattattttgtatctgagagacca

SEQ ID NO: 18699 - DNA, 25 bp, Rattus norvegicus
aaattattttgttcagccttctgtc

SEQ ID NO: 18700 - DNA, 25 bp, Rattus norvegicus
aaattattttgtttctgagagacca

SEQ ID NO: 18701 - DNA, 25 bp, Rattus norvegicus
aaattattttttcacttgccatgga

SEQ ID NO: 18702 - DNA, 25 bp, Rattus norvegicus
aaattattttttgacttgccatgga

SEQ ID NO: 18703 - DNA, 25 bp, Rattus norvegicus
aaattcaaagggacaggcgtaagat

SEQ ID NO: 18704 - DNA, 25 bp, Rattus norvegicus
aaattcaaagggtcaggcgtaagat

SEQ ID NO: 18705 - DNA, 25 bp, Rattus norvegicus
aaattcaagtgtactctcagctatt

SEQ ID NO: 18706 - DNA, 25 bp, Rattus norvegicus
aaattcaagtgtcttctgctcccgg

SEQ ID NO: 18707 - DNA, 25 bp, Rattus norvegicus
aaattcaagtgtgttctgctcccgg

SEQ ID NO: 18708 - DNA, 25 bp, Rattus norvegicus
aaattcaagtgttctctcagctatt

SEQ ID NO: 18709 - DNA, 25 bp, Rattus norvegicus
aaattcaagttgatcttctcggtga

SEQ ID NO: 18710 - DNA, 25 bp, Rattus norvegicus
aaattcaagttgttcttctcggtga

SEQ ID NO: 18711 - DNA, 25 bp, Rattus norvegicus
aaattcaagtttcgccagcagtggg

SEQ ID NO: 18712 - DNA, 25 bp, Rattus norvegicus
aaattcaagtttctgcgggagctgg

SEQ ID NO: 18713 - DNA, 25 bp, Rattus norvegicus
aaattcaagtttggccagcagtggg

SEQ ID NO: 18714 - DNA, 25 bp, Rattus norvegicus
aaattcaagtttgtgcgggagctgg

SEQ ID NO: 18715 - DNA, 25 bp, Rattus norvegicus
aaattcaatcttcgcctggacattc

SEQ ID NO: 18716 - DNA, 25 bp, Rattus norvegicus
aaattcaatcttggcctggacattc

SEQ ID NO: 18717 - DNA, 25 bp, Rattus norvegicus
aaattcaatgaaagtggccacgtgc

SEQ ID NO: 18718 - DNA, 25 bp, Rattus norvegicus
aaattcaatgaatgtggccacgtgc

SEQ ID NO: 18719 - DNA, 25 bp, Rattus norvegicus
aaattcaatgtcaatgtcactggag

SEQ ID NO: 18720 - DNA, 25 bp, Rattus norvegicus
aaattcaatgtctatgtcactggag

SEQ ID NO: 18721 - DNA, 25 bp, Rattus norvegicus
aaattcacatgtatgcgggcaactc

SEQ ID NO: 18722 - DNA, 25 bp, Rattus norvegicus
aaattcacatgtttgcgggcaactc

SEQ ID NO: 18723 - DNA, 25 bp, Rattus norvegicus
aaattcaccacccttgtcatagagc

SEQ ID NO: 18724 - DNA, 25 bp, Rattus norvegicus
aaattcaccaccgttgtcatagagc

SEQ ID NO: 18725 - DNA, 25 bp, Rattus norvegicus
aaattcaccctccttatgctgtgtc

SEQ ID NO: 18726 - DNA, 25 bp, Rattus norvegicus
aaattcaccctcgttatgctgtgtc

SEQ ID NO: 18727 - DNA, 25 bp, Rattus norvegicus
aaattcaccgtaaatagctgcatcg

SEQ ID NO: 18728 - DNA, 25 bp, Rattus norvegicus
aaattcaccgtatatagctgcatcg

SEQ ID NO: 18729 - DNA, 25 bp, Rattus norvegicus
aaattcacctatcccttcagacatg

SEQ ID NO: 18730 - DNA, 25 bp, Rattus norvegicus
aaattcacctatgccttcagacatg

SEQ ID NO: 18731 - DNA, 25 bp, Rattus norvegicus
aaattcacgactaacctggtctaca

SEQ ID NO: 18732 - DNA, 25 bp, Rattus norvegicus
aaattcacgacttacctggtctaca

SEQ ID NO: 18733 - DNA, 25 bp, Rattus norvegicus
aaattcacggaaagagcatcagagg

SEQ ID NO: 18734 - DNA, 25 bp, Rattus norvegicus
aaattcacggaatgagcatcagagg

SEQ ID NO: 18735 - DNA, 25 bp, Rattus norvegicus
aaattcacgttcacgggcagtgtgg

SEQ ID NO: 18736 - DNA, 25 bp, Rattus norvegicus
aaattcacgttctcgggcagtgtgg

SEQ ID NO: 18737 - DNA, 25 bp, Rattus norvegicus
aaattcactcttcttttgcccaaag

SEQ ID NO: 18738 - DNA, 25 bp, Rattus norvegicus
aaattcactcttgttttgcccaaag

SEQ ID NO: 18739 - DNA, 25 bp, Rattus norvegicus
aaattcactgccaatcttgtgccag

SEQ ID NO: 18740 - DNA, 25 bp, Rattus norvegicus
aaattcactgcctatcttgtgccag

SEQ ID NO: 18741 - DNA, 25 bp, Rattus norvegicus
aaattcactgtgcacttatagagaa

SEQ ID NO: 18742 - DNA, 25 bp, Rattus norvegicus
aaattcactgtggacttatagagaa

SEQ ID NO: 18743 - DNA, 25 bp, Rattus norvegicus
aaattcagagagaactccaaggcaa

SEQ ID NO: 18744 - DNA, 25 bp, Rattus norvegicus
aaattcagagagtactccaaggcaa

SEQ ID NO: 18745 - DNA, 25 bp, Rattus norvegicus
aaattcagaggtctgactgcccctg

SEQ ID NO: 18746 - DNA, 25 bp, Rattus norvegicus
aaattcagaggtgtgactgcccctg

SEQ ID NO: 18747 - DNA, 25 bp, Rattus norvegicus
aaattcagatccatgaattcttggg

SEQ ID NO: 18748 - DNA, 25 bp, Rattus norvegicus
aaattcagatccttgaattcttggg

SEQ ID NO: 18749 - DNA, 25 bp, Rattus norvegicus
aaattcagcagaactcctttctagc

SEQ ID NO: 18750 - DNA, 25 bp, Rattus norvegicus
aaattcagcagatctcctttctagc

SEQ ID NO: 18751 - DNA, 25 bp, Rattus norvegicus
aaattcagcctgagtgagcggatac

SEQ ID NO: 18752 - DNA, 25 bp, Rattus norvegicus
aaattcagcctgtgtgagcggatac

SEQ ID NO: 18753 - DNA, 25 bp, Rattus norvegicus
aaattcagctcacggcaatgtgtat

SEQ ID NO: 18754 - DNA, 25 bp, Rattus norvegicus
aaattcagctcagggcaatgtgtat

SEQ ID NO: 18755 - DNA, 25 bp, Rattus norvegicus
aaattcagctctcgtgggacagcgt

SEQ ID NO: 18756 - DNA, 25 bp, Rattus norvegicus
aaattcagctctggtgggacagcgt

SEQ ID NO: 18757 - DNA, 25 bp, Rattus norvegicus
aaattcaggaacaacctcatcccga

SEQ ID NO: 18758 - DNA, 25 bp, Rattus norvegicus
aaattcaggaactacctcatcccga

SEQ ID NO: 18759 - DNA, 25 bp, Rattus norvegicus
aaattcagggtcatggatctagcag

SEQ ID NO: 18760 - DNA, 25 bp, Rattus norvegicus
aaattcagggtcttggatctagcag

SEQ ID NO: 18761 - DNA, 25 bp, Rattus norvegicus
aaattcagggtgaggacgcctcctc

SEQ ID NO: 18762 - DNA, 25 bp, Rattus norvegicus
aaattcagggtgtggacgcctcctc

SEQ ID NO: 18763 - DNA, 25 bp, Rattus norvegicus
aaattcaggtatacaaatggtacat

SEQ ID NO: 18764 - DNA, 25 bp, Rattus norvegicus
aaattcaggtattcaaatggtacat

SEQ ID NO: 18765 - DNA, 25 bp, Rattus norvegicus
aaattcaggttccacaacacccaat

SEQ ID NO: 18766 - DNA, 25 bp, Rattus norvegicus
aaattcaggttcgacaacacccaat

SEQ ID NO: 18767 - DNA, 25 bp, Rattus norvegicus
aaattcataattcaaacagccagta

SEQ ID NO: 18768 - DNA, 25 bp, Rattus norvegicus
aaattcataattgaaacagccagta

SEQ ID NO: 18769 - DNA, 25 bp, Rattus norvegicus
aaattcatcatgaacaagtgtatga

SEQ ID NO: 18770 - DNA, 25 bp, Rattus norvegicus
aaattcatcatgtacaagtgtatga

SEQ ID NO: 18771 - DNA, 25 bp, Rattus norvegicus
aaattcatcattcctctgtactcaa

SEQ ID NO: 18772 - DNA, 25 bp, Rattus norvegicus
aaattcatcattgctctgtactcaa

SEQ ID NO: 18773 - DNA, 25 bp, Rattus norvegicus
aaattcatcctcacctgggtagctg

SEQ ID NO: 18774 - DNA, 25 bp, Rattus norvegicus
aaattcatcctctcctgggtagctg

SEQ ID NO: 18775 - DNA, 25 bp, Rattus norvegicus
aaattcatccttatggaccagccgt

SEQ ID NO: 18776 - DNA, 25 bp, Rattus norvegicus
aaattcatccttttggaccagccgt

SEQ ID NO: 18777 - DNA, 25 bp, Rattus norvegicus
aaattcatctctaacagtccaacaa

SEQ ID NO: 18778 - DNA, 25 bp, Rattus norvegicus
aaattcatctctcatctctgaccaa

SEQ ID NO: 18779 - DNA, 25 bp, Rattus norvegicus
aaattcatctctgatctctgaccaa

SEQ ID NO: 18780 - DNA, 25 bp, Rattus norvegicus
aaattcatctcttacagtccaacaa

SEQ ID NO: 18781 - DNA, 25 bp, Rattus norvegicus
aaattcatgacaacgttccttgatt

SEQ ID NO: 18782 - DNA, 25 bp, Rattus norvegicus
aaattcatgacatcgttccttgatt

SEQ ID NO: 18783 - DNA, 25 bp, Rattus norvegicus
aaattcatgattcttgtctccactc

SEQ ID NO: 18784 - DNA, 25 bp, Rattus norvegicus
aaattcatgattgttgtctccactc

SEQ ID NO: 18785 - DNA, 25 bp, Rattus norvegicus
aaattcatgcgcagatttcctccaa

SEQ ID NO: 18786 - DNA, 25 bp, Rattus norvegicus
aaattcatgcgctgatttcctccaa

SEQ ID NO: 18787 - DNA, 25 bp, Rattus norvegicus
aaattcattaccctcttcatacctg

SEQ ID NO: 18788 - DNA, 25 bp, Rattus norvegicus
aaattcattaccgtcttcatacctg

SEQ ID NO: 18789 - DNA, 25 bp, Rattus norvegicus
aaattcattattatccactgtaaga

SEQ ID NO: 18790 - DNA, 25 bp, Rattus norvegicus
aaattcattattttccactgtaaga

SEQ ID NO: 18791 - DNA, 25 bp, Rattus norvegicus
aaattcattggtccaggtgctgcca

SEQ ID NO: 18792 - DNA, 25 bp, Rattus norvegicus
aaattcattggtgcaggtgctgcca

SEQ ID NO: 18793 - DNA, 25 bp, Rattus norvegicus
aaattcattgttaaccttttcagat

SEQ ID NO: 18794 - DNA, 25 bp, Rattus norvegicus
aaattcattgtttaccttttcagat

SEQ ID NO: 18795 - DNA, 25 bp, Rattus norvegicus
aaattcatttgtcccctgggttaat

SEQ ID NO: 18796 - DNA, 25 bp, Rattus norvegicus
aaattcatttgtgccctgggttaat

SEQ ID NO: 18797 - DNA, 25 bp, Rattus norvegicus
aaattccaagtcactctcctagatg

SEQ ID NO: 18798 - DNA, 25 bp, Rattus norvegicus
aaattccaagtctctctcctagatg

SEQ ID NO: 18799 - DNA, 25 bp, Rattus norvegicus
aaattccaatgcacaggacccagtc

SEQ ID NO: 18800 - DNA, 25 bp, Rattus norvegicus
aaattccaatgctcaggacccagtc

SEQ ID NO: 18801 - DNA, 25 bp, Rattus norvegicus
aaattccacaatctcttcttgcacc

SEQ ID NO: 18802 - DNA, 25 bp, Rattus norvegicus
aaattccacaatgtcttcttgcacc

SEQ ID NO: 18803 - DNA, 25 bp, Rattus norvegicus
aaattccacagcagggtcttacagt

SEQ ID NO: 18804 - DNA, 25 bp, Rattus norvegicus
aaattccacagctgggtcttacagt

SEQ ID NO: 18805 - DNA, 25 bp, Rattus norvegicus
aaattccaccaaataccaagctcat

SEQ ID NO: 18806 - DNA, 25 bp, Rattus norvegicus
aaattccaccaattaccaagctcat

SEQ ID NO: 18807 - DNA, 25 bp, Rattus norvegicus
aaattccacccacctttggtcagca

SEQ ID NO: 18808 - DNA, 25 bp, Rattus norvegicus
aaattccacccagctttggtcagca

SEQ ID NO: 18809 - DNA, 25 bp, Rattus norvegicus
aaattccactacatctggatcccta

SEQ ID NO: 18810 - DNA, 25 bp, Rattus norvegicus
aaattccactacttctggatcccta

SEQ ID NO: 18811 - DNA, 25 bp, Rattus norvegicus
aaattccagcaaaagctccgtgcct

SEQ ID NO: 18812 - DNA, 25 bp, Rattus norvegicus
aaattccagcaatagctccgtgcct

SEQ ID NO: 18813 - DNA, 25 bp, Rattus norvegicus
aaattccagcagacttgacccttga

SEQ ID NO: 18814 - DNA, 25 bp, Rattus norvegicus
aaattccagcagtcttgacccttga

SEQ ID NO: 18815 - DNA, 25 bp, Rattus norvegicus
aaattccaggtcacgctggcaccag

SEQ ID NO: 18816 - DNA, 25 bp, Rattus norvegicus
aaattccaggtctcgctggcaccag

SEQ ID NO: 18817 - DNA, 25 bp, Rattus norvegicus
aaattccagtctcttgcatctcctg

SEQ ID NO: 18818 - DNA, 25 bp, Rattus norvegicus
aaattccagtctgttgcatctcctg

SEQ ID NO: 18819 - DNA, 25 bp, Rattus norvegicus
aaattccatgaacttaaatctgtga

SEQ ID NO: 18820 - DNA, 25 bp, Rattus norvegicus
aaattccatgaagttaaatctgtga

SEQ ID NO: 18821 - DNA, 25 bp, Rattus norvegicus
aaattccatgccagcatccagtttt

SEQ ID NO: 18822 - DNA, 25 bp, Rattus norvegicus
aaattccatgccagctgtcaacatt

SEQ ID NO: 18823 - DNA, 25 bp, Rattus norvegicus
aaattccatgcctgcatccagtttt

SEQ ID NO: 18824 - DNA, 25 bp, Rattus norvegicus
aaattccatgcctgctgtcaacatt

SEQ ID NO: 18825 - DNA, 25 bp, Rattus norvegicus
aaattccatggcagaagttctcgct

SEQ ID NO: 18826 - DNA, 25 bp, Rattus norvegicus
aaattccatggctgaagttctcgct

SEQ ID NO: 18827 - DNA, 25 bp, Rattus norvegicus
aaattcccagcaaaagtccacatca

SEQ ID NO: 18828 - DNA, 25 bp, Rattus norvegicus
aaattcccagcataagtccacatca

SEQ ID NO: 18829 - DNA, 25 bp, Rattus norvegicus
aaattcccagctcctttgtatattg

SEQ ID NO: 18830 - DNA, 25 bp, Rattus norvegicus
aaattcccagctgctttgtatattg

SEQ ID NO: 18831 - DNA, 25 bp, Rattus norvegicus
aaattcccgttcacgtagcagtatt

SEQ ID NO: 18832 - DNA, 25 bp, Rattus norvegicus
aaattcccgttctcgtagcagtatt

SEQ ID NO: 18833 - DNA, 25 bp, Rattus norvegicus
aaattccctggcattctgggtctag

SEQ ID NO: 18834 - DNA, 25 bp, Rattus norvegicus
aaattccctggctttctgggtctag

SEQ ID NO: 18835 - DNA, 25 bp, Rattus norvegicus
aaattccgaagcaaccttcctgcaa

SEQ ID NO: 18836 - DNA, 25 bp, Rattus norvegicus
aaattccgaagctaccttcctgcaa

SEQ ID NO: 18837 - DNA, 25 bp, Rattus norvegicus
aaattccggcttacttgctcggaga

SEQ ID NO: 18838 - DNA, 25 bp, Rattus norvegicus
aaattccggctttcttgctcggaga

SEQ ID NO: 18839 - DNA, 25 bp, Rattus norvegicus
aaattcctaagacatgtaacacagt

SEQ ID NO: 18840 - DNA, 25 bp, Rattus norvegicus
aaattcctaagagatgtaacacagt

SEQ ID NO: 18841 - DNA, 25 bp, Rattus norvegicus
aaattcctacacatcgtcaggacta

SEQ ID NO: 18842 - DNA, 25 bp, Rattus norvegicus
aaattcctacacttcgtcaggacta

SEQ ID NO: 18843 - DNA, 25 bp, Rattus norvegicus
aaattcctacctcagattccaagtg

SEQ ID NO: 18844 - DNA, 25 bp, Rattus norvegicus
aaattcctacctgagattccaagtg

SEQ ID NO: 18845 - DNA, 25 bp, Rattus norvegicus
aaattcctatagacttcttctccag

SEQ ID NO: 18846 - DNA, 25 bp, Rattus norvegicus
aaattcctatagtcttcttctccag

SEQ ID NO: 18847 - DNA, 25 bp, Rattus norvegicus
aaattcctcattagctcggacggcc

SEQ ID NO: 18848 - DNA, 25 bp, Rattus norvegicus
aaattcctcatttgctcggacggcc

SEQ ID NO: 18849 - DNA, 25 bp, Rattus norvegicus
aaattcctcgcacggcgctctttca

SEQ ID NO: 18850 - DNA, 25 bp, Rattus norvegicus
aaattcctcgcagggcgctctttca

SEQ ID NO: 18851 - DNA, 25 bp, Rattus norvegicus
aaattcctcgtcactatttctcatt

SEQ ID NO: 18852 - DNA, 25 bp, Rattus norvegicus
aaattcctcgtctctatttctcatt

SEQ ID NO: 18853 - DNA, 25 bp, Rattus norvegicus
aaattcctcgttcagagcctgcagc

SEQ ID NO: 18854 - DNA, 25 bp, Rattus norvegicus
aaattcctcgttgagagcctgcagc

SEQ ID NO: 18855 - DNA, 25 bp, Rattus norvegicus
aaattcctctgaatccaggcatggg

SEQ ID NO: 18856 - DNA, 25 bp, Rattus norvegicus
aaattcctctgacaaccaaagcatt

SEQ ID NO: 18857 - DNA, 25 bp, Rattus norvegicus
aaattcctctgagaaccaaagcatt

SEQ ID NO: 18858 - DNA, 25 bp, Rattus norvegicus
aaattcctctgattccaggcatggg

SEQ ID NO: 18859 - DNA, 25 bp, Rattus norvegicus
aaattcctcttaagcctgctgtgat

SEQ ID NO: 18860 - DNA, 25 bp, Rattus norvegicus
aaattcctcttatgcctgctgtgat

SEQ ID NO: 18861 - DNA, 25 bp, Rattus norvegicus
aaattcctgaacaaccacagcctgg

SEQ ID NO: 18862 - DNA, 25 bp, Rattus norvegicus
aaattcctgaactaccacagcctgg

SEQ ID NO: 18863 - DNA, 25 bp, Rattus norvegicus
aaattcctgaatacccaattgcacc

SEQ ID NO: 18864 - DNA, 25 bp, Rattus norvegicus
aaattcctgaattcccaattgcacc

SEQ ID NO: 18865 - DNA, 25 bp, Rattus norvegicus
aaattcctgcatatcaggccaggtg

SEQ ID NO: 18866 - DNA, 25 bp, Rattus norvegicus
aaattcctgcatcccgtgtatcgaa

SEQ ID NO: 18867 - DNA, 25 bp, Rattus norvegicus
aaattcctgcatgccgtgtatcgaa

SEQ ID NO: 18868 - DNA, 25 bp, Rattus norvegicus
aaattcctgcatttcaggccaggtg

SEQ ID NO: 18869 - DNA, 25 bp, Rattus norvegicus
aaattcctgctgaggatccgaactt

SEQ ID NO: 18870 - DNA, 25 bp, Rattus norvegicus
aaattcctgctgtggatccgaactt

SEQ ID NO: 18871 - DNA, 25 bp, Rattus norvegicus
aaattcctggccaattctgcagcaa

SEQ ID NO: 18872 - DNA, 25 bp, Rattus norvegicus
aaattcctggcctattctgcagcaa

SEQ ID NO: 18873 - DNA, 25 bp, Rattus norvegicus
aaattcctggctcatccttctgtgt

SEQ ID NO: 18874 - DNA, 25 bp, Rattus norvegicus
aaattcctggctgatccttctgtgt

SEQ ID NO: 18875 - DNA, 25 bp, Rattus norvegicus
aaattcctgttcaactcaggtcctg

SEQ ID NO: 18876 - DNA, 25 bp, Rattus norvegicus
aaattcctgttctactcaggtcctg

SEQ ID NO: 18877 - DNA, 25 bp, Rattus norvegicus
aaattccttacacttggtctcaggc

SEQ ID NO: 18878 - DNA, 25 bp, Rattus norvegicus
aaattccttacagttggtctcaggc

SEQ ID NO: 18879 - DNA, 25 bp, Rattus norvegicus
aaattccttacgcttagagctcaat

SEQ ID NO: 18880 - DNA, 25 bp, Rattus norvegicus
aaattccttacggttagagctcaat

SEQ ID NO: 18881 - DNA, 25 bp, Rattus norvegicus
aaattccttatccagtctctcaaaa

SEQ ID NO: 18882 - DNA, 25 bp, Rattus norvegicus
aaattccttatcgagtctctcaaaa

SEQ ID NO: 18883 - DNA, 25 bp, Rattus norvegicus
aaattccttcatcccaggaaatggg

SEQ ID NO: 18884 - DNA, 25 bp, Rattus norvegicus
aaattccttcatgccaggaaatggg

SEQ ID NO: 18885 - DNA, 25 bp, Rattus norvegicus
aaattccttcgtactagcacagaag

SEQ ID NO: 18886 - DNA, 25 bp, Rattus norvegicus
aaattccttcgttctagcacagaag

SEQ ID NO: 18887 - DNA, 25 bp, Rattus norvegicus
aaattccttctcaatgtcatgccat

SEQ ID NO: 18888 - DNA, 25 bp, Rattus norvegicus
aaattccttctctatgtcatgccat

SEQ ID NO: 18889 - DNA, 25 bp, Rattus norvegicus
aaattccttcttacctttgcacaca

SEQ ID NO: 18890 - DNA, 25 bp, Rattus norvegicus
aaattccttctttcctttgcacaca

SEQ ID NO: 18891 - DNA, 25 bp, Rattus norvegicus
aaattccttgatatgagttcggtac

SEQ ID NO: 18892 - DNA, 25 bp, Rattus norvegicus
aaattccttgatccgcctgcttttt

SEQ ID NO: 18893 - DNA, 25 bp, Rattus norvegicus
aaattccttgatgcgcctgcttttt

SEQ ID NO: 18894 - DNA, 25 bp, Rattus norvegicus
aaattccttgatttgagttcggtac

SEQ ID NO: 18895 - DNA, 25 bp, Rattus norvegicus
aaattccttgtcatatattctcatg

SEQ ID NO: 18896 - DNA, 25 bp, Rattus norvegicus
aaattccttgtcttatattctcatg

SEQ ID NO: 18897 - DNA, 25 bp, Rattus norvegicus
aaattcgcaaccattcgttctcctt

SEQ ID NO: 18898 - DNA, 25 bp, Rattus norvegicus
aaattcgcaacctttcgttctcctt

SEQ ID NO: 18899 - DNA, 25 bp, Rattus norvegicus
aaattcgctgttactgacttggctg

SEQ ID NO: 18900 - DNA, 25 bp, Rattus norvegicus
aaattcgctgtttctgacttggctg

SEQ ID NO: 18901 - DNA, 25 bp, Rattus norvegicus
aaattcgtagcaagttcaaaaacca

SEQ ID NO: 18902 - DNA, 25 bp, Rattus norvegicus
aaattcgtagcatgttcaaaaacca

SEQ ID NO: 18903 - DNA, 25 bp, Rattus norvegicus
aaattcgtatgcatgggcacctggg

SEQ ID NO: 18904 - DNA, 25 bp, Rattus norvegicus
aaattcgtatgcttgggcacctggg

SEQ ID NO: 18905 - DNA, 25 bp, Rattus norvegicus
aaattcgtcactatctattacccag

SEQ ID NO: 18906 - DNA, 25 bp, Rattus norvegicus
aaattcgtcactttctattacccag

SEQ ID NO: 18907 - DNA, 25 bp, Rattus norvegicus
aaattcgtggagcatttccttgatt

SEQ ID NO: 18908 - DNA, 25 bp, Rattus norvegicus
aaattcgtggaggatttccttgatt

SEQ ID NO: 18909 - DNA, 25 bp, Rattus norvegicus
aaattctaaacacacatcttccctc

SEQ ID NO: 18910 - DNA, 25 bp, Rattus norvegicus
aaattctaaacagacatcttccctc

SEQ ID NO: 18911 - DNA, 25 bp, Rattus norvegicus
aaattctaaactcgcctgattcctg

SEQ ID NO: 18912 - DNA, 25 bp, Rattus norvegicus
aaattctaaactggcctgattcctg

SEQ ID NO: 18913 - DNA, 25 bp, Rattus norvegicus
aaattctaacctcctgacctgatat

SEQ ID NO: 18914 - DNA, 25 bp, Rattus norvegicus
aaattctaacctcgcatggtgggca

SEQ ID NO: 18915 - DNA, 25 bp, Rattus norvegicus
aaattctaacctgctgacctgatat

SEQ ID NO: 18916 - DNA, 25 bp, Rattus norvegicus
aaattctaacctggcatggtgggca

SEQ ID NO: 18917 - DNA, 25 bp, Rattus norvegicus
aaattctaagctatcctttgccagg

SEQ ID NO: 18918 - DNA, 25 bp, Rattus norvegicus
aaattctaagctttcctttgccagg

SEQ ID NO: 18919 - DNA, 25 bp, Rattus norvegicus
aaattctaggctccgaggttgctgc

SEQ ID NO: 18920 - DNA, 25 bp, Rattus norvegicus
aaattctaggctgcgaggttgctgc

SEQ ID NO: 18921 - DNA, 25 bp, Rattus norvegicus
aaattctagggacatttagcacacc

SEQ ID NO: 18922 - DNA, 25 bp, Rattus norvegicus
aaattctagggagatttagcacacc

SEQ ID NO: 18923 - DNA, 25 bp, Rattus norvegicus
aaattctattcacggctaattgcct

SEQ ID NO: 18924 - DNA, 25 bp, Rattus norvegicus
aaattctattcagggctaattgcct

SEQ ID NO: 18925 - DNA, 25 bp, Rattus norvegicus
aaattctcaaatactaaatagtctt

SEQ ID NO: 18926 - DNA, 25 bp, Rattus norvegicus
aaattctcaaataggcaaagctgcc

SEQ ID NO: 18927 - DNA, 25 bp, Rattus norvegicus
aaattctcaaattctaaatagtctt

SEQ ID NO: 18928 - DNA, 25 bp, Rattus norvegicus
aaattctcaaattggcaaagctgcc

SEQ ID NO: 18929 - DNA, 25 bp, Rattus norvegicus
aaattctcaccacaggatcttgcac

SEQ ID NO: 18930 - DNA, 25 bp, Rattus norvegicus
aaattctcaccagaggatcttgcac

SEQ ID NO: 18931 - DNA, 25 bp, Rattus norvegicus
aaattctcatcaaaccatgcacctc

SEQ ID NO: 18932 - DNA, 25 bp, Rattus norvegicus
aaattctcatcataccatgcacctc

SEQ ID NO: 18933 - DNA, 25 bp, Rattus norvegicus
aaattctcattaattctgttcctct

SEQ ID NO: 18934 - DNA, 25 bp, Rattus norvegicus
aaattctcattatttctgttcctct

SEQ ID NO: 18935 - DNA, 25 bp, Rattus norvegicus
aaattctccaggcaaagttcccaca

SEQ ID NO: 18936 - DNA, 25 bp, Rattus norvegicus
aaattctccagggaaagttcccaca

SEQ ID NO: 18937 - DNA, 25 bp, Rattus norvegicus
aaattctccattatgctggcagggt

SEQ ID NO: 18938 - DNA, 25 bp, Rattus norvegicus
aaattctccattttgctggcagggt

SEQ ID NO: 18939 - DNA, 25 bp, Rattus norvegicus
aaattctccctcagaaaaatgcaag

SEQ ID NO: 18940 - DNA, 25 bp, Rattus norvegicus
aaattctccctctgaaaaatgcaag

SEQ ID NO: 18941 - DNA, 25 bp, Rattus norvegicus
aaattctccgacagctggtgactga

SEQ ID NO: 18942 - DNA, 25 bp, Rattus norvegicus
aaattctccgactgctggtgactga

SEQ ID NO: 18943 - DNA, 25 bp, Rattus norvegicus
aaattctcctggaacagatttctct

SEQ ID NO: 18944 - DNA, 25 bp, Rattus norvegicus
aaattctcctggtacagatttctct

SEQ ID NO: 18945 - DNA, 25 bp, Rattus norvegicus
aaattctccttaccttcatgagcag

SEQ ID NO: 18946 - DNA, 25 bp, Rattus norvegicus
aaattctccttagcttcatgagcag

SEQ ID NO: 18947 - DNA, 25 bp, Rattus norvegicus
aaattctccttgcaccatggctggc

SEQ ID NO: 18948 - DNA, 25 bp, Rattus norvegicus
aaattctccttggaccatggctggc

SEQ ID NO: 18949 - DNA, 25 bp, Rattus norvegicus
aaattctcgcatatgtgcaaggaac

SEQ ID NO: 18950 - DNA, 25 bp, Rattus norvegicus
aaattctcgcatttgtgcaaggaac

SEQ ID NO: 18951 - DNA, 25 bp, Rattus norvegicus
aaattctctcttactcgattatcaa

SEQ ID NO: 18952 - DNA, 25 bp, Rattus norvegicus
aaattctctcttatgccaacctggt

SEQ ID NO: 18953 - DNA, 25 bp, Rattus norvegicus
aaattctctctttctcgattatcaa

SEQ ID NO: 18954 - DNA, 25 bp, Rattus norvegicus
aaattctctcttttgccaacctggt

SEQ ID NO: 18955 - DNA, 25 bp, Rattus norvegicus
aaattctctgacagtctcctagggt

SEQ ID NO: 18956 - DNA, 25 bp, Rattus norvegicus
aaattctctgactgtctcctagggt

SEQ ID NO: 18957 - DNA, 25 bp, Rattus norvegicus
aaattctctgcaaaggaaggcctct

SEQ ID NO: 18958 - DNA, 25 bp, Rattus norvegicus
aaattctctgcataggaaggcctct

SEQ ID NO: 18959 - DNA, 25 bp, Rattus norvegicus
aaattctctggtctaactggatccc

SEQ ID NO: 18960 - DNA, 25 bp, Rattus norvegicus
aaattctctggtgtaactggatccc

SEQ ID NO: 18961 - DNA, 25 bp, Rattus norvegicus
aaattctgaacaagccccatcaaaa

SEQ ID NO: 18962 - DNA, 25 bp, Rattus norvegicus
aaattctgaacatgccccatcaaaa

SEQ ID NO: 18963 - DNA, 25 bp, Rattus norvegicus
aaattctgacctagacacttaacaa

SEQ ID NO: 18964 - DNA, 25 bp, Rattus norvegicus
aaattctgaccttgacacttaacaa

SEQ ID NO: 18965 - DNA, 25 bp, Rattus norvegicus
aaattctgagcaattgttttctctt

SEQ ID NO: 18966 - DNA, 25 bp, Rattus norvegicus
aaattctgagcacgcatttgccagg

SEQ ID NO: 18967 - DNA, 25 bp, Rattus norvegicus
aaattctgagcaggcatttgccagg

SEQ ID NO: 18968 - DNA, 25 bp, Rattus norvegicus
aaattctgagcatttgttttctctt

SEQ ID NO: 18969 - DNA, 25 bp, Rattus norvegicus
aaattctgagttctcagtctttgga

SEQ ID NO: 18970 - DNA, 25 bp, Rattus norvegicus
aaattctgagttgtcagtctttgga

SEQ ID NO: 18971 - DNA, 25 bp, Rattus norvegicus
aaattctgattgaccaggcccttca

SEQ ID NO: 18972 - DNA, 25 bp, Rattus norvegicus
aaattctgattgatctgtgccctca

SEQ ID NO: 18973 - DNA, 25 bp, Rattus norvegicus
aaattctgattgcacttctctatgg

SEQ ID NO: 18974 - DNA, 25 bp, Rattus norvegicus
aaattctgattggacttctctatgg

SEQ ID NO: 18975 - DNA, 25 bp, Rattus norvegicus
aaattctgattgtccaggcccttca

SEQ ID NO: 18976 - DNA, 25 bp, Rattus norvegicus
aaattctgattgttctgtgccctca

SEQ ID NO: 18977 - DNA, 25 bp, Rattus norvegicus
aaattctgccatagcgggagcattt

SEQ ID NO: 18978 - DNA, 25 bp, Rattus norvegicus
aaattctgccatccggaagtgtgtc

SEQ ID NO: 18979 - DNA, 25 bp, Rattus norvegicus
aaattctgccatgcggaagtgtgtc

SEQ ID NO: 18980 - DNA, 25 bp, Rattus norvegicus
aaattctgccattgcgggagcattt

SEQ ID NO: 18981 - DNA, 25 bp, Rattus norvegicus
aaattctgctcaccagaacccaagg

SEQ ID NO: 18982 - DNA, 25 bp, Rattus norvegicus
aaattctgctcagcagaacccaagg

SEQ ID NO: 18983 - DNA, 25 bp, Rattus norvegicus
aaattctgctccaaggttccttaga

SEQ ID NO: 18984 - DNA, 25 bp, Rattus norvegicus
aaattctgctcctaggttccttaga

SEQ ID NO: 18985 - DNA, 25 bp, Rattus norvegicus
aaattctgcttcagtctcagtctta

SEQ ID NO: 18986 - DNA, 25 bp, Rattus norvegicus
aaattctgcttctgtctcagtctta

SEQ ID NO: 18987 - DNA, 25 bp, Rattus norvegicus
aaattctggataactggcctctgac

SEQ ID NO: 18988 - DNA, 25 bp, Rattus norvegicus
aaattctggatatctggcctctgac

SEQ ID NO: 18989 - DNA, 25 bp, Rattus norvegicus
aaattctggccaaccattgctcgga

SEQ ID NO: 18990 - DNA, 25 bp, Rattus norvegicus
aaattctggccatccattgctcgga

SEQ ID NO: 18991 - DNA, 25 bp, Rattus norvegicus
aaattctgggcaccatagcagctct

SEQ ID NO: 18992 - DNA, 25 bp, Rattus norvegicus
aaattctgggcagcatagcagctct

SEQ ID NO: 18993 - DNA, 25 bp, Rattus norvegicus
aaattctgtacaacatgttcaagag

SEQ ID NO: 18994 - DNA, 25 bp, Rattus norvegicus
aaattctgtacatcatgttcaagag

SEQ ID NO: 18995 - DNA, 25 bp, Rattus norvegicus
aaattctgtcacattgcaggccttc

SEQ ID NO: 18996 - DNA, 25 bp, Rattus norvegicus
aaattctgtcactttgcaggccttc

SEQ ID NO: 18997 - DNA, 25 bp, Rattus norvegicus
aaattctgtccccattggcattcct

SEQ ID NO: 18998 - DNA, 25 bp, Rattus norvegicus
aaattctgtcccgattggcattcct

SEQ ID NO: 18999 - DNA, 25 bp, Rattus norvegicus
aaattctgtctgcagtcatttcagt

SEQ ID NO: 19000 - DNA, 25 bp, Rattus norvegicus
aaattctgtctggagtcatttcagt

SEQ ID NO: 19001 - DNA, 25 bp, Rattus norvegicus
aaattctgtgaacttctcattggca

SEQ ID NO: 19002 - DNA, 25 bp, Rattus norvegicus
aaattctgtgaagttctcattggca

SEQ ID NO: 19003 - DNA, 25 bp, Rattus norvegicus
aaattctgtgagctcctgatcaaca

SEQ ID NO: 19004 - DNA, 25 bp, Rattus norvegicus
aaattctgtgaggtcctgatcaaca

SEQ ID NO: 19005 - DNA, 25 bp, Rattus norvegicus
aaattctgttatatcagcctccgaa

SEQ ID NO: 19006 - DNA, 25 bp, Rattus norvegicus
aaattctgttatttcagcctccgaa

SEQ ID NO: 19007 - DNA, 25 bp, Rattus norvegicus
aaattcttaaatatgggcttgccta

SEQ ID NO: 19008 - DNA, 25 bp, Rattus norvegicus
aaattcttaaatttgggcttgccta

SEQ ID NO: 19009 - DNA, 25 bp, Rattus norvegicus
aaattcttcagccaaggtcctgctc

SEQ ID NO: 19010 - DNA, 25 bp, Rattus norvegicus
aaattcttcagcgaaggtcctgctc

SEQ ID NO: 19011 - DNA, 25 bp, Rattus norvegicus
aaattcttcaggcagtgtcacctca

SEQ ID NO: 19012 - DNA, 25 bp, Rattus norvegicus
aaattcttcagggagtgtcacctca

SEQ ID NO: 19013 - DNA, 25 bp, Rattus norvegicus
aaattcttcataacttctagcatgg

SEQ ID NO: 19014 - DNA, 25 bp, Rattus norvegicus
aaattcttcatatcttctagcatgg

SEQ ID NO: 19015 - DNA, 25 bp, Rattus norvegicus
aaattcttcccaacattccatgtac

SEQ ID NO: 19016 - DNA, 25 bp, Rattus norvegicus
aaattcttcccacgtgccttgaaat

SEQ ID NO: 19017 - DNA, 25 bp, Rattus norvegicus
aaattcttcccaggtgccttgaaat

SEQ ID NO: 19018 - DNA, 25 bp, Rattus norvegicus
aaattcttcccatcattccatgtac

SEQ ID NO: 19019 - DNA, 25 bp, Rattus norvegicus
aaattcttccgtacattgtactctg

SEQ ID NO: 19020 - DNA, 25 bp, Rattus norvegicus
aaattcttccgttcattgtactctg

SEQ ID NO: 19021 - DNA, 25 bp, Rattus norvegicus
aaattcttcctgacagtggcttaga

SEQ ID NO: 19022 - DNA, 25 bp, Rattus norvegicus
aaattcttcctgtcagtggcttaga

SEQ ID NO: 19023 - DNA, 25 bp, Rattus norvegicus
aaattcttgaccacatgtgctacag

SEQ ID NO: 19024 - DNA, 25 bp, Rattus norvegicus
aaattcttgacctcatgtgctacag

SEQ ID NO: 19025 - DNA, 25 bp, Rattus norvegicus
aaattcttgagccattccatccagt

SEQ ID NO: 19026 - DNA, 25 bp, Rattus norvegicus
aaattcttgagcgattccatccagt

SEQ ID NO: 19027 - DNA, 25 bp, Rattus norvegicus
aaattcttgcagacagcatcatcaa

SEQ ID NO: 19028 - DNA, 25 bp, Rattus norvegicus
aaattcttgcagtcagcatcatcaa

SEQ ID NO: 19029 - DNA, 25 bp, Rattus norvegicus
aaattcttgcctctcatgttggtgg

SEQ ID NO: 19030 - DNA, 25 bp, Rattus norvegicus
aaattcttgcctgtcatgttggtgg

SEQ ID NO: 19031 - DNA, 25 bp, Rattus norvegicus
aaattcttgctacttctccaaaggg

SEQ ID NO: 19032 - DNA, 25 bp, Rattus norvegicus
aaattcttgctagttctccaaaggg

SEQ ID NO: 19033 - DNA, 25 bp, Rattus norvegicus
aaattcttggccattctggtgaggg

SEQ ID NO: 19034 - DNA, 25 bp, Rattus norvegicus
aaattcttggccctcatgagagaag

SEQ ID NO: 19035 - DNA, 25 bp, Rattus norvegicus
aaattcttggccgtcatgagagaag

SEQ ID NO: 19036 - DNA, 25 bp, Rattus norvegicus
aaattcttggcctttctggtgaggg

SEQ ID NO: 19037 - DNA, 25 bp, Rattus norvegicus
aaattcttgggacctgagcacagtt

SEQ ID NO: 19038 - DNA, 25 bp, Rattus norvegicus
aaattcttgggagctgagcacagtt

SEQ ID NO: 19039 - DNA, 25 bp, Rattus norvegicus
aaattcttgggtctggtcatattac

SEQ ID NO: 19040 - DNA, 25 bp, Rattus norvegicus
aaattcttgggtgtggtcatattac

SEQ ID NO: 19041 - DNA, 25 bp, Rattus norvegicus
aaattcttgtctagctcctcttgtt

SEQ ID NO: 19042 - DNA, 25 bp, Rattus norvegicus
aaattcttgtcttgctcctcttgtt

SEQ ID NO: 19043 - DNA, 25 bp, Rattus norvegicus
aaattcttgtgcccacacttgatga

SEQ ID NO: 19044 - DNA, 25 bp, Rattus norvegicus
aaattcttgtgcgcacacttgatga

SEQ ID NO: 19045 - DNA, 25 bp, Rattus norvegicus
aaattctttctcagatgccgatgtt

SEQ ID NO: 19046 - DNA, 25 bp, Rattus norvegicus
aaattctttctctgatgccgatgtt

SEQ ID NO: 19047 - DNA, 25 bp, Rattus norvegicus
aaattctttcttcctattctcatat

SEQ ID NO: 19048 - DNA, 25 bp, Rattus norvegicus
aaattctttcttgctattctcatat

SEQ ID NO: 19049 - DNA, 25 bp, Rattus norvegicus
aaattctttgatattcccagatgac

SEQ ID NO: 19050 - DNA, 25 bp, Rattus norvegicus
aaattctttgattttcccagatgac

SEQ ID NO: 19051 - DNA, 25 bp, Rattus norvegicus
aaattctttgccaagatgtctacaa

SEQ ID NO: 19052 - DNA, 25 bp, Rattus norvegicus
aaattctttgcctagatgtctacaa

SEQ ID NO: 19053 - DNA, 25 bp, Rattus norvegicus
aaattctttggcacttcactctttt

SEQ ID NO: 19054 - DNA, 25 bp, Rattus norvegicus
aaattctttggctcttcactctttt

SEQ ID NO: 19055 - DNA, 25 bp, Rattus norvegicus
aaattgaaatgtcctggcagatcct

SEQ ID NO: 19056 - DNA, 25 bp, Rattus norvegicus
aaattgaaatgtgctggcagatcct

SEQ ID NO: 19057 - DNA, 25 bp, Rattus norvegicus
aaattgaacggaaccctggctatgt

SEQ ID NO: 19058 - DNA, 25 bp, Rattus norvegicus
aaattgaacggatccctggctatgt

SEQ ID NO: 19059 - DNA, 25 bp, Rattus norvegicus
aaattgaactggcagctcgtagaag

SEQ ID NO: 19060 - DNA, 25 bp, Rattus norvegicus
aaattgaactgggagctcgtagaag

SEQ ID NO: 19061 - DNA, 25 bp, Rattus norvegicus
aaattgaaggtgattatgcccgaga

SEQ ID NO: 19062 - DNA, 25 bp, Rattus norvegicus
aaattgaaggtgtttatgcccgaga

SEQ ID NO: 19063 - DNA, 25 bp, Rattus norvegicus
aaattgaatttcacctcctttctct

SEQ ID NO: 19064 - DNA, 25 bp, Rattus norvegicus
aaattgaatttctcctcctttctct

SEQ ID NO: 19065 - DNA, 25 bp, Rattus norvegicus
aaattgaccatgcagactggcgtag

SEQ ID NO: 19066 - DNA, 25 bp, Rattus norvegicus
aaattgaccatggagactggcgtag

SEQ ID NO: 19067 - DNA, 25 bp, Rattus norvegicus
aaattgaccttgaccataccagggc

SEQ ID NO: 19068 - DNA, 25 bp, Rattus norvegicus
aaattgaccttgtccataccagggc

SEQ ID NO: 19069 - DNA, 25 bp, Rattus norvegicus
aaattgacgctgactttcaaccgca

SEQ ID NO: 19070 - DNA, 25 bp, Rattus norvegicus
aaattgacgctgaggctgatgccga

SEQ ID NO: 19071 - DNA, 25 bp, Rattus norvegicus
aaattgacgctgtctttcaaccgca

SEQ ID NO: 19072 - DNA, 25 bp, Rattus norvegicus
aaattgacgctgtggctgatgccga

SEQ ID NO: 19073 - DNA, 25 bp, Rattus norvegicus
aaattgagcaacatgtgcctccctg

SEQ ID NO: 19074 - DNA, 25 bp, Rattus norvegicus
aaattgagcaacttgtgcctccctg

SEQ ID NO: 19075 - DNA, 25 bp, Rattus norvegicus
aaattgagcacgagtttcctgccta

SEQ ID NO: 19076 - DNA, 25 bp, Rattus norvegicus
aaattgagcacgtgtttcctgccta

SEQ ID NO: 19077 - DNA, 25 bp, Rattus norvegicus
aaattgagcggcacggagtcctggc

SEQ ID NO: 19078 - DNA, 25 bp, Rattus norvegicus
aaattgagcggctcggagtcctggc

SEQ ID NO: 19079 - DNA, 25 bp, Rattus norvegicus
aaattgagctatacggtcagggtcc

SEQ ID NO: 19080 - DNA, 25 bp, Rattus norvegicus
aaattgagctattcggtcagggtcc

SEQ ID NO: 19081 - DNA, 25 bp, Rattus norvegicus
aaattgaggccgctatacaaccacc

SEQ ID NO: 19082 - DNA, 25 bp, Rattus norvegicus
aaattgaggccggtatacaaccacc

SEQ ID NO: 19083 - DNA, 25 bp, Rattus norvegicus
aaattgaggctacaggactgtgaga

SEQ ID NO: 19084 - DNA, 25 bp, Rattus norvegicus
aaattgaggctagaggactgtgaga

SEQ ID NO: 19085 - DNA, 25 bp, Rattus norvegicus
aaattgaggtgccttccttgtgtac

SEQ ID NO: 19086 - DNA, 25 bp, Rattus norvegicus
aaattgaggtgcgttccttgtgtac

SEQ ID NO: 19087 - DNA, 25 bp, Rattus norvegicus
aaattgaggttacaggcacacacac

SEQ ID NO: 19088 - DNA, 25 bp, Rattus norvegicus
aaattgaggttagaggcacacacac

SEQ ID NO: 19089 - DNA, 25 bp, Rattus norvegicus
aaattgatccagattgtcctttaga

SEQ ID NO: 19090 - DNA, 25 bp, Rattus norvegicus
aaattgatccagtttgtcctttaga

SEQ ID NO: 19091 - DNA, 25 bp, Rattus norvegicus
aaattgatctcactggtcccgggaa

SEQ ID NO: 19092 - DNA, 25 bp, Rattus norvegicus
aaattgatctcagtggtcccgggaa

SEQ ID NO: 19093 - DNA, 25 bp, Rattus norvegicus
aaattgatggctctactcttgctca

SEQ ID NO: 19094 - DNA, 25 bp, Rattus norvegicus
aaattgatggctgtactcttgctca

SEQ ID NO: 19095 - DNA, 25 bp, Rattus norvegicus
aaattgatgtttagcatttgacttc

SEQ ID NO: 19096 - DNA, 25 bp, Rattus norvegicus
aaattgatgttttgcatttgacttc

SEQ ID NO: 19097 - DNA, 25 bp, Rattus norvegicus
aaattgattctaaccactgctccta

SEQ ID NO: 19098 - DNA, 25 bp, Rattus norvegicus
aaattgattctatccactgctccta

SEQ ID NO: 19099 - DNA, 25 bp, Rattus norvegicus
aaattgattgaaccactcgtgacac

SEQ ID NO: 19100 - DNA, 25 bp, Rattus norvegicus
aaattgattgaagcactcgtgacac

SEQ ID NO: 19101 - DNA, 25 bp, Rattus norvegicus
aaattgcaggttacaacgccacgag

SEQ ID NO: 19102 - DNA, 25 bp, Rattus norvegicus
aaattgcaggtttcaacgccacgag

SEQ ID NO: 19103 - DNA, 25 bp, Rattus norvegicus
aaattgcagtctaccactatgcgcg

SEQ ID NO: 19104 - DNA, 25 bp, Rattus norvegicus
aaattgcagtcttccactatgcgcg

SEQ ID NO: 19105 - DNA, 25 bp, Rattus norvegicus
aaattgcattggattggttgtcctt

SEQ ID NO: 19106 - DNA, 25 bp, Rattus norvegicus
aaattgcattggtttggttgtcctt

SEQ ID NO: 19107 - DNA, 25 bp, Rattus norvegicus
aaattgccaaaaacgggagctactc

SEQ ID NO: 19108 - DNA, 25 bp, Rattus norvegicus
aaattgccaaaatcgggagctactc

SEQ ID NO: 19109 - DNA, 25 bp, Rattus norvegicus
aaattgccaggaatctgggtccttt

SEQ ID NO: 19110 - DNA, 25 bp, Rattus norvegicus
aaattgccaggattctgggtccttt

SEQ ID NO: 19111 - DNA, 25 bp, Rattus norvegicus
aaattgccaggtacctgtgactttg

SEQ ID NO: 19112 - DNA, 25 bp, Rattus norvegicus
aaattgccaggttcctgtgactttg

SEQ ID NO: 19113 - DNA, 25 bp, Rattus norvegicus
aaattgccagtaccagagcccacga

SEQ ID NO: 19114 - DNA, 25 bp, Rattus norvegicus
aaattgccagtagcagagcccacga

SEQ ID NO: 19115 - DNA, 25 bp, Rattus norvegicus
aaattgcccacactatggccacaac

SEQ ID NO: 19116 - DNA, 25 bp, Rattus norvegicus
aaattgcccacagtatggccacaac

SEQ ID NO: 19117 - DNA, 25 bp, Rattus norvegicus
aaattgcctcctctgctgttagtac

SEQ ID NO: 19118 - DNA, 25 bp, Rattus norvegicus
aaattgcctcctgtgctgttagtac

SEQ ID NO: 19119 - DNA, 25 bp, Rattus norvegicus
aaattgcctgagacctgagattcca

SEQ ID NO: 19120 - DNA, 25 bp, Rattus norvegicus
aaattgcctgagtcctgagattcca

SEQ ID NO: 19121 - DNA, 25 bp, Rattus norvegicus
aaattgcctgcaattactctgtcag

SEQ ID NO: 19122 - DNA, 25 bp, Rattus norvegicus
aaattgcctgcatttactctgtcag

SEQ ID NO: 19123 - DNA, 25 bp, Rattus norvegicus
aaattgcctttcatctctgttgtgc

SEQ ID NO: 19124 - DNA, 25 bp, Rattus norvegicus
aaattgcctttcttctctgttgtgc

SEQ ID NO: 19125 - DNA, 25 bp, Rattus norvegicus
aaattgcggaagctattcctggcag

SEQ ID NO: 19126 - DNA, 25 bp, Rattus norvegicus
aaattgcggaaggtattcctggcag

SEQ ID NO: 19127 - DNA, 25 bp, Rattus norvegicus
aaattgcggtccaacctgatgggca

SEQ ID NO: 19128 - DNA, 25 bp, Rattus norvegicus
aaattgcggtcctacctgatgggca

SEQ ID NO: 19129 - DNA, 25 bp, Rattus norvegicus
aaattgctcactagaggctctcagc

SEQ ID NO: 19130 - DNA, 25 bp, Rattus norvegicus
aaattgctcacttgaggctctcagc

SEQ ID NO: 19131 - DNA, 25 bp, Rattus norvegicus
aaattgctctttacaatgtatcaca

SEQ ID NO: 19132 - DNA, 25 bp, Rattus norvegicus
aaattgctcttttcaatgtatcaca

SEQ ID NO: 19133 - DNA, 25 bp, Rattus norvegicus
aaattgctgcatatttgtgccgtaa

SEQ ID NO: 19134 - DNA, 25 bp, Rattus norvegicus
aaattgctgcatcaagtaccaagag

SEQ ID NO: 19135 - DNA, 25 bp, Rattus norvegicus
aaattgctgcatgaagtaccaagag

SEQ ID NO: 19136 - DNA, 25 bp, Rattus norvegicus
aaattgctgcatttttgtgccgtaa

SEQ ID NO: 19137 - DNA, 25 bp, Rattus norvegicus
aaattgctgcctctggttcaccagt

SEQ ID NO: 19138 - DNA, 25 bp, Rattus norvegicus
aaattgctgcctgtggttcaccagt

SEQ ID NO: 19139 - DNA, 25 bp, Rattus norvegicus
aaattgctgctgcttagatcactgc

SEQ ID NO: 19140 - DNA, 25 bp, Rattus norvegicus
aaattgctgctggttagatcactgc

SEQ ID NO: 19141 - DNA, 25 bp, Rattus norvegicus
aaattgcttctgcttggtgtcaaca

SEQ ID NO: 19142 - DNA, 25 bp, Rattus norvegicus
aaattgcttctggttggtgtcaaca

SEQ ID NO: 19143 - DNA, 25 bp, Rattus norvegicus
aaattgcttgtgatctctcacctac

SEQ ID NO: 19144 - DNA, 25 bp, Rattus norvegicus
aaattgcttgtgttctctcacctac

SEQ ID NO: 19145 - DNA, 25 bp, Rattus norvegicus
aaattggagcccagtcctagcttag

SEQ ID NO: 19146 - DNA, 25 bp, Rattus norvegicus
aaattggagccctgtcctagcttag

SEQ ID NO: 19147 - DNA, 25 bp, Rattus norvegicus
aaattggatctaacgcctgtcacca

SEQ ID NO: 19148 - DNA, 25 bp, Rattus norvegicus
aaattggatctatcgcctgtcacca

SEQ ID NO: 19149 - DNA, 25 bp, Rattus norvegicus
aaattggatgtaatctggtcaataa

SEQ ID NO: 19150 - DNA, 25 bp, Rattus norvegicus
aaattggatgtattctggtcaataa

SEQ ID NO: 19151 - DNA, 25 bp, Rattus norvegicus
aaattggcaatgagtggtccctctg

SEQ ID NO: 19152 - DNA, 25 bp, Rattus norvegicus
aaattggcaatgtgtggtccctctg

SEQ ID NO: 19153 - DNA, 25 bp, Rattus norvegicus
aaattggcacttccttttctgttga

SEQ ID NO: 19154 - DNA, 25 bp, Rattus norvegicus
aaattggcacttgcttttctgttga

SEQ ID NO: 19155 - DNA, 25 bp, Rattus norvegicus
aaattggcatccagtttacattttc

SEQ ID NO: 19156 - DNA, 25 bp, Rattus norvegicus
aaattggcatcctgtttacattttc

SEQ ID NO: 19157 - DNA, 25 bp, Rattus norvegicus
aaattggccaaaaggcgcgcaaccc

SEQ ID NO: 19158 - DNA, 25 bp, Rattus norvegicus
aaattggccaaatggcgcgcaaccc

SEQ ID NO: 19159 - DNA, 25 bp, Rattus norvegicus
aaattggccacaccctgagggtgca

SEQ ID NO: 19160 - DNA, 25 bp, Rattus norvegicus
aaattggccacagcctgagggtgca

SEQ ID NO: 19161 - DNA, 25 bp, Rattus norvegicus
aaattggccagcacgttcaactgtg

SEQ ID NO: 19162 - DNA, 25 bp, Rattus norvegicus
aaattggccagctcgttcaactgtg

SEQ ID NO: 19163 - DNA, 25 bp, Rattus norvegicus
aaattggccctgcatttttattggc

SEQ ID NO: 19164 - DNA, 25 bp, Rattus norvegicus
aaattggccctggatttttattggc

SEQ ID NO: 19165 - DNA, 25 bp, Rattus norvegicus
aaattggccgggactgtgtacctag

SEQ ID NO: 19166 - DNA, 25 bp, Rattus norvegicus
aaattggccgggtctgtgtacctag

SEQ ID NO: 19167 - DNA, 25 bp, Rattus norvegicus
aaattggctactcacatcctttcat

SEQ ID NO: 19168 - DNA, 25 bp, Rattus norvegicus
aaattggctactgacatcctttcat

SEQ ID NO: 19169 - DNA, 25 bp, Rattus norvegicus
aaattggctcatatcctacgtgatg

SEQ ID NO: 19170 - DNA, 25 bp, Rattus norvegicus
aaattggctcatttcctacgtgatg

SEQ ID NO: 19171 - DNA, 25 bp, Rattus norvegicus
aaattggctgtgctggctgccttaa

SEQ ID NO: 19172 - DNA, 25 bp, Rattus norvegicus
aaattggctgtggtggctgccttaa

SEQ ID NO: 19173 - DNA, 25 bp, Rattus norvegicus
aaattggctttgcagtgcttcaccc

SEQ ID NO: 19174 - DNA, 25 bp, Rattus norvegicus
aaattggctttggagtgcttcaccc

SEQ ID NO: 19175 - DNA, 25 bp, Rattus norvegicus
aaattgggctggatttcattcctca

SEQ ID NO: 19176 - DNA, 25 bp, Rattus norvegicus
aaattgggctggcaagacttctcag

SEQ ID NO: 19177 - DNA, 25 bp, Rattus norvegicus
aaattgggctgggaagacttctcag

SEQ ID NO: 19178 - DNA, 25 bp, Rattus norvegicus
aaattgggctggttttcattcctca

SEQ ID NO: 19179 - DNA, 25 bp, Rattus norvegicus
aaattgggttcaagacgcagtctcc

SEQ ID NO: 19180 - DNA, 25 bp, Rattus norvegicus
aaattgggttcatgacgcagtctcc

SEQ ID NO: 19181 - DNA, 25 bp, Rattus norvegicus
aaattggtagccaccatgtcatggg

SEQ ID NO: 19182 - DNA, 25 bp, Rattus norvegicus
aaattggtagcctccatgtcatggg

SEQ ID NO: 19183 - DNA, 25 bp, Rattus norvegicus
aaattggtctcgctagcctgtcctt

SEQ ID NO: 19184 - DNA, 25 bp, Rattus norvegicus
aaattggtctcggtagcctgtcctt

SEQ ID NO: 19185 - DNA, 25 bp, Rattus norvegicus
aaattggtgtgacacatgctcatgc

SEQ ID NO: 19186 - DNA, 25 bp, Rattus norvegicus
aaattggtgtgagacatgctcatgc

SEQ ID NO: 19187 - DNA, 25 bp, Rattus norvegicus
aaattgtaacttcagacgtccacct

SEQ ID NO: 19188 - DNA, 25 bp, Rattus norvegicus
aaattgtaacttgagacgtccacct

SEQ ID NO: 19189 - DNA, 25 bp, Rattus norvegicus
aaattgtacactaagcagggagcta

SEQ ID NO: 19190 - DNA, 25 bp, Rattus norvegicus
aaattgtacacttagcagggagcta

SEQ ID NO: 19191 - DNA, 25 bp, Rattus norvegicus
aaattgtagcctatgtgcctttcaa

SEQ ID NO: 19192 - DNA, 25 bp, Rattus norvegicus
aaattgtagcctttgtgcctttcaa

SEQ ID NO: 19193 - DNA, 25 bp, Rattus norvegicus
aaattgtagggtatctcctctcagc

SEQ ID NO: 19194 - DNA, 25 bp, Rattus norvegicus
aaattgtagggtttctcctctcagc

SEQ ID NO: 19195 - DNA, 25 bp, Rattus norvegicus
aaattgtatcggagtctccagggct

SEQ ID NO: 19196 - DNA, 25 bp, Rattus norvegicus
aaattgtatcggtgtctccagggct

SEQ ID NO: 19197 - DNA, 25 bp, Rattus norvegicus
aaattgtcaactaccttgcccaaca

SEQ ID NO: 19198 - DNA, 25 bp, Rattus norvegicus
aaattgtcaacttccttgcccaaca

SEQ ID NO: 19199 - DNA, 25 bp, Rattus norvegicus
aaattgtcagatctcaccacttcct

SEQ ID NO: 19200 - DNA, 25 bp, Rattus norvegicus
aaattgtcagatgtcaccacttcct

SEQ ID NO: 19201 - DNA, 25 bp, Rattus norvegicus
aaattgtcagccattcctgtatccg

SEQ ID NO: 19202 - DNA, 25 bp, Rattus norvegicus
aaattgtcagcctttcctgtatccg

SEQ ID NO: 19203 - DNA, 25 bp, Rattus norvegicus
aaattgtcatctctcatcaagtatg

SEQ ID NO: 19204 - DNA, 25 bp, Rattus norvegicus
aaattgtcatctgtcatcaagtatg

SEQ ID NO: 19205 - DNA, 25 bp, Rattus norvegicus
aaattgtcatttactccgcaccagg

SEQ ID NO: 19206 - DNA, 25 bp, Rattus norvegicus
aaattgtcattttctccgcaccagg

SEQ ID NO: 19207 - DNA, 25 bp, Rattus norvegicus
aaattgtccttcatttgggagacca

SEQ ID NO: 19208 - DNA, 25 bp, Rattus norvegicus
aaattgtccttcttttgggagacca

SEQ ID NO: 19209 - DNA, 25 bp, Rattus norvegicus
aaattgtcctttagataccatcttg

SEQ ID NO: 19210 - DNA, 25 bp, Rattus norvegicus
aaattgtccttttgataccatcttg

SEQ ID NO: 19211 - DNA, 25 bp, Rattus norvegicus
aaattgtctcctattcattgtgccc

SEQ ID NO: 19212 - DNA, 25 bp, Rattus norvegicus
aaattgtctccttttcattgtgccc

SEQ ID NO: 19213 - DNA, 25 bp, Rattus norvegicus
aaattgtctgtccttgccctatatg

SEQ ID NO: 19214 - DNA, 25 bp, Rattus norvegicus
aaattgtctgtcgttgccctatatg

SEQ ID NO: 19215 - DNA, 25 bp, Rattus norvegicus
aaattgtgaactcctagcttttaag

SEQ ID NO: 19216 - DNA, 25 bp, Rattus norvegicus
aaattgtgaactgctagcttttaag

SEQ ID NO: 19217 - DNA, 25 bp, Rattus norvegicus
aaattgtgacacacactggacccca

SEQ ID NO: 19218 - DNA, 25 bp, Rattus norvegicus
aaattgtgacactcactggacccca

SEQ ID NO: 19219 - DNA, 25 bp, Rattus norvegicus
aaattgtgacttccttcgggtgcat

SEQ ID NO: 19220 - DNA, 25 bp, Rattus norvegicus
aaattgtgacttgcttcgggtgcat

SEQ ID NO: 19221 - DNA, 25 bp, Rattus norvegicus
aaattgtgagctactttctgcatcc

SEQ ID NO: 19222 - DNA, 25 bp, Rattus norvegicus
aaattgtgagcttctttctgcatcc

SEQ ID NO: 19223 - DNA, 25 bp, Rattus norvegicus
aaattgtgcaggcttttcctcagac

SEQ ID NO: 19224 - DNA, 25 bp, Rattus norvegicus
aaattgtgcagggttttcctcagac

SEQ ID NO: 19225 - DNA, 25 bp, Rattus norvegicus
aaattgtgcagtcttttcatagaga

SEQ ID NO: 19226 - DNA, 25 bp, Rattus norvegicus
aaattgtgcagtgttttcatagaga

SEQ ID NO: 19227 - DNA, 25 bp, Rattus norvegicus
aaattgtgcatcagctgcccagtaa

SEQ ID NO: 19228 - DNA, 25 bp, Rattus norvegicus
aaattgtgcatctgctgcccagtaa

SEQ ID NO: 19229 - DNA, 25 bp, Rattus norvegicus
aaattgtgcccaacaccagtgtttt

SEQ ID NO: 19230 - DNA, 25 bp, Rattus norvegicus
aaattgtgcccacaggttgctttca

SEQ ID NO: 19231 - DNA, 25 bp, Rattus norvegicus
aaattgtgcccagaggttgctttca

SEQ ID NO: 19232 - DNA, 25 bp, Rattus norvegicus
aaattgtgcccatcaccagtgtttt

SEQ ID NO: 19233 - DNA, 25 bp, Rattus norvegicus
aaattgtgccttcgtctatcctatt

SEQ ID NO: 19234 - DNA, 25 bp, Rattus norvegicus
aaattgtgccttggtctatcctatt

SEQ ID NO: 19235 - DNA, 25 bp, Rattus norvegicus
aaattgtgctacagtgtgtgcgtgt

SEQ ID NO: 19236 - DNA, 25 bp, Rattus norvegicus
aaattgtgctactgtgtgtgcgtgt

SEQ ID NO: 19237 - DNA, 25 bp, Rattus norvegicus
aaattgtggaataggcctctggaca

SEQ ID NO: 19238 - DNA, 25 bp, Rattus norvegicus
aaattgtggaattggcctctggaca

SEQ ID NO: 19239 - DNA, 25 bp, Rattus norvegicus
aaattgtggtatctttttgctgtat

SEQ ID NO: 19240 - DNA, 25 bp, Rattus norvegicus
aaattgtggtatgtttttgctgtat

SEQ ID NO: 19241 - DNA, 25 bp, Rattus norvegicus
aaattgtgtatacccgccaggatcc

SEQ ID NO: 19242 - DNA, 25 bp, Rattus norvegicus
aaattgtgtatagccgccaggatcc

SEQ ID NO: 19243 - DNA, 25 bp, Rattus norvegicus
aaattgtgtcctcacctccgcatat

SEQ ID NO: 19244 - DNA, 25 bp, Rattus norvegicus
aaattgtgtcctgacctccgcatat

SEQ ID NO: 19245 - DNA, 25 bp, Rattus norvegicus
aaattgtgtcgactgtgcactcact

SEQ ID NO: 19246 - DNA, 25 bp, Rattus norvegicus
aaattgtgtcgagtgtgcactcact

SEQ ID NO: 19247 - DNA, 25 bp, Rattus norvegicus
aaattgtgtttgcttctcaggtcct

SEQ ID NO: 19248 - DNA, 25 bp, Rattus norvegicus
aaattgtgtttggttctcaggtcct

SEQ ID NO: 19249 - DNA, 25 bp, Rattus norvegicus
aaattgttccaaagagccatgtgtt

SEQ ID NO: 19250 - DNA, 25 bp, Rattus norvegicus
aaattgttccaatgagccatgtgtt

SEQ ID NO: 19251 - DNA, 25 bp, Rattus norvegicus
aaattgttcctgcagctgatttcct

SEQ ID NO: 19252 - DNA, 25 bp, Rattus norvegicus
aaattgttcctggagctgatttcct

SEQ ID NO: 19253 - DNA, 25 bp, Rattus norvegicus
aaattgttcgagatcgctgcttgtt

SEQ ID NO: 19254 - DNA, 25 bp, Rattus norvegicus
aaattgttcgagttcgctgcttgtt

SEQ ID NO: 19255 - DNA, 25 bp, Rattus norvegicus
aaattgttctctaagtcctcgtgga

SEQ ID NO: 19256 - DNA, 25 bp, Rattus norvegicus
aaattgttctcttagtcctcgtgga

SEQ ID NO: 19257 - DNA, 25 bp, Rattus norvegicus
aaattgttcttaagggtcgcaggag

SEQ ID NO: 19258 - DNA, 25 bp, Rattus norvegicus
aaattgttcttatgggtcgcaggag

SEQ ID NO: 19259 - DNA, 25 bp, Rattus norvegicus
aaattgttgcttagatcctctgcta

SEQ ID NO: 19260 - DNA, 25 bp, Rattus norvegicus
aaattgttgctttgatcctctgcta

SEQ ID NO: 19261 - DNA, 25 bp, Rattus norvegicus
aaattgttgtctcttaccacacact

SEQ ID NO: 19262 - DNA, 25 bp, Rattus norvegicus
aaattgttgtctgttaccacacact

SEQ ID NO: 19263 - DNA, 25 bp, Rattus norvegicus
aaattgtttccgcaaagctctgctc

SEQ ID NO: 19264 - DNA, 25 bp, Rattus norvegicus
aaattgtttccggaaagctctgctc

SEQ ID NO: 19265 - DNA, 25 bp, Rattus norvegicus
aaattgtttgcacgctctcttaccg

SEQ ID NO: 19266 - DNA, 25 bp, Rattus norvegicus
aaattgtttgcaggctctcttaccg

SEQ ID NO: 19267 - DNA, 25 bp, Rattus norvegicus
aaattgttttctcttgctgtgataa

SEQ ID NO: 19268 - DNA, 25 bp, Rattus norvegicus
aaattgttttctgttgctgtgataa

SEQ ID NO: 19269 - DNA, 25 bp, Rattus norvegicus
aaatttaaccagcagctgtcagctc

SEQ ID NO: 19270 - DNA, 25 bp, Rattus norvegicus
aaatttaaccaggagctgtcagctc

SEQ ID NO: 19271 - DNA, 25 bp, Rattus norvegicus
aaatttaagacaccgaggtgaggac

SEQ ID NO: 19272 - DNA, 25 bp, Rattus norvegicus
aaatttaagacagcgaggtgaggac

SEQ ID NO: 19273 - DNA, 25 bp, Rattus norvegicus
aaatttaagacccagctatgttgct

SEQ ID NO: 19274 - DNA, 25 bp, Rattus norvegicus
aaatttaagaccgagctatgttgct

SEQ ID NO: 19275 - DNA, 25 bp, Rattus norvegicus
aaatttaattcaaccttctgacgaa

SEQ ID NO: 19276 - DNA, 25 bp, Rattus norvegicus
aaatttaattcatccttctgacgaa

SEQ ID NO: 19277 - DNA, 25 bp, Rattus norvegicus
aaatttacatttactgaggtggtga

SEQ ID NO: 19278 - DNA, 25 bp, Rattus norvegicus
aaatttacattttctgaggtggtga

SEQ ID NO: 19279 - DNA, 25 bp, Rattus norvegicus
aaatttaggtttctcttcaattgct

SEQ ID NO: 19280 - DNA, 25 bp, Rattus norvegicus
aaatttaggtttgtcttcaattgct

SEQ ID NO: 19281 - DNA, 25 bp, Rattus norvegicus
aaatttatactaactcagaagcaca

SEQ ID NO: 19282 - DNA, 25 bp, Rattus norvegicus
aaatttatactatctcagaagcaca

SEQ ID NO: 19283 - DNA, 25 bp, Rattus norvegicus
aaatttatctacaggtcgtttgaca

SEQ ID NO: 19284 - DNA, 25 bp, Rattus norvegicus
aaatttatctactggtcgtttgaca

SEQ ID NO: 19285 - DNA, 25 bp, Rattus norvegicus
aaatttatcttccttgcttaccact

SEQ ID NO: 19286 - DNA, 25 bp, Rattus norvegicus
aaatttatcttcgttgcttaccact

SEQ ID NO: 19287 - DNA, 25 bp, Rattus norvegicus
aaatttatggtcactctggcttttc

SEQ ID NO: 19288 - DNA, 25 bp, Rattus norvegicus
aaatttatggtctctctggcttttc

SEQ ID NO: 19289 - DNA, 25 bp, Rattus norvegicus
aaatttattgctcctttcttgtcat

SEQ ID NO: 19290 - DNA, 25 bp, Rattus norvegicus
aaatttattgctgctttcttgtcat

SEQ ID NO: 19291 - DNA, 25 bp, Rattus norvegicus
aaatttattttgacatccagccagg

SEQ ID NO: 19292 - DNA, 25 bp, Rattus norvegicus
aaatttattttgtcatccagccagg

SEQ ID NO: 19293 - DNA, 25 bp, Rattus norvegicus
aaatttcaacttccactccttggct

SEQ ID NO: 19294 - DNA, 25 bp, Rattus norvegicus
aaatttcaacttgcactccttggct

SEQ ID NO: 19295 - DNA, 25 bp, Rattus norvegicus
aaatttcacgggaagctcacatcaa

SEQ ID NO: 19296 - DNA, 25 bp, Rattus norvegicus
aaatttcacgggtagctcacatcaa

SEQ ID NO: 19297 - DNA, 25 bp, Rattus norvegicus
aaatttcagaggagctctccagctc

SEQ ID NO: 19298 - DNA, 25 bp, Rattus norvegicus
aaatttcagaggtgctctccagctc

SEQ ID NO: 19299 - DNA, 25 bp, Rattus norvegicus
aaatttcaggccattgtggtgttgg

SEQ ID NO: 19300 - DNA, 25 bp, Rattus norvegicus
aaatttcaggcctttgtggtgttgg

SEQ ID NO: 19301 - DNA, 25 bp, Rattus norvegicus
aaatttcaggtgagtccacgctgtc

SEQ ID NO: 19302 - DNA, 25 bp, Rattus norvegicus
aaatttcaggtgtgtccacgctgtc

SEQ ID NO: 19303 - DNA, 25 bp, Rattus norvegicus
aaatttcagttcacagggtgtcacc

SEQ ID NO: 19304 - DNA, 25 bp, Rattus norvegicus
aaatttcagttctcagggtgtcacc

SEQ ID NO: 19305 - DNA, 25 bp, Rattus norvegicus
aaatttcatccgagtctttcctgac

SEQ ID NO: 19306 - DNA, 25 bp, Rattus norvegicus
aaatttcatccgtgtctttcctgac

SEQ ID NO: 19307 - DNA, 25 bp, Rattus norvegicus
aaatttcatgcactctttctacaca

SEQ ID NO: 19308 - DNA, 25 bp, Rattus norvegicus
aaatttcatgcagtctttctacaca

SEQ ID NO: 19309 - DNA, 25 bp, Rattus norvegicus
aaatttcatggccttttctatagaa

SEQ ID NO: 19310 - DNA, 25 bp, Rattus norvegicus
aaatttcatggcgttttctatagaa

SEQ ID NO: 19311 - DNA, 25 bp, Rattus norvegicus
aaatttccaagtccatcacttcagg

SEQ ID NO: 19312 - DNA, 25 bp, Rattus norvegicus
aaatttccaagtgcatcacttcagg

SEQ ID NO: 19313 - DNA, 25 bp, Rattus norvegicus
aaatttccacgaaggtcagtcagcc

SEQ ID NO: 19314 - DNA, 25 bp, Rattus norvegicus
aaatttccacgatggtcagtcagcc

SEQ ID NO: 19315 - DNA, 25 bp, Rattus norvegicus
aaatttccaggtatggcaaattgag

SEQ ID NO: 19316 - DNA, 25 bp, Rattus norvegicus
aaatttccaggtttggcaaattgag

SEQ ID NO: 19317 - DNA, 25 bp, Rattus norvegicus
aaatttccattccagtagaccagca

SEQ ID NO: 19318 - DNA, 25 bp, Rattus norvegicus
aaatttccattcgagtagaccagca

SEQ ID NO: 19319 - DNA, 25 bp, Rattus norvegicus
aaatttcccacgatctgtgtcataa

SEQ ID NO: 19320 - DNA, 25 bp, Rattus norvegicus
aaatttcccacgttctgtgtcataa

SEQ ID NO: 19321 - DNA, 25 bp, Rattus norvegicus
aaatttccctgcaggagatcctgca

SEQ ID NO: 19322 - DNA, 25 bp, Rattus norvegicus
aaatttccctgctggagatcctgca

SEQ ID NO: 19323 - DNA, 25 bp, Rattus norvegicus
aaatttccctttagcttgtgcggct

SEQ ID NO: 19324 - DNA, 25 bp, Rattus norvegicus
aaatttcccttttgcttgtgcggct

SEQ ID NO: 19325 - DNA, 25 bp, Rattus norvegicus
aaatttcctgttaataggtcagtca

SEQ ID NO: 19326 - DNA, 25 bp, Rattus norvegicus
aaatttcctgtttataggtcagtca

SEQ ID NO: 19327 - DNA, 25 bp, Rattus norvegicus
aaatttccttgcattgatttccaat

SEQ ID NO: 19328 - DNA, 25 bp, Rattus norvegicus
aaatttccttgctttgatttccaat

SEQ ID NO: 19329 - DNA, 25 bp, Rattus norvegicus
aaatttcgagacaggctggactgca

SEQ ID NO: 19330 - DNA, 25 bp, Rattus norvegicus
aaatttcgagactggctggactgca

SEQ ID NO: 19331 - DNA, 25 bp, Rattus norvegicus
aaatttcgatacattattctggata

SEQ ID NO: 19332 - DNA, 25 bp, Rattus norvegicus
aaatttcgatactttattctggata

SEQ ID NO: 19333 - DNA, 25 bp, Rattus norvegicus
aaatttcgccatccctggtggacaa

SEQ ID NO: 19334 - DNA, 25 bp, Rattus norvegicus
aaatttcgccatgcctggtggacaa

SEQ ID NO: 19335 - DNA, 25 bp, Rattus norvegicus
aaatttctataaagccacgctccac

SEQ ID NO: 19336 - DNA, 25 bp, Rattus norvegicus
aaatttctataatgccacgctccac

SEQ ID NO: 19337 - DNA, 25 bp, Rattus norvegicus
aaatttctatgcatgtggctttatg

SEQ ID NO: 19338 - DNA, 25 bp, Rattus norvegicus
aaatttctatgcttgtggctttatg

SEQ ID NO: 19339 - DNA, 25 bp, Rattus norvegicus
aaatttctcaccatgtttatcgcac

SEQ ID NO: 19340 - DNA, 25 bp, Rattus norvegicus
aaatttctcaccctgatcctttcct

SEQ ID NO: 19341 - DNA, 25 bp, Rattus norvegicus
aaatttctcaccgtgatcctttcct

SEQ ID NO: 19342 - DNA, 25 bp, Rattus norvegicus
aaatttctcaccttgtttatcgcac

SEQ ID NO: 19343 - DNA, 25 bp, Rattus norvegicus
aaatttctcataagtcttttattgt

SEQ ID NO: 19344 - DNA, 25 bp, Rattus norvegicus
aaatttctcatatgtcttttattgt

SEQ ID NO: 19345 - DNA, 25 bp, Rattus norvegicus
aaatttctcctcagttggtgtgttt

SEQ ID NO: 19346 - DNA, 25 bp, Rattus norvegicus
aaatttctcctctgttggtgtgttt

SEQ ID NO: 19347 - DNA, 25 bp, Rattus norvegicus
aaatttctcgcacaactttattagt

SEQ ID NO: 19348 - DNA, 25 bp, Rattus norvegicus
aaatttctcgcagaactttattagt

SEQ ID NO: 19349 - DNA, 25 bp, Rattus norvegicus
aaatttctctccaggagctgagcct

SEQ ID NO: 19350 - DNA, 25 bp, Rattus norvegicus
aaatttctctcctggagctgagcct

SEQ ID NO: 19351 - DNA, 25 bp, Rattus norvegicus
aaatttctgattccccttgatgtag

SEQ ID NO: 19352 - DNA, 25 bp, Rattus norvegicus
aaatttctgattgcccttgatgtag

SEQ ID NO: 19353 - DNA, 25 bp, Rattus norvegicus
aaatttctgggcatctctcagcaga

SEQ ID NO: 19354 - DNA, 25 bp, Rattus norvegicus
aaatttctgggcttctctcagcaga

SEQ ID NO: 19355 - DNA, 25 bp, Rattus norvegicus
aaatttctgtccctactctagctca

SEQ ID NO: 19356 - DNA, 25 bp, Rattus norvegicus
aaatttctgtccgtactctagctca

SEQ ID NO: 19357 - DNA, 25 bp, Rattus norvegicus
aaatttcttagtcttcttttcacag

SEQ ID NO: 19358 - DNA, 25 bp, Rattus norvegicus
aaatttcttagtgttcttttcacag

SEQ ID NO: 19359 - DNA, 25 bp, Rattus norvegicus
aaatttcttctacggagctgctggc

SEQ ID NO: 19360 - DNA, 25 bp, Rattus norvegicus
aaatttcttctagggagctgctggc

SEQ ID NO: 19361 - DNA, 25 bp, Rattus norvegicus
aaatttcttcttactagctgaacag

SEQ ID NO: 19362 - DNA, 25 bp, Rattus norvegicus
aaatttcttctttctagctgaacag

SEQ ID NO: 19363 - DNA, 25 bp, Rattus norvegicus
aaatttgaccatcggccagctagct

SEQ ID NO: 19364 - DNA, 25 bp, Rattus norvegicus
aaatttgaccatgggccagctagct

SEQ ID NO: 19365 - DNA, 25 bp, Rattus norvegicus
aaatttgactgactgggtgcctaac

SEQ ID NO: 19366 - DNA, 25 bp, Rattus norvegicus
aaatttgactgagtgggtgcctaac

SEQ ID NO: 19367 - DNA, 25 bp, Rattus norvegicus
aaatttgactttctgactgcatgca

SEQ ID NO: 19368 - DNA, 25 bp, Rattus norvegicus
aaatttgactttgtgactgcatgca

SEQ ID NO: 19369 - DNA, 25 bp, Rattus norvegicus
aaatttgagcccaccaagacccact

SEQ ID NO: 19370 - DNA, 25 bp, Rattus norvegicus
aaatttgagccctccaagacccact

SEQ ID NO: 19371 - DNA, 25 bp, Rattus norvegicus
aaatttgaggcaagggtgggccaca

SEQ ID NO: 19372 - DNA, 25 bp, Rattus norvegicus
aaatttgaggcatgggtgggccaca

SEQ ID NO: 19373 - DNA, 25 bp, Rattus norvegicus
aaatttgagtctctgtgccttttac

SEQ ID NO: 19374 - DNA, 25 bp, Rattus norvegicus
aaatttgagtctgtgtgccttttac

SEQ ID NO: 19375 - DNA, 25 bp, Rattus norvegicus
aaatttgatcgccttaactactgta

SEQ ID NO: 19376 - DNA, 25 bp, Rattus norvegicus
aaatttgatcgcgttaactactgta

SEQ ID NO: 19377 - DNA, 25 bp, Rattus norvegicus
aaatttgatgacctatagtcttgaa

SEQ ID NO: 19378 - DNA, 25 bp, Rattus norvegicus
aaatttgatgacgtatagtcttgaa

SEQ ID NO: 19379 - DNA, 25 bp, Rattus norvegicus
aaatttgatttcctgatcccacaag

SEQ ID NO: 19380 - DNA, 25 bp, Rattus norvegicus
aaatttgatttcgtgatcccacaag

SEQ ID NO: 19381 - DNA, 25 bp, Rattus norvegicus
aaatttgcactgatgttttgatgga

SEQ ID NO: 19382 - DNA, 25 bp, Rattus norvegicus
aaatttgcactgttgttttgatgga

SEQ ID NO: 19383 - DNA, 25 bp, Rattus norvegicus
aaatttgcacttacagaacgcgtct

SEQ ID NO: 19384 - DNA, 25 bp, Rattus norvegicus
aaatttgcactttcagaacgcgtct

SEQ ID NO: 19385 - DNA, 25 bp, Rattus norvegicus
aaatttgccaggaaggtgccagcgc

SEQ ID NO: 19386 - DNA, 25 bp, Rattus norvegicus
aaatttgccaggtaggtgccagcgc

SEQ ID NO: 19387 - DNA, 25 bp, Rattus norvegicus
aaatttgccattacagtgcccaaga

SEQ ID NO: 19388 - DNA, 25 bp, Rattus norvegicus
aaatttgccatttcagtgcccaaga

SEQ ID NO: 19389 - DNA, 25 bp, Rattus norvegicus
aaatttgcccttatgcacggaactg

SEQ ID NO: 19390 - DNA, 25 bp, Rattus norvegicus
aaatttgcccttttgcacggaactg

SEQ ID NO: 19391 - DNA, 25 bp, Rattus norvegicus
aaatttgccgtcattcttcctcagc

SEQ ID NO: 19392 - DNA, 25 bp, Rattus norvegicus
aaatttgccgtctttcttcctcagc

SEQ ID NO: 19393 - DNA, 25 bp, Rattus norvegicus
aaatttgcctcaagttgctctgtct

SEQ ID NO: 19394 - DNA, 25 bp, Rattus norvegicus
aaatttgcctcatgttgctctgtct

SEQ ID NO: 19395 - DNA, 25 bp, Rattus norvegicus
aaatttgcctccagtttctatggtc

SEQ ID NO: 19396 - DNA, 25 bp, Rattus norvegicus
aaatttgcctcctgtttctatggtc

SEQ ID NO: 19397 - DNA, 25 bp, Rattus norvegicus
aaatttgcctttatccagatcagag

SEQ ID NO: 19398 - DNA, 25 bp, Rattus norvegicus
aaatttgcctttttccagatcagag

SEQ ID NO: 19399 - DNA, 25 bp, Rattus norvegicus
aaatttgcgtgtatagtccctggtg

SEQ ID NO: 19400 - DNA, 25 bp, Rattus norvegicus
aaatttgcgtgtttagtccctggtg

SEQ ID NO: 19401 - DNA, 25 bp, Rattus norvegicus
aaatttgctcggattccttagcgat

SEQ ID NO: 19402 - DNA, 25 bp, Rattus norvegicus
aaatttgctcggtttccttagcgat

SEQ ID NO: 19403 - DNA, 25 bp, Rattus norvegicus
aaatttgctgcaactgtcactgtac

SEQ ID NO: 19404 - DNA, 25 bp, Rattus norvegicus
aaatttgctgcatctgtcactgtac

SEQ ID NO: 19405 - DNA, 25 bp, Rattus norvegicus
aaatttgcttccacagtattctgct

SEQ ID NO: 19406 - DNA, 25 bp, Rattus norvegicus
aaatttgcttcctcagtattctgct

SEQ ID NO: 19407 - DNA, 25 bp, Rattus norvegicus
aaatttgcttggcttaatgctcccg

SEQ ID NO: 19408 - DNA, 25 bp, Rattus norvegicus
aaatttgcttgggttaatgctcccg

SEQ ID NO: 19409 - DNA, 25 bp, Rattus norvegicus
aaatttggaagcctcatgggtgtct

SEQ ID NO: 19410 - DNA, 25 bp, Rattus norvegicus
aaatttggaagcgtcatgggtgtct

SEQ ID NO: 19411 - DNA, 25 bp, Rattus norvegicus
aaatttggatggacgtccagagaac

SEQ ID NO: 19412 - DNA, 25 bp, Rattus norvegicus
aaatttggatggtcgtccagagaac

SEQ ID NO: 19413 - DNA, 25 bp, Rattus norvegicus
aaatttggatttcccatgcactgga

SEQ ID NO: 19414 - DNA, 25 bp, Rattus norvegicus
aaatttggatttgccatgcactgga

SEQ ID NO: 19415 - DNA, 25 bp, Rattus norvegicus
aaatttggctctcaaaatgtgttat

SEQ ID NO: 19416 - DNA, 25 bp, Rattus norvegicus
aaatttggctctgaaaatgtgttat

SEQ ID NO: 19417 - DNA, 25 bp, Rattus norvegicus
aaatttgggtctatcacaagctgat

SEQ ID NO: 19418 - DNA, 25 bp, Rattus norvegicus
aaatttgggtctttcacaagctgat

SEQ ID NO: 19419 - DNA, 25 bp, Rattus norvegicus
aaatttggtgtcactgtaccttgtc

SEQ ID NO: 19420 - DNA, 25 bp, Rattus norvegicus
aaatttggtgtctctgtaccttgtc

SEQ ID NO: 19421 - DNA, 25 bp, Rattus norvegicus
aaatttggttttctcatgcgtcgct

SEQ ID NO: 19422 - DNA, 25 bp, Rattus norvegicus
aaatttggttttgtcatgcgtcgct

SEQ ID NO: 19423 - DNA, 25 bp, Rattus norvegicus
aaatttgtacaccaacctgcaagtt

SEQ ID NO: 19424 - DNA, 25 bp, Rattus norvegicus
aaatttgtacacgaacctgcaagtt

SEQ ID NO: 19425 - DNA, 25 bp, Rattus norvegicus
aaatttgtaggcctttgctattcaa

SEQ ID NO: 19426 - DNA, 25 bp, Rattus norvegicus
aaatttgtaggcgtttgctattcaa

SEQ ID NO: 19427 - DNA, 25 bp, Rattus norvegicus
aaatttgtatgaaccacctccagtg

SEQ ID NO: 19428 - DNA, 25 bp, Rattus norvegicus
aaatttgtatgatccacctccagtg

SEQ ID NO: 19429 - DNA, 25 bp, Rattus norvegicus
aaatttgtcacccagctttcataat

SEQ ID NO: 19430 - DNA, 25 bp, Rattus norvegicus
aaatttgtcaccgagctttcataat

SEQ ID NO: 19431 - DNA, 25 bp, Rattus norvegicus
aaatttgtcagcatcagcgacctct

SEQ ID NO: 19432 - DNA, 25 bp, Rattus norvegicus
aaatttgtcagcttcagcgacctct

SEQ ID NO: 19433 - DNA, 25 bp, Rattus norvegicus
aaatttgtcctcctgtcttcacatg

SEQ ID NO: 19434 - DNA, 25 bp, Rattus norvegicus
aaatttgtcctcgtgtcttcacatg

SEQ ID NO: 19435 - DNA, 25 bp, Rattus norvegicus
aaatttgtgcacagactctccatgc

SEQ ID NO: 19436 - DNA, 25 bp, Rattus norvegicus
aaatttgtgcactgactctccatgc

SEQ ID NO: 19437 - DNA, 25 bp, Rattus norvegicus
aaatttgtgccccaggtggacacct

SEQ ID NO: 19438 - DNA, 25 bp, Rattus norvegicus
aaatttgtgcccgaggtggacacct

SEQ ID NO: 19439 - DNA, 25 bp, Rattus norvegicus
aaatttgtgcgtcggacaccaggtg

SEQ ID NO: 19440 - DNA, 25 bp, Rattus norvegicus
aaatttgtgcgtgggacaccaggtg

SEQ ID NO: 19441 - DNA, 25 bp, Rattus norvegicus
aaatttgtgctcattttgtctttga

SEQ ID NO: 19442 - DNA, 25 bp, Rattus norvegicus
aaatttgtgctctttttgtctttga

SEQ ID NO: 19443 - DNA, 25 bp, Rattus norvegicus
aaatttgtgtctagggtctggatgt

SEQ ID NO: 19444 - DNA, 25 bp, Rattus norvegicus
aaatttgtgtcttgggtctggatgt

SEQ ID NO: 19445 - DNA, 25 bp, Rattus norvegicus
aaatttgtgtttctagagcccgagg

SEQ ID NO: 19446 - DNA, 25 bp, Rattus norvegicus
aaatttgtgtttgtagagcccgagg

SEQ ID NO: 19447 - DNA, 25 bp, Rattus norvegicus
aaatttgtttgcagatcatgattca

SEQ ID NO: 19448 - DNA, 25 bp, Rattus norvegicus
aaatttgtttgctgatcatgattca

SEQ ID NO: 19449 - DNA, 25 bp, Rattus norvegicus
aaatttgtttttcctgctccagagt

SEQ ID NO: 19450 - DNA, 25 bp, Rattus norvegicus
aaatttgtttttgctgctccagagt

SEQ ID NO: 19451 - DNA, 25 bp, Rattus norvegicus
aaattttacattaccagggcacatc

SEQ ID NO: 19452 - DNA, 25 bp, Rattus norvegicus
aaattttacatttccagggcacatc

SEQ ID NO: 19453 - DNA, 25 bp, Rattus norvegicus
aaattttaccagatgaccggccgcg

SEQ ID NO: 19454 - DNA, 25 bp, Rattus norvegicus
aaattttaccagttgaccggccgcg

SEQ ID NO: 19455 - DNA, 25 bp, Rattus norvegicus
aaattttacctcagcaggacccgtg

SEQ ID NO: 19456 - DNA, 25 bp, Rattus norvegicus
aaattttacctctgcaggacccgtg

SEQ ID NO: 19457 - DNA, 25 bp, Rattus norvegicus
aaattttactggatgctgttgtgga

SEQ ID NO: 19458 - DNA, 25 bp, Rattus norvegicus
aaattttactggttgctgttgtgga

SEQ ID NO: 19459 - DNA, 25 bp, Rattus norvegicus
aaattttcagtgagctgggcatggc

SEQ ID NO: 19460 - DNA, 25 bp, Rattus norvegicus
aaattttcagtgtgctgggcatggc

SEQ ID NO: 19461 - DNA, 25 bp, Rattus norvegicus
aaattttcatttcctggctttccct

SEQ ID NO: 19462 - DNA, 25 bp, Rattus norvegicus
aaattttcatttgctggctttccct

SEQ ID NO: 19463 - DNA, 25 bp, Rattus norvegicus
aaattttccatgagtttctagccat

SEQ ID NO: 19464 - DNA, 25 bp, Rattus norvegicus
aaattttccatgtgtttctagccat

SEQ ID NO: 19465 - DNA, 25 bp, Rattus norvegicus
aaattttccttactaatgttgctgt

SEQ ID NO: 19466 - DNA, 25 bp, Rattus norvegicus
aaattttccttagtaatgttgctgt

SEQ ID NO: 19467 - DNA, 25 bp, Rattus norvegicus
aaattttctattcctgctagccaca

SEQ ID NO: 19468 - DNA, 25 bp, Rattus norvegicus
aaattttctattgctgctagccaca

SEQ ID NO: 19469 - DNA, 25 bp, Rattus norvegicus
aaattttctcataaacactttgctg

SEQ ID NO: 19470 - DNA, 25 bp, Rattus norvegicus
aaattttctcattaacactttgctg

SEQ ID NO: 19471 - DNA, 25 bp, Rattus norvegicus
aaattttcttcaacttgtacactta

SEQ ID NO: 19472 - DNA, 25 bp, Rattus norvegicus
aaattttcttcatcttgtacactta

SEQ ID NO: 19473 - DNA, 25 bp, Rattus norvegicus
aaattttgagcaaaccgggcactta

SEQ ID NO: 19474 - DNA, 25 bp, Rattus norvegicus
aaattttgagcataccgggcactta

SEQ ID NO: 19475 - DNA, 25 bp, Rattus norvegicus
aaattttgatgtcagtgccccttcc

SEQ ID NO: 19476 - DNA, 25 bp, Rattus norvegicus
aaattttgatgtgagtgccccttcc

SEQ ID NO: 19477 - DNA, 25 bp, Rattus norvegicus
aaattttgcgctcggtgcgatactg

SEQ ID NO: 19478 - DNA, 25 bp, Rattus norvegicus
aaattttgcgctgggtgcgatactg

SEQ ID NO: 19479 - DNA, 25 bp, Rattus norvegicus
aaattttggccccacaggcattggg

SEQ ID NO: 19480 - DNA, 25 bp, Rattus norvegicus
aaattttggcccgacaggcattggg

SEQ ID NO: 19481 - DNA, 25 bp, Rattus norvegicus
aaattttggctgattctttcttcaa

SEQ ID NO: 19482 - DNA, 25 bp, Rattus norvegicus
aaattttggctgtttctttcttcaa

SEQ ID NO: 19483 - DNA, 25 bp, Rattus norvegicus
aaattttggtgacagccacccctat

SEQ ID NO: 19484 - DNA, 25 bp, Rattus norvegicus
aaattttggtgagagccacccctat

SEQ ID NO: 19485 - DNA, 25 bp, Rattus norvegicus
aaattttgtcagctttcgctttcat

SEQ ID NO: 19486 - DNA, 25 bp, Rattus norvegicus
aaattttgtcaggtttcgctttcat

SEQ ID NO: 19487 - DNA, 25 bp, Rattus norvegicus
aaattttgtgctacttgatctgtgt

SEQ ID NO: 19488 - DNA, 25 bp, Rattus norvegicus
aaattttgtgcttcttgatctgtgt

SEQ ID NO: 19489 - DNA, 25 bp, Rattus norvegicus
aaattttgtggaagtctacttgcag

SEQ ID NO: 19490 - DNA, 25 bp, Rattus norvegicus
aaattttgtggatgtctacttgcag

SEQ ID NO: 19491 - DNA, 25 bp, Rattus norvegicus
aaatttttatgtatgctccatcttc

SEQ ID NO: 19492 - DNA, 25 bp, Rattus norvegicus
aaatttttatgtttgctccatcttc

SEQ ID NO: 19493 - DNA, 25 bp, Rattus norvegicus
aaatttttccatctgagatactcag

SEQ ID NO: 19494 - DNA, 25 bp, Rattus norvegicus
aaatttttccatgtgagatactcag

SEQ ID NO: 19495 - DNA, 25 bp, Rattus norvegicus
aaatttttgcctattctctgctaca

SEQ ID NO: 19496 - DNA, 25 bp, Rattus norvegicus
aaatttttgccttttctctgctaca

SEQ ID NO: 19497 - DNA, 25 bp, Rattus norvegicus
aaatttttgtgcagtctttcccaag

SEQ ID NO: 19498 - DNA, 25 bp, Rattus norvegicus
aaatttttgtgctgtctttcccaag

SEQ ID NO: 19499 - DNA, 25 bp, Rattus norvegicus
aacaaaaaatttacaccagagcatt

SEQ ID NO: 19500 - DNA, 25 bp, Rattus norvegicus
aacaaaaaattttcaccagagcatt

SEQ ID NO: 19501 - DNA, 25 bp, Rattus norvegicus
aacaaaaaggtgacagcctcctccg

SEQ ID NO: 19502 - DNA, 25 bp, Rattus norvegicus
aacaaaaaggtgtcagcctcctccg

SEQ ID NO: 19503 - DNA, 25 bp, Rattus norvegicus
aacaaaacaaccctcattctcttct

SEQ ID NO: 19504 - DNA, 25 bp, Rattus norvegicus
aacaaaacaaccgtcattctcttct

SEQ ID NO: 19505 - DNA, 25 bp, Rattus norvegicus
aacaaaacacgcagtcatccaaaga

SEQ ID NO: 19506 - DNA, 25 bp, Rattus norvegicus
aacaaaacacgctgtcatccaaaga

SEQ ID NO: 19507 - DNA, 25 bp, Rattus norvegicus
aacaaaacagacagtcccctagcca

SEQ ID NO: 19508 - DNA, 25 bp, Rattus norvegicus
aacaaaacagactgtcccctagcca

SEQ ID NO: 19509 - DNA, 25 bp, Rattus norvegicus
aacaaaacatgtctctgcaccagag

SEQ ID NO: 19510 - DNA, 25 bp, Rattus norvegicus
aacaaaacatgtgtctgcaccagag

SEQ ID NO: 19511 - DNA, 25 bp, Rattus norvegicus
aacaaaacccgcaagttagagcagg

SEQ ID NO: 19512 - DNA, 25 bp, Rattus norvegicus
aacaaaacccgctagttagagcagg

SEQ ID NO: 19513 - DNA, 25 bp, Rattus norvegicus
aacaaaacctgtcaacctcagtcac

SEQ ID NO: 19514 - DNA, 25 bp, Rattus norvegicus
aacaaaacctgtgaacctcagtcac

SEQ ID NO: 19515 - DNA, 25 bp, Rattus norvegicus
aacaaaactcctctgtgtgcgtgtg

SEQ ID NO: 19516 - DNA, 25 bp, Rattus norvegicus
aacaaaactcctcttgccatgctgc

SEQ ID NO: 19517 - DNA, 25 bp, Rattus norvegicus
aacaaaactcctgtgtgtgcgtgtg

SEQ ID NO: 19518 - DNA, 25 bp, Rattus norvegicus
aacaaaactcctgttgccatgctgc

SEQ ID NO: 19519 - DNA, 25 bp, Rattus norvegicus
aacaaaactggtccgcattgctctt

SEQ ID NO: 19520 - DNA, 25 bp, Rattus norvegicus
aacaaaactggtgcgcattgctctt

SEQ ID NO: 19521 - DNA, 25 bp, Rattus norvegicus
aacaaaactgtcaggctgggttaca

SEQ ID NO: 19522 - DNA, 25 bp, Rattus norvegicus
aacaaaactgtctggctgggttaca

SEQ ID NO: 19523 - DNA, 25 bp, Rattus norvegicus
aacaaaagagagacacaccgcggtg

SEQ ID NO: 19524 - DNA, 25 bp, Rattus norvegicus
aacaaaagagagtcacaccgcggtg

SEQ ID NO: 19525 - DNA, 25 bp, Rattus norvegicus
aacaaaagaggacccccacatatca

SEQ ID NO: 19526 - DNA, 25 bp, Rattus norvegicus
aacaaaagaggagccccacatatca

SEQ ID NO: 19527 - DNA, 25 bp, Rattus norvegicus
aacaaaagccgaactgaggccagga

SEQ ID NO: 19528 - DNA, 25 bp, Rattus norvegicus
aacaaaagccgatctgaggccagga

SEQ ID NO: 19529 - DNA, 25 bp, Rattus norvegicus
aacaaaagcctgctgtttgcccagt

SEQ ID NO: 19530 - DNA, 25 bp, Rattus norvegicus
aacaaaagcctggtgtttgcccagt

SEQ ID NO: 19531 - DNA, 25 bp, Rattus norvegicus
aacaaaaggctcatctgctcctggg

SEQ ID NO: 19532 - DNA, 25 bp, Rattus norvegicus
aacaaaaggctcttctgctcctggg

SEQ ID NO: 19533 - DNA, 25 bp, Rattus norvegicus
aacaaaatagccaagctgcctcaat

SEQ ID NO: 19534 - DNA, 25 bp, Rattus norvegicus
aacaaaatagcctagctgcctcaat

SEQ ID NO: 19535 - DNA, 25 bp, Rattus norvegicus
aacaaaattgtgatcagtgctgtac

SEQ ID NO: 19536 - DNA, 25 bp, Rattus norvegicus
aacaaaattgtgttcagtgctgtac

SEQ ID NO: 19537 - DNA, 25 bp, Rattus norvegicus
aacaaaatttctatctgcctgaata

SEQ ID NO: 19538 - DNA, 25 bp, Rattus norvegicus
aacaaaatttctttctgcctgaata

SEQ ID NO: 19539 - DNA, 25 bp, Rattus norvegicus
aacaaacacagaacgctcaggacag

SEQ ID NO: 19540 - DNA, 25 bp, Rattus norvegicus
aacaaacacagatcgctcaggacag

SEQ ID NO: 19541 - DNA, 25 bp, Rattus norvegicus
aacaaacacagtagccgggtggcag

SEQ ID NO: 19542 - DNA, 25 bp, Rattus norvegicus
aacaaacacagttgccgggtggcag

SEQ ID NO: 19543 - DNA, 25 bp, Rattus norvegicus
aacaaacaccacattttgcacagcc

SEQ ID NO: 19544 - DNA, 25 bp, Rattus norvegicus
aacaaacaccactttttgcacagcc

SEQ ID NO: 19545 - DNA, 25 bp, Rattus norvegicus
aacaaacaggtgactgcacacgtat

SEQ ID NO: 19546 - DNA, 25 bp, Rattus norvegicus
aacaaacaggtgtctgcacacgtat

SEQ ID NO: 19547 - DNA, 25 bp, Rattus norvegicus
aacaaaccaactagcttctgacctt

SEQ ID NO: 19548 - DNA, 25 bp, Rattus norvegicus
aacaaaccaacttgcttctgacctt

SEQ ID NO: 19549 - DNA, 25 bp, Rattus norvegicus
aacaaaccattgaaaccattgaaga

SEQ ID NO: 19550 - DNA, 25 bp, Rattus norvegicus
aacaaaccattgtaaccattgaaga

SEQ ID NO: 19551 - DNA, 25 bp, Rattus norvegicus
aacaaacctagcaccccgtctggtg

SEQ ID NO: 19552 - DNA, 25 bp, Rattus norvegicus
aacaaacctagctccccgtctggtg

SEQ ID NO: 19553 - DNA, 25 bp, Rattus norvegicus
aacaaacctatgaacttacgcctct

SEQ ID NO: 19554 - DNA, 25 bp, Rattus norvegicus
aacaaacctatgtacttacgcctct

SEQ ID NO: 19555 - DNA, 25 bp, Rattus norvegicus
aacaaacgaaccacctagactcttg

SEQ ID NO: 19556 - DNA, 25 bp, Rattus norvegicus
aacaaacgaacctcctagactcttg

SEQ ID NO: 19557 - DNA, 25 bp, Rattus norvegicus
aacaaacgcgagatcttcagatccc

SEQ ID NO: 19558 - DNA, 25 bp, Rattus norvegicus
aacaaacgcgagttcttcagatccc

SEQ ID NO: 19559 - DNA, 25 bp, Rattus norvegicus
aacaaactcaacaacgtgtggagct

SEQ ID NO: 19560 - DNA, 25 bp, Rattus norvegicus
aacaaactcaactacgtgtggagct

SEQ ID NO: 19561 - DNA, 25 bp, Rattus norvegicus
aacaaactccatactggactaggga

SEQ ID NO: 19562 - DNA, 25 bp, Rattus norvegicus
aacaaactccattctggactaggga

SEQ ID NO: 19563 - DNA, 25 bp, Rattus norvegicus
aacaaactcgtacgctggcgctgga

SEQ ID NO: 19564 - DNA, 25 bp, Rattus norvegicus
aacaaactcgtaggctggcgctgga

SEQ ID NO: 19565 - DNA, 25 bp, Rattus norvegicus
aacaaactcgtcctatgtgtactcc

SEQ ID NO: 19566 - DNA, 25 bp, Rattus norvegicus
aacaaactcgtcgtatgtgtactcc

SEQ ID NO: 19567 - DNA, 25 bp, Rattus norvegicus
aacaaactgccaagaactacgctca

SEQ ID NO: 19568 - DNA, 25 bp, Rattus norvegicus
aacaaactgccatgaactacgctca

SEQ ID NO: 19569 - DNA, 25 bp, Rattus norvegicus
aacaaactgctacgctggctcagaa

SEQ ID NO: 19570 - DNA, 25 bp, Rattus norvegicus
aacaaactgctaggctggctcagaa

SEQ ID NO: 19571 - DNA, 25 bp, Rattus norvegicus
aacaaacttctgcttttcctcaaag

SEQ ID NO: 19572 - DNA, 25 bp, Rattus norvegicus
aacaaacttctggttttcctcaaag

SEQ ID NO: 19573 - DNA, 25 bp, Rattus norvegicus
aacaaacttgtacagccattaccaa

SEQ ID NO: 19574 - DNA, 25 bp, Rattus norvegicus
aacaaacttgtagagccattaccaa

SEQ ID NO: 19575 - DNA, 25 bp, Rattus norvegicus
aacaaagaatgtaccccgcagtgca

SEQ ID NO: 19576 - DNA, 25 bp, Rattus norvegicus
aacaaagaatgttccccgcagtgca

SEQ ID NO: 19577 - DNA, 25 bp, Rattus norvegicus
aacaaagaccgaagcttctgggcct

SEQ ID NO: 19578 - DNA, 25 bp, Rattus norvegicus
aacaaagaccgatgcttctgggcct

SEQ ID NO: 19579 - DNA, 25 bp, Rattus norvegicus
aacaaagacgctcatggctgctgga

SEQ ID NO: 19580 - DNA, 25 bp, Rattus norvegicus
aacaaagacgctgatggctgctgga

SEQ ID NO: 19581 - DNA, 25 bp, Rattus norvegicus
aacaaagagcaaagtcctgtccctt

SEQ ID NO: 19582 - DNA, 25 bp, Rattus norvegicus
aacaaagagcaatgtcctgtccctt

SEQ ID NO: 19583 - DNA, 25 bp, Rattus norvegicus
aacaaagagctcattccttccgtgt

SEQ ID NO: 19584 - DNA, 25 bp, Rattus norvegicus
aacaaagagctctttccttccgtgt

SEQ ID NO: 19585 - DNA, 25 bp, Rattus norvegicus
aacaaagagctgagcttctcccaat

SEQ ID NO: 19586 - DNA, 25 bp, Rattus norvegicus
aacaaagagctgtgcttctcccaat

SEQ ID NO: 19587 - DNA, 25 bp, Rattus norvegicus
aacaaagagttcctgctgagacgca

SEQ ID NO: 19588 - DNA, 25 bp, Rattus norvegicus
aacaaagagttcgtgctgagacgca

SEQ ID NO: 19589 - DNA, 25 bp, Rattus norvegicus
aacaaagattggaagcatcagctgt

SEQ ID NO: 19590 - DNA, 25 bp, Rattus norvegicus
aacaaagattggtagcatcagctgt

SEQ ID NO: 19591 - DNA, 25 bp, Rattus norvegicus
aacaaagcaagactgggagccaccc

SEQ ID NO: 19592 - DNA, 25 bp, Rattus norvegicus
aacaaagcaagagtgggagccaccc

SEQ ID NO: 19593 - DNA, 25 bp, Rattus norvegicus
aacaaagcacttcgtattcatctgt

SEQ ID NO: 19594 - DNA, 25 bp, Rattus norvegicus
aacaaagcacttggtattcatctgt

SEQ ID NO: 19595 - DNA, 25 bp, Rattus norvegicus
aacaaagcagctcttttggatcaaa

SEQ ID NO: 19596 - DNA, 25 bp, Rattus norvegicus
aacaaagcagctgttttggatcaaa

SEQ ID NO: 19597 - DNA, 25 bp, Rattus norvegicus
aacaaagccaagacatccagccaag

SEQ ID NO: 19598 - DNA, 25 bp, Rattus norvegicus
aacaaagccaagtcatccagccaag

SEQ ID NO: 19599 - DNA, 25 bp, Rattus norvegicus
aacaaagccagcacggaggcacagc

SEQ ID NO: 19600 - DNA, 25 bp, Rattus norvegicus
aacaaagccagctcggaggcacagc

SEQ ID NO: 19601 - DNA, 25 bp, Rattus norvegicus
aacaaagccataacctttcaccgtg

SEQ ID NO: 19602 - DNA, 25 bp, Rattus norvegicus
aacaaagccatatcctttcaccgtg

SEQ ID NO: 19603 - DNA, 25 bp, Rattus norvegicus
aacaaagccggcagtgtagtctgca

SEQ ID NO: 19604 - DNA, 25 bp, Rattus norvegicus
aacaaagccggctgtgtagtctgca

SEQ ID NO: 19605 - DNA, 25 bp, Rattus norvegicus
aacaaagcctgacctgagcctgctg

SEQ ID NO: 19606 - DNA, 25 bp, Rattus norvegicus
aacaaagcctgagctgagcctgctg

SEQ ID NO: 19607 - DNA, 25 bp, Rattus norvegicus
aacaaagctagactgctctcttgag

SEQ ID NO: 19608 - DNA, 25 bp, Rattus norvegicus
aacaaagctagagtgctctcttgag

SEQ ID NO: 19609 - DNA, 25 bp, Rattus norvegicus
aacaaagctgctaccgtccgtgagt

SEQ ID NO: 19610 - DNA, 25 bp, Rattus norvegicus
aacaaagctgcttccgtccgtgagt

SEQ ID NO: 19611 - DNA, 25 bp, Rattus norvegicus
aacaaagctgttagctgctctatgc

SEQ ID NO: 19612 - DNA, 25 bp, Rattus norvegicus
aacaaagctgtttgctgctctatgc

SEQ ID NO: 19613 - DNA, 25 bp, Rattus norvegicus
aacaaaggccctagtgctgtggtct

SEQ ID NO: 19614 - DNA, 25 bp, Rattus norvegicus
aacaaaggcccttgtgctgtggtct

SEQ ID NO: 19615 - DNA, 25 bp, Rattus norvegicus
aacaaagggctgactcatttccctc

SEQ ID NO: 19616 - DNA, 25 bp, Rattus norvegicus
aacaaagggctgtctcatttccctc

SEQ ID NO: 19617 - DNA, 25 bp, Rattus norvegicus
aacaaaggtaatcagcccgccagga

SEQ ID NO: 19618 - DNA, 25 bp, Rattus norvegicus
aacaaaggtaatgagcccgccagga

SEQ ID NO: 19619 - DNA, 25 bp, Rattus norvegicus
aacaaaggtaccacactgatctaag

SEQ ID NO: 19620 - DNA, 25 bp, Rattus norvegicus
aacaaaggtacctcactgatctaag

SEQ ID NO: 19621 - DNA, 25 bp, Rattus norvegicus
aacaaaggttccaatctgatactat

SEQ ID NO: 19622 - DNA, 25 bp, Rattus norvegicus
aacaaaggttcctatctgatactat

SEQ ID NO: 19623 - DNA, 25 bp, Rattus norvegicus
aacaaagtacggagctgcacaccaa

SEQ ID NO: 19624 - DNA, 25 bp, Rattus norvegicus
aacaaagtacggtgctgcacaccaa

SEQ ID NO: 19625 - DNA, 25 bp, Rattus norvegicus
aacaaagtcacccagatactacctc

SEQ ID NO: 19626 - DNA, 25 bp, Rattus norvegicus
aacaaagtcaccgagatactacctc

SEQ ID NO: 19627 - DNA, 25 bp, Rattus norvegicus
aacaaagtcttcagcagtcacagga

SEQ ID NO: 19628 - DNA, 25 bp, Rattus norvegicus
aacaaagtcttctgcagtcacagga

SEQ ID NO: 19629 - DNA, 25 bp, Rattus norvegicus
aacaaagtcttgactagcacaatga

SEQ ID NO: 19630 - DNA, 25 bp, Rattus norvegicus
aacaaagtcttgtctagcacaatga

SEQ ID NO: 19631 - DNA, 25 bp, Rattus norvegicus
aacaaagtggagactccgttcttga

SEQ ID NO: 19632 - DNA, 25 bp, Rattus norvegicus
aacaaagtggagtctccgttcttga

SEQ ID NO: 19633 - DNA, 25 bp, Rattus norvegicus
aacaaagtgttaccccacaggcctt

SEQ ID NO: 19634 - DNA, 25 bp, Rattus norvegicus
aacaaagtgttagcccacaggcctt

SEQ ID NO: 19635 - DNA, 25 bp, Rattus norvegicus
aacaaagttggaattctgcattttc

SEQ ID NO: 19636 - DNA, 25 bp, Rattus norvegicus
aacaaagttggatttctgcattttc

SEQ ID NO: 19637 - DNA, 25 bp, Rattus norvegicus
aacaaagtttctaccatcttccaag

SEQ ID NO: 19638 - DNA, 25 bp, Rattus norvegicus
aacaaagtttcttccatcttccaag

SEQ ID NO: 19639 - DNA, 25 bp, Rattus norvegicus
aacaaatagatcaccatcgcttgcc

SEQ ID NO: 19640 - DNA, 25 bp, Rattus norvegicus
aacaaatagatctccatcgcttgcc

SEQ ID NO: 19641 - DNA, 25 bp, Rattus norvegicus
aacaaatagcaacccggagtcccac

SEQ ID NO: 19642 - DNA, 25 bp, Rattus norvegicus
aacaaatagcaagccggagtcccac

SEQ ID NO: 19643 - DNA, 25 bp, Rattus norvegicus
aacaaatcaaccaagcactcaaaca

SEQ ID NO: 19644 - DNA, 25 bp, Rattus norvegicus
aacaaatcaacctagcactcaaaca

SEQ ID NO: 19645 - DNA, 25 bp, Rattus norvegicus
aacaaatcattgagtcgtgtggtca

SEQ ID NO: 19646 - DNA, 25 bp, Rattus norvegicus
aacaaatcattgtgtcgtgtggtca

SEQ ID NO: 19647 - DNA, 25 bp, Rattus norvegicus
aacaaatcccctcactgtacagtat

SEQ ID NO: 19648 - DNA, 25 bp, Rattus norvegicus
aacaaatcccctgactgtacagtat

SEQ ID NO: 19649 - DNA, 25 bp, Rattus norvegicus
aacaaatcgctgactacaatgccct

SEQ ID NO: 19650 - DNA, 25 bp, Rattus norvegicus
aacaaatcgctgtctacaatgccct

SEQ ID NO: 19651 - DNA, 25 bp, Rattus norvegicus
aacaaatctctgcttcactgaacat

SEQ ID NO: 19652 - DNA, 25 bp, Rattus norvegicus
aacaaatctctggttcactgaacat

SEQ ID NO: 19653 - DNA, 25 bp, Rattus norvegicus
aacaaatgccttatctgaattttac

SEQ ID NO: 19654 - DNA, 25 bp, Rattus norvegicus
aacaaatgccttttctgaattttac

SEQ ID NO: 19655 - DNA, 25 bp, Rattus norvegicus
aacaaatgctgtaacttctcttcct

SEQ ID NO: 19656 - DNA, 25 bp, Rattus norvegicus
aacaaatgctgttacttctcttcct

SEQ ID NO: 19657 - DNA, 25 bp, Rattus norvegicus
aacaaatggacactggtatcgggca

SEQ ID NO: 19658 - DNA, 25 bp, Rattus norvegicus
aacaaatggacagtggtatcgggca

SEQ ID NO: 19659 - DNA, 25 bp, Rattus norvegicus
aacaaatggcataacagtgtcttta

SEQ ID NO: 19660 - DNA, 25 bp, Rattus norvegicus
aacaaatggcattacagtgtcttta

SEQ ID NO: 19661 - DNA, 25 bp, Rattus norvegicus
aacaaatgtaccagtttctgcctcc

SEQ ID NO: 19662 - DNA, 25 bp, Rattus norvegicus
aacaaatgtacctgtttctgcctcc

SEQ ID NO: 19663 - DNA, 25 bp, Rattus norvegicus
aacaaattcagtcctaagaggctgc

SEQ ID NO: 19664 - DNA, 25 bp, Rattus norvegicus
aacaaattcagtgctaagaggctgc

SEQ ID NO: 19665 - DNA, 25 bp, Rattus norvegicus
aacaaattccagacagccctccttt

SEQ ID NO: 19666 - DNA, 25 bp, Rattus norvegicus
aacaaattccagtcagccctccttt

SEQ ID NO: 19667 - DNA, 25 bp, Rattus norvegicus
aacaaattcgctctgtatagtgtcg

SEQ ID NO: 19668 - DNA, 25 bp, Rattus norvegicus
aacaaattcgctgtgtatagtgtcg

SEQ ID NO: 19669 - DNA, 25 bp, Rattus norvegicus
aacaaattcgtcatgagtctggagc

SEQ ID NO: 19670 - DNA, 25 bp, Rattus norvegicus
aacaaattcgtcttgagtctggagc

SEQ ID NO: 19671 - DNA, 25 bp, Rattus norvegicus
aacaaattctatcctaatgctaggg

SEQ ID NO: 19672 - DNA, 25 bp, Rattus norvegicus
aacaaattctatgctaatgctaggg

SEQ ID NO: 19673 - DNA, 25 bp, Rattus norvegicus
aacaaattctgtcccattctggagg

SEQ ID NO: 19674 - DNA, 25 bp, Rattus norvegicus
aacaaattctgtgccattctggagg

SEQ ID NO: 19675 - DNA, 25 bp, Rattus norvegicus
aacaaattgtacatcttccagaggt

SEQ ID NO: 19676 - DNA, 25 bp, Rattus norvegicus
aacaaattgtacttcttccagaggt

SEQ ID NO: 19677 - DNA, 25 bp, Rattus norvegicus
aacaaattgtcacccctgcgtgctg

SEQ ID NO: 19678 - DNA, 25 bp, Rattus norvegicus
aacaaattgtcagccctgcgtgctg

SEQ ID NO: 19679 - DNA, 25 bp, Rattus norvegicus
aacaaatttggaaccgcaagcaagg

SEQ ID NO: 19680 - DNA, 25 bp, Rattus norvegicus
aacaaatttggatccgcaagcaagg

SEQ ID NO: 19681 - DNA, 25 bp, Rattus norvegicus
aacaacaaactcacgctgtccaatg

SEQ ID NO: 19682 - DNA, 25 bp, Rattus norvegicus
aacaacaaactctcgctgtccaatg

SEQ ID NO: 19683 - DNA, 25 bp, Rattus norvegicus
aacaacaaatcaaccaaacccttgc

SEQ ID NO: 19684 - DNA, 25 bp, Rattus norvegicus
aacaacaaatcatccaaacccttgc

SEQ ID NO: 19685 - DNA, 25 bp, Rattus norvegicus
aacaacaacacgctttctcaatggg

SEQ ID NO: 19686 - DNA, 25 bp, Rattus norvegicus
aacaacaacacggtttctcaatggg

SEQ ID NO: 19687 - DNA, 25 bp, Rattus norvegicus
aacaacaacagaaaccagggtgcct

SEQ ID NO: 19688 - DNA, 25 bp, Rattus norvegicus
aacaacaacagataccagggtgcct

SEQ ID NO: 19689 - DNA, 25 bp, Rattus norvegicus
aacaacaagatgaggtttcaaagcc

SEQ ID NO: 19690 - DNA, 25 bp, Rattus norvegicus
aacaacaagatgtggtttcaaagcc

SEQ ID NO: 19691 - DNA, 25 bp, Rattus norvegicus
aacaacaagctcatcttcaacgtct

SEQ ID NO: 19692 - DNA, 25 bp, Rattus norvegicus
aacaacaagctcttcttcaacgtct

SEQ ID NO: 19693 - DNA, 25 bp, Rattus norvegicus
aacaacaatcaacccaaagcatcct

SEQ ID NO: 19694 - DNA, 25 bp, Rattus norvegicus
aacaacaatcaagccaaagcatcct

SEQ ID NO: 19695 - DNA, 25 bp, Rattus norvegicus
aacaacacagtaatccgcagtcaaa

SEQ ID NO: 19696 - DNA, 25 bp, Rattus norvegicus
aacaacacagtattccgcagtcaaa

SEQ ID NO: 19697 - DNA, 25 bp, Rattus norvegicus
aacaacaccattactgtgcttctct

SEQ ID NO: 19698 - DNA, 25 bp, Rattus norvegicus
aacaacaccatttctgtgcttctct

SEQ ID NO: 19699 - DNA, 25 bp, Rattus norvegicus
aacaacacctgtagcttctgctggt

SEQ ID NO: 19700 - DNA, 25 bp, Rattus norvegicus
aacaacacctgttgcttctgctggt

SEQ ID NO: 19701 - DNA, 25 bp, Rattus norvegicus
aacaacaccttgcagcacagacgtg

SEQ ID NO: 19702 - DNA, 25 bp, Rattus norvegicus
aacaacaccttggagcacagacgtg

SEQ ID NO: 19703 - DNA, 25 bp, Rattus norvegicus
aacaacacttgacttctgcacagat

SEQ ID NO: 19704 - DNA, 25 bp, Rattus norvegicus
aacaacacttgagttctgcacagat

SEQ ID NO: 19705 - DNA, 25 bp, Rattus norvegicus
aacaacactttgaccatacttctgt

SEQ ID NO: 19706 - DNA, 25 bp, Rattus norvegicus
aacaacactttgtccatacttctgt

SEQ ID NO: 19707 - DNA, 25 bp, Rattus norvegicus
aacaacagcatgaatcttgatctat

SEQ ID NO: 19708 - DNA, 25 bp, Rattus norvegicus
aacaacagcatgtatcttgatctat

SEQ ID NO: 19709 - DNA, 25 bp, Rattus norvegicus
aacaacagccgcaggtagtaactga

SEQ ID NO: 19710 - DNA, 25 bp, Rattus norvegicus
aacaacagccgctggtagtaactga

SEQ ID NO: 19711 - DNA, 25 bp, Rattus norvegicus
aacaacaggaatccttaactttaag

SEQ ID NO: 19712 - DNA, 25 bp, Rattus norvegicus
aacaacaggaatgcttaactttaag

SEQ ID NO: 19713 - DNA, 25 bp, Rattus norvegicus
aacaacaggcgcaccaggccagagt

SEQ ID NO: 19714 - DNA, 25 bp, Rattus norvegicus
aacaacaggcgctccaggccagagt

SEQ ID NO: 19715 - DNA, 25 bp, Rattus norvegicus
aacaacagtctgaactccttcggag

SEQ ID NO: 19716 - DNA, 25 bp, Rattus norvegicus
aacaacagtctgtactccttcggag

SEQ ID NO: 19717 - DNA, 25 bp, Rattus norvegicus
aacaacagtgtcacttttttcctag

SEQ ID NO: 19718 - DNA, 25 bp, Rattus norvegicus
aacaacagtgtcatgcccagaagat

SEQ ID NO: 19719 - DNA, 25 bp, Rattus norvegicus
aacaacagtgtctcttttttcctag

SEQ ID NO: 19720 - DNA, 25 bp, Rattus norvegicus
aacaacagtgtcttgcccagaagat

SEQ ID NO: 19721 - DNA, 25 bp, Rattus norvegicus
aacaacagttggacccgaggctgat

SEQ ID NO: 19722 - DNA, 25 bp, Rattus norvegicus
aacaacagttggtcccgaggctgat

SEQ ID NO: 19723 - DNA, 25 bp, Rattus norvegicus
aacaacatcaacaacctcacgggct

SEQ ID NO: 19724 - DNA, 25 bp, Rattus norvegicus
aacaacatcaactacctcacgggct

SEQ ID NO: 19725 - DNA, 25 bp, Rattus norvegicus
aacaacatccctagttctgctgtgt

SEQ ID NO: 19726 - DNA, 25 bp, Rattus norvegicus
aacaacatcccttgttctgctgtgt

SEQ ID NO: 19727 - DNA, 25 bp, Rattus norvegicus
aacaacatccttctacctctatgtg

SEQ ID NO: 19728 - DNA, 25 bp, Rattus norvegicus
aacaacatccttgtacctctatgtg

SEQ ID NO: 19729 - DNA, 25 bp, Rattus norvegicus
aacaacatgcgtcctcaatcataac

SEQ ID NO: 19730 - DNA, 25 bp, Rattus norvegicus
aacaacatgcgtgctcaatcataac

SEQ ID NO: 19731 - DNA, 25 bp, Rattus norvegicus
aacaacatgctacgtggtatcacat

SEQ ID NO: 19732 - DNA, 25 bp, Rattus norvegicus
aacaacatgctaggtggtatcacat

SEQ ID NO: 19733 - DNA, 25 bp, Rattus norvegicus
aacaacatgtctattctcaaataca

SEQ ID NO: 19734 - DNA, 25 bp, Rattus norvegicus
aacaacatgtcttttctcaaataca

SEQ ID NO: 19735 - DNA, 25 bp, Rattus norvegicus
aacaacattggcaccatagcaagaa

SEQ ID NO: 19736 - DNA, 25 bp, Rattus norvegicus
aacaacattggctccatagcaagaa

SEQ ID NO: 19737 - DNA, 25 bp, Rattus norvegicus
aacaacatttgtcgccttctcttaa

SEQ ID NO: 19738 - DNA, 25 bp, Rattus norvegicus
aacaacatttgtggccttctcttaa

SEQ ID NO: 19739 - DNA, 25 bp, Rattus norvegicus
aacaaccaacagagtgcacgctgcg

SEQ ID NO: 19740 - DNA, 25 bp, Rattus norvegicus
aacaaccaacagtgtgcacgctgcg

SEQ ID NO: 19741 - DNA, 25 bp, Rattus norvegicus
aacaaccacaagcagtctgggctct

SEQ ID NO: 19742 - DNA, 25 bp, Rattus norvegicus
aacaaccacaaggagtctgggctct

SEQ ID NO: 19743 - DNA, 25 bp, Rattus norvegicus
aacaaccacactcaactgctaggaa

SEQ ID NO: 19744 - DNA, 25 bp, Rattus norvegicus
aacaaccacactgaactgctaggaa

SEQ ID NO: 19745 - DNA, 25 bp, Rattus norvegicus
aacaaccagatgagggccttcccaa

SEQ ID NO: 19746 - DNA, 25 bp, Rattus norvegicus
aacaaccagatgtgggccttcccaa

SEQ ID NO: 19747 - DNA, 25 bp, Rattus norvegicus
aacaaccagtatatcaaccatcacc

SEQ ID NO: 19748 - DNA, 25 bp, Rattus norvegicus
aacaaccagtatttcaaccatcacc

SEQ ID NO: 19749 - DNA, 25 bp, Rattus norvegicus
aacaacccacagcaatgtctgcaag

SEQ ID NO: 19750 - DNA, 25 bp, Rattus norvegicus
aacaacccacaggaatgtctgcaag

SEQ ID NO: 19751 - DNA, 25 bp, Rattus norvegicus
aacaacccggcacctcagagaggag

SEQ ID NO: 19752 - DNA, 25 bp, Rattus norvegicus
aacaacccggcagctcagagaggag

SEQ ID NO: 19753 - DNA, 25 bp, Rattus norvegicus
aacaacccgttgaatggtgacgtga

SEQ ID NO: 19754 - DNA, 25 bp, Rattus norvegicus
aacaacccgttgtatggtgacgtga

SEQ ID NO: 19755 - DNA, 25 bp, Rattus norvegicus
aacaaccctattcagaaggccccat

SEQ ID NO: 19756 - DNA, 25 bp, Rattus norvegicus
aacaaccctattgagaaggccccat

SEQ ID NO: 19757 - DNA, 25 bp, Rattus norvegicus
aacaacccttgtccctttgattttg

SEQ ID NO: 19758 - DNA, 25 bp, Rattus norvegicus
aacaacccttgtgcctttgattttg

SEQ ID NO: 19759 - DNA, 25 bp, Rattus norvegicus
aacaaccgcacaactcagtttggaa

SEQ ID NO: 19760 - DNA, 25 bp, Rattus norvegicus
aacaaccgcacatctcagtttggaa

SEQ ID NO: 19761 - DNA, 25 bp, Rattus norvegicus
aacaacctaggtctcccacaataga

SEQ ID NO: 19762 - DNA, 25 bp, Rattus norvegicus
aacaacctaggtgtcccacaataga

SEQ ID NO: 19763 - DNA, 25 bp, Rattus norvegicus
aacaacctctctccgttaagacaac

SEQ ID NO: 19764 - DNA, 25 bp, Rattus norvegicus
aacaacctctctgcgttaagacaac

SEQ ID NO: 19765 - DNA, 25 bp, Rattus norvegicus
aacaacctggtcattgctcattctg

SEQ ID NO: 19766 - DNA, 25 bp, Rattus norvegicus
aacaacctggtctttgctcattctg

SEQ ID NO: 19767 - DNA, 25 bp, Rattus norvegicus
aacaacctgtaacggctggccctgc

SEQ ID NO: 19768 - DNA, 25 bp, Rattus norvegicus
aacaacctgtaagggctggccctgc

SEQ ID NO: 19769 - DNA, 25 bp, Rattus norvegicus
aacaacctgtgtatgcttggcatat

SEQ ID NO: 19770 - DNA, 25 bp, Rattus norvegicus
aacaacctgtgtttgcttggcatat

SEQ ID NO: 19771 - DNA, 25 bp, Rattus norvegicus
aacaaccttaagattgcgcgccatg

SEQ ID NO: 19772 - DNA, 25 bp, Rattus norvegicus
aacaaccttaagtttgcgcgccatg

SEQ ID NO: 19773 - DNA, 25 bp, Rattus norvegicus
aacaaccttaggagtcattctcagg

SEQ ID NO: 19774 - DNA, 25 bp, Rattus norvegicus
aacaaccttaggtgtcattctcagg

SEQ ID NO: 19775 - DNA, 25 bp, Rattus norvegicus
aacaaccttctgcaccttattaata

SEQ ID NO: 19776 - DNA, 25 bp, Rattus norvegicus
aacaaccttctggaccttattaata

SEQ ID NO: 19777 - DNA, 25 bp, Rattus norvegicus
aacaaccttgaaagcccttgagcac

SEQ ID NO: 19778 - DNA, 25 bp, Rattus norvegicus
aacaaccttgaatgcccttgagcac

SEQ ID NO: 19779 - DNA, 25 bp, Rattus norvegicus
aacaaccttgttacgagctgtgaat

SEQ ID NO: 19780 - DNA, 25 bp, Rattus norvegicus
aacaaccttgtttcgagctgtgaat

SEQ ID NO: 19781 - DNA, 25 bp, Rattus norvegicus
aacaacgacttcatttcttatgatc

SEQ ID NO: 19782 - DNA, 25 bp, Rattus norvegicus
aacaacgacttcttttcttatgatc

SEQ ID NO: 19783 - DNA, 25 bp, Rattus norvegicus
aacaacgcaggcatccgagtgtgga

SEQ ID NO: 19784 - DNA, 25 bp, Rattus norvegicus
aacaacgcaggcttccgagtgtgga

SEQ ID NO: 19785 - DNA, 25 bp, Rattus norvegicus
aacaacgctctaacaccagactgtg

SEQ ID NO: 19786 - DNA, 25 bp, Rattus norvegicus
aacaacgctctatcaccagactgtg

SEQ ID NO: 19787 - DNA, 25 bp, Rattus norvegicus
aacaacgctgttattgctaccaaga

SEQ ID NO: 19788 - DNA, 25 bp, Rattus norvegicus
aacaacgctgtttttgctaccaaga

SEQ ID NO: 19789 - DNA, 25 bp, Rattus norvegicus
aacaacgcttttccgaagcctgtag

SEQ ID NO: 19790 - DNA, 25 bp, Rattus norvegicus
aacaacgcttttgcgaagcctgtag

SEQ ID NO: 19791 - DNA, 25 bp, Rattus norvegicus
aacaacggagtcaccaggcagggaa

SEQ ID NO: 19792 - DNA, 25 bp, Rattus norvegicus
aacaacggagtctccaggcagggaa

SEQ ID NO: 19793 - DNA, 25 bp, Rattus norvegicus
aacaacggatttattgcacccaatg

SEQ ID NO: 19794 - DNA, 25 bp, Rattus norvegicus
aacaacggattttttgcacccaatg

SEQ ID NO: 19795 - DNA, 25 bp, Rattus norvegicus
aacaacggtgtcatacacactcacg

SEQ ID NO: 19796 - DNA, 25 bp, Rattus norvegicus
aacaacggtgtcatgtggaaccata

SEQ ID NO: 19797 - DNA, 25 bp, Rattus norvegicus
aacaacggtgtcttacacactcacg

SEQ ID NO: 19798 - DNA, 25 bp, Rattus norvegicus
aacaacggtgtcttgtggaaccata

SEQ ID NO: 19799 - DNA, 25 bp, Rattus norvegicus
aacaacgtaatcagtggcactctcc

SEQ ID NO: 19800 - DNA, 25 bp, Rattus norvegicus
aacaacgtaatctgtggcactctcc

SEQ ID NO: 19801 - DNA, 25 bp, Rattus norvegicus
aacaacgttaccaacatctcgtcgt

SEQ ID NO: 19802 - DNA, 25 bp, Rattus norvegicus
aacaacgttacctacatctcgtcgt

SEQ ID NO: 19803 - DNA, 25 bp, Rattus norvegicus
aacaactagaggaggtgcctcctcc

SEQ ID NO: 19804 - DNA, 25 bp, Rattus norvegicus
aacaactagaggtggtgcctcctcc

SEQ ID NO: 19805 - DNA, 25 bp, Rattus norvegicus
aacaactagccaatcaagtacgagt

SEQ ID NO: 19806 - DNA, 25 bp, Rattus norvegicus
aacaactagccattcaagtacgagt

SEQ ID NO: 19807 - DNA, 25 bp, Rattus norvegicus
aacaactagggcaggtcagaggaca

SEQ ID NO: 19808 - DNA, 25 bp, Rattus norvegicus
aacaactagggctggtcagaggaca

SEQ ID NO: 19809 - DNA, 25 bp, Rattus norvegicus
aacaactatgtcaacttgggcatga

SEQ ID NO: 19810 - DNA, 25 bp, Rattus norvegicus
aacaactatgtctacttgggcatga

SEQ ID NO: 19811 - DNA, 25 bp, Rattus norvegicus
aacaactattcaacagtctcctgct

SEQ ID NO: 19812 - DNA, 25 bp, Rattus norvegicus
aacaactattcatcagtctcctgct

SEQ ID NO: 19813 - DNA, 25 bp, Rattus norvegicus
aacaactcctaccaggttacatctt

SEQ ID NO: 19814 - DNA, 25 bp, Rattus norvegicus
aacaactcctacgaggttacatctt

SEQ ID NO: 19815 - DNA, 25 bp, Rattus norvegicus
aacaactcttctaaggactagtcct

SEQ ID NO: 19816 - DNA, 25 bp, Rattus norvegicus
aacaactcttcttaggactagtcct

SEQ ID NO: 19817 - DNA, 25 bp, Rattus norvegicus
aacaactgaaacaggccatggagca

SEQ ID NO: 19818 - DNA, 25 bp, Rattus norvegicus
aacaactgaaactggccatggagca

SEQ ID NO: 19819 - DNA, 25 bp, Rattus norvegicus
aacaactgccggagatactggtagt

SEQ ID NO: 19820 - DNA, 25 bp, Rattus norvegicus
aacaactgccggtgatactggtagt

SEQ ID NO: 19821 - DNA, 25 bp, Rattus norvegicus
aacaactgcctgcagtgctgcaaca

SEQ ID NO: 19822 - DNA, 25 bp, Rattus norvegicus
aacaactgcctggagtgctgcaaca

SEQ ID NO: 19823 - DNA, 25 bp, Rattus norvegicus
aacaactgcgaacgattctttctgg

SEQ ID NO: 19824 - DNA, 25 bp, Rattus norvegicus
aacaactgcgaaggattctttctgg

SEQ ID NO: 19825 - DNA, 25 bp, Rattus norvegicus
aacaactgctgactagccatccctg

SEQ ID NO: 19826 - DNA, 25 bp, Rattus norvegicus
aacaactgctgagtagccatccctg

SEQ ID NO: 19827 - DNA, 25 bp, Rattus norvegicus
aacaactgctgcctgttatcactgt

SEQ ID NO: 19828 - DNA, 25 bp, Rattus norvegicus
aacaactgctgcgtgttatcactgt

SEQ ID NO: 19829 - DNA, 25 bp, Rattus norvegicus
aacaactggcacaacttcttaggct

SEQ ID NO: 19830 - DNA, 25 bp, Rattus norvegicus
aacaactggcactacttcttaggct

SEQ ID NO: 19831 - DNA, 25 bp, Rattus norvegicus
aacaactggcgcaggtttgatgacc

SEQ ID NO: 19832 - DNA, 25 bp, Rattus norvegicus
aacaactggcgctggtttgatgacc

SEQ ID NO: 19833 - DNA, 25 bp, Rattus norvegicus
aacaactggttccttcaactgggct

SEQ ID NO: 19834 - DNA, 25 bp, Rattus norvegicus
aacaactggttcgttcaactgggct

SEQ ID NO: 19835 - DNA, 25 bp, Rattus norvegicus
aacaactgtactatcaaggaccgat

SEQ ID NO: 19836 - DNA, 25 bp, Rattus norvegicus
aacaactgtactttcaaggaccgat

SEQ ID NO: 19837 - DNA, 25 bp, Rattus norvegicus
aacaactgtctgagggcttcaggaa

SEQ ID NO: 19838 - DNA, 25 bp, Rattus norvegicus
aacaactgtctgtgggcttcaggaa

SEQ ID NO: 19839 - DNA, 25 bp, Rattus norvegicus
aacaactgtgcacggcttacacgat

SEQ ID NO: 19840 - DNA, 25 bp, Rattus norvegicus
aacaactgtgcagggcttacacgat

SEQ ID NO: 19841 - DNA, 25 bp, Rattus norvegicus
aacaactgttagaccacacgaagga

SEQ ID NO: 19842 - DNA, 25 bp, Rattus norvegicus
aacaactgttagtccacacgaagga

SEQ ID NO: 19843 - DNA, 25 bp, Rattus norvegicus
aacaacttacagaagctgcttgaga

SEQ ID NO: 19844 - DNA, 25 bp, Rattus norvegicus
aacaacttacagtagctgcttgaga

SEQ ID NO: 19845 - DNA, 25 bp, Rattus norvegicus
aacaacttatctatcaatatgacct

SEQ ID NO: 19846 - DNA, 25 bp, Rattus norvegicus
aacaacttatctttcaatatgacct

SEQ ID NO: 19847 - DNA, 25 bp, Rattus norvegicus
aacaacttgattccaggctccactt

SEQ ID NO: 19848 - DNA, 25 bp, Rattus norvegicus
aacaacttgattgcaggctccactt

SEQ ID NO: 19849 - DNA, 25 bp, Rattus norvegicus
aacaacttggagcatctggtcctgt

SEQ ID NO: 19850 - DNA, 25 bp, Rattus norvegicus
aacaacttggaggatctggtcctgt

SEQ ID NO: 19851 - DNA, 25 bp, Rattus norvegicus
aacaacttggtaccagagccacact

SEQ ID NO: 19852 - DNA, 25 bp, Rattus norvegicus
aacaacttggtagcagagccacact

SEQ ID NO: 19853 - DNA, 25 bp, Rattus norvegicus
aacaacttggtgctccaagtgccca

SEQ ID NO: 19854 - DNA, 25 bp, Rattus norvegicus
aacaacttggtgctctaaagcggag

SEQ ID NO: 19855 - DNA, 25 bp, Rattus norvegicus
aacaacttggtggtccaagtgccca

SEQ ID NO: 19856 - DNA, 25 bp, Rattus norvegicus
aacaacttggtggtctaaagcggag

SEQ ID NO: 19857 - DNA, 25 bp, Rattus norvegicus
aacaactttagtcatcccagatgct

SEQ ID NO: 19858 - DNA, 25 bp, Rattus norvegicus
aacaactttagtgatcccagatgct

SEQ ID NO: 19859 - DNA, 25 bp, Rattus norvegicus
aacaactttgatcgcttctgtgtgc

SEQ ID NO: 19860 - DNA, 25 bp, Rattus norvegicus
aacaactttgatggcttctgtgtgc

SEQ ID NO: 19861 - DNA, 25 bp, Rattus norvegicus
aacaactttgctaccctggagaaca

SEQ ID NO: 19862 - DNA, 25 bp, Rattus norvegicus
aacaactttgcttccctggagaaca

SEQ ID NO: 19863 - DNA, 25 bp, Rattus norvegicus
aacaagaaagctatcccattggcag

SEQ ID NO: 19864 - DNA, 25 bp, Rattus norvegicus
aacaagaaagctttcccattggcag

SEQ ID NO: 19865 - DNA, 25 bp, Rattus norvegicus
aacaagaagatgaatggcgtctgtg

SEQ ID NO: 19866 - DNA, 25 bp, Rattus norvegicus
aacaagaagatgtatggcgtctgtg

SEQ ID NO: 19867 - DNA, 25 bp, Rattus norvegicus
aacaagaagcttccggagcctctga

SEQ ID NO: 19868 - DNA, 25 bp, Rattus norvegicus
aacaagaagcttgcggagcctctga

SEQ ID NO: 19869 - DNA, 25 bp, Rattus norvegicus
aacaagacccaaacatttaccagag

SEQ ID NO: 19870 - DNA, 25 bp, Rattus norvegicus
aacaagacccaatcatttaccagag

SEQ ID NO: 19871 - DNA, 25 bp, Rattus norvegicus
aacaagacctttccttcgacagata

SEQ ID NO: 19872 - DNA, 25 bp, Rattus norvegicus
aacaagacctttgcttcgacagata

SEQ ID NO: 19873 - DNA, 25 bp, Rattus norvegicus
aacaagacgcgtctgcgcagtggca

SEQ ID NO: 19874 - DNA, 25 bp, Rattus norvegicus
aacaagacgcgtgtgcgcagtggca

SEQ ID NO: 19875 - DNA, 25 bp, Rattus norvegicus
aacaagactacgactgcttcctaag

SEQ ID NO: 19876 - DNA, 25 bp, Rattus norvegicus
aacaagactacgtctgcttcctaag

SEQ ID NO: 19877 - DNA, 25 bp, Rattus norvegicus
aacaagacttctcttttaggtgctg

SEQ ID NO: 19878 - DNA, 25 bp, Rattus norvegicus
aacaagacttctgttttaggtgctg

SEQ ID NO: 19879 - DNA, 25 bp, Rattus norvegicus
aacaagagacgtctgatctcaccct

SEQ ID NO: 19880 - DNA, 25 bp, Rattus norvegicus
aacaagagacgtgtgatctcaccct

SEQ ID NO: 19881 - DNA, 25 bp, Rattus norvegicus
aacaagagaggtagcctgcatgcca

SEQ ID NO: 19882 - DNA, 25 bp, Rattus norvegicus
aacaagagaggttgcctgcatgcca

SEQ ID NO: 19883 - DNA, 25 bp, Rattus norvegicus
aacaagagccagagttgtagcaact

SEQ ID NO: 19884 - DNA, 25 bp, Rattus norvegicus
aacaagagccagtgttgtagcaact

SEQ ID NO: 19885 - DNA, 25 bp, Rattus norvegicus
aacaagagcgatccaccatgtctga

SEQ ID NO: 19886 - DNA, 25 bp, Rattus norvegicus
aacaagagcgatgcaccatgtctga

SEQ ID NO: 19887 - DNA, 25 bp, Rattus norvegicus
aacaagagctgtatccttagagtgg

SEQ ID NO: 19888 - DNA, 25 bp, Rattus norvegicus
aacaagagctgtttccttagagtgg

SEQ ID NO: 19889 - DNA, 25 bp, Rattus norvegicus
aacaagagctttatccagtccgagg

SEQ ID NO: 19890 - DNA, 25 bp, Rattus norvegicus
aacaagagctttttccagtccgagg

SEQ ID NO: 19891 - DNA, 25 bp, Rattus norvegicus
aacaagaggccccttgagctgggat

SEQ ID NO: 19892 - DNA, 25 bp, Rattus norvegicus
aacaagaggcccgttgagctgggat

SEQ ID NO: 19893 - DNA, 25 bp, Rattus norvegicus
aacaagaggccgactgcgcgcatag

SEQ ID NO: 19894 - DNA, 25 bp, Rattus norvegicus
aacaagaggccgtctgcgcgcatag

SEQ ID NO: 19895 - DNA, 25 bp, Rattus norvegicus
aacaagaggctccagcgacagctcc

SEQ ID NO: 19896 - DNA, 25 bp, Rattus norvegicus
aacaagaggctcgagcgacagctcc

SEQ ID NO: 19897 - DNA, 25 bp, Rattus norvegicus
aacaagatcaacctgggacgccctc

SEQ ID NO: 19898 - DNA, 25 bp, Rattus norvegicus
aacaagatcaacgtgggacgccctc

SEQ ID NO: 19899 - DNA, 25 bp, Rattus norvegicus
aacaagatcatcactaccacagctg

SEQ ID NO: 19900 - DNA, 25 bp, Rattus norvegicus
aacaagatcatctctaccacagctg

SEQ ID NO: 19901 - DNA, 25 bp, Rattus norvegicus
aacaagatcgtgaagccaagccaga

SEQ ID NO: 19902 - DNA, 25 bp, Rattus norvegicus
aacaagatcgtgtagccaagccaga

SEQ ID NO: 19903 - DNA, 25 bp, Rattus norvegicus
aacaagatctatctcctactcagag

SEQ ID NO: 19904 - DNA, 25 bp, Rattus norvegicus
aacaagatctatgtcctactcagag

SEQ ID NO: 19905 - DNA, 25 bp, Rattus norvegicus
aacaagatctcgctccgtggctatc

SEQ ID NO: 19906 - DNA, 25 bp, Rattus norvegicus
aacaagatctcggtccgtggctatc

SEQ ID NO: 19907 - DNA, 25 bp, Rattus norvegicus
aacaagatcttcatcagttccatcc

SEQ ID NO: 19908 - DNA, 25 bp, Rattus norvegicus
aacaagatcttcttcagttccatcc

SEQ ID NO: 19909 - DNA, 25 bp, Rattus norvegicus
aacaagatgaagctcactttcctcc

SEQ ID NO: 19910 - DNA, 25 bp, Rattus norvegicus
aacaagatgaaggtcactttcctcc

SEQ ID NO: 19911 - DNA, 25 bp, Rattus norvegicus
aacaagatgcagatctatgtcccgc

SEQ ID NO: 19912 - DNA, 25 bp, Rattus norvegicus
aacaagatgcagttctatgtcccgc

SEQ ID NO: 19913 - DNA, 25 bp, Rattus norvegicus
aacaagattggcagtttctggccca

SEQ ID NO: 19914 - DNA, 25 bp, Rattus norvegicus
aacaagattggctgtttctggccca

SEQ ID NO: 19915 - DNA, 25 bp, Rattus norvegicus
aacaagcaaacacgttaggccccag

SEQ ID NO: 19916 - DNA, 25 bp, Rattus norvegicus
aacaagcaaacaggttaggccccag

SEQ ID NO: 19917 - DNA, 25 bp, Rattus norvegicus
aacaagcaagtcatcagcatccaca

SEQ ID NO: 19918 - DNA, 25 bp, Rattus norvegicus
aacaagcaagtcttcagcatccaca

SEQ ID NO: 19919 - DNA, 25 bp, Rattus norvegicus
aacaagcacaggacagagccacacc

SEQ ID NO: 19920 - DNA, 25 bp, Rattus norvegicus
aacaagcacaggtcagagccacacc

SEQ ID NO: 19921 - DNA, 25 bp, Rattus norvegicus
aacaagcactgtataacggtcctca

SEQ ID NO: 19922 - DNA, 25 bp, Rattus norvegicus
aacaagcactgtttaacggtcctca

SEQ ID NO: 19923 - DNA, 25 bp, Rattus norvegicus
aacaagcagctactgtatgtatgta

SEQ ID NO: 19924 - DNA, 25 bp, Rattus norvegicus
aacaagcagctagtgtatgtatgta

SEQ ID NO: 19925 - DNA, 25 bp, Rattus norvegicus
aacaagcaggatctgctcacggcgg

SEQ ID NO: 19926 - DNA, 25 bp, Rattus norvegicus
aacaagcaggatgtgctcacggcgg

SEQ ID NO: 19927 - DNA, 25 bp, Rattus norvegicus
aacaagcagggccacagcattctct

SEQ ID NO: 19928 - DNA, 25 bp, Rattus norvegicus
aacaagcagggcctcttctttggct

SEQ ID NO: 19929 - DNA, 25 bp, Rattus norvegicus
aacaagcagggcgacagcattctct

SEQ ID NO: 19930 - DNA, 25 bp, Rattus norvegicus
aacaagcagggcgtcttctttggct

SEQ ID NO: 19931 - DNA, 25 bp, Rattus norvegicus
aacaagcattctccctgatgtcttc

SEQ ID NO: 19932 - DNA, 25 bp, Rattus norvegicus
aacaagcattctgcctgatgtcttc

SEQ ID NO: 19933 - DNA, 25 bp, Rattus norvegicus
aacaagccaataccagagtctgcag

SEQ ID NO: 19934 - DNA, 25 bp, Rattus norvegicus
aacaagccaatagcagagtctgcag

SEQ ID NO: 19935 - DNA, 25 bp, Rattus norvegicus
aacaagccagggacttctgaagcca

SEQ ID NO: 19936 - DNA, 25 bp, Rattus norvegicus
aacaagccagggtcttctgaagcca

SEQ ID NO: 19937 - DNA, 25 bp, Rattus norvegicus
aacaagccatcactattgcccagat

SEQ ID NO: 19938 - DNA, 25 bp, Rattus norvegicus
aacaagccatcagtattgcccagat

SEQ ID NO: 19939 - DNA, 25 bp, Rattus norvegicus
aacaagccattgcaatccgagtcac

SEQ ID NO: 19940 - DNA, 25 bp, Rattus norvegicus
aacaagccattggaatccgagtcac

SEQ ID NO: 19941 - DNA, 25 bp, Rattus norvegicus
aacaagcccaaaacacgtgaccatg

SEQ ID NO: 19942 - DNA, 25 bp, Rattus norvegicus
aacaagcccaaatcacgtgaccatg

SEQ ID NO: 19943 - DNA, 25 bp, Rattus norvegicus
aacaagcccagtaccctgaagttgg

SEQ ID NO: 19944 - DNA, 25 bp, Rattus norvegicus
aacaagcccagttccctgaagttgg

SEQ ID NO: 19945 - DNA, 25 bp, Rattus norvegicus
aacaagccctgtactgttttgtgaa

SEQ ID NO: 19946 - DNA, 25 bp, Rattus norvegicus
aacaagccctgttctgttttgtgaa

SEQ ID NO: 19947 - DNA, 25 bp, Rattus norvegicus
aacaagccgtgtaccagaccatttt

SEQ ID NO: 19948 - DNA, 25 bp, Rattus norvegicus
aacaagccgtgttccagaccatttt

SEQ ID NO: 19949 - DNA, 25 bp, Rattus norvegicus
aacaagcctgcccaggagatcaaca

SEQ ID NO: 19950 - DNA, 25 bp, Rattus norvegicus
aacaagcctgccgaggagatcaaca

SEQ ID NO: 19951 - DNA, 25 bp, Rattus norvegicus
aacaagcctgtcacaaactcccgtg

SEQ ID NO: 19952 - DNA, 25 bp, Rattus norvegicus
aacaagcctgtcctgcctttagtcc

SEQ ID NO: 19953 - DNA, 25 bp, Rattus norvegicus
aacaagcctgtcgtgcctttagtcc

SEQ ID NO: 19954 - DNA, 25 bp, Rattus norvegicus
aacaagcctgtctcaaactcccgtg

SEQ ID NO: 19955 - DNA, 25 bp, Rattus norvegicus
aacaagcggctacatgtctgtaaag

SEQ ID NO: 19956 - DNA, 25 bp, Rattus norvegicus
aacaagcggctagatgtctgtaaag

SEQ ID NO: 19957 - DNA, 25 bp, Rattus norvegicus
aacaagcgtgtcatctttgggctgg

SEQ ID NO: 19958 - DNA, 25 bp, Rattus norvegicus
aacaagcgtgtcttctttgggctgg

SEQ ID NO: 19959 - DNA, 25 bp, Rattus norvegicus
aacaagctacttcctgtattagtta

SEQ ID NO: 19960 - DNA, 25 bp, Rattus norvegicus
aacaagctacttgctgtattagtta

SEQ ID NO: 19961 - DNA, 25 bp, Rattus norvegicus
aacaagctagaactccaccattcct

SEQ ID NO: 19962 - DNA, 25 bp, Rattus norvegicus
aacaagctagaagtccaccattcct

SEQ ID NO: 19963 - DNA, 25 bp, Rattus norvegicus
aacaagctagcaatcaaactggaga

SEQ ID NO: 19964 - DNA, 25 bp, Rattus norvegicus
aacaagctagcattcaaactggaga

SEQ ID NO: 19965 - DNA, 25 bp, Rattus norvegicus
aacaagctcattcaagcctcatctg

SEQ ID NO: 19966 - DNA, 25 bp, Rattus norvegicus
aacaagctcattgaagcctcatctg

SEQ ID NO: 19967 - DNA, 25 bp, Rattus norvegicus
aacaagctccaaaagtctgcagaca

SEQ ID NO: 19968 - DNA, 25 bp, Rattus norvegicus
aacaagctccaatagtctgcagaca

SEQ ID NO: 19969 - DNA, 25 bp, Rattus norvegicus
aacaagctccttatacagactataa

SEQ ID NO: 19970 - DNA, 25 bp, Rattus norvegicus
aacaagctccttttacagactataa

SEQ ID NO: 19971 - DNA, 25 bp, Rattus norvegicus
aacaagctctcacttgtggatcaga

SEQ ID NO: 19972 - DNA, 25 bp, Rattus norvegicus
aacaagctctcagttgtggatcaga

SEQ ID NO: 19973 - DNA, 25 bp, Rattus norvegicus
aacaagctctggcaatcggacaaaa

SEQ ID NO: 19974 - DNA, 25 bp, Rattus norvegicus
aacaagctctgggaatcggacaaaa

SEQ ID NO: 19975 - DNA, 25 bp, Rattus norvegicus
aacaagctgatacgagccagggagt

SEQ ID NO: 19976 - DNA, 25 bp, Rattus norvegicus
aacaagctgataggagccagggagt

SEQ ID NO: 19977 - DNA, 25 bp, Rattus norvegicus
aacaagctgcagaaccttttaatac

SEQ ID NO: 19978 - DNA, 25 bp, Rattus norvegicus
aacaagctgcagtaccttttaatac

SEQ ID NO: 19979 - DNA, 25 bp, Rattus norvegicus
aacaagctgcctaccgggactttga

SEQ ID NO: 19980 - DNA, 25 bp, Rattus norvegicus
aacaagctgcctcccgtttgtggtg

SEQ ID NO: 19981 - DNA, 25 bp, Rattus norvegicus
aacaagctgcctgccgtttgtggtg

SEQ ID NO: 19982 - DNA, 25 bp, Rattus norvegicus
aacaagctgccttccgggactttga

SEQ ID NO: 19983 - DNA, 25 bp, Rattus norvegicus
aacaagctgcttcatgatgattaca

SEQ ID NO: 19984 - DNA, 25 bp, Rattus norvegicus
aacaagctgcttgatgatgattaca

SEQ ID NO: 19985 - DNA, 25 bp, Rattus norvegicus
aacaagctgggcagactgggtccct

SEQ ID NO: 19986 - DNA, 25 bp, Rattus norvegicus
aacaagctgggctgactgggtccct

SEQ ID NO: 19987 - DNA, 25 bp, Rattus norvegicus
aacaagctggtcactgtactctacg

SEQ ID NO: 19988 - DNA, 25 bp, Rattus norvegicus
aacaagctggtctctgtactctacg

SEQ ID NO: 19989 - DNA, 25 bp, Rattus norvegicus
aacaagctgtcgcatcgagggctcc

SEQ ID NO: 19990 - DNA, 25 bp, Rattus norvegicus
aacaagctgtcggatcgagggctcc

SEQ ID NO: 19991 - DNA, 25 bp, Rattus norvegicus
aacaagctgtgcagtgagggcccca

SEQ ID NO: 19992 - DNA, 25 bp, Rattus norvegicus
aacaagctgtgctgtgagggcccca

SEQ ID NO: 19993 - DNA, 25 bp, Rattus norvegicus
aacaagcttcggctgttggacccag

SEQ ID NO: 19994 - DNA, 25 bp, Rattus norvegicus
aacaagcttcgggtgttggacccag

SEQ ID NO: 19995 - DNA, 25 bp, Rattus norvegicus
aacaaggacagcagcagttcagcca

SEQ ID NO: 19996 - DNA, 25 bp, Rattus norvegicus
aacaaggacagctgcagttcagcca

SEQ ID NO: 19997 - DNA, 25 bp, Rattus norvegicus
aacaaggactgcatcttctgcaaag

SEQ ID NO: 19998 - DNA, 25 bp, Rattus norvegicus
aacaaggactgcttcttctgcaaag

SEQ ID NO: 19999 - DNA, 25 bp, Rattus norvegicus
aacaaggagcagctggtttcccaga

SEQ ID NO: 20000 - DNA, 25 bp, Rattus norvegicus
aacaaggagcaggtggtttcccaga

SEQ ID NO: 20001 - DNA, 25 bp, Rattus norvegicus
aacaaggagctacccttctgagcct

SEQ ID NO: 20002 - DNA, 25 bp, Rattus norvegicus
aacaaggagctagccttctgagcct

SEQ ID NO: 20003 - DNA, 25 bp, Rattus norvegicus
aacaaggaggttcccagccagatgc

SEQ ID NO: 20004 - DNA, 25 bp, Rattus norvegicus
aacaaggaggttgccagccagatgc

SEQ ID NO: 20005 - DNA, 25 bp, Rattus norvegicus
aacaaggagtcaccagcacttgctg

SEQ ID NO: 20006 - DNA, 25 bp, Rattus norvegicus
aacaaggagtcagcagcacttgctg

SEQ ID NO: 20007 - DNA, 25 bp, Rattus norvegicus
aacaaggagtccatcagttcccggg

SEQ ID NO: 20008 - DNA, 25 bp, Rattus norvegicus
aacaaggagtccttcagttcccggg

SEQ ID NO: 20009 - DNA, 25 bp, Rattus norvegicus
aacaaggagttgaatctggcctaca

SEQ ID NO: 20010 - DNA, 25 bp, Rattus norvegicus
aacaaggagttgtatctggcctaca

SEQ ID NO: 20011 - DNA, 25 bp, Rattus norvegicus
aacaaggatggtcaggtctactgca

SEQ ID NO: 20012 - DNA, 25 bp, Rattus norvegicus
aacaaggatggtgaggtctactgca

SEQ ID NO: 20013 - DNA, 25 bp, Rattus norvegicus
aacaaggcagcccagtgctttctgt

SEQ ID NO: 20014 - DNA, 25 bp, Rattus norvegicus
aacaaggcagccgagtgctttctgt

SEQ ID NO: 20015 - DNA, 25 bp, Rattus norvegicus
aacaaggcaggaacacacccagcat

SEQ ID NO: 20016 - DNA, 25 bp, Rattus norvegicus
aacaaggcaggatcacacccagcat

SEQ ID NO: 20017 - DNA, 25 bp, Rattus norvegicus
aacaaggccaggaatcacagatatt

SEQ ID NO: 20018 - DNA, 25 bp, Rattus norvegicus
aacaaggccaggtatcacagatatt

SEQ ID NO: 20019 - DNA, 25 bp, Rattus norvegicus
aacaaggcccaaaccagtatactgg

SEQ ID NO: 20020 - DNA, 25 bp, Rattus norvegicus
aacaaggcccaatccagtatactgg

SEQ ID NO: 20021 - DNA, 25 bp, Rattus norvegicus
aacaaggccctgaaaatacatgata

SEQ ID NO: 20022 - DNA, 25 bp, Rattus norvegicus
aacaaggccctgaatgtcagtgaca

SEQ ID NO: 20023 - DNA, 25 bp, Rattus norvegicus
aacaaggccctgtaaatacatgata

SEQ ID NO: 20024 - DNA, 25 bp, Rattus norvegicus
aacaaggccctgtatgtcagtgaca

SEQ ID NO: 20025 - DNA, 25 bp, Rattus norvegicus
aacaaggccttgcagctggacagca

SEQ ID NO: 20026 - DNA, 25 bp, Rattus norvegicus
aacaaggccttggagctggacagca

SEQ ID NO: 20027 - DNA, 25 bp, Rattus norvegicus
aacaaggctgagacctgggacccca

SEQ ID NO: 20028 - DNA, 25 bp, Rattus norvegicus
aacaaggctgagtcctgggacccca

SEQ ID NO: 20029 - DNA, 25 bp, Rattus norvegicus
aacaaggctgctcgactgactaggc

SEQ ID NO: 20030 - DNA, 25 bp, Rattus norvegicus
aacaaggctgctggactgactaggc

SEQ ID NO: 20031 - DNA, 25 bp, Rattus norvegicus
aacaaggctgtcattggtcatgtcc

SEQ ID NO: 20032 - DNA, 25 bp, Rattus norvegicus
aacaaggctgtctttggtcatgtcc

SEQ ID NO: 20033 - DNA, 25 bp, Rattus norvegicus
aacaagggagatacttttctgtaga

SEQ ID NO: 20034 - DNA, 25 bp, Rattus norvegicus
aacaagggagattcttttctgtaga

SEQ ID NO: 20035 - DNA, 25 bp, Rattus norvegicus
aacaagggctccagactggatgtcc

SEQ ID NO: 20036 - DNA, 25 bp, Rattus norvegicus
aacaagggctcctgactggatgtcc

SEQ ID NO: 20037 - DNA, 25 bp, Rattus norvegicus
aacaaggtagcaagctttgagctca

SEQ ID NO: 20038 - DNA, 25 bp, Rattus norvegicus
aacaaggtagcatgctttgagctca

SEQ ID NO: 20039 - DNA, 25 bp, Rattus norvegicus
aacaaggtatgcaatgtctgtatga

SEQ ID NO: 20040 - DNA, 25 bp, Rattus norvegicus
aacaaggtatgctatgtctgtatga

SEQ ID NO: 20041 - DNA, 25 bp, Rattus norvegicus
aacaaggtcagccattctctacttc

SEQ ID NO: 20042 - DNA, 25 bp, Rattus norvegicus
aacaaggtcagcgattctctacttc

SEQ ID NO: 20043 - DNA, 25 bp, Rattus norvegicus
aacaaggtctaaccatgatggtctg

SEQ ID NO: 20044 - DNA, 25 bp, Rattus norvegicus
aacaaggtctaagcatgatggtctg

SEQ ID NO: 20045 - DNA, 25 bp, Rattus norvegicus
aacaaggtctctccctgagaggtaa

SEQ ID NO: 20046 - DNA, 25 bp, Rattus norvegicus
aacaaggtctctgcctgagaggtaa

SEQ ID NO: 20047 - DNA, 25 bp, Rattus norvegicus
aacaaggtggagaacgcacagcagc

SEQ ID NO: 20048 - DNA, 25 bp, Rattus norvegicus
aacaaggtggagagctttcccatac

SEQ ID NO: 20049 - DNA, 25 bp, Rattus norvegicus
aacaaggtggagtacgcacagcagc

SEQ ID NO: 20050 - DNA, 25 bp, Rattus norvegicus
aacaaggtggagtgctttcccatac

SEQ ID NO: 20051 - DNA, 25 bp, Rattus norvegicus
aacaaggtgtcgctggcactgctgc

SEQ ID NO: 20052 - DNA, 25 bp, Rattus norvegicus
aacaaggtgtcggtggcactgctgc

SEQ ID NO: 20053 - DNA, 25 bp, Rattus norvegicus
aacaaggttaagaatgcagctcagg

SEQ ID NO: 20054 - DNA, 25 bp, Rattus norvegicus
aacaaggttaagtatgcagctcagg

SEQ ID NO: 20055 - DNA, 25 bp, Rattus norvegicus
aacaaggttctgagcatggccatgt

SEQ ID NO: 20056 - DNA, 25 bp, Rattus norvegicus
aacaaggttctgtgcatggccatgt

SEQ ID NO: 20057 - DNA, 25 bp, Rattus norvegicus
aacaaggttggccatttcgcatccc

SEQ ID NO: 20058 - DNA, 25 bp, Rattus norvegicus
aacaaggttggcctgaactcccctg

SEQ ID NO: 20059 - DNA, 25 bp, Rattus norvegicus
aacaaggttggcgatttcgcatccc

SEQ ID NO: 20060 - DNA, 25 bp, Rattus norvegicus
aacaaggttggcgtgaactcccctg

SEQ ID NO: 20061 - DNA, 25 bp, Rattus norvegicus
aacaagtagatgctggtaccgacaa

SEQ ID NO: 20062 - DNA, 25 bp, Rattus norvegicus
aacaagtagatggtggtaccgacaa

SEQ ID NO: 20063 - DNA, 25 bp, Rattus norvegicus
aacaagtagcccattcagtgatctg

SEQ ID NO: 20064 - DNA, 25 bp, Rattus norvegicus
aacaagtagccctttcagtgatctg

SEQ ID NO: 20065 - DNA, 25 bp, Rattus norvegicus
aacaagtcaggcagagcaacccgct

SEQ ID NO: 20066 - DNA, 25 bp, Rattus norvegicus
aacaagtcaggctgagcaacccgct

SEQ ID NO: 20067 - DNA, 25 bp, Rattus norvegicus
aacaagtcatacaggatctcactgt

SEQ ID NO: 20068 - DNA, 25 bp, Rattus norvegicus
aacaagtcatactggatctcactgt

SEQ ID NO: 20069 - DNA, 25 bp, Rattus norvegicus
aacaagtccagcctagaattcccaa

SEQ ID NO: 20070 - DNA, 25 bp, Rattus norvegicus
aacaagtccagcgtagaattcccaa

SEQ ID NO: 20071 - DNA, 25 bp, Rattus norvegicus
aacaagtccttcatcaccgatgatg

SEQ ID NO: 20072 - DNA, 25 bp, Rattus norvegicus
aacaagtccttcttcaccgatgatg

SEQ ID NO: 20073 - DNA, 25 bp, Rattus norvegicus
aacaagtcttttacaggacctgaag

SEQ ID NO: 20074 - DNA, 25 bp, Rattus norvegicus
aacaagtctttttcaggacctgaag

SEQ ID NO: 20075 - DNA, 25 bp, Rattus norvegicus
aacaagtgagctacagcctgcagaa

SEQ ID NO: 20076 - DNA, 25 bp, Rattus norvegicus
aacaagtgagcttcagcctgcagaa

SEQ ID NO: 20077 - DNA, 25 bp, Rattus norvegicus
aacaagtgggatcagcagcctttta

SEQ ID NO: 20078 - DNA, 25 bp, Rattus norvegicus
aacaagtgggatgagcagcctttta

SEQ ID NO: 20079 - DNA, 25 bp, Rattus norvegicus
aacaagtgtgttcgttcaccctagg

SEQ ID NO: 20080 - DNA, 25 bp, Rattus norvegicus
aacaagtgtgttggttcaccctagg

SEQ ID NO: 20081 - DNA, 25 bp, Rattus norvegicus
aacaagttattcaccttcataccca

SEQ ID NO: 20082 - DNA, 25 bp, Rattus norvegicus
aacaagttattctccttcataccca

SEQ ID NO: 20083 - DNA, 25 bp, Rattus norvegicus
aacaagttcagtcatgacacatatc

SEQ ID NO: 20084 - DNA, 25 bp, Rattus norvegicus
aacaagttcagtgatgacacatatc

SEQ ID NO: 20085 - DNA, 25 bp, Rattus norvegicus
aacaagttcatccaggcaggccagt

SEQ ID NO: 20086 - DNA, 25 bp, Rattus norvegicus
aacaagttcatcgaggcaggccagt

SEQ ID NO: 20087 - DNA, 25 bp, Rattus norvegicus
aacaagttccagatgacctgtcgac

SEQ ID NO: 20088 - DNA, 25 bp, Rattus norvegicus
aacaagttccagttgacctgtcgac

SEQ ID NO: 20089 - DNA, 25 bp, Rattus norvegicus
aacaagttcttcaggctgagcaagc

SEQ ID NO: 20090 - DNA, 25 bp, Rattus norvegicus
aacaagttcttctggctgagcaagc

SEQ ID NO: 20091 - DNA, 25 bp, Rattus norvegicus
aacaagttggttactaattagcatg

SEQ ID NO: 20092 - DNA, 25 bp, Rattus norvegicus
aacaagttggtttctaattagcatg

SEQ ID NO: 20093 - DNA, 25 bp, Rattus norvegicus
aacaagttgtaacctttagtgatgc

SEQ ID NO: 20094 - DNA, 25 bp, Rattus norvegicus
aacaagttgtaagctttagtgatgc

SEQ ID NO: 20095 - DNA, 25 bp, Rattus norvegicus
aacaagttgtcactgcaccttgcat

SEQ ID NO: 20096 - DNA, 25 bp, Rattus norvegicus
aacaagttgtcagtgcaccttgcat

SEQ ID NO: 20097 - DNA, 25 bp, Rattus norvegicus
aacaagtttttcatcgatacctcca

SEQ ID NO: 20098 - DNA, 25 bp, Rattus norvegicus
aacaagtttttcttcgatacctcca

SEQ ID NO: 20099 - DNA, 25 bp, Rattus norvegicus
aacaataactcaagctgtcagccac

SEQ ID NO: 20100 - DNA, 25 bp, Rattus norvegicus
aacaataactcatgctgtcagccac

SEQ ID NO: 20101 - DNA, 25 bp, Rattus norvegicus
aacaataagcccaaactgccagtgg

SEQ ID NO: 20102 - DNA, 25 bp, Rattus norvegicus
aacaataagccctaactgccagtgg

SEQ ID NO: 20103 - DNA, 25 bp, Rattus norvegicus
aacaataatcccaactcctgtgtca

SEQ ID NO: 20104 - DNA, 25 bp, Rattus norvegicus
aacaataatccctactcctgtgtca

SEQ ID NO: 20105 - DNA, 25 bp, Rattus norvegicus
aacaataatgaaaggctgagcccca

SEQ ID NO: 20106 - DNA, 25 bp, Rattus norvegicus
aacaataatgaatggctgagcccca

SEQ ID NO: 20107 - DNA, 25 bp, Rattus norvegicus
aacaataatgcaccatatccctatg

SEQ ID NO: 20108 - DNA, 25 bp, Rattus norvegicus
aacaataatgcagcatatccctatg

SEQ ID NO: 20109 - DNA, 25 bp, Rattus norvegicus
aacaatacatgtacttctggtagtg

SEQ ID NO: 20110 - DNA, 25 bp, Rattus norvegicus
aacaatacatgttcttctggtagtg

SEQ ID NO: 20111 - DNA, 25 bp, Rattus norvegicus
aacaatacgcttagagctcgctgaa

SEQ ID NO: 20112 - DNA, 25 bp, Rattus norvegicus
aacaatacgctttgagctcgctgaa

SEQ ID NO: 20113 - DNA, 25 bp, Rattus norvegicus
aacaatagccagcaacttctttagg

SEQ ID NO: 20114 - DNA, 25 bp, Rattus norvegicus
aacaatagccaggaacttctttagg

SEQ ID NO: 20115 - DNA, 25 bp, Rattus norvegicus
aacaatagcctaccatataaccaat

SEQ ID NO: 20116 - DNA, 25 bp, Rattus norvegicus
aacaatagcctagcatataaccaat

SEQ ID NO: 20117 - DNA, 25 bp, Rattus norvegicus
aacaatagctttagtagtacattca

SEQ ID NO: 20118 - DNA, 25 bp, Rattus norvegicus
aacaatagcttttgtagtacattca

SEQ ID NO: 20119 - DNA, 25 bp, Rattus norvegicus
aacaatatagaccatctcctaccta

SEQ ID NO: 20120 - DNA, 25 bp, Rattus norvegicus
aacaatatagacgatctcctaccta

SEQ ID NO: 20121 - DNA, 25 bp, Rattus norvegicus
aacaatattggacttttgctccttt

SEQ ID NO: 20122 - DNA, 25 bp, Rattus norvegicus
aacaatattggagttttgctccttt

SEQ ID NO: 20123 - DNA, 25 bp, Rattus norvegicus
aacaatcacgagcacttctagcaca

SEQ ID NO: 20124 - DNA, 25 bp, Rattus norvegicus
aacaatcacgaggacttctagcaca

SEQ ID NO: 20125 - DNA, 25 bp, Rattus norvegicus
aacaatcatccgacctccagtgagg

SEQ ID NO: 20126 - DNA, 25 bp, Rattus norvegicus
aacaatcatccgtcctccagtgagg

SEQ ID NO: 20127 - DNA, 25 bp, Rattus norvegicus
aacaatcatgctcaccgggttttta

SEQ ID NO: 20128 - DNA, 25 bp, Rattus norvegicus
aacaatcatgctgaccgggttttta

SEQ ID NO: 20129 - DNA, 25 bp, Rattus norvegicus
aacaatcattctcaacccctttggt

SEQ ID NO: 20130 - DNA, 25 bp, Rattus norvegicus
aacaatcattctgaacccctttggt

SEQ ID NO: 20131 - DNA, 25 bp, Rattus norvegicus
aacaatccagacagaagtcttctat

SEQ ID NO: 20132 - DNA, 25 bp, Rattus norvegicus
aacaatccagactgaagtcttctat

SEQ ID NO: 20133 - DNA, 25 bp, Rattus norvegicus
aacaatccctcaattactcaggaca

SEQ ID NO: 20134 - DNA, 25 bp, Rattus norvegicus
aacaatccctcatttactcaggaca

SEQ ID NO: 20135 - DNA, 25 bp, Rattus norvegicus
aacaatccctgtatcgttcgagaag

SEQ ID NO: 20136 - DNA, 25 bp, Rattus norvegicus
aacaatccctgtttcgttcgagaag

SEQ ID NO: 20137 - DNA, 25 bp, Rattus norvegicus
aacaatccggagcaggtgggcaaat

SEQ ID NO: 20138 - DNA, 25 bp, Rattus norvegicus
aacaatccggaggaggtgggcaaat

SEQ ID NO: 20139 - DNA, 25 bp, Rattus norvegicus
aacaatcctcgtcttccagataatt

SEQ ID NO: 20140 - DNA, 25 bp, Rattus norvegicus
aacaatcctcgtgttccagataatt

SEQ ID NO: 20141 - DNA, 25 bp, Rattus norvegicus
aacaatcgtaggctcttttctctgt

SEQ ID NO: 20142 - DNA, 25 bp, Rattus norvegicus
aacaatcgtagggtcttttctctgt

SEQ ID NO: 20143 - DNA, 25 bp, Rattus norvegicus
aacaatcgtctgagaatgtcgtgat

SEQ ID NO: 20144 - DNA, 25 bp, Rattus norvegicus
aacaatcgtctgtgaatgtcgtgat

SEQ ID NO: 20145 - DNA, 25 bp, Rattus norvegicus
aacaatcgtttgatctgtgctaact

SEQ ID NO: 20146 - DNA, 25 bp, Rattus norvegicus
aacaatcgtttgttctgtgctaact

SEQ ID NO: 20147 - DNA, 25 bp, Rattus norvegicus
aacaatctcagcaaggtgtggtgat

SEQ ID NO: 20148 - DNA, 25 bp, Rattus norvegicus
aacaatctcagctaggtgtggtgat

SEQ ID NO: 20149 - DNA, 25 bp, Rattus norvegicus
aacaatctcttgagggctgcaccta

SEQ ID NO: 20150 - DNA, 25 bp, Rattus norvegicus
aacaatctcttgtgggctgcaccta

SEQ ID NO: 20151 - DNA, 25 bp, Rattus norvegicus
aacaatctctttcggtcagcttctg

SEQ ID NO: 20152 - DNA, 25 bp, Rattus norvegicus
aacaatctctttgggtcagcttctg

SEQ ID NO: 20153 - DNA, 25 bp, Rattus norvegicus
aacaatctggtgaaactgactccgt

SEQ ID NO: 20154 - DNA, 25 bp, Rattus norvegicus
aacaatctggtgtaactgactccgt

SEQ ID NO: 20155 - DNA, 25 bp, Rattus norvegicus
aacaatctgtataactttccgtagt

SEQ ID NO: 20156 - DNA, 25 bp, Rattus norvegicus
aacaatctgtattactttccgtagt

SEQ ID NO: 20157 - DNA, 25 bp, Rattus norvegicus
aacaatctgtgtaaaactatgctaa

SEQ ID NO: 20158 - DNA, 25 bp, Rattus norvegicus
aacaatctgtgttaaactatgctaa

SEQ ID NO: 20159 - DNA, 25 bp, Rattus norvegicus
aacaatctgttccttctcagtgagg

SEQ ID NO: 20160 - DNA, 25 bp, Rattus norvegicus
aacaatctgttcgttctcagtgagg

SEQ ID NO: 20161 - DNA, 25 bp, Rattus norvegicus
aacaatgacctgactcttctgaagc

SEQ ID NO: 20162 - DNA, 25 bp, Rattus norvegicus
aacaatgacctgtctcttctgaagc

SEQ ID NO: 20163 - DNA, 25 bp, Rattus norvegicus
aacaatgagcttactcttggttaat

SEQ ID NO: 20164 - DNA, 25 bp, Rattus norvegicus
aacaatgagctttctcttggttaat

SEQ ID NO: 20165 - DNA, 25 bp, Rattus norvegicus
aacaatgatgtaagcctgccaccgc

SEQ ID NO: 20166 - DNA, 25 bp, Rattus norvegicus
aacaatgatgtatgcctgccaccgc

SEQ ID NO: 20167 - DNA, 25 bp, Rattus norvegicus
aacaatgcattcaaacctggctgga

SEQ ID NO: 20168 - DNA, 25 bp, Rattus norvegicus
aacaatgcattctaacctggctgga

SEQ ID NO: 20169 - DNA, 25 bp, Rattus norvegicus
aacaatgcatttccttctctgttcc

SEQ ID NO: 20170 - DNA, 25 bp, Rattus norvegicus
aacaatgcatttgcttctctgttcc

SEQ ID NO: 20171 - DNA, 25 bp, Rattus norvegicus
aacaatgccagccttctcatctggt

SEQ ID NO: 20172 - DNA, 25 bp, Rattus norvegicus
aacaatgccagcgttctcatctggt

SEQ ID NO: 20173 - DNA, 25 bp, Rattus norvegicus
aacaatgcccctccaagtgcctgtt

SEQ ID NO: 20174 - DNA, 25 bp, Rattus norvegicus
aacaatgcccctgcaagtgcctgtt

SEQ ID NO: 20175 - DNA, 25 bp, Rattus norvegicus
aacaatgcctttcggtagtctgctt

SEQ ID NO: 20176 - DNA, 25 bp, Rattus norvegicus
aacaatgcctttgggtagtctgctt

SEQ ID NO: 20177 - DNA, 25 bp, Rattus norvegicus
aacaatggaaccagctttgtggccc

SEQ ID NO: 20178 - DNA, 25 bp, Rattus norvegicus
aacaatggaacctgctttgtggccc

SEQ ID NO: 20179 - DNA, 25 bp, Rattus norvegicus
aacaatggccatactgagtgaccct

SEQ ID NO: 20180 - DNA, 25 bp, Rattus norvegicus
aacaatggccattctgagtgaccct

SEQ ID NO: 20181 - DNA, 25 bp, Rattus norvegicus
aacaatggccgactggcaccatgaa

SEQ ID NO: 20182 - DNA, 25 bp, Rattus norvegicus
aacaatggccgagtggcaccatgaa

SEQ ID NO: 20183 - DNA, 25 bp, Rattus norvegicus
aacaatggctgcatgggacatgccc

SEQ ID NO: 20184 - DNA, 25 bp, Rattus norvegicus
aacaatggctgcttgggacatgccc

SEQ ID NO: 20185 - DNA, 25 bp, Rattus norvegicus
aacaatgggagcaggttcgtctacc

SEQ ID NO: 20186 - DNA, 25 bp, Rattus norvegicus
aacaatgggagctggttcgtctacc

SEQ ID NO: 20187 - DNA, 25 bp, Rattus norvegicus
aacaatgggagtcctcagcttgcaa

SEQ ID NO: 20188 - DNA, 25 bp, Rattus norvegicus
aacaatgggagtgctcagcttgcaa

SEQ ID NO: 20189 - DNA, 25 bp, Rattus norvegicus
aacaatgggcagagctgggctgact

SEQ ID NO: 20190 - DNA, 25 bp, Rattus norvegicus
aacaatgggcagtgctgggctgact

SEQ ID NO: 20191 - DNA, 25 bp, Rattus norvegicus
aacaatggtccaagaggccctgcct

SEQ ID NO: 20192 - DNA, 25 bp, Rattus norvegicus
aacaatggtccatgaggccctgcct

SEQ ID NO: 20193 - DNA, 25 bp, Rattus norvegicus
aacaatgtagacacacccaggctgg

SEQ ID NO: 20194 - DNA, 25 bp, Rattus norvegicus
aacaatgtagactcacccaggctgg

SEQ ID NO: 20195 - DNA, 25 bp, Rattus norvegicus
aacaatgtcattcccacgagattgg

SEQ ID NO: 20196 - DNA, 25 bp, Rattus norvegicus
aacaatgtcattgccacgagattgg

SEQ ID NO: 20197 - DNA, 25 bp, Rattus norvegicus
aacaatgtccctctggtgtgctggc

SEQ ID NO: 20198 - DNA, 25 bp, Rattus norvegicus
aacaatgtccctgtggtgtgctggc

SEQ ID NO: 20199 - DNA, 25 bp, Rattus norvegicus
aacaatgtccggacaacgactggca

SEQ ID NO: 20200 - DNA, 25 bp, Rattus norvegicus
aacaatgtccggtcaacgactggca

SEQ ID NO: 20201 - DNA, 25 bp, Rattus norvegicus
aacaatgtcctgactggaggcacca

SEQ ID NO: 20202 - DNA, 25 bp, Rattus norvegicus
aacaatgtcctgtctggaggcacca

SEQ ID NO: 20203 - DNA, 25 bp, Rattus norvegicus
aacaatgtctatcttctcgttccct

SEQ ID NO: 20204 - DNA, 25 bp, Rattus norvegicus
aacaatgtctatgttctcgttccct

SEQ ID NO: 20205 - DNA, 25 bp, Rattus norvegicus
aacaatgtctggctcccttctcctt

SEQ ID NO: 20206 - DNA, 25 bp, Rattus norvegicus
aacaatgtctgggtcccttctcctt

SEQ ID NO: 20207 - DNA, 25 bp, Rattus norvegicus
aacaatgtctttcaatcccatgtag

SEQ ID NO: 20208 - DNA, 25 bp, Rattus norvegicus
aacaatgtctttgaatcccatgtag

SEQ ID NO: 20209 - DNA, 25 bp, Rattus norvegicus
aacaatgtgaaaaccctggccatcc

SEQ ID NO: 20210 - DNA, 25 bp, Rattus norvegicus
aacaatgtgaaatccctggccatcc

SEQ ID NO: 20211 - DNA, 25 bp, Rattus norvegicus
aacaatgtgtctactgctcacgtct

SEQ ID NO: 20212 - DNA, 25 bp, Rattus norvegicus
aacaatgtgtcttctgctcacgtct

SEQ ID NO: 20213 - DNA, 25 bp, Rattus norvegicus
aacaatgtgtgcaccactgggtccc

SEQ ID NO: 20214 - DNA, 25 bp, Rattus norvegicus
aacaatgtgtgctccactgggtccc

SEQ ID NO: 20215 - DNA, 25 bp, Rattus norvegicus
aacaattatctcaaggtctctgaag

SEQ ID NO: 20216 - DNA, 25 bp, Rattus norvegicus
aacaattatctctaggtctctgaag

SEQ ID NO: 20217 - DNA, 25 bp, Rattus norvegicus
aacaattcaaggcatttcgcagagg

SEQ ID NO: 20218 - DNA, 25 bp, Rattus norvegicus
aacaattcaagggatttcgcagagg

SEQ ID NO: 20219 - DNA, 25 bp, Rattus norvegicus
aacaattcagagatcctattatgga

SEQ ID NO: 20220 - DNA, 25 bp, Rattus norvegicus
aacaattcagagttcctattatgga

SEQ ID NO: 20221 - DNA, 25 bp, Rattus norvegicus
aacaattcataactgcactttctat

SEQ ID NO: 20222 - DNA, 25 bp, Rattus norvegicus
aacaattcataagtgcactttctat

SEQ ID NO: 20223 - DNA, 25 bp, Rattus norvegicus
aacaattccgggatgcttctcggat

SEQ ID NO: 20224 - DNA, 25 bp, Rattus norvegicus
aacaattccgggttgcttctcggat

SEQ ID NO: 20225 - DNA, 25 bp, Rattus norvegicus
aacaattcctatccctaaaaccgtg

SEQ ID NO: 20226 - DNA, 25 bp, Rattus norvegicus
aacaattcctatgcctaaaaccgtg

SEQ ID NO: 20227 - DNA, 25 bp, Rattus norvegicus
aacaattcctttaataacagacgag

SEQ ID NO: 20228 - DNA, 25 bp, Rattus norvegicus
aacaattccttttataacagacgag

SEQ ID NO: 20229 - DNA, 25 bp, Rattus norvegicus
aacaattgaggtcggctccgttacg

SEQ ID NO: 20230 - DNA, 25 bp, Rattus norvegicus
aacaattgaggtgggctccgttacg

SEQ ID NO: 20231 - DNA, 25 bp, Rattus norvegicus
aacaattgatctcgtgtgcttagaa

SEQ ID NO: 20232 - DNA, 25 bp, Rattus norvegicus
aacaattgatctggtgtgcttagaa

SEQ ID NO: 20233 - DNA, 25 bp, Rattus norvegicus
aacaattgctctcagttcagggtca

SEQ ID NO: 20234 - DNA, 25 bp, Rattus norvegicus
aacaattgctctgagttcagggtca

SEQ ID NO: 20235 - DNA, 25 bp, Rattus norvegicus
aacaattgctggaaccatgctctta

SEQ ID NO: 20236 - DNA, 25 bp, Rattus norvegicus
aacaattgctggtaccatgctctta

SEQ ID NO: 20237 - DNA, 25 bp, Rattus norvegicus
aacaattggcaacaccaggtatggt

SEQ ID NO: 20238 - DNA, 25 bp, Rattus norvegicus
aacaattggcaagaccaggtatggt

SEQ ID NO: 20239 - DNA, 25 bp, Rattus norvegicus
aacaatttatttacttcctcaatct

SEQ ID NO: 20240 - DNA, 25 bp, Rattus norvegicus
aacaatttattttcttcctcaatct

SEQ ID NO: 20241 - DNA, 25 bp, Rattus norvegicus
aacaatttcatgatgtcctccgcct

SEQ ID NO: 20242 - DNA, 25 bp, Rattus norvegicus
aacaatttcatgttgtcctccgcct

SEQ ID NO: 20243 - DNA, 25 bp, Rattus norvegicus
aacaatttcccgacgtgagcgagga

SEQ ID NO: 20244 - DNA, 25 bp, Rattus norvegicus
aacaatttcccgtcgtgagcgagga

SEQ ID NO: 20245 - DNA, 25 bp, Rattus norvegicus
aacaatttgtatacgctctaaagac

SEQ ID NO: 20246 - DNA, 25 bp, Rattus norvegicus
aacaatttgtattcgctctaaagac

SEQ ID NO: 20247 - DNA, 25 bp, Rattus norvegicus
aacaattttgctcactttccctagt

SEQ ID NO: 20248 - DNA, 25 bp, Rattus norvegicus
aacaattttgctgactttccctagt

SEQ ID NO: 20249 - DNA, 25 bp, Rattus norvegicus
aacacaaaccaaagtgcactccgaa

SEQ ID NO: 20250 - DNA, 25 bp, Rattus norvegicus
aacacaaaccaatgtgcactccgaa

SEQ ID NO: 20251 - DNA, 25 bp, Rattus norvegicus
aacacaaactcacagaactcagcct

SEQ ID NO: 20252 - DNA, 25 bp, Rattus norvegicus
aacacaaactcagagaactcagcct

SEQ ID NO: 20253 - DNA, 25 bp, Rattus norvegicus
aacacaaactggctcaatggcggta

SEQ ID NO: 20254 - DNA, 25 bp, Rattus norvegicus
aacacaaactgggtcaatggcggta

SEQ ID NO: 20255 - DNA, 25 bp, Rattus norvegicus
aacacaaagcagaatccggccctga

SEQ ID NO: 20256 - DNA, 25 bp, Rattus norvegicus
aacacaaagcagtatccggccctga

SEQ ID NO: 20257 - DNA, 25 bp, Rattus norvegicus
aacacaaaggacacccgacttctga

SEQ ID NO: 20258 - DNA, 25 bp, Rattus norvegicus
aacacaaaggactcccgacttctga

SEQ ID NO: 20259 - DNA, 25 bp, Rattus norvegicus
aacacaacagacacatgcacgaaca

SEQ ID NO: 20260 - DNA, 25 bp, Rattus norvegicus
aacacaacagactcatgcacgaaca

SEQ ID NO: 20261 - DNA, 25 bp, Rattus norvegicus
aacacaacatcaaagggtcatccgt

SEQ ID NO: 20262 - DNA, 25 bp, Rattus norvegicus
aacacaacatcatagggtcatccgt

SEQ ID NO: 20263 - DNA, 25 bp, Rattus norvegicus
aacacaaccttgctgcctcagtttt

SEQ ID NO: 20264 - DNA, 25 bp, Rattus norvegicus
aacacaaccttggtgcctcagtttt

SEQ ID NO: 20265 - DNA, 25 bp, Rattus norvegicus
aacacaactcgtacaatgttgggac

SEQ ID NO: 20266 - DNA, 25 bp, Rattus norvegicus
aacacaactcgttcaatgttgggac

SEQ ID NO: 20267 - DNA, 25 bp, Rattus norvegicus
aacacaactctccagggtcatgcta

SEQ ID NO: 20268 - DNA, 25 bp, Rattus norvegicus
aacacaactctcgagggtcatgcta

SEQ ID NO: 20269 - DNA, 25 bp, Rattus norvegicus
aacacaactgagaacttgccctgag

SEQ ID NO: 20270 - DNA, 25 bp, Rattus norvegicus
aacacaactgagtacttgccctgag

SEQ ID NO: 20271 - DNA, 25 bp, Rattus norvegicus
aacacaacttggcatcaggctctgt

SEQ ID NO: 20272 - DNA, 25 bp, Rattus norvegicus
aacacaacttgggatcaggctctgt

SEQ ID NO: 20273 - DNA, 25 bp, Rattus norvegicus
aacacaagcactagtttatttgctt

SEQ ID NO: 20274 - DNA, 25 bp, Rattus norvegicus
aacacaagcacttgtttatttgctt

SEQ ID NO: 20275 - DNA, 25 bp, Rattus norvegicus
aacacaagccaaactgtacctttat

SEQ ID NO: 20276 - DNA, 25 bp, Rattus norvegicus
aacacaagccaatctgtacctttat

SEQ ID NO: 20277 - DNA, 25 bp, Rattus norvegicus
aacacaagccctaccagggcatgga

SEQ ID NO: 20278 - DNA, 25 bp, Rattus norvegicus
aacacaagcccttccagggcatgga

SEQ ID NO: 20279 - DNA, 25 bp, Rattus norvegicus
aacacaaggccacctatcttagctt

SEQ ID NO: 20280 - DNA, 25 bp, Rattus norvegicus
aacacaaggccagctatcttagctt

SEQ ID NO: 20281 - DNA, 25 bp, Rattus norvegicus
aacacaaggccgaacactcgcagga

SEQ ID NO: 20282 - DNA, 25 bp, Rattus norvegicus
aacacaaggccgtacactcgcagga

SEQ ID NO: 20283 - DNA, 25 bp, Rattus norvegicus
aacacaagggcaattctcaaaagga

SEQ ID NO: 20284 - DNA, 25 bp, Rattus norvegicus
aacacaagggcatttctcaaaagga

SEQ ID NO: 20285 - DNA, 25 bp, Rattus norvegicus
aacacaaggttaactggctttgcca

SEQ ID NO: 20286 - DNA, 25 bp, Rattus norvegicus
aacacaaggttatctggctttgcca

SEQ ID NO: 20287 - DNA, 25 bp, Rattus norvegicus
aacacaagtcctacagggccattat

SEQ ID NO: 20288 - DNA, 25 bp, Rattus norvegicus
aacacaagtccttcagggccattat

SEQ ID NO: 20289 - DNA, 25 bp, Rattus norvegicus
aacacaagtctcatgcttacgcaga

SEQ ID NO: 20290 - DNA, 25 bp, Rattus norvegicus
aacacaagtctcttgcttacgcaga

SEQ ID NO: 20291 - DNA, 25 bp, Rattus norvegicus
aacacaatagttctgctgtcttaat

SEQ ID NO: 20292 - DNA, 25 bp, Rattus norvegicus
aacacaatagttgtgctgtcttaat

SEQ ID NO: 20293 - DNA, 25 bp, Rattus norvegicus
aacacaattatcatgctccttatcc

SEQ ID NO: 20294 - DNA, 25 bp, Rattus norvegicus
aacacaattatcttgctccttatcc

SEQ ID NO: 20295 - DNA, 25 bp, Rattus norvegicus
aacacaattctaccatggcggtggg

SEQ ID NO: 20296 - DNA, 25 bp, Rattus norvegicus
aacacaattctagcatggcggtggg

SEQ ID NO: 20297 - DNA, 25 bp, Rattus norvegicus
aacacaatttgcaaggcactcctgt

SEQ ID NO: 20298 - DNA, 25 bp, Rattus norvegicus
aacacaatttgctaggcactcctgt

SEQ ID NO: 20299 - DNA, 25 bp, Rattus norvegicus
aacacacaaactacatggttgacat

SEQ ID NO: 20300 - DNA, 25 bp, Rattus norvegicus
aacacacaaacttcatggttgacat

SEQ ID NO: 20301 - DNA, 25 bp, Rattus norvegicus
aacacacaactcatgcagtgacaat

SEQ ID NO: 20302 - DNA, 25 bp, Rattus norvegicus
aacacacaactcttgcagtgacaat

SEQ ID NO: 20303 - DNA, 25 bp, Rattus norvegicus
aacacacaatgcaagctggagagat

SEQ ID NO: 20304 - DNA, 25 bp, Rattus norvegicus
aacacacaatgctagctggagagat

SEQ ID NO: 20305 - DNA, 25 bp, Rattus norvegicus
aacacacaattcaacgatgctgggt

SEQ ID NO: 20306 - DNA, 25 bp, Rattus norvegicus
aacacacaattctacgatgctgggt

SEQ ID NO: 20307 - DNA, 25 bp, Rattus norvegicus
aacacacacagtaaatcgggctccc

SEQ ID NO: 20308 - DNA, 25 bp, Rattus norvegicus
aacacacacagtaagcccagaacgg

SEQ ID NO: 20309 - DNA, 25 bp, Rattus norvegicus
aacacacacagttaatcgggctccc

SEQ ID NO: 20310 - DNA, 25 bp, Rattus norvegicus
aacacacacagttagcccagaacgg

SEQ ID NO: 20311 - DNA, 25 bp, Rattus norvegicus
aacacacacctcaggaaagcgtgtc

SEQ ID NO: 20312 - DNA, 25 bp, Rattus norvegicus
aacacacacctctggaaagcgtgtc

SEQ ID NO: 20313 - DNA, 25 bp, Rattus norvegicus
aacacacaccttccttttcagatgg

SEQ ID NO: 20314 - DNA, 25 bp, Rattus norvegicus
aacacacaccttgcttttcagatgg

SEQ ID NO: 20315 - DNA, 25 bp, Rattus norvegicus
aacacacactttagatcagctccaa

SEQ ID NO: 20316 - DNA, 25 bp, Rattus norvegicus
aacacacacttttgatcagctccaa

SEQ ID NO: 20317 - DNA, 25 bp, Rattus norvegicus
aacacacagtgccttttgacgataa

SEQ ID NO: 20318 - DNA, 25 bp, Rattus norvegicus
aacacacagtgcgttttgacgataa

SEQ ID NO: 20319 - DNA, 25 bp, Rattus norvegicus
aacacacatcacacaatctgcaaac

SEQ ID NO: 20320 - DNA, 25 bp, Rattus norvegicus
aacacacatcactcaatctgcaaac

SEQ ID NO: 20321 - DNA, 25 bp, Rattus norvegicus
aacacacatgacaagggatttgcct

SEQ ID NO: 20322 - DNA, 25 bp, Rattus norvegicus
aacacacatgactagggatttgcct

SEQ ID NO: 20323 - DNA, 25 bp, Rattus norvegicus
aacacacatgccagtctgcaggcag

SEQ ID NO: 20324 - DNA, 25 bp, Rattus norvegicus
aacacacatgcctgtctgcaggcag

SEQ ID NO: 20325 - DNA, 25 bp, Rattus norvegicus
aacacacatgctccagagctctgga

SEQ ID NO: 20326 - DNA, 25 bp, Rattus norvegicus
aacacacatgctgcagagctctgga

SEQ ID NO: 20327 - DNA, 25 bp, Rattus norvegicus
aacacacatgtcatcaacgtagcca

SEQ ID NO: 20328 - DNA, 25 bp, Rattus norvegicus
aacacacatgtcttcaacgtagcca

SEQ ID NO: 20329 - DNA, 25 bp, Rattus norvegicus
aacacacattagcacctcgtgggtg

SEQ ID NO: 20330 - DNA, 25 bp, Rattus norvegicus
aacacacattaggacctcgtgggtg

SEQ ID NO: 20331 - DNA, 25 bp, Rattus norvegicus
aacacaccaagtaactcttcagggt

SEQ ID NO: 20332 - DNA, 25 bp, Rattus norvegicus
aacacaccaagttactcttcagggt

SEQ ID NO: 20333 - DNA, 25 bp, Rattus norvegicus
aacacaccatccatttggcagggcg

SEQ ID NO: 20334 - DNA, 25 bp, Rattus norvegicus
aacacaccatccttttggcagggcg

SEQ ID NO: 20335 - DNA, 25 bp, Rattus norvegicus
aacacacccagtcaaggctgtacta

SEQ ID NO: 20336 - DNA, 25 bp, Rattus norvegicus
aacacacccagtgaaggctgtacta

SEQ ID NO: 20337 - DNA, 25 bp, Rattus norvegicus
aacacaccgagacagctgtacagaa

SEQ ID NO: 20338 - DNA, 25 bp, Rattus norvegicus
aacacaccgagagagctgtacagaa

SEQ ID NO: 20339 - DNA, 25 bp, Rattus norvegicus
aacacaccgggccagacaagcaatc

SEQ ID NO: 20340 - DNA, 25 bp, Rattus norvegicus
aacacaccgggcgagacaagcaatc

SEQ ID NO: 20341 - DNA, 25 bp, Rattus norvegicus
aacacaccgggtcgaactgcagcct

SEQ ID NO: 20342 - DNA, 25 bp, Rattus norvegicus
aacacaccgggtggaactgcagcct

SEQ ID NO: 20343 - DNA, 25 bp, Rattus norvegicus
aacacacctaaacccctaagcagag

SEQ ID NO: 20344 - DNA, 25 bp, Rattus norvegicus
aacacacctaaagccctaagcagag

SEQ ID NO: 20345 - DNA, 25 bp, Rattus norvegicus
aacacacctggactagtcggaagac

SEQ ID NO: 20346 - DNA, 25 bp, Rattus norvegicus
aacacacctggagtagtcggaagac

SEQ ID NO: 20347 - DNA, 25 bp, Rattus norvegicus
aacacacctggcatatctataagct

SEQ ID NO: 20348 - DNA, 25 bp, Rattus norvegicus
aacacacctggcttatctataagct

SEQ ID NO: 20349 - DNA, 25 bp, Rattus norvegicus
aacacacgacaacctccttcaggaa

SEQ ID NO: 20350 - DNA, 25 bp, Rattus norvegicus
aacacacgacaagctccttcaggaa

SEQ ID NO: 20351 - DNA, 25 bp, Rattus norvegicus
aacacacgcattacggatccagaga

SEQ ID NO: 20352 - DNA, 25 bp, Rattus norvegicus
aacacacgcatttcggatccagaga

SEQ ID NO: 20353 - DNA, 25 bp, Rattus norvegicus
aacacacggtttatatttgcagaat

SEQ ID NO: 20354 - DNA, 25 bp, Rattus norvegicus
aacacacggtttttatttgcagaat

SEQ ID NO: 20355 - DNA, 25 bp, Rattus norvegicus
aacacacgtgtaactgtcagccggg

SEQ ID NO: 20356 - DNA, 25 bp, Rattus norvegicus
aacacacgtgtatctgtcagccggg

SEQ ID NO: 20357 - DNA, 25 bp, Rattus norvegicus
aacacacgtgttagcttcattcatg

SEQ ID NO: 20358 - DNA, 25 bp, Rattus norvegicus
aacacacgtgtttgcttcattcatg

SEQ ID NO: 20359 - DNA, 25 bp, Rattus norvegicus
aacacacgttttcctgttactcagc

SEQ ID NO: 20360 - DNA, 25 bp, Rattus norvegicus
aacacacgttttgctgttactcagc

SEQ ID NO: 20361 - DNA, 25 bp, Rattus norvegicus
aacacactcagaatccatctcacgg

SEQ ID NO: 20362 - DNA, 25 bp, Rattus norvegicus
aacacactcagattccatctcacgg

SEQ ID NO: 20363 - DNA, 25 bp, Rattus norvegicus
aacacactgctccattacttcagta

SEQ ID NO: 20364 - DNA, 25 bp, Rattus norvegicus
aacacactgctcgattacttcagta

SEQ ID NO: 20365 - DNA, 25 bp, Rattus norvegicus
aacacactgggtctcctgggaagac

SEQ ID NO: 20366 - DNA, 25 bp, Rattus norvegicus
aacacactgggtgtcctgggaagac

SEQ ID NO: 20367 - DNA, 25 bp, Rattus norvegicus
aacacactggttctggatttggcct

SEQ ID NO: 20368 - DNA, 25 bp, Rattus norvegicus
aacacactggttgtggatttggcct

SEQ ID NO: 20369 - DNA, 25 bp, Rattus norvegicus
aacacactgtgcaggtcgagtccca

SEQ ID NO: 20370 - DNA, 25 bp, Rattus norvegicus
aacacactgtgctggtcgagtccca

SEQ ID NO: 20371 - DNA, 25 bp, Rattus norvegicus
aacacacttaagatacatgtctgaa

SEQ ID NO: 20372 - DNA, 25 bp, Rattus norvegicus
aacacacttaagttacatgtctgaa

SEQ ID NO: 20373 - DNA, 25 bp, Rattus norvegicus
aacacacttcagaggcactgggagt

SEQ ID NO: 20374 - DNA, 25 bp, Rattus norvegicus
aacacacttcagtggcactgggagt

SEQ ID NO: 20375 - DNA, 25 bp, Rattus norvegicus
aacacacttggtcgtcactacttgt

SEQ ID NO: 20376 - DNA, 25 bp, Rattus norvegicus
aacacacttggtggtcactacttgt

SEQ ID NO: 20377 - DNA, 25 bp, Rattus norvegicus
aacacacttgtcctttgtggttaca

SEQ ID NO: 20378 - DNA, 25 bp, Rattus norvegicus
aacacacttgtcgtttgtggttaca

SEQ ID NO: 20379 - DNA, 25 bp, Rattus norvegicus
aacacacttgttaattggccacaga

SEQ ID NO: 20380 - DNA, 25 bp, Rattus norvegicus
aacacacttgtttattggccacaga

SEQ ID NO: 20381 - DNA, 25 bp, Rattus norvegicus
aacacagaactccaggtgcttctgc

SEQ ID NO: 20382 - DNA, 25 bp, Rattus norvegicus
aacacagaactcgaggtgcttctgc

SEQ ID NO: 20383 - DNA, 25 bp, Rattus norvegicus
aacacagaacttatgcggcctgtcg

SEQ ID NO: 20384 - DNA, 25 bp, Rattus norvegicus
aacacagaacttcctatctacagtt

SEQ ID NO: 20385 - DNA, 25 bp, Rattus norvegicus
aacacagaacttgctatctacagtt

SEQ ID NO: 20386 - DNA, 25 bp, Rattus norvegicus
aacacagaacttttgcggcctgtcg

SEQ ID NO: 20387 - DNA, 25 bp, Rattus norvegicus
aacacagacaggagttgccccaaag

SEQ ID NO: 20388 - DNA, 25 bp, Rattus norvegicus
aacacagacaggtgttgccccaaag

SEQ ID NO: 20389 - DNA, 25 bp, Rattus norvegicus
aacacagaccaaacgccgggaatgt

SEQ ID NO: 20390 - DNA, 25 bp, Rattus norvegicus
aacacagaccaatcgccgggaatgt

SEQ ID NO: 20391 - DNA, 25 bp, Rattus norvegicus
aacacagaccccatcaagttcgaga

SEQ ID NO: 20392 - DNA, 25 bp, Rattus norvegicus
aacacagaccccttcaagttcgaga

SEQ ID NO: 20393 - DNA, 25 bp, Rattus norvegicus
aacacagaccctaagtagaaccaga

SEQ ID NO: 20394 - DNA, 25 bp, Rattus norvegicus
aacacagacccttagtagaaccaga

SEQ ID NO: 20395 - DNA, 25 bp, Rattus norvegicus
aacacagacctgacacgaaccggat

SEQ ID NO: 20396 - DNA, 25 bp, Rattus norvegicus
aacacagacctgtcacgaaccggat

SEQ ID NO: 20397 - DNA, 25 bp, Rattus norvegicus
aacacagacgcactggcccgtgcag

SEQ ID NO: 20398 - DNA, 25 bp, Rattus norvegicus
aacacagacgcagtggcccgtgcag

SEQ ID NO: 20399 - DNA, 25 bp, Rattus norvegicus
aacacagacgtcctttgccaactgt

SEQ ID NO: 20400 - DNA, 25 bp, Rattus norvegicus
aacacagacgtcgtttgccaactgt

SEQ ID NO: 20401 - DNA, 25 bp, Rattus norvegicus
aacacagacttcaggatcctccctg

SEQ ID NO: 20402 - DNA, 25 bp, Rattus norvegicus
aacacagacttctggatcctccctg

SEQ ID NO: 20403 - DNA, 25 bp, Rattus norvegicus
aacacagacttgcaggagacccctc

SEQ ID NO: 20404 - DNA, 25 bp, Rattus norvegicus
aacacagacttggaggagacccctc

SEQ ID NO: 20405 - DNA, 25 bp, Rattus norvegicus
aacacagagatgacgactgcggcag

SEQ ID NO: 20406 - DNA, 25 bp, Rattus norvegicus
aacacagagatgtcgactgcggcag

SEQ ID NO: 20407 - DNA, 25 bp, Rattus norvegicus
aacacagagccaactctgtagcctt

SEQ ID NO: 20408 - DNA, 25 bp, Rattus norvegicus
aacacagagccatctctgtagcctt

SEQ ID NO: 20409 - DNA, 25 bp, Rattus norvegicus
aacacagatatacggtccggccgcc

SEQ ID NO: 20410 - DNA, 25 bp, Rattus norvegicus
aacacagatatagggtccggccgcc

SEQ ID NO: 20411 - DNA, 25 bp, Rattus norvegicus
aacacagatatcacagccgattcct

SEQ ID NO: 20412 - DNA, 25 bp, Rattus norvegicus
aacacagatatctcagccgattcct

SEQ ID NO: 20413 - DNA, 25 bp, Rattus norvegicus
aacacagatatgactaacaagcatt

SEQ ID NO: 20414 - DNA, 25 bp, Rattus norvegicus
aacacagatatgtctaacaagcatt

SEQ ID NO: 20415 - DNA, 25 bp, Rattus norvegicus
aacacagatgacctccaagggcctg

SEQ ID NO: 20416 - DNA, 25 bp, Rattus norvegicus
aacacagatgacgtccaagggcctg

SEQ ID NO: 20417 - DNA, 25 bp, Rattus norvegicus
aacacagcactaccattgcgtgaga

SEQ ID NO: 20418 - DNA, 25 bp, Rattus norvegicus
aacacagcactagcattgcgtgaga

SEQ ID NO: 20419 - DNA, 25 bp, Rattus norvegicus
aacacagcagctcggaccgaggcca

SEQ ID NO: 20420 - DNA, 25 bp, Rattus norvegicus
aacacagcagctgggaccgaggcca

SEQ ID NO: 20421 - DNA, 25 bp, Rattus norvegicus
aacacagcagtgatagccaggtccc

SEQ ID NO: 20422 - DNA, 25 bp, Rattus norvegicus
aacacagcagtgttagccaggtccc

SEQ ID NO: 20423 - DNA, 25 bp, Rattus norvegicus
aacacagcatgccacaaaccgtatg

SEQ ID NO: 20424 - DNA, 25 bp, Rattus norvegicus
aacacagcatgcgacaaaccgtatg

SEQ ID NO: 20425 - DNA, 25 bp, Rattus norvegicus
aacacagcatgtccgaggtctgaat

SEQ ID NO: 20426 - DNA, 25 bp, Rattus norvegicus
aacacagcatgtgcgaggtctgaat

SEQ ID NO: 20427 - DNA, 25 bp, Rattus norvegicus
aacacagccaagctagaccgggaga

SEQ ID NO: 20428 - DNA, 25 bp, Rattus norvegicus
aacacagccaaggtagaccgggaga

SEQ ID NO: 20429 - DNA, 25 bp, Rattus norvegicus
aacacagccacgcacttggaaggat

SEQ ID NO: 20430 - DNA, 25 bp, Rattus norvegicus
aacacagccacggacttggaaggat

SEQ ID NO: 20431 - DNA, 25 bp, Rattus norvegicus
aacacagccagaacccacgattcta

SEQ ID NO: 20432 - DNA, 25 bp, Rattus norvegicus
aacacagccagatcccacgattcta

SEQ ID NO: 20433 - DNA, 25 bp, Rattus norvegicus
aacacagcccgtctctgaaattttg

SEQ ID NO: 20434 - DNA, 25 bp, Rattus norvegicus
aacacagcccgtgtctgaaattttg

SEQ ID NO: 20435 - DNA, 25 bp, Rattus norvegicus
aacacagccctaccagagagaagtc

SEQ ID NO: 20436 - DNA, 25 bp, Rattus norvegicus
aacacagccctagcagagagaagtc

SEQ ID NO: 20437 - DNA, 25 bp, Rattus norvegicus
aacacagcccttaagaagcgttcat

SEQ ID NO: 20438 - DNA, 25 bp, Rattus norvegicus
aacacagccctttagaagcgttcat

SEQ ID NO: 20439 - DNA, 25 bp, Rattus norvegicus
aacacagcctagaatggtgggcaca

SEQ ID NO: 20440 - DNA, 25 bp, Rattus norvegicus
aacacagcctagtatggtgggcaca

SEQ ID NO: 20441 - DNA, 25 bp, Rattus norvegicus
aacacagcctctccattgtggcaaa

SEQ ID NO: 20442 - DNA, 25 bp, Rattus norvegicus
aacacagcctctgcattgtggcaaa

SEQ ID NO: 20443 - DNA, 25 bp, Rattus norvegicus
aacacagcctttctagctaacgggt

SEQ ID NO: 20444 - DNA, 25 bp, Rattus norvegicus
aacacagcctttgtagctaacgggt

SEQ ID NO: 20445 - DNA, 25 bp, Rattus norvegicus
aacacagcgtgcagctgaggactca

SEQ ID NO: 20446 - DNA, 25 bp, Rattus norvegicus
aacacagcgtgctgctgaggactca

SEQ ID NO: 20447 - DNA, 25 bp, Rattus norvegicus
aacacagctatcaagagagccacat

SEQ ID NO: 20448 - DNA, 25 bp, Rattus norvegicus
aacacagctatctagagagccacat

SEQ ID NO: 20449 - DNA, 25 bp, Rattus norvegicus
aacacagctgacacggttgagctcc

SEQ ID NO: 20450 - DNA, 25 bp, Rattus norvegicus
aacacagctgactcggttgagctcc

SEQ ID NO: 20451 - DNA, 25 bp, Rattus norvegicus
aacacagctgcaagggcaattcaaa

SEQ ID NO: 20452 - DNA, 25 bp, Rattus norvegicus
aacacagctgcatgggcaattcaaa

SEQ ID NO: 20453 - DNA, 25 bp, Rattus norvegicus
aacacagcttccctgggagacgcga

SEQ ID NO: 20454 - DNA, 25 bp, Rattus norvegicus
aacacagcttccgtgggagacgcga

SEQ ID NO: 20455 - DNA, 25 bp, Rattus norvegicus
aacacagcttttcaggttgcagtca

SEQ ID NO: 20456 - DNA, 25 bp, Rattus norvegicus
aacacagcttttgaggttgcagtca

SEQ ID NO: 20457 - DNA, 25 bp, Rattus norvegicus
aacacaggaacaaggctcagactca

SEQ ID NO: 20458 - DNA, 25 bp, Rattus norvegicus
aacacaggaacatggctcagactca

SEQ ID NO: 20459 - DNA, 25 bp, Rattus norvegicus
aacacaggactcaagccttgagggt

SEQ ID NO: 20460 - DNA, 25 bp, Rattus norvegicus
aacacaggactctagccttgagggt

SEQ ID NO: 20461 - DNA, 25 bp, Rattus norvegicus
aacacaggagttactggactggcca

SEQ ID NO: 20462 - DNA, 25 bp, Rattus norvegicus
aacacaggagtttctggactggcca

SEQ ID NO: 20463 - DNA, 25 bp, Rattus norvegicus
aacacaggatgcatttttcgagtat

SEQ ID NO: 20464 - DNA, 25 bp, Rattus norvegicus
aacacaggatgcttttttcgagtat

SEQ ID NO: 20465 - DNA, 25 bp, Rattus norvegicus
aacacaggcctgatagtcagcatca

SEQ ID NO: 20466 - DNA, 25 bp, Rattus norvegicus
aacacaggcctgatgtatctggcag

SEQ ID NO: 20467 - DNA, 25 bp, Rattus norvegicus
aacacaggcctgttagtcagcatca

SEQ ID NO: 20468 - DNA, 25 bp, Rattus norvegicus
aacacaggcctgttgtatctggcag

SEQ ID NO: 20469 - DNA, 25 bp, Rattus norvegicus
aacacaggctaaaggtggcacaaga

SEQ ID NO: 20470 - DNA, 25 bp, Rattus norvegicus
aacacaggctaatggtggcacaaga

SEQ ID NO: 20471 - DNA, 25 bp, Rattus norvegicus
aacacaggctgtctattaaggtcca

SEQ ID NO: 20472 - DNA, 25 bp, Rattus norvegicus
aacacaggctgtgtattaaggtcca

SEQ ID NO: 20473 - DNA, 25 bp, Rattus norvegicus
aacacagggatgagcaccggagccc

SEQ ID NO: 20474 - DNA, 25 bp, Rattus norvegicus
aacacagggatgtgcaccggagccc

SEQ ID NO: 20475 - DNA, 25 bp, Rattus norvegicus
aacacagggattcctcttcggtgat

SEQ ID NO: 20476 - DNA, 25 bp, Rattus norvegicus
aacacagggattgctcttcggtgat

SEQ ID NO: 20477 - DNA, 25 bp, Rattus norvegicus
aacacagggctcagaacataatttc

SEQ ID NO: 20478 - DNA, 25 bp, Rattus norvegicus
aacacagggctctgaacataatttc

SEQ ID NO: 20479 - DNA, 25 bp, Rattus norvegicus
aacacaggtctaagagggttctcac

SEQ ID NO: 20480 - DNA, 25 bp, Rattus norvegicus
aacacaggtctatgagggttctcac

SEQ ID NO: 20481 - DNA, 25 bp, Rattus norvegicus
aacacaggtcttaggtggacatcat

SEQ ID NO: 20482 - DNA, 25 bp, Rattus norvegicus
aacacaggtctttggtggacatcat

SEQ ID NO: 20483 - DNA, 25 bp, Rattus norvegicus
aacacaggtggcatatacacgcact

SEQ ID NO: 20484 - DNA, 25 bp, Rattus norvegicus
aacacaggtggcttatacacgcact

SEQ ID NO: 20485 - DNA, 25 bp, Rattus norvegicus
aacacaggtgggaaacgcagcggac

SEQ ID NO: 20486 - DNA, 25 bp, Rattus norvegicus
aacacaggtgggtaacgcagcggac

SEQ ID NO: 20487 - DNA, 25 bp, Rattus norvegicus
aacacaggttctaacctagtctcca

SEQ ID NO: 20488 - DNA, 25 bp, Rattus norvegicus
aacacaggttcttacctagtctcca

SEQ ID NO: 20489 - DNA, 25 bp, Rattus norvegicus
aacacaggttgactgtcccatgcct

SEQ ID NO: 20490 - DNA, 25 bp, Rattus norvegicus
aacacaggttgagtgtcccatgcct

SEQ ID NO: 20491 - DNA, 25 bp, Rattus norvegicus
aacacagtacctcgcggctgtgatc

SEQ ID NO: 20492 - DNA, 25 bp, Rattus norvegicus
aacacagtacctggcggctgtgatc

SEQ ID NO: 20493 - DNA, 25 bp, Rattus norvegicus
aacacagtaggtaatgactagtctt

SEQ ID NO: 20494 - DNA, 25 bp, Rattus norvegicus
aacacagtaggttatgactagtctt

SEQ ID NO: 20495 - DNA, 25 bp, Rattus norvegicus
aacacagtatcaagactcgggtgga

SEQ ID NO: 20496 - DNA, 25 bp, Rattus norvegicus
aacacagtatcatgactcgggtgga

SEQ ID NO: 20497 - DNA, 25 bp, Rattus norvegicus
aacacagtcaagagctaggcaagct

SEQ ID NO: 20498 - DNA, 25 bp, Rattus norvegicus
aacacagtcaagtgctaggcaagct

SEQ ID NO: 20499 - DNA, 25 bp, Rattus norvegicus
aacacagtccatatctgagagctat

SEQ ID NO: 20500 - DNA, 25 bp, Rattus norvegicus
aacacagtccatttctgagagctat

SEQ ID NO: 20501 - DNA, 25 bp, Rattus norvegicus
aacacagtccttaccatgagcatgt

SEQ ID NO: 20502 - DNA, 25 bp, Rattus norvegicus
aacacagtcctttccatgagcatgt

SEQ ID NO: 20503 - DNA, 25 bp, Rattus norvegicus
aacacagtcgtcctttggcagatct

SEQ ID NO: 20504 - DNA, 25 bp, Rattus norvegicus
aacacagtcgtcgtttggcagatct

SEQ ID NO: 20505 - DNA, 25 bp, Rattus norvegicus
aacacagtgctcattttaggaaatc

SEQ ID NO: 20506 - DNA, 25 bp, Rattus norvegicus
aacacagtgctctttttaggaaatc

SEQ ID NO: 20507 - DNA, 25 bp, Rattus norvegicus
aacacagtggccatgttgatcttgc

SEQ ID NO: 20508 - DNA, 25 bp, Rattus norvegicus
aacacagtggccttgttgatcttgc

SEQ ID NO: 20509 - DNA, 25 bp, Rattus norvegicus
aacacagtgggcatgagttcccagc

SEQ ID NO: 20510 - DNA, 25 bp, Rattus norvegicus
aacacagtgggcttgagttcccagc

SEQ ID NO: 20511 - DNA, 25 bp, Rattus norvegicus
aacacagtgggtactccatttccta

SEQ ID NO: 20512 - DNA, 25 bp, Rattus norvegicus
aacacagtgggttctccatttccta

SEQ ID NO: 20513 - DNA, 25 bp, Rattus norvegicus
aacacagtgttgcatatctaacaga

SEQ ID NO: 20514 - DNA, 25 bp, Rattus norvegicus
aacacagtgttggatatctaacaga

SEQ ID NO: 20515 - DNA, 25 bp, Rattus norvegicus
aacacagttcagacgctgggtgtct

SEQ ID NO: 20516 - DNA, 25 bp, Rattus norvegicus
aacacagttcagtcgctgggtgtct

SEQ ID NO: 20517 - DNA, 25 bp, Rattus norvegicus
aacacagttctccatgaccgccggt

SEQ ID NO: 20518 - DNA, 25 bp, Rattus norvegicus
aacacagttctcgatgaccgccggt

SEQ ID NO: 20519 - DNA, 25 bp, Rattus norvegicus
aacacagttggccttcagactgcgt

SEQ ID NO: 20520 - DNA, 25 bp, Rattus norvegicus
aacacagttggcgttcagactgcgt

SEQ ID NO: 20521 - DNA, 25 bp, Rattus norvegicus
aacacagtttctactactgtaacat

SEQ ID NO: 20522 - DNA, 25 bp, Rattus norvegicus
aacacagtttcttctactgtaacat

SEQ ID NO: 20523 - DNA, 25 bp, Rattus norvegicus
aacacataaactaccattcctcata

SEQ ID NO: 20524 - DNA, 25 bp, Rattus norvegicus
aacacataaacttccattcctcata

SEQ ID NO: 20525 - DNA, 25 bp, Rattus norvegicus
aacacataatgccagtccacaatca

SEQ ID NO: 20526 - DNA, 25 bp, Rattus norvegicus
aacacataatgcgagtccacaatca

SEQ ID NO: 20527 - DNA, 25 bp, Rattus norvegicus
aacacatacgccacacgacgttgga

SEQ ID NO: 20528 - DNA, 25 bp, Rattus norvegicus
aacacatacgcctcacgacgttgga

SEQ ID NO: 20529 - DNA, 25 bp, Rattus norvegicus
aacacatactagagtgaaaccttat

SEQ ID NO: 20530 - DNA, 25 bp, Rattus norvegicus
aacacatactagtgtgaaaccttat

SEQ ID NO: 20531 - DNA, 25 bp, Rattus norvegicus
aacacatactctcttgactcaacat

SEQ ID NO: 20532 - DNA, 25 bp, Rattus norvegicus
aacacatactctgttgactcaacat

SEQ ID NO: 20533 - DNA, 25 bp, Rattus norvegicus
aacacataggcgacgatgggaaggc

SEQ ID NO: 20534 - DNA, 25 bp, Rattus norvegicus
aacacataggcgtcgatgggaaggc

SEQ ID NO: 20535 - DNA, 25 bp, Rattus norvegicus
aacacatagttgaacccttgggatg

SEQ ID NO: 20536 - DNA, 25 bp, Rattus norvegicus
aacacatagttgtacccttgggatg

SEQ ID NO: 20537 - DNA, 25 bp, Rattus norvegicus
aacacatatctacatgtccctgctc

SEQ ID NO: 20538 - DNA, 25 bp, Rattus norvegicus
aacacatatctagatgtccctgctc

SEQ ID NO: 20539 - DNA, 25 bp, Rattus norvegicus
aacacatcagctccaaattgccttc

SEQ ID NO: 20540 - DNA, 25 bp, Rattus norvegicus
aacacatcagctgcaaattgccttc

SEQ ID NO: 20541 - DNA, 25 bp, Rattus norvegicus
aacacatccagtctgataatgagga

SEQ ID NO: 20542 - DNA, 25 bp, Rattus norvegicus
aacacatccagtgtgataatgagga

SEQ ID NO: 20543 - DNA, 25 bp, Rattus norvegicus
aacacatccgttctctgctgtgcag

SEQ ID NO: 20544 - DNA, 25 bp, Rattus norvegicus
aacacatccgttgtctgctgtgcag

SEQ ID NO: 20545 - DNA, 25 bp, Rattus norvegicus
aacacatcctccagcaaagtatggc

SEQ ID NO: 20546 - DNA, 25 bp, Rattus norvegicus
aacacatcctcctgcaaagtatggc

SEQ ID NO: 20547 - DNA, 25 bp, Rattus norvegicus
aacacatcgcagaacttcttcatca

SEQ ID NO: 20548 - DNA, 25 bp, Rattus norvegicus
aacacatcgcagtacttcttcatca

SEQ ID NO: 20549 - DNA, 25 bp, Rattus norvegicus
aacacatcggagaagtcccttccaa

SEQ ID NO: 20550 - DNA, 25 bp, Rattus norvegicus
aacacatcggagtagtcccttccaa

SEQ ID NO: 20551 - DNA, 25 bp, Rattus norvegicus
aacacatctagtacttaagtggcac

SEQ ID NO: 20552 - DNA, 25 bp, Rattus norvegicus
aacacatctagttcttaagtggcac

SEQ ID NO: 20553 - DNA, 25 bp, Rattus norvegicus
aacacatctcaacaaacaaggcaga

SEQ ID NO: 20554 - DNA, 25 bp, Rattus norvegicus
aacacatctcaagaaacaaggcaga

SEQ ID NO: 20555 - DNA, 25 bp, Rattus norvegicus
aacacatctgcaagggattcctgcc

SEQ ID NO: 20556 - DNA, 25 bp, Rattus norvegicus
aacacatctgcaccaatccatgaag

SEQ ID NO: 20557 - DNA, 25 bp, Rattus norvegicus
aacacatctgcagcaatccatgaag

SEQ ID NO: 20558 - DNA, 25 bp, Rattus norvegicus
aacacatctgcatgggattcctgcc

SEQ ID NO: 20559 - DNA, 25 bp, Rattus norvegicus
aacacatgcacacacatccacttgt

SEQ ID NO: 20560 - DNA, 25 bp, Rattus norvegicus
aacacatgcacagacatccacttgt

SEQ ID NO: 20561 - DNA, 25 bp, Rattus norvegicus
aacacatgcaccaagggtctcttta

SEQ ID NO: 20562 - DNA, 25 bp, Rattus norvegicus
aacacatgcacctagggtctcttta

SEQ ID NO: 20563 - DNA, 25 bp, Rattus norvegicus
aacacatgcagaagaaggttccgaa

SEQ ID NO: 20564 - DNA, 25 bp, Rattus norvegicus
aacacatgcagatgaaggttccgaa

SEQ ID NO: 20565 - DNA, 25 bp, Rattus norvegicus
aacacatgcatcaatgggaccaaac

SEQ ID NO: 20566 - DNA, 25 bp, Rattus norvegicus
aacacatgcatctatgggaccaaac

SEQ ID NO: 20567 - DNA, 25 bp, Rattus norvegicus
aacacatgccatcttctgtgcagcc

SEQ ID NO: 20568 - DNA, 25 bp, Rattus norvegicus
aacacatgccatgttctgtgcagcc

SEQ ID NO: 20569 - DNA, 25 bp, Rattus norvegicus
aacacatgctaccttagtccctttt

SEQ ID NO: 20570 - DNA, 25 bp, Rattus norvegicus
aacacatgctacgttagtccctttt

SEQ ID NO: 20571 - DNA, 25 bp, Rattus norvegicus
aacacatgcttaattgactgtgcag

SEQ ID NO: 20572 - DNA, 25 bp, Rattus norvegicus
aacacatgcttatttgactgtgcag

SEQ ID NO: 20573 - DNA, 25 bp, Rattus norvegicus
aacacatggccaaggaggcctttga

SEQ ID NO: 20574 - DNA, 25 bp, Rattus norvegicus
aacacatggccatggaggcctttga

SEQ ID NO: 20575 - DNA, 25 bp, Rattus norvegicus
aacacatggctaacgctgggacgat

SEQ ID NO: 20576 - DNA, 25 bp, Rattus norvegicus
aacacatggctatcgctgggacgat

SEQ ID NO: 20577 - DNA, 25 bp, Rattus norvegicus
aacacatggctcattggaacaattt

SEQ ID NO: 20578 - DNA, 25 bp, Rattus norvegicus
aacacatggctctttggaacaattt

SEQ ID NO: 20579 - DNA, 25 bp, Rattus norvegicus
aacacatgtatcactcagttaaaga

SEQ ID NO: 20580 - DNA, 25 bp, Rattus norvegicus
aacacatgtatctctcagttaaaga

SEQ ID NO: 20581 - DNA, 25 bp, Rattus norvegicus
aacacattcagcagctgggtgtcca

SEQ ID NO: 20582 - DNA, 25 bp, Rattus norvegicus
aacacattcagctgctgggtgtcca

SEQ ID NO: 20583 - DNA, 25 bp, Rattus norvegicus
aacacattcccaaggatcactgaga

SEQ ID NO: 20584 - DNA, 25 bp, Rattus norvegicus
aacacattcccatggatcactgaga

SEQ ID NO: 20585 - DNA, 25 bp, Rattus norvegicus
aacacattctgaactcaggctgcct

SEQ ID NO: 20586 - DNA, 25 bp, Rattus norvegicus
aacacattctgatctcaggctgcct

SEQ ID NO: 20587 - DNA, 25 bp, Rattus norvegicus
aacacattgaagagcccaagcttga

SEQ ID NO: 20588 - DNA, 25 bp, Rattus norvegicus
aacacattgaagtgcccaagcttga

SEQ ID NO: 20589 - DNA, 25 bp, Rattus norvegicus
aacacattgtatagccttgttggct

SEQ ID NO: 20590 - DNA, 25 bp, Rattus norvegicus
aacacattgtattgccttgttggct

SEQ ID NO: 20591 - DNA, 25 bp, Rattus norvegicus
aacacatttattcttaccagtggac

SEQ ID NO: 20592 - DNA, 25 bp, Rattus norvegicus
aacacatttattgttaccagtggac

SEQ ID NO: 20593 - DNA, 25 bp, Rattus norvegicus
aacacatttcaactggctggccatg

SEQ ID NO: 20594 - DNA, 25 bp, Rattus norvegicus
aacacatttcaagtggctggccatg

SEQ ID NO: 20595 - DNA, 25 bp, Rattus norvegicus
aacacatttcacacttatccataca

SEQ ID NO: 20596 - DNA, 25 bp, Rattus norvegicus
aacacatttcactcttatccataca

SEQ ID NO: 20597 - DNA, 25 bp, Rattus norvegicus
aacacatttcctaggttcttggctg

SEQ ID NO: 20598 - DNA, 25 bp, Rattus norvegicus
aacacatttcctcctggtagtgcct

SEQ ID NO: 20599 - DNA, 25 bp, Rattus norvegicus
aacacatttcctgctggtagtgcct

SEQ ID NO: 20600 - DNA, 25 bp, Rattus norvegicus
aacacatttccttggttcttggctg

SEQ ID NO: 20601 - DNA, 25 bp, Rattus norvegicus
aacacattttgtccactgctgacac

SEQ ID NO: 20602 - DNA, 25 bp, Rattus norvegicus
aacacattttgtgcactgctgacac

SEQ ID NO: 20603 - DNA, 25 bp, Rattus norvegicus
aacaccaaatgccacctagttaggt

SEQ ID NO: 20604 - DNA, 25 bp, Rattus norvegicus
aacaccaaatgcgacctagttaggt

SEQ ID NO: 20605 - DNA, 25 bp, Rattus norvegicus
aacaccaacacgctcaacaggaaaa

SEQ ID NO: 20606 - DNA, 25 bp, Rattus norvegicus
aacaccaacacggtcaacaggaaaa

SEQ ID NO: 20607 - DNA, 25 bp, Rattus norvegicus
aacaccaacatccatgggcggcgga

SEQ ID NO: 20608 - DNA, 25 bp, Rattus norvegicus
aacaccaacatcgatgggcggcgga

SEQ ID NO: 20609 - DNA, 25 bp, Rattus norvegicus
aacaccaactctagagccgtgagac

SEQ ID NO: 20610 - DNA, 25 bp, Rattus norvegicus
aacaccaactcttgagccgtgagac

SEQ ID NO: 20611 - DNA, 25 bp, Rattus norvegicus
aacaccaacttgcttatgggcaaag

SEQ ID NO: 20612 - DNA, 25 bp, Rattus norvegicus
aacaccaacttggttatgggcaaag

SEQ ID NO: 20613 - DNA, 25 bp, Rattus norvegicus
aacaccaagtagagtcttcctgcct

SEQ ID NO: 20614 - DNA, 25 bp, Rattus norvegicus
aacaccaagtagtgtcttcctgcct

SEQ ID NO: 20615 - DNA, 25 bp, Rattus norvegicus
aacaccaagttgagggactccagtc

SEQ ID NO: 20616 - DNA, 25 bp, Rattus norvegicus
aacaccaagttgtgggactccagtc

SEQ ID NO: 20617 - DNA, 25 bp, Rattus norvegicus
aacaccacacacatcagcggggatt

SEQ ID NO: 20618 - DNA, 25 bp, Rattus norvegicus
aacaccacacacttcagcggggatt

SEQ ID NO: 20619 - DNA, 25 bp, Rattus norvegicus
aacaccacagtgcagagctgctcat

SEQ ID NO: 20620 - DNA, 25 bp, Rattus norvegicus
aacaccacagtggagagctgctcat

SEQ ID NO: 20621 - DNA, 25 bp, Rattus norvegicus
aacaccacccagatgttacctatgt

SEQ ID NO: 20622 - DNA, 25 bp, Rattus norvegicus
aacaccacccagttgttacctatgt

SEQ ID NO: 20623 - DNA, 25 bp, Rattus norvegicus
aacaccacgtggagctgtttaatcc

SEQ ID NO: 20624 - DNA, 25 bp, Rattus norvegicus
aacaccacgtggtgctgtttaatcc

SEQ ID NO: 20625 - DNA, 25 bp, Rattus norvegicus
aacaccactgatcgatccaggctag

SEQ ID NO: 20626 - DNA, 25 bp, Rattus norvegicus
aacaccactgatggatccaggctag

SEQ ID NO: 20627 - DNA, 25 bp, Rattus norvegicus
aacaccactggaaattagacattca

SEQ ID NO: 20628 - DNA, 25 bp, Rattus norvegicus
aacaccactggatattagacattca

SEQ ID NO: 20629 - DNA, 25 bp, Rattus norvegicus
aacaccactggcattagggacacca

SEQ ID NO: 20630 - DNA, 25 bp, Rattus norvegicus
aacaccactggctttagggacacca

SEQ ID NO: 20631 - DNA, 25 bp, Rattus norvegicus
aacaccacttgcattgtataggctg

SEQ ID NO: 20632 - DNA, 25 bp, Rattus norvegicus
aacaccacttgctttgtataggctg

SEQ ID NO: 20633 - DNA, 25 bp, Rattus norvegicus
aacaccagagctagcagcgcagaaa

SEQ ID NO: 20634 - DNA, 25 bp, Rattus norvegicus
aacaccagagcttgcagcgcagaaa

SEQ ID NO: 20635 - DNA, 25 bp, Rattus norvegicus
aacaccagaggtcgctttcgtgaga

SEQ ID NO: 20636 - DNA, 25 bp, Rattus norvegicus
aacaccagaggtggctttcgtgaga

SEQ ID NO: 20637 - DNA, 25 bp, Rattus norvegicus
aacaccagcagcagatagggccagt

SEQ ID NO: 20638 - DNA, 25 bp, Rattus norvegicus
aacaccagcagctgatagggccagt

SEQ ID NO: 20639 - DNA, 25 bp, Rattus norvegicus
aacaccagcatcaagttcacaatgt

SEQ ID NO: 20640 - DNA, 25 bp, Rattus norvegicus
aacaccagcatctagttcacaatgt

SEQ ID NO: 20641 - DNA, 25 bp, Rattus norvegicus
aacaccaggaccagactgtgactca

SEQ ID NO: 20642 - DNA, 25 bp, Rattus norvegicus
aacaccaggacctgactgtgactca

SEQ ID NO: 20643 - DNA, 25 bp, Rattus norvegicus
aacaccaggccaccgaatgtgaaaa

SEQ ID NO: 20644 - DNA, 25 bp, Rattus norvegicus
aacaccaggccagcgaatgtgaaaa

SEQ ID NO: 20645 - DNA, 25 bp, Rattus norvegicus
aacaccaggcccaatggacattgtt

SEQ ID NO: 20646 - DNA, 25 bp, Rattus norvegicus
aacaccaggccctatggacattgtt

SEQ ID NO: 20647 - DNA, 25 bp, Rattus norvegicus
aacaccagtgacactctaggaatcc

SEQ ID NO: 20648 - DNA, 25 bp, Rattus norvegicus
aacaccagtgactctctaggaatcc

SEQ ID NO: 20649 - DNA, 25 bp, Rattus norvegicus
aacaccagttctaggtggcaagcca

SEQ ID NO: 20650 - DNA, 25 bp, Rattus norvegicus
aacaccagttcttggtggcaagcca

SEQ ID NO: 20651 - DNA, 25 bp, Rattus norvegicus
aacaccagttggagctctgtgacca

SEQ ID NO: 20652 - DNA, 25 bp, Rattus norvegicus
aacaccagttggtgctctgtgacca

SEQ ID NO: 20653 - DNA, 25 bp, Rattus norvegicus
aacaccatctcgaactgtgcatttt

SEQ ID NO: 20654 - DNA, 25 bp, Rattus norvegicus
aacaccatctcgtactgtgcatttt

SEQ ID NO: 20655 - DNA, 25 bp, Rattus norvegicus
aacaccatgatacttcttcagggat

SEQ ID NO: 20656 - DNA, 25 bp, Rattus norvegicus
aacaccatgatagttcttcagggat

SEQ ID NO: 20657 - DNA, 25 bp, Rattus norvegicus
aacaccatgcgtctagtgcctgtac

SEQ ID NO: 20658 - DNA, 25 bp, Rattus norvegicus
aacaccatgcgtgtagtgcctgtac

SEQ ID NO: 20659 - DNA, 25 bp, Rattus norvegicus
aacaccatgctcatggacaccaagt

SEQ ID NO: 20660 - DNA, 25 bp, Rattus norvegicus
aacaccatgctcttggacaccaagt

SEQ ID NO: 20661 - DNA, 25 bp, Rattus norvegicus
aacaccatgttacatgctccagcct

SEQ ID NO: 20662 - DNA, 25 bp, Rattus norvegicus
aacaccatgttagatgctccagcct

SEQ ID NO: 20663 - DNA, 25 bp, Rattus norvegicus
aacaccattccccactgagagatgt

SEQ ID NO: 20664 - DNA, 25 bp, Rattus norvegicus
aacaccattcccgactgagagatgt

SEQ ID NO: 20665 - DNA, 25 bp, Rattus norvegicus
aacaccattgctattactttgatta

SEQ ID NO: 20666 - DNA, 25 bp, Rattus norvegicus
aacaccattgcttttactttgatta

SEQ ID NO: 20667 - DNA, 25 bp, Rattus norvegicus
aacaccattgttagctttttccaca

SEQ ID NO: 20668 - DNA, 25 bp, Rattus norvegicus
aacaccattgtttgctttttccaca

SEQ ID NO: 20669 - DNA, 25 bp, Rattus norvegicus
aacacccaaactcgactgtggcgca

SEQ ID NO: 20670 - DNA, 25 bp, Rattus norvegicus
aacacccaaactggactgtggcgca

SEQ ID NO: 20671 - DNA, 25 bp, Rattus norvegicus
aacacccaagtgataatttgccaca

SEQ ID NO: 20672 - DNA, 25 bp, Rattus norvegicus
aacacccaagtgttaatttgccaca

SEQ ID NO: 20673 - DNA, 25 bp, Rattus norvegicus
aacacccacaagcacatttggccaa

SEQ ID NO: 20674 - DNA, 25 bp, Rattus norvegicus
aacacccacaaggacatttggccaa

SEQ ID NO: 20675 - DNA, 25 bp, Rattus norvegicus
aacacccagataccagcacaagtcg

SEQ ID NO: 20676 - DNA, 25 bp, Rattus norvegicus
aacacccagatagcagcacaagtcg

SEQ ID NO: 20677 - DNA, 25 bp, Rattus norvegicus
aacacccagtcacgtggctgacagt

SEQ ID NO: 20678 - DNA, 25 bp, Rattus norvegicus
aacacccagtcaggtggctgacagt

SEQ ID NO: 20679 - DNA, 25 bp, Rattus norvegicus
aacacccagtggcaggcctcattgg

SEQ ID NO: 20680 - DNA, 25 bp, Rattus norvegicus
aacacccagtgggaggcctcattgg

SEQ ID NO: 20681 - DNA, 25 bp, Rattus norvegicus
aacacccagtttagcattgctgttt

SEQ ID NO: 20682 - DNA, 25 bp, Rattus norvegicus
aacacccagttttgcattgctgttt

SEQ ID NO: 20683 - DNA, 25 bp, Rattus norvegicus
aacacccatgtccactggaacagga

SEQ ID NO: 20684 - DNA, 25 bp, Rattus norvegicus
aacacccatgtcgactggaacagga

SEQ ID NO: 20685 - DNA, 25 bp, Rattus norvegicus
aacaccccaaagaaggattgcacgt

SEQ ID NO: 20686 - DNA, 25 bp, Rattus norvegicus
aacaccccaaagtaggattgcacgt

SEQ ID NO: 20687 - DNA, 25 bp, Rattus norvegicus
aacaccccaagtacaacaatcacag

SEQ ID NO: 20688 - DNA, 25 bp, Rattus norvegicus
aacaccccaagttcaacaatcacag

SEQ ID NO: 20689 - DNA, 25 bp, Rattus norvegicus
aacaccccatttactctgaggtcat

SEQ ID NO: 20690 - DNA, 25 bp, Rattus norvegicus
aacaccccattttctctgaggtcat

SEQ ID NO: 20691 - DNA, 25 bp, Rattus norvegicus
aacaccccgtacagtgatgtctatg

SEQ ID NO: 20692 - DNA, 25 bp, Rattus norvegicus
aacaccccgtactgtgatgtctatg

SEQ ID NO: 20693 - DNA, 25 bp, Rattus norvegicus
aacacccctgacctatggacataat

SEQ ID NO: 20694 - DNA, 25 bp, Rattus norvegicus
aacacccctgacgtatggacataat

SEQ ID NO: 20695 - DNA, 25 bp, Rattus norvegicus
aacacccctgggaacttgtagcaga

SEQ ID NO: 20696 - DNA, 25 bp, Rattus norvegicus
aacacccctgggtacttgtagcaga

SEQ ID NO: 20697 - DNA, 25 bp, Rattus norvegicus
aacaccccttctccatatgttagtg

SEQ ID NO: 20698 - DNA, 25 bp, Rattus norvegicus
aacaccccttctgcatatgttagtg

SEQ ID NO: 20699 - DNA, 25 bp, Rattus norvegicus
aacaccccttgaagttgtccagtag

SEQ ID NO: 20700 - DNA, 25 bp, Rattus norvegicus
aacaccccttgatgttgtccagtag

SEQ ID NO: 20701 - DNA, 25 bp, Rattus norvegicus
aacacccgagacatcttatattggc

SEQ ID NO: 20702 - DNA, 25 bp, Rattus norvegicus
aacacccgagacttcttatattggc

SEQ ID NO: 20703 - DNA, 25 bp, Rattus norvegicus
aacacccgagttcatttctcttaat

SEQ ID NO: 20704 - DNA, 25 bp, Rattus norvegicus
aacacccgagttgatttctcttaat

SEQ ID NO: 20705 - DNA, 25 bp, Rattus norvegicus
aacacccgggacactagttccagag

SEQ ID NO: 20706 - DNA, 25 bp, Rattus norvegicus
aacacccgggactctagttccagag

SEQ ID NO: 20707 - DNA, 25 bp, Rattus norvegicus
aacacccgtgttaatatggaataag

SEQ ID NO: 20708 - DNA, 25 bp, Rattus norvegicus
aacacccgtgtttatatggaataag

SEQ ID NO: 20709 - DNA, 25 bp, Rattus norvegicus
aacaccctcagtcttggtgtgaaca

SEQ ID NO: 20710 - DNA, 25 bp, Rattus norvegicus
aacaccctcagtgttggtgtgaaca

SEQ ID NO: 20711 - DNA, 25 bp, Rattus norvegicus
aacaccctcatgctcatagcattgc

SEQ ID NO: 20712 - DNA, 25 bp, Rattus norvegicus
aacaccctcatggtcatagcattgc

SEQ ID NO: 20713 - DNA, 25 bp, Rattus norvegicus
aacaccctctgcactgtaatgaatg

SEQ ID NO: 20714 - DNA, 25 bp, Rattus norvegicus
aacaccctctgctctgtaatgaatg

SEQ ID NO: 20715 - DNA, 25 bp, Rattus norvegicus
aacaccctcttgcaactttatcttg

SEQ ID NO: 20716 - DNA, 25 bp, Rattus norvegicus
aacaccctcttggaactttatcttg

SEQ ID NO: 20717 - DNA, 25 bp, Rattus norvegicus
aacaccctgacgctagtcacagcat

SEQ ID NO: 20718 - DNA, 25 bp, Rattus norvegicus
aacaccctgacggtagtcacagcat

SEQ ID NO: 20719 - DNA, 25 bp, Rattus norvegicus
aacaccctgcagcatttagctcagt

SEQ ID NO: 20720 - DNA, 25 bp, Rattus norvegicus
aacaccctgcaggatttagctcagt

SEQ ID NO: 20721 - DNA, 25 bp, Rattus norvegicus
aacaccctgggcagaggctatcttt

SEQ ID NO: 20722 - DNA, 25 bp, Rattus norvegicus
aacaccctgggctgaggctatcttt

SEQ ID NO: 20723 - DNA, 25 bp, Rattus norvegicus
aacaccctgggtcctttggcaaagg

SEQ ID NO: 20724 - DNA, 25 bp, Rattus norvegicus
aacaccctgggtgctttggcaaagg

SEQ ID NO: 20725 - DNA, 25 bp, Rattus norvegicus
aacaccgagtagatcataccaccaa

SEQ ID NO: 20726 - DNA, 25 bp, Rattus norvegicus
aacaccgagtagttcataccaccaa

SEQ ID NO: 20727 - DNA, 25 bp, Rattus norvegicus
aacaccgatgttctcactgaactct

SEQ ID NO: 20728 - DNA, 25 bp, Rattus norvegicus
aacaccgatgttgtcactgaactct

SEQ ID NO: 20729 - DNA, 25 bp, Rattus norvegicus
aacaccgcaaaaccttcattggcag

SEQ ID NO: 20730 - DNA, 25 bp, Rattus norvegicus
aacaccgcaaaagcttcattggcag

SEQ ID NO: 20731 - DNA, 25 bp, Rattus norvegicus
aacaccgcatccctggagaactgta

SEQ ID NO: 20732 - DNA, 25 bp, Rattus norvegicus
aacaccgcatccgtggagaactgta

SEQ ID NO: 20733 - DNA, 25 bp, Rattus norvegicus
aacaccgcgccacttaagctggaga

SEQ ID NO: 20734 - DNA, 25 bp, Rattus norvegicus
aacaccgcgccagttaagctggaga

SEQ ID NO: 20735 - DNA, 25 bp, Rattus norvegicus
aacaccgcgtttcacataaagcact

SEQ ID NO: 20736 - DNA, 25 bp, Rattus norvegicus
aacaccgcgtttgacataaagcact

SEQ ID NO: 20737 - DNA, 25 bp, Rattus norvegicus
aacaccggcctgaccacaaactggg

SEQ ID NO: 20738 - DNA, 25 bp, Rattus norvegicus
aacaccggcctgtccacaaactggg

SEQ ID NO: 20739 - DNA, 25 bp, Rattus norvegicus
aacaccggcgacacggacagacggc

SEQ ID NO: 20740 - DNA, 25 bp, Rattus norvegicus
aacaccggcgactcggacagacggc

SEQ ID NO: 20741 - DNA, 25 bp, Rattus norvegicus
aacaccggcgggatcttgttgctct

SEQ ID NO: 20742 - DNA, 25 bp, Rattus norvegicus
aacaccggcgggttcttgttgctct

SEQ ID NO: 20743 - DNA, 25 bp, Rattus norvegicus
aacaccggctacatgttggcatgtt

SEQ ID NO: 20744 - DNA, 25 bp, Rattus norvegicus
aacaccggctacttgttggcatgtt

SEQ ID NO: 20745 - DNA, 25 bp, Rattus norvegicus
aacaccggtcacaatattatcctga

SEQ ID NO: 20746 - DNA, 25 bp, Rattus norvegicus
aacaccggtcactatattatcctga

SEQ ID NO: 20747 - DNA, 25 bp, Rattus norvegicus
aacaccgtacctagatggtggtgaa

SEQ ID NO: 20748 - DNA, 25 bp, Rattus norvegicus
aacaccgtaccttgatggtggtgaa

SEQ ID NO: 20749 - DNA, 25 bp, Rattus norvegicus
aacaccgtagcaatgtatccttcga

SEQ ID NO: 20750 - DNA, 25 bp, Rattus norvegicus
aacaccgtagcattgtatccttcga

SEQ ID NO: 20751 - DNA, 25 bp, Rattus norvegicus
aacaccgtcaagactgcagcaggct

SEQ ID NO: 20752 - DNA, 25 bp, Rattus norvegicus
aacaccgtcaagtctgcagcaggct

SEQ ID NO: 20753 - DNA, 25 bp, Rattus norvegicus
aacaccgtcattcgcggagtggacc

SEQ ID NO: 20754 - DNA, 25 bp, Rattus norvegicus
aacaccgtcattggcggagtggacc

SEQ ID NO: 20755 - DNA, 25 bp, Rattus norvegicus
aacaccgtgaccaaagcaacttaag

SEQ ID NO: 20756 - DNA, 25 bp, Rattus norvegicus
aacaccgtgacctaagcaacttaag

SEQ ID NO: 20757 - DNA, 25 bp, Rattus norvegicus
aacaccgtggatagctacatcgctc

SEQ ID NO: 20758 - DNA, 25 bp, Rattus norvegicus
aacaccgtggattgctacatcgctc

SEQ ID NO: 20759 - DNA, 25 bp, Rattus norvegicus
aacaccgttatgagttcccctggct

SEQ ID NO: 20760 - DNA, 25 bp, Rattus norvegicus
aacaccgttatgtgttcccctggct

SEQ ID NO: 20761 - DNA, 25 bp, Rattus norvegicus
aacacctaaatcactgtcagcgttt

SEQ ID NO: 20762 - DNA, 25 bp, Rattus norvegicus
aacacctaaatctctgtcagcgttt

SEQ ID NO: 20763 - DNA, 25 bp, Rattus norvegicus
aacacctacacaaagagccaaagaa

SEQ ID NO: 20764 - DNA, 25 bp, Rattus norvegicus
aacacctacacatagagccaaagaa

SEQ ID NO: 20765 - DNA, 25 bp, Rattus norvegicus
aacacctacctcagggtggtcagga

SEQ ID NO: 20766 - DNA, 25 bp, Rattus norvegicus
aacacctacctctgggtggtcagga

SEQ ID NO: 20767 - DNA, 25 bp, Rattus norvegicus
aacacctactgtatataagtgtggg

SEQ ID NO: 20768 - DNA, 25 bp, Rattus norvegicus
aacacctactgtttataagtgtggg

SEQ ID NO: 20769 - DNA, 25 bp, Rattus norvegicus
aacacctacttccatatggccttgg

SEQ ID NO: 20770 - DNA, 25 bp, Rattus norvegicus
aacacctacttcgatatggccttgg

SEQ ID NO: 20771 - DNA, 25 bp, Rattus norvegicus
aacacctaggtcatgctctgatctg

SEQ ID NO: 20772 - DNA, 25 bp, Rattus norvegicus
aacacctaggtcttgctctgatctg

SEQ ID NO: 20773 - DNA, 25 bp, Rattus norvegicus
aacacctatctgacttgactgcttt

SEQ ID NO: 20774 - DNA, 25 bp, Rattus norvegicus
aacacctatctgtcttgactgcttt

SEQ ID NO: 20775 - DNA, 25 bp, Rattus norvegicus
aacacctattggacatggcttcgct

SEQ ID NO: 20776 - DNA, 25 bp, Rattus norvegicus
aacacctattggtcatggcttcgct

SEQ ID NO: 20777 - DNA, 25 bp, Rattus norvegicus
aacacctcaccaccgagcagaatat

SEQ ID NO: 20778 - DNA, 25 bp, Rattus norvegicus
aacacctcaccagcgagcagaatat

SEQ ID NO: 20779 - DNA, 25 bp, Rattus norvegicus
aacacctcaccgcacttgtaggaag

SEQ ID NO: 20780 - DNA, 25 bp, Rattus norvegicus
aacacctcaccggacttgtaggaag

SEQ ID NO: 20781 - DNA, 25 bp, Rattus norvegicus
aacacctcagaaatgctccaacagt

SEQ ID NO: 20782 - DNA, 25 bp, Rattus norvegicus
aacacctcagaattgctccaacagt

SEQ ID NO: 20783 - DNA, 25 bp, Rattus norvegicus
aacacctcagccagttgtggaacag

SEQ ID NO: 20784 - DNA, 25 bp, Rattus norvegicus
aacacctcagcctgttgtggaacag

SEQ ID NO: 20785 - DNA, 25 bp, Rattus norvegicus
aacacctcatccagggcttgcagaa

SEQ ID NO: 20786 - DNA, 25 bp, Rattus norvegicus
aacacctcatcctgggcttgcagaa

SEQ ID NO: 20787 - DNA, 25 bp, Rattus norvegicus
aacacctcgctgagtggccacagag

SEQ ID NO: 20788 - DNA, 25 bp, Rattus norvegicus
aacacctcgctgtgtggccacagag

SEQ ID NO: 20789 - DNA, 25 bp, Rattus norvegicus
aacacctctagtcttgagtatttga

SEQ ID NO: 20790 - DNA, 25 bp, Rattus norvegicus
aacacctctagtgttgagtatttga

SEQ ID NO: 20791 - DNA, 25 bp, Rattus norvegicus
aacacctctccacgacatagtctag

SEQ ID NO: 20792 - DNA, 25 bp, Rattus norvegicus
aacacctctccaggacatagtctag

SEQ ID NO: 20793 - DNA, 25 bp, Rattus norvegicus
aacacctgacctagcacactgacac

SEQ ID NO: 20794 - DNA, 25 bp, Rattus norvegicus
aacacctgaccttgcacactgacac

SEQ ID NO: 20795 - DNA, 25 bp, Rattus norvegicus
aacacctgatgtcctgttccatttc

SEQ ID NO: 20796 - DNA, 25 bp, Rattus norvegicus
aacacctgatgtgctgttccatttc

SEQ ID NO: 20797 - DNA, 25 bp, Rattus norvegicus
aacacctgcactcggccacagtggg

SEQ ID NO: 20798 - DNA, 25 bp, Rattus norvegicus
aacacctgcactgggccacagtggg

SEQ ID NO: 20799 - DNA, 25 bp, Rattus norvegicus
aacacctgcctactttacattaaca

SEQ ID NO: 20800 - DNA, 25 bp, Rattus norvegicus
aacacctgcctagtttacattaaca

SEQ ID NO: 20801 - DNA, 25 bp, Rattus norvegicus
aacacctggcgcagtgcaaaattat

SEQ ID NO: 20802 - DNA, 25 bp, Rattus norvegicus
aacacctggcgctgtgcaaaattat

SEQ ID NO: 20803 - DNA, 25 bp, Rattus norvegicus
aacacctgtcgcagtggttacactt

SEQ ID NO: 20804 - DNA, 25 bp, Rattus norvegicus
aacacctgtcgctgtggttacactt

SEQ ID NO: 20805 - DNA, 25 bp, Rattus norvegicus
aacacctgtgacacatggcgagcca

SEQ ID NO: 20806 - DNA, 25 bp, Rattus norvegicus
aacacctgtgactcatggcgagcca

SEQ ID NO: 20807 - DNA, 25 bp, Rattus norvegicus
aacacctgtgtactcattccttgga

SEQ ID NO: 20808 - DNA, 25 bp, Rattus norvegicus
aacacctgtgtagtcattccttgga

SEQ ID NO: 20809 - DNA, 25 bp, Rattus norvegicus
aacacctgtgtgcaaggccttcgat

SEQ ID NO: 20810 - DNA, 25 bp, Rattus norvegicus
aacacctgtgtggaaggccttcgat

SEQ ID NO: 20811 - DNA, 25 bp, Rattus norvegicus
aacaccttaatcactcactgaggac

SEQ ID NO: 20812 - DNA, 25 bp, Rattus norvegicus
aacaccttaatctctcactgaggac

SEQ ID NO: 20813 - DNA, 25 bp, Rattus norvegicus
aacaccttacttccagttatatcaa

SEQ ID NO: 20814 - DNA, 25 bp, Rattus norvegicus
aacaccttacttgcagttatatcaa

SEQ ID NO: 20815 - DNA, 25 bp, Rattus norvegicus
aacaccttcataaacatggcgtagc

SEQ ID NO: 20816 - DNA, 25 bp, Rattus norvegicus
aacaccttcatatacatggcgtagc

SEQ ID NO: 20817 - DNA, 25 bp, Rattus norvegicus
aacaccttcattcggcggagccaca

SEQ ID NO: 20818 - DNA, 25 bp, Rattus norvegicus
aacaccttcattgggcggagccaca

SEQ ID NO: 20819 - DNA, 25 bp, Rattus norvegicus
aacaccttctggcttttatgccgtg

SEQ ID NO: 20820 - DNA, 25 bp, Rattus norvegicus
aacaccttctgggttttatgccgtg

SEQ ID NO: 20821 - DNA, 25 bp, Rattus norvegicus
aacaccttcttcagacatctgcagg

SEQ ID NO: 20822 - DNA, 25 bp, Rattus norvegicus
aacaccttcttctgacatctgcagg

SEQ ID NO: 20823 - DNA, 25 bp, Rattus norvegicus
aacaccttgcttagtggtcactgta

SEQ ID NO: 20824 - DNA, 25 bp, Rattus norvegicus
aacaccttgctttgtggtcactgta

SEQ ID NO: 20825 - DNA, 25 bp, Rattus norvegicus
aacaccttggccagctctttaggaa

SEQ ID NO: 20826 - DNA, 25 bp, Rattus norvegicus
aacaccttggcctgctctttaggaa

SEQ ID NO: 20827 - DNA, 25 bp, Rattus norvegicus
aacaccttgggtagttctgtttgtg

SEQ ID NO: 20828 - DNA, 25 bp, Rattus norvegicus
aacaccttgggttgttctgtttgtg

SEQ ID NO: 20829 - DNA, 25 bp, Rattus norvegicus
aacaccttgtctctgctgagtgaga

SEQ ID NO: 20830 - DNA, 25 bp, Rattus norvegicus
aacaccttgtctgtgctgagtgaga

SEQ ID NO: 20831 - DNA, 25 bp, Rattus norvegicus
aacaccttgtgaagctttctctact

SEQ ID NO: 20832 - DNA, 25 bp, Rattus norvegicus
aacaccttgtgatgctttctctact

SEQ ID NO: 20833 - DNA, 25 bp, Rattus norvegicus
aacaccttgtttattgtcttctcag

SEQ ID NO: 20834 - DNA, 25 bp, Rattus norvegicus
aacaccttgttttttgtcttctcag

SEQ ID NO: 20835 - DNA, 25 bp, Rattus norvegicus
aacacctttgtgactctggagggcc

SEQ ID NO: 20836 - DNA, 25 bp, Rattus norvegicus
aacacctttgtgtctctggagggcc

SEQ ID NO: 20837 - DNA, 25 bp, Rattus norvegicus
aacacctttgttatgcactgaccag

SEQ ID NO: 20838 - DNA, 25 bp, Rattus norvegicus
aacacctttgttttgcactgaccag

SEQ ID NO: 20839 - DNA, 25 bp, Rattus norvegicus
aacacgaaaaatactgatgctgctt

SEQ ID NO: 20840 - DNA, 25 bp, Rattus norvegicus
aacacgaaaaattctgatgctgctt

SEQ ID NO: 20841 - DNA, 25 bp, Rattus norvegicus
aacacgaacaataccgcagggtcca

SEQ ID NO: 20842 - DNA, 25 bp, Rattus norvegicus
aacacgaacaattccgcagggtcca

SEQ ID NO: 20843 - DNA, 25 bp, Rattus norvegicus
aacacgaagtcgctttgggcaaatc

SEQ ID NO: 20844 - DNA, 25 bp, Rattus norvegicus
aacacgaagtcggtttgggcaaatc

SEQ ID NO: 20845 - DNA, 25 bp, Rattus norvegicus
aacacgacggacagcaagacaggat

SEQ ID NO: 20846 - DNA, 25 bp, Rattus norvegicus
aacacgacggactgcaagacaggat

SEQ ID NO: 20847 - DNA, 25 bp, Rattus norvegicus
aacacgacgggtccatggcttccct

SEQ ID NO: 20848 - DNA, 25 bp, Rattus norvegicus
aacacgacgggtgcatggcttccct

SEQ ID NO: 20849 - DNA, 25 bp, Rattus norvegicus
aacacgactttgaagaaggagctga

SEQ ID NO: 20850 - DNA, 25 bp, Rattus norvegicus
aacacgactttgtagaaggagctga

SEQ ID NO: 20851 - DNA, 25 bp, Rattus norvegicus
aacacgagaaccagaggacgaaaga

SEQ ID NO: 20852 - DNA, 25 bp, Rattus norvegicus
aacacgagaacctgaggacgaaaga

SEQ ID NO: 20853 - DNA, 25 bp, Rattus norvegicus
aacacgagcttcacttccaagctgc

SEQ ID NO: 20854 - DNA, 25 bp, Rattus norvegicus
aacacgagcttctcttccaagctgc

SEQ ID NO: 20855 - DNA, 25 bp, Rattus norvegicus
aacacgagcttgatgaccctgggaa

SEQ ID NO: 20856 - DNA, 25 bp, Rattus norvegicus
aacacgagcttgttgaccctgggaa

SEQ ID NO: 20857 - DNA, 25 bp, Rattus norvegicus
aacacgaggatcctagtctcatagt

SEQ ID NO: 20858 - DNA, 25 bp, Rattus norvegicus
aacacgaggatcgtagtctcatagt

SEQ ID NO: 20859 - DNA, 25 bp, Rattus norvegicus
aacacgaggcccacgccgcggacca

SEQ ID NO: 20860 - DNA, 25 bp, Rattus norvegicus
aacacgaggccctcgccgcggacca

SEQ ID NO: 20861 - DNA, 25 bp, Rattus norvegicus
aacacgatatttacagctctcactg

SEQ ID NO: 20862 - DNA, 25 bp, Rattus norvegicus
aacacgatattttcagctctcactg

SEQ ID NO: 20863 - DNA, 25 bp, Rattus norvegicus
aacacgatctgaccgctgaatccaa

SEQ ID NO: 20864 - DNA, 25 bp, Rattus norvegicus
aacacgatctgagcgctgaatccaa

SEQ ID NO: 20865 - DNA, 25 bp, Rattus norvegicus
aacacgatgtagcttttacagtctc

SEQ ID NO: 20866 - DNA, 25 bp, Rattus norvegicus
aacacgatgtaggttttacagtctc

SEQ ID NO: 20867 - DNA, 25 bp, Rattus norvegicus
aacacgcctcacagcttacaggtag

SEQ ID NO: 20868 - DNA, 25 bp, Rattus norvegicus
aacacgcctcactgcttacaggtag

SEQ ID NO: 20869 - DNA, 25 bp, Rattus norvegicus
aacacgcgacctcagctggagtggc

SEQ ID NO: 20870 - DNA, 25 bp, Rattus norvegicus
aacacgcgacctgagctggagtggc

SEQ ID NO: 20871 - DNA, 25 bp, Rattus norvegicus
aacacgcgcagaagatgcagtggct

SEQ ID NO: 20872 - DNA, 25 bp, Rattus norvegicus
aacacgcgcagatgatgcagtggct

SEQ ID NO: 20873 - DNA, 25 bp, Rattus norvegicus
aacacgctcactctggttgtcttaa

SEQ ID NO: 20874 - DNA, 25 bp, Rattus norvegicus
aacacgctcactgtggttgtcttaa

SEQ ID NO: 20875 - DNA, 25 bp, Rattus norvegicus
aacacgctcagcagtggcgtcaatg

SEQ ID NO: 20876 - DNA, 25 bp, Rattus norvegicus
aacacgctcagctgtggcgtcaatg

SEQ ID NO: 20877 - DNA, 25 bp, Rattus norvegicus
aacacgctgggccttgcactgtggt

SEQ ID NO: 20878 - DNA, 25 bp, Rattus norvegicus
aacacgctgggcgttgcactgtggt

SEQ ID NO: 20879 - DNA, 25 bp, Rattus norvegicus
aacacgctgtacacagcacttgcga

SEQ ID NO: 20880 - DNA, 25 bp, Rattus norvegicus
aacacgctgtactcagcacttgcga

SEQ ID NO: 20881 - DNA, 25 bp, Rattus norvegicus
aacacgcttaacatctatgagtata

SEQ ID NO: 20882 - DNA, 25 bp, Rattus norvegicus
aacacgcttaacttctatgagtata

SEQ ID NO: 20883 - DNA, 25 bp, Rattus norvegicus
aacacgcttgtgatcattgtggatg

SEQ ID NO: 20884 - DNA, 25 bp, Rattus norvegicus
aacacgcttgtgttcattgtggatg

SEQ ID NO: 20885 - DNA, 25 bp, Rattus norvegicus
aacacggaactgacctagcagtggc

SEQ ID NO: 20886 - DNA, 25 bp, Rattus norvegicus
aacacggaactgtcctagcagtggc

SEQ ID NO: 20887 - DNA, 25 bp, Rattus norvegicus
aacacggaagttccacatccatgtt

SEQ ID NO: 20888 - DNA, 25 bp, Rattus norvegicus
aacacggaagttgcacatccatgtt

SEQ ID NO: 20889 - DNA, 25 bp, Rattus norvegicus
aacacggaccttctagacagacaag

SEQ ID NO: 20890 - DNA, 25 bp, Rattus norvegicus
aacacggaccttgtagacagacaag

SEQ ID NO: 20891 - DNA, 25 bp, Rattus norvegicus
aacacggagccgacaacatccacaa

SEQ ID NO: 20892 - DNA, 25 bp, Rattus norvegicus
aacacggagccgtcaacatccacaa

SEQ ID NO: 20893 - DNA, 25 bp, Rattus norvegicus
aacacggagttcattctaacacaga

SEQ ID NO: 20894 - DNA, 25 bp, Rattus norvegicus
aacacggagttctttctaacacaga

SEQ ID NO: 20895 - DNA, 25 bp, Rattus norvegicus
aacacggatggcatttactattgat

SEQ ID NO: 20896 - DNA, 25 bp, Rattus norvegicus
aacacggatggcttttactattgat

SEQ ID NO: 20897 - DNA, 25 bp, Rattus norvegicus
aacacggcacagcatctcagacttg

SEQ ID NO: 20898 - DNA, 25 bp, Rattus norvegicus
aacacggcacaggatctcagacttg

SEQ ID NO: 20899 - DNA, 25 bp, Rattus norvegicus
aacacggcagtgctcttcttgcaga

SEQ ID NO: 20900 - DNA, 25 bp, Rattus norvegicus
aacacggcagtggtcttcttgcaga

SEQ ID NO: 20901 - DNA, 25 bp, Rattus norvegicus
aacacggctctgaatgcacaggcag

SEQ ID NO: 20902 - DNA, 25 bp, Rattus norvegicus
aacacggctctgtatgcacaggcag

SEQ ID NO: 20903 - DNA, 25 bp, Rattus norvegicus
aacacgggacacagtgaggccactt

SEQ ID NO: 20904 - DNA, 25 bp, Rattus norvegicus
aacacgggacactgtgaggccactt

SEQ ID NO: 20905 - DNA, 25 bp, Rattus norvegicus
aacacgggctggattcacagctgca

SEQ ID NO: 20906 - DNA, 25 bp, Rattus norvegicus
aacacgggctggtttcacagctgca

SEQ ID NO: 20907 - DNA, 25 bp, Rattus norvegicus
aacacgggtgtaattgagtcattca

SEQ ID NO: 20908 - DNA, 25 bp, Rattus norvegicus
aacacgggtgtatttgagtcattca

SEQ ID NO: 20909 - DNA, 25 bp, Rattus norvegicus
aacacggtgttccttttgatcttcg

SEQ ID NO: 20910 - DNA, 25 bp, Rattus norvegicus
aacacggtgttcgttttgatcttcg

SEQ ID NO: 20911 - DNA, 25 bp, Rattus norvegicus
aacacgtactccctggccaggtggg

SEQ ID NO: 20912 - DNA, 25 bp, Rattus norvegicus
aacacgtactccgtggccaggtggg

SEQ ID NO: 20913 - DNA, 25 bp, Rattus norvegicus
aacacgtcacgtcgttctgcttagc

SEQ ID NO: 20914 - DNA, 25 bp, Rattus norvegicus
aacacgtcacgtggttctgcttagc

SEQ ID NO: 20915 - DNA, 25 bp, Rattus norvegicus
aacacgtcactcagaaggagcccaa

SEQ ID NO: 20916 - DNA, 25 bp, Rattus norvegicus
aacacgtcactctgaaggagcccaa

SEQ ID NO: 20917 - DNA, 25 bp, Rattus norvegicus
aacacgtccacacgcttggtgcagg

SEQ ID NO: 20918 - DNA, 25 bp, Rattus norvegicus
aacacgtccacaggcttggtgcagg

SEQ ID NO: 20919 - DNA, 25 bp, Rattus norvegicus
aacacgtcccggagctgagcctgga

SEQ ID NO: 20920 - DNA, 25 bp, Rattus norvegicus
aacacgtcccggtgctgagcctgga

SEQ ID NO: 20921 - DNA, 25 bp, Rattus norvegicus
aacacgtcctttctggctattgcta

SEQ ID NO: 20922 - DNA, 25 bp, Rattus norvegicus
aacacgtcctttgtggctattgcta

SEQ ID NO: 20923 - DNA, 25 bp, Rattus norvegicus
aacacgtcggcccaagtcagtgaag

SEQ ID NO: 20924 - DNA, 25 bp, Rattus norvegicus
aacacgtcggccgaagtcagtgaag

SEQ ID NO: 20925 - DNA, 25 bp, Rattus norvegicus
aacacgtgctgaaggctggcgaacc

SEQ ID NO: 20926 - DNA, 25 bp, Rattus norvegicus
aacacgtgctgatggctggcgaacc

SEQ ID NO: 20927 - DNA, 25 bp, Rattus norvegicus
aacacgtgctgtcagagagtcaaca

SEQ ID NO: 20928 - DNA, 25 bp, Rattus norvegicus
aacacgtgctgtgagagagtcaaca

SEQ ID NO: 20929 - DNA, 25 bp, Rattus norvegicus
aacacgtgcttcatgttcgttcctt

SEQ ID NO: 20930 - DNA, 25 bp, Rattus norvegicus
aacacgtgcttcttgttcgttcctt

SEQ ID NO: 20931 - DNA, 25 bp, Rattus norvegicus
aacacgtggattactttgcccattg

SEQ ID NO: 20932 - DNA, 25 bp, Rattus norvegicus
aacacgtggatttctttgcccattg

SEQ ID NO: 20933 - DNA, 25 bp, Rattus norvegicus
aacacgtgtcagacacattgctttt

SEQ ID NO: 20934 - DNA, 25 bp, Rattus norvegicus
aacacgtgtcagtcacattgctttt

SEQ ID NO: 20935 - DNA, 25 bp, Rattus norvegicus
aacacgtgtgacaagccttaaaact

SEQ ID NO: 20936 - DNA, 25 bp, Rattus norvegicus
aacacgtgtgactagccttaaaact

SEQ ID NO: 20937 - DNA, 25 bp, Rattus norvegicus
aacacgtgtgtgacatctgatgctg

SEQ ID NO: 20938 - DNA, 25 bp, Rattus norvegicus
aacacgtgtgtgtcatctgatgctg

SEQ ID NO: 20939 - DNA, 25 bp, Rattus norvegicus
aacacgttgagacgtagaaaagcca

SEQ ID NO: 20940 - DNA, 25 bp, Rattus norvegicus
aacacgttgagaggtagaaaagcca

SEQ ID NO: 20941 - DNA, 25 bp, Rattus norvegicus
aacacgttgcaaatgttacatttta

SEQ ID NO: 20942 - DNA, 25 bp, Rattus norvegicus
aacacgttgcaattgttacatttta

SEQ ID NO: 20943 - DNA, 25 bp, Rattus norvegicus
aacacgttgggcatcctagatgacc

SEQ ID NO: 20944 - DNA, 25 bp, Rattus norvegicus
aacacgttgggcttcctagatgacc

SEQ ID NO: 20945 - DNA, 25 bp, Rattus norvegicus
aacacgttggttctctgagcccatt

SEQ ID NO: 20946 - DNA, 25 bp, Rattus norvegicus
aacacgttggttgtctgagcccatt

SEQ ID NO: 20947 - DNA, 25 bp, Rattus norvegicus
aacacgtttttcattgcaatacttg

SEQ ID NO: 20948 - DNA, 25 bp, Rattus norvegicus
aacacgtttttctttgcaatacttg

SEQ ID NO: 20949 - DNA, 25 bp, Rattus norvegicus
aacactaaattcaatcacttgccat

SEQ ID NO: 20950 - DNA, 25 bp, Rattus norvegicus
aacactaaattctatcacttgccat

SEQ ID NO: 20951 - DNA, 25 bp, Rattus norvegicus
aacactaacgtgcaattctaactct

SEQ ID NO: 20952 - DNA, 25 bp, Rattus norvegicus
aacactaacgtggaattctaactct

SEQ ID NO: 20953 - DNA, 25 bp, Rattus norvegicus
aacactaacttcaacttagagtctg

SEQ ID NO: 20954 - DNA, 25 bp, Rattus norvegicus
aacactaacttctacttagagtctg

SEQ ID NO: 20955 - DNA, 25 bp, Rattus norvegicus
aacactaagtgcctactcttcttgt

SEQ ID NO: 20956 - DNA, 25 bp, Rattus norvegicus
aacactaagtgcgtactcttcttgt

SEQ ID NO: 20957 - DNA, 25 bp, Rattus norvegicus
aacactacaataactgtccctgggt

SEQ ID NO: 20958 - DNA, 25 bp, Rattus norvegicus
aacactacaatatctgtccctgggt

SEQ ID NO: 20959 - DNA, 25 bp, Rattus norvegicus
aacactacatcccttggcagagcag

SEQ ID NO: 20960 - DNA, 25 bp, Rattus norvegicus
aacactacatccgttggcagagcag

SEQ ID NO: 20961 - DNA, 25 bp, Rattus norvegicus
aacactacctctatttgctaatcaa

SEQ ID NO: 20962 - DNA, 25 bp, Rattus norvegicus
aacactacctctttttgctaatcaa

SEQ ID NO: 20963 - DNA, 25 bp, Rattus norvegicus
aacactacgctgatgtggatactta

SEQ ID NO: 20964 - DNA, 25 bp, Rattus norvegicus
aacactacgctgttgtggatactta

SEQ ID NO: 20965 - DNA, 25 bp, Rattus norvegicus
aacactactcggagctgctagtgca

SEQ ID NO: 20966 - DNA, 25 bp, Rattus norvegicus
aacactactcggtgctgctagtgca

SEQ ID NO: 20967 - DNA, 25 bp, Rattus norvegicus
aacactagcaccacacaaggaaacc

SEQ ID NO: 20968 - DNA, 25 bp, Rattus norvegicus
aacactagcacctcacaaggaaacc

SEQ ID NO: 20969 - DNA, 25 bp, Rattus norvegicus
aacactagcaggctttttctctact

SEQ ID NO: 20970 - DNA, 25 bp, Rattus norvegicus
aacactagcagggtttttctctact

SEQ ID NO: 20971 - DNA, 25 bp, Rattus norvegicus
aacactataccaccattggcctaca

SEQ ID NO: 20972 - DNA, 25 bp, Rattus norvegicus
aacactataccagcattggcctaca

SEQ ID NO: 20973 - DNA, 25 bp, Rattus norvegicus
aacactatagcactagatacacaca

SEQ ID NO: 20974 - DNA, 25 bp, Rattus norvegicus
aacactatagcagtagatacacaca

SEQ ID NO: 20975 - DNA, 25 bp, Rattus norvegicus
aacactatcgtgcacagagaggaga

SEQ ID NO: 20976 - DNA, 25 bp, Rattus norvegicus
aacactatcgtggacagagaggaga

SEQ ID NO: 20977 - DNA, 25 bp, Rattus norvegicus
aacactatgagtacctgtgtggcag

SEQ ID NO: 20978 - DNA, 25 bp, Rattus norvegicus
aacactatgagttcctgtgtggcag

SEQ ID NO: 20979 - DNA, 25 bp, Rattus norvegicus
aacactatgcccagctgcctcagtt

SEQ ID NO: 20980 - DNA, 25 bp, Rattus norvegicus
aacactatgccctgctgcctcagtt

SEQ ID NO: 20981 - DNA, 25 bp, Rattus norvegicus
aacactatggagactgcacttcagt

SEQ ID NO: 20982 - DNA, 25 bp, Rattus norvegicus
aacactatggagtctgcacttcagt

SEQ ID NO: 20983 - DNA, 25 bp, Rattus norvegicus
aacactatgtgcacttacccaaccg

SEQ ID NO: 20984 - DNA, 25 bp, Rattus norvegicus
aacactatgtgctcttacccaaccg

SEQ ID NO: 20985 - DNA, 25 bp, Rattus norvegicus
aacactattgttcaatcctcctgtg

SEQ ID NO: 20986 - DNA, 25 bp, Rattus norvegicus
aacactattgttgaatcctcctgtg

SEQ ID NO: 20987 - DNA, 25 bp, Rattus norvegicus
aacactcaaatcatgttttggatcc

SEQ ID NO: 20988 - DNA, 25 bp, Rattus norvegicus
aacactcaaatcttgttttggatcc

SEQ ID NO: 20989 - DNA, 25 bp, Rattus norvegicus
aacactcacagtacataggctaccc

SEQ ID NO: 20990 - DNA, 25 bp, Rattus norvegicus
aacactcacagttcataggctaccc

SEQ ID NO: 20991 - DNA, 25 bp, Rattus norvegicus
aacactcacattcggtggctcaaag

SEQ ID NO: 20992 - DNA, 25 bp, Rattus norvegicus
aacactcacattgggtggctcaaag

SEQ ID NO: 20993 - DNA, 25 bp, Rattus norvegicus
aacactcactgtctatgttctgtcc

SEQ ID NO: 20994 - DNA, 25 bp, Rattus norvegicus
aacactcactgtgtatgttctgtcc

SEQ ID NO: 20995 - DNA, 25 bp, Rattus norvegicus
aacactcacttgaagctcagcgggc

SEQ ID NO: 20996 - DNA, 25 bp, Rattus norvegicus
aacactcacttgtagctcagcgggc

SEQ ID NO: 20997 - DNA, 25 bp, Rattus norvegicus
aacactcaggccctacaggattggc

SEQ ID NO: 20998 - DNA, 25 bp, Rattus norvegicus
aacactcaggccgtacaggattggc

SEQ ID NO: 20999 - DNA, 25 bp, Rattus norvegicus
aacactcagtggcttggagctcacg

SEQ ID NO: 21000 - DNA, 25 bp, Rattus norvegicus
aacactcagtgggttggagctcacg

SEQ ID NO: 21001 - DNA, 25 bp, Rattus norvegicus
aacactcatgctagaaggccaggtc

SEQ ID NO: 21002 - DNA, 25 bp, Rattus norvegicus
aacactcatgcttgaaggccaggtc

SEQ ID NO: 21003 - DNA, 25 bp, Rattus norvegicus
aacactcatgggaaatggcttttgt

SEQ ID NO: 21004 - DNA, 25 bp, Rattus norvegicus
aacactcatgggtaatggcttttgt

SEQ ID NO: 21005 - DNA, 25 bp, Rattus norvegicus
aacactcattgccatcacaggcggt

SEQ ID NO: 21006 - DNA, 25 bp, Rattus norvegicus
aacactcattgcgatcacaggcggt

SEQ ID NO: 21007 - DNA, 25 bp, Rattus norvegicus
aacactcccatgatttggtgcagac

SEQ ID NO: 21008 - DNA, 25 bp, Rattus norvegicus
aacactcccatgttttggtgcagac

SEQ ID NO: 21009 - DNA, 25 bp, Rattus norvegicus
aacactccccataatgtgcttgtgg

SEQ ID NO: 21010 - DNA, 25 bp, Rattus norvegicus
aacactccccattatgtgcttgtgg

SEQ ID NO: 21011 - DNA, 25 bp, Rattus norvegicus
aacactcccgctctgtgcagttgga

SEQ ID NO: 21012 - DNA, 25 bp, Rattus norvegicus
aacactcccgctgtgtgcagttgga

SEQ ID NO: 21013 - DNA, 25 bp, Rattus norvegicus
aacactcccggcagatcaatgacat

SEQ ID NO: 21014 - DNA, 25 bp, Rattus norvegicus
aacactcccggctgatcaatgacat

SEQ ID NO: 21015 - DNA, 25 bp, Rattus norvegicus
aacactccctaccaactgtgaggaa

SEQ ID NO: 21016 - DNA, 25 bp, Rattus norvegicus
aacactccctacgaactgtgaggaa

SEQ ID NO: 21017 - DNA, 25 bp, Rattus norvegicus
aacactccctgactggatgaatggt

SEQ ID NO: 21018 - DNA, 25 bp, Rattus norvegicus
aacactccctgagtggatgaatggt

SEQ ID NO: 21019 - DNA, 25 bp, Rattus norvegicus
aacactcctcctcactggaggaggg

SEQ ID NO: 21020 - DNA, 25 bp, Rattus norvegicus
aacactcctcctgactggaggaggg

SEQ ID NO: 21021 - DNA, 25 bp, Rattus norvegicus
aacactcctgttactaaaaactgag

SEQ ID NO: 21022 - DNA, 25 bp, Rattus norvegicus
aacactcctgtttctaaaaactgag

SEQ ID NO: 21023 - DNA, 25 bp, Rattus norvegicus
aacactcggagccttaggagcactg

SEQ ID NO: 21024 - DNA, 25 bp, Rattus norvegicus
aacactcggagcgttaggagcactg

SEQ ID NO: 21025 - DNA, 25 bp, Rattus norvegicus
aacactcggcttctggttgatgagt

SEQ ID NO: 21026 - DNA, 25 bp, Rattus norvegicus
aacactcggcttgtggttgatgagt

SEQ ID NO: 21027 - DNA, 25 bp, Rattus norvegicus
aacactcggtgtagcaggtgtctcc

SEQ ID NO: 21028 - DNA, 25 bp, Rattus norvegicus
aacactcggtgttgcaggtgtctcc

SEQ ID NO: 21029 - DNA, 25 bp, Rattus norvegicus
aacactcggttcatgagtggcacca

SEQ ID NO: 21030 - DNA, 25 bp, Rattus norvegicus
aacactcggttcttgagtggcacca

SEQ ID NO: 21031 - DNA, 25 bp, Rattus norvegicus
aacactcgtctacactctgagttcg

SEQ ID NO: 21032 - DNA, 25 bp, Rattus norvegicus
aacactcgtctagactctgagttcg

SEQ ID NO: 21033 - DNA, 25 bp, Rattus norvegicus
aacactcgtggaagacagacccgca

SEQ ID NO: 21034 - DNA, 25 bp, Rattus norvegicus
aacactcgtggatgacagacccgca

SEQ ID NO: 21035 - DNA, 25 bp, Rattus norvegicus
aacactctaagcatcgagccggtag

SEQ ID NO: 21036 - DNA, 25 bp, Rattus norvegicus
aacactctaagcttcgagccggtag

SEQ ID NO: 21037 - DNA, 25 bp, Rattus norvegicus
aacactctagatatcttgccttggg

SEQ ID NO: 21038 - DNA, 25 bp, Rattus norvegicus
aacactctagatttcttgccttggg

SEQ ID NO: 21039 - DNA, 25 bp, Rattus norvegicus
aacactctaggcatggcatgggctt

SEQ ID NO: 21040 - DNA, 25 bp, Rattus norvegicus
aacactctaggcttggcatgggctt

SEQ ID NO: 21041 - DNA, 25 bp, Rattus norvegicus
aacactctagttactgtatcttgat

SEQ ID NO: 21042 - DNA, 25 bp, Rattus norvegicus
aacactctagtttctgtatcttgat

SEQ ID NO: 21043 - DNA, 25 bp, Rattus norvegicus
aacactctgaatacctttctggtag

SEQ ID NO: 21044 - DNA, 25 bp, Rattus norvegicus
aacactctgaattcctttctggtag

SEQ ID NO: 21045 - DNA, 25 bp, Rattus norvegicus
aacactctgaggagagaccattcac

SEQ ID NO: 21046 - DNA, 25 bp, Rattus norvegicus
aacactctgaggtgagaccattcac

SEQ ID NO: 21047 - DNA, 25 bp, Rattus norvegicus
aacactctgtacaaatgctagcctt

SEQ ID NO: 21048 - DNA, 25 bp, Rattus norvegicus
aacactctgtacatcgaccaggaaa

SEQ ID NO: 21049 - DNA, 25 bp, Rattus norvegicus
aacactctgtactaatgctagcctt

SEQ ID NO: 21050 - DNA, 25 bp, Rattus norvegicus
aacactctgtacttcgaccaggaaa

SEQ ID NO: 21051 - DNA, 25 bp, Rattus norvegicus
aacactctgtccatttttaactcta

SEQ ID NO: 21052 - DNA, 25 bp, Rattus norvegicus
aacactctgtccttttttaactcta

SEQ ID NO: 21053 - DNA, 25 bp, Rattus norvegicus
aacactctgtgaatatggtctatat

SEQ ID NO: 21054 - DNA, 25 bp, Rattus norvegicus
aacactctgtgattatggtctatat

SEQ ID NO: 21055 - DNA, 25 bp, Rattus norvegicus
aacactctgtgtcatggaattttgg

SEQ ID NO: 21056 - DNA, 25 bp, Rattus norvegicus
aacactctgtgtgatggaattttgg

SEQ ID NO: 21057 - DNA, 25 bp, Rattus norvegicus
aacactctgttcaacgtgaaggaga

SEQ ID NO: 21058 - DNA, 25 bp, Rattus norvegicus
aacactctgttctacgtgaaggaga

SEQ ID NO: 21059 - DNA, 25 bp, Rattus norvegicus
aacactcttccaatgctggtatggt

SEQ ID NO: 21060 - DNA, 25 bp, Rattus norvegicus
aacactcttccattgctggtatggt

SEQ ID NO: 21061 - DNA, 25 bp, Rattus norvegicus
aacactctttgcagtttgttgttct

SEQ ID NO: 21062 - DNA, 25 bp, Rattus norvegicus
aacactctttgctgtttgttgttct

SEQ ID NO: 21063 - DNA, 25 bp, Rattus norvegicus
aacactgaagtgacacataactgga

SEQ ID NO: 21064 - DNA, 25 bp, Rattus norvegicus
aacactgaagtgtcacataactgga

SEQ ID NO: 21065 - DNA, 25 bp, Rattus norvegicus
aacactgacagcctgtagcactgtg

SEQ ID NO: 21066 - DNA, 25 bp, Rattus norvegicus
aacactgacagcgtgtagcactgtg

SEQ ID NO: 21067 - DNA, 25 bp, Rattus norvegicus
aacactgaccaaagggtgctcagaa

SEQ ID NO: 21068 - DNA, 25 bp, Rattus norvegicus
aacactgaccaatgggtgctcagaa

SEQ ID NO: 21069 - DNA, 25 bp, Rattus norvegicus
aacactgacccaaagttatcttagg

SEQ ID NO: 21070 - DNA, 25 bp, Rattus norvegicus
aacactgacccatagttatcttagg

SEQ ID NO: 21071 - DNA, 25 bp, Rattus norvegicus
aacactgactgcactgacaatggat

SEQ ID NO: 21072 - DNA, 25 bp, Rattus norvegicus
aacactgactgctctgacaatggat

SEQ ID NO: 21073 - DNA, 25 bp, Rattus norvegicus
aacactgactttaccattttcttgg

SEQ ID NO: 21074 - DNA, 25 bp, Rattus norvegicus
aacactgacttttccattttcttgg

SEQ ID NO: 21075 - DNA, 25 bp, Rattus norvegicus
aacactgagcccactgatgagctga

SEQ ID NO: 21076 - DNA, 25 bp, Rattus norvegicus
aacactgagccctctgatgagctga

SEQ ID NO: 21077 - DNA, 25 bp, Rattus norvegicus
aacactgagctgctgagtctcctgt

SEQ ID NO: 21078 - DNA, 25 bp, Rattus norvegicus
aacactgagctggtgagtctcctgt

SEQ ID NO: 21079 - DNA, 25 bp, Rattus norvegicus
aacactgaggaacacaatctttctc

SEQ ID NO: 21080 - DNA, 25 bp, Rattus norvegicus
aacactgaggaagacaatctttctc

SEQ ID NO: 21081 - DNA, 25 bp, Rattus norvegicus
aacactgaggctcatccttctagga

SEQ ID NO: 21082 - DNA, 25 bp, Rattus norvegicus
aacactgaggctgatccttctagga

SEQ ID NO: 21083 - DNA, 25 bp, Rattus norvegicus
aacactgaggttaaaggcgtgcgcc

SEQ ID NO: 21084 - DNA, 25 bp, Rattus norvegicus
aacactgaggtttaaggcgtgcgcc

SEQ ID NO: 21085 - DNA, 25 bp, Rattus norvegicus
aacactgagtacacagcggctgcca

SEQ ID NO: 21086 - DNA, 25 bp, Rattus norvegicus
aacactgagtactcagcggctgcca

SEQ ID NO: 21087 - DNA, 25 bp, Rattus norvegicus
aacactgatagcctcggaatcctct

SEQ ID NO: 21088 - DNA, 25 bp, Rattus norvegicus
aacactgatagcgtcggaatcctct

SEQ ID NO: 21089 - DNA, 25 bp, Rattus norvegicus
aacactgatcaaaagcaactaaggg

SEQ ID NO: 21090 - DNA, 25 bp, Rattus norvegicus
aacactgatcaatagcaactaaggg

SEQ ID NO: 21091 - DNA, 25 bp, Rattus norvegicus
aacactgatctcaaatactatggga

SEQ ID NO: 21092 - DNA, 25 bp, Rattus norvegicus
aacactgatctctaatactatggga

SEQ ID NO: 21093 - DNA, 25 bp, Rattus norvegicus
aacactgatcttcgcagggaccgac

SEQ ID NO: 21094 - DNA, 25 bp, Rattus norvegicus
aacactgatcttggcagggaccgac

SEQ ID NO: 21095 - DNA, 25 bp, Rattus norvegicus
aacactgatggtaccttccgctgta

SEQ ID NO: 21096 - DNA, 25 bp, Rattus norvegicus
aacactgatggttccttccgctgta

SEQ ID NO: 21097 - DNA, 25 bp, Rattus norvegicus
aacactgatgtgacgtttcttaagt

SEQ ID NO: 21098 - DNA, 25 bp, Rattus norvegicus
aacactgatgtgtcgtttcttaagt

SEQ ID NO: 21099 - DNA, 25 bp, Rattus norvegicus
aacactgcagcaagatgtcagtcat

SEQ ID NO: 21100 - DNA, 25 bp, Rattus norvegicus
aacactgcagcatgatgtcagtcat

SEQ ID NO: 21101 - DNA, 25 bp, Rattus norvegicus
aacactgcagctaaaggtgtaaacg

SEQ ID NO: 21102 - DNA, 25 bp, Rattus norvegicus
aacactgcagcttaaggtgtaaacg

SEQ ID NO: 21103 - DNA, 25 bp, Rattus norvegicus
aacactgcagtgcattgctcatctc

SEQ ID NO: 21104 - DNA, 25 bp, Rattus norvegicus
aacactgcagtggattgctcatctc

SEQ ID NO: 21105 - DNA, 25 bp, Rattus norvegicus
aacactgcagttaaccatgggacac

SEQ ID NO: 21106 - DNA, 25 bp, Rattus norvegicus
aacactgcagtttaccatgggacac

SEQ ID NO: 21107 - DNA, 25 bp, Rattus norvegicus
aacactgcataactttgacctctct

SEQ ID NO: 21108 - DNA, 25 bp, Rattus norvegicus
aacactgcataagtttgacctctct

SEQ ID NO: 21109 - DNA, 25 bp, Rattus norvegicus
aacactgcatttaacaatcaccgga

SEQ ID NO: 21110 - DNA, 25 bp, Rattus norvegicus
aacactgcattttacaatcaccgga

SEQ ID NO: 21111 - DNA, 25 bp, Rattus norvegicus
aacactgccagcaccaaggagtgga

SEQ ID NO: 21112 - DNA, 25 bp, Rattus norvegicus
aacactgccagctccaaggagtgga

SEQ ID NO: 21113 - DNA, 25 bp, Rattus norvegicus
aacactgccctaagaggaggtcttg

SEQ ID NO: 21114 - DNA, 25 bp, Rattus norvegicus
aacactgccctatgaggaggtcttg

SEQ ID NO: 21115 - DNA, 25 bp, Rattus norvegicus
aacactgcctttccacaggcgtgga

SEQ ID NO: 21116 - DNA, 25 bp, Rattus norvegicus
aacactgcctttgcacaggcgtgga

SEQ ID NO: 21117 - DNA, 25 bp, Rattus norvegicus
aacactgcgcttaattttcttaatc

SEQ ID NO: 21118 - DNA, 25 bp, Rattus norvegicus
aacactgcgctttattttcttaatc

SEQ ID NO: 21119 - DNA, 25 bp, Rattus norvegicus
aacactgcggccatcttgctgctga

SEQ ID NO: 21120 - DNA, 25 bp, Rattus norvegicus
aacactgcggccttcttgctgctga

SEQ ID NO: 21121 - DNA, 25 bp, Rattus norvegicus
aacactgcgttgatccaggtggacg

SEQ ID NO: 21122 - DNA, 25 bp, Rattus norvegicus
aacactgcgttgttccaggtggacg

SEQ ID NO: 21123 - DNA, 25 bp, Rattus norvegicus
aacactgctcaaaactttacaaact

SEQ ID NO: 21124 - DNA, 25 bp, Rattus norvegicus
aacactgctcaatactttacaaact

SEQ ID NO: 21125 - DNA, 25 bp, Rattus norvegicus
aacactgctcttcgctttgatgctt

SEQ ID NO: 21126 - DNA, 25 bp, Rattus norvegicus
aacactgctcttggctttgatgctt

SEQ ID NO: 21127 - DNA, 25 bp, Rattus norvegicus
aacactgctgcaagggctaaggatc

SEQ ID NO: 21128 - DNA, 25 bp, Rattus norvegicus
aacactgctgcaatcacaattgata

SEQ ID NO: 21129 - DNA, 25 bp, Rattus norvegicus
aacactgctgcatgggctaaggatc

SEQ ID NO: 21130 - DNA, 25 bp, Rattus norvegicus
aacactgctgcattcacaattgata

SEQ ID NO: 21131 - DNA, 25 bp, Rattus norvegicus
aacactgctgctccagtgcaggaga

SEQ ID NO: 21132 - DNA, 25 bp, Rattus norvegicus
aacactgctgctcgtgattgttggt

SEQ ID NO: 21133 - DNA, 25 bp, Rattus norvegicus
aacactgctgctgcagtgcaggaga

SEQ ID NO: 21134 - DNA, 25 bp, Rattus norvegicus
aacactgctgctggtgattgttggt

SEQ ID NO: 21135 - DNA, 25 bp, Rattus norvegicus
aacactgctggcaatggacacctca

SEQ ID NO: 21136 - DNA, 25 bp, Rattus norvegicus
aacactgctggctatggacacctca

SEQ ID NO: 21137 - DNA, 25 bp, Rattus norvegicus
aacactgctgtcatgtttggctgca

SEQ ID NO: 21138 - DNA, 25 bp, Rattus norvegicus
aacactgctgtcttgtttggctgca

SEQ ID NO: 21139 - DNA, 25 bp, Rattus norvegicus
aacactgctgtgataagctgttcat

SEQ ID NO: 21140 - DNA, 25 bp, Rattus norvegicus
aacactgctgtgttaagctgttcat

SEQ ID NO: 21141 - DNA, 25 bp, Rattus norvegicus
aacactggaaaccacagcccacggt

SEQ ID NO: 21142 - DNA, 25 bp, Rattus norvegicus
aacactggaaacgacagcccacggt

SEQ ID NO: 21143 - DNA, 25 bp, Rattus norvegicus
aacactggactgctttccaactact

SEQ ID NO: 21144 - DNA, 25 bp, Rattus norvegicus
aacactggactggtttccaactact

SEQ ID NO: 21145 - DNA, 25 bp, Rattus norvegicus
aacactggatgtctcaactttttga

SEQ ID NO: 21146 - DNA, 25 bp, Rattus norvegicus
aacactggatgtgtcaactttttga

SEQ ID NO: 21147 - DNA, 25 bp, Rattus norvegicus
aacactggctacacagggcttggta

SEQ ID NO: 21148 - DNA, 25 bp, Rattus norvegicus
aacactggctactcagggcttggta

SEQ ID NO: 21149 - DNA, 25 bp, Rattus norvegicus
aacactggctgccatttgattccca

SEQ ID NO: 21150 - DNA, 25 bp, Rattus norvegicus
aacactggctgcgatttgattccca

SEQ ID NO: 21151 - DNA, 25 bp, Rattus norvegicus
aacactggcttcacttgtgcagcat

SEQ ID NO: 21152 - DNA, 25 bp, Rattus norvegicus
aacactggcttctcttgtgcagcat

SEQ ID NO: 21153 - DNA, 25 bp, Rattus norvegicus
aacactgggataccgcccttctatg

SEQ ID NO: 21154 - DNA, 25 bp, Rattus norvegicus
aacactgggatagcgcccttctatg

SEQ ID NO: 21155 - DNA, 25 bp, Rattus norvegicus
aacactggtccaaagcctgtactaa

SEQ ID NO: 21156 - DNA, 25 bp, Rattus norvegicus
aacactggtccatagcctgtactaa

SEQ ID NO: 21157 - DNA, 25 bp, Rattus norvegicus
aacactggtcctacttcgagaaaga

SEQ ID NO: 21158 - DNA, 25 bp, Rattus norvegicus
aacactggtccttcttcgagaaaga

SEQ ID NO: 21159 - DNA, 25 bp, Rattus norvegicus
aacactggtctacgtgcaaggcaca

SEQ ID NO: 21160 - DNA, 25 bp, Rattus norvegicus
aacactggtctaggtgcaaggcaca

SEQ ID NO: 21161 - DNA, 25 bp, Rattus norvegicus
aacactggtgaactgcacaagcaag

SEQ ID NO: 21162 - DNA, 25 bp, Rattus norvegicus
aacactggtgaagtgcacaagcaag

SEQ ID NO: 21163 - DNA, 25 bp, Rattus norvegicus
aacactggttcccaagattccatgg

SEQ ID NO: 21164 - DNA, 25 bp, Rattus norvegicus
aacactggttccgaagattccatgg

SEQ ID NO: 21165 - DNA, 25 bp, Rattus norvegicus
aacactggtttacatcttagtcact

SEQ ID NO: 21166 - DNA, 25 bp, Rattus norvegicus
aacactggtttagatcttagtcact

SEQ ID NO: 21167 - DNA, 25 bp, Rattus norvegicus
aacactggtttcatctgggctgggt

SEQ ID NO: 21168 - DNA, 25 bp, Rattus norvegicus
aacactggtttcttctgggctgggt

SEQ ID NO: 21169 - DNA, 25 bp, Rattus norvegicus
aacactgtagagctccatattctgg

SEQ ID NO: 21170 - DNA, 25 bp, Rattus norvegicus
aacactgtagaggtccatattctgg

SEQ ID NO: 21171 - DNA, 25 bp, Rattus norvegicus
aacactgtagcacctttggtttttc

SEQ ID NO: 21172 - DNA, 25 bp, Rattus norvegicus
aacactgtagcagctttggtttttc

SEQ ID NO: 21173 - DNA, 25 bp, Rattus norvegicus
aacactgtcacgatagacccaaact

SEQ ID NO: 21174 - DNA, 25 bp, Rattus norvegicus
aacactgtcacgttagacccaaact

SEQ ID NO: 21175 - DNA, 25 bp, Rattus norvegicus
aacactgtcactaggagactgtcat

SEQ ID NO: 21176 - DNA, 25 bp, Rattus norvegicus
aacactgtcacttggagactgtcat

SEQ ID NO: 21177 - DNA, 25 bp, Rattus norvegicus
aacactgtccttacgaattccacag

SEQ ID NO: 21178 - DNA, 25 bp, Rattus norvegicus
aacactgtcctttcgaattccacag

SEQ ID NO: 21179 - DNA, 25 bp, Rattus norvegicus
aacactgtcgtgactttgctgtata

SEQ ID NO: 21180 - DNA, 25 bp, Rattus norvegicus
aacactgtcgtgtctttgctgtata

SEQ ID NO: 21181 - DNA, 25 bp, Rattus norvegicus
aacactgtctccaagggtcaggcag

SEQ ID NO: 21182 - DNA, 25 bp, Rattus norvegicus
aacactgtctcctagggtcaggcag

SEQ ID NO: 21183 - DNA, 25 bp, Rattus norvegicus
aacactgtgactaccttcagatctc

SEQ ID NO: 21184 - DNA, 25 bp, Rattus norvegicus
aacactgtgactatataagactaac

SEQ ID NO: 21185 - DNA, 25 bp, Rattus norvegicus
aacactgtgacttccttcagatctc

SEQ ID NO: 21186 - DNA, 25 bp, Rattus norvegicus
aacactgtgactttataagactaac

SEQ ID NO: 21187 - DNA, 25 bp, Rattus norvegicus
aacactgtgcacataatgcagctgg

SEQ ID NO: 21188 - DNA, 25 bp, Rattus norvegicus
aacactgtgcacttaatgcagctgg

SEQ ID NO: 21189 - DNA, 25 bp, Rattus norvegicus
aacactgtgtagacggacgtgccac

SEQ ID NO: 21190 - DNA, 25 bp, Rattus norvegicus
aacactgtgtagtcggacgtgccac

SEQ ID NO: 21191 - DNA, 25 bp, Rattus norvegicus
aacactgtgtctctggcaattctaa

SEQ ID NO: 21192 - DNA, 25 bp, Rattus norvegicus
aacactgtgtctgtggcaattctaa

SEQ ID NO: 21193 - DNA, 25 bp, Rattus norvegicus
aacactgtgtgtccaggtggacctc

SEQ ID NO: 21194 - DNA, 25 bp, Rattus norvegicus
aacactgtgtgtgcaggtggacctc

SEQ ID NO: 21195 - DNA, 25 bp, Rattus norvegicus
aacactgttataagttcgaggccat

SEQ ID NO: 21196 - DNA, 25 bp, Rattus norvegicus
aacactgttatatgttcgaggccat

SEQ ID NO: 21197 - DNA, 25 bp, Rattus norvegicus
aacactgttcgtagtatggtcattg

SEQ ID NO: 21198 - DNA, 25 bp, Rattus norvegicus
aacactgttcgttgtatggtcattg

SEQ ID NO: 21199 - DNA, 25 bp, Rattus norvegicus
aacactgttctaaggcattcttaag

SEQ ID NO: 21200 - DNA, 25 bp, Rattus norvegicus
aacactgttctatggcattcttaag

SEQ ID NO: 21201 - DNA, 25 bp, Rattus norvegicus
aacactgttgcactttgcttcatac

SEQ ID NO: 21202 - DNA, 25 bp, Rattus norvegicus
aacactgttgcagtttgcttcatac

SEQ ID NO: 21203 - DNA, 25 bp, Rattus norvegicus
aacactgttgccagtggacttcaca

SEQ ID NO: 21204 - DNA, 25 bp, Rattus norvegicus
aacactgttgcctgtggacttcaca

SEQ ID NO: 21205 - DNA, 25 bp, Rattus norvegicus
aacactgttgcgatttgttgctctt

SEQ ID NO: 21206 - DNA, 25 bp, Rattus norvegicus
aacactgttgcgttttgttgctctt

SEQ ID NO: 21207 - DNA, 25 bp, Rattus norvegicus
aacactgttggcacttataggtgac

SEQ ID NO: 21208 - DNA, 25 bp, Rattus norvegicus
aacactgttggctcttataggtgac

SEQ ID NO: 21209 - DNA, 25 bp, Rattus norvegicus
aacactgttgtgctatgtatgctac

SEQ ID NO: 21210 - DNA, 25 bp, Rattus norvegicus
aacactgttgtggtatgtatgctac

SEQ ID NO: 21211 - DNA, 25 bp, Rattus norvegicus
aacactgtttaaatcttgtcgccct

SEQ ID NO: 21212 - DNA, 25 bp, Rattus norvegicus
aacactgtttaaatgatctttctca

SEQ ID NO: 21213 - DNA, 25 bp, Rattus norvegicus
aacactgtttaattcttgtcgccct

SEQ ID NO: 21214 - DNA, 25 bp, Rattus norvegicus
aacactgtttaattgatctttctca

SEQ ID NO: 21215 - DNA, 25 bp, Rattus norvegicus
aacactgtttccattcctggcatta

SEQ ID NO: 21216 - DNA, 25 bp, Rattus norvegicus
aacactgtttcctttcctggcatta

SEQ ID NO: 21217 - DNA, 25 bp, Rattus norvegicus
aacactgttttacatgccccaaagg

SEQ ID NO: 21218 - DNA, 25 bp, Rattus norvegicus
aacactgttttagatgccccaaagg

SEQ ID NO: 21219 - DNA, 25 bp, Rattus norvegicus
aacacttaaactatccatcctttgc

SEQ ID NO: 21220 - DNA, 25 bp, Rattus norvegicus
aacacttaaactttccatcctttgc

SEQ ID NO: 21221 - DNA, 25 bp, Rattus norvegicus
aacacttaatctctccaggtctggg

SEQ ID NO: 21222 - DNA, 25 bp, Rattus norvegicus
aacacttaatctgtccaggtctggg

SEQ ID NO: 21223 - DNA, 25 bp, Rattus norvegicus
aacacttacactatccttccggtag

SEQ ID NO: 21224 - DNA, 25 bp, Rattus norvegicus
aacacttacactttccttccggtag

SEQ ID NO: 21225 - DNA, 25 bp, Rattus norvegicus
aacacttacctccacggaccagatt

SEQ ID NO: 21226 - DNA, 25 bp, Rattus norvegicus
aacacttacctcgacggaccagatt

SEQ ID NO: 21227 - DNA, 25 bp, Rattus norvegicus
aacacttaggctcaactctcatgga

SEQ ID NO: 21228 - DNA, 25 bp, Rattus norvegicus
aacacttaggctgaactctcatgga

SEQ ID NO: 21229 - DNA, 25 bp, Rattus norvegicus
aacacttagtaacaattcctctgga

SEQ ID NO: 21230 - DNA, 25 bp, Rattus norvegicus
aacacttagtaagaattcctctgga

SEQ ID NO: 21231 - DNA, 25 bp, Rattus norvegicus
aacacttatctgaagcattttaact

SEQ ID NO: 21232 - DNA, 25 bp, Rattus norvegicus
aacacttatctgtagcattttaact

SEQ ID NO: 21233 - DNA, 25 bp, Rattus norvegicus
aacacttatgctcttccagaggctg

SEQ ID NO: 21234 - DNA, 25 bp, Rattus norvegicus
aacacttatgctgttccagaggctg

SEQ ID NO: 21235 - DNA, 25 bp, Rattus norvegicus
aacacttcagaactatcctcagtat

SEQ ID NO: 21236 - DNA, 25 bp, Rattus norvegicus
aacacttcagaagtatcctcagtat

SEQ ID NO: 21237 - DNA, 25 bp, Rattus norvegicus
aacacttcagccagtgctgtttgtc

SEQ ID NO: 21238 - DNA, 25 bp, Rattus norvegicus
aacacttcagcctgtgctgtttgtc

SEQ ID NO: 21239 - DNA, 25 bp, Rattus norvegicus
aacacttccacccagtttacactgt

SEQ ID NO: 21240 - DNA, 25 bp, Rattus norvegicus
aacacttccaccgagtttacactgt

SEQ ID NO: 21241 - DNA, 25 bp, Rattus norvegicus
aacacttccattactgctgtttctt

SEQ ID NO: 21242 - DNA, 25 bp, Rattus norvegicus
aacacttccatttctgctgtttctt

SEQ ID NO: 21243 - DNA, 25 bp, Rattus norvegicus
aacacttcccacactgctgcaatgg

SEQ ID NO: 21244 - DNA, 25 bp, Rattus norvegicus
aacacttcccactctgctgcaatgg

SEQ ID NO: 21245 - DNA, 25 bp, Rattus norvegicus
aacacttcccttatttgtcagactg

SEQ ID NO: 21246 - DNA, 25 bp, Rattus norvegicus
aacacttcccttttttgtcagactg

SEQ ID NO: 21247 - DNA, 25 bp, Rattus norvegicus
aacacttcctgcacattgctttagg

SEQ ID NO: 21248 - DNA, 25 bp, Rattus norvegicus
aacacttcctgctcattgctttagg

SEQ ID NO: 21249 - DNA, 25 bp, Rattus norvegicus
aacacttctgatccaacactcaaag

SEQ ID NO: 21250 - DNA, 25 bp, Rattus norvegicus
aacacttctgatgcaacactcaaag

SEQ ID NO: 21251 - DNA, 25 bp, Rattus norvegicus
aacacttctgtacctctgtattcac

SEQ ID NO: 21252 - DNA, 25 bp, Rattus norvegicus
aacacttctgtagctctgtattcac

SEQ ID NO: 21253 - DNA, 25 bp, Rattus norvegicus
aacacttctgtgctggcaggaccta

SEQ ID NO: 21254 - DNA, 25 bp, Rattus norvegicus
aacacttctgtggtggcaggaccta

SEQ ID NO: 21255 - DNA, 25 bp, Rattus norvegicus
aacacttcttggcactgtgcctcag

SEQ ID NO: 21256 - DNA, 25 bp, Rattus norvegicus
aacacttcttgggactgtgcctcag

SEQ ID NO: 21257 - DNA, 25 bp, Rattus norvegicus
aacacttctttcagactgttcacca

SEQ ID NO: 21258 - DNA, 25 bp, Rattus norvegicus
aacacttctttctgactgttcacca

SEQ ID NO: 21259 - DNA, 25 bp, Rattus norvegicus
aacacttcttttcatcccaattatg

SEQ ID NO: 21260 - DNA, 25 bp, Rattus norvegicus
aacacttcttttgatcccaattatg

SEQ ID NO: 21261 - DNA, 25 bp, Rattus norvegicus
aacacttgaagcagtgtggcccggc

SEQ ID NO: 21262 - DNA, 25 bp, Rattus norvegicus
aacacttgaagctgtgtggcccggc

SEQ ID NO: 21263 - DNA, 25 bp, Rattus norvegicus
aacacttgacttactgtgacttttg

SEQ ID NO: 21264 - DNA, 25 bp, Rattus norvegicus
aacacttgacttcggaaacactgca

SEQ ID NO: 21265 - DNA, 25 bp, Rattus norvegicus
aacacttgacttgggaaacactgca

SEQ ID NO: 21266 - DNA, 25 bp, Rattus norvegicus
aacacttgactttctgtgacttttg

SEQ ID NO: 21267 - DNA, 25 bp, Rattus norvegicus
aacacttgagtaaccatcctaaggg

SEQ ID NO: 21268 - DNA, 25 bp, Rattus norvegicus
aacacttgagtatccatcctaaggg

SEQ ID NO: 21269 - DNA, 25 bp, Rattus norvegicus
aacacttgatacaactgaaatgagt

SEQ ID NO: 21270 - DNA, 25 bp, Rattus norvegicus
aacacttgatactactgaaatgagt

SEQ ID NO: 21271 - DNA, 25 bp, Rattus norvegicus
aacacttgcatgacgggagagtcta

SEQ ID NO: 21272 - DNA, 25 bp, Rattus norvegicus
aacacttgcatgtcgggagagtcta

SEQ ID NO: 21273 - DNA, 25 bp, Rattus norvegicus
aacacttgcccaccatctgtctttt

SEQ ID NO: 21274 - DNA, 25 bp, Rattus norvegicus
aacacttgcccagcatctgtctttt

SEQ ID NO: 21275 - DNA, 25 bp, Rattus norvegicus
aacacttgccttaagtggctgggat

SEQ ID NO: 21276 - DNA, 25 bp, Rattus norvegicus
aacacttgcctttagtggctgggat

SEQ ID NO: 21277 - DNA, 25 bp, Rattus norvegicus
aacacttgcgtacccgcacgtggta

SEQ ID NO: 21278 - DNA, 25 bp, Rattus norvegicus
aacacttgcgtagccgcacgtggta

SEQ ID NO: 21279 - DNA, 25 bp, Rattus norvegicus
aacacttgctaaatttcccatcctc

SEQ ID NO: 21280 - DNA, 25 bp, Rattus norvegicus
aacacttgctaattttcccatcctc

SEQ ID NO: 21281 - DNA, 25 bp, Rattus norvegicus
aacacttgcttcctttaggttcact

SEQ ID NO: 21282 - DNA, 25 bp, Rattus norvegicus
aacacttgcttcgtttaggttcact

SEQ ID NO: 21283 - DNA, 25 bp, Rattus norvegicus
aacacttggagcacgggttgttggc

SEQ ID NO: 21284 - DNA, 25 bp, Rattus norvegicus
aacacttggagctcgggttgttggc

SEQ ID NO: 21285 - DNA, 25 bp, Rattus norvegicus
aacacttggataaattgattagtca

SEQ ID NO: 21286 - DNA, 25 bp, Rattus norvegicus
aacacttggatatattgattagtca

SEQ ID NO: 21287 - DNA, 25 bp, Rattus norvegicus
aacacttggccgaggtagagcgcga

SEQ ID NO: 21288 - DNA, 25 bp, Rattus norvegicus
aacacttggccgtggtagagcgcga

SEQ ID NO: 21289 - DNA, 25 bp, Rattus norvegicus
aacacttggctgacgtttcttcttt

SEQ ID NO: 21290 - DNA, 25 bp, Rattus norvegicus
aacacttggctgtcgtttcttcttt

SEQ ID NO: 21291 - DNA, 25 bp, Rattus norvegicus
aacacttggcttatttgcctctgtg

SEQ ID NO: 21292 - DNA, 25 bp, Rattus norvegicus
aacacttggcttttttgcctctgtg

SEQ ID NO: 21293 - DNA, 25 bp, Rattus norvegicus
aacacttgggatatttctcctctgt

SEQ ID NO: 21294 - DNA, 25 bp, Rattus norvegicus
aacacttgggatttttctcctctgt

SEQ ID NO: 21295 - DNA, 25 bp, Rattus norvegicus
aacacttgggtgatgtgcttgggaa

SEQ ID NO: 21296 - DNA, 25 bp, Rattus norvegicus
aacacttgggtgttgtgcttgggaa

SEQ ID NO: 21297 - DNA, 25 bp, Rattus norvegicus
aacacttggtcgactgcagtgactg

SEQ ID NO: 21298 - DNA, 25 bp, Rattus norvegicus
aacacttggtcgtctgcagtgactg

SEQ ID NO: 21299 - DNA, 25 bp, Rattus norvegicus
aacacttgtcttaggtagtgcttct

SEQ ID NO: 21300 - DNA, 25 bp, Rattus norvegicus
aacacttgtctttggtagtgcttct

SEQ ID NO: 21301 - DNA, 25 bp, Rattus norvegicus
aacacttgtgaaagccacgtttgta

SEQ ID NO: 21302 - DNA, 25 bp, Rattus norvegicus
aacacttgtgaatgccacgtttgta

SEQ ID NO: 21303 - DNA, 25 bp, Rattus norvegicus
aacacttgtgcaaatctgtcttgat

SEQ ID NO: 21304 - DNA, 25 bp, Rattus norvegicus
aacacttgtgcatatctgtcttgat

SEQ ID NO: 21305 - DNA, 25 bp, Rattus norvegicus
aacacttgtgttacatgagactgca

SEQ ID NO: 21306 - DNA, 25 bp, Rattus norvegicus
aacacttgtgtttcatgagactgca

SEQ ID NO: 21307 - DNA, 25 bp, Rattus norvegicus
aacactttaagtcctaattggcatt

SEQ ID NO: 21308 - DNA, 25 bp, Rattus norvegicus
aacactttaagtgctaattggcatt

SEQ ID NO: 21309 - DNA, 25 bp, Rattus norvegicus
aacactttagatctattttcaggaa

SEQ ID NO: 21310 - DNA, 25 bp, Rattus norvegicus
aacactttagatgtattttcaggaa

SEQ ID NO: 21311 - DNA, 25 bp, Rattus norvegicus
aacactttcaacatctctacagcaa

SEQ ID NO: 21312 - DNA, 25 bp, Rattus norvegicus
aacactttcaacttctctacagcaa

SEQ ID NO: 21313 - DNA, 25 bp, Rattus norvegicus
aacactttccaccacacctatgaga

SEQ ID NO: 21314 - DNA, 25 bp, Rattus norvegicus
aacactttccacgacacctatgaga

SEQ ID NO: 21315 - DNA, 25 bp, Rattus norvegicus
aacactttccataaagctctctctg

SEQ ID NO: 21316 - DNA, 25 bp, Rattus norvegicus
aacactttccatatggcttgctcgg

SEQ ID NO: 21317 - DNA, 25 bp, Rattus norvegicus
aacactttccattaagctctctctg

SEQ ID NO: 21318 - DNA, 25 bp, Rattus norvegicus
aacactttccatttggcttgctcgg

SEQ ID NO: 21319 - DNA, 25 bp, Rattus norvegicus
aacactttcctgacctgttttgagg

SEQ ID NO: 21320 - DNA, 25 bp, Rattus norvegicus
aacactttcctgtcctgttttgagg

SEQ ID NO: 21321 - DNA, 25 bp, Rattus norvegicus
aacactttcttacagttatcttctt

SEQ ID NO: 21322 - DNA, 25 bp, Rattus norvegicus
aacactttcttagagttatcttctt

SEQ ID NO: 21323 - DNA, 25 bp, Rattus norvegicus
aacactttcttcagagccaccttct

SEQ ID NO: 21324 - DNA, 25 bp, Rattus norvegicus
aacactttcttctgagccaccttct

SEQ ID NO: 21325 - DNA, 25 bp, Rattus norvegicus
aacactttcttgaaccctgcaatta

SEQ ID NO: 21326 - DNA, 25 bp, Rattus norvegicus
aacactttcttgtaccctgcaatta

SEQ ID NO: 21327 - DNA, 25 bp, Rattus norvegicus
aacactttgcttcccggtttccatg

SEQ ID NO: 21328 - DNA, 25 bp, Rattus norvegicus
aacactttgcttgccggtttccatg

SEQ ID NO: 21329 - DNA, 25 bp, Rattus norvegicus
aacactttggcaaagcttagcttgt

SEQ ID NO: 21330 - DNA, 25 bp, Rattus norvegicus
aacactttggcatagcttagcttgt

SEQ ID NO: 21331 - DNA, 25 bp, Rattus norvegicus
aacactttgtagaccctgtgtcttt

SEQ ID NO: 21332 - DNA, 25 bp, Rattus norvegicus
aacactttgtagtccctgtgtcttt

SEQ ID NO: 21333 - DNA, 25 bp, Rattus norvegicus
aacactttgtcacctacctttttgc

SEQ ID NO: 21334 - DNA, 25 bp, Rattus norvegicus
aacactttgtcagctacctttttgc

SEQ ID NO: 21335 - DNA, 25 bp, Rattus norvegicus
aacactttgttcactgcctttgatg

SEQ ID NO: 21336 - DNA, 25 bp, Rattus norvegicus
aacactttgttctctgcctttgatg

SEQ ID NO: 21337 - DNA, 25 bp, Rattus norvegicus
aacacttttcgtaaatgaggcccat

SEQ ID NO: 21338 - DNA, 25 bp, Rattus norvegicus
aacacttttcgttaatgaggcccat

SEQ ID NO: 21339 - DNA, 25 bp, Rattus norvegicus
aacacttttctaaacccagaccaca

SEQ ID NO: 21340 - DNA, 25 bp, Rattus norvegicus
aacacttttctatacccagaccaca

SEQ ID NO: 21341 - DNA, 25 bp, Rattus norvegicus
aacactttttcccagtgctcgataa

SEQ ID NO: 21342 - DNA, 25 bp, Rattus norvegicus
aacactttttccgagtgctcgataa

SEQ ID NO: 21343 - DNA, 25 bp, Rattus norvegicus
aacagaaacagaagcgccaccggac

SEQ ID NO: 21344 - DNA, 25 bp, Rattus norvegicus
aacagaaacagatgcgccaccggac

SEQ ID NO: 21345 - DNA, 25 bp, Rattus norvegicus
aacagaaaccctcgagccgtggcgt

SEQ ID NO: 21346 - DNA, 25 bp, Rattus norvegicus
aacagaaaccctggagccgtggcgt

SEQ ID NO: 21347 - DNA, 25 bp, Rattus norvegicus
aacagaaacctgagcaagaggacag

SEQ ID NO: 21348 - DNA, 25 bp, Rattus norvegicus
aacagaaacctgtgcaagaggacag

SEQ ID NO: 21349 - DNA, 25 bp, Rattus norvegicus
aacagaaacgtaatgctgaggccgt

SEQ ID NO: 21350 - DNA, 25 bp, Rattus norvegicus
aacagaaacgtattgctgaggccgt

SEQ ID NO: 21351 - DNA, 25 bp, Rattus norvegicus
aacagaaagatgaaggcctgcagct

SEQ ID NO: 21352 - DNA, 25 bp, Rattus norvegicus
aacagaaagatgtaggcctgcagct

SEQ ID NO: 21353 - DNA, 25 bp, Rattus norvegicus
aacagaaagtacctgcctggcccga

SEQ ID NO: 21354 - DNA, 25 bp, Rattus norvegicus
aacagaaagtacgtgcctggcccga

SEQ ID NO: 21355 - DNA, 25 bp, Rattus norvegicus
aacagaaatgctcgcactggagctt

SEQ ID NO: 21356 - DNA, 25 bp, Rattus norvegicus
aacagaaatgctggcactggagctt

SEQ ID NO: 21357 - DNA, 25 bp, Rattus norvegicus
aacagaacactactttccgccaatc

SEQ ID NO: 21358 - DNA, 25 bp, Rattus norvegicus
aacagaacactagtttccgccaatc

SEQ ID NO: 21359 - DNA, 25 bp, Rattus norvegicus
aacagaacagtcactcccagcttga

SEQ ID NO: 21360 - DNA, 25 bp, Rattus norvegicus
aacagaacagtctctcccagcttga

SEQ ID NO: 21361 - DNA, 25 bp, Rattus norvegicus
aacagaacatgcatcgggtcctcat

SEQ ID NO: 21362 - DNA, 25 bp, Rattus norvegicus
aacagaacatgcttcgggtcctcat

SEQ ID NO: 21363 - DNA, 25 bp, Rattus norvegicus
aacagaactataaagctccgccacg

SEQ ID NO: 21364 - DNA, 25 bp, Rattus norvegicus
aacagaactatatagctccgccacg

SEQ ID NO: 21365 - DNA, 25 bp, Rattus norvegicus
aacagaactcatccagctcagaagt

SEQ ID NO: 21366 - DNA, 25 bp, Rattus norvegicus
aacagaactcatgcagctcagaagt

SEQ ID NO: 21367 - DNA, 25 bp, Rattus norvegicus
aacagaactcggaggccctgatcga

SEQ ID NO: 21368 - DNA, 25 bp, Rattus norvegicus
aacagaactcggtggccctgatcga

SEQ ID NO: 21369 - DNA, 25 bp, Rattus norvegicus
aacagaactctgaaagcgacttgca

SEQ ID NO: 21370 - DNA, 25 bp, Rattus norvegicus
aacagaactctgtaagcgacttgca

SEQ ID NO: 21371 - DNA, 25 bp, Rattus norvegicus
aacagaagactcaccttctgcacag

SEQ ID NO: 21372 - DNA, 25 bp, Rattus norvegicus
aacagaagactctccttctgcacag

SEQ ID NO: 21373 - DNA, 25 bp, Rattus norvegicus
aacagaagccttcaattgaaattta

SEQ ID NO: 21374 - DNA, 25 bp, Rattus norvegicus
aacagaagccttgaattgaaattta

SEQ ID NO: 21375 - DNA, 25 bp, Rattus norvegicus
aacagaagctctatccattttttgt

SEQ ID NO: 21376 - DNA, 25 bp, Rattus norvegicus
aacagaagctctttccattttttgt

SEQ ID NO: 21377 - DNA, 25 bp, Rattus norvegicus
aacagaagcttcagtgactgtccct

SEQ ID NO: 21378 - DNA, 25 bp, Rattus norvegicus
aacagaagcttctgtgactgtccct

SEQ ID NO: 21379 - DNA, 25 bp, Rattus norvegicus
aacagaaggcccagggtcgcatgtt

SEQ ID NO: 21380 - DNA, 25 bp, Rattus norvegicus
aacagaaggcccctctgggagtgat

SEQ ID NO: 21381 - DNA, 25 bp, Rattus norvegicus
aacagaaggcccgtctgggagtgat

SEQ ID NO: 21382 - DNA, 25 bp, Rattus norvegicus
aacagaaggccctgggtcgcatgtt

SEQ ID NO: 21383 - DNA, 25 bp, Rattus norvegicus
aacagaaggtctcctgatgacagct

SEQ ID NO: 21384 - DNA, 25 bp, Rattus norvegicus
aacagaaggtctgctgatgacagct

SEQ ID NO: 21385 - DNA, 25 bp, Rattus norvegicus
aacagaaggtttagaggtcaccatt

SEQ ID NO: 21386 - DNA, 25 bp, Rattus norvegicus
aacagaaggttttgaggtcaccatt

SEQ ID NO: 21387 - DNA, 25 bp, Rattus norvegicus
aacagaagttatcctggacttaaca

SEQ ID NO: 21388 - DNA, 25 bp, Rattus norvegicus
aacagaagttatgctggacttaaca

SEQ ID NO: 21389 - DNA, 25 bp, Rattus norvegicus
aacagaagttctcaccagcctcaca

SEQ ID NO: 21390 - DNA, 25 bp, Rattus norvegicus
aacagaagttctgaccagcctcaca

SEQ ID NO: 21391 - DNA, 25 bp, Rattus norvegicus
aacagaagtttcacccaaccggcag

SEQ ID NO: 21392 - DNA, 25 bp, Rattus norvegicus
aacagaagtttctcccaaccggcag

SEQ ID NO: 21393 - DNA, 25 bp, Rattus norvegicus
aacagaatcctgacatctccagaga

SEQ ID NO: 21394 - DNA, 25 bp, Rattus norvegicus
aacagaatcctgtcatctccagaga

SEQ ID NO: 21395 - DNA, 25 bp, Rattus norvegicus
aacagaattcccatcattgtcacag

SEQ ID NO: 21396 - DNA, 25 bp, Rattus norvegicus
aacagaattcccttcattgtcacag

SEQ ID NO: 21397 - DNA, 25 bp, Rattus norvegicus
aacagacaagatccacaccacagtg

SEQ ID NO: 21398 - DNA, 25 bp, Rattus norvegicus
aacagacaagatgcacaccacagtg

SEQ ID NO: 21399 - DNA, 25 bp, Rattus norvegicus
aacagacacagcagggcgccagtga

SEQ ID NO: 21400 - DNA, 25 bp, Rattus norvegicus
aacagacacagctgggcgccagtga

SEQ ID NO: 21401 - DNA, 25 bp, Rattus norvegicus
aacagacacctccttgctgttttca

SEQ ID NO: 21402 - DNA, 25 bp, Rattus norvegicus
aacagacacctcgttgctgttttca

SEQ ID NO: 21403 - DNA, 25 bp, Rattus norvegicus
aacagacacggtccgaggccttgtg

SEQ ID NO: 21404 - DNA, 25 bp, Rattus norvegicus
aacagacacggtgcgaggccttgtg

SEQ ID NO: 21405 - DNA, 25 bp, Rattus norvegicus
aacagacactttcagttcacgccct

SEQ ID NO: 21406 - DNA, 25 bp, Rattus norvegicus
aacagacactttgagttcacgccct

SEQ ID NO: 21407 - DNA, 25 bp, Rattus norvegicus
aacagacagctccttcctgatggac

SEQ ID NO: 21408 - DNA, 25 bp, Rattus norvegicus
aacagacagctcgttcctgatggac

SEQ ID NO: 21409 - DNA, 25 bp, Rattus norvegicus
aacagacagtccctcggtttcatgt

SEQ ID NO: 21410 - DNA, 25 bp, Rattus norvegicus
aacagacagtccgtcggtttcatgt

SEQ ID NO: 21411 - DNA, 25 bp, Rattus norvegicus
aacagacataatccccaaagcgcat

SEQ ID NO: 21412 - DNA, 25 bp, Rattus norvegicus
aacagacataatgcccaaagcgcat

SEQ ID NO: 21413 - DNA, 25 bp, Rattus norvegicus
aacagacatattagcctcgagattc

SEQ ID NO: 21414 - DNA, 25 bp, Rattus norvegicus
aacagacatatttgcctcgagattc

SEQ ID NO: 21415 - DNA, 25 bp, Rattus norvegicus
aacagacatgatagccctgaggatg

SEQ ID NO: 21416 - DNA, 25 bp, Rattus norvegicus
aacagacatgattgccctgaggatg

SEQ ID NO: 21417 - DNA, 25 bp, Rattus norvegicus
aacagacatggacccctgagtccta

SEQ ID NO: 21418 - DNA, 25 bp, Rattus norvegicus
aacagacatggagccctgagtccta

SEQ ID NO: 21419 - DNA, 25 bp, Rattus norvegicus
aacagacattagaagcttggccagt

SEQ ID NO: 21420 - DNA, 25 bp, Rattus norvegicus
aacagacattagtagcttggccagt

SEQ ID NO: 21421 - DNA, 25 bp, Rattus norvegicus
aacagacattggagtcactgggtgt

SEQ ID NO: 21422 - DNA, 25 bp, Rattus norvegicus
aacagacattggtgtcactgggtgt

SEQ ID NO: 21423 - DNA, 25 bp, Rattus norvegicus
aacagaccagaacgtgagctctcac

SEQ ID NO: 21424 - DNA, 25 bp, Rattus norvegicus
aacagaccagaaggtgagctctcac

SEQ ID NO: 21425 - DNA, 25 bp, Rattus norvegicus
aacagaccaggtcacatgggatgca

SEQ ID NO: 21426 - DNA, 25 bp, Rattus norvegicus
aacagaccaggtgacatgggatgca

SEQ ID NO: 21427 - DNA, 25 bp, Rattus norvegicus
aacagaccagtgacttgacttgaga

SEQ ID NO: 21428 - DNA, 25 bp, Rattus norvegicus
aacagaccagtgtcttgacttgaga

SEQ ID NO: 21429 - DNA, 25 bp, Rattus norvegicus
aacagacccggtacattaacatgta

SEQ ID NO: 21430 - DNA, 25 bp, Rattus norvegicus
aacagacccggttcattaacatgta

SEQ ID NO: 21431 - DNA, 25 bp, Rattus norvegicus
aacagaccggtcatgaatctcaatg

SEQ ID NO: 21432 - DNA, 25 bp, Rattus norvegicus
aacagaccggtcttgaatctcaatg

SEQ ID NO: 21433 - DNA, 25 bp, Rattus norvegicus
aacagaccggttcatagtgaaatct

SEQ ID NO: 21434 - DNA, 25 bp, Rattus norvegicus
aacagaccggttgatagtgaaatct

SEQ ID NO: 21435 - DNA, 25 bp, Rattus norvegicus
aacagacctcagcagggcctttgat

SEQ ID NO: 21436 - DNA, 25 bp, Rattus norvegicus
aacagacctcaggagggcctttgat

SEQ ID NO: 21437 - DNA, 25 bp, Rattus norvegicus
aacagacctctcctaagattctcat

SEQ ID NO: 21438 - DNA, 25 bp, Rattus norvegicus
aacagacctctcgtaagattctcat

SEQ ID NO: 21439 - DNA, 25 bp, Rattus norvegicus
aacagacctgtgattctaaggtgga

SEQ ID NO: 21440 - DNA, 25 bp, Rattus norvegicus
aacagacctgtgtttctaaggtgga

SEQ ID NO: 21441 - DNA, 25 bp, Rattus norvegicus
aacagacctgttatgtactgagtta

SEQ ID NO: 21442 - DNA, 25 bp, Rattus norvegicus
aacagacctgttttgtactgagtta

SEQ ID NO: 21443 - DNA, 25 bp, Rattus norvegicus
aacagacgcaaaattccctctcgtt

SEQ ID NO: 21444 - DNA, 25 bp, Rattus norvegicus
aacagacgcaaatttccctctcgtt

SEQ ID NO: 21445 - DNA, 25 bp, Rattus norvegicus
aacagacgcctgactcaagtgaagg

SEQ ID NO: 21446 - DNA, 25 bp, Rattus norvegicus
aacagacgcctgtctcaagtgaagg

SEQ ID NO: 21447 - DNA, 25 bp, Rattus norvegicus
aacagacgtaggcatctcaggtcct

SEQ ID NO: 21448 - DNA, 25 bp, Rattus norvegicus
aacagacgtagggatctcaggtcct

SEQ ID NO: 21449 - DNA, 25 bp, Rattus norvegicus
aacagacgtgtgactgcagaaggca

SEQ ID NO: 21450 - DNA, 25 bp, Rattus norvegicus
aacagacgtgtgtctgcagaaggca

SEQ ID NO: 21451 - DNA, 25 bp, Rattus norvegicus
aacagactagtgctgctctcaaaca

SEQ ID NO: 21452 - DNA, 25 bp, Rattus norvegicus
aacagactagtggtgctctcaaaca

SEQ ID NO: 21453 - DNA, 25 bp, Rattus norvegicus
aacagactataccagccacatccgg

SEQ ID NO: 21454 - DNA, 25 bp, Rattus norvegicus
aacagactatacgagccacatccgg

SEQ ID NO: 21455 - DNA, 25 bp, Rattus norvegicus
aacagactcaagaaccactcaggga

SEQ ID NO: 21456 - DNA, 25 bp, Rattus norvegicus
aacagactcaagtaccactcaggga

SEQ ID NO: 21457 - DNA, 25 bp, Rattus norvegicus
aacagactcaggcgatgtgctttat

SEQ ID NO: 21458 - DNA, 25 bp, Rattus norvegicus
aacagactcaggggatgtgctttat

SEQ ID NO: 21459 - DNA, 25 bp, Rattus norvegicus
aacagactcctgaaggacgcgtgct

SEQ ID NO: 21460 - DNA, 25 bp, Rattus norvegicus
aacagactcctgtaggacgcgtgct

SEQ ID NO: 21461 - DNA, 25 bp, Rattus norvegicus
aacagactcggaaagccctggaact

SEQ ID NO: 21462 - DNA, 25 bp, Rattus norvegicus
aacagactcggatagccctggaact

SEQ ID NO: 21463 - DNA, 25 bp, Rattus norvegicus
aacagactctggcagcctggctagg

SEQ ID NO: 21464 - DNA, 25 bp, Rattus norvegicus
aacagactctgggagcctggctagg

SEQ ID NO: 21465 - DNA, 25 bp, Rattus norvegicus
aacagactgggcactacactagaac

SEQ ID NO: 21466 - DNA, 25 bp, Rattus norvegicus
aacagactgggctctacactagaac

SEQ ID NO: 21467 - DNA, 25 bp, Rattus norvegicus
aacagactggtgctgacgttcgtgc

SEQ ID NO: 21468 - DNA, 25 bp, Rattus norvegicus
aacagactggtggtgacgttcgtgc

SEQ ID NO: 21469 - DNA, 25 bp, Rattus norvegicus
aacagactgtggaccctaaagacaa

SEQ ID NO: 21470 - DNA, 25 bp, Rattus norvegicus
aacagactgtggacctgaaacccag

SEQ ID NO: 21471 - DNA, 25 bp, Rattus norvegicus
aacagactgtggtccctaaagacaa

SEQ ID NO: 21472 - DNA, 25 bp, Rattus norvegicus
aacagactgtggtcctgaaacccag

SEQ ID NO: 21473 - DNA, 25 bp, Rattus norvegicus
aacagacttagaatggtattcacag

SEQ ID NO: 21474 - DNA, 25 bp, Rattus norvegicus
aacagacttagattggtattcacag

SEQ ID NO: 21475 - DNA, 25 bp, Rattus norvegicus
aacagacttcaacctttgggagtgt

SEQ ID NO: 21476 - DNA, 25 bp, Rattus norvegicus
aacagacttcaagctttgggagtgt

SEQ ID NO: 21477 - DNA, 25 bp, Rattus norvegicus
aacagacttcttaacctgcttgcgt

SEQ ID NO: 21478 - DNA, 25 bp, Rattus norvegicus
aacagacttctttacctgcttgcgt

SEQ ID NO: 21479 - DNA, 25 bp, Rattus norvegicus
aacagacttgtcatcatcataccgc

SEQ ID NO: 21480 - DNA, 25 bp, Rattus norvegicus
aacagacttgtcttcatcataccgc

SEQ ID NO: 21481 - DNA, 25 bp, Rattus norvegicus
aacagacttgttagacattgtgccg

SEQ ID NO: 21482 - DNA, 25 bp, Rattus norvegicus
aacagacttgtttgacattgtgccg

SEQ ID NO: 21483 - DNA, 25 bp, Rattus norvegicus
aacagactttctcccgcggttgcct

SEQ ID NO: 21484 - DNA, 25 bp, Rattus norvegicus
aacagactttctgccgcggttgcct

SEQ ID NO: 21485 - DNA, 25 bp, Rattus norvegicus
aacagacttttcaaatgacggcaat

SEQ ID NO: 21486 - DNA, 25 bp, Rattus norvegicus
aacagacttttctaatgacggcaat

SEQ ID NO: 21487 - DNA, 25 bp, Rattus norvegicus
aacagagaaagcctgtggaccaaca

SEQ ID NO: 21488 - DNA, 25 bp, Rattus norvegicus
aacagagaaagcgtgtggaccaaca

SEQ ID NO: 21489 - DNA, 25 bp, Rattus norvegicus
aacagagaaccaatcgggagcatgc

SEQ ID NO: 21490 - DNA, 25 bp, Rattus norvegicus
aacagagaaccattcgggagcatgc

SEQ ID NO: 21491 - DNA, 25 bp, Rattus norvegicus
aacagagacgttaaggatgtgagat

SEQ ID NO: 21492 - DNA, 25 bp, Rattus norvegicus
aacagagacgtttaggatgtgagat

SEQ ID NO: 21493 - DNA, 25 bp, Rattus norvegicus
aacagagagaacaatcagccggcaa

SEQ ID NO: 21494 - DNA, 25 bp, Rattus norvegicus
aacagagagaactatcagccggcaa

SEQ ID NO: 21495 - DNA, 25 bp, Rattus norvegicus
aacagagagcctagcagactgacag

SEQ ID NO: 21496 - DNA, 25 bp, Rattus norvegicus
aacagagagccttgcagactgacag

SEQ ID NO: 21497 - DNA, 25 bp, Rattus norvegicus
aacagagaggagctggtacctcctt

SEQ ID NO: 21498 - DNA, 25 bp, Rattus norvegicus
aacagagaggaggtggtacctcctt

SEQ ID NO: 21499 - DNA, 25 bp, Rattus norvegicus
aacagagaggccattgacgtgtacc

SEQ ID NO: 21500 - DNA, 25 bp, Rattus norvegicus
aacagagaggcccagtaccactcct

SEQ ID NO: 21501 - DNA, 25 bp, Rattus norvegicus
aacagagaggccgagtaccactcct

SEQ ID NO: 21502 - DNA, 25 bp, Rattus norvegicus
aacagagaggcctttgacgtgtacc

SEQ ID NO: 21503 - DNA, 25 bp, Rattus norvegicus
aacagagaggctagaactctttgta

SEQ ID NO: 21504 - DNA, 25 bp, Rattus norvegicus
aacagagaggcttgaactctttgta

SEQ ID NO: 21505 - DNA, 25 bp, Rattus norvegicus
aacagagataccacgcatacctttt

SEQ ID NO: 21506 - DNA, 25 bp, Rattus norvegicus
aacagagatacctcgcatacctttt

SEQ ID NO: 21507 - DNA, 25 bp, Rattus norvegicus
aacagagatcccaatgtgtgtggca

SEQ ID NO: 21508 - DNA, 25 bp, Rattus norvegicus
aacagagatccctatgtgtgtggca

SEQ ID NO: 21509 - DNA, 25 bp, Rattus norvegicus
aacagagatctgagtggcgctttat

SEQ ID NO: 21510 - DNA, 25 bp, Rattus norvegicus
aacagagatctgtgtggcgctttat

SEQ ID NO: 21511 - DNA, 25 bp, Rattus norvegicus
aacagagatggcacccaagtcaaaa

SEQ ID NO: 21512 - DNA, 25 bp, Rattus norvegicus
aacagagatggctcccaagtcaaaa

SEQ ID NO: 21513 - DNA, 25 bp, Rattus norvegicus
aacagagcacctcacagctgggagg

SEQ ID NO: 21514 - DNA, 25 bp, Rattus norvegicus
aacagagcacctgacagctgggagg

SEQ ID NO: 21515 - DNA, 25 bp, Rattus norvegicus
aacagagcagcacacccccggaatt

SEQ ID NO: 21516 - DNA, 25 bp, Rattus norvegicus
aacagagcagcagacccccggaatt

SEQ ID NO: 21517 - DNA, 25 bp, Rattus norvegicus
aacagagcagctacgtatctccgag

SEQ ID NO: 21518 - DNA, 25 bp, Rattus norvegicus
aacagagcagcttcgtatctccgag

SEQ ID NO: 21519 - DNA, 25 bp, Rattus norvegicus
aacagagcaggtcgttctttcctct

SEQ ID NO: 21520 - DNA, 25 bp, Rattus norvegicus
aacagagcaggtggttctttcctct

SEQ ID NO: 21521 - DNA, 25 bp, Rattus norvegicus
aacagagcagtcaagggagccccag

SEQ ID NO: 21522 - DNA, 25 bp, Rattus norvegicus
aacagagcagtctagggagccccag

SEQ ID NO: 21523 - DNA, 25 bp, Rattus norvegicus
aacagagcccggaacagcacacatt

SEQ ID NO: 21524 - DNA, 25 bp, Rattus norvegicus
aacagagcccggtacagcacacatt

SEQ ID NO: 21525 - DNA, 25 bp, Rattus norvegicus
aacagagcctgtcgcatgccgacta

SEQ ID NO: 21526 - DNA, 25 bp, Rattus norvegicus
aacagagcctgtggcatgccgacta

SEQ ID NO: 21527 - DNA, 25 bp, Rattus norvegicus
aacagagctcggcaggaaccacctg

SEQ ID NO: 21528 - DNA, 25 bp, Rattus norvegicus
aacagagctcgggaggaaccacctg

SEQ ID NO: 21529 - DNA, 25 bp, Rattus norvegicus
aacagagctctcaggcgctgtgaca

SEQ ID NO: 21530 - DNA, 25 bp, Rattus norvegicus
aacagagctctcagtgatcgccaac

SEQ ID NO: 21531 - DNA, 25 bp, Rattus norvegicus
aacagagctctctggcgctgtgaca

SEQ ID NO: 21532 - DNA, 25 bp, Rattus norvegicus
aacagagctctctgtgatcgccaac

SEQ ID NO: 21533 - DNA, 25 bp, Rattus norvegicus
aacagagctgagctgcggctcacat

SEQ ID NO: 21534 - DNA, 25 bp, Rattus norvegicus
aacagagctgaggtgcggctcacat

SEQ ID NO: 21535 - DNA, 25 bp, Rattus norvegicus
aacagagcttggaatacatcaggga

SEQ ID NO: 21536 - DNA, 25 bp, Rattus norvegicus
aacagagcttggtatacatcaggga

SEQ ID NO: 21537 - DNA, 25 bp, Rattus norvegicus
aacagaggacatatgcccagggatc

SEQ ID NO: 21538 - DNA, 25 bp, Rattus norvegicus
aacagaggacatttgcccagggatc

SEQ ID NO: 21539 - DNA, 25 bp, Rattus norvegicus
aacagaggacccctgaggacattga

SEQ ID NO: 21540 - DNA, 25 bp, Rattus norvegicus
aacagaggacccgtgaggacattga

SEQ ID NO: 21541 - DNA, 25 bp, Rattus norvegicus
aacagaggatcaacgggctagcctt

SEQ ID NO: 21542 - DNA, 25 bp, Rattus norvegicus
aacagaggatcatcgggctagcctt

SEQ ID NO: 21543 - DNA, 25 bp, Rattus norvegicus
aacagaggatctcaaccagcccttc

SEQ ID NO: 21544 - DNA, 25 bp, Rattus norvegicus
aacagaggatctgaaccagcccttc

SEQ ID NO: 21545 - DNA, 25 bp, Rattus norvegicus
aacagaggcctccatgggactggac

SEQ ID NO: 21546 - DNA, 25 bp, Rattus norvegicus
aacagaggcctcgatgggactggac

SEQ ID NO: 21547 - DNA, 25 bp, Rattus norvegicus
aacagaggctccctgcgaacagaac

SEQ ID NO: 21548 - DNA, 25 bp, Rattus norvegicus
aacagaggctccgtgcgaacagaac

SEQ ID NO: 21549 - DNA, 25 bp, Rattus norvegicus
aacagaggctctccgtgggaaagac

SEQ ID NO: 21550 - DNA, 25 bp, Rattus norvegicus
aacagaggctctgcgtgggaaagac

SEQ ID NO: 21551 - DNA, 25 bp, Rattus norvegicus
aacagaggcttcctgtccctaaatg

SEQ ID NO: 21552 - DNA, 25 bp, Rattus norvegicus
aacagaggcttcgtgtccctaaatg

SEQ ID NO: 21553 - DNA, 25 bp, Rattus norvegicus
aacagagggcttatatccacaatat

SEQ ID NO: 21554 - DNA, 25 bp, Rattus norvegicus
aacagagggcttttatccacaatat

SEQ ID NO: 21555 - DNA, 25 bp, Rattus norvegicus
aacagagtcctgaagctagctcgtg

SEQ ID NO: 21556 - DNA, 25 bp, Rattus norvegicus
aacagagtcctgtagctagctcgtg

SEQ ID NO: 21557 - DNA, 25 bp, Rattus norvegicus
aacagagtcggcagatagctgcctc

SEQ ID NO: 21558 - DNA, 25 bp, Rattus norvegicus
aacagagtcggctgatagctgcctc

SEQ ID NO: 21559 - DNA, 25 bp, Rattus norvegicus
aacagagtgagtcagacgctttgct

SEQ ID NO: 21560 - DNA, 25 bp, Rattus norvegicus
aacagagtgagtgagacgctttgct

SEQ ID NO: 21561 - DNA, 25 bp, Rattus norvegicus
aacagagtgccaagcgcagagtctc

SEQ ID NO: 21562 - DNA, 25 bp, Rattus norvegicus
aacagagtgccatgcgcagagtctc

SEQ ID NO: 21563 - DNA, 25 bp, Rattus norvegicus
aacagagtggtcagtgcgcagcccg

SEQ ID NO: 21564 - DNA, 25 bp, Rattus norvegicus
aacagagtggtctgtgcgcagcccg

SEQ ID NO: 21565 - DNA, 25 bp, Rattus norvegicus
aacagagtgtgtcaagcccagattc

SEQ ID NO: 21566 - DNA, 25 bp, Rattus norvegicus
aacagagtgtgtgaagcccagattc

SEQ ID NO: 21567 - DNA, 25 bp, Rattus norvegicus
aacagagtgttcacagtccttgctg

SEQ ID NO: 21568 - DNA, 25 bp, Rattus norvegicus
aacagagtgttcaggtttgggaact

SEQ ID NO: 21569 - DNA, 25 bp, Rattus norvegicus
aacagagtgttctcagtccttgctg

SEQ ID NO: 21570 - DNA, 25 bp, Rattus norvegicus
aacagagtgttctggtttgggaact

SEQ ID NO: 21571 - DNA, 25 bp, Rattus norvegicus
aacagagttcgtctttccgtaagca

SEQ ID NO: 21572 - DNA, 25 bp, Rattus norvegicus
aacagagttcgtgtttccgtaagca

SEQ ID NO: 21573 - DNA, 25 bp, Rattus norvegicus
aacagagttctacttggtctggcct

SEQ ID NO: 21574 - DNA, 25 bp, Rattus norvegicus
aacagagttctagttggtctggcct

SEQ ID NO: 21575 - DNA, 25 bp, Rattus norvegicus
aacagagttgttatcttggcatatg

SEQ ID NO: 21576 - DNA, 25 bp, Rattus norvegicus
aacagagttgttttcttggcatatg

SEQ ID NO: 21577 - DNA, 25 bp, Rattus norvegicus
aacagataacagctggttcacctta

SEQ ID NO: 21578 - DNA, 25 bp, Rattus norvegicus
aacagataacaggtggttcacctta

SEQ ID NO: 21579 - DNA, 25 bp, Rattus norvegicus
aacagataagcccttgctgcttcct

SEQ ID NO: 21580 - DNA, 25 bp, Rattus norvegicus
aacagataagccgttgctgcttcct

SEQ ID NO: 21581 - DNA, 25 bp, Rattus norvegicus
aacagatcacggagccttcttgtag

SEQ ID NO: 21582 - DNA, 25 bp, Rattus norvegicus
aacagatcacggtgccttcttgtag

SEQ ID NO: 21583 - DNA, 25 bp, Rattus norvegicus
aacagatcatgtagatagcacaagt

SEQ ID NO: 21584 - DNA, 25 bp, Rattus norvegicus
aacagatcatgttgatagcacaagt

SEQ ID NO: 21585 - DNA, 25 bp, Rattus norvegicus
aacagatccccactaccttgaaggt

SEQ ID NO: 21586 - DNA, 25 bp, Rattus norvegicus
aacagatccccagtaccttgaaggt

SEQ ID NO: 21587 - DNA, 25 bp, Rattus norvegicus
aacagatccctcagtgccttggaac

SEQ ID NO: 21588 - DNA, 25 bp, Rattus norvegicus
aacagatccctctgtgccttggaac

SEQ ID NO: 21589 - DNA, 25 bp, Rattus norvegicus
aacagatcttagacggtgcttggaa

SEQ ID NO: 21590 - DNA, 25 bp, Rattus norvegicus
aacagatcttagtcggtgcttggaa

SEQ ID NO: 21591 - DNA, 25 bp, Rattus norvegicus
aacagatcttttcgtcttgcctcga

SEQ ID NO: 21592 - DNA, 25 bp, Rattus norvegicus
aacagatcttttggtcttgcctcga

SEQ ID NO: 21593 - DNA, 25 bp, Rattus norvegicus
aacagatgaggccttacacgcgttt

SEQ ID NO: 21594 - DNA, 25 bp, Rattus norvegicus
aacagatgaggcgttacacgcgttt

SEQ ID NO: 21595 - DNA, 25 bp, Rattus norvegicus
aacagatgcaggctttcatttgtaa

SEQ ID NO: 21596 - DNA, 25 bp, Rattus norvegicus
aacagatgcagggtttcatttgtaa

SEQ ID NO: 21597 - DNA, 25 bp, Rattus norvegicus
aacagatgcctgactgctttagaag

SEQ ID NO: 21598 - DNA, 25 bp, Rattus norvegicus
aacagatgcctgtctgctttagaag

SEQ ID NO: 21599 - DNA, 25 bp, Rattus norvegicus
aacagatgcttgacgttgtagataa

SEQ ID NO: 21600 - DNA, 25 bp, Rattus norvegicus
aacagatgcttgtcgttgtagataa

SEQ ID NO: 21601 - DNA, 25 bp, Rattus norvegicus
aacagatggacacttccagccacct

SEQ ID NO: 21602 - DNA, 25 bp, Rattus norvegicus
aacagatggacagttccagccacct

SEQ ID NO: 21603 - DNA, 25 bp, Rattus norvegicus
aacagatggagcatgccaaccagca

SEQ ID NO: 21604 - DNA, 25 bp, Rattus norvegicus
aacagatggagcttgccaaccagca

SEQ ID NO: 21605 - DNA, 25 bp, Rattus norvegicus
aacagatgtcttacccatcagggag

SEQ ID NO: 21606 - DNA, 25 bp, Rattus norvegicus
aacagatgtctttcccatcagggag

SEQ ID NO: 21607 - DNA, 25 bp, Rattus norvegicus
aacagatgtgctaggtgacctgaga

SEQ ID NO: 21608 - DNA, 25 bp, Rattus norvegicus
aacagatgtgcttggtgacctgaga

SEQ ID NO: 21609 - DNA, 25 bp, Rattus norvegicus
aacagatgttgcaaaatagttcatt

SEQ ID NO: 21610 - DNA, 25 bp, Rattus norvegicus
aacagatgttgctaaatagttcatt

SEQ ID NO: 21611 - DNA, 25 bp, Rattus norvegicus
aacagattactgaaggttttcctca

SEQ ID NO: 21612 - DNA, 25 bp, Rattus norvegicus
aacagattactgtaggttttcctca

SEQ ID NO: 21613 - DNA, 25 bp, Rattus norvegicus
aacagattcattattccttattaag

SEQ ID NO: 21614 - DNA, 25 bp, Rattus norvegicus
aacagattcatttttccttattaag

SEQ ID NO: 21615 - DNA, 25 bp, Rattus norvegicus
aacagattccctaacatttaccagt

SEQ ID NO: 21616 - DNA, 25 bp, Rattus norvegicus
aacagattcccttacatttaccagt

SEQ ID NO: 21617 - DNA, 25 bp, Rattus norvegicus
aacagattcctaagaagagtgggca

SEQ ID NO: 21618 - DNA, 25 bp, Rattus norvegicus
aacagattcctatgaagagtgggca

SEQ ID NO: 21619 - DNA, 25 bp, Rattus norvegicus
aacagattcctcagatggagcgaga

SEQ ID NO: 21620 - DNA, 25 bp, Rattus norvegicus
aacagattcctctgatggagcgaga

SEQ ID NO: 21621 - DNA, 25 bp, Rattus norvegicus
aacagattcctgctcgggagattca

SEQ ID NO: 21622 - DNA, 25 bp, Rattus norvegicus
aacagattcctggtcgggagattca

SEQ ID NO: 21623 - DNA, 25 bp, Rattus norvegicus
aacagattctggacgtggcaatgga

SEQ ID NO: 21624 - DNA, 25 bp, Rattus norvegicus
aacagattctggtcgtggcaatgga

SEQ ID NO: 21625 - DNA, 25 bp, Rattus norvegicus
aacagattcttaccgtttccacaag

SEQ ID NO: 21626 - DNA, 25 bp, Rattus norvegicus
aacagattcttagcgtttccacaag

SEQ ID NO: 21627 - DNA, 25 bp, Rattus norvegicus
aacagatttccaaccgataccttga

SEQ ID NO: 21628 - DNA, 25 bp, Rattus norvegicus
aacagatttccatccgataccttga

SEQ ID NO: 21629 - DNA, 25 bp, Rattus norvegicus
aacagatttctaacactccaagcgc

SEQ ID NO: 21630 - DNA, 25 bp, Rattus norvegicus
aacagatttctatcactccaagcgc

SEQ ID NO: 21631 - DNA, 25 bp, Rattus norvegicus
aacagatttgcacccactctgggta

SEQ ID NO: 21632 - DNA, 25 bp, Rattus norvegicus
aacagatttgcagccactctgggta

SEQ ID NO: 21633 - DNA, 25 bp, Rattus norvegicus
aacagatttgtgcttttgagtccga

SEQ ID NO: 21634 - DNA, 25 bp, Rattus norvegicus
aacagatttgtggttttgagtccga

SEQ ID NO: 21635 - DNA, 25 bp, Rattus norvegicus
aacagattttgcacgtggcctgatc

SEQ ID NO: 21636 - DNA, 25 bp, Rattus norvegicus
aacagattttgctcgtggcctgatc

SEQ ID NO: 21637 - DNA, 25 bp, Rattus norvegicus
aacagattttgtcactttaccagtg

SEQ ID NO: 21638 - DNA, 25 bp, Rattus norvegicus
aacagattttgtcttctttggccct

SEQ ID NO: 21639 - DNA, 25 bp, Rattus norvegicus
aacagattttgtgactttaccagtg

SEQ ID NO: 21640 - DNA, 25 bp, Rattus norvegicus
aacagattttgtgttctttggccct

SEQ ID NO: 21641 - DNA, 25 bp, Rattus norvegicus
aacagcaaagctccagttttactga

SEQ ID NO: 21642 - DNA, 25 bp, Rattus norvegicus
aacagcaaagctgcagttttactga

SEQ ID NO: 21643 - DNA, 25 bp, Rattus norvegicus
aacagcaaagttaccctctgactga

SEQ ID NO: 21644 - DNA, 25 bp, Rattus norvegicus
aacagcaaagtttccctctgactga

SEQ ID NO: 21645 - DNA, 25 bp, Rattus norvegicus
aacagcaaatctcagggtacccttt

SEQ ID NO: 21646 - DNA, 25 bp, Rattus norvegicus
aacagcaaatctgagggtacccttt

SEQ ID NO: 21647 - DNA, 25 bp, Rattus norvegicus
aacagcaacaagagctccttgggct

SEQ ID NO: 21648 - DNA, 25 bp, Rattus norvegicus
aacagcaacaagtgctccttgggct

SEQ ID NO: 21649 - DNA, 25 bp, Rattus norvegicus
aacagcaacagcagatcttaaggca

SEQ ID NO: 21650 - DNA, 25 bp, Rattus norvegicus
aacagcaacagctgatcttaaggca

SEQ ID NO: 21651 - DNA, 25 bp, Rattus norvegicus
aacagcaagcagagtcgtggcacta

SEQ ID NO: 21652 - DNA, 25 bp, Rattus norvegicus
aacagcaagcagctttctcatccaa

SEQ ID NO: 21653 - DNA, 25 bp, Rattus norvegicus
aacagcaagcaggtttctcatccaa

SEQ ID NO: 21654 - DNA, 25 bp, Rattus norvegicus
aacagcaagcagtgtcgtggcacta

SEQ ID NO: 21655 - DNA, 25 bp, Rattus norvegicus
aacagcaagcttaccagttccagga

SEQ ID NO: 21656 - DNA, 25 bp, Rattus norvegicus
aacagcaagctttccagttccagga

SEQ ID NO: 21657 - DNA, 25 bp, Rattus norvegicus
aacagcaagtgtatccatctgccac

SEQ ID NO: 21658 - DNA, 25 bp, Rattus norvegicus
aacagcaagtgtttccatctgccac

SEQ ID NO: 21659 - DNA, 25 bp, Rattus norvegicus
aacagcaatcacaaagcggccggcg

SEQ ID NO: 21660 - DNA, 25 bp, Rattus norvegicus
aacagcaatcactaagcggccggcg

SEQ ID NO: 21661 - DNA, 25 bp, Rattus norvegicus
aacagcaatctaacttacccaaaag

SEQ ID NO: 21662 - DNA, 25 bp, Rattus norvegicus
aacagcaatctatcttacccaaaag

SEQ ID NO: 21663 - DNA, 25 bp, Rattus norvegicus
aacagcaatgaccttttacaaactt

SEQ ID NO: 21664 - DNA, 25 bp, Rattus norvegicus
aacagcaatgacgttttacaaactt

SEQ ID NO: 21665 - DNA, 25 bp, Rattus norvegicus
aacagcaatgagagctctgccagtt

SEQ ID NO: 21666 - DNA, 25 bp, Rattus norvegicus
aacagcaatgagtgctctgccagtt

SEQ ID NO: 21667 - DNA, 25 bp, Rattus norvegicus
aacagcaatgcaactggacccagcc

SEQ ID NO: 21668 - DNA, 25 bp, Rattus norvegicus
aacagcaatgcatctggacccagcc

SEQ ID NO: 21669 - DNA, 25 bp, Rattus norvegicus
aacagcacacacattctaatccttc

SEQ ID NO: 21670 - DNA, 25 bp, Rattus norvegicus
aacagcacacactttctaatccttc

SEQ ID NO: 21671 - DNA, 25 bp, Rattus norvegicus
aacagcacagccagagttgcgcaca

SEQ ID NO: 21672 - DNA, 25 bp, Rattus norvegicus
aacagcacagcctgagttgcgcaca

SEQ ID NO: 21673 - DNA, 25 bp, Rattus norvegicus
aacagcacagtgcactttctaatgt

SEQ ID NO: 21674 - DNA, 25 bp, Rattus norvegicus
aacagcacagtggactttctaatgt

SEQ ID NO: 21675 - DNA, 25 bp, Rattus norvegicus
aacagcacatttcaagccgaaggca

SEQ ID NO: 21676 - DNA, 25 bp, Rattus norvegicus
aacagcacatttgaagccgaaggca

SEQ ID NO: 21677 - DNA, 25 bp, Rattus norvegicus
aacagcaccacaaaactgtgtttgt

SEQ ID NO: 21678 - DNA, 25 bp, Rattus norvegicus
aacagcaccacataactgtgtttgt

SEQ ID NO: 21679 - DNA, 25 bp, Rattus norvegicus
aacagcacccagcaaggcagccttt

SEQ ID NO: 21680 - DNA, 25 bp, Rattus norvegicus
aacagcacccaggaaggcagccttt

SEQ ID NO: 21681 - DNA, 25 bp, Rattus norvegicus
aacagcacgggccatctggcattag

SEQ ID NO: 21682 - DNA, 25 bp, Rattus norvegicus
aacagcacgggcgatctggcattag

SEQ ID NO: 21683 - DNA, 25 bp, Rattus norvegicus
aacagcacggtgagaatcattcatc

SEQ ID NO: 21684 - DNA, 25 bp, Rattus norvegicus
aacagcacggtgtgaatcattcatc

SEQ ID NO: 21685 - DNA, 25 bp, Rattus norvegicus
aacagcacgtttatctcagtggcct

SEQ ID NO: 21686 - DNA, 25 bp, Rattus norvegicus
aacagcacgtttttctcagtggcct

SEQ ID NO: 21687 - DNA, 25 bp, Rattus norvegicus
aacagcactctgacttctaacaaga

SEQ ID NO: 21688 - DNA, 25 bp, Rattus norvegicus
aacagcactctgagggcaactggtt

SEQ ID NO: 21689 - DNA, 25 bp, Rattus norvegicus
aacagcactctgtcttctaacaaga

SEQ ID NO: 21690 - DNA, 25 bp, Rattus norvegicus
aacagcactctgtgggcaactggtt

SEQ ID NO: 21691 - DNA, 25 bp, Rattus norvegicus
aacagcactgtgaacaataccgtca

SEQ ID NO: 21692 - DNA, 25 bp, Rattus norvegicus
aacagcactgtgattgatcacctgt

SEQ ID NO: 21693 - DNA, 25 bp, Rattus norvegicus
aacagcactgtgtacaataccgtca

SEQ ID NO: 21694 - DNA, 25 bp, Rattus norvegicus
aacagcactgtgtttgatcacctgt

SEQ ID NO: 21695 - DNA, 25 bp, Rattus norvegicus
aacagcacttatacagcacagaggg

SEQ ID NO: 21696 - DNA, 25 bp, Rattus norvegicus
aacagcacttattcagcacagaggg

SEQ ID NO: 21697 - DNA, 25 bp, Rattus norvegicus
aacagcacttgcatatatctctccc

SEQ ID NO: 21698 - DNA, 25 bp, Rattus norvegicus
aacagcacttgcttatatctctccc

SEQ ID NO: 21699 - DNA, 25 bp, Rattus norvegicus
aacagcagaatcacggcttgactcc

SEQ ID NO: 21700 - DNA, 25 bp, Rattus norvegicus
aacagcagaatctcggcttgactcc

SEQ ID NO: 21701 - DNA, 25 bp, Rattus norvegicus
aacagcagactaaccctctgaagaa

SEQ ID NO: 21702 - DNA, 25 bp, Rattus norvegicus
aacagcagactatccctctgaagaa

SEQ ID NO: 21703 - DNA, 25 bp, Rattus norvegicus
aacagcagacttccaagtacacctc

SEQ ID NO: 21704 - DNA, 25 bp, Rattus norvegicus
aacagcagacttgcaagtacacctc

SEQ ID NO: 21705 - DNA, 25 bp, Rattus norvegicus
aacagcagcacacgctgacgtggtg

SEQ ID NO: 21706 - DNA, 25 bp, Rattus norvegicus
aacagcagcacaggctgacgtggtg

SEQ ID NO: 21707 - DNA, 25 bp, Rattus norvegicus
aacagcagcagcaccggcctcagtt

SEQ ID NO: 21708 - DNA, 25 bp, Rattus norvegicus
aacagcagcagctccggcctcagtt

SEQ ID NO: 21709 - DNA, 25 bp, Rattus norvegicus
aacagcagccgtaggttgtggccaa

SEQ ID NO: 21710 - DNA, 25 bp, Rattus norvegicus
aacagcagccgttggttgtggccaa

SEQ ID NO: 21711 - DNA, 25 bp, Rattus norvegicus
aacagcagcctgagtgccagaggaa

SEQ ID NO: 21712 - DNA, 25 bp, Rattus norvegicus
aacagcagcctgtgtgccagaggaa

SEQ ID NO: 21713 - DNA, 25 bp, Rattus norvegicus
aacagcagcggcaagcccaggagca

SEQ ID NO: 21714 - DNA, 25 bp, Rattus norvegicus
aacagcagcggctagcccaggagca

SEQ ID NO: 21715 - DNA, 25 bp, Rattus norvegicus
aacagcagcgtgctccatcgagagc

SEQ ID NO: 21716 - DNA, 25 bp, Rattus norvegicus
aacagcagcgtggtccatcgagagc

SEQ ID NO: 21717 - DNA, 25 bp, Rattus norvegicus
aacagcagcgttagttgcgggaaca

SEQ ID NO: 21718 - DNA, 25 bp, Rattus norvegicus
aacagcagcgtttgttgcgggaaca

SEQ ID NO: 21719 - DNA, 25 bp, Rattus norvegicus
aacagcagctttctgagttacagga

SEQ ID NO: 21720 - DNA, 25 bp, Rattus norvegicus
aacagcagctttgtgagttacagga

SEQ ID NO: 21721 - DNA, 25 bp, Rattus norvegicus
aacagcaggcatctcctgtggagat

SEQ ID NO: 21722 - DNA, 25 bp, Rattus norvegicus
aacagcaggcatgtcctgtggagat

SEQ ID NO: 21723 - DNA, 25 bp, Rattus norvegicus
aacagcaggcgccaccgatttggac

SEQ ID NO: 21724 - DNA, 25 bp, Rattus norvegicus
aacagcaggcgcgaccgatttggac

SEQ ID NO: 21725 - DNA, 25 bp, Rattus norvegicus
aacagcaggctgatcgtcacaggat

SEQ ID NO: 21726 - DNA, 25 bp, Rattus norvegicus
aacagcaggctgttcgtcacaggat

SEQ ID NO: 21727 - DNA, 25 bp, Rattus norvegicus
aacagcagtagtactccagaggagt

SEQ ID NO: 21728 - DNA, 25 bp, Rattus norvegicus
aacagcagtagttctccagaggagt

SEQ ID NO: 21729 - DNA, 25 bp, Rattus norvegicus
aacagcagtctcatgggtgtgatcc

SEQ ID NO: 21730 - DNA, 25 bp, Rattus norvegicus
aacagcagtctcttgggtgtgatcc

SEQ ID NO: 21731 - DNA, 25 bp, Rattus norvegicus
aacagcagtgacaaactctccatgg

SEQ ID NO: 21732 - DNA, 25 bp, Rattus norvegicus
aacagcagtgactaactctccatgg

SEQ ID NO: 21733 - DNA, 25 bp, Rattus norvegicus
aacagcagtgcaacaggaagttcgg

SEQ ID NO: 21734 - DNA, 25 bp, Rattus norvegicus
aacagcagtgcatcaggaagttcgg

SEQ ID NO: 21735 - DNA, 25 bp, Rattus norvegicus
aacagcagtgctataccagtgtaga

SEQ ID NO: 21736 - DNA, 25 bp, Rattus norvegicus
aacagcagtgctttaccagtgtaga

SEQ ID NO: 21737 - DNA, 25 bp, Rattus norvegicus
aacagcagtgttactctaagctctg

SEQ ID NO: 21738 - DNA, 25 bp, Rattus norvegicus
aacagcagtgttcccaaactgggtt

SEQ ID NO: 21739 - DNA, 25 bp, Rattus norvegicus
aacagcagtgttgccaaactgggtt

SEQ ID NO: 21740 - DNA, 25 bp, Rattus norvegicus
aacagcagtgtttctctaagctctg

SEQ ID NO: 21741 - DNA, 25 bp, Rattus norvegicus
aacagcagtttaattcccttcacag

SEQ ID NO: 21742 - DNA, 25 bp, Rattus norvegicus
aacagcagtttatttcccttcacag

SEQ ID NO: 21743 - DNA, 25 bp, Rattus norvegicus
aacagcagtttgagggcgtcatcaa

SEQ ID NO: 21744 - DNA, 25 bp, Rattus norvegicus
aacagcagtttgagtgcacgcgccg

SEQ ID NO: 21745 - DNA, 25 bp, Rattus norvegicus
aacagcagtttgtgggcgtcatcaa

SEQ ID NO: 21746 - DNA, 25 bp, Rattus norvegicus
aacagcagtttgtgtgcacgcgccg

SEQ ID NO: 21747 - DNA, 25 bp, Rattus norvegicus
aacagcatatcgctgcctcttaatg

SEQ ID NO: 21748 - DNA, 25 bp, Rattus norvegicus
aacagcatatcggtgcctcttaatg

SEQ ID NO: 21749 - DNA, 25 bp, Rattus norvegicus
aacagcatccagatcagcaggccgg

SEQ ID NO: 21750 - DNA, 25 bp, Rattus norvegicus
aacagcatccagttcagcaggccgg

SEQ ID NO: 21751 - DNA, 25 bp, Rattus norvegicus
aacagcatcccgcaagactggcagg

SEQ ID NO: 21752 - DNA, 25 bp, Rattus norvegicus
aacagcatcccggaagactggcagg

SEQ ID NO: 21753 - DNA, 25 bp, Rattus norvegicus
aacagcatctctacgaagccagtgg

SEQ ID NO: 21754 - DNA, 25 bp, Rattus norvegicus
aacagcatctcttcgaagccagtgg

SEQ ID NO: 21755 - DNA, 25 bp, Rattus norvegicus
aacagcatgctgactgccatttgtc

SEQ ID NO: 21756 - DNA, 25 bp, Rattus norvegicus
aacagcatgctgtctgccatttgtc

SEQ ID NO: 21757 - DNA, 25 bp, Rattus norvegicus
aacagcatgcttcattcaggaggat

SEQ ID NO: 21758 - DNA, 25 bp, Rattus norvegicus
aacagcatgcttgattcaggaggat

SEQ ID NO: 21759 - DNA, 25 bp, Rattus norvegicus
aacagcatggtacccagtcctatag

SEQ ID NO: 21760 - DNA, 25 bp, Rattus norvegicus
aacagcatggtagccagtcctatag

SEQ ID NO: 21761 - DNA, 25 bp, Rattus norvegicus
aacagcatggttctgtacggcagga

SEQ ID NO: 21762 - DNA, 25 bp, Rattus norvegicus
aacagcatggttgtgtacggcagga

SEQ ID NO: 21763 - DNA, 25 bp, Rattus norvegicus
aacagcattataccctatgaccaaa

SEQ ID NO: 21764 - DNA, 25 bp, Rattus norvegicus
aacagcattatagcctatgaccaaa

SEQ ID NO: 21765 - DNA, 25 bp, Rattus norvegicus
aacagcattatcactgatttccagt

SEQ ID NO: 21766 - DNA, 25 bp, Rattus norvegicus
aacagcattatctctgatttccagt

SEQ ID NO: 21767 - DNA, 25 bp, Rattus norvegicus
aacagcattcttagggtcagtggta

SEQ ID NO: 21768 - DNA, 25 bp, Rattus norvegicus
aacagcattctttgggtcagtggta

SEQ ID NO: 21769 - DNA, 25 bp, Rattus norvegicus
aacagcattggcacaagttcgagac

SEQ ID NO: 21770 - DNA, 25 bp, Rattus norvegicus
aacagcattggctcaagttcgagac

SEQ ID NO: 21771 - DNA, 25 bp, Rattus norvegicus
aacagccaaccacagtccagatttt

SEQ ID NO: 21772 - DNA, 25 bp, Rattus norvegicus
aacagccaaccagagtccagatttt

SEQ ID NO: 21773 - DNA, 25 bp, Rattus norvegicus
aacagccaagggaacggtggttatg

SEQ ID NO: 21774 - DNA, 25 bp, Rattus norvegicus
aacagccaagggtacggtggttatg

SEQ ID NO: 21775 - DNA, 25 bp, Rattus norvegicus
aacagccaatgaagtcgcaggtcct

SEQ ID NO: 21776 - DNA, 25 bp, Rattus norvegicus
aacagccaatgatgtcgcaggtcct

SEQ ID NO: 21777 - DNA, 25 bp, Rattus norvegicus
aacagccacacaacaccgagggaaa

SEQ ID NO: 21778 - DNA, 25 bp, Rattus norvegicus
aacagccacacatcaccgagggaaa

SEQ ID NO: 21779 - DNA, 25 bp, Rattus norvegicus
aacagccacatcacagagcacagca

SEQ ID NO: 21780 - DNA, 25 bp, Rattus norvegicus
aacagccacatctcagagcacagca

SEQ ID NO: 21781 - DNA, 25 bp, Rattus norvegicus
aacagccacgttagctacaggagca

SEQ ID NO: 21782 - DNA, 25 bp, Rattus norvegicus
aacagccacgtttgctacaggagca

SEQ ID NO: 21783 - DNA, 25 bp, Rattus norvegicus
aacagccagcaaaatatttcacaag

SEQ ID NO: 21784 - DNA, 25 bp, Rattus norvegicus
aacagccagcaacgtgagatcttaa

SEQ ID NO: 21785 - DNA, 25 bp, Rattus norvegicus
aacagccagcaaggtgagatcttaa

SEQ ID NO: 21786 - DNA, 25 bp, Rattus norvegicus
aacagccagcaatatatttcacaag

SEQ ID NO: 21787 - DNA, 25 bp, Rattus norvegicus
aacagccaggtgaagtgtgtagcct

SEQ ID NO: 21788 - DNA, 25 bp, Rattus norvegicus
aacagccaggtgtagtgtgtagcct

SEQ ID NO: 21789 - DNA, 25 bp, Rattus norvegicus
aacagccaggttagcctgacactga

SEQ ID NO: 21790 - DNA, 25 bp, Rattus norvegicus
aacagccaggtttgcctgacactga

SEQ ID NO: 21791 - DNA, 25 bp, Rattus norvegicus
aacagccatggccagggagacctgc

SEQ ID NO: 21792 - DNA, 25 bp, Rattus norvegicus
aacagccatggcgagggagacctgc

SEQ ID NO: 21793 - DNA, 25 bp, Rattus norvegicus
aacagccatgtaataactctcctcg

SEQ ID NO: 21794 - DNA, 25 bp, Rattus norvegicus
aacagccatgtattaactctcctcg

SEQ ID NO: 21795 - DNA, 25 bp, Rattus norvegicus
aacagccattctctggtttcaccca

SEQ ID NO: 21796 - DNA, 25 bp, Rattus norvegicus
aacagccattctgtggtttcaccca

SEQ ID NO: 21797 - DNA, 25 bp, Rattus norvegicus
aacagccattggctgcaaggagtca

SEQ ID NO: 21798 - DNA, 25 bp, Rattus norvegicus
aacagccattgggtgcaaggagtca

SEQ ID NO: 21799 - DNA, 25 bp, Rattus norvegicus
aacagcccaagaacagtttttgtat

SEQ ID NO: 21800 - DNA, 25 bp, Rattus norvegicus
aacagcccaagatcagtttttgtat

SEQ ID NO: 21801 - DNA, 25 bp, Rattus norvegicus
aacagcccaagtactattgctggga

SEQ ID NO: 21802 - DNA, 25 bp, Rattus norvegicus
aacagcccaagttctattgctggga

SEQ ID NO: 21803 - DNA, 25 bp, Rattus norvegicus
aacagcccaatccaaagagtccaat

SEQ ID NO: 21804 - DNA, 25 bp, Rattus norvegicus
aacagcccaatcgaaagagtccaat

SEQ ID NO: 21805 - DNA, 25 bp, Rattus norvegicus
aacagcccaggcctgcgtccggaaa

SEQ ID NO: 21806 - DNA, 25 bp, Rattus norvegicus
aacagcccaggcgtgcgtccggaaa

SEQ ID NO: 21807 - DNA, 25 bp, Rattus norvegicus
aacagcccctgaaaacctatgtaca

SEQ ID NO: 21808 - DNA, 25 bp, Rattus norvegicus
aacagcccctgataacctatgtaca

SEQ ID NO: 21809 - DNA, 25 bp, Rattus norvegicus
aacagcccgggaccagtttctggta

SEQ ID NO: 21810 - DNA, 25 bp, Rattus norvegicus
aacagcccgggagcagtttctggta

SEQ ID NO: 21811 - DNA, 25 bp, Rattus norvegicus
aacagccctacactgcgagagcgcg

SEQ ID NO: 21812 - DNA, 25 bp, Rattus norvegicus
aacagccctacagtgcgagagcgcg

SEQ ID NO: 21813 - DNA, 25 bp, Rattus norvegicus
aacagccctgatagcctgagcaagt

SEQ ID NO: 21814 - DNA, 25 bp, Rattus norvegicus
aacagccctgattgcctgagcaagt

SEQ ID NO: 21815 - DNA, 25 bp, Rattus norvegicus
aacagccctgtaattgtcagtgtca

SEQ ID NO: 21816 - DNA, 25 bp, Rattus norvegicus
aacagccctgtatttgtcagtgtca

SEQ ID NO: 21817 - DNA, 25 bp, Rattus norvegicus
aacagccctgttaggttttccacag

SEQ ID NO: 21818 - DNA, 25 bp, Rattus norvegicus
aacagccctgtttggttttccacag

SEQ ID NO: 21819 - DNA, 25 bp, Rattus norvegicus
aacagccctttgacagttcttttgg

SEQ ID NO: 21820 - DNA, 25 bp, Rattus norvegicus
aacagccctttgtcagttcttttgg

SEQ ID NO: 21821 - DNA, 25 bp, Rattus norvegicus
aacagccgaagccttcaccactgga

SEQ ID NO: 21822 - DNA, 25 bp, Rattus norvegicus
aacagccgaagcgttcaccactgga

SEQ ID NO: 21823 - DNA, 25 bp, Rattus norvegicus
aacagccggcgcacgttagtgtgac

SEQ ID NO: 21824 - DNA, 25 bp, Rattus norvegicus
aacagccggcgctcgttagtgtgac

SEQ ID NO: 21825 - DNA, 25 bp, Rattus norvegicus
aacagccgtggcactctgttggaga

SEQ ID NO: 21826 - DNA, 25 bp, Rattus norvegicus
aacagccgtggctctctgttggaga

SEQ ID NO: 21827 - DNA, 25 bp, Rattus norvegicus
aacagcctactaagaacagtgccat

SEQ ID NO: 21828 - DNA, 25 bp, Rattus norvegicus
aacagcctactatgaacagtgccat

SEQ ID NO: 21829 - DNA, 25 bp, Rattus norvegicus
aacagcctagatccattctctgcta

SEQ ID NO: 21830 - DNA, 25 bp, Rattus norvegicus
aacagcctagatgcattctctgcta

SEQ ID NO: 21831 - DNA, 25 bp, Rattus norvegicus
aacagcctatgaagtgataacacca

SEQ ID NO: 21832 - DNA, 25 bp, Rattus norvegicus
aacagcctatgatgtgataacacca

SEQ ID NO: 21833 - DNA, 25 bp, Rattus norvegicus
aacagcctatggacactggaagtat

SEQ ID NO: 21834 - DNA, 25 bp, Rattus norvegicus
aacagcctatggtcactggaagtat

SEQ ID NO: 21835 - DNA, 25 bp, Rattus norvegicus
aacagcctatgtcgtctatgaagac

SEQ ID NO: 21836 - DNA, 25 bp, Rattus norvegicus
aacagcctatgtggtctatgaagac

SEQ ID NO: 21837 - DNA, 25 bp, Rattus norvegicus
aacagcctcaggacagtgttaccct

SEQ ID NO: 21838 - DNA, 25 bp, Rattus norvegicus
aacagcctcaggtcagtgttaccct

SEQ ID NO: 21839 - DNA, 25 bp, Rattus norvegicus
aacagcctcgctacatgttgtagtg

SEQ ID NO: 21840 - DNA, 25 bp, Rattus norvegicus
aacagcctcgcttcatgttgtagtg

SEQ ID NO: 21841 - DNA, 25 bp, Rattus norvegicus
aacagcctcgttcaagacttaaaga

SEQ ID NO: 21842 - DNA, 25 bp, Rattus norvegicus
aacagcctcgttgaagacttaaaga

SEQ ID NO: 21843 - DNA, 25 bp, Rattus norvegicus
aacagcctctctattcttagacttc

SEQ ID NO: 21844 - DNA, 25 bp, Rattus norvegicus
aacagcctctcttttcttagacttc

SEQ ID NO: 21845 - DNA, 25 bp, Rattus norvegicus
aacagcctgcgtctggcgctttctg

SEQ ID NO: 21846 - DNA, 25 bp, Rattus norvegicus
aacagcctgcgtgtggcgctttctg

SEQ ID NO: 21847 - DNA, 25 bp, Rattus norvegicus
aacagcctgctgagaaccggatagg

SEQ ID NO: 21848 - DNA, 25 bp, Rattus norvegicus
aacagcctgctgtgaaccggatagg

SEQ ID NO: 21849 - DNA, 25 bp, Rattus norvegicus
aacagcctggagaacctcatttttt

SEQ ID NO: 21850 - DNA, 25 bp, Rattus norvegicus
aacagcctggagtacctcatttttt

SEQ ID NO: 21851 - DNA, 25 bp, Rattus norvegicus
aacagcctggatacactgtttcgtt

SEQ ID NO: 21852 - DNA, 25 bp, Rattus norvegicus
aacagcctggatcatgttcaaggtc

SEQ ID NO: 21853 - DNA, 25 bp, Rattus norvegicus
aacagcctggatgatgttcaaggtc

SEQ ID NO: 21854 - DNA, 25 bp, Rattus norvegicus
aacagcctggattcactgtttcgtt

SEQ ID NO: 21855 - DNA, 25 bp, Rattus norvegicus
aacagcctggctcgctacccaagaa

SEQ ID NO: 21856 - DNA, 25 bp, Rattus norvegicus
aacagcctggctggctacccaagaa

SEQ ID NO: 21857 - DNA, 25 bp, Rattus norvegicus
aacagcctgggaatagtgaacggaa

SEQ ID NO: 21858 - DNA, 25 bp, Rattus norvegicus
aacagcctgggattagtgaacggaa

SEQ ID NO: 21859 - DNA, 25 bp, Rattus norvegicus
aacagcctgtggatcgggtatgatg

SEQ ID NO: 21860 - DNA, 25 bp, Rattus norvegicus
aacagcctgtggttcgggtatgatg

SEQ ID NO: 21861 - DNA, 25 bp, Rattus norvegicus
aacagcctgttcctcgaatatgcaa

SEQ ID NO: 21862 - DNA, 25 bp, Rattus norvegicus
aacagcctgttcgtcgaatatgcaa

SEQ ID NO: 21863 - DNA, 25 bp, Rattus norvegicus
aacagccttaatacctaagctcagg

SEQ ID NO: 21864 - DNA, 25 bp, Rattus norvegicus
aacagccttaattcctaagctcagg

SEQ ID NO: 21865 - DNA, 25 bp, Rattus norvegicus
aacagccttaggcacacagaatgac

SEQ ID NO: 21866 - DNA, 25 bp, Rattus norvegicus
aacagccttagggacacagaatgac

SEQ ID NO: 21867 - DNA, 25 bp, Rattus norvegicus
aacagccttcgaagagtttttcaat

SEQ ID NO: 21868 - DNA, 25 bp, Rattus norvegicus
aacagccttcgatgagtttttcaat

SEQ ID NO: 21869 - DNA, 25 bp, Rattus norvegicus
aacagcctttatactggtccttctg

SEQ ID NO: 21870 - DNA, 25 bp, Rattus norvegicus
aacagcctttattctggtccttctg

SEQ ID NO: 21871 - DNA, 25 bp, Rattus norvegicus
aacagcctttgtactttgcttctta

SEQ ID NO: 21872 - DNA, 25 bp, Rattus norvegicus
aacagcctttgttctttgcttctta

SEQ ID NO: 21873 - DNA, 25 bp, Rattus norvegicus
aacagcgactaccaagacaccgatg

SEQ ID NO: 21874 - DNA, 25 bp, Rattus norvegicus
aacagcgactacgaagacaccgatg

SEQ ID NO: 21875 - DNA, 25 bp, Rattus norvegicus
aacagcgactccatggtgggttacg

SEQ ID NO: 21876 - DNA, 25 bp, Rattus norvegicus
aacagcgactccttggtgggttacg

SEQ ID NO: 21877 - DNA, 25 bp, Rattus norvegicus
aacagcgatcctagctcccctaatt

SEQ ID NO: 21878 - DNA, 25 bp, Rattus norvegicus
aacagcgatccttgctcccctaatt

SEQ ID NO: 21879 - DNA, 25 bp, Rattus norvegicus
aacagcgcaacgaggagacgcagca

SEQ ID NO: 21880 - DNA, 25 bp, Rattus norvegicus
aacagcgcaacgtggagacgcagca

SEQ ID NO: 21881 - DNA, 25 bp, Rattus norvegicus
aacagcgcaagaccatctgggtgga

SEQ ID NO: 21882 - DNA, 25 bp, Rattus norvegicus
aacagcgcaagagcatctgggtgga

SEQ ID NO: 21883 - DNA, 25 bp, Rattus norvegicus
aacagcgcagtcatgacaatggtct

SEQ ID NO: 21884 - DNA, 25 bp, Rattus norvegicus
aacagcgcagtcattcgggatgccg

SEQ ID NO: 21885 - DNA, 25 bp, Rattus norvegicus
aacagcgcagtcttgacaatggtct

SEQ ID NO: 21886 - DNA, 25 bp, Rattus norvegicus
aacagcgcagtctttcgggatgccg

SEQ ID NO: 21887 - DNA, 25 bp, Rattus norvegicus
aacagcgcccctcgtggacaggatg

SEQ ID NO: 21888 - DNA, 25 bp, Rattus norvegicus
aacagcgcccctggtggacaggatg

SEQ ID NO: 21889 - DNA, 25 bp, Rattus norvegicus
aacagcgctggtctgaacttctaag

SEQ ID NO: 21890 - DNA, 25 bp, Rattus norvegicus
aacagcgctggtgtgaacttctaag

SEQ ID NO: 21891 - DNA, 25 bp, Rattus norvegicus
aacagcgcttgcctaaccgagtctt

SEQ ID NO: 21892 - DNA, 25 bp, Rattus norvegicus
aacagcgcttgcgtaaccgagtctt

SEQ ID NO: 21893 - DNA, 25 bp, Rattus norvegicus
aacagcggagctaagaccttcggag

SEQ ID NO: 21894 - DNA, 25 bp, Rattus norvegicus
aacagcggagcttagaccttcggag

SEQ ID NO: 21895 - DNA, 25 bp, Rattus norvegicus
aacagcggcctgcactacatcaaag

SEQ ID NO: 21896 - DNA, 25 bp, Rattus norvegicus
aacagcggcctggactacatcaaag

SEQ ID NO: 21897 - DNA, 25 bp, Rattus norvegicus
aacagcgggccgaaggtgcatgcca

SEQ ID NO: 21898 - DNA, 25 bp, Rattus norvegicus
aacagcgggccgtaggtgcatgcca

SEQ ID NO: 21899 - DNA, 25 bp, Rattus norvegicus
aacagcggtggccagctcatagtaa

SEQ ID NO: 21900 - DNA, 25 bp, Rattus norvegicus
aacagcggtggcgagctcatagtaa

SEQ ID NO: 21901 - DNA, 25 bp, Rattus norvegicus
aacagcgtcctacatgcgcaagctt

SEQ ID NO: 21902 - DNA, 25 bp, Rattus norvegicus
aacagcgtcctagatgcgcaagctt

SEQ ID NO: 21903 - DNA, 25 bp, Rattus norvegicus
aacagcgtctcgataaattactcag

SEQ ID NO: 21904 - DNA, 25 bp, Rattus norvegicus
aacagcgtctcgttaaattactcag

SEQ ID NO: 21905 - DNA, 25 bp, Rattus norvegicus
aacagcgtgaggacatgcttacggg

SEQ ID NO: 21906 - DNA, 25 bp, Rattus norvegicus
aacagcgtgaggtcatgcttacggg

SEQ ID NO: 21907 - DNA, 25 bp, Rattus norvegicus
aacagcgtgctgaatttttggccct

SEQ ID NO: 21908 - DNA, 25 bp, Rattus norvegicus
aacagcgtgctgtatttttggccct

SEQ ID NO: 21909 - DNA, 25 bp, Rattus norvegicus
aacagcgtggccatatgagcatccc

SEQ ID NO: 21910 - DNA, 25 bp, Rattus norvegicus
aacagcgtggccttatgagcatccc

SEQ ID NO: 21911 - DNA, 25 bp, Rattus norvegicus
aacagcgtgtcaactttcatttgga

SEQ ID NO: 21912 - DNA, 25 bp, Rattus norvegicus
aacagcgtgtcatctttcatttgga

SEQ ID NO: 21913 - DNA, 25 bp, Rattus norvegicus
aacagcgttgtaaacttctcaaaga

SEQ ID NO: 21914 - DNA, 25 bp, Rattus norvegicus
aacagcgttgtatacttctcaaaga

SEQ ID NO: 21915 - DNA, 25 bp, Rattus norvegicus
aacagcgtttgcaattcttgcagag

SEQ ID NO: 21916 - DNA, 25 bp, Rattus norvegicus
aacagcgtttgctattcttgcagag

SEQ ID NO: 21917 - DNA, 25 bp, Rattus norvegicus
aacagctaagtcacctgagttcagt

SEQ ID NO: 21918 - DNA, 25 bp, Rattus norvegicus
aacagctaagtctcctgagttcagt

SEQ ID NO: 21919 - DNA, 25 bp, Rattus norvegicus
aacagctacataccgtcccagagag

SEQ ID NO: 21920 - DNA, 25 bp, Rattus norvegicus
aacagctacatagcgtcccagagag

SEQ ID NO: 21921 - DNA, 25 bp, Rattus norvegicus
aacagctaccatctcactcttcggt

SEQ ID NO: 21922 - DNA, 25 bp, Rattus norvegicus
aacagctaccatgtcactcttcggt

SEQ ID NO: 21923 - DNA, 25 bp, Rattus norvegicus
aacagctactgaattctacaatgga

SEQ ID NO: 21924 - DNA, 25 bp, Rattus norvegicus
aacagctactgatttctacaatgga

SEQ ID NO: 21925 - DNA, 25 bp, Rattus norvegicus
aacagctagaacaggcttacaggaa

SEQ ID NO: 21926 - DNA, 25 bp, Rattus norvegicus
aacagctagaactggcttacaggaa

SEQ ID NO: 21927 - DNA, 25 bp, Rattus norvegicus
aacagctagcgtcttttctttccct

SEQ ID NO: 21928 - DNA, 25 bp, Rattus norvegicus
aacagctagcgtgttttctttccct

SEQ ID NO: 21929 - DNA, 25 bp, Rattus norvegicus
aacagctaggcccagtgactcagga

SEQ ID NO: 21930 - DNA, 25 bp, Rattus norvegicus
aacagctaggccgagtgactcagga

SEQ ID NO: 21931 - DNA, 25 bp, Rattus norvegicus
aacagctagtcacagcgctaactca

SEQ ID NO: 21932 - DNA, 25 bp, Rattus norvegicus
aacagctagtcagagcgctaactca

SEQ ID NO: 21933 - DNA, 25 bp, Rattus norvegicus
aacagctagtgtcttctgactatat

SEQ ID NO: 21934 - DNA, 25 bp, Rattus norvegicus
aacagctagtgtgttctgactatat

SEQ ID NO: 21935 - DNA, 25 bp, Rattus norvegicus
aacagctagttactcccgggccgag

SEQ ID NO: 21936 - DNA, 25 bp, Rattus norvegicus
aacagctagttagtcccgggccgag

SEQ ID NO: 21937 - DNA, 25 bp, Rattus norvegicus
aacagctatcaaattagggttaatt

SEQ ID NO: 21938 - DNA, 25 bp, Rattus norvegicus
aacagctatcaatttagggttaatt

SEQ ID NO: 21939 - DNA, 25 bp, Rattus norvegicus
aacagctatcctccacacagaactg

SEQ ID NO: 21940 - DNA, 25 bp, Rattus norvegicus
aacagctatcctgcacacagaactg

SEQ ID NO: 21941 - DNA, 25 bp, Rattus norvegicus
aacagctatctcctggttgcacagt

SEQ ID NO: 21942 - DNA, 25 bp, Rattus norvegicus
aacagctatctcgtggttgcacagt

SEQ ID NO: 21943 - DNA, 25 bp, Rattus norvegicus
aacagctatggcaccagcgggtcat

SEQ ID NO: 21944 - DNA, 25 bp, Rattus norvegicus
aacagctatggctccagcgggtcat

SEQ ID NO: 21945 - DNA, 25 bp, Rattus norvegicus
aacagctcagagatgttttggagac

SEQ ID NO: 21946 - DNA, 25 bp, Rattus norvegicus
aacagctcagagttgttttggagac

SEQ ID NO: 21947 - DNA, 25 bp, Rattus norvegicus
aacagctcaggtattattgccgact

SEQ ID NO: 21948 - DNA, 25 bp, Rattus norvegicus
aacagctcaggttttattgccgact

SEQ ID NO: 21949 - DNA, 25 bp, Rattus norvegicus
aacagctcagtgcaatgggattctt

SEQ ID NO: 21950 - DNA, 25 bp, Rattus norvegicus
aacagctcagtggaatgggattctt

SEQ ID NO: 21951 - DNA, 25 bp, Rattus norvegicus
aacagctccgaaatgcgttgtggca

SEQ ID NO: 21952 - DNA, 25 bp, Rattus norvegicus
aacagctccgaattgcgttgtggca

SEQ ID NO: 21953 - DNA, 25 bp, Rattus norvegicus
aacagctccgacaggtttacaaaca

SEQ ID NO: 21954 - DNA, 25 bp, Rattus norvegicus
aacagctccgactggtttacaaaca

SEQ ID NO: 21955 - DNA, 25 bp, Rattus norvegicus
aacagctccgatagtgccgtttcta

SEQ ID NO: 21956 - DNA, 25 bp, Rattus norvegicus
aacagctccgattgtgccgtttcta

SEQ ID NO: 21957 - DNA, 25 bp, Rattus norvegicus
aacagctccgttattcgaatactcg

SEQ ID NO: 21958 - DNA, 25 bp, Rattus norvegicus
aacagctccgtttttcgaatactcg

SEQ ID NO: 21959 - DNA, 25 bp, Rattus norvegicus
aacagctcctggctattgtcaccgc

SEQ ID NO: 21960 - DNA, 25 bp, Rattus norvegicus
aacagctcctgggtattgtcaccgc

SEQ ID NO: 21961 - DNA, 25 bp, Rattus norvegicus
aacagctccttcatgcctttgtagt

SEQ ID NO: 21962 - DNA, 25 bp, Rattus norvegicus
aacagctccttcttgcctttgtagt

SEQ ID NO: 21963 - DNA, 25 bp, Rattus norvegicus
aacagctcgcagagggagtgtgctt

SEQ ID NO: 21964 - DNA, 25 bp, Rattus norvegicus
aacagctcgcagtgggagtgtgctt

SEQ ID NO: 21965 - DNA, 25 bp, Rattus norvegicus
aacagctcgtccctgtggaaggcgt

SEQ ID NO: 21966 - DNA, 25 bp, Rattus norvegicus
aacagctcgtccgtgtggaaggcgt

SEQ ID NO: 21967 - DNA, 25 bp, Rattus norvegicus
aacagctctcttattcactcttatt

SEQ ID NO: 21968 - DNA, 25 bp, Rattus norvegicus
aacagctctctttttcactcttatt

SEQ ID NO: 21969 - DNA, 25 bp, Rattus norvegicus
aacagctctgaaccctgtggccctg

SEQ ID NO: 21970 - DNA, 25 bp, Rattus norvegicus
aacagctctgaagcctgtggccctg

SEQ ID NO: 21971 - DNA, 25 bp, Rattus norvegicus
aacagctctgatcgtcacggtggct

SEQ ID NO: 21972 - DNA, 25 bp, Rattus norvegicus
aacagctctgatggtcacggtggct

SEQ ID NO: 21973 - DNA, 25 bp, Rattus norvegicus
aacagctctgctaactgctttcgta

SEQ ID NO: 21974 - DNA, 25 bp, Rattus norvegicus
aacagctctgctctgggcctgtttc

SEQ ID NO: 21975 - DNA, 25 bp, Rattus norvegicus
aacagctctgctgtgggcctgtttc

SEQ ID NO: 21976 - DNA, 25 bp, Rattus norvegicus
aacagctctgcttactgctttcgta

SEQ ID NO: 21977 - DNA, 25 bp, Rattus norvegicus
aacagctgaagaacttgcttggtca

SEQ ID NO: 21978 - DNA, 25 bp, Rattus norvegicus
aacagctgaagatcttgcttggtca

SEQ ID NO: 21979 - DNA, 25 bp, Rattus norvegicus
aacagctgagccctgaactggacac

SEQ ID NO: 21980 - DNA, 25 bp, Rattus norvegicus
aacagctgagccgtgaactggacac

SEQ ID NO: 21981 - DNA, 25 bp, Rattus norvegicus
aacagctgagttctgccagttacac

SEQ ID NO: 21982 - DNA, 25 bp, Rattus norvegicus
aacagctgagttgtgccagttacac

SEQ ID NO: 21983 - DNA, 25 bp, Rattus norvegicus
aacagctgatggatgatgaccttca

SEQ ID NO: 21984 - DNA, 25 bp, Rattus norvegicus
aacagctgatggttgatgaccttca

SEQ ID NO: 21985 - DNA, 25 bp, Rattus norvegicus
aacagctgcagaaatccatttccac

SEQ ID NO: 21986 - DNA, 25 bp, Rattus norvegicus
aacagctgcagatatccatttccac

SEQ ID NO: 21987 - DNA, 25 bp, Rattus norvegicus
aacagctgcaggctcctcaggagat

SEQ ID NO: 21988 - DNA, 25 bp, Rattus norvegicus
aacagctgcagggtcctcaggagat

SEQ ID NO: 21989 - DNA, 25 bp, Rattus norvegicus
aacagctgccaacagtgggatgcct

SEQ ID NO: 21990 - DNA, 25 bp, Rattus norvegicus
aacagctgccaagagtgggatgcct

SEQ ID NO: 21991 - DNA, 25 bp, Rattus norvegicus
aacagctgccatacctgccaaggta

SEQ ID NO: 21992 - DNA, 25 bp, Rattus norvegicus
aacagctgccattcctgccaaggta

SEQ ID NO: 21993 - DNA, 25 bp, Rattus norvegicus
aacagctgcccaaggtacacaggag

SEQ ID NO: 21994 - DNA, 25 bp, Rattus norvegicus
aacagctgcccatggtacacaggag

SEQ ID NO: 21995 - DNA, 25 bp, Rattus norvegicus
aacagctgccggagtctagtgagga

SEQ ID NO: 21996 - DNA, 25 bp, Rattus norvegicus
aacagctgccggtgtctagtgagga

SEQ ID NO: 21997 - DNA, 25 bp, Rattus norvegicus
aacagctgcctaccaggttttgtgc

SEQ ID NO: 21998 - DNA, 25 bp, Rattus norvegicus
aacagctgcctagcaggttttgtgc

SEQ ID NO: 21999 - DNA, 25 bp, Rattus norvegicus
aacagctgcctgacatcctcaagat

SEQ ID NO: 22000 - DNA, 25 bp, Rattus norvegicus
aacagctgcctgtcatcctcaagat

SEQ ID NO: 22001 - DNA, 25 bp, Rattus norvegicus
aacagctgccttagagttgcccatg

SEQ ID NO: 22002 - DNA, 25 bp, Rattus norvegicus
aacagctgcctttgagttgcccatg

SEQ ID NO: 22003 - DNA, 25 bp, Rattus norvegicus
aacagctgctacaaggaaccttcgg

SEQ ID NO: 22004 - DNA, 25 bp, Rattus norvegicus
aacagctgctactaggaaccttcgg

SEQ ID NO: 22005 - DNA, 25 bp, Rattus norvegicus
aacagctgctagagaagacttgcca

SEQ ID NO: 22006 - DNA, 25 bp, Rattus norvegicus
aacagctgctagtgaagacttgcca

SEQ ID NO: 22007 - DNA, 25 bp, Rattus norvegicus
aacagctgctgccattcggagaggt

SEQ ID NO: 22008 - DNA, 25 bp, Rattus norvegicus
aacagctgctgcgattcggagaggt

SEQ ID NO: 22009 - DNA, 25 bp, Rattus norvegicus
aacagctggaaactcctggagccta

SEQ ID NO: 22010 - DNA, 25 bp, Rattus norvegicus
aacagctggaaagtcctggagccta

SEQ ID NO: 22011 - DNA, 25 bp, Rattus norvegicus
aacagctggcgacttgtgacaacct

SEQ ID NO: 22012 - DNA, 25 bp, Rattus norvegicus
aacagctggcgagttgtgacaacct

SEQ ID NO: 22013 - DNA, 25 bp, Rattus norvegicus
aacagctgggtacattttgtcaatc

SEQ ID NO: 22014 - DNA, 25 bp, Rattus norvegicus
aacagctgggtagattttgtcaatc

SEQ ID NO: 22015 - DNA, 25 bp, Rattus norvegicus
aacagctgggtcatgactctaggac

SEQ ID NO: 22016 - DNA, 25 bp, Rattus norvegicus
aacagctgggtcttgactctaggac

SEQ ID NO: 22017 - DNA, 25 bp, Rattus norvegicus
aacagctggtgcctggctcacacaa

SEQ ID NO: 22018 - DNA, 25 bp, Rattus norvegicus
aacagctggtgcgtggctcacacaa

SEQ ID NO: 22019 - DNA, 25 bp, Rattus norvegicus
aacagctgtgtgctgacgcctgcga

SEQ ID NO: 22020 - DNA, 25 bp, Rattus norvegicus
aacagctgtgtggtgacgcctgcga

SEQ ID NO: 22021 - DNA, 25 bp, Rattus norvegicus
aacagctgtgttagccatagcttaa

SEQ ID NO: 22022 - DNA, 25 bp, Rattus norvegicus
aacagctgtgtttgccatagcttaa

SEQ ID NO: 22023 - DNA, 25 bp, Rattus norvegicus
aacagcttatccagtacactgcctt

SEQ ID NO: 22024 - DNA, 25 bp, Rattus norvegicus
aacagcttatcctgtacactgcctt

SEQ ID NO: 22025 - DNA, 25 bp, Rattus norvegicus
aacagcttcaacactacgagggaat

SEQ ID NO: 22026 - DNA, 25 bp, Rattus norvegicus
aacagcttcaactctacgagggaat

SEQ ID NO: 22027 - DNA, 25 bp, Rattus norvegicus
aacagcttcagaatcttcagcatca

SEQ ID NO: 22028 - DNA, 25 bp, Rattus norvegicus
aacagcttcagattcttcagcatca

SEQ ID NO: 22029 - DNA, 25 bp, Rattus norvegicus
aacagcttcgagaagcgtgcccgga

SEQ ID NO: 22030 - DNA, 25 bp, Rattus norvegicus
aacagcttcgagtagcgtgcccgga

SEQ ID NO: 22031 - DNA, 25 bp, Rattus norvegicus
aacagcttcgctagctagcttgcca

SEQ ID NO: 22032 - DNA, 25 bp, Rattus norvegicus
aacagcttcgcttgctagcttgcca

SEQ ID NO: 22033 - DNA, 25 bp, Rattus norvegicus
aacagcttcggcaacaatgagataa

SEQ ID NO: 22034 - DNA, 25 bp, Rattus norvegicus
aacagcttcggctacaatgagataa

SEQ ID NO: 22035 - DNA, 25 bp, Rattus norvegicus
aacagcttctcacggttttgtattg

SEQ ID NO: 22036 - DNA, 25 bp, Rattus norvegicus
aacagcttctcagggttttgtattg

SEQ ID NO: 22037 - DNA, 25 bp, Rattus norvegicus
aacagcttcttcagcacgaattggc

SEQ ID NO: 22038 - DNA, 25 bp, Rattus norvegicus
aacagcttcttctgcacgaattggc

SEQ ID NO: 22039 - DNA, 25 bp, Rattus norvegicus
aacagcttgctgagcttttgaacat

SEQ ID NO: 22040 - DNA, 25 bp, Rattus norvegicus
aacagcttgctgtgcttttgaacat

SEQ ID NO: 22041 - DNA, 25 bp, Rattus norvegicus
aacagcttgtgtcatgacttaacat

SEQ ID NO: 22042 - DNA, 25 bp, Rattus norvegicus
aacagcttgtgtgatgacttaacat

SEQ ID NO: 22043 - DNA, 25 bp, Rattus norvegicus
aacagctttaccaagaacgagttct

SEQ ID NO: 22044 - DNA, 25 bp, Rattus norvegicus
aacagctttacctagaacgagttct

SEQ ID NO: 22045 - DNA, 25 bp, Rattus norvegicus
aacagctttcaccaagtagcttggg

SEQ ID NO: 22046 - DNA, 25 bp, Rattus norvegicus
aacagctttcacgaagtagcttggg

SEQ ID NO: 22047 - DNA, 25 bp, Rattus norvegicus
aacagctttcatacactttggagat

SEQ ID NO: 22048 - DNA, 25 bp, Rattus norvegicus
aacagctttcatctgtattgtctta

SEQ ID NO: 22049 - DNA, 25 bp, Rattus norvegicus
aacagctttcatgtgtattgtctta

SEQ ID NO: 22050 - DNA, 25 bp, Rattus norvegicus
aacagctttcattcactttggagat

SEQ ID NO: 22051 - DNA, 25 bp, Rattus norvegicus
aacagctttgagacatttattccca

SEQ ID NO: 22052 - DNA, 25 bp, Rattus norvegicus
aacagctttgagtcatttattccca

SEQ ID NO: 22053 - DNA, 25 bp, Rattus norvegicus
aacagctttggcctcactgtggaga

SEQ ID NO: 22054 - DNA, 25 bp, Rattus norvegicus
aacagctttggcgtcactgtggaga

SEQ ID NO: 22055 - DNA, 25 bp, Rattus norvegicus
aacagctttgtgagggtcacgatta

SEQ ID NO: 22056 - DNA, 25 bp, Rattus norvegicus
aacagctttgtgtgggtcacgatta

SEQ ID NO: 22057 - DNA, 25 bp, Rattus norvegicus
aacagcttttacatctgtgggcgcc

SEQ ID NO: 22058 - DNA, 25 bp, Rattus norvegicus
aacagcttttacttctgtgggcgcc

SEQ ID NO: 22059 - DNA, 25 bp, Rattus norvegicus
aacagcttttctcgctagcaacaag

SEQ ID NO: 22060 - DNA, 25 bp, Rattus norvegicus
aacagcttttctggctagcaacaag

SEQ ID NO: 22061 - DNA, 25 bp, Rattus norvegicus
aacaggaaacccacaggcttggcat

SEQ ID NO: 22062 - DNA, 25 bp, Rattus norvegicus
aacaggaaaccctcaggcttggcat

SEQ ID NO: 22063 - DNA, 25 bp, Rattus norvegicus
aacaggaacacgctttgccagcaag

SEQ ID NO: 22064 - DNA, 25 bp, Rattus norvegicus
aacaggaacacggtttgccagcaag

SEQ ID NO: 22065 - DNA, 25 bp, Rattus norvegicus
aacaggaacctacattgcacttttg

SEQ ID NO: 22066 - DNA, 25 bp, Rattus norvegicus
aacaggaacctagattgcacttttg

SEQ ID NO: 22067 - DNA, 25 bp, Rattus norvegicus
aacaggaacgttatcagcagagagt

SEQ ID NO: 22068 - DNA, 25 bp, Rattus norvegicus
aacaggaacgttttcagcagagagt

SEQ ID NO: 22069 - DNA, 25 bp, Rattus norvegicus
aacaggaagacgctggcactgtccc

SEQ ID NO: 22070 - DNA, 25 bp, Rattus norvegicus
aacaggaagacggtggcactgtccc

SEQ ID NO: 22071 - DNA, 25 bp, Rattus norvegicus
aacaggaagcctagtcttgtgctgc

SEQ ID NO: 22072 - DNA, 25 bp, Rattus norvegicus
aacaggaagccttgtcttgtgctgc

SEQ ID NO: 22073 - DNA, 25 bp, Rattus norvegicus
aacaggaagcgtcgccatgtctttg

SEQ ID NO: 22074 - DNA, 25 bp, Rattus norvegicus
aacaggaagcgtggccatgtctttg

SEQ ID NO: 22075 - DNA, 25 bp, Rattus norvegicus
aacaggaagtacctgggccacacca

SEQ ID NO: 22076 - DNA, 25 bp, Rattus norvegicus
aacaggaagtacgtgggccacacca

SEQ ID NO: 22077 - DNA, 25 bp, Rattus norvegicus
aacaggaatttaaatgacaggtgat

SEQ ID NO: 22078 - DNA, 25 bp, Rattus norvegicus
aacaggaatttatatgacaggtgat

SEQ ID NO: 22079 - DNA, 25 bp, Rattus norvegicus
aacaggaatttcacagagctctctg

SEQ ID NO: 22080 - DNA, 25 bp, Rattus norvegicus
aacaggaatttctcagagctctctg

SEQ ID NO: 22081 - DNA, 25 bp, Rattus norvegicus
aacaggacagcgaggaggacttcct

SEQ ID NO: 22082 - DNA, 25 bp, Rattus norvegicus
aacaggacagcgtggaggacttcct

SEQ ID NO: 22083 - DNA, 25 bp, Rattus norvegicus
aacaggacagtcaattttgctcaga

SEQ ID NO: 22084 - DNA, 25 bp, Rattus norvegicus
aacaggacagtctattttgctcaga

SEQ ID NO: 22085 - DNA, 25 bp, Rattus norvegicus
aacaggaccctcaggattcgtcaaa

SEQ ID NO: 22086 - DNA, 25 bp, Rattus norvegicus
aacaggaccctctggattcgtcaaa

SEQ ID NO: 22087 - DNA, 25 bp, Rattus norvegicus
aacaggacgcagctcttgatgccct

SEQ ID NO: 22088 - DNA, 25 bp, Rattus norvegicus
aacaggacgcaggtcttgatgccct

SEQ ID NO: 22089 - DNA, 25 bp, Rattus norvegicus
aacaggactccacggtttgctgaga

SEQ ID NO: 22090 - DNA, 25 bp, Rattus norvegicus
aacaggactccagggtttgctgaga

SEQ ID NO: 22091 - DNA, 25 bp, Rattus norvegicus
aacaggactcctcaactgaggtgag

SEQ ID NO: 22092 - DNA, 25 bp, Rattus norvegicus
aacaggactcctgaactgaggtgag

SEQ ID NO: 22093 - DNA, 25 bp, Rattus norvegicus
aacaggactcggaggagtgcgctac

SEQ ID NO: 22094 - DNA, 25 bp, Rattus norvegicus
aacaggactcggtggagtgcgctac

SEQ ID NO: 22095 - DNA, 25 bp, Rattus norvegicus
aacaggactctcatacttcctataa

SEQ ID NO: 22096 - DNA, 25 bp, Rattus norvegicus
aacaggactctcttacttcctataa

SEQ ID NO: 22097 - DNA, 25 bp, Rattus norvegicus
aacaggactggaaggccttgctgcc

SEQ ID NO: 22098 - DNA, 25 bp, Rattus norvegicus
aacaggactggatggccttgctgcc

SEQ ID NO: 22099 - DNA, 25 bp, Rattus norvegicus
aacaggagacgccattgatcccggg

SEQ ID NO: 22100 - DNA, 25 bp, Rattus norvegicus
aacaggagacgcgattgatcccggg

SEQ ID NO: 22101 - DNA, 25 bp, Rattus norvegicus
aacaggagcaaacactccagggccc

SEQ ID NO: 22102 - DNA, 25 bp, Rattus norvegicus
aacaggagcaaagactccagggccc

SEQ ID NO: 22103 - DNA, 25 bp, Rattus norvegicus
aacaggagcaagaactcgacccgga

SEQ ID NO: 22104 - DNA, 25 bp, Rattus norvegicus
aacaggagcaagtactcgacccgga

SEQ ID NO: 22105 - DNA, 25 bp, Rattus norvegicus
aacaggagcagtaaagagactacaa

SEQ ID NO: 22106 - DNA, 25 bp, Rattus norvegicus
aacaggagcagttaagagactacaa

SEQ ID NO: 22107 - DNA, 25 bp, Rattus norvegicus
aacaggagcatccagttatgggaca

SEQ ID NO: 22108 - DNA, 25 bp, Rattus norvegicus
aacaggagcatcgagttatgggaca

SEQ ID NO: 22109 - DNA, 25 bp, Rattus norvegicus
aacaggagctagaatcacccggtgg

SEQ ID NO: 22110 - DNA, 25 bp, Rattus norvegicus
aacaggagctagtatcacccggtgg

SEQ ID NO: 22111 - DNA, 25 bp, Rattus norvegicus
aacaggagctcactgttccagaaca

SEQ ID NO: 22112 - DNA, 25 bp, Rattus norvegicus
aacaggagctcagtgttccagaaca

SEQ ID NO: 22113 - DNA, 25 bp, Rattus norvegicus
aacaggaggcagacaccggtgcttg

SEQ ID NO: 22114 - DNA, 25 bp, Rattus norvegicus
aacaggaggcagtcaccggtgcttg

SEQ ID NO: 22115 - DNA, 25 bp, Rattus norvegicus
aacaggagtcagcattaccacaaca

SEQ ID NO: 22116 - DNA, 25 bp, Rattus norvegicus
aacaggagtcaggattaccacaaca

SEQ ID NO: 22117 - DNA, 25 bp, Rattus norvegicus
aacaggatagttatggaccccaaag

SEQ ID NO: 22118 - DNA, 25 bp, Rattus norvegicus
aacaggatagttttggaccccaaag

SEQ ID NO: 22119 - DNA, 25 bp, Rattus norvegicus
aacaggatcaatccagacgacagga

SEQ ID NO: 22120 - DNA, 25 bp, Rattus norvegicus
aacaggatcaatgcagacgacagga

SEQ ID NO: 22121 - DNA, 25 bp, Rattus norvegicus
aacaggatcccactgtagagcttct

SEQ ID NO: 22122 - DNA, 25 bp, Rattus norvegicus
aacaggatcccagtgtagagcttct

SEQ ID NO: 22123 - DNA, 25 bp, Rattus norvegicus
aacaggatccttataagctatatat

SEQ ID NO: 22124 - DNA, 25 bp, Rattus norvegicus
aacaggatccttttaagctatatat

SEQ ID NO: 22125 - DNA, 25 bp, Rattus norvegicus
aacaggatctcacctggagcgcagc

SEQ ID NO: 22126 - DNA, 25 bp, Rattus norvegicus
aacaggatctcagctggagcgcagc

SEQ ID NO: 22127 - DNA, 25 bp, Rattus norvegicus
aacaggatgccgatgactgcgccac

SEQ ID NO: 22128 - DNA, 25 bp, Rattus norvegicus
aacaggatgccgttgactgcgccac

SEQ ID NO: 22129 - DNA, 25 bp, Rattus norvegicus
aacaggatgggacgctctactcctt

SEQ ID NO: 22130 - DNA, 25 bp, Rattus norvegicus
aacaggatgggaggctctactcctt

SEQ ID NO: 22131 - DNA, 25 bp, Rattus norvegicus
aacaggattcataggaactgccact

SEQ ID NO: 22132 - DNA, 25 bp, Rattus norvegicus
aacaggattcattggaactgccact

SEQ ID NO: 22133 - DNA, 25 bp, Rattus norvegicus
aacaggattggccttaactgagcta

SEQ ID NO: 22134 - DNA, 25 bp, Rattus norvegicus
aacaggattggcgttaactgagcta

SEQ ID NO: 22135 - DNA, 25 bp, Rattus norvegicus
aacaggattggtctggcttctgctg

SEQ ID NO: 22136 - DNA, 25 bp, Rattus norvegicus
aacaggattggtgtggcttctgctg

SEQ ID NO: 22137 - DNA, 25 bp, Rattus norvegicus
aacaggcactgactgcttttggact

SEQ ID NO: 22138 - DNA, 25 bp, Rattus norvegicus
aacaggcactgagtgcttttggact

SEQ ID NO: 22139 - DNA, 25 bp, Rattus norvegicus
aacaggcagaccatgatcctggaaa

SEQ ID NO: 22140 - DNA, 25 bp, Rattus norvegicus
aacaggcagaccatttacttcaggg

SEQ ID NO: 22141 - DNA, 25 bp, Rattus norvegicus
aacaggcagaccttgatcctggaaa

SEQ ID NO: 22142 - DNA, 25 bp, Rattus norvegicus
aacaggcagaccttttacttcaggg

SEQ ID NO: 22143 - DNA, 25 bp, Rattus norvegicus
aacaggcagagaaagggaaccctct

SEQ ID NO: 22144 - DNA, 25 bp, Rattus norvegicus
aacaggcagagatagggaaccctct

SEQ ID NO: 22145 - DNA, 25 bp, Rattus norvegicus
aacaggcagcagagtattcttagga

SEQ ID NO: 22146 - DNA, 25 bp, Rattus norvegicus
aacaggcagcagtgtattcttagga

SEQ ID NO: 22147 - DNA, 25 bp, Rattus norvegicus
aacaggcagcctatatttagacttg

SEQ ID NO: 22148 - DNA, 25 bp, Rattus norvegicus
aacaggcagcctttatttagacttg

SEQ ID NO: 22149 - DNA, 25 bp, Rattus norvegicus
aacaggcaggctattgcaaggcaga

SEQ ID NO: 22150 - DNA, 25 bp, Rattus norvegicus
aacaggcaggcttttgcaaggcaga

SEQ ID NO: 22151 - DNA, 25 bp, Rattus norvegicus
aacaggccaaacagccttgtaggta

SEQ ID NO: 22152 - DNA, 25 bp, Rattus norvegicus
aacaggccaaactgccttgtaggta

SEQ ID NO: 22153 - DNA, 25 bp, Rattus norvegicus
aacaggccaaagatgtctctcgcat

SEQ ID NO: 22154 - DNA, 25 bp, Rattus norvegicus
aacaggccaaagttgtctctcgcat

SEQ ID NO: 22155 - DNA, 25 bp, Rattus norvegicus
aacaggccaatgcaatttaactatg

SEQ ID NO: 22156 - DNA, 25 bp, Rattus norvegicus
aacaggccaatggaatttaactatg

SEQ ID NO: 22157 - DNA, 25 bp, Rattus norvegicus
aacaggccaccactcatttgagagc

SEQ ID NO: 22158 - DNA, 25 bp, Rattus norvegicus
aacaggccaccagtcatttgagagc

SEQ ID NO: 22159 - DNA, 25 bp, Rattus norvegicus
aacaggccactcaatctaagcagtc

SEQ ID NO: 22160 - DNA, 25 bp, Rattus norvegicus
aacaggccactctatctaagcagtc

SEQ ID NO: 22161 - DNA, 25 bp, Rattus norvegicus
aacaggccactgatcatcttgggca

SEQ ID NO: 22162 - DNA, 25 bp, Rattus norvegicus
aacaggccactgttcatcttgggca

SEQ ID NO: 22163 - DNA, 25 bp, Rattus norvegicus
aacaggccagaactctatctctaga

SEQ ID NO: 22164 - DNA, 25 bp, Rattus norvegicus
aacaggccagaagtctatctctaga

SEQ ID NO: 22165 - DNA, 25 bp, Rattus norvegicus
aacaggccagggacaagttgaacaa

SEQ ID NO: 22166 - DNA, 25 bp, Rattus norvegicus
aacaggccagggtcaagttgaacaa

SEQ ID NO: 22167 - DNA, 25 bp, Rattus norvegicus
aacaggccatgtatggacttcgctt

SEQ ID NO: 22168 - DNA, 25 bp, Rattus norvegicus
aacaggccatgtttggacttcgctt

SEQ ID NO: 22169 - DNA, 25 bp, Rattus norvegicus
aacaggcccattccaagaaagagtt

SEQ ID NO: 22170 - DNA, 25 bp, Rattus norvegicus
aacaggcccattgcaagaaagagtt

SEQ ID NO: 22171 - DNA, 25 bp, Rattus norvegicus
aacaggccgctccagagactcagga

SEQ ID NO: 22172 - DNA, 25 bp, Rattus norvegicus
aacaggccgctcgagagactcagga

SEQ ID NO: 22173 - DNA, 25 bp, Rattus norvegicus
aacaggccgtaaaggtatcccagag

SEQ ID NO: 22174 - DNA, 25 bp, Rattus norvegicus
aacaggccgtaatggtatcccagag

SEQ ID NO: 22175 - DNA, 25 bp, Rattus norvegicus
aacaggcctggacgattgagctccg

SEQ ID NO: 22176 - DNA, 25 bp, Rattus norvegicus
aacaggcctggaggattgagctccg

SEQ ID NO: 22177 - DNA, 25 bp, Rattus norvegicus
aacaggcctggcatctacactcggg

SEQ ID NO: 22178 - DNA, 25 bp, Rattus norvegicus
aacaggcctggcttctacactcggg

SEQ ID NO: 22179 - DNA, 25 bp, Rattus norvegicus
aacaggccttacagcatctctggat

SEQ ID NO: 22180 - DNA, 25 bp, Rattus norvegicus
aacaggccttactgcatctctggat

SEQ ID NO: 22181 - DNA, 25 bp, Rattus norvegicus
aacaggcggtgtactctacggctct

SEQ ID NO: 22182 - DNA, 25 bp, Rattus norvegicus
aacaggcggtgttctctacggctct

SEQ ID NO: 22183 - DNA, 25 bp, Rattus norvegicus
aacaggctaaggcaagcttctcacc

SEQ ID NO: 22184 - DNA, 25 bp, Rattus norvegicus
aacaggctaagggaagcttctcacc

SEQ ID NO: 22185 - DNA, 25 bp, Rattus norvegicus
aacaggctacacctggcactatctg

SEQ ID NO: 22186 - DNA, 25 bp, Rattus norvegicus
aacaggctacacgtggcactatctg

SEQ ID NO: 22187 - DNA, 25 bp, Rattus norvegicus
aacaggctaggaatccgcacaactt

SEQ ID NO: 22188 - DNA, 25 bp, Rattus norvegicus
aacaggctaggattccgcacaactt

SEQ ID NO: 22189 - DNA, 25 bp, Rattus norvegicus
aacaggctagttacatccagttagt

SEQ ID NO: 22190 - DNA, 25 bp, Rattus norvegicus
aacaggctagtttcatccagttagt

SEQ ID NO: 22191 - DNA, 25 bp, Rattus norvegicus
aacaggctcaggctcaaagcactat

SEQ ID NO: 22192 - DNA, 25 bp, Rattus norvegicus
aacaggctcagggtcaaagcactat

SEQ ID NO: 22193 - DNA, 25 bp, Rattus norvegicus
aacaggctctatctgttggtgccca

SEQ ID NO: 22194 - DNA, 25 bp, Rattus norvegicus
aacaggctctatgtgttggtgccca

SEQ ID NO: 22195 - DNA, 25 bp, Rattus norvegicus
aacaggctgacaagcctcaagtatt

SEQ ID NO: 22196 - DNA, 25 bp, Rattus norvegicus
aacaggctgacatgcctcaagtatt

SEQ ID NO: 22197 - DNA, 25 bp, Rattus norvegicus
aacaggctgcctcgaggttcatcag

SEQ ID NO: 22198 - DNA, 25 bp, Rattus norvegicus
aacaggctgcctggaggttcatcag

SEQ ID NO: 22199 - DNA, 25 bp, Rattus norvegicus
aacaggctggccactgatctataat

SEQ ID NO: 22200 - DNA, 25 bp, Rattus norvegicus
aacaggctggcctctgatctataat

SEQ ID NO: 22201 - DNA, 25 bp, Rattus norvegicus
aacaggctggttaactctggtacaa

SEQ ID NO: 22202 - DNA, 25 bp, Rattus norvegicus
aacaggctggtttactctggtacaa

SEQ ID NO: 22203 - DNA, 25 bp, Rattus norvegicus
aacaggctgtgcagaccctggagat

SEQ ID NO: 22204 - DNA, 25 bp, Rattus norvegicus
aacaggctgtgctgaccctggagat

SEQ ID NO: 22205 - DNA, 25 bp, Rattus norvegicus
aacaggctgttgatcaagcccctgg

SEQ ID NO: 22206 - DNA, 25 bp, Rattus norvegicus
aacaggctgttgttcaagcccctgg

SEQ ID NO: 22207 - DNA, 25 bp, Rattus norvegicus
aacaggcttagcagtgcttcacagt

SEQ ID NO: 22208 - DNA, 25 bp, Rattus norvegicus
aacaggcttagcagtttcccaggct

SEQ ID NO: 22209 - DNA, 25 bp, Rattus norvegicus
aacaggcttagctgtgcttcacagt

SEQ ID NO: 22210 - DNA, 25 bp, Rattus norvegicus
aacaggcttagctgtttcccaggct

SEQ ID NO: 22211 - DNA, 25 bp, Rattus norvegicus
aacaggcttccaatgctcttcaaat

SEQ ID NO: 22212 - DNA, 25 bp, Rattus norvegicus
aacaggcttccattgctcttcaaat

SEQ ID NO: 22213 - DNA, 25 bp, Rattus norvegicus
aacaggcttgctcgaaatgttgtcc

SEQ ID NO: 22214 - DNA, 25 bp, Rattus norvegicus
aacaggcttgctggaaatgttgtcc

SEQ ID NO: 22215 - DNA, 25 bp, Rattus norvegicus
aacaggcttggcagtgagcactcct

SEQ ID NO: 22216 - DNA, 25 bp, Rattus norvegicus
aacaggcttggctgtgagcactcct

SEQ ID NO: 22217 - DNA, 25 bp, Rattus norvegicus
aacaggctttgtacagctacccgtt

SEQ ID NO: 22218 - DNA, 25 bp, Rattus norvegicus
aacaggctttgttcagctacccgtt

SEQ ID NO: 22219 - DNA, 25 bp, Rattus norvegicus
aacaggcttttaagtactcccacat

SEQ ID NO: 22220 - DNA, 25 bp, Rattus norvegicus
aacaggcttttatgtactcccacat

SEQ ID NO: 22221 - DNA, 25 bp, Rattus norvegicus
aacagggaagtccatgtccacaaca

SEQ ID NO: 22222 - DNA, 25 bp, Rattus norvegicus
aacagggaagtcgatgtccacaaca

SEQ ID NO: 22223 - DNA, 25 bp, Rattus norvegicus
aacagggacccaagttgatgcccaa

SEQ ID NO: 22224 - DNA, 25 bp, Rattus norvegicus
aacagggacccatgttgatgcccaa

SEQ ID NO: 22225 - DNA, 25 bp, Rattus norvegicus
aacagggcagcaagcctctgaggga

SEQ ID NO: 22226 - DNA, 25 bp, Rattus norvegicus
aacagggcagcaccacagatcacca

SEQ ID NO: 22227 - DNA, 25 bp, Rattus norvegicus
aacagggcagcagcacagatcacca

SEQ ID NO: 22228 - DNA, 25 bp, Rattus norvegicus
aacagggcagcatgcctctgaggga

SEQ ID NO: 22229 - DNA, 25 bp, Rattus norvegicus
aacagggcctggcattggtcacaac

SEQ ID NO: 22230 - DNA, 25 bp, Rattus norvegicus
aacagggcctgggattggtcacaac

SEQ ID NO: 22231 - DNA, 25 bp, Rattus norvegicus
aacagggcgtttccttatgcattct

SEQ ID NO: 22232 - DNA, 25 bp, Rattus norvegicus
aacagggcgtttgcttatgcattct

SEQ ID NO: 22233 - DNA, 25 bp, Rattus norvegicus
aacagggctaagaaactactagaca

SEQ ID NO: 22234 - DNA, 25 bp, Rattus norvegicus
aacagggctaagtaactactagaca

SEQ ID NO: 22235 - DNA, 25 bp, Rattus norvegicus
aacagggctcctcagctttatggtg

SEQ ID NO: 22236 - DNA, 25 bp, Rattus norvegicus
aacagggctcctccgtacaggtcaa

SEQ ID NO: 22237 - DNA, 25 bp, Rattus norvegicus
aacagggctcctcttgatctgtgtt

SEQ ID NO: 22238 - DNA, 25 bp, Rattus norvegicus
aacagggctcctgagctttatggtg

SEQ ID NO: 22239 - DNA, 25 bp, Rattus norvegicus
aacagggctcctgcgtacaggtcaa

SEQ ID NO: 22240 - DNA, 25 bp, Rattus norvegicus
aacagggctcctgttgatctgtgtt

SEQ ID NO: 22241 - DNA, 25 bp, Rattus norvegicus
aacagggctgctattagggactaca

SEQ ID NO: 22242 - DNA, 25 bp, Rattus norvegicus
aacagggctgcttttagggactaca

SEQ ID NO: 22243 - DNA, 25 bp, Rattus norvegicus
aacagggcttcactgtgttcacatc

SEQ ID NO: 22244 - DNA, 25 bp, Rattus norvegicus
aacagggcttcagtgtgttcacatc

SEQ ID NO: 22245 - DNA, 25 bp, Rattus norvegicus
aacagggcttgacccacatctggca

SEQ ID NO: 22246 - DNA, 25 bp, Rattus norvegicus
aacagggcttgagccacatctggca

SEQ ID NO: 22247 - DNA, 25 bp, Rattus norvegicus
aacagggtaaaaatctctcggagat

SEQ ID NO: 22248 - DNA, 25 bp, Rattus norvegicus
aacagggtaaaattctctcggagat

SEQ ID NO: 22249 - DNA, 25 bp, Rattus norvegicus
aacagggtcagcactgccagaggta

SEQ ID NO: 22250 - DNA, 25 bp, Rattus norvegicus
aacagggtcagctctgccagaggta

SEQ ID NO: 22251 - DNA, 25 bp, Rattus norvegicus
aacagggtctggagcctaagactgc

SEQ ID NO: 22252 - DNA, 25 bp, Rattus norvegicus
aacagggtctggtgcctaagactgc

SEQ ID NO: 22253 - DNA, 25 bp, Rattus norvegicus
aacagggtcttcctgtatagttcag

SEQ ID NO: 22254 - DNA, 25 bp, Rattus norvegicus
aacagggtcttcgtgtatagttcag

SEQ ID NO: 22255 - DNA, 25 bp, Rattus norvegicus
aacagggtgcccactgttttggcta

SEQ ID NO: 22256 - DNA, 25 bp, Rattus norvegicus
aacagggtgccctctgttttggcta

SEQ ID NO: 22257 - DNA, 25 bp, Rattus norvegicus
aacagggtgtcaatccgtatcccag

SEQ ID NO: 22258 - DNA, 25 bp, Rattus norvegicus
aacagggtgtcattccgtatcccag

SEQ ID NO: 22259 - DNA, 25 bp, Rattus norvegicus
aacagggtttcaagatccagccaaa

SEQ ID NO: 22260 - DNA, 25 bp, Rattus norvegicus
aacagggtttcatgatccagccaaa

SEQ ID NO: 22261 - DNA, 25 bp, Rattus norvegicus
aacaggtaacaaatgagtgggcagc

SEQ ID NO: 22262 - DNA, 25 bp, Rattus norvegicus
aacaggtaacaattgagtgggcagc

SEQ ID NO: 22263 - DNA, 25 bp, Rattus norvegicus
aacaggtaacttcgagcccagctct

SEQ ID NO: 22264 - DNA, 25 bp, Rattus norvegicus
aacaggtaacttggagcccagctct

SEQ ID NO: 22265 - DNA, 25 bp, Rattus norvegicus
aacaggtaattcatgtcatctccat

SEQ ID NO: 22266 - DNA, 25 bp, Rattus norvegicus
aacaggtaattcttgtcatctccat

SEQ ID NO: 22267 - DNA, 25 bp, Rattus norvegicus
aacaggtacagaccactgcatacgt

SEQ ID NO: 22268 - DNA, 25 bp, Rattus norvegicus
aacaggtacagagcactgcatacgt

SEQ ID NO: 22269 - DNA, 25 bp, Rattus norvegicus
aacaggtaccttaaactctcacttg

SEQ ID NO: 22270 - DNA, 25 bp, Rattus norvegicus
aacaggtacctttaactctcacttg

SEQ ID NO: 22271 - DNA, 25 bp, Rattus norvegicus
aacaggtagcacagacccttgggcg

SEQ ID NO: 22272 - DNA, 25 bp, Rattus norvegicus
aacaggtagcactgacccttgggcg

SEQ ID NO: 22273 - DNA, 25 bp, Rattus norvegicus
aacaggtcaacaataaggcccagaa

SEQ ID NO: 22274 - DNA, 25 bp, Rattus norvegicus
aacaggtcaacattaaggcccagaa

SEQ ID NO: 22275 - DNA, 25 bp, Rattus norvegicus
aacaggtcacacacggctagtctta

SEQ ID NO: 22276 - DNA, 25 bp, Rattus norvegicus
aacaggtcacactcggctagtctta

SEQ ID NO: 22277 - DNA, 25 bp, Rattus norvegicus
aacaggtcactgctatggtggctga

SEQ ID NO: 22278 - DNA, 25 bp, Rattus norvegicus
aacaggtcactggtatggtggctga

SEQ ID NO: 22279 - DNA, 25 bp, Rattus norvegicus
aacaggtcaggcattgcttaccatc

SEQ ID NO: 22280 - DNA, 25 bp, Rattus norvegicus
aacaggtcaggctttgcttaccatc

SEQ ID NO: 22281 - DNA, 25 bp, Rattus norvegicus
aacaggtccaccacgaaattcttgg

SEQ ID NO: 22282 - DNA, 25 bp, Rattus norvegicus
aacaggtccacctcgaaattcttgg

SEQ ID NO: 22283 - DNA, 25 bp, Rattus norvegicus
aacaggtccatgactgggtccaggt

SEQ ID NO: 22284 - DNA, 25 bp, Rattus norvegicus
aacaggtccatgtctgggtccaggt

SEQ ID NO: 22285 - DNA, 25 bp, Rattus norvegicus
aacaggtcctgcatggttcatttga

SEQ ID NO: 22286 - DNA, 25 bp, Rattus norvegicus
aacaggtcctgcttggttcatttga

SEQ ID NO: 22287 - DNA, 25 bp, Rattus norvegicus
aacaggtccttgcacagctacctga

SEQ ID NO: 22288 - DNA, 25 bp, Rattus norvegicus
aacaggtccttggacagctacctga

SEQ ID NO: 22289 - DNA, 25 bp, Rattus norvegicus
aacaggtgacgtaaagtgacccaca

SEQ ID NO: 22290 - DNA, 25 bp, Rattus norvegicus
aacaggtgacgttaagtgacccaca

SEQ ID NO: 22291 - DNA, 25 bp, Rattus norvegicus
aacaggtgagctctttgggacctct

SEQ ID NO: 22292 - DNA, 25 bp, Rattus norvegicus
aacaggtgagctgtttgggacctct

SEQ ID NO: 22293 - DNA, 25 bp, Rattus norvegicus
aacaggtgagttcaccagccagcca

SEQ ID NO: 22294 - DNA, 25 bp, Rattus norvegicus
aacaggtgagttgaccagccagcca

SEQ ID NO: 22295 - DNA, 25 bp, Rattus norvegicus
aacaggtgcctaactttgacaaaaa

SEQ ID NO: 22296 - DNA, 25 bp, Rattus norvegicus
aacaggtgcctatctttgacaaaaa

SEQ ID NO: 22297 - DNA, 25 bp, Rattus norvegicus
aacaggtggatcaacccaaggagac

SEQ ID NO: 22298 - DNA, 25 bp, Rattus norvegicus
aacaggtggatctacccaaggagac

SEQ ID NO: 22299 - DNA, 25 bp, Rattus norvegicus
aacaggtggctgacacaactcccag

SEQ ID NO: 22300 - DNA, 25 bp, Rattus norvegicus
aacaggtggctgtcacaactcccag

SEQ ID NO: 22301 - DNA, 25 bp, Rattus norvegicus
aacaggtgtcatctcatggtgtcaa

SEQ ID NO: 22302 - DNA, 25 bp, Rattus norvegicus
aacaggtgtcatgtcatggtgtcaa

SEQ ID NO: 22303 - DNA, 25 bp, Rattus norvegicus
aacaggttacaactgagctcccctc

SEQ ID NO: 22304 - DNA, 25 bp, Rattus norvegicus
aacaggttacaagtgagctcccctc

SEQ ID NO: 22305 - DNA, 25 bp, Rattus norvegicus
aacaggttccccatgaggcacctct

SEQ ID NO: 22306 - DNA, 25 bp, Rattus norvegicus
aacaggttccccttgaggcacctct

SEQ ID NO: 22307 - DNA, 25 bp, Rattus norvegicus
aacaggttccgtcagatgaccgacc

SEQ ID NO: 22308 - DNA, 25 bp, Rattus norvegicus
aacaggttccgtgagatgaccgacc

SEQ ID NO: 22309 - DNA, 25 bp, Rattus norvegicus
aacaggttgaagctcagcctctctt

SEQ ID NO: 22310 - DNA, 25 bp, Rattus norvegicus
aacaggttgaaggtcagcctctctt

SEQ ID NO: 22311 - DNA, 25 bp, Rattus norvegicus
aacaggttgcctaggcattgtcatt

SEQ ID NO: 22312 - DNA, 25 bp, Rattus norvegicus
aacaggttgccttggcattgtcatt

SEQ ID NO: 22313 - DNA, 25 bp, Rattus norvegicus
aacaggttggaactccagcccgcgt

SEQ ID NO: 22314 - DNA, 25 bp, Rattus norvegicus
aacaggttggaagtccagcccgcgt

SEQ ID NO: 22315 - DNA, 25 bp, Rattus norvegicus
aacaggttgttcactacacacgtag

SEQ ID NO: 22316 - DNA, 25 bp, Rattus norvegicus
aacaggttgttctctacacacgtag

SEQ ID NO: 22317 - DNA, 25 bp, Rattus norvegicus
aacaggtttcttaactattcagccg

SEQ ID NO: 22318 - DNA, 25 bp, Rattus norvegicus
aacaggtttctttactattcagccg

SEQ ID NO: 22319 - DNA, 25 bp, Rattus norvegicus
aacagtaaagcaatggccacctcca

SEQ ID NO: 22320 - DNA, 25 bp, Rattus norvegicus
aacagtaaagcattggccacctcca

SEQ ID NO: 22321 - DNA, 25 bp, Rattus norvegicus
aacagtaacaacagctcacagattt

SEQ ID NO: 22322 - DNA, 25 bp, Rattus norvegicus
aacagtaacaactgctcacagattt

SEQ ID NO: 22323 - DNA, 25 bp, Rattus norvegicus
aacagtaactgccatttcgtgtccg

SEQ ID NO: 22324 - DNA, 25 bp, Rattus norvegicus
aacagtaactgcgatttcgtgtccg

SEQ ID NO: 22325 - DNA, 25 bp, Rattus norvegicus
aacagtaagcttaaccctcttgtat

SEQ ID NO: 22326 - DNA, 25 bp, Rattus norvegicus
aacagtaagctttaccctcttgtat

SEQ ID NO: 22327 - DNA, 25 bp, Rattus norvegicus
aacagtacaaagagccttccttcca

SEQ ID NO: 22328 - DNA, 25 bp, Rattus norvegicus
aacagtacaaagtgccttccttcca

SEQ ID NO: 22329 - DNA, 25 bp, Rattus norvegicus
aacagtacaatcaacggccggtggg

SEQ ID NO: 22330 - DNA, 25 bp, Rattus norvegicus
aacagtacaatctacggccggtggg

SEQ ID NO: 22331 - DNA, 25 bp, Rattus norvegicus
aacagtacacttcttaagctcttat

SEQ ID NO: 22332 - DNA, 25 bp, Rattus norvegicus
aacagtacacttgttaagctcttat

SEQ ID NO: 22333 - DNA, 25 bp, Rattus norvegicus
aacagtacagatagtgacgcccgga

SEQ ID NO: 22334 - DNA, 25 bp, Rattus norvegicus
aacagtacagattgtgacgcccgga

SEQ ID NO: 22335 - DNA, 25 bp, Rattus norvegicus
aacagtacatacaggacacatccca

SEQ ID NO: 22336 - DNA, 25 bp, Rattus norvegicus
aacagtacatactggacacatccca

SEQ ID NO: 22337 - DNA, 25 bp, Rattus norvegicus
aacagtacatagctgcaatgttgta

SEQ ID NO: 22338 - DNA, 25 bp, Rattus norvegicus
aacagtacataggtgcaatgttgta

SEQ ID NO: 22339 - DNA, 25 bp, Rattus norvegicus
aacagtaccacacaacagcttgtct

SEQ ID NO: 22340 - DNA, 25 bp, Rattus norvegicus
aacagtaccacagaacagcttgtct

SEQ ID NO: 22341 - DNA, 25 bp, Rattus norvegicus
aacagtaccagtcagaattctccat

SEQ ID NO: 22342 - DNA, 25 bp, Rattus norvegicus
aacagtaccagtgagaattctccat

SEQ ID NO: 22343 - DNA, 25 bp, Rattus norvegicus
aacagtacctggatgctttgcttca

SEQ ID NO: 22344 - DNA, 25 bp, Rattus norvegicus
aacagtacctggttgctttgcttca

SEQ ID NO: 22345 - DNA, 25 bp, Rattus norvegicus
aacagtacctgtccaatcttttgta

SEQ ID NO: 22346 - DNA, 25 bp, Rattus norvegicus
aacagtacctgtgcaatcttttgta

SEQ ID NO: 22347 - DNA, 25 bp, Rattus norvegicus
aacagtactctgagatgctgtccct

SEQ ID NO: 22348 - DNA, 25 bp, Rattus norvegicus
aacagtactctgtgatgctgtccct

SEQ ID NO: 22349 - DNA, 25 bp, Rattus norvegicus
aacagtactgtacacaagttcttct

SEQ ID NO: 22350 - DNA, 25 bp, Rattus norvegicus
aacagtactgtagacaagttcttct

SEQ ID NO: 22351 - DNA, 25 bp, Rattus norvegicus
aacagtactgtgcttagtgccctta

SEQ ID NO: 22352 - DNA, 25 bp, Rattus norvegicus
aacagtactgtggttagtgccctta

SEQ ID NO: 22353 - DNA, 25 bp, Rattus norvegicus
aacagtagatcactgctgccctgac

SEQ ID NO: 22354 - DNA, 25 bp, Rattus norvegicus
aacagtagatcagtgctgccctgac

SEQ ID NO: 22355 - DNA, 25 bp, Rattus norvegicus
aacagtagcctgacttttccttttg

SEQ ID NO: 22356 - DNA, 25 bp, Rattus norvegicus
aacagtagcctgtcttttccttttg

SEQ ID NO: 22357 - DNA, 25 bp, Rattus norvegicus
aacagtagcgctatggacgggctct

SEQ ID NO: 22358 - DNA, 25 bp, Rattus norvegicus
aacagtagcgctttggacgggctct

SEQ ID NO: 22359 - DNA, 25 bp, Rattus norvegicus
aacagtagcgtgagggtggaaccct

SEQ ID NO: 22360 - DNA, 25 bp, Rattus norvegicus
aacagtagcgtgtgggtggaaccct

SEQ ID NO: 22361 - DNA, 25 bp, Rattus norvegicus
aacagtagctcacctgtagacctga

SEQ ID NO: 22362 - DNA, 25 bp, Rattus norvegicus
aacagtagctcagctgtagacctga

SEQ ID NO: 22363 - DNA, 25 bp, Rattus norvegicus
aacagtaggaccctattgctatgat

SEQ ID NO: 22364 - DNA, 25 bp, Rattus norvegicus
aacagtaggaccgtattgctatgat

SEQ ID NO: 22365 - DNA, 25 bp, Rattus norvegicus
aacagtaggaggatcctcgggcctg

SEQ ID NO: 22366 - DNA, 25 bp, Rattus norvegicus
aacagtaggaggttcctcgggcctg

SEQ ID NO: 22367 - DNA, 25 bp, Rattus norvegicus
aacagtagtcagcagccatgcttgt

SEQ ID NO: 22368 - DNA, 25 bp, Rattus norvegicus
aacagtagtcaggagccatgcttgt

SEQ ID NO: 22369 - DNA, 25 bp, Rattus norvegicus
aacagtagttgcactcgtgccgaat

SEQ ID NO: 22370 - DNA, 25 bp, Rattus norvegicus
aacagtagttgctctcgtgccgaat

SEQ ID NO: 22371 - DNA, 25 bp, Rattus norvegicus
aacagtagttggatgcttggcacat

SEQ ID NO: 22372 - DNA, 25 bp, Rattus norvegicus
aacagtagttggttgcttggcacat

SEQ ID NO: 22373 - DNA, 25 bp, Rattus norvegicus
aacagtatagctctgctggctttga

SEQ ID NO: 22374 - DNA, 25 bp, Rattus norvegicus
aacagtatagctgtgctggctttga

SEQ ID NO: 22375 - DNA, 25 bp, Rattus norvegicus
aacagtatattgactctgcccagga

SEQ ID NO: 22376 - DNA, 25 bp, Rattus norvegicus
aacagtatattgtctctgcccagga

SEQ ID NO: 22377 - DNA, 25 bp, Rattus norvegicus
aacagtatcgctccttcgaactggc

SEQ ID NO: 22378 - DNA, 25 bp, Rattus norvegicus
aacagtatcgctgcttcgaactggc

SEQ ID NO: 22379 - DNA, 25 bp, Rattus norvegicus
aacagtatcggccagctctggctca

SEQ ID NO: 22380 - DNA, 25 bp, Rattus norvegicus
aacagtatcggcgagctctggctca

SEQ ID NO: 22381 - DNA, 25 bp, Rattus norvegicus
aacagtatctgcaatccatcgagga

SEQ ID NO: 22382 - DNA, 25 bp, Rattus norvegicus
aacagtatctgctatccatcgagga

SEQ ID NO: 22383 - DNA, 25 bp, Rattus norvegicus
aacagtatgcgcaggtcttggctca

SEQ ID NO: 22384 - DNA, 25 bp, Rattus norvegicus
aacagtatgcgctggtcttggctca

SEQ ID NO: 22385 - DNA, 25 bp, Rattus norvegicus
aacagtatgttgctagctgaggcta

SEQ ID NO: 22386 - DNA, 25 bp, Rattus norvegicus
aacagtatgttggtagctgaggcta

SEQ ID NO: 22387 - DNA, 25 bp, Rattus norvegicus
aacagtattactagctccataccct

SEQ ID NO: 22388 - DNA, 25 bp, Rattus norvegicus
aacagtattacttgctccataccct

SEQ ID NO: 22389 - DNA, 25 bp, Rattus norvegicus
aacagtattccactcccaaagtagc

SEQ ID NO: 22390 - DNA, 25 bp, Rattus norvegicus
aacagtattccagtcccaaagtagc

SEQ ID NO: 22391 - DNA, 25 bp, Rattus norvegicus
aacagtattgttagcaacacttcag

SEQ ID NO: 22392 - DNA, 25 bp, Rattus norvegicus
aacagtattgtttgcaacacttcag

SEQ ID NO: 22393 - DNA, 25 bp, Rattus norvegicus
aacagtatttcccatcttttgcctg

SEQ ID NO: 22394 - DNA, 25 bp, Rattus norvegicus
aacagtatttccgatcttttgcctg

SEQ ID NO: 22395 - DNA, 25 bp, Rattus norvegicus
aacagtattttaagggttgcagtac

SEQ ID NO: 22396 - DNA, 25 bp, Rattus norvegicus
aacagtattttatgggttgcagtac

SEQ ID NO: 22397 - DNA, 25 bp, Rattus norvegicus
aacagtcaagttaccagtctcacag

SEQ ID NO: 22398 - DNA, 25 bp, Rattus norvegicus
aacagtcaagtttccagtctcacag

SEQ ID NO: 22399 - DNA, 25 bp, Rattus norvegicus
aacagtcaatggagtctggaggagc

SEQ ID NO: 22400 - DNA, 25 bp, Rattus norvegicus
aacagtcaatggtgtctggaggagc

SEQ ID NO: 22401 - DNA, 25 bp, Rattus norvegicus
aacagtcaccagaccagcactgcag

SEQ ID NO: 22402 - DNA, 25 bp, Rattus norvegicus
aacagtcaccagtccagcactgcag

SEQ ID NO: 22403 - DNA, 25 bp, Rattus norvegicus
aacagtcacctgattcctagtacct

SEQ ID NO: 22404 - DNA, 25 bp, Rattus norvegicus
aacagtcacctgcttcctagggcag

SEQ ID NO: 22405 - DNA, 25 bp, Rattus norvegicus
aacagtcacctggttcctagggcag

SEQ ID NO: 22406 - DNA, 25 bp, Rattus norvegicus
aacagtcacctgtttcctagtacct

SEQ ID NO: 22407 - DNA, 25 bp, Rattus norvegicus
aacagtcactgtaatgtactaggaa

SEQ ID NO: 22408 - DNA, 25 bp, Rattus norvegicus
aacagtcactgttatgtactaggaa

SEQ ID NO: 22409 - DNA, 25 bp, Rattus norvegicus
aacagtcagctgatctacatggagc

SEQ ID NO: 22410 - DNA, 25 bp, Rattus norvegicus
aacagtcagctgttctacatggagc

SEQ ID NO: 22411 - DNA, 25 bp, Rattus norvegicus
aacagtcagcttatcctagaaggtc

SEQ ID NO: 22412 - DNA, 25 bp, Rattus norvegicus
aacagtcagcttttcctagaaggtc

SEQ ID NO: 22413 - DNA, 25 bp, Rattus norvegicus
aacagtcaggctccaaagtcctttt

SEQ ID NO: 22414 - DNA, 25 bp, Rattus norvegicus
aacagtcaggctgcaaagtcctttt

SEQ ID NO: 22415 - DNA, 25 bp, Rattus norvegicus
aacagtcaggttaacagctctttgg

SEQ ID NO: 22416 - DNA, 25 bp, Rattus norvegicus
aacagtcaggtttacagctctttgg

SEQ ID NO: 22417 - DNA, 25 bp, Rattus norvegicus
aacagtcatctgcatcatttttcta

SEQ ID NO: 22418 - DNA, 25 bp, Rattus norvegicus
aacagtcatctggatcatttttcta

SEQ ID NO: 22419 - DNA, 25 bp, Rattus norvegicus
aacagtcattgcatcatattgtgct

SEQ ID NO: 22420 - DNA, 25 bp, Rattus norvegicus
aacagtcattgcttcatattgtgct

SEQ ID NO: 22421 - DNA, 25 bp, Rattus norvegicus
aacagtccacagagcactctgaggg

SEQ ID NO: 22422 - DNA, 25 bp, Rattus norvegicus
aacagtccacagtgcactctgaggg

SEQ ID NO: 22423 - DNA, 25 bp, Rattus norvegicus
aacagtccactgaacggctagaatg

SEQ ID NO: 22424 - DNA, 25 bp, Rattus norvegicus
aacagtccactgtacggctagaatg

SEQ ID NO: 22425 - DNA, 25 bp, Rattus norvegicus
aacagtccagagcagcttcagctga

SEQ ID NO: 22426 - DNA, 25 bp, Rattus norvegicus
aacagtccagaggagcttcagctga

SEQ ID NO: 22427 - DNA, 25 bp, Rattus norvegicus
aacagtccatctctgacatgctctg

SEQ ID NO: 22428 - DNA, 25 bp, Rattus norvegicus
aacagtccatctgtgacatgctctg

SEQ ID NO: 22429 - DNA, 25 bp, Rattus norvegicus
aacagtccattcacttgggcggagt

SEQ ID NO: 22430 - DNA, 25 bp, Rattus norvegicus
aacagtccattctcttgggcggagt

SEQ ID NO: 22431 - DNA, 25 bp, Rattus norvegicus
aacagtcccaaaagtgttggtcatc

SEQ ID NO: 22432 - DNA, 25 bp, Rattus norvegicus
aacagtcccaaatgtgttggtcatc

SEQ ID NO: 22433 - DNA, 25 bp, Rattus norvegicus
aacagtccctatcgctctgcaggag

SEQ ID NO: 22434 - DNA, 25 bp, Rattus norvegicus
aacagtccctatggctctgcaggag

SEQ ID NO: 22435 - DNA, 25 bp, Rattus norvegicus
aacagtccctgcatgaatggttttt

SEQ ID NO: 22436 - DNA, 25 bp, Rattus norvegicus
aacagtccctgcttgaatggttttt

SEQ ID NO: 22437 - DNA, 25 bp, Rattus norvegicus
aacagtcccttcagttgcagtagct

SEQ ID NO: 22438 - DNA, 25 bp, Rattus norvegicus
aacagtcccttctgttgcagtagct

SEQ ID NO: 22439 - DNA, 25 bp, Rattus norvegicus
aacagtcctcataagatcagcctag

SEQ ID NO: 22440 - DNA, 25 bp, Rattus norvegicus
aacagtcctcattagatcagcctag

SEQ ID NO: 22441 - DNA, 25 bp, Rattus norvegicus
aacagtcctctgcatctgaagacag

SEQ ID NO: 22442 - DNA, 25 bp, Rattus norvegicus
aacagtcctctggatctgaagacag

SEQ ID NO: 22443 - DNA, 25 bp, Rattus norvegicus
aacagtcctgtccatgtttgcatgt

SEQ ID NO: 22444 - DNA, 25 bp, Rattus norvegicus
aacagtcctgtcgatgtttgcatgt

SEQ ID NO: 22445 - DNA, 25 bp, Rattus norvegicus
aacagtcctgttccacagcaggtct

SEQ ID NO: 22446 - DNA, 25 bp, Rattus norvegicus
aacagtcctgttgcacagcaggtct

SEQ ID NO: 22447 - DNA, 25 bp, Rattus norvegicus
aacagtccttgtattcagaatccct

SEQ ID NO: 22448 - DNA, 25 bp, Rattus norvegicus
aacagtccttgtcaaagttcacgcc

SEQ ID NO: 22449 - DNA, 25 bp, Rattus norvegicus
aacagtccttgtgaaagttcacgcc

SEQ ID NO: 22450 - DNA, 25 bp, Rattus norvegicus
aacagtccttgttttcagaatccct

SEQ ID NO: 22451 - DNA, 25 bp, Rattus norvegicus
aacagtcgagttctacagcagcatt

SEQ ID NO: 22452 - DNA, 25 bp, Rattus norvegicus
aacagtcgagttgtacagcagcatt

SEQ ID NO: 22453 - DNA, 25 bp, Rattus norvegicus
aacagtcgcggtctatctcgaggag

SEQ ID NO: 22454 - DNA, 25 bp, Rattus norvegicus
aacagtcgcggtgtatctcgaggag

SEQ ID NO: 22455 - DNA, 25 bp, Rattus norvegicus
aacagtcgctgaacggcgtgcatta

SEQ ID NO: 22456 - DNA, 25 bp, Rattus norvegicus
aacagtcgctgatcggcgtgcatta

SEQ ID NO: 22457 - DNA, 25 bp, Rattus norvegicus
aacagtcgcttgcaagagaagacca

SEQ ID NO: 22458 - DNA, 25 bp, Rattus norvegicus
aacagtcgcttggaagagaagacca

SEQ ID NO: 22459 - DNA, 25 bp, Rattus norvegicus
aacagtcgtggtatcctgtcgtgga

SEQ ID NO: 22460 - DNA, 25 bp, Rattus norvegicus
aacagtcgtggtttcctgtcgtgga

SEQ ID NO: 22461 - DNA, 25 bp, Rattus norvegicus
aacagtcgtgtgctcaacagtcgtt

SEQ ID NO: 22462 - DNA, 25 bp, Rattus norvegicus
aacagtcgtgtggtcaacagtcgtt

SEQ ID NO: 22463 - DNA, 25 bp, Rattus norvegicus
aacagtcgtgttccttaatgcagct

SEQ ID NO: 22464 - DNA, 25 bp, Rattus norvegicus
aacagtcgtgttgcttaatgcagct

SEQ ID NO: 22465 - DNA, 25 bp, Rattus norvegicus
aacagtctaacacgaaagtatctta

SEQ ID NO: 22466 - DNA, 25 bp, Rattus norvegicus
aacagtctaacaggaaagtatctta

SEQ ID NO: 22467 - DNA, 25 bp, Rattus norvegicus
aacagtctaatccatagtctactaa

SEQ ID NO: 22468 - DNA, 25 bp, Rattus norvegicus
aacagtctaatcgatagtctactaa

SEQ ID NO: 22469 - DNA, 25 bp, Rattus norvegicus
aacagtctccagaggtctgagctgt

SEQ ID NO: 22470 - DNA, 25 bp, Rattus norvegicus
aacagtctccagtggtctgagctgt

SEQ ID NO: 22471 - DNA, 25 bp, Rattus norvegicus
aacagtctcctaagtgtggatagca

SEQ ID NO: 22472 - DNA, 25 bp, Rattus norvegicus
aacagtctcctatgtgtggatagca

SEQ ID NO: 22473 - DNA, 25 bp, Rattus norvegicus
aacagtctcctgaagtctgattggt

SEQ ID NO: 22474 - DNA, 25 bp, Rattus norvegicus
aacagtctcctgtagtctgattggt

SEQ ID NO: 22475 - DNA, 25 bp, Rattus norvegicus
aacagtctctggcttctggaagaat

SEQ ID NO: 22476 - DNA, 25 bp, Rattus norvegicus
aacagtctctgggttctggaagaat

SEQ ID NO: 22477 - DNA, 25 bp, Rattus norvegicus
aacagtctgatccagtttatgcacc

SEQ ID NO: 22478 - DNA, 25 bp, Rattus norvegicus
aacagtctgatcgagtttatgcacc

SEQ ID NO: 22479 - DNA, 25 bp, Rattus norvegicus
aacagtctgcagaccaggcctgagg

SEQ ID NO: 22480 - DNA, 25 bp, Rattus norvegicus
aacagtctgcagtccaggcctgagg

SEQ ID NO: 22481 - DNA, 25 bp, Rattus norvegicus
aacagtctgcatagtgacgatcaca

SEQ ID NO: 22482 - DNA, 25 bp, Rattus norvegicus
aacagtctgcattgtgacgatcaca

SEQ ID NO: 22483 - DNA, 25 bp, Rattus norvegicus
aacagtctgctaagaggtcctgggt

SEQ ID NO: 22484 - DNA, 25 bp, Rattus norvegicus
aacagtctgctatgaggtcctgggt

SEQ ID NO: 22485 - DNA, 25 bp, Rattus norvegicus
aacagtctgctcaaggaaaccaagt

SEQ ID NO: 22486 - DNA, 25 bp, Rattus norvegicus
aacagtctgctctaggaaaccaagt

SEQ ID NO: 22487 - DNA, 25 bp, Rattus norvegicus
aacagtctggtcacatgactttaca

SEQ ID NO: 22488 - DNA, 25 bp, Rattus norvegicus
aacagtctggtctcatgactttaca

SEQ ID NO: 22489 - DNA, 25 bp, Rattus norvegicus
aacagtctgtagactgctggcgaga

SEQ ID NO: 22490 - DNA, 25 bp, Rattus norvegicus
aacagtctgtagtctgctggcgaga

SEQ ID NO: 22491 - DNA, 25 bp, Rattus norvegicus
aacagtctgtcaacagttctgtcaa

SEQ ID NO: 22492 - DNA, 25 bp, Rattus norvegicus
aacagtctgtcatcagttctgtcaa

SEQ ID NO: 22493 - DNA, 25 bp, Rattus norvegicus
aacagtctgtgactcgtcccagagg

SEQ ID NO: 22494 - DNA, 25 bp, Rattus norvegicus
aacagtctgtgagtcgtcccagagg

SEQ ID NO: 22495 - DNA, 25 bp, Rattus norvegicus
aacagtcttcccaataagcacctag

SEQ ID NO: 22496 - DNA, 25 bp, Rattus norvegicus
aacagtcttccctataagcacctag

SEQ ID NO: 22497 - DNA, 25 bp, Rattus norvegicus
aacagtcttctgcacattcctagag

SEQ ID NO: 22498 - DNA, 25 bp, Rattus norvegicus
aacagtcttctggacattcctagag

SEQ ID NO: 22499 - DNA, 25 bp, Rattus norvegicus
aacagtctttgactttgctcccaga

SEQ ID NO: 22500 - DNA, 25 bp, Rattus norvegicus
aacagtctttgagtttgctcccaga

SEQ ID NO: 22501 - DNA, 25 bp, Rattus norvegicus
aacagtgaacctcagcgtctcaaga

SEQ ID NO: 22502 - DNA, 25 bp, Rattus norvegicus
aacagtgaacctgagcgtctcaaga

SEQ ID NO: 22503 - DNA, 25 bp, Rattus norvegicus
aacagtgaactaaacttatgaagta

SEQ ID NO: 22504 - DNA, 25 bp, Rattus norvegicus
aacagtgaactatacttatgaagta

SEQ ID NO: 22505 - DNA, 25 bp, Rattus norvegicus
aacagtgaagtcacggtccagccca

SEQ ID NO: 22506 - DNA, 25 bp, Rattus norvegicus
aacagtgaagtctcggtccagccca

SEQ ID NO: 22507 - DNA, 25 bp, Rattus norvegicus
aacagtgacaaaaccgccgcttggg

SEQ ID NO: 22508 - DNA, 25 bp, Rattus norvegicus
aacagtgacaaatccgccgcttggg

SEQ ID NO: 22509 - DNA, 25 bp, Rattus norvegicus
aacagtgacactaaggatttggaca

SEQ ID NO: 22510 - DNA, 25 bp, Rattus norvegicus
aacagtgacacttaggatttggaca

SEQ ID NO: 22511 - DNA, 25 bp, Rattus norvegicus
aacagtgaccacagctgcggcgacg

SEQ ID NO: 22512 - DNA, 25 bp, Rattus norvegicus
aacagtgaccactgctgcggcgacg

SEQ ID NO: 22513 - DNA, 25 bp, Rattus norvegicus
aacagtgagcaactccaccaggcaa

SEQ ID NO: 22514 - DNA, 25 bp, Rattus norvegicus
aacagtgagcaagtccaccaggcaa

SEQ ID NO: 22515 - DNA, 25 bp, Rattus norvegicus
aacagtgagcctccatgtcatgtaa

SEQ ID NO: 22516 - DNA, 25 bp, Rattus norvegicus
aacagtgagcctgcatgtcatgtaa

SEQ ID NO: 22517 - DNA, 25 bp, Rattus norvegicus
aacagtgaggcaagcagggctgctt

SEQ ID NO: 22518 - DNA, 25 bp, Rattus norvegicus
aacagtgaggcatgcagggctgctt

SEQ ID NO: 22519 - DNA, 25 bp, Rattus norvegicus
aacagtgaggtcacatccacacggc

SEQ ID NO: 22520 - DNA, 25 bp, Rattus norvegicus
aacagtgaggtctcatccacacggc

SEQ ID NO: 22521 - DNA, 25 bp, Rattus norvegicus
aacagtgagtggagtcttagatcaa

SEQ ID NO: 22522 - DNA, 25 bp, Rattus norvegicus
aacagtgagtggtgtcttagatcaa

SEQ ID NO: 22523 - DNA, 25 bp, Rattus norvegicus
aacagtgatattacctattttggtg

SEQ ID NO: 22524 - DNA, 25 bp, Rattus norvegicus
aacagtgatatttcctattttggtg

SEQ ID NO: 22525 - DNA, 25 bp, Rattus norvegicus
aacagtgatcttcgcttgttctgag

SEQ ID NO: 22526 - DNA, 25 bp, Rattus norvegicus
aacagtgatcttctttgttcctttt

SEQ ID NO: 22527 - DNA, 25 bp, Rattus norvegicus
aacagtgatcttggcttgttctgag

SEQ ID NO: 22528 - DNA, 25 bp, Rattus norvegicus
aacagtgatcttgtttgttcctttt

SEQ ID NO: 22529 - DNA, 25 bp, Rattus norvegicus
aacagtgatgcaattggtggccaga

SEQ ID NO: 22530 - DNA, 25 bp, Rattus norvegicus
aacagtgatgcatttggtggccaga

SEQ ID NO: 22531 - DNA, 25 bp, Rattus norvegicus
aacagtgatgtgaacacctctgaca

SEQ ID NO: 22532 - DNA, 25 bp, Rattus norvegicus
aacagtgatgtgtacacctctgaca

SEQ ID NO: 22533 - DNA, 25 bp, Rattus norvegicus
aacagtgattctcactcgacagctt

SEQ ID NO: 22534 - DNA, 25 bp, Rattus norvegicus
aacagtgattctcatgacccctgct

SEQ ID NO: 22535 - DNA, 25 bp, Rattus norvegicus
aacagtgattctgactcgacagctt

SEQ ID NO: 22536 - DNA, 25 bp, Rattus norvegicus
aacagtgattctgatgacccctgct

SEQ ID NO: 22537 - DNA, 25 bp, Rattus norvegicus
aacagtgcacaaacgcctagcaatc

SEQ ID NO: 22538 - DNA, 25 bp, Rattus norvegicus
aacagtgcacaatcgcctagcaatc

SEQ ID NO: 22539 - DNA, 25 bp, Rattus norvegicus
aacagtgcacgtaggagaccataat

SEQ ID NO: 22540 - DNA, 25 bp, Rattus norvegicus
aacagtgcacgttggagaccataat

SEQ ID NO: 22541 - DNA, 25 bp, Rattus norvegicus
aacagtgcactcatcgtcagttagc

SEQ ID NO: 22542 - DNA, 25 bp, Rattus norvegicus
aacagtgcactcttcgtcagttagc

SEQ ID NO: 22543 - DNA, 25 bp, Rattus norvegicus
aacagtgcagtcagtgttgagggca

SEQ ID NO: 22544 - DNA, 25 bp, Rattus norvegicus
aacagtgcagtctgtgttgagggca

SEQ ID NO: 22545 - DNA, 25 bp, Rattus norvegicus
aacagtgccatcaagctactataaa

SEQ ID NO: 22546 - DNA, 25 bp, Rattus norvegicus
aacagtgccatctagctactataaa

SEQ ID NO: 22547 - DNA, 25 bp, Rattus norvegicus
aacagtgcctctctctttgagcgac

SEQ ID NO: 22548 - DNA, 25 bp, Rattus norvegicus
aacagtgcctctgtctttgagcgac

SEQ ID NO: 22549 - DNA, 25 bp, Rattus norvegicus
aacagtgctaacagtgcgctctcga

SEQ ID NO: 22550 - DNA, 25 bp, Rattus norvegicus
aacagtgctaactgtgcgctctcga

SEQ ID NO: 22551 - DNA, 25 bp, Rattus norvegicus
aacagtgctcacattgaagccataa

SEQ ID NO: 22552 - DNA, 25 bp, Rattus norvegicus
aacagtgctcactttgaagccataa

SEQ ID NO: 22553 - DNA, 25 bp, Rattus norvegicus
aacagtgctccaacctgagagacga

SEQ ID NO: 22554 - DNA, 25 bp, Rattus norvegicus
aacagtgctccatcctgagagacga

SEQ ID NO: 22555 - DNA, 25 bp, Rattus norvegicus
aacagtgctcgtctggccgatggat

SEQ ID NO: 22556 - DNA, 25 bp, Rattus norvegicus
aacagtgctcgtgtggccgatggat

SEQ ID NO: 22557 - DNA, 25 bp, Rattus norvegicus
aacagtgctctcatgggagacaaga

SEQ ID NO: 22558 - DNA, 25 bp, Rattus norvegicus
aacagtgctctcttgggagacaaga

SEQ ID NO: 22559 - DNA, 25 bp, Rattus norvegicus
aacagtgctgcaccggtatcaatgc

SEQ ID NO: 22560 - DNA, 25 bp, Rattus norvegicus
aacagtgctgcagcggtatcaatgc

SEQ ID NO: 22561 - DNA, 25 bp, Rattus norvegicus
aacagtgctgccagtgttgtcatag

SEQ ID NO: 22562 - DNA, 25 bp, Rattus norvegicus
aacagtgctgcctgtgttgtcatag

SEQ ID NO: 22563 - DNA, 25 bp, Rattus norvegicus
aacagtgctgtaactcagcctcaga

SEQ ID NO: 22564 - DNA, 25 bp, Rattus norvegicus
aacagtgctgtatctcagcctcaga

SEQ ID NO: 22565 - DNA, 25 bp, Rattus norvegicus
aacagtgctgttctagcatccctca

SEQ ID NO: 22566 - DNA, 25 bp, Rattus norvegicus
aacagtgctgttgtagcatccctca

SEQ ID NO: 22567 - DNA, 25 bp, Rattus norvegicus
aacagtgcttaccatttccaccatc

SEQ ID NO: 22568 - DNA, 25 bp, Rattus norvegicus
aacagtgcttacgatttccaccatc

SEQ ID NO: 22569 - DNA, 25 bp, Rattus norvegicus
aacagtgcttcaactgcaagttctg

SEQ ID NO: 22570 - DNA, 25 bp, Rattus norvegicus
aacagtgcttcatctgcaagttctg

SEQ ID NO: 22571 - DNA, 25 bp, Rattus norvegicus
aacagtggataaaccttcttccttg

SEQ ID NO: 22572 - DNA, 25 bp, Rattus norvegicus
aacagtggataatccttcttccttg

SEQ ID NO: 22573 - DNA, 25 bp, Rattus norvegicus
aacagtggatttatggacagccaac

SEQ ID NO: 22574 - DNA, 25 bp, Rattus norvegicus
aacagtggatttttggacagccaac

SEQ ID NO: 22575 - DNA, 25 bp, Rattus norvegicus
aacagtggcatgaatcccatccaga

SEQ ID NO: 22576 - DNA, 25 bp, Rattus norvegicus
aacagtggcatgtatcccatccaga

SEQ ID NO: 22577 - DNA, 25 bp, Rattus norvegicus
aacagtggccagatcttagggcctt

SEQ ID NO: 22578 - DNA, 25 bp, Rattus norvegicus
aacagtggccagttcttagggcctt

SEQ ID NO: 22579 - DNA, 25 bp, Rattus norvegicus
aacagtggcctcacagaaccagagt

SEQ ID NO: 22580 - DNA, 25 bp, Rattus norvegicus
aacagtggcctctcagaaccagagt

SEQ ID NO: 22581 - DNA, 25 bp, Rattus norvegicus
aacagtggcctgagccagtctgtgg

SEQ ID NO: 22582 - DNA, 25 bp, Rattus norvegicus
aacagtggcctgtgccagtctgtgg

SEQ ID NO: 22583 - DNA, 25 bp, Rattus norvegicus
aacagtggccttcacatggagcaga

SEQ ID NO: 22584 - DNA, 25 bp, Rattus norvegicus
aacagtggccttcactgtgtgagcc

SEQ ID NO: 22585 - DNA, 25 bp, Rattus norvegicus
aacagtggccttgacatggagcaga

SEQ ID NO: 22586 - DNA, 25 bp, Rattus norvegicus
aacagtggccttgactgtgtgagcc

SEQ ID NO: 22587 - DNA, 25 bp, Rattus norvegicus
aacagtggctgcacaggagtccaga

SEQ ID NO: 22588 - DNA, 25 bp, Rattus norvegicus
aacagtggctgcctgtgccaaagcc

SEQ ID NO: 22589 - DNA, 25 bp, Rattus norvegicus
aacagtggctgcgtgtgccaaagcc

SEQ ID NO: 22590 - DNA, 25 bp, Rattus norvegicus
aacagtggctgctcaggagtccaga

SEQ ID NO: 22591 - DNA, 25 bp, Rattus norvegicus
aacagtgggataagggtcttgtacg

SEQ ID NO: 22592 - DNA, 25 bp, Rattus norvegicus
aacagtgggatatgggtcttgtacg

SEQ ID NO: 22593 - DNA, 25 bp, Rattus norvegicus
aacagtgggctgaaaacatccttgg

SEQ ID NO: 22594 - DNA, 25 bp, Rattus norvegicus
aacagtgggctgtaaacatccttgg

SEQ ID NO: 22595 - DNA, 25 bp, Rattus norvegicus
aacagtgggcttacgtggaacttct

SEQ ID NO: 22596 - DNA, 25 bp, Rattus norvegicus
aacagtgggctttcgtggaacttct

SEQ ID NO: 22597 - DNA, 25 bp, Rattus norvegicus
aacagtgggtgccaagatcagactt

SEQ ID NO: 22598 - DNA, 25 bp, Rattus norvegicus
aacagtgggtgcgaagatcagactt

SEQ ID NO: 22599 - DNA, 25 bp, Rattus norvegicus
aacagtggtactacatcagtcccga

SEQ ID NO: 22600 - DNA, 25 bp, Rattus norvegicus
aacagtggtacttcatcagtcccga

SEQ ID NO: 22601 - DNA, 25 bp, Rattus norvegicus
aacagtggtcacctgcaaggcaaac

SEQ ID NO: 22602 - DNA, 25 bp, Rattus norvegicus
aacagtggtcacgtgcaaggcaaac

SEQ ID NO: 22603 - DNA, 25 bp, Rattus norvegicus
aacagtggtcatcgtggagctcttg

SEQ ID NO: 22604 - DNA, 25 bp, Rattus norvegicus
aacagtggtcatggtggagctcttg

SEQ ID NO: 22605 - DNA, 25 bp, Rattus norvegicus
aacagtggtgacacaaagcattaag

SEQ ID NO: 22606 - DNA, 25 bp, Rattus norvegicus
aacagtggtgactcaaagcattaag

SEQ ID NO: 22607 - DNA, 25 bp, Rattus norvegicus
aacagtggtgggaattgtcagctct

SEQ ID NO: 22608 - DNA, 25 bp, Rattus norvegicus
aacagtggtgggtattgtcagctct

SEQ ID NO: 22609 - DNA, 25 bp, Rattus norvegicus
aacagtggtgtaaacttccctccat

SEQ ID NO: 22610 - DNA, 25 bp, Rattus norvegicus
aacagtggtgtaacttacgtacttt

SEQ ID NO: 22611 - DNA, 25 bp, Rattus norvegicus
aacagtggtgtatacttccctccat

SEQ ID NO: 22612 - DNA, 25 bp, Rattus norvegicus
aacagtggtgtatcttacgtacttt

SEQ ID NO: 22613 - DNA, 25 bp, Rattus norvegicus
aacagtggtgtccaacagttccata

SEQ ID NO: 22614 - DNA, 25 bp, Rattus norvegicus
aacagtggtgtcgaacagttccata

SEQ ID NO: 22615 - DNA, 25 bp, Rattus norvegicus
aacagtggtgttagcagctgctctg

SEQ ID NO: 22616 - DNA, 25 bp, Rattus norvegicus
aacagtggtgtttgcagctgctctg

SEQ ID NO: 22617 - DNA, 25 bp, Rattus norvegicus
aacagtggtttcaaggcaggtgcct

SEQ ID NO: 22618 - DNA, 25 bp, Rattus norvegicus
aacagtggtttctaggcaggtgcct

SEQ ID NO: 22619 - DNA, 25 bp, Rattus norvegicus
aacagtggtttgaccagggttcact

SEQ ID NO: 22620 - DNA, 25 bp, Rattus norvegicus
aacagtggtttgtccagggttcact

SEQ ID NO: 22621 - DNA, 25 bp, Rattus norvegicus
aacagtgtacccaggcggtaatcca

SEQ ID NO: 22622 - DNA, 25 bp, Rattus norvegicus
aacagtgtaccctggcggtaatcca

SEQ ID NO: 22623 - DNA, 25 bp, Rattus norvegicus
aacagtgtatgtcgtccctttggcc

SEQ ID NO: 22624 - DNA, 25 bp, Rattus norvegicus
aacagtgtatgtggtccctttggcc

SEQ ID NO: 22625 - DNA, 25 bp, Rattus norvegicus
aacagtgtccagaaatggcattctt

SEQ ID NO: 22626 - DNA, 25 bp, Rattus norvegicus
aacagtgtccagtaatggcattctt

SEQ ID NO: 22627 - DNA, 25 bp, Rattus norvegicus
aacagtgtcccaagggcaacagccc

SEQ ID NO: 22628 - DNA, 25 bp, Rattus norvegicus
aacagtgtcccatgggcaacagccc

SEQ ID NO: 22629 - DNA, 25 bp, Rattus norvegicus
aacagtgtcctccagttttacagag

SEQ ID NO: 22630 - DNA, 25 bp, Rattus norvegicus
aacagtgtcctcgagttttacagag

SEQ ID NO: 22631 - DNA, 25 bp, Rattus norvegicus
aacagtgtcctgacttaggagttta

SEQ ID NO: 22632 - DNA, 25 bp, Rattus norvegicus
aacagtgtcctgtcttaggagttta

SEQ ID NO: 22633 - DNA, 25 bp, Rattus norvegicus
aacagtgtctaacgacaaaaggcac

SEQ ID NO: 22634 - DNA, 25 bp, Rattus norvegicus
aacagtgtctaaggacaaaaggcac

SEQ ID NO: 22635 - DNA, 25 bp, Rattus norvegicus
aacagtgtgactccggcggcccctt

SEQ ID NO: 22636 - DNA, 25 bp, Rattus norvegicus
aacagtgtgactgcggcggcccctt

SEQ ID NO: 22637 - DNA, 25 bp, Rattus norvegicus
aacagtgtgagaaatgccgactcaa

SEQ ID NO: 22638 - DNA, 25 bp, Rattus norvegicus
aacagtgtgagatatgccgactcaa

SEQ ID NO: 22639 - DNA, 25 bp, Rattus norvegicus
aacagtgtgcttccaagttacaaat

SEQ ID NO: 22640 - DNA, 25 bp, Rattus norvegicus
aacagtgtgcttgcaagttacaaat

SEQ ID NO: 22641 - DNA, 25 bp, Rattus norvegicus
aacagtgtggtgaggcctcgcatct

SEQ ID NO: 22642 - DNA, 25 bp, Rattus norvegicus
aacagtgtggtgtggcctcgcatct

SEQ ID NO: 22643 - DNA, 25 bp, Rattus norvegicus
aacagtgttaccctgagccgcaagg

SEQ ID NO: 22644 - DNA, 25 bp, Rattus norvegicus
aacagtgttaccgtgagccgcaagg

SEQ ID NO: 22645 - DNA, 25 bp, Rattus norvegicus
aacagtgttatcatccagcagggca

SEQ ID NO: 22646 - DNA, 25 bp, Rattus norvegicus
aacagtgttatcttccagcagggca

SEQ ID NO: 22647 - DNA, 25 bp, Rattus norvegicus
aacagtgttcatccttaaaatccat

SEQ ID NO: 22648 - DNA, 25 bp, Rattus norvegicus
aacagtgttcatgcttaaaatccat

SEQ ID NO: 22649 - DNA, 25 bp, Rattus norvegicus
aacagtgttctgacctcagaaggcc

SEQ ID NO: 22650 - DNA, 25 bp, Rattus norvegicus
aacagtgttctgtcctcagaaggcc

SEQ ID NO: 22651 - DNA, 25 bp, Rattus norvegicus
aacagtgttcttactttcttcaagt

SEQ ID NO: 22652 - DNA, 25 bp, Rattus norvegicus
aacagtgttcttcagacacgtgctt

SEQ ID NO: 22653 - DNA, 25 bp, Rattus norvegicus
aacagtgttcttgagacacgtgctt

SEQ ID NO: 22654 - DNA, 25 bp, Rattus norvegicus
aacagtgttctttctttcttcaagt

SEQ ID NO: 22655 - DNA, 25 bp, Rattus norvegicus
aacagtgttggtatgtgctcttccc

SEQ ID NO: 22656 - DNA, 25 bp, Rattus norvegicus
aacagtgttggtttgtgctcttccc

SEQ ID NO: 22657 - DNA, 25 bp, Rattus norvegicus
aacagtgttgtcattcttaccaaat

SEQ ID NO: 22658 - DNA, 25 bp, Rattus norvegicus
aacagtgttgtctttcttaccaaat

SEQ ID NO: 22659 - DNA, 25 bp, Rattus norvegicus
aacagtgttgtgacacctgtggtca

SEQ ID NO: 22660 - DNA, 25 bp, Rattus norvegicus
aacagtgttgtgtcacctgtggtca

SEQ ID NO: 22661 - DNA, 25 bp, Rattus norvegicus
aacagtgtttatcatgagccctcaa

SEQ ID NO: 22662 - DNA, 25 bp, Rattus norvegicus
aacagtgtttatgatgagccctcaa

SEQ ID NO: 22663 - DNA, 25 bp, Rattus norvegicus
aacagtgtttgtagcccttatttct

SEQ ID NO: 22664 - DNA, 25 bp, Rattus norvegicus
aacagtgtttgttgcccttatttct

SEQ ID NO: 22665 - DNA, 25 bp, Rattus norvegicus
aacagttaaagcactcattcctggg

SEQ ID NO: 22666 - DNA, 25 bp, Rattus norvegicus
aacagttaaagctctcattcctggg

SEQ ID NO: 22667 - DNA, 25 bp, Rattus norvegicus
aacagttaaagtacgcgtgtcttgg

SEQ ID NO: 22668 - DNA, 25 bp, Rattus norvegicus
aacagttaaagttcgcgtgtcttgg

SEQ ID NO: 22669 - DNA, 25 bp, Rattus norvegicus
aacagttaactgaaggccctcatgg

SEQ ID NO: 22670 - DNA, 25 bp, Rattus norvegicus
aacagttaactgtaggccctcatgg

SEQ ID NO: 22671 - DNA, 25 bp, Rattus norvegicus
aacagttaattgaccgtaacacaca

SEQ ID NO: 22672 - DNA, 25 bp, Rattus norvegicus
aacagttaattgtccgtaacacaca

SEQ ID NO: 22673 - DNA, 25 bp, Rattus norvegicus
aacagttaccacatagcgaatctct

SEQ ID NO: 22674 - DNA, 25 bp, Rattus norvegicus
aacagttaccacttagcgaatctct

SEQ ID NO: 22675 - DNA, 25 bp, Rattus norvegicus
aacagttagcttagctgtgtaacaa

SEQ ID NO: 22676 - DNA, 25 bp, Rattus norvegicus
aacagttagcttcagctctcttgaa

SEQ ID NO: 22677 - DNA, 25 bp, Rattus norvegicus
aacagttagcttgagctctcttgaa

SEQ ID NO: 22678 - DNA, 25 bp, Rattus norvegicus
aacagttagctttgctgtgtaacaa

SEQ ID NO: 22679 - DNA, 25 bp, Rattus norvegicus
aacagttagtgcagtcttctttccc

SEQ ID NO: 22680 - DNA, 25 bp, Rattus norvegicus
aacagttagtgctgtcttctttccc

SEQ ID NO: 22681 - DNA, 25 bp, Rattus norvegicus
aacagttatctactaccaacggaga

SEQ ID NO: 22682 - DNA, 25 bp, Rattus norvegicus
aacagttatctagtaccaacggaga

SEQ ID NO: 22683 - DNA, 25 bp, Rattus norvegicus
aacagttatgtcatctgctctctgc

SEQ ID NO: 22684 - DNA, 25 bp, Rattus norvegicus
aacagttatgtcttctgctctctgc

SEQ ID NO: 22685 - DNA, 25 bp, Rattus norvegicus
aacagttattacactgatcctgccc

SEQ ID NO: 22686 - DNA, 25 bp, Rattus norvegicus
aacagttattactctgatcctgccc

SEQ ID NO: 22687 - DNA, 25 bp, Rattus norvegicus
aacagttattggatcttgtattctg

SEQ ID NO: 22688 - DNA, 25 bp, Rattus norvegicus
aacagttattggttcttgtattctg

SEQ ID NO: 22689 - DNA, 25 bp, Rattus norvegicus
aacagttcacacaaacatctctgat

SEQ ID NO: 22690 - DNA, 25 bp, Rattus norvegicus
aacagttcacactaacatctctgat

SEQ ID NO: 22691 - DNA, 25 bp, Rattus norvegicus
aacagttcacagaaggcttctcagc

SEQ ID NO: 22692 - DNA, 25 bp, Rattus norvegicus
aacagttcacagtaggcttctcagc

SEQ ID NO: 22693 - DNA, 25 bp, Rattus norvegicus
aacagttcacttcgtctcagtttct

SEQ ID NO: 22694 - DNA, 25 bp, Rattus norvegicus
aacagttcacttggtctcagtttct

SEQ ID NO: 22695 - DNA, 25 bp, Rattus norvegicus
aacagttcagagatcatgcttccct

SEQ ID NO: 22696 - DNA, 25 bp, Rattus norvegicus
aacagttcagagttcatgcttccct

SEQ ID NO: 22697 - DNA, 25 bp, Rattus norvegicus
aacagttcattcagatgtcgtagtt

SEQ ID NO: 22698 - DNA, 25 bp, Rattus norvegicus
aacagttcattctgatgtcgtagtt

SEQ ID NO: 22699 - DNA, 25 bp, Rattus norvegicus
aacagttcgggtcgaccgtctacat

SEQ ID NO: 22700 - DNA, 25 bp, Rattus norvegicus
aacagttcgggtggaccgtctacat

SEQ ID NO: 22701 - DNA, 25 bp, Rattus norvegicus
aacagttcgtatctgaataggactc

SEQ ID NO: 22702 - DNA, 25 bp, Rattus norvegicus
aacagttcgtatgtgaataggactc

SEQ ID NO: 22703 - DNA, 25 bp, Rattus norvegicus
aacagttctccaagtacctgtacct

SEQ ID NO: 22704 - DNA, 25 bp, Rattus norvegicus
aacagttctccatgtacctgtacct

SEQ ID NO: 22705 - DNA, 25 bp, Rattus norvegicus
aacagttctgatcttgtgtccatca

SEQ ID NO: 22706 - DNA, 25 bp, Rattus norvegicus
aacagttctgatgttgtgtccatca

SEQ ID NO: 22707 - DNA, 25 bp, Rattus norvegicus
aacagttctgtgagtgacgcaccca

SEQ ID NO: 22708 - DNA, 25 bp, Rattus norvegicus
aacagttctgtgtgtgacgcaccca

SEQ ID NO: 22709 - DNA, 25 bp, Rattus norvegicus
aacagttcttaaagattttctggga

SEQ ID NO: 22710 - DNA, 25 bp, Rattus norvegicus
aacagttcttaatgattttctggga

SEQ ID NO: 22711 - DNA, 25 bp, Rattus norvegicus
aacagttctttgacagcttcaagga

SEQ ID NO: 22712 - DNA, 25 bp, Rattus norvegicus
aacagttctttgtcagcttcaagga

SEQ ID NO: 22713 - DNA, 25 bp, Rattus norvegicus
aacagttgaaggatgctctcggaaa

SEQ ID NO: 22714 - DNA, 25 bp, Rattus norvegicus
aacagttgaaggttgctctcggaaa

SEQ ID NO: 22715 - DNA, 25 bp, Rattus norvegicus
aacagttgcaacagagacccaggaa

SEQ ID NO: 22716 - DNA, 25 bp, Rattus norvegicus
aacagttgcaactgagacccaggaa

SEQ ID NO: 22717 - DNA, 25 bp, Rattus norvegicus
aacagttgcattatctcctcaacct

SEQ ID NO: 22718 - DNA, 25 bp, Rattus norvegicus
aacagttgcattttctcctcaacct

SEQ ID NO: 22719 - DNA, 25 bp, Rattus norvegicus
aacagttgccaaccacttgtagtta

SEQ ID NO: 22720 - DNA, 25 bp, Rattus norvegicus
aacagttgccaagcacttgtagtta

SEQ ID NO: 22721 - DNA, 25 bp, Rattus norvegicus
aacagttgcggcatttgcagccagc

SEQ ID NO: 22722 - DNA, 25 bp, Rattus norvegicus
aacagttgcggcttttgcagccagc

SEQ ID NO: 22723 - DNA, 25 bp, Rattus norvegicus
aacagttgctgaagtcctttcgagg

SEQ ID NO: 22724 - DNA, 25 bp, Rattus norvegicus
aacagttgctgatgtcctttcgagg

SEQ ID NO: 22725 - DNA, 25 bp, Rattus norvegicus
aacagttggacacttgctacaagcc

SEQ ID NO: 22726 - DNA, 25 bp, Rattus norvegicus
aacagttggacagttgctacaagcc

SEQ ID NO: 22727 - DNA, 25 bp, Rattus norvegicus
aacagttggaccatagccctgaatg

SEQ ID NO: 22728 - DNA, 25 bp, Rattus norvegicus
aacagttggaccttagccctgaatg

SEQ ID NO: 22729 - DNA, 25 bp, Rattus norvegicus
aacagttggcccatgctaagaagaa

SEQ ID NO: 22730 - DNA, 25 bp, Rattus norvegicus
aacagttggcccttgctaagaagaa

SEQ ID NO: 22731 - DNA, 25 bp, Rattus norvegicus
aacagttgggacagctggtccccat

SEQ ID NO: 22732 - DNA, 25 bp, Rattus norvegicus
aacagttgggactgctggtccccat

SEQ ID NO: 22733 - DNA, 25 bp, Rattus norvegicus
aacagttgtcaaccctttggtgcct

SEQ ID NO: 22734 - DNA, 25 bp, Rattus norvegicus
aacagttgtcaagcctttggtgcct

SEQ ID NO: 22735 - DNA, 25 bp, Rattus norvegicus
aacagttgtctaacgccaggcacat

SEQ ID NO: 22736 - DNA, 25 bp, Rattus norvegicus
aacagttgtctatcgccaggcacat

SEQ ID NO: 22737 - DNA, 25 bp, Rattus norvegicus
aacagttgtctcctgcagttaatga

SEQ ID NO: 22738 - DNA, 25 bp, Rattus norvegicus
aacagttgtctcgtgcagttaatga

SEQ ID NO: 22739 - DNA, 25 bp, Rattus norvegicus
aacagttgtggtcttaccgttctgt

SEQ ID NO: 22740 - DNA, 25 bp, Rattus norvegicus
aacagttgtggtgttaccgttctgt

SEQ ID NO: 22741 - DNA, 25 bp, Rattus norvegicus
aacagttgttgcaaccacgagacct

SEQ ID NO: 22742 - DNA, 25 bp, Rattus norvegicus
aacagttgttgctaccacgagacct

SEQ ID NO: 22743 - DNA, 25 bp, Rattus norvegicus
aacagttgttgtagcagcctctgac

SEQ ID NO: 22744 - DNA, 25 bp, Rattus norvegicus
aacagttgttgttgcagcctctgac

SEQ ID NO: 22745 - DNA, 25 bp, Rattus norvegicus
aacagtttactccttctggtctcaa

SEQ ID NO: 22746 - DNA, 25 bp, Rattus norvegicus
aacagtttactcgttctggtctcaa

SEQ ID NO: 22747 - DNA, 25 bp, Rattus norvegicus
aacagtttatgcacaccttctttgg

SEQ ID NO: 22748 - DNA, 25 bp, Rattus norvegicus
aacagtttatgctcaccttctttgg

SEQ ID NO: 22749 - DNA, 25 bp, Rattus norvegicus
aacagtttcaccagatattcccaaa

SEQ ID NO: 22750 - DNA, 25 bp, Rattus norvegicus
aacagtttcacctgatattcccaaa

SEQ ID NO: 22751 - DNA, 25 bp, Rattus norvegicus
aacagtttccagagccatcaaccca

SEQ ID NO: 22752 - DNA, 25 bp, Rattus norvegicus
aacagtttccagtgccatcaaccca

SEQ ID NO: 22753 - DNA, 25 bp, Rattus norvegicus
aacagtttcctcctatactgtagga

SEQ ID NO: 22754 - DNA, 25 bp, Rattus norvegicus
aacagtttcctcgtatactgtagga

SEQ ID NO: 22755 - DNA, 25 bp, Rattus norvegicus
aacagtttctacctcagcattttca

SEQ ID NO: 22756 - DNA, 25 bp, Rattus norvegicus
aacagtttctacgtcagcattttca

SEQ ID NO: 22757 - DNA, 25 bp, Rattus norvegicus
aacagtttctcgaaggctttcaggg

SEQ ID NO: 22758 - DNA, 25 bp, Rattus norvegicus
aacagtttctcgtaggctttcaggg

SEQ ID NO: 22759 - DNA, 25 bp, Rattus norvegicus
aacagtttctggatcttttgtcaag

SEQ ID NO: 22760 - DNA, 25 bp, Rattus norvegicus
aacagtttctggttcttttgtcaag

SEQ ID NO: 22761 - DNA, 25 bp, Rattus norvegicus
aacagtttctgtcaatatctcatct

SEQ ID NO: 22762 - DNA, 25 bp, Rattus norvegicus
aacagtttctgtgaatatctcatct

SEQ ID NO: 22763 - DNA, 25 bp, Rattus norvegicus
aacagtttgactcttgaatccctta

SEQ ID NO: 22764 - DNA, 25 bp, Rattus norvegicus
aacagtttgactgttgaatccctta

SEQ ID NO: 22765 - DNA, 25 bp, Rattus norvegicus
aacagtttgcccaagatcccggact

SEQ ID NO: 22766 - DNA, 25 bp, Rattus norvegicus
aacagtttgccctagatcccggact

SEQ ID NO: 22767 - DNA, 25 bp, Rattus norvegicus
aacagtttgctgacagacccataga

SEQ ID NO: 22768 - DNA, 25 bp, Rattus norvegicus
aacagtttgctgtcagacccataga

SEQ ID NO: 22769 - DNA, 25 bp, Rattus norvegicus
aacagtttgcttatcctgtgggtct

SEQ ID NO: 22770 - DNA, 25 bp, Rattus norvegicus
aacagtttgcttttcctgtgggtct

SEQ ID NO: 22771 - DNA, 25 bp, Rattus norvegicus
aacagtttgggaagcatatgccttt

SEQ ID NO: 22772 - DNA, 25 bp, Rattus norvegicus
aacagtttgggatgcatatgccttt

SEQ ID NO: 22773 - DNA, 25 bp, Rattus norvegicus
aacagtttgttaatgccagatggca

SEQ ID NO: 22774 - DNA, 25 bp, Rattus norvegicus
aacagtttgttattgccagatggca

SEQ ID NO: 22775 - DNA, 25 bp, Rattus norvegicus
aacagttttcttatggacctggcag

SEQ ID NO: 22776 - DNA, 25 bp, Rattus norvegicus
aacagttttcttttggacctggcag

SEQ ID NO: 22777 - DNA, 25 bp, Rattus norvegicus
aacataaaagtcaccagtctcccat

SEQ ID NO: 22778 - DNA, 25 bp, Rattus norvegicus
aacataaaagtctccagtctcccat

SEQ ID NO: 22779 - DNA, 25 bp, Rattus norvegicus
aacataaacccaacttcagtcagcc

SEQ ID NO: 22780 - DNA, 25 bp, Rattus norvegicus
aacataaacccatcttcagtcagcc

SEQ ID NO: 22781 - DNA, 25 bp, Rattus norvegicus
aacataaactagcactctgccccaa

SEQ ID NO: 22782 - DNA, 25 bp, Rattus norvegicus
aacataaactaggactctgccccaa

SEQ ID NO: 22783 - DNA, 25 bp, Rattus norvegicus
aacataacatccacctcatgaaact

SEQ ID NO: 22784 - DNA, 25 bp, Rattus norvegicus
aacataacatcctcctcatgaaact

SEQ ID NO: 22785 - DNA, 25 bp, Rattus norvegicus
aacataacatttatccctcaacact

SEQ ID NO: 22786 - DNA, 25 bp, Rattus norvegicus
aacataacatttttccctcaacact

SEQ ID NO: 22787 - DNA, 25 bp, Rattus norvegicus
aacataagtctcactccatggtgga

SEQ ID NO: 22788 - DNA, 25 bp, Rattus norvegicus
aacataagtctctctccatggtgga

SEQ ID NO: 22789 - DNA, 25 bp, Rattus norvegicus
aacataagttggactttctcactat

SEQ ID NO: 22790 - DNA, 25 bp, Rattus norvegicus
aacataagttggtctttctcactat

SEQ ID NO: 22791 - DNA, 25 bp, Rattus norvegicus
aacataatactcaacacctctttct

SEQ ID NO: 22792 - DNA, 25 bp, Rattus norvegicus
aacataatactctacacctctttct

SEQ ID NO: 22793 - DNA, 25 bp, Rattus norvegicus
aacataatagctaggcggtgaggga

SEQ ID NO: 22794 - DNA, 25 bp, Rattus norvegicus
aacataatagcttggcggtgaggga

SEQ ID NO: 22795 - DNA, 25 bp, Rattus norvegicus
aacataatgcatagggccctgtgct

SEQ ID NO: 22796 - DNA, 25 bp, Rattus norvegicus
aacataatgcattgggccctgtgct

SEQ ID NO: 22797 - DNA, 25 bp, Rattus norvegicus
aacataattcatacttggtagttag

SEQ ID NO: 22798 - DNA, 25 bp, Rattus norvegicus
aacataattcattcttggtagttag

SEQ ID NO: 22799 - DNA, 25 bp, Rattus norvegicus
aacataattctgcagatgccctgga

SEQ ID NO: 22800 - DNA, 25 bp, Rattus norvegicus
aacataattctggagatgccctgga

SEQ ID NO: 22801 - DNA, 25 bp, Rattus norvegicus
aacatacaacgaccctgggtctcaa

SEQ ID NO: 22802 - DNA, 25 bp, Rattus norvegicus
aacatacaacgagcctgggtctcaa

SEQ ID NO: 22803 - DNA, 25 bp, Rattus norvegicus
aacatacagggtcggacttctccgt

SEQ ID NO: 22804 - DNA, 25 bp, Rattus norvegicus
aacatacagggtgggacttctccgt

SEQ ID NO: 22805 - DNA, 25 bp, Rattus norvegicus
aacatacagtgtccagttctgctgg

SEQ ID NO: 22806 - DNA, 25 bp, Rattus norvegicus
aacatacagtgtgcagttctgctgg

SEQ ID NO: 22807 - DNA, 25 bp, Rattus norvegicus
aacatacatctgaacctacttccca

SEQ ID NO: 22808 - DNA, 25 bp, Rattus norvegicus
aacatacatctgtacctacttccca

SEQ ID NO: 22809 - DNA, 25 bp, Rattus norvegicus
aacataccacaacttctgcttctac

SEQ ID NO: 22810 - DNA, 25 bp, Rattus norvegicus
aacataccacaagttctgcttctac

SEQ ID NO: 22811 - DNA, 25 bp, Rattus norvegicus
aacataccagccaagcagacaagta

SEQ ID NO: 22812 - DNA, 25 bp, Rattus norvegicus
aacataccagcctagcagacaagta

SEQ ID NO: 22813 - DNA, 25 bp, Rattus norvegicus
aacataccctccattgctcctttag

SEQ ID NO: 22814 - DNA, 25 bp, Rattus norvegicus
aacataccctcctttgctcctttag

SEQ ID NO: 22815 - DNA, 25 bp, Rattus norvegicus
aacatacctggtatgattcctcaag

SEQ ID NO: 22816 - DNA, 25 bp, Rattus norvegicus
aacatacctggtttgattcctcaag

SEQ ID NO: 22817 - DNA, 25 bp, Rattus norvegicus
aacatacgcattctagactattcag

SEQ ID NO: 22818 - DNA, 25 bp, Rattus norvegicus
aacatacgcattgtagactattcag

SEQ ID NO: 22819 - DNA, 25 bp, Rattus norvegicus
aacatactacatacctctgcatgag

SEQ ID NO: 22820 - DNA, 25 bp, Rattus norvegicus
aacatactacattcctctgcatgag

SEQ ID NO: 22821 - DNA, 25 bp, Rattus norvegicus
aacatactcatgctagaatccccga

SEQ ID NO: 22822 - DNA, 25 bp, Rattus norvegicus
aacatactcatggtagaatccccga

SEQ ID NO: 22823 - DNA, 25 bp, Rattus norvegicus
aacatactccttcacatggcttctt

SEQ ID NO: 22824 - DNA, 25 bp, Rattus norvegicus
aacatactccttgacatggcttctt

SEQ ID NO: 22825 - DNA, 25 bp, Rattus norvegicus
aacatactgctcaatctgctcttga

SEQ ID NO: 22826 - DNA, 25 bp, Rattus norvegicus
aacatactgctctatctgctcttga

SEQ ID NO: 22827 - DNA, 25 bp, Rattus norvegicus
aacatacttcatcgtgttcctttcc

SEQ ID NO: 22828 - DNA, 25 bp, Rattus norvegicus
aacatacttcatggtgttcctttcc

SEQ ID NO: 22829 - DNA, 25 bp, Rattus norvegicus
aacatagaaactactccaggccact

SEQ ID NO: 22830 - DNA, 25 bp, Rattus norvegicus
aacatagaaacttctccaggccact

SEQ ID NO: 22831 - DNA, 25 bp, Rattus norvegicus
aacatagaccacctgcaacccaggt

SEQ ID NO: 22832 - DNA, 25 bp, Rattus norvegicus
aacatagaccacgtgcaacccaggt

SEQ ID NO: 22833 - DNA, 25 bp, Rattus norvegicus
aacatagacgctctttgggtttcta

SEQ ID NO: 22834 - DNA, 25 bp, Rattus norvegicus
aacatagacgctgtttgggtttcta

SEQ ID NO: 22835 - DNA, 25 bp, Rattus norvegicus
aacatagcaagactttgtcttccaa

SEQ ID NO: 22836 - DNA, 25 bp, Rattus norvegicus
aacatagcaagagtttgtcttccaa

SEQ ID NO: 22837 - DNA, 25 bp, Rattus norvegicus
aacatagcaggtctgtggcagaaat

SEQ ID NO: 22838 - DNA, 25 bp, Rattus norvegicus
aacatagcaggtgtgtggcagaaat

SEQ ID NO: 22839 - DNA, 25 bp, Rattus norvegicus
aacatagcctcgatgcattaaacaa

SEQ ID NO: 22840 - DNA, 25 bp, Rattus norvegicus
aacatagcctcgttgcattaaacaa

SEQ ID NO: 22841 - DNA, 25 bp, Rattus norvegicus
aacatagccttgaggaggcttctca

SEQ ID NO: 22842 - DNA, 25 bp, Rattus norvegicus
aacatagccttgtggaggcttctca

SEQ ID NO: 22843 - DNA, 25 bp, Rattus norvegicus
aacatagctgccatgctgtctgtca

SEQ ID NO: 22844 - DNA, 25 bp, Rattus norvegicus
aacatagctgccttgctgtctgtca

SEQ ID NO: 22845 - DNA, 25 bp, Rattus norvegicus
aacatagctggcatttcttccaagc

SEQ ID NO: 22846 - DNA, 25 bp, Rattus norvegicus
aacatagctggcttttcttccaagc

SEQ ID NO: 22847 - DNA, 25 bp, Rattus norvegicus
aacataggagcacctatctgatgaa

SEQ ID NO: 22848 - DNA, 25 bp, Rattus norvegicus
aacataggagcagctatctgatgaa

SEQ ID NO: 22849 - DNA, 25 bp, Rattus norvegicus
aacatagtctgcatacatgtgacat

SEQ ID NO: 22850 - DNA, 25 bp, Rattus norvegicus
aacatagtctgcttacatgtgacat

SEQ ID NO: 22851 - DNA, 25 bp, Rattus norvegicus
aacatataccaaagccaaacacgaa

SEQ ID NO: 22852 - DNA, 25 bp, Rattus norvegicus
aacatataccaatgccaaacacgaa

SEQ ID NO: 22853 - DNA, 25 bp, Rattus norvegicus
aacatatccgtaacaggtctccttc

SEQ ID NO: 22854 - DNA, 25 bp, Rattus norvegicus
aacatatccgtatcaggtctccttc

SEQ ID NO: 22855 - DNA, 25 bp, Rattus norvegicus
aacatatcctggaatccggtggtgg

SEQ ID NO: 22856 - DNA, 25 bp, Rattus norvegicus
aacatatcctggtatccggtggtgg

SEQ ID NO: 22857 - DNA, 25 bp, Rattus norvegicus
aacatatctctaccctcctaaggaa

SEQ ID NO: 22858 - DNA, 25 bp, Rattus norvegicus
aacatatctctagcctcctaaggaa

SEQ ID NO: 22859 - DNA, 25 bp, Rattus norvegicus
aacatatctgtgactccatgcttga

SEQ ID NO: 22860 - DNA, 25 bp, Rattus norvegicus
aacatatctgtgtctccatgcttga

SEQ ID NO: 22861 - DNA, 25 bp, Rattus norvegicus
aacatatgagtgctacttgcgtgaa

SEQ ID NO: 22862 - DNA, 25 bp, Rattus norvegicus
aacatatgagtggtacttgcgtgaa

SEQ ID NO: 22863 - DNA, 25 bp, Rattus norvegicus
aacatatgcctgatggaggtcacca

SEQ ID NO: 22864 - DNA, 25 bp, Rattus norvegicus
aacatatgcctgttggaggtcacca

SEQ ID NO: 22865 - DNA, 25 bp, Rattus norvegicus
aacatatgtgctctactctttcaag

SEQ ID NO: 22866 - DNA, 25 bp, Rattus norvegicus
aacatatgtgctgtactctttcaag

SEQ ID NO: 22867 - DNA, 25 bp, Rattus norvegicus
aacatattcactaggattgttgaag

SEQ ID NO: 22868 - DNA, 25 bp, Rattus norvegicus
aacatattcacttggattgttgaag

SEQ ID NO: 22869 - DNA, 25 bp, Rattus norvegicus
aacatattcaggacatggcttgaga

SEQ ID NO: 22870 - DNA, 25 bp, Rattus norvegicus
aacatattcaggtcatggcttgaga

SEQ ID NO: 22871 - DNA, 25 bp, Rattus norvegicus
aacatattctttaacctactagtgg

SEQ ID NO: 22872 - DNA, 25 bp, Rattus norvegicus
aacatattcttttacctactagtgg

SEQ ID NO: 22873 - DNA, 25 bp, Rattus norvegicus
aacatattgtccatctggcactaat

SEQ ID NO: 22874 - DNA, 25 bp, Rattus norvegicus
aacatattgtccttctggcactaat

SEQ ID NO: 22875 - DNA, 25 bp, Rattus norvegicus
aacatatttctgctaaatccattag

SEQ ID NO: 22876 - DNA, 25 bp, Rattus norvegicus
aacatatttctggtaaatccattag

SEQ ID NO: 22877 - DNA, 25 bp, Rattus norvegicus
aacatatttgcccagttccggaaga

SEQ ID NO: 22878 - DNA, 25 bp, Rattus norvegicus
aacatatttgccgagttccggaaga

SEQ ID NO: 22879 - DNA, 25 bp, Rattus norvegicus
aacatatttgtgactccttgggcat

SEQ ID NO: 22880 - DNA, 25 bp, Rattus norvegicus
aacatatttgtgtctccttgggcat

SEQ ID NO: 22881 - DNA, 25 bp, Rattus norvegicus
aacatcaacaaacggattcctcgtt

SEQ ID NO: 22882 - DNA, 25 bp, Rattus norvegicus
aacatcaacaaagggattcctcgtt

SEQ ID NO: 22883 - DNA, 25 bp, Rattus norvegicus
aacatcaactatctgcccttgcagt

SEQ ID NO: 22884 - DNA, 25 bp, Rattus norvegicus
aacatcaactatgtgcccttgcagt

SEQ ID NO: 22885 - DNA, 25 bp, Rattus norvegicus
aacatcaaggagatcactgcccaaa

SEQ ID NO: 22886 - DNA, 25 bp, Rattus norvegicus
aacatcaaggagttcactgcccaaa

SEQ ID NO: 22887 - DNA, 25 bp, Rattus norvegicus
aacatcaaggcgacctaccattttg

SEQ ID NO: 22888 - DNA, 25 bp, Rattus norvegicus
aacatcaaggcgtcctaccattttg

SEQ ID NO: 22889 - DNA, 25 bp, Rattus norvegicus
aacatcaatgatacagctctagaag

SEQ ID NO: 22890 - DNA, 25 bp, Rattus norvegicus
aacatcaatgattcagctctagaag

SEQ ID NO: 22891 - DNA, 25 bp, Rattus norvegicus
aacatcaatgcacctctttctggtc

SEQ ID NO: 22892 - DNA, 25 bp, Rattus norvegicus
aacatcaatgcagctctttctggtc

SEQ ID NO: 22893 - DNA, 25 bp, Rattus norvegicus
aacatcaatgctaaagaaatcactt

SEQ ID NO: 22894 - DNA, 25 bp, Rattus norvegicus
aacatcaatgcttaagaaatcactt

SEQ ID NO: 22895 - DNA, 25 bp, Rattus norvegicus
aacatcaatgtactgtgtccccacc

SEQ ID NO: 22896 - DNA, 25 bp, Rattus norvegicus
aacatcaatgtagtgtgtccccacc

SEQ ID NO: 22897 - DNA, 25 bp, Rattus norvegicus
aacatcaattgtattcctaggcccc

SEQ ID NO: 22898 - DNA, 25 bp, Rattus norvegicus
aacatcaattgttttcctaggcccc

SEQ ID NO: 22899 - DNA, 25 bp, Rattus norvegicus
aacatcaattttatagtagtagcaa

SEQ ID NO: 22900 - DNA, 25 bp, Rattus norvegicus
aacatcaattttttagtagtagcaa

SEQ ID NO: 22901 - DNA, 25 bp, Rattus norvegicus
aacatcacacttctgttagtggcat

SEQ ID NO: 22902 - DNA, 25 bp, Rattus norvegicus
aacatcacacttgtgttagtggcat

SEQ ID NO: 22903 - DNA, 25 bp, Rattus norvegicus
aacatcacatttccatttctgcttg

SEQ ID NO: 22904 - DNA, 25 bp, Rattus norvegicus
aacatcacatttgcatttctgcttg

SEQ ID NO: 22905 - DNA, 25 bp, Rattus norvegicus
aacatcaccaatcggacggccaagg

SEQ ID NO: 22906 - DNA, 25 bp, Rattus norvegicus
aacatcaccaatgggacggccaagg

SEQ ID NO: 22907 - DNA, 25 bp, Rattus norvegicus
aacatcaccttaacttttatcctca

SEQ ID NO: 22908 - DNA, 25 bp, Rattus norvegicus
aacatcaccttatcttttatcctca

SEQ ID NO: 22909 - DNA, 25 bp, Rattus norvegicus
aacatcagactgacctttcgaagga

SEQ ID NO: 22910 - DNA, 25 bp, Rattus norvegicus
aacatcagactgtcctttcgaagga

SEQ ID NO: 22911 - DNA, 25 bp, Rattus norvegicus
aacatcagagcacggttctcaggct

SEQ ID NO: 22912 - DNA, 25 bp, Rattus norvegicus
aacatcagagcagggttctcaggct

SEQ ID NO: 22913 - DNA, 25 bp, Rattus norvegicus
aacatcagatagagcgcggccgtcg

SEQ ID NO: 22914 - DNA, 25 bp, Rattus norvegicus
aacatcagatagtgcgcggccgtcg

SEQ ID NO: 22915 - DNA, 25 bp, Rattus norvegicus
aacatcagcaccattggtcctggaa

SEQ ID NO: 22916 - DNA, 25 bp, Rattus norvegicus
aacatcagcacctttggtcctggaa

SEQ ID NO: 22917 - DNA, 25 bp, Rattus norvegicus
aacatcagcattctactctccaagg

SEQ ID NO: 22918 - DNA, 25 bp, Rattus norvegicus
aacatcagcattgtactctccaagg

SEQ ID NO: 22919 - DNA, 25 bp, Rattus norvegicus
aacatcaggactcgagcaagaacat

SEQ ID NO: 22920 - DNA, 25 bp, Rattus norvegicus
aacatcaggactggagcaagaacat

SEQ ID NO: 22921 - DNA, 25 bp, Rattus norvegicus
aacatcaggccccactgtgtaggta

SEQ ID NO: 22922 - DNA, 25 bp, Rattus norvegicus
aacatcaggcccgactgtgtaggta

SEQ ID NO: 22923 - DNA, 25 bp, Rattus norvegicus
aacatcaggcttatctaatttatct

SEQ ID NO: 22924 - DNA, 25 bp, Rattus norvegicus
aacatcaggcttttctaatttatct

SEQ ID NO: 22925 - DNA, 25 bp, Rattus norvegicus
aacatcaggtttaggctctgccgca

SEQ ID NO: 22926 - DNA, 25 bp, Rattus norvegicus
aacatcaggttttggctctgccgca

SEQ ID NO: 22927 - DNA, 25 bp, Rattus norvegicus
aacatcagtcatcgcagtgggctct

SEQ ID NO: 22928 - DNA, 25 bp, Rattus norvegicus
aacatcagtcatggcagtgggctct

SEQ ID NO: 22929 - DNA, 25 bp, Rattus norvegicus
aacatcagtctgctccactacattg

SEQ ID NO: 22930 - DNA, 25 bp, Rattus norvegicus
aacatcagtctggtccactacattg

SEQ ID NO: 22931 - DNA, 25 bp, Rattus norvegicus
aacatcagtgatactgaggccagga

SEQ ID NO: 22932 - DNA, 25 bp, Rattus norvegicus
aacatcagtgattctgaggccagga

SEQ ID NO: 22933 - DNA, 25 bp, Rattus norvegicus
aacatcagtggtcagcagctcctgc

SEQ ID NO: 22934 - DNA, 25 bp, Rattus norvegicus
aacatcagtggtgagcagctcctgc

SEQ ID NO: 22935 - DNA, 25 bp, Rattus norvegicus
aacatcagtgtcattgttgccaaga

SEQ ID NO: 22936 - DNA, 25 bp, Rattus norvegicus
aacatcagtgtctttgttgccaaga

SEQ ID NO: 22937 - DNA, 25 bp, Rattus norvegicus
aacatcataggcacacttaccggat

SEQ ID NO: 22938 - DNA, 25 bp, Rattus norvegicus
aacatcataggctcacttaccggat

SEQ ID NO: 22939 - DNA, 25 bp, Rattus norvegicus
aacatcatcactatgctgagcctac

SEQ ID NO: 22940 - DNA, 25 bp, Rattus norvegicus
aacatcatcactttgctgagcctac

SEQ ID NO: 22941 - DNA, 25 bp, Rattus norvegicus
aacatcatctacagggcggcgtata

SEQ ID NO: 22942 - DNA, 25 bp, Rattus norvegicus
aacatcatctactgggcggcgtata

SEQ ID NO: 22943 - DNA, 25 bp, Rattus norvegicus
aacatcatctgcactttcatttctt

SEQ ID NO: 22944 - DNA, 25 bp, Rattus norvegicus
aacatcatctgctctttcatttctt

SEQ ID NO: 22945 - DNA, 25 bp, Rattus norvegicus
aacatcatgactctgctgtgggcat

SEQ ID NO: 22946 - DNA, 25 bp, Rattus norvegicus
aacatcatgactgtgctgtgggcat

SEQ ID NO: 22947 - DNA, 25 bp, Rattus norvegicus
aacatcatggcacactacacacgta

SEQ ID NO: 22948 - DNA, 25 bp, Rattus norvegicus
aacatcatggcagactacacacgta

SEQ ID NO: 22949 - DNA, 25 bp, Rattus norvegicus
aacatcatggtcctagcaagcagta

SEQ ID NO: 22950 - DNA, 25 bp, Rattus norvegicus
aacatcatggtcgtagcaagcagta

SEQ ID NO: 22951 - DNA, 25 bp, Rattus norvegicus
aacatcattacaacatgcgtccgtc

SEQ ID NO: 22952 - DNA, 25 bp, Rattus norvegicus
aacatcattacatcatgcgtccgtc

SEQ ID NO: 22953 - DNA, 25 bp, Rattus norvegicus
aacatcattcgcaagaggccaggta

SEQ ID NO: 22954 - DNA, 25 bp, Rattus norvegicus
aacatcattcgctagaggccaggta

SEQ ID NO: 22955 - DNA, 25 bp, Rattus norvegicus
aacatcattgagctcttctacgtct

SEQ ID NO: 22956 - DNA, 25 bp, Rattus norvegicus
aacatcattgaggtcttctacgtct

SEQ ID NO: 22957 - DNA, 25 bp, Rattus norvegicus
aacatcattgctaacttctaggaca

SEQ ID NO: 22958 - DNA, 25 bp, Rattus norvegicus
aacatcattgcttacttctaggaca

SEQ ID NO: 22959 - DNA, 25 bp, Rattus norvegicus
aacatcatttctccttttcatgcta

SEQ ID NO: 22960 - DNA, 25 bp, Rattus norvegicus
aacatcatttctgcttttcatgcta

SEQ ID NO: 22961 - DNA, 25 bp, Rattus norvegicus
aacatccaatagacccagatcaaat

SEQ ID NO: 22962 - DNA, 25 bp, Rattus norvegicus
aacatccaatagtcccagatcaaat

SEQ ID NO: 22963 - DNA, 25 bp, Rattus norvegicus
aacatccactagacagtctctttag

SEQ ID NO: 22964 - DNA, 25 bp, Rattus norvegicus
aacatccactagtcagtctctttag

SEQ ID NO: 22965 - DNA, 25 bp, Rattus norvegicus
aacatccaggaaatgcagtataatg

SEQ ID NO: 22966 - DNA, 25 bp, Rattus norvegicus
aacatccaggaattgcagtataatg

SEQ ID NO: 22967 - DNA, 25 bp, Rattus norvegicus
aacatccaggatcgtggttgcaccc

SEQ ID NO: 22968 - DNA, 25 bp, Rattus norvegicus
aacatccaggatggtggttgcaccc

SEQ ID NO: 22969 - DNA, 25 bp, Rattus norvegicus
aacatccaggcaagagatttcattg

SEQ ID NO: 22970 - DNA, 25 bp, Rattus norvegicus
aacatccaggcatgagatttcattg

SEQ ID NO: 22971 - DNA, 25 bp, Rattus norvegicus
aacatccatcagatcatggctcagt

SEQ ID NO: 22972 - DNA, 25 bp, Rattus norvegicus
aacatccatcagttcatggctcagt

SEQ ID NO: 22973 - DNA, 25 bp, Rattus norvegicus
aacatccatgtaaagtaagctagct

SEQ ID NO: 22974 - DNA, 25 bp, Rattus norvegicus
aacatccatgtatagtaagctagct

SEQ ID NO: 22975 - DNA, 25 bp, Rattus norvegicus
aacatcccagctcaagtgggccggt

SEQ ID NO: 22976 - DNA, 25 bp, Rattus norvegicus
aacatcccagctgaagtgggccggt

SEQ ID NO: 22977 - DNA, 25 bp, Rattus norvegicus
aacatcccagggaaggtttcactct

SEQ ID NO: 22978 - DNA, 25 bp, Rattus norvegicus
aacatcccagggtaggtttcactct

SEQ ID NO: 22979 - DNA, 25 bp, Rattus norvegicus
aacatccccaagatttccaagaaca

SEQ ID NO: 22980 - DNA, 25 bp, Rattus norvegicus
aacatccccaagttttccaagaaca

SEQ ID NO: 22981 - DNA, 25 bp, Rattus norvegicus
aacatccctcttcggaggtttggag

SEQ ID NO: 22982 - DNA, 25 bp, Rattus norvegicus
aacatccctcttgggaggtttggag

SEQ ID NO: 22983 - DNA, 25 bp, Rattus norvegicus
aacatccctgatcggcatgcctata

SEQ ID NO: 22984 - DNA, 25 bp, Rattus norvegicus
aacatccctgatgggcatgcctata

SEQ ID NO: 22985 - DNA, 25 bp, Rattus norvegicus
aacatcccttttcgcatcactgagg

SEQ ID NO: 22986 - DNA, 25 bp, Rattus norvegicus
aacatcccttttggcatcactgagg

SEQ ID NO: 22987 - DNA, 25 bp, Rattus norvegicus
aacatccgccatcaggttcttgagg

SEQ ID NO: 22988 - DNA, 25 bp, Rattus norvegicus
aacatccgccatgaggttcttgagg

SEQ ID NO: 22989 - DNA, 25 bp, Rattus norvegicus
aacatccgcctgactttggagaagc

SEQ ID NO: 22990 - DNA, 25 bp, Rattus norvegicus
aacatccgcctgtctttggagaagc

SEQ ID NO: 22991 - DNA, 25 bp, Rattus norvegicus
aacatccggagaccggtaccctttg

SEQ ID NO: 22992 - DNA, 25 bp, Rattus norvegicus
aacatccggagagcggtaccctttg

SEQ ID NO: 22993 - DNA, 25 bp, Rattus norvegicus
aacatccggcaaaactgaacgctaa

SEQ ID NO: 22994 - DNA, 25 bp, Rattus norvegicus
aacatccggcaatactgaacgctaa

SEQ ID NO: 22995 - DNA, 25 bp, Rattus norvegicus
aacatcctctcaacctggagggcag

SEQ ID NO: 22996 - DNA, 25 bp, Rattus norvegicus
aacatcctctcatcctggagggcag

SEQ ID NO: 22997 - DNA, 25 bp, Rattus norvegicus
aacatcctctccaggcagaagcatg

SEQ ID NO: 22998 - DNA, 25 bp, Rattus norvegicus
aacatcctctcctggcagaagcatg

SEQ ID NO: 22999 - DNA, 25 bp, Rattus norvegicus
aacatcctctggaaaatggacgcag

SEQ ID NO: 23000 - DNA, 25 bp, Rattus norvegicus
aacatcctctggtaaatggacgcag

SEQ ID NO: 23001 - DNA, 25 bp, Rattus norvegicus
aacatcctgaatccgagttctctct

SEQ ID NO: 23002 - DNA, 25 bp, Rattus norvegicus
aacatcctgaatgcgagttctctct

SEQ ID NO: 23003 - DNA, 25 bp, Rattus norvegicus
aacatcctgaggattgccaaggaca

SEQ ID NO: 23004 - DNA, 25 bp, Rattus norvegicus
aacatcctgaggctacaacaactgg

SEQ ID NO: 23005 - DNA, 25 bp, Rattus norvegicus
aacatcctgagggtacaacaactgg

SEQ ID NO: 23006 - DNA, 25 bp, Rattus norvegicus
aacatcctgaggtttgccaaggaca

SEQ ID NO: 23007 - DNA, 25 bp, Rattus norvegicus
aacatcctgatgctgggtctcctac

SEQ ID NO: 23008 - DNA, 25 bp, Rattus norvegicus
aacatcctgatggtgggtctcctac

SEQ ID NO: 23009 - DNA, 25 bp, Rattus norvegicus
aacatcctgcacctatgttacagct

SEQ ID NO: 23010 - DNA, 25 bp, Rattus norvegicus
aacatcctgcacgtatgttacagct

SEQ ID NO: 23011 - DNA, 25 bp, Rattus norvegicus
aacatcctgtccagtaaggtggtct

SEQ ID NO: 23012 - DNA, 25 bp, Rattus norvegicus
aacatcctgtcctgtaaggtggtct

SEQ ID NO: 23013 - DNA, 25 bp, Rattus norvegicus
aacatcctgtgactcctaggtaaag

SEQ ID NO: 23014 - DNA, 25 bp, Rattus norvegicus
aacatcctgtgagtcctaggtaaag

SEQ ID NO: 23015 - DNA, 25 bp, Rattus norvegicus
aacatcctgtgtcgctgcgtctgtg

SEQ ID NO: 23016 - DNA, 25 bp, Rattus norvegicus
aacatcctgtgtggctgcgtctgtg

SEQ ID NO: 23017 - DNA, 25 bp, Rattus norvegicus
aacatccttctgaaactcccatttt

SEQ ID NO: 23018 - DNA, 25 bp, Rattus norvegicus
aacatccttctgtaactcccatttt

SEQ ID NO: 23019 - DNA, 25 bp, Rattus norvegicus
aacatccttgacactcgggagagca

SEQ ID NO: 23020 - DNA, 25 bp, Rattus norvegicus
aacatccttgactctcgggagagca

SEQ ID NO: 23021 - DNA, 25 bp, Rattus norvegicus
aacatccttggcactcagcggcagt

SEQ ID NO: 23022 - DNA, 25 bp, Rattus norvegicus
aacatccttggctctcagcggcagt

SEQ ID NO: 23023 - DNA, 25 bp, Rattus norvegicus
aacatccttttgctgctagagggcg

SEQ ID NO: 23024 - DNA, 25 bp, Rattus norvegicus
aacatccttttggtgctagagggcg

SEQ ID NO: 23025 - DNA, 25 bp, Rattus norvegicus
aacatcgacgggaaggacatccaac

SEQ ID NO: 23026 - DNA, 25 bp, Rattus norvegicus
aacatcgacgggtaggacatccaac

SEQ ID NO: 23027 - DNA, 25 bp, Rattus norvegicus
aacatcgagatcacgcgccaggagc

SEQ ID NO: 23028 - DNA, 25 bp, Rattus norvegicus
aacatcgagatctcgcgccaggagc

SEQ ID NO: 23029 - DNA, 25 bp, Rattus norvegicus
aacatcgccatgcacggcctgaggg

SEQ ID NO: 23030 - DNA, 25 bp, Rattus norvegicus
aacatcgccatggacggcctgaggg

SEQ ID NO: 23031 - DNA, 25 bp, Rattus norvegicus
aacatcgctggccagagctgtggat

SEQ ID NO: 23032 - DNA, 25 bp, Rattus norvegicus
aacatcgctggcgagagctgtggat

SEQ ID NO: 23033 - DNA, 25 bp, Rattus norvegicus
aacatcggaacacctgccaaatatc

SEQ ID NO: 23034 - DNA, 25 bp, Rattus norvegicus
aacatcggaacagctgccaaatatc

SEQ ID NO: 23035 - DNA, 25 bp, Rattus norvegicus
aacatcggcagcatgtgagctcacc

SEQ ID NO: 23036 - DNA, 25 bp, Rattus norvegicus
aacatcggcagcttgtgagctcacc

SEQ ID NO: 23037 - DNA, 25 bp, Rattus norvegicus
aacatcgggaagaccctggcagcac

SEQ ID NO: 23038 - DNA, 25 bp, Rattus norvegicus
aacatcgggaagtccctggcagcac

SEQ ID NO: 23039 - DNA, 25 bp, Rattus norvegicus
aacatcgtatgcatttgactcagta

SEQ ID NO: 23040 - DNA, 25 bp, Rattus norvegicus
aacatcgtatgcttttgactcagta

SEQ ID NO: 23041 - DNA, 25 bp, Rattus norvegicus
aacatcgtgattatcctggagactc

SEQ ID NO: 23042 - DNA, 25 bp, Rattus norvegicus
aacatcgtgattttcctggagactc

SEQ ID NO: 23043 - DNA, 25 bp, Rattus norvegicus
aacatcgtgggcatctggtcgactt

SEQ ID NO: 23044 - DNA, 25 bp, Rattus norvegicus
aacatcgtgggcttctggtcgactt

SEQ ID NO: 23045 - DNA, 25 bp, Rattus norvegicus
aacatctaccctagaccatggctgg

SEQ ID NO: 23046 - DNA, 25 bp, Rattus norvegicus
aacatctaccctcacggaagagtgt

SEQ ID NO: 23047 - DNA, 25 bp, Rattus norvegicus
aacatctaccctgacggaagagtgt

SEQ ID NO: 23048 - DNA, 25 bp, Rattus norvegicus
aacatctacccttgaccatggctgg

SEQ ID NO: 23049 - DNA, 25 bp, Rattus norvegicus
aacatctattttaaaaggcgcccat

SEQ ID NO: 23050 - DNA, 25 bp, Rattus norvegicus
aacatctatttttaaaggcgcccat

SEQ ID NO: 23051 - DNA, 25 bp, Rattus norvegicus
aacatctcagctcctactgtgtaag

SEQ ID NO: 23052 - DNA, 25 bp, Rattus norvegicus
aacatctcagctgctactgtgtaag

SEQ ID NO: 23053 - DNA, 25 bp, Rattus norvegicus
aacatctcatcacgtcgatctgctg

SEQ ID NO: 23054 - DNA, 25 bp, Rattus norvegicus
aacatctcatcaggtcgatctgctg

SEQ ID NO: 23055 - DNA, 25 bp, Rattus norvegicus
aacatctccaagcaggcccgaagcg

SEQ ID NO: 23056 - DNA, 25 bp, Rattus norvegicus
aacatctccaaggaggcccgaagcg

SEQ ID NO: 23057 - DNA, 25 bp, Rattus norvegicus
aacatctcccgccaaaagcacgagg

SEQ ID NO: 23058 - DNA, 25 bp, Rattus norvegicus
aacatctcccgcgaaaagcacgagg

SEQ ID NO: 23059 - DNA, 25 bp, Rattus norvegicus
aacatctccgaacttgggcagcatg

SEQ ID NO: 23060 - DNA, 25 bp, Rattus norvegicus
aacatctccgaagttgggcagcatg

SEQ ID NO: 23061 - DNA, 25 bp, Rattus norvegicus
aacatctcctcactagtacatttgc

SEQ ID NO: 23062 - DNA, 25 bp, Rattus norvegicus
aacatctcctcagtagtacatttgc

SEQ ID NO: 23063 - DNA, 25 bp, Rattus norvegicus
aacatctcgatccagggccggtgga

SEQ ID NO: 23064 - DNA, 25 bp, Rattus norvegicus
aacatctcgatcgagggccggtgga

SEQ ID NO: 23065 - DNA, 25 bp, Rattus norvegicus
aacatctcgtgtctggtcggtcagc

SEQ ID NO: 23066 - DNA, 25 bp, Rattus norvegicus
aacatctcgtgtgtggtcggtcagc

SEQ ID NO: 23067 - DNA, 25 bp, Rattus norvegicus
aacatctctaacaagcttctctaac

SEQ ID NO: 23068 - DNA, 25 bp, Rattus norvegicus
aacatctctaactagcttctctaac

SEQ ID NO: 23069 - DNA, 25 bp, Rattus norvegicus
aacatctctaagctgagccctgagg

SEQ ID NO: 23070 - DNA, 25 bp, Rattus norvegicus
aacatctctaaggtgagccctgagg

SEQ ID NO: 23071 - DNA, 25 bp, Rattus norvegicus
aacatctctgtacaagtcaggccta

SEQ ID NO: 23072 - DNA, 25 bp, Rattus norvegicus
aacatctctgtagaagtcaggccta

SEQ ID NO: 23073 - DNA, 25 bp, Rattus norvegicus
aacatctcttgaagccaaactccac

SEQ ID NO: 23074 - DNA, 25 bp, Rattus norvegicus
aacatctcttgatgccaaactccac

SEQ ID NO: 23075 - DNA, 25 bp, Rattus norvegicus
aacatctgaatgaattccctgcacc

SEQ ID NO: 23076 - DNA, 25 bp, Rattus norvegicus
aacatctgaatgcttttagaacaca

SEQ ID NO: 23077 - DNA, 25 bp, Rattus norvegicus
aacatctgaatggttttagaacaca

SEQ ID NO: 23078 - DNA, 25 bp, Rattus norvegicus
aacatctgaatgtattccctgcacc

SEQ ID NO: 23079 - DNA, 25 bp, Rattus norvegicus
aacatctgagagagcacaggcgtgc

SEQ ID NO: 23080 - DNA, 25 bp, Rattus norvegicus
aacatctgagagtgcacaggcgtgc

SEQ ID NO: 23081 - DNA, 25 bp, Rattus norvegicus
aacatctgagccacctttctgtttg

SEQ ID NO: 23082 - DNA, 25 bp, Rattus norvegicus
aacatctgagcctcctttctgtttg

SEQ ID NO: 23083 - DNA, 25 bp, Rattus norvegicus
aacatctgcgttagtcaagtcctat

SEQ ID NO: 23084 - DNA, 25 bp, Rattus norvegicus
aacatctgcgtttgtcaagtcctat

SEQ ID NO: 23085 - DNA, 25 bp, Rattus norvegicus
aacatctggacgaagcgcagcctgt

SEQ ID NO: 23086 - DNA, 25 bp, Rattus norvegicus
aacatctggacgtagcgcagcctgt

SEQ ID NO: 23087 - DNA, 25 bp, Rattus norvegicus
aacatctggagcctactccgtgtat

SEQ ID NO: 23088 - DNA, 25 bp, Rattus norvegicus
aacatctggagcgtactccgtgtat

SEQ ID NO: 23089 - DNA, 25 bp, Rattus norvegicus
aacatctggatgaccttgagctgaa

SEQ ID NO: 23090 - DNA, 25 bp, Rattus norvegicus
aacatctggatgtccttgagctgaa

SEQ ID NO: 23091 - DNA, 25 bp, Rattus norvegicus
aacatctgggcgcagcgcgagccac

SEQ ID NO: 23092 - DNA, 25 bp, Rattus norvegicus
aacatctgggcggagcgcgagccac

SEQ ID NO: 23093 - DNA, 25 bp, Rattus norvegicus
aacatctgggtgagacattccgagt

SEQ ID NO: 23094 - DNA, 25 bp, Rattus norvegicus
aacatctgggtgtgacattccgagt

SEQ ID NO: 23095 - DNA, 25 bp, Rattus norvegicus
aacatctggtacattgtggttagtc

SEQ ID NO: 23096 - DNA, 25 bp, Rattus norvegicus
aacatctggtactttgtggttagtc

SEQ ID NO: 23097 - DNA, 25 bp, Rattus norvegicus
aacatctgtaatcccaacctgtggg

SEQ ID NO: 23098 - DNA, 25 bp, Rattus norvegicus
aacatctgtaatgccaacctgtggg

SEQ ID NO: 23099 - DNA, 25 bp, Rattus norvegicus
aacatctgtagtattgtcccaggag

SEQ ID NO: 23100 - DNA, 25 bp, Rattus norvegicus
aacatctgtagttttgtcccaggag

SEQ ID NO: 23101 - DNA, 25 bp, Rattus norvegicus
aacatcttagtgacgttctcctggg

SEQ ID NO: 23102 - DNA, 25 bp, Rattus norvegicus
aacatcttagtgctcaggaattcaa

SEQ ID NO: 23103 - DNA, 25 bp, Rattus norvegicus
aacatcttagtggtcaggaattcaa

SEQ ID NO: 23104 - DNA, 25 bp, Rattus norvegicus
aacatcttagtgtcgttctcctggg

SEQ ID NO: 23105 - DNA, 25 bp, Rattus norvegicus
aacatcttcagtcagggacccattg

SEQ ID NO: 23106 - DNA, 25 bp, Rattus norvegicus
aacatcttcagtgagggacccattg

SEQ ID NO: 23107 - DNA, 25 bp, Rattus norvegicus
aacatcttgcagacagagtggccat

SEQ ID NO: 23108 - DNA, 25 bp, Rattus norvegicus
aacatcttgcagtcagagtggccat

SEQ ID NO: 23109 - DNA, 25 bp, Rattus norvegicus
aacatcttgccactcctttttgctt

SEQ ID NO: 23110 - DNA, 25 bp, Rattus norvegicus
aacatcttgccagtcctttttgctt

SEQ ID NO: 23111 - DNA, 25 bp, Rattus norvegicus
aacatgaaagatctccaggcctctc

SEQ ID NO: 23112 - DNA, 25 bp, Rattus norvegicus
aacatgaaagatgtccaggcctctc

SEQ ID NO: 23113 - DNA, 25 bp, Rattus norvegicus
aacatgaaagggaggctgctctcct

SEQ ID NO: 23114 - DNA, 25 bp, Rattus norvegicus
aacatgaaagggtggctgctctcct

SEQ ID NO: 23115 - DNA, 25 bp, Rattus norvegicus
aacatgaaccataattctctctgta

SEQ ID NO: 23116 - DNA, 25 bp, Rattus norvegicus
aacatgaaccattattctctctgta

SEQ ID NO: 23117 - DNA, 25 bp, Rattus norvegicus
aacatgaactagcaagccgggctct

SEQ ID NO: 23118 - DNA, 25 bp, Rattus norvegicus
aacatgaactaggaagccgggctct

SEQ ID NO: 23119 - DNA, 25 bp, Rattus norvegicus
aacatgaagatgctcccaagtccta

SEQ ID NO: 23120 - DNA, 25 bp, Rattus norvegicus
aacatgaagatggtcccaagtccta

SEQ ID NO: 23121 - DNA, 25 bp, Rattus norvegicus
aacatgaagctgcttcctggtgtga

SEQ ID NO: 23122 - DNA, 25 bp, Rattus norvegicus
aacatgaagctggttcctggtgtga

SEQ ID NO: 23123 - DNA, 25 bp, Rattus norvegicus
aacatgaaggtcctctaacaggtta

SEQ ID NO: 23124 - DNA, 25 bp, Rattus norvegicus
aacatgaaggtcgtctaacaggtta

SEQ ID NO: 23125 - DNA, 25 bp, Rattus norvegicus
aacatgaatacgagcctctgcgatt

SEQ ID NO: 23126 - DNA, 25 bp, Rattus norvegicus
aacatgaatacgtgcctctgcgatt

SEQ ID NO: 23127 - DNA, 25 bp, Rattus norvegicus
aacatgaatttgcaccttacaggaa

SEQ ID NO: 23128 - DNA, 25 bp, Rattus norvegicus
aacatgaatttggaccttacaggaa

SEQ ID NO: 23129 - DNA, 25 bp, Rattus norvegicus
aacatgacagagctgctggctggtc

SEQ ID NO: 23130 - DNA, 25 bp, Rattus norvegicus
aacatgacagaggtgctggctggtc

SEQ ID NO: 23131 - DNA, 25 bp, Rattus norvegicus
aacatgacagcaagatagctacgat

SEQ ID NO: 23132 - DNA, 25 bp, Rattus norvegicus
aacatgacagcatgatagctacgat

SEQ ID NO: 23133 - DNA, 25 bp, Rattus norvegicus
aacatgacagtgctgctgctgacct

SEQ ID NO: 23134 - DNA, 25 bp, Rattus norvegicus
aacatgacagtggtgctgctgacct

SEQ ID NO: 23135 - DNA, 25 bp, Rattus norvegicus
aacatgacagttatgtcttggtgtt

SEQ ID NO: 23136 - DNA, 25 bp, Rattus norvegicus
aacatgacagttttgtcttggtgtt

SEQ ID NO: 23137 - DNA, 25 bp, Rattus norvegicus
aacatgacatgtacctggcctctgg

SEQ ID NO: 23138 - DNA, 25 bp, Rattus norvegicus
aacatgacatgttcctggcctctgg

SEQ ID NO: 23139 - DNA, 25 bp, Rattus norvegicus
aacatgaccacacctaagagctctg

SEQ ID NO: 23140 - DNA, 25 bp, Rattus norvegicus
aacatgaccacagctaagagctctg

SEQ ID NO: 23141 - DNA, 25 bp, Rattus norvegicus
aacatgacggtcaatagctgagtac

SEQ ID NO: 23142 - DNA, 25 bp, Rattus norvegicus
aacatgacggtctatagctgagtac

SEQ ID NO: 23143 - DNA, 25 bp, Rattus norvegicus
aacatgactagtcgttcgggctcct

SEQ ID NO: 23144 - DNA, 25 bp, Rattus norvegicus
aacatgactagtggttcgggctcct

SEQ ID NO: 23145 - DNA, 25 bp, Rattus norvegicus
aacatgacttcgataacacgccttc

SEQ ID NO: 23146 - DNA, 25 bp, Rattus norvegicus
aacatgacttcgttaacacgccttc

SEQ ID NO: 23147 - DNA, 25 bp, Rattus norvegicus
aacatgactttgatggtcttgtttg

SEQ ID NO: 23148 - DNA, 25 bp, Rattus norvegicus
aacatgactttgttggtcttgtttg

SEQ ID NO: 23149 - DNA, 25 bp, Rattus norvegicus
aacatgagcagtctcacccagagct

SEQ ID NO: 23150 - DNA, 25 bp, Rattus norvegicus
aacatgagcagtgtcacccagagct

SEQ ID NO: 23151 - DNA, 25 bp, Rattus norvegicus
aacatgagccatacgatagaggtac

SEQ ID NO: 23152 - DNA, 25 bp, Rattus norvegicus
aacatgagccattcgatagaggtac

SEQ ID NO: 23153 - DNA, 25 bp, Rattus norvegicus
aacatgagccgcatggcgaggcaga

SEQ ID NO: 23154 - DNA, 25 bp, Rattus norvegicus
aacatgagccgcttggcgaggcaga

SEQ ID NO: 23155 - DNA, 25 bp, Rattus norvegicus
aacatgagcggtcgttccaacggct

SEQ ID NO: 23156 - DNA, 25 bp, Rattus norvegicus
aacatgagcggtggttccaacggct

SEQ ID NO: 23157 - DNA, 25 bp, Rattus norvegicus
aacatgaggactctttctagggtca

SEQ ID NO: 23158 - DNA, 25 bp, Rattus norvegicus
aacatgaggactgtttctagggtca

SEQ ID NO: 23159 - DNA, 25 bp, Rattus norvegicus
aacatgagtatccacactgcgtcta

SEQ ID NO: 23160 - DNA, 25 bp, Rattus norvegicus
aacatgagtatcgacactgcgtcta

SEQ ID NO: 23161 - DNA, 25 bp, Rattus norvegicus
aacatgagtcacacgtctttctgtc

SEQ ID NO: 23162 - DNA, 25 bp, Rattus norvegicus
aacatgagtcactcgtctttctgtc

SEQ ID NO: 23163 - DNA, 25 bp, Rattus norvegicus
aacatgatctttctatagcttgtaa

SEQ ID NO: 23164 - DNA, 25 bp, Rattus norvegicus
aacatgatctttgtatagcttgtaa

SEQ ID NO: 23165 - DNA, 25 bp, Rattus norvegicus
aacatgatgcgacctgttgcaagac

SEQ ID NO: 23166 - DNA, 25 bp, Rattus norvegicus
aacatgatgcgagctgttgcaagac

SEQ ID NO: 23167 - DNA, 25 bp, Rattus norvegicus
aacatgatggctcagacccagaccc

SEQ ID NO: 23168 - DNA, 25 bp, Rattus norvegicus
aacatgatggctgagacccagaccc

SEQ ID NO: 23169 - DNA, 25 bp, Rattus norvegicus
aacatgattcaaacccatgcatggt

SEQ ID NO: 23170 - DNA, 25 bp, Rattus norvegicus
aacatgattcaatcccatgcatggt

SEQ ID NO: 23171 - DNA, 25 bp, Rattus norvegicus
aacatgattctcagtcttgtccagg

SEQ ID NO: 23172 - DNA, 25 bp, Rattus norvegicus
aacatgattctctgtcttgtccagg

SEQ ID NO: 23173 - DNA, 25 bp, Rattus norvegicus
aacatgattttgagcctctgacaaa

SEQ ID NO: 23174 - DNA, 25 bp, Rattus norvegicus
aacatgattttgtgcctctgacaaa

SEQ ID NO: 23175 - DNA, 25 bp, Rattus norvegicus
aacatgcaaactactgtatctggaa

SEQ ID NO: 23176 - DNA, 25 bp, Rattus norvegicus
aacatgcaaacttctgtatctggaa

SEQ ID NO: 23177 - DNA, 25 bp, Rattus norvegicus
aacatgcaaatcacactaagcggtg

SEQ ID NO: 23178 - DNA, 25 bp, Rattus norvegicus
aacatgcaaatctcactaagcggtg

SEQ ID NO: 23179 - DNA, 25 bp, Rattus norvegicus
aacatgcactgcagggtactactgt

SEQ ID NO: 23180 - DNA, 25 bp, Rattus norvegicus
aacatgcactgcattgtcaactgaa

SEQ ID NO: 23181 - DNA, 25 bp, Rattus norvegicus
aacatgcactgctgggtactactgt

SEQ ID NO: 23182 - DNA, 25 bp, Rattus norvegicus
aacatgcactgctttgtcaactgaa

SEQ ID NO: 23183 - DNA, 25 bp, Rattus norvegicus
aacatgcagataattcctaccttaa

SEQ ID NO: 23184 - DNA, 25 bp, Rattus norvegicus
aacatgcagatatttcctaccttaa

SEQ ID NO: 23185 - DNA, 25 bp, Rattus norvegicus
aacatgcagatcaacagcgccagag

SEQ ID NO: 23186 - DNA, 25 bp, Rattus norvegicus
aacatgcagatctacagcgccagag

SEQ ID NO: 23187 - DNA, 25 bp, Rattus norvegicus
aacatgcagcagagtggccagcgct

SEQ ID NO: 23188 - DNA, 25 bp, Rattus norvegicus
aacatgcagcagatggcccgggaaa

SEQ ID NO: 23189 - DNA, 25 bp, Rattus norvegicus
aacatgcagcagtgtggccagcgct

SEQ ID NO: 23190 - DNA, 25 bp, Rattus norvegicus
aacatgcagcagttggcccgggaaa

SEQ ID NO: 23191 - DNA, 25 bp, Rattus norvegicus
aacatgcagcggcaaggcttgactc

SEQ ID NO: 23192 - DNA, 25 bp, Rattus norvegicus
aacatgcagcgggaaggcttgactc

SEQ ID NO: 23193 - DNA, 25 bp, Rattus norvegicus
aacatgcatctcactctgggtgtct

SEQ ID NO: 23194 - DNA, 25 bp, Rattus norvegicus
aacatgcatctctctctgggtgtct

SEQ ID NO: 23195 - DNA, 25 bp, Rattus norvegicus
aacatgcatgtgcttatatccaaac

SEQ ID NO: 23196 - DNA, 25 bp, Rattus norvegicus
aacatgcatgtggttatatccaaac

SEQ ID NO: 23197 - DNA, 25 bp, Rattus norvegicus
aacatgccaactcctgagttcctga

SEQ ID NO: 23198 - DNA, 25 bp, Rattus norvegicus
aacatgccaactgctgagttcctga

SEQ ID NO: 23199 - DNA, 25 bp, Rattus norvegicus
aacatgccacagctttagtgttcag

SEQ ID NO: 23200 - DNA, 25 bp, Rattus norvegicus
aacatgccacaggtttagtgttcag

SEQ ID NO: 23201 - DNA, 25 bp, Rattus norvegicus
aacatgccaggcacgatagcacatg

SEQ ID NO: 23202 - DNA, 25 bp, Rattus norvegicus
aacatgccaggctcgatagcacatg

SEQ ID NO: 23203 - DNA, 25 bp, Rattus norvegicus
aacatgccgaatccccaggaatgga

SEQ ID NO: 23204 - DNA, 25 bp, Rattus norvegicus
aacatgccgaatgcccaggaatgga

SEQ ID NO: 23205 - DNA, 25 bp, Rattus norvegicus
aacatgccgagtatgctctgctaca

SEQ ID NO: 23206 - DNA, 25 bp, Rattus norvegicus
aacatgccgagtttgctctgctaca

SEQ ID NO: 23207 - DNA, 25 bp, Rattus norvegicus
aacatgccggccattggtgagcttc

SEQ ID NO: 23208 - DNA, 25 bp, Rattus norvegicus
aacatgccggcctttggtgagcttc

SEQ ID NO: 23209 - DNA, 25 bp, Rattus norvegicus
aacatgcctcttagttgagcttgca

SEQ ID NO: 23210 - DNA, 25 bp, Rattus norvegicus
aacatgcctctttgttgagcttgca

SEQ ID NO: 23211 - DNA, 25 bp, Rattus norvegicus
aacatgcctggcaggtagaatcagt

SEQ ID NO: 23212 - DNA, 25 bp, Rattus norvegicus
aacatgcctggctggtagaatcagt

SEQ ID NO: 23213 - DNA, 25 bp, Rattus norvegicus
aacatgcggagcaactgccagggac

SEQ ID NO: 23214 - DNA, 25 bp, Rattus norvegicus
aacatgcggagctactgccagggac

SEQ ID NO: 23215 - DNA, 25 bp, Rattus norvegicus
aacatgcggctcacacagctgaagc

SEQ ID NO: 23216 - DNA, 25 bp, Rattus norvegicus
aacatgcggctctcacagctgaagc

SEQ ID NO: 23217 - DNA, 25 bp, Rattus norvegicus
aacatgcgtgcaaccacaggaagag

SEQ ID NO: 23218 - DNA, 25 bp, Rattus norvegicus
aacatgcgtgcatccacaggaagag

SEQ ID NO: 23219 - DNA, 25 bp, Rattus norvegicus
aacatgctaaggatttcgaggctca

SEQ ID NO: 23220 - DNA, 25 bp, Rattus norvegicus
aacatgctaaggttttcgaggctca

SEQ ID NO: 23221 - DNA, 25 bp, Rattus norvegicus
aacatgctaattatgtgtgctgcag

SEQ ID NO: 23222 - DNA, 25 bp, Rattus norvegicus
aacatgctaattttgtgtgctgcag

SEQ ID NO: 23223 - DNA, 25 bp, Rattus norvegicus
aacatgctacgacatgctggcctag

SEQ ID NO: 23224 - DNA, 25 bp, Rattus norvegicus
aacatgctacgagatgctggcctag

SEQ ID NO: 23225 - DNA, 25 bp, Rattus norvegicus
aacatgctatgtccttgctctgact

SEQ ID NO: 23226 - DNA, 25 bp, Rattus norvegicus
aacatgctatgtgcttgctctgact

SEQ ID NO: 23227 - DNA, 25 bp, Rattus norvegicus
aacatgctcgctctacattactaat

SEQ ID NO: 23228 - DNA, 25 bp, Rattus norvegicus
aacatgctcgctgtacattactaat

SEQ ID NO: 23229 - DNA, 25 bp, Rattus norvegicus
aacatgctctcgactctttattttc

SEQ ID NO: 23230 - DNA, 25 bp, Rattus norvegicus
aacatgctctcgtctctttattttc

SEQ ID NO: 23231 - DNA, 25 bp, Rattus norvegicus
aacatgctctgaacccttcatgtca

SEQ ID NO: 23232 - DNA, 25 bp, Rattus norvegicus
aacatgctctgatcccttcatgtca

SEQ ID NO: 23233 - DNA, 25 bp, Rattus norvegicus
aacatgctgaggatcgtggagccct

SEQ ID NO: 23234 - DNA, 25 bp, Rattus norvegicus
aacatgctgaggttcgtggagccct

SEQ ID NO: 23235 - DNA, 25 bp, Rattus norvegicus
aacatgctgcttcacagagtgacat

SEQ ID NO: 23236 - DNA, 25 bp, Rattus norvegicus
aacatgctgcttgacagagtgacat

SEQ ID NO: 23237 - DNA, 25 bp, Rattus norvegicus
aacatgctggacaagccatgcaaga

SEQ ID NO: 23238 - DNA, 25 bp, Rattus norvegicus
aacatgctggactagccatgcaaga

SEQ ID NO: 23239 - DNA, 25 bp, Rattus norvegicus
aacatgctggccctaggagtctgga

SEQ ID NO: 23240 - DNA, 25 bp, Rattus norvegicus
aacatgctggccgtaggagtctgga

SEQ ID NO: 23241 - DNA, 25 bp, Rattus norvegicus
aacatgctgggcctgtcgcttttct

SEQ ID NO: 23242 - DNA, 25 bp, Rattus norvegicus
aacatgctgggcgtgtcgcttttct

SEQ ID NO: 23243 - DNA, 25 bp, Rattus norvegicus
aacatgctggtcctgatctggcact

SEQ ID NO: 23244 - DNA, 25 bp, Rattus norvegicus
aacatgctggtcgtgatctggcact

SEQ ID NO: 23245 - DNA, 25 bp, Rattus norvegicus
aacatgctgtttacaagtccgccag

SEQ ID NO: 23246 - DNA, 25 bp, Rattus norvegicus
aacatgctgttttcaagtccgccag

SEQ ID NO: 23247 - DNA, 25 bp, Rattus norvegicus
aacatgcttcatcaatctttcttaa

SEQ ID NO: 23248 - DNA, 25 bp, Rattus norvegicus
aacatgcttcatgaatctttcttaa

SEQ ID NO: 23249 - DNA, 25 bp, Rattus norvegicus
aacatgcttgcaaatcacccttgga

SEQ ID NO: 23250 - DNA, 25 bp, Rattus norvegicus
aacatgcttgcatatcacccttgga

SEQ ID NO: 23251 - DNA, 25 bp, Rattus norvegicus
aacatgctttagatcggattccaag

SEQ ID NO: 23252 - DNA, 25 bp, Rattus norvegicus
aacatgctttagttcggattccaag

SEQ ID NO: 23253 - DNA, 25 bp, Rattus norvegicus
aacatgctttatctgtgggcgtcat

SEQ ID NO: 23254 - DNA, 25 bp, Rattus norvegicus
aacatgctttatgtgtgggcgtcat

SEQ ID NO: 23255 - DNA, 25 bp, Rattus norvegicus
aacatggacacacgaatcttcttga

SEQ ID NO: 23256 - DNA, 25 bp, Rattus norvegicus
aacatggacacaggaatcttcttga

SEQ ID NO: 23257 - DNA, 25 bp, Rattus norvegicus
aacatggacccacctgcttttcaga

SEQ ID NO: 23258 - DNA, 25 bp, Rattus norvegicus
aacatggacccagctgcttttcaga

SEQ ID NO: 23259 - DNA, 25 bp, Rattus norvegicus
aacatggacctaaagctcctggagc

SEQ ID NO: 23260 - DNA, 25 bp, Rattus norvegicus
aacatggacctatagctcctggagc

SEQ ID NO: 23261 - DNA, 25 bp, Rattus norvegicus
aacatggacggacccttcttggtgc

SEQ ID NO: 23262 - DNA, 25 bp, Rattus norvegicus
aacatggacggagccttcttggtgc

SEQ ID NO: 23263 - DNA, 25 bp, Rattus norvegicus
aacatggacttgcttagggtgacag

SEQ ID NO: 23264 - DNA, 25 bp, Rattus norvegicus
aacatggacttggttagggtgacag

SEQ ID NO: 23265 - DNA, 25 bp, Rattus norvegicus
aacatggagcacacttctcattcca

SEQ ID NO: 23266 - DNA, 25 bp, Rattus norvegicus
aacatggagcactcttctcattcca

SEQ ID NO: 23267 - DNA, 25 bp, Rattus norvegicus
aacatggagcagaccatcaaggacc

SEQ ID NO: 23268 - DNA, 25 bp, Rattus norvegicus
aacatggagcagtccatcaaggacc

SEQ ID NO: 23269 - DNA, 25 bp, Rattus norvegicus
aacatggaggacacttccagcatcc

SEQ ID NO: 23270 - DNA, 25 bp, Rattus norvegicus
aacatggaggactcttccagcatcc

SEQ ID NO: 23271 - DNA, 25 bp, Rattus norvegicus
aacatggaggtcactgaggcctgaa

SEQ ID NO: 23272 - DNA, 25 bp, Rattus norvegicus
aacatggaggtctctgaggcctgaa

SEQ ID NO: 23273 - DNA, 25 bp, Rattus norvegicus
aacatggagtcaccagcacccttat

SEQ ID NO: 23274 - DNA, 25 bp, Rattus norvegicus
aacatggagtcagcagcacccttat

SEQ ID NO: 23275 - DNA, 25 bp, Rattus norvegicus
aacatggagtgtattttctaatact

SEQ ID NO: 23276 - DNA, 25 bp, Rattus norvegicus
aacatggagtgttttttctaatact

SEQ ID NO: 23277 - DNA, 25 bp, Rattus norvegicus
aacatggatgtcctcaggtgcccaa

SEQ ID NO: 23278 - DNA, 25 bp, Rattus norvegicus
aacatggatgtcgtcaggtgcccaa

SEQ ID NO: 23279 - DNA, 25 bp, Rattus norvegicus
aacatggatgtgcattcgtgtaatc

SEQ ID NO: 23280 - DNA, 25 bp, Rattus norvegicus
aacatggatgtggattcgtgtaatc

SEQ ID NO: 23281 - DNA, 25 bp, Rattus norvegicus
aacatggattagacctgagcctcaa

SEQ ID NO: 23282 - DNA, 25 bp, Rattus norvegicus
aacatggattagtcctgagcctcaa

SEQ ID NO: 23283 - DNA, 25 bp, Rattus norvegicus
aacatggcaaggaggcgagcctgac

SEQ ID NO: 23284 - DNA, 25 bp, Rattus norvegicus
aacatggcaaggtggcgagcctgac

SEQ ID NO: 23285 - DNA, 25 bp, Rattus norvegicus
aacatggcactgacctgttctccag

SEQ ID NO: 23286 - DNA, 25 bp, Rattus norvegicus
aacatggcactgtcctgttctccag

SEQ ID NO: 23287 - DNA, 25 bp, Rattus norvegicus
aacatggcaggcactccaaggtcag

SEQ ID NO: 23288 - DNA, 25 bp, Rattus norvegicus
aacatggcaggctctccaaggtcag

SEQ ID NO: 23289 - DNA, 25 bp, Rattus norvegicus
aacatggcatcgctctgggcaagag

SEQ ID NO: 23290 - DNA, 25 bp, Rattus norvegicus
aacatggcatcggtctgggcaagag

SEQ ID NO: 23291 - DNA, 25 bp, Rattus norvegicus
aacatggccagaacccaggtctgtg

SEQ ID NO: 23292 - DNA, 25 bp, Rattus norvegicus
aacatggccagatcccaggtctgtg

SEQ ID NO: 23293 - DNA, 25 bp, Rattus norvegicus
aacatggccgacctgcagtgcgagc

SEQ ID NO: 23294 - DNA, 25 bp, Rattus norvegicus
aacatggccgacgtgcagtgcgagc

SEQ ID NO: 23295 - DNA, 25 bp, Rattus norvegicus
aacatggcgagtcggcttttcacct

SEQ ID NO: 23296 - DNA, 25 bp, Rattus norvegicus
aacatggcgagtgggcttttcacct

SEQ ID NO: 23297 - DNA, 25 bp, Rattus norvegicus
aacatggcggaaccctttctgtctt

SEQ ID NO: 23298 - DNA, 25 bp, Rattus norvegicus
aacatggcggaagcctttctgtctt

SEQ ID NO: 23299 - DNA, 25 bp, Rattus norvegicus
aacatggcggacactctgtgagcga

SEQ ID NO: 23300 - DNA, 25 bp, Rattus norvegicus
aacatggcggactctctgtgagcga

SEQ ID NO: 23301 - DNA, 25 bp, Rattus norvegicus
aacatggcggccagtgatgccctta

SEQ ID NO: 23302 - DNA, 25 bp, Rattus norvegicus
aacatggcggcctgtgatgccctta

SEQ ID NO: 23303 - DNA, 25 bp, Rattus norvegicus
aacatggctgcactagacttcttta

SEQ ID NO: 23304 - DNA, 25 bp, Rattus norvegicus
aacatggctgcagtagacttcttta

SEQ ID NO: 23305 - DNA, 25 bp, Rattus norvegicus
aacatggctggcaagactttgagaa

SEQ ID NO: 23306 - DNA, 25 bp, Rattus norvegicus
aacatggctggctagactttgagaa

SEQ ID NO: 23307 - DNA, 25 bp, Rattus norvegicus
aacatggctgtgagttctgtcttcc

SEQ ID NO: 23308 - DNA, 25 bp, Rattus norvegicus
aacatggctgtgtgttctgtcttcc

SEQ ID NO: 23309 - DNA, 25 bp, Rattus norvegicus
aacatggcttcaactccagggagtt

SEQ ID NO: 23310 - DNA, 25 bp, Rattus norvegicus
aacatggcttcatctccagggagtt

SEQ ID NO: 23311 - DNA, 25 bp, Rattus norvegicus
aacatggctttcctagctctcagta

SEQ ID NO: 23312 - DNA, 25 bp, Rattus norvegicus
aacatggctttcgtagctctcagta

SEQ ID NO: 23313 - DNA, 25 bp, Rattus norvegicus
aacatgggacctcaaaatcagtgaa

SEQ ID NO: 23314 - DNA, 25 bp, Rattus norvegicus
aacatgggacctgaaaatcagtgaa

SEQ ID NO: 23315 - DNA, 25 bp, Rattus norvegicus
aacatgggactaccctttgaattct

SEQ ID NO: 23316 - DNA, 25 bp, Rattus norvegicus
aacatgggactagcctttgaattct

SEQ ID NO: 23317 - DNA, 25 bp, Rattus norvegicus
aacatgggagctacaccttgatcct

SEQ ID NO: 23318 - DNA, 25 bp, Rattus norvegicus
aacatgggagcttcaccttgatcct

SEQ ID NO: 23319 - DNA, 25 bp, Rattus norvegicus
aacatgggatggctggccctgctcc

SEQ ID NO: 23320 - DNA, 25 bp, Rattus norvegicus
aacatgggatgggtggccctgctcc

SEQ ID NO: 23321 - DNA, 25 bp, Rattus norvegicus
aacatgggcagcaatggaagattcc

SEQ ID NO: 23322 - DNA, 25 bp, Rattus norvegicus
aacatgggcagctatggaagattcc

SEQ ID NO: 23323 - DNA, 25 bp, Rattus norvegicus
aacatgggcgtcatgtactgtgagt

SEQ ID NO: 23324 - DNA, 25 bp, Rattus norvegicus
aacatgggcgtcttgtactgtgagt

SEQ ID NO: 23325 - DNA, 25 bp, Rattus norvegicus
aacatgggtcggagatgccaggctc

SEQ ID NO: 23326 - DNA, 25 bp, Rattus norvegicus
aacatgggtcggtgatgccaggctc

SEQ ID NO: 23327 - DNA, 25 bp, Rattus norvegicus
aacatgggttccagcacatggctcg

SEQ ID NO: 23328 - DNA, 25 bp, Rattus norvegicus
aacatgggttcctgcacatggctcg

SEQ ID NO: 23329 - DNA, 25 bp, Rattus norvegicus
aacatggtaggtcacaaaaaaggat

SEQ ID NO: 23330 - DNA, 25 bp, Rattus norvegicus
aacatggtaggtgacaaaaaaggat

SEQ ID NO: 23331 - DNA, 25 bp, Rattus norvegicus
aacatggtcactacttgtcttctgc

SEQ ID NO: 23332 - DNA, 25 bp, Rattus norvegicus
aacatggtcacttcttgtcttctgc

SEQ ID NO: 23333 - DNA, 25 bp, Rattus norvegicus
aacatggtcaggaccgtcacagaaa

SEQ ID NO: 23334 - DNA, 25 bp, Rattus norvegicus
aacatggtcaggtccgtcacagaaa

SEQ ID NO: 23335 - DNA, 25 bp, Rattus norvegicus
aacatggtctcgacctcaatgagga

SEQ ID NO: 23336 - DNA, 25 bp, Rattus norvegicus
aacatggtctcgtcctcaatgagga

SEQ ID NO: 23337 - DNA, 25 bp, Rattus norvegicus
aacatggtgcctatatctgagagac

SEQ ID NO: 23338 - DNA, 25 bp, Rattus norvegicus
aacatggtgcctcctaaatgtacat

SEQ ID NO: 23339 - DNA, 25 bp, Rattus norvegicus
aacatggtgcctgctaaatgtacat

SEQ ID NO: 23340 - DNA, 25 bp, Rattus norvegicus
aacatggtgcctttatctgagagac

SEQ ID NO: 23341 - DNA, 25 bp, Rattus norvegicus
aacatggtgctgctaatcgtcaata

SEQ ID NO: 23342 - DNA, 25 bp, Rattus norvegicus
aacatggtgctggtaatcgtcaata

SEQ ID NO: 23343 - DNA, 25 bp, Rattus norvegicus
aacatggtggcgatgcctggtttta

SEQ ID NO: 23344 - DNA, 25 bp, Rattus norvegicus
aacatggtggcgttgcctggtttta

SEQ ID NO: 23345 - DNA, 25 bp, Rattus norvegicus
aacatggtggctaccgaatgcggct

SEQ ID NO: 23346 - DNA, 25 bp, Rattus norvegicus
aacatggtggcttccgaatgcggct

SEQ ID NO: 23347 - DNA, 25 bp, Rattus norvegicus
aacatggtgggcctagctaatctcc

SEQ ID NO: 23348 - DNA, 25 bp, Rattus norvegicus
aacatggtgggcgtagctaatctcc

SEQ ID NO: 23349 - DNA, 25 bp, Rattus norvegicus
aacatggtgtagctgctgcggcctc

SEQ ID NO: 23350 - DNA, 25 bp, Rattus norvegicus
aacatggtgtaggtgctgcggcctc

SEQ ID NO: 23351 - DNA, 25 bp, Rattus norvegicus
aacatggtgtgaactgttccattca

SEQ ID NO: 23352 - DNA, 25 bp, Rattus norvegicus
aacatggtgtgatctgttccattca

SEQ ID NO: 23353 - DNA, 25 bp, Rattus norvegicus
aacatggttccacgctcttcagtga

SEQ ID NO: 23354 - DNA, 25 bp, Rattus norvegicus
aacatggttccaggctcttcagtga

SEQ ID NO: 23355 - DNA, 25 bp, Rattus norvegicus
aacatggttgtcatggtttccctct

SEQ ID NO: 23356 - DNA, 25 bp, Rattus norvegicus
aacatggttgtcttggtttccctct

SEQ ID NO: 23357 - DNA, 25 bp, Rattus norvegicus
aacatggttgttccactatgccttc

SEQ ID NO: 23358 - DNA, 25 bp, Rattus norvegicus
aacatggttgttgcactatgccttc

SEQ ID NO: 23359 - DNA, 25 bp, Rattus norvegicus
aacatggtttagaaccttcccactg

SEQ ID NO: 23360 - DNA, 25 bp, Rattus norvegicus
aacatggtttagtaccttcccactg

SEQ ID NO: 23361 - DNA, 25 bp, Rattus norvegicus
aacatgtaagtaactccccaggctc

SEQ ID NO: 23362 - DNA, 25 bp, Rattus norvegicus
aacatgtaagtatctccccaggctc

SEQ ID NO: 23363 - DNA, 25 bp, Rattus norvegicus
aacatgtaatctctcatttttcatc

SEQ ID NO: 23364 - DNA, 25 bp, Rattus norvegicus
aacatgtaatctgtcatttttcatc

SEQ ID NO: 23365 - DNA, 25 bp, Rattus norvegicus
aacatgtacattccaaggctgagca

SEQ ID NO: 23366 - DNA, 25 bp, Rattus norvegicus
aacatgtacattgcaaggctgagca

SEQ ID NO: 23367 - DNA, 25 bp, Rattus norvegicus
aacatgtactacatcccctcaaaga

SEQ ID NO: 23368 - DNA, 25 bp, Rattus norvegicus
aacatgtactacatctcagagcttg

SEQ ID NO: 23369 - DNA, 25 bp, Rattus norvegicus
aacatgtactacttcccctcaaaga

SEQ ID NO: 23370 - DNA, 25 bp, Rattus norvegicus
aacatgtactacttctcagagcttg

SEQ ID NO: 23371 - DNA, 25 bp, Rattus norvegicus
aacatgtcagcccagaagtcggagc

SEQ ID NO: 23372 - DNA, 25 bp, Rattus norvegicus
aacatgtcagccgagaagtcggagc

SEQ ID NO: 23373 - DNA, 25 bp, Rattus norvegicus
aacatgtcagctcggtagagatcac

SEQ ID NO: 23374 - DNA, 25 bp, Rattus norvegicus
aacatgtcagctgggtagagatcac

SEQ ID NO: 23375 - DNA, 25 bp, Rattus norvegicus
aacatgtcccatcaactgtgacgcc

SEQ ID NO: 23376 - DNA, 25 bp, Rattus norvegicus
aacatgtcccatgaactgtgacgcc

SEQ ID NO: 23377 - DNA, 25 bp, Rattus norvegicus
aacatgtccgtcaaggccatgcgct

SEQ ID NO: 23378 - DNA, 25 bp, Rattus norvegicus
aacatgtccgtctaggccatgcgct

SEQ ID NO: 23379 - DNA, 25 bp, Rattus norvegicus
aacatgtcctgcctattttctgtca

SEQ ID NO: 23380 - DNA, 25 bp, Rattus norvegicus
aacatgtcctgcgtattttctgtca

SEQ ID NO: 23381 - DNA, 25 bp, Rattus norvegicus
aacatgtcctttaccacctaaaatg

SEQ ID NO: 23382 - DNA, 25 bp, Rattus norvegicus
aacatgtccttttccacctaaaatg

SEQ ID NO: 23383 - DNA, 25 bp, Rattus norvegicus
aacatgtgacgcaaagagccccttt

SEQ ID NO: 23384 - DNA, 25 bp, Rattus norvegicus
aacatgtgacgctaagagccccttt

SEQ ID NO: 23385 - DNA, 25 bp, Rattus norvegicus
aacatgtgcccgaatactcagatcc

SEQ ID NO: 23386 - DNA, 25 bp, Rattus norvegicus
aacatgtgcccgtatactcagatcc

SEQ ID NO: 23387 - DNA, 25 bp, Rattus norvegicus
aacatgtgcctactcttgggcttaa

SEQ ID NO: 23388 - DNA, 25 bp, Rattus norvegicus
aacatgtgcctagtcttgggcttaa

SEQ ID NO: 23389 - DNA, 25 bp, Rattus norvegicus
aacatgtgcctgcaagcccttttca

SEQ ID NO: 23390 - DNA, 25 bp, Rattus norvegicus
aacatgtgcctggaagcccttttca

SEQ ID NO: 23391 - DNA, 25 bp, Rattus norvegicus
aacatgtgctggctatcctagcaac

SEQ ID NO: 23392 - DNA, 25 bp, Rattus norvegicus
aacatgtgctgggtatcctagcaac

SEQ ID NO: 23393 - DNA, 25 bp, Rattus norvegicus
aacatgtgcttaacgatgtgggaac

SEQ ID NO: 23394 - DNA, 25 bp, Rattus norvegicus
aacatgtgcttatcgatgtgggaac

SEQ ID NO: 23395 - DNA, 25 bp, Rattus norvegicus
aacatgtgcttccaggacttccaga

SEQ ID NO: 23396 - DNA, 25 bp, Rattus norvegicus
aacatgtgcttcgaggacttccaga

SEQ ID NO: 23397 - DNA, 25 bp, Rattus norvegicus
aacatgtgctttaatgccccacaca

SEQ ID NO: 23398 - DNA, 25 bp, Rattus norvegicus
aacatgtgcttttatgccccacaca

SEQ ID NO: 23399 - DNA, 25 bp, Rattus norvegicus
aacatgtggactcaggtttttacca

SEQ ID NO: 23400 - DNA, 25 bp, Rattus norvegicus
aacatgtggactgaggtttttacca

SEQ ID NO: 23401 - DNA, 25 bp, Rattus norvegicus
aacatgtgggtaatccgtcctgggc

SEQ ID NO: 23402 - DNA, 25 bp, Rattus norvegicus
aacatgtgggtattccgtcctgggc

SEQ ID NO: 23403 - DNA, 25 bp, Rattus norvegicus
aacatgtggttcactgcttgagtct

SEQ ID NO: 23404 - DNA, 25 bp, Rattus norvegicus
aacatgtggttctctgcttgagtct

SEQ ID NO: 23405 - DNA, 25 bp, Rattus norvegicus
aacatgtgtgctattgaatttccta

SEQ ID NO: 23406 - DNA, 25 bp, Rattus norvegicus
aacatgtgtgcttttgaatttccta

SEQ ID NO: 23407 - DNA, 25 bp, Rattus norvegicus
aacatgtgttctctgaagccatcct

SEQ ID NO: 23408 - DNA, 25 bp, Rattus norvegicus
aacatgtgttctgtgaagccatcct

SEQ ID NO: 23409 - DNA, 25 bp, Rattus norvegicus
aacatgtgttgcaagacagtcccat

SEQ ID NO: 23410 - DNA, 25 bp, Rattus norvegicus
aacatgtgttgctagacagtcccat

SEQ ID NO: 23411 - DNA, 25 bp, Rattus norvegicus
aacatgttacctcacgcccctatat

SEQ ID NO: 23412 - DNA, 25 bp, Rattus norvegicus
aacatgttacctgacgcccctatat

SEQ ID NO: 23413 - DNA, 25 bp, Rattus norvegicus
aacatgttactgcaccggaaatccc

SEQ ID NO: 23414 - DNA, 25 bp, Rattus norvegicus
aacatgttactggaccggaaatccc

SEQ ID NO: 23415 - DNA, 25 bp, Rattus norvegicus
aacatgttctacaggatcatctaca

SEQ ID NO: 23416 - DNA, 25 bp, Rattus norvegicus
aacatgttctactggatcatctaca

SEQ ID NO: 23417 - DNA, 25 bp, Rattus norvegicus
aacatgttctctcagcacaaagcag

SEQ ID NO: 23418 - DNA, 25 bp, Rattus norvegicus
aacatgttctctgagcacaaagcag

SEQ ID NO: 23419 - DNA, 25 bp, Rattus norvegicus
aacatgttggcacaaattccggatc

SEQ ID NO: 23420 - DNA, 25 bp, Rattus norvegicus
aacatgttggcagaaattccggatc

SEQ ID NO: 23421 - DNA, 25 bp, Rattus norvegicus
aacatgtttagcaagacccagagaa

SEQ ID NO: 23422 - DNA, 25 bp, Rattus norvegicus
aacatgtttagctagacccagagaa

SEQ ID NO: 23423 - DNA, 25 bp, Rattus norvegicus
aacatgtttatgctatccattctgt

SEQ ID NO: 23424 - DNA, 25 bp, Rattus norvegicus
aacatgtttatggtatccattctgt

SEQ ID NO: 23425 - DNA, 25 bp, Rattus norvegicus
aacattacaaatcaagccgccttct

SEQ ID NO: 23426 - DNA, 25 bp, Rattus norvegicus
aacattacaaatgaagccgccttct

SEQ ID NO: 23427 - DNA, 25 bp, Rattus norvegicus
aacattacactaaccagcagctcaa

SEQ ID NO: 23428 - DNA, 25 bp, Rattus norvegicus
aacattacactatccagcagctcaa

SEQ ID NO: 23429 - DNA, 25 bp, Rattus norvegicus
aacattacactgactgtatttagat

SEQ ID NO: 23430 - DNA, 25 bp, Rattus norvegicus
aacattacactgtctgtatttagat

SEQ ID NO: 23431 - DNA, 25 bp, Rattus norvegicus
aacattacagcgattgcctcaaagt

SEQ ID NO: 23432 - DNA, 25 bp, Rattus norvegicus
aacattacagcgtttgcctcaaagt

SEQ ID NO: 23433 - DNA, 25 bp, Rattus norvegicus
aacattacagtccatgtttggcatg

SEQ ID NO: 23434 - DNA, 25 bp, Rattus norvegicus
aacattacagtcgatgtttggcatg

SEQ ID NO: 23435 - DNA, 25 bp, Rattus norvegicus
aacattaccaacactgggatgggca

SEQ ID NO: 23436 - DNA, 25 bp, Rattus norvegicus
aacattaccaactctgggatgggca

SEQ ID NO: 23437 - DNA, 25 bp, Rattus norvegicus
aacattactcctattcacgttgaag

SEQ ID NO: 23438 - DNA, 25 bp, Rattus norvegicus
aacattactccttttcacgttgaag

SEQ ID NO: 23439 - DNA, 25 bp, Rattus norvegicus
aacattactcttcgttgggtctgga

SEQ ID NO: 23440 - DNA, 25 bp, Rattus norvegicus
aacattactcttggttgggtctgga

SEQ ID NO: 23441 - DNA, 25 bp, Rattus norvegicus
aacattactgcaataactccaccga

SEQ ID NO: 23442 - DNA, 25 bp, Rattus norvegicus
aacattactgcattaactccaccga

SEQ ID NO: 23443 - DNA, 25 bp, Rattus norvegicus
aacattactggtatgttctgccatt

SEQ ID NO: 23444 - DNA, 25 bp, Rattus norvegicus
aacattactggtttgttctgccatt

SEQ ID NO: 23445 - DNA, 25 bp, Rattus norvegicus
aacattagagtcagaatcctggaca

SEQ ID NO: 23446 - DNA, 25 bp, Rattus norvegicus
aacattagagtctgaatcctggaca

SEQ ID NO: 23447 - DNA, 25 bp, Rattus norvegicus
aacattagcaatctcccatcaggaa

SEQ ID NO: 23448 - DNA, 25 bp, Rattus norvegicus
aacattagcaatgtcccatcaggaa

SEQ ID NO: 23449 - DNA, 25 bp, Rattus norvegicus
aacattagcatcaactcggcaatcc

SEQ ID NO: 23450 - DNA, 25 bp, Rattus norvegicus
aacattagcatctactcggcaatcc

SEQ ID NO: 23451 - DNA, 25 bp, Rattus norvegicus
aacattatattgcaaggcatagcat

SEQ ID NO: 23452 - DNA, 25 bp, Rattus norvegicus
aacattatattggaaggcatagcat

SEQ ID NO: 23453 - DNA, 25 bp, Rattus norvegicus
aacattatctcaacttgccaagcga

SEQ ID NO: 23454 - DNA, 25 bp, Rattus norvegicus
aacattatctcatcttgccaagcga

SEQ ID NO: 23455 - DNA, 25 bp, Rattus norvegicus
aacattatcttcagtctttgcccac

SEQ ID NO: 23456 - DNA, 25 bp, Rattus norvegicus
aacattatcttctgtctttgcccac

SEQ ID NO: 23457 - DNA, 25 bp, Rattus norvegicus
aacattatgtttcttgcctcttcag

SEQ ID NO: 23458 - DNA, 25 bp, Rattus norvegicus
aacattatgtttgttgcctcttcag

SEQ ID NO: 23459 - DNA, 25 bp, Rattus norvegicus
aacattatttctctactcagcctgt

SEQ ID NO: 23460 - DNA, 25 bp, Rattus norvegicus
aacattatttctgtactcagcctgt

SEQ ID NO: 23461 - DNA, 25 bp, Rattus norvegicus
aacattatttgaaccatttgccatt

SEQ ID NO: 23462 - DNA, 25 bp, Rattus norvegicus
aacattatttgatccatttgccatt

SEQ ID NO: 23463 - DNA, 25 bp, Rattus norvegicus
aacattcaacacacttcttacaggt

SEQ ID NO: 23464 - DNA, 25 bp, Rattus norvegicus
aacattcaacactcttcttacaggt

SEQ ID NO: 23465 - DNA, 25 bp, Rattus norvegicus
aacattcaccctactgggagtggcc

SEQ ID NO: 23466 - DNA, 25 bp, Rattus norvegicus
aacattcacccttctgggagtggcc

SEQ ID NO: 23467 - DNA, 25 bp, Rattus norvegicus
aacattcactggctctactttatag

SEQ ID NO: 23468 - DNA, 25 bp, Rattus norvegicus
aacattcactgggtctactttatag

SEQ ID NO: 23469 - DNA, 25 bp, Rattus norvegicus
aacattcaggttcctgactttgaaa

SEQ ID NO: 23470 - DNA, 25 bp, Rattus norvegicus
aacattcaggttgctgactttgaaa

SEQ ID NO: 23471 - DNA, 25 bp, Rattus norvegicus
aacattcagtgtctactctcagctg

SEQ ID NO: 23472 - DNA, 25 bp, Rattus norvegicus
aacattcagtgtgtactctcagctg

SEQ ID NO: 23473 - DNA, 25 bp, Rattus norvegicus
aacattcatgctagtcagcgctctg

SEQ ID NO: 23474 - DNA, 25 bp, Rattus norvegicus
aacattcatgcttgtcagcgctctg

SEQ ID NO: 23475 - DNA, 25 bp, Rattus norvegicus
aacattcatgttatatacctcaagt

SEQ ID NO: 23476 - DNA, 25 bp, Rattus norvegicus
aacattcatgttttatacctcaagt

SEQ ID NO: 23477 - DNA, 25 bp, Rattus norvegicus
aacattccagttccaaagcattttt

SEQ ID NO: 23478 - DNA, 25 bp, Rattus norvegicus
aacattccagttgcaaagcattttt

SEQ ID NO: 23479 - DNA, 25 bp, Rattus norvegicus
aacattcccaccctaggcgagtgca

SEQ ID NO: 23480 - DNA, 25 bp, Rattus norvegicus
aacattcccaccgtaggcgagtgca

SEQ ID NO: 23481 - DNA, 25 bp, Rattus norvegicus
aacattcccgtcatgcgtgtgtgca

SEQ ID NO: 23482 - DNA, 25 bp, Rattus norvegicus
aacattcccgtcttgcgtgtgtgca

SEQ ID NO: 23483 - DNA, 25 bp, Rattus norvegicus
aacattccctatctacttgggcaac

SEQ ID NO: 23484 - DNA, 25 bp, Rattus norvegicus
aacattccctatgtacttgggcaac

SEQ ID NO: 23485 - DNA, 25 bp, Rattus norvegicus
aacattccctctccttataccaaat

SEQ ID NO: 23486 - DNA, 25 bp, Rattus norvegicus
aacattccctctgcttataccaaat

SEQ ID NO: 23487 - DNA, 25 bp, Rattus norvegicus
aacattcctaagatccatacgtccg

SEQ ID NO: 23488 - DNA, 25 bp, Rattus norvegicus
aacattcctaagttccatacgtccg

SEQ ID NO: 23489 - DNA, 25 bp, Rattus norvegicus
aacattcctaatcaggtgtcctccg

SEQ ID NO: 23490 - DNA, 25 bp, Rattus norvegicus
aacattcctaatgaggtgtcctccg

SEQ ID NO: 23491 - DNA, 25 bp, Rattus norvegicus
aacattcctcaaagggctctttctt

SEQ ID NO: 23492 - DNA, 25 bp, Rattus norvegicus
aacattcctcaatgggctctttctt

SEQ ID NO: 23493 - DNA, 25 bp, Rattus norvegicus
aacattcctctcatgggccaatgaa

SEQ ID NO: 23494 - DNA, 25 bp, Rattus norvegicus
aacattcctctcttgggccaatgaa

SEQ ID NO: 23495 - DNA, 25 bp, Rattus norvegicus
aacattcctggacttctgtaaagaa

SEQ ID NO: 23496 - DNA, 25 bp, Rattus norvegicus
aacattcctggagttctgtaaagaa

SEQ ID NO: 23497 - DNA, 25 bp, Rattus norvegicus
aacattcctgtgagcgtttgtctaa

SEQ ID NO: 23498 - DNA, 25 bp, Rattus norvegicus
aacattcctgtgtgcgtttgtctaa

SEQ ID NO: 23499 - DNA, 25 bp, Rattus norvegicus
aacattccttgcagagtttgtagct

SEQ ID NO: 23500 - DNA, 25 bp, Rattus norvegicus
aacattccttgctgagtttgtagct

SEQ ID NO: 23501 - DNA, 25 bp, Rattus norvegicus
aacattcctttacctgtagcataca

SEQ ID NO: 23502 - DNA, 25 bp, Rattus norvegicus
aacattcctttagctgtagcataca

SEQ ID NO: 23503 - DNA, 25 bp, Rattus norvegicus
aacattcgaatacgccacttctgct

SEQ ID NO: 23504 - DNA, 25 bp, Rattus norvegicus
aacattcgaataggccacttctgct

SEQ ID NO: 23505 - DNA, 25 bp, Rattus norvegicus
aacattcgtcagatattagctctct

SEQ ID NO: 23506 - DNA, 25 bp, Rattus norvegicus
aacattcgtcagttattagctctct

SEQ ID NO: 23507 - DNA, 25 bp, Rattus norvegicus
aacattctactaactcttatcctaa

SEQ ID NO: 23508 - DNA, 25 bp, Rattus norvegicus
aacattctactatctcttatcctaa

SEQ ID NO: 23509 - DNA, 25 bp, Rattus norvegicus
aacattctattcacttcacagtttg

SEQ ID NO: 23510 - DNA, 25 bp, Rattus norvegicus
aacattctattctcttcacagtttg

SEQ ID NO: 23511 - DNA, 25 bp, Rattus norvegicus
aacattctcattaggtaacttactg

SEQ ID NO: 23512 - DNA, 25 bp, Rattus norvegicus
aacattctcatttggtaacttactg

SEQ ID NO: 23513 - DNA, 25 bp, Rattus norvegicus
aacattctccatcttctataacaac

SEQ ID NO: 23514 - DNA, 25 bp, Rattus norvegicus
aacattctccatgttctataacaac

SEQ ID NO: 23515 - DNA, 25 bp, Rattus norvegicus
aacattctctcaacatacttagcct

SEQ ID NO: 23516 - DNA, 25 bp, Rattus norvegicus
aacattctctcatcatacttagcct

SEQ ID NO: 23517 - DNA, 25 bp, Rattus norvegicus
aacattctgcacagcgagtctacga

SEQ ID NO: 23518 - DNA, 25 bp, Rattus norvegicus
aacattctgcactgcgagtctacga

SEQ ID NO: 23519 - DNA, 25 bp, Rattus norvegicus
aacattctggctaatgcctcacatt

SEQ ID NO: 23520 - DNA, 25 bp, Rattus norvegicus
aacattctggcttatgcctcacatt

SEQ ID NO: 23521 - DNA, 25 bp, Rattus norvegicus
aacattctgggtcaggatctggcct

SEQ ID NO: 23522 - DNA, 25 bp, Rattus norvegicus
aacattctgggtcttgtcccatcga

SEQ ID NO: 23523 - DNA, 25 bp, Rattus norvegicus
aacattctgggtgaggatctggcct

SEQ ID NO: 23524 - DNA, 25 bp, Rattus norvegicus
aacattctgggtgttgtcccatcga

SEQ ID NO: 23525 - DNA, 25 bp, Rattus norvegicus
aacattctgtcaacattagcctatt

SEQ ID NO: 23526 - DNA, 25 bp, Rattus norvegicus
aacattctgtcatcattagcctatt

SEQ ID NO: 23527 - DNA, 25 bp, Rattus norvegicus
aacattctgtgtactagctctggtc

SEQ ID NO: 23528 - DNA, 25 bp, Rattus norvegicus
aacattctgtgttctagctctggtc

SEQ ID NO: 23529 - DNA, 25 bp, Rattus norvegicus
aacattcttcctcccatagttcaaa

SEQ ID NO: 23530 - DNA, 25 bp, Rattus norvegicus
aacattcttcctgccatagttcaaa

SEQ ID NO: 23531 - DNA, 25 bp, Rattus norvegicus
aacattcttgaaattgctgcatact

SEQ ID NO: 23532 - DNA, 25 bp, Rattus norvegicus
aacattcttgaatttgctgcatact

SEQ ID NO: 23533 - DNA, 25 bp, Rattus norvegicus
aacattctttagaccttaaccacag

SEQ ID NO: 23534 - DNA, 25 bp, Rattus norvegicus
aacattctttagtccttaaccacag

SEQ ID NO: 23535 - DNA, 25 bp, Rattus norvegicus
aacattgaattcaaccctcccaaga

SEQ ID NO: 23536 - DNA, 25 bp, Rattus norvegicus
aacattgaattccagtactccacgc

SEQ ID NO: 23537 - DNA, 25 bp, Rattus norvegicus
aacattgaattcgagtactccacgc

SEQ ID NO: 23538 - DNA, 25 bp, Rattus norvegicus
aacattgaattctaccctcccaaga

SEQ ID NO: 23539 - DNA, 25 bp, Rattus norvegicus
aacattgaatttacagatttcctgg

SEQ ID NO: 23540 - DNA, 25 bp, Rattus norvegicus
aacattgaattttcagatttcctgg

SEQ ID NO: 23541 - DNA, 25 bp, Rattus norvegicus
aacattgacatcctcactggggcac

SEQ ID NO: 23542 - DNA, 25 bp, Rattus norvegicus
aacattgacatcgtcactggggcac

SEQ ID NO: 23543 - DNA, 25 bp, Rattus norvegicus
aacattgacttcagcaacgccgaca

SEQ ID NO: 23544 - DNA, 25 bp, Rattus norvegicus
aacattgacttctgcaacgccgaca

SEQ ID NO: 23545 - DNA, 25 bp, Rattus norvegicus
aacattgagacacatgtcacgctgt

SEQ ID NO: 23546 - DNA, 25 bp, Rattus norvegicus
aacattgagacagatgtcacgctgt

SEQ ID NO: 23547 - DNA, 25 bp, Rattus norvegicus
aacattgatgagagggatcccagtg

SEQ ID NO: 23548 - DNA, 25 bp, Rattus norvegicus
aacattgatgagtgggatcccagtg

SEQ ID NO: 23549 - DNA, 25 bp, Rattus norvegicus
aacattgatgttccctgtggtggca

SEQ ID NO: 23550 - DNA, 25 bp, Rattus norvegicus
aacattgatgttgcctgtggtggca

SEQ ID NO: 23551 - DNA, 25 bp, Rattus norvegicus
aacattgcagcacagagacgggaga

SEQ ID NO: 23552 - DNA, 25 bp, Rattus norvegicus
aacattgcagcagagagacgggaga

SEQ ID NO: 23553 - DNA, 25 bp, Rattus norvegicus
aacattgcatgcacatgacgcacag

SEQ ID NO: 23554 - DNA, 25 bp, Rattus norvegicus
aacattgcatgctcatgacgcacag

SEQ ID NO: 23555 - DNA, 25 bp, Rattus norvegicus
aacattgccaaccaggaaccactgc

SEQ ID NO: 23556 - DNA, 25 bp, Rattus norvegicus
aacattgccaacgaggaaccactgc

SEQ ID NO: 23557 - DNA, 25 bp, Rattus norvegicus
aacattgccaggatttagtgctgac

SEQ ID NO: 23558 - DNA, 25 bp, Rattus norvegicus
aacattgccaggttttagtgctgac

SEQ ID NO: 23559 - DNA, 25 bp, Rattus norvegicus
aacattgcccacatcacaattaagg

SEQ ID NO: 23560 - DNA, 25 bp, Rattus norvegicus
aacattgcccacttcacaattaagg

SEQ ID NO: 23561 - DNA, 25 bp, Rattus norvegicus
aacattgcctatcaggtgacctgga

SEQ ID NO: 23562 - DNA, 25 bp, Rattus norvegicus
aacattgcctatgaggtgacctgga

SEQ ID NO: 23563 - DNA, 25 bp, Rattus norvegicus
aacattgcgtgtctggtcttcatgc

SEQ ID NO: 23564 - DNA, 25 bp, Rattus norvegicus
aacattgcgtgtgtggtcttcatgc

SEQ ID NO: 23565 - DNA, 25 bp, Rattus norvegicus
aacattgctaggacattgtcacgtg

SEQ ID NO: 23566 - DNA, 25 bp, Rattus norvegicus
aacattgctaggtcattgtcacgtg

SEQ ID NO: 23567 - DNA, 25 bp, Rattus norvegicus
aacattgctagtctgccctgagaca

SEQ ID NO: 23568 - DNA, 25 bp, Rattus norvegicus
aacattgctagtgtgccctgagaca

SEQ ID NO: 23569 - DNA, 25 bp, Rattus norvegicus
aacattgctcaccttggcaaccggg

SEQ ID NO: 23570 - DNA, 25 bp, Rattus norvegicus
aacattgctcacgttggcaaccggg

SEQ ID NO: 23571 - DNA, 25 bp, Rattus norvegicus
aacattgcttacacagaattccatg

SEQ ID NO: 23572 - DNA, 25 bp, Rattus norvegicus
aacattgcttactcagaattccatg

SEQ ID NO: 23573 - DNA, 25 bp, Rattus norvegicus
aacattgcttccacaaagaaacaga

SEQ ID NO: 23574 - DNA, 25 bp, Rattus norvegicus
aacattgcttcctcaaagaaacaga

SEQ ID NO: 23575 - DNA, 25 bp, Rattus norvegicus
aacattggaatgctgcagcgtctga

SEQ ID NO: 23576 - DNA, 25 bp, Rattus norvegicus
aacattggaatggtgcagcgtctga

SEQ ID NO: 23577 - DNA, 25 bp, Rattus norvegicus
aacattggcaatcccagaggcatct

SEQ ID NO: 23578 - DNA, 25 bp, Rattus norvegicus
aacattggcaatgccagaggcatct

SEQ ID NO: 23579 - DNA, 25 bp, Rattus norvegicus
aacattggctatcgctctggcttgg

SEQ ID NO: 23580 - DNA, 25 bp, Rattus norvegicus
aacattggctatggctctggcttgg

SEQ ID NO: 23581 - DNA, 25 bp, Rattus norvegicus
aacattggctgtctggttcctgacc

SEQ ID NO: 23582 - DNA, 25 bp, Rattus norvegicus
aacattggctgtgtggttcctgacc

SEQ ID NO: 23583 - DNA, 25 bp, Rattus norvegicus
aacattgggctgagtttcccatcaa

SEQ ID NO: 23584 - DNA, 25 bp, Rattus norvegicus
aacattgggctgtgtttcccatcaa

SEQ ID NO: 23585 - DNA, 25 bp, Rattus norvegicus
aacattgggtgcagtggctgcacta

SEQ ID NO: 23586 - DNA, 25 bp, Rattus norvegicus
aacattgggtgctgtggctgcacta

SEQ ID NO: 23587 - DNA, 25 bp, Rattus norvegicus
aacattggtcatagtttgaggtaca

SEQ ID NO: 23588 - DNA, 25 bp, Rattus norvegicus
aacattggtcattgtttgaggtaca

SEQ ID NO: 23589 - DNA, 25 bp, Rattus norvegicus
aacattgtaacaagtcctccccttt

SEQ ID NO: 23590 - DNA, 25 bp, Rattus norvegicus
aacattgtaacatgtcctccccttt

SEQ ID NO: 23591 - DNA, 25 bp, Rattus norvegicus
aacattgtaattaaccctgggcagt

SEQ ID NO: 23592 - DNA, 25 bp, Rattus norvegicus
aacattgtaatttaccctgggcagt

SEQ ID NO: 23593 - DNA, 25 bp, Rattus norvegicus
aacattgtcccacagacgttcttca

SEQ ID NO: 23594 - DNA, 25 bp, Rattus norvegicus
aacattgtcccagagacgttcttca

SEQ ID NO: 23595 - DNA, 25 bp, Rattus norvegicus
aacattgtcttcacactgtctgagg

SEQ ID NO: 23596 - DNA, 25 bp, Rattus norvegicus
aacattgtcttctcactgtctgagg

SEQ ID NO: 23597 - DNA, 25 bp, Rattus norvegicus
aacattgtgactctccatgtgacct

SEQ ID NO: 23598 - DNA, 25 bp, Rattus norvegicus
aacattgtgactgtccatgtgacct

SEQ ID NO: 23599 - DNA, 25 bp, Rattus norvegicus
aacattgtgctgcagagtacccctc

SEQ ID NO: 23600 - DNA, 25 bp, Rattus norvegicus
aacattgtgctggagagtacccctc

SEQ ID NO: 23601 - DNA, 25 bp, Rattus norvegicus
aacattgtggctacgtgtaccaaac

SEQ ID NO: 23602 - DNA, 25 bp, Rattus norvegicus
aacattgtggcttcgtgtaccaaac

SEQ ID NO: 23603 - DNA, 25 bp, Rattus norvegicus
aacattgttatcatgcttgtgggca

SEQ ID NO: 23604 - DNA, 25 bp, Rattus norvegicus
aacattgttatcttgcttgtgggca

SEQ ID NO: 23605 - DNA, 25 bp, Rattus norvegicus
aacattgtttctattgcctgaccat

SEQ ID NO: 23606 - DNA, 25 bp, Rattus norvegicus
aacattgtttcttttgcctgaccat

SEQ ID NO: 23607 - DNA, 25 bp, Rattus norvegicus
aacattgtttgcacacagtacgtgt

SEQ ID NO: 23608 - DNA, 25 bp, Rattus norvegicus
aacattgtttgctcacagtacgtgt

SEQ ID NO: 23609 - DNA, 25 bp, Rattus norvegicus
aacattgtttgtccatggcttctta

SEQ ID NO: 23610 - DNA, 25 bp, Rattus norvegicus
aacattgtttgtgcatggcttctta

SEQ ID NO: 23611 - DNA, 25 bp, Rattus norvegicus
aacatttaaacaatcgcacaccgca

SEQ ID NO: 23612 - DNA, 25 bp, Rattus norvegicus
aacatttaaacattcgcacaccgca

SEQ ID NO: 23613 - DNA, 25 bp, Rattus norvegicus
aacatttaaactccgccaatgcggc

SEQ ID NO: 23614 - DNA, 25 bp, Rattus norvegicus
aacatttaaactgcgccaatgcggc

SEQ ID NO: 23615 - DNA, 25 bp, Rattus norvegicus
aacatttaaattctgcacagcagca

SEQ ID NO: 23616 - DNA, 25 bp, Rattus norvegicus
aacatttaaattgtgcacagcagca

SEQ ID NO: 23617 - DNA, 25 bp, Rattus norvegicus
aacatttaatctatctggcctttat

SEQ ID NO: 23618 - DNA, 25 bp, Rattus norvegicus
aacatttaatctttctggcctttat

SEQ ID NO: 23619 - DNA, 25 bp, Rattus norvegicus
aacatttaatgcctgtactccagta

SEQ ID NO: 23620 - DNA, 25 bp, Rattus norvegicus
aacatttaatgcgtgtactccagta

SEQ ID NO: 23621 - DNA, 25 bp, Rattus norvegicus
aacatttaccgacttctcttggcat

SEQ ID NO: 23622 - DNA, 25 bp, Rattus norvegicus
aacatttaccgagttctcttggcat

SEQ ID NO: 23623 - DNA, 25 bp, Rattus norvegicus
aacatttaccgccactgagtgtctg

SEQ ID NO: 23624 - DNA, 25 bp, Rattus norvegicus
aacatttaccgcgactgagtgtctg

SEQ ID NO: 23625 - DNA, 25 bp, Rattus norvegicus
aacatttaggctctttggcccgtga

SEQ ID NO: 23626 - DNA, 25 bp, Rattus norvegicus
aacatttaggctgtttggcccgtga

SEQ ID NO: 23627 - DNA, 25 bp, Rattus norvegicus
aacatttatccaattgcctttgcaa

SEQ ID NO: 23628 - DNA, 25 bp, Rattus norvegicus
aacatttatccatttgcctttgcaa

SEQ ID NO: 23629 - DNA, 25 bp, Rattus norvegicus
aacatttcaaccagttcaaggccgc

SEQ ID NO: 23630 - DNA, 25 bp, Rattus norvegicus
aacatttcaacctgttcaaggccgc

SEQ ID NO: 23631 - DNA, 25 bp, Rattus norvegicus
aacatttcacccagaagtgcagtgg

SEQ ID NO: 23632 - DNA, 25 bp, Rattus norvegicus
aacatttcaccctgaagtgcagtgg

SEQ ID NO: 23633 - DNA, 25 bp, Rattus norvegicus
aacatttcagaaatcctaaaggatt

SEQ ID NO: 23634 - DNA, 25 bp, Rattus norvegicus
aacatttcagaattcctaaaggatt

SEQ ID NO: 23635 - DNA, 25 bp, Rattus norvegicus
aacatttcattactgcagtcctttg

SEQ ID NO: 23636 - DNA, 25 bp, Rattus norvegicus
aacatttcattagtgcagtcctttg

SEQ ID NO: 23637 - DNA, 25 bp, Rattus norvegicus
aacatttcatttacttcttgtcaca

SEQ ID NO: 23638 - DNA, 25 bp, Rattus norvegicus
aacatttcattttcttcttgtcaca

SEQ ID NO: 23639 - DNA, 25 bp, Rattus norvegicus
aacatttccataattcatggatcac

SEQ ID NO: 23640 - DNA, 25 bp, Rattus norvegicus
aacatttccatatttcatggatcac

SEQ ID NO: 23641 - DNA, 25 bp, Rattus norvegicus
aacatttccattactcatgacacct

SEQ ID NO: 23642 - DNA, 25 bp, Rattus norvegicus
aacatttccatttctcatgacacct

SEQ ID NO: 23643 - DNA, 25 bp, Rattus norvegicus
aacatttcccaacttggtctgtgag

SEQ ID NO: 23644 - DNA, 25 bp, Rattus norvegicus
aacatttcccaagttggtctgtgag

SEQ ID NO: 23645 - DNA, 25 bp, Rattus norvegicus
aacatttcccttattaatgctgaac

SEQ ID NO: 23646 - DNA, 25 bp, Rattus norvegicus
aacatttccctttttaatgctgaac

SEQ ID NO: 23647 - DNA, 25 bp, Rattus norvegicus
aacatttcgggaaggcttcttgtct

SEQ ID NO: 23648 - DNA, 25 bp, Rattus norvegicus
aacatttcgggatggcttcttgtct

SEQ ID NO: 23649 - DNA, 25 bp, Rattus norvegicus
aacatttctagtactgctcttattg

SEQ ID NO: 23650 - DNA, 25 bp, Rattus norvegicus
aacatttctagttctgctcttattg

SEQ ID NO: 23651 - DNA, 25 bp, Rattus norvegicus
aacatttctgtaagttcgtgccgcc

SEQ ID NO: 23652 - DNA, 25 bp, Rattus norvegicus
aacatttctgtatgttcgtgccgcc

SEQ ID NO: 23653 - DNA, 25 bp, Rattus norvegicus
aacatttctgttcaagcttccttga

SEQ ID NO: 23654 - DNA, 25 bp, Rattus norvegicus
aacatttctgttgaagcttccttga

SEQ ID NO: 23655 - DNA, 25 bp, Rattus norvegicus
aacatttcttctaaacattttgaat

SEQ ID NO: 23656 - DNA, 25 bp, Rattus norvegicus
aacatttcttcttaacattttgaat

SEQ ID NO: 23657 - DNA, 25 bp, Rattus norvegicus
aacatttcttgcctgtgggccatga

SEQ ID NO: 23658 - DNA, 25 bp, Rattus norvegicus
aacatttcttgcgtgtgggccatga

SEQ ID NO: 23659 - DNA, 25 bp, Rattus norvegicus
aacatttcttggaattgtgacagca

SEQ ID NO: 23660 - DNA, 25 bp, Rattus norvegicus
aacatttcttggtattgtgacagca

SEQ ID NO: 23661 - DNA, 25 bp, Rattus norvegicus
aacatttcttgtctgtcctagcatc

SEQ ID NO: 23662 - DNA, 25 bp, Rattus norvegicus
aacatttcttgtgtgtcctagcatc

SEQ ID NO: 23663 - DNA, 25 bp, Rattus norvegicus
aacatttgcataatccttcttggag

SEQ ID NO: 23664 - DNA, 25 bp, Rattus norvegicus
aacatttgcatattccttcttggag

SEQ ID NO: 23665 - DNA, 25 bp, Rattus norvegicus
aacatttgccatctcttgctgctgc

SEQ ID NO: 23666 - DNA, 25 bp, Rattus norvegicus
aacatttgccatgtcttgctgctgc

SEQ ID NO: 23667 - DNA, 25 bp, Rattus norvegicus
aacatttggagcactttgcaccgct

SEQ ID NO: 23668 - DNA, 25 bp, Rattus norvegicus
aacatttggagctctttgcaccgct

SEQ ID NO: 23669 - DNA, 25 bp, Rattus norvegicus
aacatttggcacattgggcccttct

SEQ ID NO: 23670 - DNA, 25 bp, Rattus norvegicus
aacatttggcactttgggcccttct

SEQ ID NO: 23671 - DNA, 25 bp, Rattus norvegicus
aacatttggcggctcaccatcgaag

SEQ ID NO: 23672 - DNA, 25 bp, Rattus norvegicus
aacatttggcgggtcaccatcgaag

SEQ ID NO: 23673 - DNA, 25 bp, Rattus norvegicus
aacatttgggaacctgctcccctac

SEQ ID NO: 23674 - DNA, 25 bp, Rattus norvegicus
aacatttgggaagctgctcccctac

SEQ ID NO: 23675 - DNA, 25 bp, Rattus norvegicus
aacatttgggtgacgtgtggcccac

SEQ ID NO: 23676 - DNA, 25 bp, Rattus norvegicus
aacatttgggtgtcgtgtggcccac

SEQ ID NO: 23677 - DNA, 25 bp, Rattus norvegicus
aacatttggtttccatccatggccc

SEQ ID NO: 23678 - DNA, 25 bp, Rattus norvegicus
aacatttggtttgcatccatggccc

SEQ ID NO: 23679 - DNA, 25 bp, Rattus norvegicus
aacatttgtggcatggtgactttag

SEQ ID NO: 23680 - DNA, 25 bp, Rattus norvegicus
aacatttgtggcttggtgactttag

SEQ ID NO: 23681 - DNA, 25 bp, Rattus norvegicus
aacatttgtgggatctcttagcaga

SEQ ID NO: 23682 - DNA, 25 bp, Rattus norvegicus
aacatttgtgggttctcttagcaga

SEQ ID NO: 23683 - DNA, 25 bp, Rattus norvegicus
aacatttgttctcagtttgcttatg

SEQ ID NO: 23684 - DNA, 25 bp, Rattus norvegicus
aacatttgttctgagtttgcttatg

SEQ ID NO: 23685 - DNA, 25 bp, Rattus norvegicus
aacattttacagacacgtgatgtgc

SEQ ID NO: 23686 - DNA, 25 bp, Rattus norvegicus
aacattttacagtcacgtgatgtgc

SEQ ID NO: 23687 - DNA, 25 bp, Rattus norvegicus
aacattttaggcctcattctattta

SEQ ID NO: 23688 - DNA, 25 bp, Rattus norvegicus
aacattttaggcgtcattctattta

SEQ ID NO: 23689 - DNA, 25 bp, Rattus norvegicus
aacattttagtcacctcactagcct

SEQ ID NO: 23690 - DNA, 25 bp, Rattus norvegicus
aacattttagtctcctcactagcct

SEQ ID NO: 23691 - DNA, 25 bp, Rattus norvegicus
aacattttagttacgcctctggaca

SEQ ID NO: 23692 - DNA, 25 bp, Rattus norvegicus
aacattttagttatattagcattga

SEQ ID NO: 23693 - DNA, 25 bp, Rattus norvegicus
aacattttagtttcgcctctggaca

SEQ ID NO: 23694 - DNA, 25 bp, Rattus norvegicus
aacattttagttttattagcattga

SEQ ID NO: 23695 - DNA, 25 bp, Rattus norvegicus
aacattttcccaatatttgccaaag

SEQ ID NO: 23696 - DNA, 25 bp, Rattus norvegicus
aacattttcccattatttgccaaag

SEQ ID NO: 23697 - DNA, 25 bp, Rattus norvegicus
aacattttccgaccttcaattcaag

SEQ ID NO: 23698 - DNA, 25 bp, Rattus norvegicus
aacattttccgagcttcaattcaag

SEQ ID NO: 23699 - DNA, 25 bp, Rattus norvegicus
aacattttcctgaatgctttactgg

SEQ ID NO: 23700 - DNA, 25 bp, Rattus norvegicus
aacattttcctgtatgctttactgg

SEQ ID NO: 23701 - DNA, 25 bp, Rattus norvegicus
aacattttgacccaggtgttcctgt

SEQ ID NO: 23702 - DNA, 25 bp, Rattus norvegicus
aacattttgaccgaggtgttcctgt

SEQ ID NO: 23703 - DNA, 25 bp, Rattus norvegicus
aacattttgatcagtccagaggaat

SEQ ID NO: 23704 - DNA, 25 bp, Rattus norvegicus
aacattttgatctgtccagaggaat

SEQ ID NO: 23705 - DNA, 25 bp, Rattus norvegicus
aacattttgtgccattaaagctctc

SEQ ID NO: 23706 - DNA, 25 bp, Rattus norvegicus
aacattttgtgcgattaaagctctc

SEQ ID NO: 23707 - DNA, 25 bp, Rattus norvegicus
aacattttgtttcccttcacatgcc

SEQ ID NO: 23708 - DNA, 25 bp, Rattus norvegicus
aacattttgtttgccttcacatgcc

SEQ ID NO: 23709 - DNA, 25 bp, Rattus norvegicus
aacatttttattaccatctctacca

SEQ ID NO: 23710 - DNA, 25 bp, Rattus norvegicus
aacatttttatttccatctctacca

SEQ ID NO: 23711 - DNA, 25 bp, Rattus norvegicus
aacatttttcttatcgcagagagga

SEQ ID NO: 23712 - DNA, 25 bp, Rattus norvegicus
aacatttttcttttcgcagagagga

SEQ ID NO: 23713 - DNA, 25 bp, Rattus norvegicus
aacatttttgccaggcacggtgaca

SEQ ID NO: 23714 - DNA, 25 bp, Rattus norvegicus
aacatttttgcctggcacggtgaca

SEQ ID NO: 23715 - DNA, 25 bp, Rattus norvegicus
aaccaaaaaccaagggtctgctgga

SEQ ID NO: 23716 - DNA, 25 bp, Rattus norvegicus
aaccaaaaaccatgggtctgctgga

SEQ ID NO: 23717 - DNA, 25 bp, Rattus norvegicus
aaccaaaaggccatcaggtagattt

SEQ ID NO: 23718 - DNA, 25 bp, Rattus norvegicus
aaccaaaaggccttcaggtagattt

SEQ ID NO: 23719 - DNA, 25 bp, Rattus norvegicus
aaccaaaatatcagtgctctgacta

SEQ ID NO: 23720 - DNA, 25 bp, Rattus norvegicus
aaccaaaatatctgtgctctgacta

SEQ ID NO: 23721 - DNA, 25 bp, Rattus norvegicus
aaccaaacaggtccgatttaggatc

SEQ ID NO: 23722 - DNA, 25 bp, Rattus norvegicus
aaccaaacaggtgcgatttaggatc

SEQ ID NO: 23723 - DNA, 25 bp, Rattus norvegicus
aaccaaaccgcaatcgtgtggattt

SEQ ID NO: 23724 - DNA, 25 bp, Rattus norvegicus
aaccaaaccgcattcgtgtggattt

SEQ ID NO: 23725 - DNA, 25 bp, Rattus norvegicus
aaccaaacgaaactctggccaggtg

SEQ ID NO: 23726 - DNA, 25 bp, Rattus norvegicus
aaccaaacgaaagtctggccaggtg

SEQ ID NO: 23727 - DNA, 25 bp, Rattus norvegicus
aaccaaacggaaagctttaatacag

SEQ ID NO: 23728 - DNA, 25 bp, Rattus norvegicus
aaccaaacggaatgctttaatacag

SEQ ID NO: 23729 - DNA, 25 bp, Rattus norvegicus
aaccaaactgccacagtgttccaaa

SEQ ID NO: 23730 - DNA, 25 bp, Rattus norvegicus
aaccaaactgcctcagtgttccaaa

SEQ ID NO: 23731 - DNA, 25 bp, Rattus norvegicus
aaccaaagacaacggacggcgctga

SEQ ID NO: 23732 - DNA, 25 bp, Rattus norvegicus
aaccaaagacaagggacggcgctga

SEQ ID NO: 23733 - DNA, 25 bp, Rattus norvegicus
aaccaaagagtgattctggcccgcg

SEQ ID NO: 23734 - DNA, 25 bp, Rattus norvegicus
aaccaaagagtgtttctggcccgcg

SEQ ID NO: 23735 - DNA, 25 bp, Rattus norvegicus
aaccaaagatttctctgccatcctc

SEQ ID NO: 23736 - DNA, 25 bp, Rattus norvegicus
aaccaaagatttgtctgccatcctc

SEQ ID NO: 23737 - DNA, 25 bp, Rattus norvegicus
aaccaaagccggattctcagtttga

SEQ ID NO: 23738 - DNA, 25 bp, Rattus norvegicus
aaccaaagccggtttctcagtttga

SEQ ID NO: 23739 - DNA, 25 bp, Rattus norvegicus
aaccaaagcctgcaagctgacctaa

SEQ ID NO: 23740 - DNA, 25 bp, Rattus norvegicus
aaccaaagcctggaagctgacctaa

SEQ ID NO: 23741 - DNA, 25 bp, Rattus norvegicus
aaccaaagctgaattgccccacatg

SEQ ID NO: 23742 - DNA, 25 bp, Rattus norvegicus
aaccaaagctgatttgccccacatg

SEQ ID NO: 23743 - DNA, 25 bp, Rattus norvegicus
aaccaaagcttgagcttgtcacact

SEQ ID NO: 23744 - DNA, 25 bp, Rattus norvegicus
aaccaaagcttgtgcttgtcacact

SEQ ID NO: 23745 - DNA, 25 bp, Rattus norvegicus
aaccaaagggatacactgtcagagt

SEQ ID NO: 23746 - DNA, 25 bp, Rattus norvegicus
aaccaaagggattcactgtcagagt

SEQ ID NO: 23747 - DNA, 25 bp, Rattus norvegicus
aaccaaagtgcaattctcagcgacg

SEQ ID NO: 23748 - DNA, 25 bp, Rattus norvegicus
aaccaaagtgcatttctcagcgacg

SEQ ID NO: 23749 - DNA, 25 bp, Rattus norvegicus
aaccaaataacccagcaacaagcca

SEQ ID NO: 23750 - DNA, 25 bp, Rattus norvegicus
aaccaaataaccgagcaacaagcca

SEQ ID NO: 23751 - DNA, 25 bp, Rattus norvegicus
aaccaaatatctctgggtccgcctg

SEQ ID NO: 23752 - DNA, 25 bp, Rattus norvegicus
aaccaaatatctgtgggtccgcctg

SEQ ID NO: 23753 - DNA, 25 bp, Rattus norvegicus
aaccaaatgctaaattctaccctcg

SEQ ID NO: 23754 - DNA, 25 bp, Rattus norvegicus
aaccaaatgctatattctaccctcg

SEQ ID NO: 23755 - DNA, 25 bp, Rattus norvegicus
aaccaaatgtgtcctggtcctcgtg

SEQ ID NO: 23756 - DNA, 25 bp, Rattus norvegicus
aaccaaatgtgtgctggtcctcgtg

SEQ ID NO: 23757 - DNA, 25 bp, Rattus norvegicus
aaccaaatgttgactgttcccaaat

SEQ ID NO: 23758 - DNA, 25 bp, Rattus norvegicus
aaccaaatgttgtctgttcccaaat

SEQ ID NO: 23759 - DNA, 25 bp, Rattus norvegicus
aaccaaattagtcgctccctccgag

SEQ ID NO: 23760 - DNA, 25 bp, Rattus norvegicus
aaccaaattagtggctccctccgag

SEQ ID NO: 23761 - DNA, 25 bp, Rattus norvegicus
aaccaaattcacattggcgatttaa

SEQ ID NO: 23762 - DNA, 25 bp, Rattus norvegicus
aaccaaattcactttggcgatttaa

SEQ ID NO: 23763 - DNA, 25 bp, Rattus norvegicus
aaccaacaacaactctgcacattaa

SEQ ID NO: 23764 - DNA, 25 bp, Rattus norvegicus
aaccaacaacaagtctgcacattaa

SEQ ID NO: 23765 - DNA, 25 bp, Rattus norvegicus
aaccaacaacggcattcactacaag

SEQ ID NO: 23766 - DNA, 25 bp, Rattus norvegicus
aaccaacaacgggattcactacaag

SEQ ID NO: 23767 - DNA, 25 bp, Rattus norvegicus
aaccaacacttccaaattacgcaca

SEQ ID NO: 23768 - DNA, 25 bp, Rattus norvegicus
aaccaacacttcgaaattacgcaca

SEQ ID NO: 23769 - DNA, 25 bp, Rattus norvegicus
aaccaacagagacaagcagtccaga

SEQ ID NO: 23770 - DNA, 25 bp, Rattus norvegicus
aaccaacagagagaagcagtccaga

SEQ ID NO: 23771 - DNA, 25 bp, Rattus norvegicus
aaccaacagctaaaccattcgagtg

SEQ ID NO: 23772 - DNA, 25 bp, Rattus norvegicus
aaccaacagctataccattcgagtg

SEQ ID NO: 23773 - DNA, 25 bp, Rattus norvegicus
aaccaacaggcccatcttagtaatg

SEQ ID NO: 23774 - DNA, 25 bp, Rattus norvegicus
aaccaacaggccgatcttagtaatg

SEQ ID NO: 23775 - DNA, 25 bp, Rattus norvegicus
aaccaacaggctctcttgaagtgag

SEQ ID NO: 23776 - DNA, 25 bp, Rattus norvegicus
aaccaacaggctgtcttgaagtgag

SEQ ID NO: 23777 - DNA, 25 bp, Rattus norvegicus
aaccaacaggtaccaaaggatgtca

SEQ ID NO: 23778 - DNA, 25 bp, Rattus norvegicus
aaccaacaggtagcaaaggatgtca

SEQ ID NO: 23779 - DNA, 25 bp, Rattus norvegicus
aaccaacagtgaccgctggctagtc

SEQ ID NO: 23780 - DNA, 25 bp, Rattus norvegicus
aaccaacagtgagcgctggctagtc

SEQ ID NO: 23781 - DNA, 25 bp, Rattus norvegicus
aaccaacatagacatggcgcccctg

SEQ ID NO: 23782 - DNA, 25 bp, Rattus norvegicus
aaccaacatagagatggcgcccctg

SEQ ID NO: 23783 - DNA, 25 bp, Rattus norvegicus
aaccaaccaaagagcactgtacgcc

SEQ ID NO: 23784 - DNA, 25 bp, Rattus norvegicus
aaccaaccaaagtgcactgtacgcc

SEQ ID NO: 23785 - DNA, 25 bp, Rattus norvegicus
aaccaaccaacgagacgaatgcagt

SEQ ID NO: 23786 - DNA, 25 bp, Rattus norvegicus
aaccaaccaacgtgacgaatgcagt

SEQ ID NO: 23787 - DNA, 25 bp, Rattus norvegicus
aaccaaccattcaatctgtcttcaa

SEQ ID NO: 23788 - DNA, 25 bp, Rattus norvegicus
aaccaaccattctatctgtcttcaa

SEQ ID NO: 23789 - DNA, 25 bp, Rattus norvegicus
aaccaaccctgccttctaagtatgg

SEQ ID NO: 23790 - DNA, 25 bp, Rattus norvegicus
aaccaaccctgcgttctaagtatgg

SEQ ID NO: 23791 - DNA, 25 bp, Rattus norvegicus
aaccaacctgctcaaatggctgttc

SEQ ID NO: 23792 - DNA, 25 bp, Rattus norvegicus
aaccaacctgctgaaatggctgttc

SEQ ID NO: 23793 - DNA, 25 bp, Rattus norvegicus
aaccaacgaggactgtgcccagaat

SEQ ID NO: 23794 - DNA, 25 bp, Rattus norvegicus
aaccaacgaggagtgtgcccagaat

SEQ ID NO: 23795 - DNA, 25 bp, Rattus norvegicus
aaccaacgccagcacatttgaggac

SEQ ID NO: 23796 - DNA, 25 bp, Rattus norvegicus
aaccaacgccaggacatttgaggac

SEQ ID NO: 23797 - DNA, 25 bp, Rattus norvegicus
aaccaacgctggaatttctgtatta

SEQ ID NO: 23798 - DNA, 25 bp, Rattus norvegicus
aaccaacgctggtatttctgtatta

SEQ ID NO: 23799 - DNA, 25 bp, Rattus norvegicus
aaccaactcaatcgaggcagcgcta

SEQ ID NO: 23800 - DNA, 25 bp, Rattus norvegicus
aaccaactcaatggaggcagcgcta

SEQ ID NO: 23801 - DNA, 25 bp, Rattus norvegicus
aaccaactcctcaaagttgtactgt

SEQ ID NO: 23802 - DNA, 25 bp, Rattus norvegicus
aaccaactcctctaagttgtactgt

SEQ ID NO: 23803 - DNA, 25 bp, Rattus norvegicus
aaccaactcgatcacaaggacactg

SEQ ID NO: 23804 - DNA, 25 bp, Rattus norvegicus
aaccaactcgatgacaaggacactg

SEQ ID NO: 23805 - DNA, 25 bp, Rattus norvegicus
aaccaactgaaaagtcaatttctat

SEQ ID NO: 23806 - DNA, 25 bp, Rattus norvegicus
aaccaactgaaatgtcaatttctat

SEQ ID NO: 23807 - DNA, 25 bp, Rattus norvegicus
aaccaactgtatctattctcttgaa

SEQ ID NO: 23808 - DNA, 25 bp, Rattus norvegicus
aaccaactgtatgtattctcttgaa

SEQ ID NO: 23809 - DNA, 25 bp, Rattus norvegicus
aaccaactgtgcatgtagagactca

SEQ ID NO: 23810 - DNA, 25 bp, Rattus norvegicus
aaccaactgtgcttgtagagactca

SEQ ID NO: 23811 - DNA, 25 bp, Rattus norvegicus
aaccaacttcttaacacagctctta

SEQ ID NO: 23812 - DNA, 25 bp, Rattus norvegicus
aaccaacttctttacacagctctta

SEQ ID NO: 23813 - DNA, 25 bp, Rattus norvegicus
aaccaagagggcctgggtccagctc

SEQ ID NO: 23814 - DNA, 25 bp, Rattus norvegicus
aaccaagagggcgtgggtccagctc

SEQ ID NO: 23815 - DNA, 25 bp, Rattus norvegicus
aaccaagaggtccagaggccagcca

SEQ ID NO: 23816 - DNA, 25 bp, Rattus norvegicus
aaccaagaggtcgagaggccagcca

SEQ ID NO: 23817 - DNA, 25 bp, Rattus norvegicus
aaccaagatcttcctgacactgaat

SEQ ID NO: 23818 - DNA, 25 bp, Rattus norvegicus
aaccaagatcttgctgacactgaat

SEQ ID NO: 23819 - DNA, 25 bp, Rattus norvegicus
aaccaagatgtcagcagatctccat

SEQ ID NO: 23820 - DNA, 25 bp, Rattus norvegicus
aaccaagatgtctgcagatctccat

SEQ ID NO: 23821 - DNA, 25 bp, Rattus norvegicus
aaccaagcaagtacacaggatcatg

SEQ ID NO: 23822 - DNA, 25 bp, Rattus norvegicus
aaccaagcaagttcacaggatcatg

SEQ ID NO: 23823 - DNA, 25 bp, Rattus norvegicus
aaccaagccatgcagtgtgtgctca

SEQ ID NO: 23824 - DNA, 25 bp, Rattus norvegicus
aaccaagccatggagtgtgtgctca

SEQ ID NO: 23825 - DNA, 25 bp, Rattus norvegicus
aaccaagcctggagctgagtttcta

SEQ ID NO: 23826 - DNA, 25 bp, Rattus norvegicus
aaccaagcctggtgctgagtttcta

SEQ ID NO: 23827 - DNA, 25 bp, Rattus norvegicus
aaccaaggaaccagagacaccacct

SEQ ID NO: 23828 - DNA, 25 bp, Rattus norvegicus
aaccaaggaacctgagacaccacct

SEQ ID NO: 23829 - DNA, 25 bp, Rattus norvegicus
aaccaaggagctcagtctcggctgc

SEQ ID NO: 23830 - DNA, 25 bp, Rattus norvegicus
aaccaaggagctgagtctcggctgc

SEQ ID NO: 23831 - DNA, 25 bp, Rattus norvegicus
aaccaaggcactcgctacagaggaa

SEQ ID NO: 23832 - DNA, 25 bp, Rattus norvegicus
aaccaaggcactggctacagaggaa

SEQ ID NO: 23833 - DNA, 25 bp, Rattus norvegicus
aaccaaggcatcctcggagatgagt

SEQ ID NO: 23834 - DNA, 25 bp, Rattus norvegicus
aaccaaggcatcgtcggagatgagt

SEQ ID NO: 23835 - DNA, 25 bp, Rattus norvegicus
aaccaaggctgacagaagttgtaga

SEQ ID NO: 23836 - DNA, 25 bp, Rattus norvegicus
aaccaaggctgagagaagttgtaga

SEQ ID NO: 23837 - DNA, 25 bp, Rattus norvegicus
aaccaaggctttactcatatccaaa

SEQ ID NO: 23838 - DNA, 25 bp, Rattus norvegicus
aaccaaggcttttctcatatccaaa

SEQ ID NO: 23839 - DNA, 25 bp, Rattus norvegicus
aaccaagggaccacataacctgatt

SEQ ID NO: 23840 - DNA, 25 bp, Rattus norvegicus
aaccaagggacctcataacctgatt

SEQ ID NO: 23841 - DNA, 25 bp, Rattus norvegicus
aaccaagggaggcacctgattccag

SEQ ID NO: 23842 - DNA, 25 bp, Rattus norvegicus
aaccaagggagggacctgattccag

SEQ ID NO: 23843 - DNA, 25 bp, Rattus norvegicus
aaccaaggtgtgctcgtaggccagt

SEQ ID NO: 23844 - DNA, 25 bp, Rattus norvegicus
aaccaaggtgtggtcgtaggccagt

SEQ ID NO: 23845 - DNA, 25 bp, Rattus norvegicus
aaccaagtaagacctcagatccctc

SEQ ID NO: 23846 - DNA, 25 bp, Rattus norvegicus
aaccaagtaagagctcagatccctc

SEQ ID NO: 23847 - DNA, 25 bp, Rattus norvegicus
aaccaagtctccagtcaggcagatg

SEQ ID NO: 23848 - DNA, 25 bp, Rattus norvegicus
aaccaagtctcctgtcaggcagatg

SEQ ID NO: 23849 - DNA, 25 bp, Rattus norvegicus
aaccaagtggacatctgtgccctgg

SEQ ID NO: 23850 - DNA, 25 bp, Rattus norvegicus
aaccaagtggacttctgtgccctgg

SEQ ID NO: 23851 - DNA, 25 bp, Rattus norvegicus
aaccaagtggccagggaggcttctc

SEQ ID NO: 23852 - DNA, 25 bp, Rattus norvegicus
aaccaagtggcctgggaggcttctc

SEQ ID NO: 23853 - DNA, 25 bp, Rattus norvegicus
aaccaagtgggcaggctgactacct

SEQ ID NO: 23854 - DNA, 25 bp, Rattus norvegicus
aaccaagtgggctggctgactacct

SEQ ID NO: 23855 - DNA, 25 bp, Rattus norvegicus
aaccaagtggttcatacatgccaat

SEQ ID NO: 23856 - DNA, 25 bp, Rattus norvegicus
aaccaagtggttgatacatgccaat

SEQ ID NO: 23857 - DNA, 25 bp, Rattus norvegicus
aaccaagtgtgcacatgctattttt

SEQ ID NO: 23858 - DNA, 25 bp, Rattus norvegicus
aaccaagtgtgctcatgctattttt

SEQ ID NO: 23859 - DNA, 25 bp, Rattus norvegicus
aaccaagttcacactcgcagggagc

SEQ ID NO: 23860 - DNA, 25 bp, Rattus norvegicus
aaccaagttcactctcgcagggagc

SEQ ID NO: 23861 - DNA, 25 bp, Rattus norvegicus
aaccaagttccccagtgatcaagaa

SEQ ID NO: 23862 - DNA, 25 bp, Rattus norvegicus
aaccaagttcccgagtgatcaagaa

SEQ ID NO: 23863 - DNA, 25 bp, Rattus norvegicus
aaccaagttcgtcagggaggcgtct

SEQ ID NO: 23864 - DNA, 25 bp, Rattus norvegicus
aaccaagttcgtgagggaggcgtct

SEQ ID NO: 23865 - DNA, 25 bp, Rattus norvegicus
aaccaagttttgagcttgccttctt

SEQ ID NO: 23866 - DNA, 25 bp, Rattus norvegicus
aaccaagttttgtgcttgccttctt

SEQ ID NO: 23867 - DNA, 25 bp, Rattus norvegicus
aaccaataaataacagtacttgagg

SEQ ID NO: 23868 - DNA, 25 bp, Rattus norvegicus
aaccaataaatatcagtacttgagg

SEQ ID NO: 23869 - DNA, 25 bp, Rattus norvegicus
aaccaatatcatattaaacctgaga

SEQ ID NO: 23870 - DNA, 25 bp, Rattus norvegicus
aaccaatatcattttaaacctgaga

SEQ ID NO: 23871 - DNA, 25 bp, Rattus norvegicus
aaccaatatgccaacaaagtgtata

SEQ ID NO: 23872 - DNA, 25 bp, Rattus norvegicus
aaccaatatgcctacaaagtgtata

SEQ ID NO: 23873 - DNA, 25 bp, Rattus norvegicus
aaccaatcacttcgtggctcacgac

SEQ ID NO: 23874 - DNA, 25 bp, Rattus norvegicus
aaccaatcacttggtggctcacgac

SEQ ID NO: 23875 - DNA, 25 bp, Rattus norvegicus
aaccaatcaggccttgatgcgtgcc

SEQ ID NO: 23876 - DNA, 25 bp, Rattus norvegicus
aaccaatcaggcgttgatgcgtgcc

SEQ ID NO: 23877 - DNA, 25 bp, Rattus norvegicus
aaccaatctgtgcatcggtgtagac

SEQ ID NO: 23878 - DNA, 25 bp, Rattus norvegicus
aaccaatctgtggatcggtgtagac

SEQ ID NO: 23879 - DNA, 25 bp, Rattus norvegicus
aaccaatgacacatgcagtttgcta

SEQ ID NO: 23880 - DNA, 25 bp, Rattus norvegicus
aaccaatgacacttgcagtttgcta

SEQ ID NO: 23881 - DNA, 25 bp, Rattus norvegicus
aaccaatgagccaactgcgggagat

SEQ ID NO: 23882 - DNA, 25 bp, Rattus norvegicus
aaccaatgagcctactgcgggagat

SEQ ID NO: 23883 - DNA, 25 bp, Rattus norvegicus
aaccaatggatgaaattgatgcagt

SEQ ID NO: 23884 - DNA, 25 bp, Rattus norvegicus
aaccaatggatgtaattgatgcagt

SEQ ID NO: 23885 - DNA, 25 bp, Rattus norvegicus
aaccaattcgaaattgtccttgtca

SEQ ID NO: 23886 - DNA, 25 bp, Rattus norvegicus
aaccaattcgaatttgtccttgtca

SEQ ID NO: 23887 - DNA, 25 bp, Rattus norvegicus
aaccaattgggcaaatactcataat

SEQ ID NO: 23888 - DNA, 25 bp, Rattus norvegicus
aaccaattgggctaatactcataat

SEQ ID NO: 23889 - DNA, 25 bp, Rattus norvegicus
aaccaattgttgatgccctaatcta

SEQ ID NO: 23890 - DNA, 25 bp, Rattus norvegicus
aaccaattgttgttgccctaatcta

SEQ ID NO: 23891 - DNA, 25 bp, Rattus norvegicus
aaccaatttccccagatgttcaaag

SEQ ID NO: 23892 - DNA, 25 bp, Rattus norvegicus
aaccaatttcccgagatgttcaaag

SEQ ID NO: 23893 - DNA, 25 bp, Rattus norvegicus
aaccaattttgcaagggctctgatt

SEQ ID NO: 23894 - DNA, 25 bp, Rattus norvegicus
aaccaattttgctagggctctgatt

SEQ ID NO: 23895 - DNA, 25 bp, Rattus norvegicus
aaccacaaaactaggagcctgtggt

SEQ ID NO: 23896 - DNA, 25 bp, Rattus norvegicus
aaccacaaaacttggagcctgtggt

SEQ ID NO: 23897 - DNA, 25 bp, Rattus norvegicus
aaccacaatcctatgtatcacatga

SEQ ID NO: 23898 - DNA, 25 bp, Rattus norvegicus
aaccacaatcctttgtatcacatga

SEQ ID NO: 23899 - DNA, 25 bp, Rattus norvegicus
aaccacacctcacgctggctaaggt

SEQ ID NO: 23900 - DNA, 25 bp, Rattus norvegicus
aaccacacctcaggctggctaaggt

SEQ ID NO: 23901 - DNA, 25 bp, Rattus norvegicus
aaccacaccttgcatgccggcttgt

SEQ ID NO: 23902 - DNA, 25 bp, Rattus norvegicus
aaccacaccttggatgccggcttgt

SEQ ID NO: 23903 - DNA, 25 bp, Rattus norvegicus
aaccacactgttcttttacactgac

SEQ ID NO: 23904 - DNA, 25 bp, Rattus norvegicus
aaccacactgttgttttacactgac

SEQ ID NO: 23905 - DNA, 25 bp, Rattus norvegicus
aaccacagactgagacatgacacct

SEQ ID NO: 23906 - DNA, 25 bp, Rattus norvegicus
aaccacagactgtgacatgacacct

SEQ ID NO: 23907 - DNA, 25 bp, Rattus norvegicus
aaccacagagcgattaaatgccgtc

SEQ ID NO: 23908 - DNA, 25 bp, Rattus norvegicus
aaccacagagcgtttaaatgccgtc

SEQ ID NO: 23909 - DNA, 25 bp, Rattus norvegicus
aaccacagaggtaaggtagctagta

SEQ ID NO: 23910 - DNA, 25 bp, Rattus norvegicus
aaccacagaggttaggtagctagta

SEQ ID NO: 23911 - DNA, 25 bp, Rattus norvegicus
aaccacagccatctgaagacctggt

SEQ ID NO: 23912 - DNA, 25 bp, Rattus norvegicus
aaccacagccatgtgaagacctggt

SEQ ID NO: 23913 - DNA, 25 bp, Rattus norvegicus
aaccacagccctccacaaaggatgt

SEQ ID NO: 23914 - DNA, 25 bp, Rattus norvegicus
aaccacagccctgcacaaaggatgt

SEQ ID NO: 23915 - DNA, 25 bp, Rattus norvegicus
aaccacagccggcacctgttgaaga

SEQ ID NO: 23916 - DNA, 25 bp, Rattus norvegicus
aaccacagccgggacctgttgaaga

SEQ ID NO: 23917 - DNA, 25 bp, Rattus norvegicus
aaccacagctagctaggcactgcgg

SEQ ID NO: 23918 - DNA, 25 bp, Rattus norvegicus
aaccacagctaggtaggcactgcgg

SEQ ID NO: 23919 - DNA, 25 bp, Rattus norvegicus
aaccacagggcccatgtcagagagt

SEQ ID NO: 23920 - DNA, 25 bp, Rattus norvegicus
aaccacagggccgatgtcagagagt

SEQ ID NO: 23921 - DNA, 25 bp, Rattus norvegicus
aaccacagggtgcatctttcaaata

SEQ ID NO: 23922 - DNA, 25 bp, Rattus norvegicus
aaccacagggtggatctttcaaata

SEQ ID NO: 23923 - DNA, 25 bp, Rattus norvegicus
aaccacaggtggcttatggctctcc

SEQ ID NO: 23924 - DNA, 25 bp, Rattus norvegicus
aaccacaggtgggttatggctctcc

SEQ ID NO: 23925 - DNA, 25 bp, Rattus norvegicus
aaccacaggtgtagatttttcttct

SEQ ID NO: 23926 - DNA, 25 bp, Rattus norvegicus
aaccacaggtgttgatttttcttct

SEQ ID NO: 23927 - DNA, 25 bp, Rattus norvegicus
aaccacatagtgaccagaaggcgct

SEQ ID NO: 23928 - DNA, 25 bp, Rattus norvegicus
aaccacatagtgtccagaaggcgct

SEQ ID NO: 23929 - DNA, 25 bp, Rattus norvegicus
aaccacatcatcagttgcttttgta

SEQ ID NO: 23930 - DNA, 25 bp, Rattus norvegicus
aaccacatcatctgttgcttttgta

SEQ ID NO: 23931 - DNA, 25 bp, Rattus norvegicus
aaccacatccttacctgaagaagca

SEQ ID NO: 23932 - DNA, 25 bp, Rattus norvegicus
aaccacatcctttcctgaagaagca

SEQ ID NO: 23933 - DNA, 25 bp, Rattus norvegicus
aaccacattggtattcagtccccaa

SEQ ID NO: 23934 - DNA, 25 bp, Rattus norvegicus
aaccacattggttttcagtccccaa

SEQ ID NO: 23935 - DNA, 25 bp, Rattus norvegicus
aaccacatttggagacttcaggccc

SEQ ID NO: 23936 - DNA, 25 bp, Rattus norvegicus
aaccacatttggcatttctttggag

SEQ ID NO: 23937 - DNA, 25 bp, Rattus norvegicus
aaccacatttgggatttctttggag

SEQ ID NO: 23938 - DNA, 25 bp, Rattus norvegicus
aaccacatttggtgacttcaggccc

SEQ ID NO: 23939 - DNA, 25 bp, Rattus norvegicus
aaccaccaatcacagagttcatatg

SEQ ID NO: 23940 - DNA, 25 bp, Rattus norvegicus
aaccaccaatcagagagttcatatg

SEQ ID NO: 23941 - DNA, 25 bp, Rattus norvegicus
aaccaccacgaccatatggaggaca

SEQ ID NO: 23942 - DNA, 25 bp, Rattus norvegicus
aaccaccacgacgatatggaggaca

SEQ ID NO: 23943 - DNA, 25 bp, Rattus norvegicus
aaccaccacgggatgagcccggcgt

SEQ ID NO: 23944 - DNA, 25 bp, Rattus norvegicus
aaccaccacgggttgagcccggcgt

SEQ ID NO: 23945 - DNA, 25 bp, Rattus norvegicus
aaccaccagggcattggagcaggta

SEQ ID NO: 23946 - DNA, 25 bp, Rattus norvegicus
aaccaccagggctttggagcaggta

SEQ ID NO: 23947 - DNA, 25 bp, Rattus norvegicus
aaccaccataagcatctttaaccct

SEQ ID NO: 23948 - DNA, 25 bp, Rattus norvegicus
aaccaccataaggatctttaaccct

SEQ ID NO: 23949 - DNA, 25 bp, Rattus norvegicus
aaccaccatctacttctgtttcagt

SEQ ID NO: 23950 - DNA, 25 bp, Rattus norvegicus
aaccaccatctagttctgtttcagt

SEQ ID NO: 23951 - DNA, 25 bp, Rattus norvegicus
aaccaccatcttaagagtacacagg

SEQ ID NO: 23952 - DNA, 25 bp, Rattus norvegicus
aaccaccatctttagagtacacagg

SEQ ID NO: 23953 - DNA, 25 bp, Rattus norvegicus
aaccaccattctagatgtatctcgg

SEQ ID NO: 23954 - DNA, 25 bp, Rattus norvegicus
aaccaccattcttgatgtatctcgg

SEQ ID NO: 23955 - DNA, 25 bp, Rattus norvegicus
aaccacccagttctggagggctgga

SEQ ID NO: 23956 - DNA, 25 bp, Rattus norvegicus
aaccacccagttgtggagggctgga

SEQ ID NO: 23957 - DNA, 25 bp, Rattus norvegicus
aaccaccctggcacttaggtaacat

SEQ ID NO: 23958 - DNA, 25 bp, Rattus norvegicus
aaccaccctggctcttaggtaacat

SEQ ID NO: 23959 - DNA, 25 bp, Rattus norvegicus
aaccaccgcaagaataagttcctgt

SEQ ID NO: 23960 - DNA, 25 bp, Rattus norvegicus
aaccaccgcaagtataagttcctgt

SEQ ID NO: 23961 - DNA, 25 bp, Rattus norvegicus
aaccaccggctgactgaagagctgc

SEQ ID NO: 23962 - DNA, 25 bp, Rattus norvegicus
aaccaccggctgtctgaagagctgc

SEQ ID NO: 23963 - DNA, 25 bp, Rattus norvegicus
aaccaccgtccaaccagaaatgaga

SEQ ID NO: 23964 - DNA, 25 bp, Rattus norvegicus
aaccaccgtccatccagaaatgaga

SEQ ID NO: 23965 - DNA, 25 bp, Rattus norvegicus
aaccaccgtgggaagtgtccgccag

SEQ ID NO: 23966 - DNA, 25 bp, Rattus norvegicus
aaccaccgtgggtagtgtccgccag

SEQ ID NO: 23967 - DNA, 25 bp, Rattus norvegicus
aaccacctccccagaatagagcaga

SEQ ID NO: 23968 - DNA, 25 bp, Rattus norvegicus
aaccacctcccctgaatagagcaga

SEQ ID NO: 23969 - DNA, 25 bp, Rattus norvegicus
aaccacctcgtgatggtaactgctc

SEQ ID NO: 23970 - DNA, 25 bp, Rattus norvegicus
aaccacctcgtgttggtaactgctc

SEQ ID NO: 23971 - DNA, 25 bp, Rattus norvegicus
aaccacctctccattgaatttgtaa

SEQ ID NO: 23972 - DNA, 25 bp, Rattus norvegicus
aaccacctctcctttgaatttgtaa

SEQ ID NO: 23973 - DNA, 25 bp, Rattus norvegicus
aaccacctgagtccatgttctggaa

SEQ ID NO: 23974 - DNA, 25 bp, Rattus norvegicus
aaccacctgagtgcatgttctggaa

SEQ ID NO: 23975 - DNA, 25 bp, Rattus norvegicus
aaccacctgctccatgtgtttgatg

SEQ ID NO: 23976 - DNA, 25 bp, Rattus norvegicus
aaccacctgctcgatgtgtttgatg

SEQ ID NO: 23977 - DNA, 25 bp, Rattus norvegicus
aaccacctggagacgctggccgaag

SEQ ID NO: 23978 - DNA, 25 bp, Rattus norvegicus
aaccacctggagtcgctggccgaag

SEQ ID NO: 23979 - DNA, 25 bp, Rattus norvegicus
aaccacctgggtaagcagtgatgct

SEQ ID NO: 23980 - DNA, 25 bp, Rattus norvegicus
aaccacctgggttagcagtgatgct

SEQ ID NO: 23981 - DNA, 25 bp, Rattus norvegicus
aaccacctggtgctgctgttgtaca

SEQ ID NO: 23982 - DNA, 25 bp, Rattus norvegicus
aaccacctggtggtgctgttgtaca

SEQ ID NO: 23983 - DNA, 25 bp, Rattus norvegicus
aaccaccttggaactacagtgacat

SEQ ID NO: 23984 - DNA, 25 bp, Rattus norvegicus
aaccaccttggatctacagtgacat

SEQ ID NO: 23985 - DNA, 25 bp, Rattus norvegicus
aaccaccttgggatttgtatccatc

SEQ ID NO: 23986 - DNA, 25 bp, Rattus norvegicus
aaccaccttgggttttgtatccatc

SEQ ID NO: 23987 - DNA, 25 bp, Rattus norvegicus
aaccacgagtttattgatgagcaga

SEQ ID NO: 23988 - DNA, 25 bp, Rattus norvegicus
aaccacgagttttttgatgagcaga

SEQ ID NO: 23989 - DNA, 25 bp, Rattus norvegicus
aaccacgatggcactgtcagttttg

SEQ ID NO: 23990 - DNA, 25 bp, Rattus norvegicus
aaccacgatggctctgtcagttttg

SEQ ID NO: 23991 - DNA, 25 bp, Rattus norvegicus
aaccacgcggtgatgtcatgggcca

SEQ ID NO: 23992 - DNA, 25 bp, Rattus norvegicus
aaccacgcggtgttgtcatgggcca

SEQ ID NO: 23993 - DNA, 25 bp, Rattus norvegicus
aaccacgcgtggcttctatggagtg

SEQ ID NO: 23994 - DNA, 25 bp, Rattus norvegicus
aaccacgcgtgggttctatggagtg

SEQ ID NO: 23995 - DNA, 25 bp, Rattus norvegicus
aaccacgctagtctacttttctctg

SEQ ID NO: 23996 - DNA, 25 bp, Rattus norvegicus
aaccacgctagtgtacttttctctg

SEQ ID NO: 23997 - DNA, 25 bp, Rattus norvegicus
aaccacgcttgcacagaatgtcagg

SEQ ID NO: 23998 - DNA, 25 bp, Rattus norvegicus
aaccacgcttgctcagaatgtcagg

SEQ ID NO: 23999 - DNA, 25 bp, Rattus norvegicus
aaccacggatgcaccctgttgccag

SEQ ID NO: 24000 - DNA, 25 bp, Rattus norvegicus
aaccacggatgctccctgttgccag

SEQ ID NO: 24001 - DNA, 25 bp, Rattus norvegicus
aaccacggcattcagctggctgtga

SEQ ID NO: 24002 - DNA, 25 bp, Rattus norvegicus
aaccacggcattgagctggctgtga

SEQ ID NO: 24003 - DNA, 25 bp, Rattus norvegicus
aaccacgtgaaacgcctgcacttaa

SEQ ID NO: 24004 - DNA, 25 bp, Rattus norvegicus
aaccacgtgaaaggcctgcacttaa

SEQ ID NO: 24005 - DNA, 25 bp, Rattus norvegicus
aaccacgtgctaatattccttcatt

SEQ ID NO: 24006 - DNA, 25 bp, Rattus norvegicus
aaccacgtgctattattccttcatt

SEQ ID NO: 24007 - DNA, 25 bp, Rattus norvegicus
aaccacgtgtgacgtgactgtcagc

SEQ ID NO: 24008 - DNA, 25 bp, Rattus norvegicus
aaccacgtgtgaggtgactgtcagc

SEQ ID NO: 24009 - DNA, 25 bp, Rattus norvegicus
aaccacgttagtcctggagctgcaa

SEQ ID NO: 24010 - DNA, 25 bp, Rattus norvegicus
aaccacgttagtgctggagctgcaa

SEQ ID NO: 24011 - DNA, 25 bp, Rattus norvegicus
aaccactaagtaactgagaacattg

SEQ ID NO: 24012 - DNA, 25 bp, Rattus norvegicus
aaccactaagtatctgagaacattg

SEQ ID NO: 24013 - DNA, 25 bp, Rattus norvegicus
aaccactaccgacatgatcgctgag

SEQ ID NO: 24014 - DNA, 25 bp, Rattus norvegicus
aaccactaccgagatgatcgctgag

SEQ ID NO: 24015 - DNA, 25 bp, Rattus norvegicus
aaccactagaatactccagccattg

SEQ ID NO: 24016 - DNA, 25 bp, Rattus norvegicus
aaccactagaattctccagccattg

SEQ ID NO: 24017 - DNA, 25 bp, Rattus norvegicus
aaccactagtcaagttcagggcaaa

SEQ ID NO: 24018 - DNA, 25 bp, Rattus norvegicus
aaccactagtcatgttcagggcaaa

SEQ ID NO: 24019 - DNA, 25 bp, Rattus norvegicus
aaccactatccccagtatgtaatgg

SEQ ID NO: 24020 - DNA, 25 bp, Rattus norvegicus
aaccactatcccgagtatgtaatgg

SEQ ID NO: 24021 - DNA, 25 bp, Rattus norvegicus
aaccactcaactattagatctttat

SEQ ID NO: 24022 - DNA, 25 bp, Rattus norvegicus
aaccactcaacttttagatctttat

SEQ ID NO: 24023 - DNA, 25 bp, Rattus norvegicus
aaccactcacttagctaatagtcat

SEQ ID NO: 24024 - DNA, 25 bp, Rattus norvegicus
aaccactcactttgctaatagtcat

SEQ ID NO: 24025 - DNA, 25 bp, Rattus norvegicus
aaccactcagcaaggaggcactatt

SEQ ID NO: 24026 - DNA, 25 bp, Rattus norvegicus
aaccactcagcatggaggcactatt

SEQ ID NO: 24027 - DNA, 25 bp, Rattus norvegicus
aaccactcatgcatgttgaaaccca

SEQ ID NO: 24028 - DNA, 25 bp, Rattus norvegicus
aaccactcatgcttgttgaaaccca

SEQ ID NO: 24029 - DNA, 25 bp, Rattus norvegicus
aaccactccacgctgctatgtttgt

SEQ ID NO: 24030 - DNA, 25 bp, Rattus norvegicus
aaccactccacggtgctatgtttgt

SEQ ID NO: 24031 - DNA, 25 bp, Rattus norvegicus
aaccactccctgattgttcagagag

SEQ ID NO: 24032 - DNA, 25 bp, Rattus norvegicus
aaccactccctgtttgttcagagag

SEQ ID NO: 24033 - DNA, 25 bp, Rattus norvegicus
aaccactcgggaacaacatccctgt

SEQ ID NO: 24034 - DNA, 25 bp, Rattus norvegicus
aaccactcgggatcaacatccctgt

SEQ ID NO: 24035 - DNA, 25 bp, Rattus norvegicus
aaccactgcatgaccttttacatag

SEQ ID NO: 24036 - DNA, 25 bp, Rattus norvegicus
aaccactgcatgtccttttacatag

SEQ ID NO: 24037 - DNA, 25 bp, Rattus norvegicus
aaccactggaggcattgacctctga

SEQ ID NO: 24038 - DNA, 25 bp, Rattus norvegicus
aaccactggagggattgacctctga

SEQ ID NO: 24039 - DNA, 25 bp, Rattus norvegicus
aaccactgttctagagcctgtgctt

SEQ ID NO: 24040 - DNA, 25 bp, Rattus norvegicus
aaccactgttctattctttgtgact

SEQ ID NO: 24041 - DNA, 25 bp, Rattus norvegicus
aaccactgttcttgagcctgtgctt

SEQ ID NO: 24042 - DNA, 25 bp, Rattus norvegicus
aaccactgttcttttctttgtgact

SEQ ID NO: 24043 - DNA, 25 bp, Rattus norvegicus
aaccactgtttcctgaagacttctg

SEQ ID NO: 24044 - DNA, 25 bp, Rattus norvegicus
aaccactgtttcgtgaagacttctg

SEQ ID NO: 24045 - DNA, 25 bp, Rattus norvegicus
aaccactgttttccagcttttatgg

SEQ ID NO: 24046 - DNA, 25 bp, Rattus norvegicus
aaccactgttttgcagcttttatgg

SEQ ID NO: 24047 - DNA, 25 bp, Rattus norvegicus
aaccacttcggccaacttgtaggag

SEQ ID NO: 24048 - DNA, 25 bp, Rattus norvegicus
aaccacttcggcgaacttgtaggag

SEQ ID NO: 24049 - DNA, 25 bp, Rattus norvegicus
aaccacttgagtatgtcggcagcgc

SEQ ID NO: 24050 - DNA, 25 bp, Rattus norvegicus
aaccacttgagtttgtcggcagcgc

SEQ ID NO: 24051 - DNA, 25 bp, Rattus norvegicus
aaccacttgggactcagatcttagc

SEQ ID NO: 24052 - DNA, 25 bp, Rattus norvegicus
aaccacttgggagtcagatcttagc

SEQ ID NO: 24053 - DNA, 25 bp, Rattus norvegicus
aaccacttgggtaggctgtgagaat

SEQ ID NO: 24054 - DNA, 25 bp, Rattus norvegicus
aaccacttgggttggctgtgagaat

SEQ ID NO: 24055 - DNA, 25 bp, Rattus norvegicus
aaccacttgtggcttatttccatca

SEQ ID NO: 24056 - DNA, 25 bp, Rattus norvegicus
aaccacttgtgggttatttccatca

SEQ ID NO: 24057 - DNA, 25 bp, Rattus norvegicus
aaccacttttagagagcagttcact

SEQ ID NO: 24058 - DNA, 25 bp, Rattus norvegicus
aaccacttttagtgagcagttcact

SEQ ID NO: 24059 - DNA, 25 bp, Rattus norvegicus
aaccagaaagcaaccatcgcccgag

SEQ ID NO: 24060 - DNA, 25 bp, Rattus norvegicus
aaccagaaagcatccatcgcccgag

SEQ ID NO: 24061 - DNA, 25 bp, Rattus norvegicus
aaccagaaatggcagcagcagcaca

SEQ ID NO: 24062 - DNA, 25 bp, Rattus norvegicus
aaccagaaatgggagcagcagcaca

SEQ ID NO: 24063 - DNA, 25 bp, Rattus norvegicus
aaccagaacctcacatcttactgtt

SEQ ID NO: 24064 - DNA, 25 bp, Rattus norvegicus
aaccagaacctctcatcttactgtt

SEQ ID NO: 24065 - DNA, 25 bp, Rattus norvegicus
aaccagaagcctcccaagtcggtgt

SEQ ID NO: 24066 - DNA, 25 bp, Rattus norvegicus
aaccagaagcctgccaagtcggtgt

SEQ ID NO: 24067 - DNA, 25 bp, Rattus norvegicus
aaccagaagtgaacccgtgtagcct

SEQ ID NO: 24068 - DNA, 25 bp, Rattus norvegicus
aaccagaagtgatcccgtgtagcct

SEQ ID NO: 24069 - DNA, 25 bp, Rattus norvegicus
aaccagaatacactgcttatgcgca

SEQ ID NO: 24070 - DNA, 25 bp, Rattus norvegicus
aaccagaatacagtgcttatgcgca

SEQ ID NO: 24071 - DNA, 25 bp, Rattus norvegicus
aaccagaattacagaggagggcgct

SEQ ID NO: 24072 - DNA, 25 bp, Rattus norvegicus
aaccagaattactgaggagggcgct

SEQ ID NO: 24073 - DNA, 25 bp, Rattus norvegicus
aaccagaattgtcctcaaggcccag

SEQ ID NO: 24074 - DNA, 25 bp, Rattus norvegicus
aaccagaattgtgctcaaggcccag

SEQ ID NO: 24075 - DNA, 25 bp, Rattus norvegicus
aaccagacagtgaggtcggtgcttc

SEQ ID NO: 24076 - DNA, 25 bp, Rattus norvegicus
aaccagacagtgtggtcggtgcttc

SEQ ID NO: 24077 - DNA, 25 bp, Rattus norvegicus
aaccagaccctcagaactcttactg

SEQ ID NO: 24078 - DNA, 25 bp, Rattus norvegicus
aaccagaccctctgaactcttactg

SEQ ID NO: 24079 - DNA, 25 bp, Rattus norvegicus
aaccagacgcgcagtacattttcac

SEQ ID NO: 24080 - DNA, 25 bp, Rattus norvegicus
aaccagacgcgctgtacattttcac

SEQ ID NO: 24081 - DNA, 25 bp, Rattus norvegicus
aaccagactaaaaagaggacaggag

SEQ ID NO: 24082 - DNA, 25 bp, Rattus norvegicus
aaccagactaaatagaggacaggag

SEQ ID NO: 24083 - DNA, 25 bp, Rattus norvegicus
aaccagactcagattcagatctccc

SEQ ID NO: 24084 - DNA, 25 bp, Rattus norvegicus
aaccagactcagtttcagatctccc

SEQ ID NO: 24085 - DNA, 25 bp, Rattus norvegicus
aaccagactctaacaagttgtcctt

SEQ ID NO: 24086 - DNA, 25 bp, Rattus norvegicus
aaccagactctatcaagttgtcctt

SEQ ID NO: 24087 - DNA, 25 bp, Rattus norvegicus
aaccagactcttctcaactgttgat

SEQ ID NO: 24088 - DNA, 25 bp, Rattus norvegicus
aaccagactcttgtcaactgttgat

SEQ ID NO: 24089 - DNA, 25 bp, Rattus norvegicus
aaccagagacctcttgggagcctca

SEQ ID NO: 24090 - DNA, 25 bp, Rattus norvegicus
aaccagagacctgttgggagcctca

SEQ ID NO: 24091 - DNA, 25 bp, Rattus norvegicus
aaccagagagtcctcatagaccaca

SEQ ID NO: 24092 - DNA, 25 bp, Rattus norvegicus
aaccagagagtcgtcatagaccaca

SEQ ID NO: 24093 - DNA, 25 bp, Rattus norvegicus
aaccagagatttactaaaccctcag

SEQ ID NO: 24094 - DNA, 25 bp, Rattus norvegicus
aaccagagattttctaaaccctcag

SEQ ID NO: 24095 - DNA, 25 bp, Rattus norvegicus
aaccagagcaccagtgatgggaact

SEQ ID NO: 24096 - DNA, 25 bp, Rattus norvegicus
aaccagagcacctgtgatgggaact

SEQ ID NO: 24097 - DNA, 25 bp, Rattus norvegicus
aaccagagcactccgtggaggccga

SEQ ID NO: 24098 - DNA, 25 bp, Rattus norvegicus
aaccagagcactgcgtggaggccga

SEQ ID NO: 24099 - DNA, 25 bp, Rattus norvegicus
aaccagagccctcagatggagccaa

SEQ ID NO: 24100 - DNA, 25 bp, Rattus norvegicus
aaccagagccctgagatggagccaa

SEQ ID NO: 24101 - DNA, 25 bp, Rattus norvegicus
aaccagagcctgactatgaagccat

SEQ ID NO: 24102 - DNA, 25 bp, Rattus norvegicus
aaccagagcctgagatcccaccaga

SEQ ID NO: 24103 - DNA, 25 bp, Rattus norvegicus
aaccagagcctgtctatgaagccat

SEQ ID NO: 24104 - DNA, 25 bp, Rattus norvegicus
aaccagagcctgtgatcccaccaga

SEQ ID NO: 24105 - DNA, 25 bp, Rattus norvegicus
aaccagagcgacatccaattggcaa

SEQ ID NO: 24106 - DNA, 25 bp, Rattus norvegicus
aaccagagcgacttccaattggcaa

SEQ ID NO: 24107 - DNA, 25 bp, Rattus norvegicus
aaccagaggacgaaagagaagcttt

SEQ ID NO: 24108 - DNA, 25 bp, Rattus norvegicus
aaccagaggacgtaagagaagcttt

SEQ ID NO: 24109 - DNA, 25 bp, Rattus norvegicus
aaccagaggattcggtgttgcgtcc

SEQ ID NO: 24110 - DNA, 25 bp, Rattus norvegicus
aaccagaggattgggtgttgcgtcc

SEQ ID NO: 24111 - DNA, 25 bp, Rattus norvegicus
aaccagaggtcccttgcccaggcaa

SEQ ID NO: 24112 - DNA, 25 bp, Rattus norvegicus
aaccagaggtccgttgcccaggcaa

SEQ ID NO: 24113 - DNA, 25 bp, Rattus norvegicus
aaccagagtgcccaggcccttgaga

SEQ ID NO: 24114 - DNA, 25 bp, Rattus norvegicus
aaccagagtgccgaggcccttgaga

SEQ ID NO: 24115 - DNA, 25 bp, Rattus norvegicus
aaccagatatctctgcgggcagcct

SEQ ID NO: 24116 - DNA, 25 bp, Rattus norvegicus
aaccagatatctgtgcgggcagcct

SEQ ID NO: 24117 - DNA, 25 bp, Rattus norvegicus
aaccagatccatacacctacgatta

SEQ ID NO: 24118 - DNA, 25 bp, Rattus norvegicus
aaccagatccattcacctacgatta

SEQ ID NO: 24119 - DNA, 25 bp, Rattus norvegicus
aaccagatcggcactgtgacagaat

SEQ ID NO: 24120 - DNA, 25 bp, Rattus norvegicus
aaccagatcggctctgtgacagaat

SEQ ID NO: 24121 - DNA, 25 bp, Rattus norvegicus
aaccagatgctaattatctcttgaa

SEQ ID NO: 24122 - DNA, 25 bp, Rattus norvegicus
aaccagatgctatttatctcttgaa

SEQ ID NO: 24123 - DNA, 25 bp, Rattus norvegicus
aaccagatggccatcaatgttcagc

SEQ ID NO: 24124 - DNA, 25 bp, Rattus norvegicus
aaccagatggccttcaatgttcagc

SEQ ID NO: 24125 - DNA, 25 bp, Rattus norvegicus
aaccagatgtgcatcactgcagtct

SEQ ID NO: 24126 - DNA, 25 bp, Rattus norvegicus
aaccagatgtgcatcccttccatta

SEQ ID NO: 24127 - DNA, 25 bp, Rattus norvegicus
aaccagatgtgcttcactgcagtct

SEQ ID NO: 24128 - DNA, 25 bp, Rattus norvegicus
aaccagatgtgcttcccttccatta

SEQ ID NO: 24129 - DNA, 25 bp, Rattus norvegicus
aaccagattggtccaggctgtttct

SEQ ID NO: 24130 - DNA, 25 bp, Rattus norvegicus
aaccagattggtgcaggctgtttct

SEQ ID NO: 24131 - DNA, 25 bp, Rattus norvegicus
aaccagattttgacctgggtttctg

SEQ ID NO: 24132 - DNA, 25 bp, Rattus norvegicus
aaccagattttgtcctgggtttctg

SEQ ID NO: 24133 - DNA, 25 bp, Rattus norvegicus
aaccagcaaagcacagacttggact

SEQ ID NO: 24134 - DNA, 25 bp, Rattus norvegicus
aaccagcaaagctcagacttggact

SEQ ID NO: 24135 - DNA, 25 bp, Rattus norvegicus
aaccagcacatcactcttatggagg

SEQ ID NO: 24136 - DNA, 25 bp, Rattus norvegicus
aaccagcacatctctcttatggagg

SEQ ID NO: 24137 - DNA, 25 bp, Rattus norvegicus
aaccagcacgttcacttcgaggact

SEQ ID NO: 24138 - DNA, 25 bp, Rattus norvegicus
aaccagcacgttgacttcgaggact

SEQ ID NO: 24139 - DNA, 25 bp, Rattus norvegicus
aaccagcactacaagtgatcagcgg

SEQ ID NO: 24140 - DNA, 25 bp, Rattus norvegicus
aaccagcactactagtgatcagcgg

SEQ ID NO: 24141 - DNA, 25 bp, Rattus norvegicus
aaccagcagcacagtcagattctag

SEQ ID NO: 24142 - DNA, 25 bp, Rattus norvegicus
aaccagcagcactgtcagattctag

SEQ ID NO: 24143 - DNA, 25 bp, Rattus norvegicus
aaccagcagcctcagacgattctta

SEQ ID NO: 24144 - DNA, 25 bp, Rattus norvegicus
aaccagcagcctgagacgattctta

SEQ ID NO: 24145 - DNA, 25 bp, Rattus norvegicus
aaccagcagtgacaatcccaggact

SEQ ID NO: 24146 - DNA, 25 bp, Rattus norvegicus
aaccagcagtgagaatcccaggact

SEQ ID NO: 24147 - DNA, 25 bp, Rattus norvegicus
aaccagcatattagttttctgatgg

SEQ ID NO: 24148 - DNA, 25 bp, Rattus norvegicus
aaccagcatatttgttttctgatgg

SEQ ID NO: 24149 - DNA, 25 bp, Rattus norvegicus
aaccagcatgggatactttagagaa

SEQ ID NO: 24150 - DNA, 25 bp, Rattus norvegicus
aaccagcatgggttactttagagaa

SEQ ID NO: 24151 - DNA, 25 bp, Rattus norvegicus
aaccagcatggtctcaggcaagctt

SEQ ID NO: 24152 - DNA, 25 bp, Rattus norvegicus
aaccagcatggtgtcaggcaagctt

SEQ ID NO: 24153 - DNA, 25 bp, Rattus norvegicus
aaccagcatttcaccagatcgtatc

SEQ ID NO: 24154 - DNA, 25 bp, Rattus norvegicus
aaccagcatttctccagatcgtatc

SEQ ID NO: 24155 - DNA, 25 bp, Rattus norvegicus
aaccagccagtgattatgtgagaat

SEQ ID NO: 24156 - DNA, 25 bp, Rattus norvegicus
aaccagccagtgtttatgtgagaat

SEQ ID NO: 24157 - DNA, 25 bp, Rattus norvegicus
aaccagccagttcctagtagagaca

SEQ ID NO: 24158 - DNA, 25 bp, Rattus norvegicus
aaccagccagttgctagtagagaca

SEQ ID NO: 24159 - DNA, 25 bp, Rattus norvegicus
aaccagcctctgaatgttcatgatc

SEQ ID NO: 24160 - DNA, 25 bp, Rattus norvegicus
aaccagcctctgtatgttcatgatc

SEQ ID NO: 24161 - DNA, 25 bp, Rattus norvegicus
aaccagccttgcacgtggtgagcaa

SEQ ID NO: 24162 - DNA, 25 bp, Rattus norvegicus
aaccagccttgctcgtggtgagcaa

SEQ ID NO: 24163 - DNA, 25 bp, Rattus norvegicus
aaccagcgagcaagttcctgaccaa

SEQ ID NO: 24164 - DNA, 25 bp, Rattus norvegicus
aaccagcgagcatgttcctgaccaa

SEQ ID NO: 24165 - DNA, 25 bp, Rattus norvegicus
aaccagcgcgggacattggcttcaa

SEQ ID NO: 24166 - DNA, 25 bp, Rattus norvegicus
aaccagcgcgggtcattggcttcaa

SEQ ID NO: 24167 - DNA, 25 bp, Rattus norvegicus
aaccagcgtatgcaggagaccttca

SEQ ID NO: 24168 - DNA, 25 bp, Rattus norvegicus
aaccagcgtatggaggagaccttca

SEQ ID NO: 24169 - DNA, 25 bp, Rattus norvegicus
aaccagcgtgagcatgctggccttc

SEQ ID NO: 24170 - DNA, 25 bp, Rattus norvegicus
aaccagcgtgaggatgctggccttc

SEQ ID NO: 24171 - DNA, 25 bp, Rattus norvegicus
aaccagctatagctgatcagcccca

SEQ ID NO: 24172 - DNA, 25 bp, Rattus norvegicus
aaccagctataggtgatcagcccca

SEQ ID NO: 24173 - DNA, 25 bp, Rattus norvegicus
aaccagctctgcagtgacggtgtgc

SEQ ID NO: 24174 - DNA, 25 bp, Rattus norvegicus
aaccagctctgctgtgacggtgtgc

SEQ ID NO: 24175 - DNA, 25 bp, Rattus norvegicus
aaccagctctggctgtcagtgattt

SEQ ID NO: 24176 - DNA, 25 bp, Rattus norvegicus
aaccagctctgggtgtcagtgattt

SEQ ID NO: 24177 - DNA, 25 bp, Rattus norvegicus
aaccagctgaatctttgacctgatg

SEQ ID NO: 24178 - DNA, 25 bp, Rattus norvegicus
aaccagctgaatgtttgacctgatg

SEQ ID NO: 24179 - DNA, 25 bp, Rattus norvegicus
aaccagctgcccattttgtgagatt

SEQ ID NO: 24180 - DNA, 25 bp, Rattus norvegicus
aaccagctgccctttttgtgagatt

SEQ ID NO: 24181 - DNA, 25 bp, Rattus norvegicus
aaccagctggctaggccattattga

SEQ ID NO: 24182 - DNA, 25 bp, Rattus norvegicus
aaccagctggcttggccattattga

SEQ ID NO: 24183 - DNA, 25 bp, Rattus norvegicus
aaccagctggtactatttctcccgt

SEQ ID NO: 24184 - DNA, 25 bp, Rattus norvegicus
aaccagctggtagtatttctcccgt

SEQ ID NO: 24185 - DNA, 25 bp, Rattus norvegicus
aaccagctgtctcctgttcatggga

SEQ ID NO: 24186 - DNA, 25 bp, Rattus norvegicus
aaccagctgtctgctgttcatggga

SEQ ID NO: 24187 - DNA, 25 bp, Rattus norvegicus
aaccagctgttcagaaccttctgat

SEQ ID NO: 24188 - DNA, 25 bp, Rattus norvegicus
aaccagctgttctgaaccttctgat

SEQ ID NO: 24189 - DNA, 25 bp, Rattus norvegicus
aaccagcttaacaatctcaacaata

SEQ ID NO: 24190 - DNA, 25 bp, Rattus norvegicus
aaccagcttaactatctcaacaata

SEQ ID NO: 24191 - DNA, 25 bp, Rattus norvegicus
aaccagcttgctcgtgactgatcag

SEQ ID NO: 24192 - DNA, 25 bp, Rattus norvegicus
aaccagcttgctggtgactgatcag

SEQ ID NO: 24193 - DNA, 25 bp, Rattus norvegicus
aaccagcttggtccagacagtctga

SEQ ID NO: 24194 - DNA, 25 bp, Rattus norvegicus
aaccagcttggtgcagacagtctga

SEQ ID NO: 24195 - DNA, 25 bp, Rattus norvegicus
aaccagctttatacacaacatcagg

SEQ ID NO: 24196 - DNA, 25 bp, Rattus norvegicus
aaccagctttattcacaacatcagg

SEQ ID NO: 24197 - DNA, 25 bp, Rattus norvegicus
aaccagctttgaaccagcagaatgg

SEQ ID NO: 24198 - DNA, 25 bp, Rattus norvegicus
aaccagctttgatccagcagaatgg

SEQ ID NO: 24199 - DNA, 25 bp, Rattus norvegicus
aaccagcttttcatcattgcctttg

SEQ ID NO: 24200 - DNA, 25 bp, Rattus norvegicus
aaccagcttttcttcattgcctttg

SEQ ID NO: 24201 - DNA, 25 bp, Rattus norvegicus
aaccaggaaattattatagatctag

SEQ ID NO: 24202 - DNA, 25 bp, Rattus norvegicus
aaccaggaaatttttatagatctag

SEQ ID NO: 24203 - DNA, 25 bp, Rattus norvegicus
aaccaggaacccattagctgacagc

SEQ ID NO: 24204 - DNA, 25 bp, Rattus norvegicus
aaccaggaaccctttagctgacagc

SEQ ID NO: 24205 - DNA, 25 bp, Rattus norvegicus
aaccaggaagccagtccatggcgac

SEQ ID NO: 24206 - DNA, 25 bp, Rattus norvegicus
aaccaggaagcctgtccatggcgac

SEQ ID NO: 24207 - DNA, 25 bp, Rattus norvegicus
aaccaggactctctgtttttgtgag

SEQ ID NO: 24208 - DNA, 25 bp, Rattus norvegicus
aaccaggactctgtgtttttgtgag

SEQ ID NO: 24209 - DNA, 25 bp, Rattus norvegicus
aaccaggactttctgcactgttctg

SEQ ID NO: 24210 - DNA, 25 bp, Rattus norvegicus
aaccaggactttgtgcactgttctg

SEQ ID NO: 24211 - DNA, 25 bp, Rattus norvegicus
aaccaggagacactacgggccacag

SEQ ID NO: 24212 - DNA, 25 bp, Rattus norvegicus
aaccaggagacagtacgggccacag

SEQ ID NO: 24213 - DNA, 25 bp, Rattus norvegicus
aaccaggagtctataggcaaacgct

SEQ ID NO: 24214 - DNA, 25 bp, Rattus norvegicus
aaccaggagtctttaggcaaacgct

SEQ ID NO: 24215 - DNA, 25 bp, Rattus norvegicus
aaccaggagtggcatgtcgttccct

SEQ ID NO: 24216 - DNA, 25 bp, Rattus norvegicus
aaccaggagtgggatgtcgttccct

SEQ ID NO: 24217 - DNA, 25 bp, Rattus norvegicus
aaccaggatacacagccctgctcta

SEQ ID NO: 24218 - DNA, 25 bp, Rattus norvegicus
aaccaggatacagagccctgctcta

SEQ ID NO: 24219 - DNA, 25 bp, Rattus norvegicus
aaccaggatcggctacttcaagtaa

SEQ ID NO: 24220 - DNA, 25 bp, Rattus norvegicus
aaccaggatcgggtacttcaagtaa

SEQ ID NO: 24221 - DNA, 25 bp, Rattus norvegicus
aaccaggcaaatagtcttcccaaca

SEQ ID NO: 24222 - DNA, 25 bp, Rattus norvegicus
aaccaggcaaattgtcttcccaaca

SEQ ID NO: 24223 - DNA, 25 bp, Rattus norvegicus
aaccaggcagccagctgtagacagc

SEQ ID NO: 24224 - DNA, 25 bp, Rattus norvegicus
aaccaggcagcctgctgtagacagc

SEQ ID NO: 24225 - DNA, 25 bp, Rattus norvegicus
aaccaggcatgtacagttttgagaa

SEQ ID NO: 24226 - DNA, 25 bp, Rattus norvegicus
aaccaggcatgttcagttttgagaa

SEQ ID NO: 24227 - DNA, 25 bp, Rattus norvegicus
aaccaggccatccaggctgtgcgtg

SEQ ID NO: 24228 - DNA, 25 bp, Rattus norvegicus
aaccaggccatcgaggctgtgcgtg

SEQ ID NO: 24229 - DNA, 25 bp, Rattus norvegicus
aaccaggcgttgacaaacccagtct

SEQ ID NO: 24230 - DNA, 25 bp, Rattus norvegicus
aaccaggcgttgtcaaacccagtct

SEQ ID NO: 24231 - DNA, 25 bp, Rattus norvegicus
aaccaggctctcagcaaattagaca

SEQ ID NO: 24232 - DNA, 25 bp, Rattus norvegicus
aaccaggctctctgcaaattagaca

SEQ ID NO: 24233 - DNA, 25 bp, Rattus norvegicus
aaccaggctctgaaatctactcatc

SEQ ID NO: 24234 - DNA, 25 bp, Rattus norvegicus
aaccaggctctgtaatctactcatc

SEQ ID NO: 24235 - DNA, 25 bp, Rattus norvegicus
aaccaggcttctagttgttcgtgat

SEQ ID NO: 24236 - DNA, 25 bp, Rattus norvegicus
aaccaggcttcttgttgttcgtgat

SEQ ID NO: 24237 - DNA, 25 bp, Rattus norvegicus
aaccagggcaatctgtacattccag

SEQ ID NO: 24238 - DNA, 25 bp, Rattus norvegicus
aaccagggcaatgtgtacattccag

SEQ ID NO: 24239 - DNA, 25 bp, Rattus norvegicus
aaccagggcaccaggaggcaggaac

SEQ ID NO: 24240 - DNA, 25 bp, Rattus norvegicus
aaccagggcacctggaggcaggaac

SEQ ID NO: 24241 - DNA, 25 bp, Rattus norvegicus
aaccagggcagacgcacgcccagga

SEQ ID NO: 24242 - DNA, 25 bp, Rattus norvegicus
aaccagggcagaggcacgcccagga

SEQ ID NO: 24243 - DNA, 25 bp, Rattus norvegicus
aaccagggcagcatcacgtttgcag

SEQ ID NO: 24244 - DNA, 25 bp, Rattus norvegicus
aaccagggcagcttcacgtttgcag

SEQ ID NO: 24245 - DNA, 25 bp, Rattus norvegicus
aaccagggcatgactgagcctcatg

SEQ ID NO: 24246 - DNA, 25 bp, Rattus norvegicus
aaccagggcatgtctgagcctcatg

SEQ ID NO: 24247 - DNA, 25 bp, Rattus norvegicus
aaccagggccagatgtgcatcaaca

SEQ ID NO: 24248 - DNA, 25 bp, Rattus norvegicus
aaccagggccagttgtgcatcaaca

SEQ ID NO: 24249 - DNA, 25 bp, Rattus norvegicus
aaccagggtcgtatcttggcatgta

SEQ ID NO: 24250 - DNA, 25 bp, Rattus norvegicus
aaccagggtcgtttcttggcatgta

SEQ ID NO: 24251 - DNA, 25 bp, Rattus norvegicus
aaccagggtggacctggcccaagtc

SEQ ID NO: 24252 - DNA, 25 bp, Rattus norvegicus
aaccagggtggagctggcccaagtc

SEQ ID NO: 24253 - DNA, 25 bp, Rattus norvegicus
aaccaggtatcaacttgcacgtgct

SEQ ID NO: 24254 - DNA, 25 bp, Rattus norvegicus
aaccaggtatcatcttgcacgtgct

SEQ ID NO: 24255 - DNA, 25 bp, Rattus norvegicus
aaccaggtgatacgtgcctgacctt

SEQ ID NO: 24256 - DNA, 25 bp, Rattus norvegicus
aaccaggtgataggtgcctgacctt

SEQ ID NO: 24257 - DNA, 25 bp, Rattus norvegicus
aaccaggtgcatattgttgcctctg

SEQ ID NO: 24258 - DNA, 25 bp, Rattus norvegicus
aaccaggtgcattttgttgcctctg

SEQ ID NO: 24259 - DNA, 25 bp, Rattus norvegicus
aaccaggtgccaagagcgtggctgc

SEQ ID NO: 24260 - DNA, 25 bp, Rattus norvegicus
aaccaggtgccatgagcgtggctgc

SEQ ID NO: 24261 - DNA, 25 bp, Rattus norvegicus
aaccaggtgctcactgtgggtacca

SEQ ID NO: 24262 - DNA, 25 bp, Rattus norvegicus
aaccaggtgctctctgtgggtacca

SEQ ID NO: 24263 - DNA, 25 bp, Rattus norvegicus
aaccaggttagacagctccctgcac

SEQ ID NO: 24264 - DNA, 25 bp, Rattus norvegicus
aaccaggttagagagctccctgcac

SEQ ID NO: 24265 - DNA, 25 bp, Rattus norvegicus
aaccaggttgctccagaagtggcta

SEQ ID NO: 24266 - DNA, 25 bp, Rattus norvegicus
aaccaggttgctgcagaagtggcta

SEQ ID NO: 24267 - DNA, 25 bp, Rattus norvegicus
aaccaggtttcccactagatctctg

SEQ ID NO: 24268 - DNA, 25 bp, Rattus norvegicus
aaccaggtttccgactagatctctg

SEQ ID NO: 24269 - DNA, 25 bp, Rattus norvegicus
aaccagtaacgccatgaagtccaat

SEQ ID NO: 24270 - DNA, 25 bp, Rattus norvegicus
aaccagtaacgcgatgaagtccaat

SEQ ID NO: 24271 - DNA, 25 bp, Rattus norvegicus
aaccagtaccaaagagtccctctgc

SEQ ID NO: 24272 - DNA, 25 bp, Rattus norvegicus
aaccagtaccaatgagtccctctgc

SEQ ID NO: 24273 - DNA, 25 bp, Rattus norvegicus
aaccagtaccgcctggtggacttgg

SEQ ID NO: 24274 - DNA, 25 bp, Rattus norvegicus
aaccagtaccgcgtggtggacttgg

SEQ ID NO: 24275 - DNA, 25 bp, Rattus norvegicus
aaccagtactgcagcccggagcgga

SEQ ID NO: 24276 - DNA, 25 bp, Rattus norvegicus
aaccagtactgctgcccggagcgga

SEQ ID NO: 24277 - DNA, 25 bp, Rattus norvegicus
aaccagtagctacttgcatgacctt

SEQ ID NO: 24278 - DNA, 25 bp, Rattus norvegicus
aaccagtagctagttgcatgacctt

SEQ ID NO: 24279 - DNA, 25 bp, Rattus norvegicus
aaccagtaggctccttgcctttaac

SEQ ID NO: 24280 - DNA, 25 bp, Rattus norvegicus
aaccagtaggctgcttgcctttaac

SEQ ID NO: 24281 - DNA, 25 bp, Rattus norvegicus
aaccagtagtgtcgctgctttgcaa

SEQ ID NO: 24282 - DNA, 25 bp, Rattus norvegicus
aaccagtagtgtggctgctttgcaa

SEQ ID NO: 24283 - DNA, 25 bp, Rattus norvegicus
aaccagtagtttccatatatttcag

SEQ ID NO: 24284 - DNA, 25 bp, Rattus norvegicus
aaccagtagtttgcatatatttcag

SEQ ID NO: 24285 - DNA, 25 bp, Rattus norvegicus
aaccagtatcttctgaggagacact

SEQ ID NO: 24286 - DNA, 25 bp, Rattus norvegicus
aaccagtatcttgtgaggagacact

SEQ ID NO: 24287 - DNA, 25 bp, Rattus norvegicus
aaccagtattcaccttcatccttat

SEQ ID NO: 24288 - DNA, 25 bp, Rattus norvegicus
aaccagtattcagcttcatccttat

SEQ ID NO: 24289 - DNA, 25 bp, Rattus norvegicus
aaccagtcaaacacatgggatgcat

SEQ ID NO: 24290 - DNA, 25 bp, Rattus norvegicus
aaccagtcaaactcatgggatgcat

SEQ ID NO: 24291 - DNA, 25 bp, Rattus norvegicus
aaccagtcactgctaccagaacatt

SEQ ID NO: 24292 - DNA, 25 bp, Rattus norvegicus
aaccagtcactggtaccagaacatt

SEQ ID NO: 24293 - DNA, 25 bp, Rattus norvegicus
aaccagtcagttcgccatacagtat

SEQ ID NO: 24294 - DNA, 25 bp, Rattus norvegicus
aaccagtcagttggccatacagtat

SEQ ID NO: 24295 - DNA, 25 bp, Rattus norvegicus
aaccagtcccagcactttcagtcag

SEQ ID NO: 24296 - DNA, 25 bp, Rattus norvegicus
aaccagtcccaggactttcagtcag

SEQ ID NO: 24297 - DNA, 25 bp, Rattus norvegicus
aaccagtcccgcaaatggcacagaa

SEQ ID NO: 24298 - DNA, 25 bp, Rattus norvegicus
aaccagtcccgctaatggcacagaa

SEQ ID NO: 24299 - DNA, 25 bp, Rattus norvegicus
aaccagtctggaatgcttttaggaa

SEQ ID NO: 24300 - DNA, 25 bp, Rattus norvegicus
aaccagtctggattgcttttaggaa

SEQ ID NO: 24301 - DNA, 25 bp, Rattus norvegicus
aaccagtgagccatttgagccatct

SEQ ID NO: 24302 - DNA, 25 bp, Rattus norvegicus
aaccagtgagccttttgagccatct

SEQ ID NO: 24303 - DNA, 25 bp, Rattus norvegicus
aaccagtgattcaagctatactatg

SEQ ID NO: 24304 - DNA, 25 bp, Rattus norvegicus
aaccagtgattctagctatactatg

SEQ ID NO: 24305 - DNA, 25 bp, Rattus norvegicus
aaccagtgcaatcttccgtttcatc

SEQ ID NO: 24306 - DNA, 25 bp, Rattus norvegicus
aaccagtgcaatgttccgtttcatc

SEQ ID NO: 24307 - DNA, 25 bp, Rattus norvegicus
aaccagtgcaggaccgctgacagtt

SEQ ID NO: 24308 - DNA, 25 bp, Rattus norvegicus
aaccagtgcaggtccgctgacagtt

SEQ ID NO: 24309 - DNA, 25 bp, Rattus norvegicus
aaccagtgctggagtcctagtgctg

SEQ ID NO: 24310 - DNA, 25 bp, Rattus norvegicus
aaccagtgctggtgtcctagtgctg

SEQ ID NO: 24311 - DNA, 25 bp, Rattus norvegicus
aaccagtggcagcagggtcaattct

SEQ ID NO: 24312 - DNA, 25 bp, Rattus norvegicus
aaccagtggcaggagggtcaattct

SEQ ID NO: 24313 - DNA, 25 bp, Rattus norvegicus
aaccagtgggagctgtgagcaccta

SEQ ID NO: 24314 - DNA, 25 bp, Rattus norvegicus
aaccagtgggaggtgtgagcaccta

SEQ ID NO: 24315 - DNA, 25 bp, Rattus norvegicus
aaccagtgtacaatgtgctttgtgt

SEQ ID NO: 24316 - DNA, 25 bp, Rattus norvegicus
aaccagtgtacattgtgctttgtgt

SEQ ID NO: 24317 - DNA, 25 bp, Rattus norvegicus
aaccagtgtcaccaagaatttccat

SEQ ID NO: 24318 - DNA, 25 bp, Rattus norvegicus
aaccagtgtcacgaagaatttccat

SEQ ID NO: 24319 - DNA, 25 bp, Rattus norvegicus
aaccagtgtctgcatgctgctccaa

SEQ ID NO: 24320 - DNA, 25 bp, Rattus norvegicus
aaccagtgtctggatgctgctccaa

SEQ ID NO: 24321 - DNA, 25 bp, Rattus norvegicus
aaccagtgtgatcgaccgtcacgct

SEQ ID NO: 24322 - DNA, 25 bp, Rattus norvegicus
aaccagtgtgatggaccgtcacgct

SEQ ID NO: 24323 - DNA, 25 bp, Rattus norvegicus
aaccagtgtgctatgactgtcctac

SEQ ID NO: 24324 - DNA, 25 bp, Rattus norvegicus
aaccagtgtgctttgactgtcctac

SEQ ID NO: 24325 - DNA, 25 bp, Rattus norvegicus
aaccagttacgactgaagtcagtgt

SEQ ID NO: 24326 - DNA, 25 bp, Rattus norvegicus
aaccagttacgagtgaagtcagtgt

SEQ ID NO: 24327 - DNA, 25 bp, Rattus norvegicus
aaccagttagctccagtctgtactc

SEQ ID NO: 24328 - DNA, 25 bp, Rattus norvegicus
aaccagttagctgcagtctgtactc

SEQ ID NO: 24329 - DNA, 25 bp, Rattus norvegicus
aaccagttccgcatacaggaggtat

SEQ ID NO: 24330 - DNA, 25 bp, Rattus norvegicus
aaccagttccgcttacaggaggtat

SEQ ID NO: 24331 - DNA, 25 bp, Rattus norvegicus
aaccagttcctaacgcaagtggact

SEQ ID NO: 24332 - DNA, 25 bp, Rattus norvegicus
aaccagttcctatcgcaagtggact

SEQ ID NO: 24333 - DNA, 25 bp, Rattus norvegicus
aaccagttctggcatgaaacatcaa

SEQ ID NO: 24334 - DNA, 25 bp, Rattus norvegicus
aaccagttctgggatgaaacatcaa

SEQ ID NO: 24335 - DNA, 25 bp, Rattus norvegicus
aaccagttgctgcagtgcttggcca

SEQ ID NO: 24336 - DNA, 25 bp, Rattus norvegicus
aaccagttgctggagtgcttggcca

SEQ ID NO: 24337 - DNA, 25 bp, Rattus norvegicus
aaccagttgcttctactgcttctca

SEQ ID NO: 24338 - DNA, 25 bp, Rattus norvegicus
aaccagttgcttgtactgcttctca

SEQ ID NO: 24339 - DNA, 25 bp, Rattus norvegicus
aaccagttggtgcttagagatccct

SEQ ID NO: 24340 - DNA, 25 bp, Rattus norvegicus
aaccagttggtggttagagatccct

SEQ ID NO: 24341 - DNA, 25 bp, Rattus norvegicus
aaccagttgtctattgtcctacaga

SEQ ID NO: 24342 - DNA, 25 bp, Rattus norvegicus
aaccagttgtcttttgtcctacaga

SEQ ID NO: 24343 - DNA, 25 bp, Rattus norvegicus
aaccataacaagcaccatttgagga

SEQ ID NO: 24344 - DNA, 25 bp, Rattus norvegicus
aaccataacaaggaccatttgagga

SEQ ID NO: 24345 - DNA, 25 bp, Rattus norvegicus
aaccataagaatccagacaagactg

SEQ ID NO: 24346 - DNA, 25 bp, Rattus norvegicus
aaccataagaatgcagacaagactg

SEQ ID NO: 24347 - DNA, 25 bp, Rattus norvegicus
aaccatacaccgagtacccacaggg

SEQ ID NO: 24348 - DNA, 25 bp, Rattus norvegicus
aaccatacaccgtgtacccacaggg

SEQ ID NO: 24349 - DNA, 25 bp, Rattus norvegicus
aaccatacactgacacactgactga

SEQ ID NO: 24350 - DNA, 25 bp, Rattus norvegicus
aaccatacactgtcacactgactga

SEQ ID NO: 24351 - DNA, 25 bp, Rattus norvegicus
aaccatacggttctatgtgaggtgc

SEQ ID NO: 24352 - DNA, 25 bp, Rattus norvegicus
aaccatacggttgtatgtgaggtgc

SEQ ID NO: 24353 - DNA, 25 bp, Rattus norvegicus
aaccatactgatcagtgtctagcta

SEQ ID NO: 24354 - DNA, 25 bp, Rattus norvegicus
aaccatactgatgagtgtctagcta

SEQ ID NO: 24355 - DNA, 25 bp, Rattus norvegicus
aaccatacttggatcatgtcttcca

SEQ ID NO: 24356 - DNA, 25 bp, Rattus norvegicus
aaccatacttggttcatgtcttcca

SEQ ID NO: 24357 - DNA, 25 bp, Rattus norvegicus
aaccatagatttcaagcagtgactt

SEQ ID NO: 24358 - DNA, 25 bp, Rattus norvegicus
aaccatagatttgaagcagtgactt

SEQ ID NO: 24359 - DNA, 25 bp, Rattus norvegicus
aaccatagcctgctttgtagccata

SEQ ID NO: 24360 - DNA, 25 bp, Rattus norvegicus
aaccatagcctggtttgtagccata

SEQ ID NO: 24361 - DNA, 25 bp, Rattus norvegicus
aaccatagctcgatcctgaacttga

SEQ ID NO: 24362 - DNA, 25 bp, Rattus norvegicus
aaccatagctcgttcctgaacttga

SEQ ID NO: 24363 - DNA, 25 bp, Rattus norvegicus
aaccataggcttctttcatgtcaga

SEQ ID NO: 24364 - DNA, 25 bp, Rattus norvegicus
aaccataggcttgtttcatgtcaga

SEQ ID NO: 24365 - DNA, 25 bp, Rattus norvegicus
aaccatagggatctcctttgtggct

SEQ ID NO: 24366 - DNA, 25 bp, Rattus norvegicus
aaccatagggatgtcctttgtggct

SEQ ID NO: 24367 - DNA, 25 bp, Rattus norvegicus
aaccatagtcccacaaatcttcaga

SEQ ID NO: 24368 - DNA, 25 bp, Rattus norvegicus
aaccatagtccctcaaatcttcaga

SEQ ID NO: 24369 - DNA, 25 bp, Rattus norvegicus
aaccatagtgatatacctgtacgta

SEQ ID NO: 24370 - DNA, 25 bp, Rattus norvegicus
aaccatagtgatttacctgtacgta

SEQ ID NO: 24371 - DNA, 25 bp, Rattus norvegicus
aaccatagttcaatgtctctgctgt

SEQ ID NO: 24372 - DNA, 25 bp, Rattus norvegicus
aaccatagttcattgtctctgctgt

SEQ ID NO: 24373 - DNA, 25 bp, Rattus norvegicus
aaccatatccgacagcagtcgtgtc

SEQ ID NO: 24374 - DNA, 25 bp, Rattus norvegicus
aaccatatccgagagcagtcgtgtc

SEQ ID NO: 24375 - DNA, 25 bp, Rattus norvegicus
aaccatatgtagattgtcttctata

SEQ ID NO: 24376 - DNA, 25 bp, Rattus norvegicus
aaccatatgtagtttgtcttctata

SEQ ID NO: 24377 - DNA, 25 bp, Rattus norvegicus
aaccatcaaaatctattcccatcct

SEQ ID NO: 24378 - DNA, 25 bp, Rattus norvegicus
aaccatcaaaatgtattcccatcct

SEQ ID NO: 24379 - DNA, 25 bp, Rattus norvegicus
aaccatcaaatgctgtgctattcta

SEQ ID NO: 24380 - DNA, 25 bp, Rattus norvegicus
aaccatcaaatggtgtgctattcta

SEQ ID NO: 24381 - DNA, 25 bp, Rattus norvegicus
aaccatcaaccgaagagtacatatg

SEQ ID NO: 24382 - DNA, 25 bp, Rattus norvegicus
aaccatcaaccgtagagtacatatg

SEQ ID NO: 24383 - DNA, 25 bp, Rattus norvegicus
aaccatcactgtatgaagtgtgtgg

SEQ ID NO: 24384 - DNA, 25 bp, Rattus norvegicus
aaccatcactgtttgaagtgtgtgg

SEQ ID NO: 24385 - DNA, 25 bp, Rattus norvegicus
aaccatcacttgaggtagccggact

SEQ ID NO: 24386 - DNA, 25 bp, Rattus norvegicus
aaccatcacttgtggtagccggact

SEQ ID NO: 24387 - DNA, 25 bp, Rattus norvegicus
aaccatcagaccacagttgtacaag

SEQ ID NO: 24388 - DNA, 25 bp, Rattus norvegicus
aaccatcagacctcagttgtacaag

SEQ ID NO: 24389 - DNA, 25 bp, Rattus norvegicus
aaccatcagattattgacaaacctg

SEQ ID NO: 24390 - DNA, 25 bp, Rattus norvegicus
aaccatcagatttttgacaaacctg

SEQ ID NO: 24391 - DNA, 25 bp, Rattus norvegicus
aaccatcagtgtagacgttcttaat

SEQ ID NO: 24392 - DNA, 25 bp, Rattus norvegicus
aaccatcagtgttgacgttcttaat

SEQ ID NO: 24393 - DNA, 25 bp, Rattus norvegicus
aaccatcatcacacatcattaatta

SEQ ID NO: 24394 - DNA, 25 bp, Rattus norvegicus
aaccatcatcactcatcattaatta

SEQ ID NO: 24395 - DNA, 25 bp, Rattus norvegicus
aaccatccaacaccaaacactgttg

SEQ ID NO: 24396 - DNA, 25 bp, Rattus norvegicus
aaccatccaacagcaaacactgttg

SEQ ID NO: 24397 - DNA, 25 bp, Rattus norvegicus
aaccatccacaacctgattcagagt

SEQ ID NO: 24398 - DNA, 25 bp, Rattus norvegicus
aaccatccacaagctgattcagagt

SEQ ID NO: 24399 - DNA, 25 bp, Rattus norvegicus
aaccatccagtgagaaccttgcttc

SEQ ID NO: 24400 - DNA, 25 bp, Rattus norvegicus
aaccatccagtgtgaaccttgcttc

SEQ ID NO: 24401 - DNA, 25 bp, Rattus norvegicus
aaccatccagttcttttgtcagtca

SEQ ID NO: 24402 - DNA, 25 bp, Rattus norvegicus
aaccatccagttgttttgtcagtca

SEQ ID NO: 24403 - DNA, 25 bp, Rattus norvegicus
aaccatccattcatatgtttgtgtg

SEQ ID NO: 24404 - DNA, 25 bp, Rattus norvegicus
aaccatccattcttatgtttgtgtg

SEQ ID NO: 24405 - DNA, 25 bp, Rattus norvegicus
aaccatcccatgactgtagtcagct

SEQ ID NO: 24406 - DNA, 25 bp, Rattus norvegicus
aaccatcccatgtctgtagtcagct

SEQ ID NO: 24407 - DNA, 25 bp, Rattus norvegicus
aaccatccggaccaggaagttcatg

SEQ ID NO: 24408 - DNA, 25 bp, Rattus norvegicus
aaccatccggacgaggaagttcatg

SEQ ID NO: 24409 - DNA, 25 bp, Rattus norvegicus
aaccatcctcacattattttcttca

SEQ ID NO: 24410 - DNA, 25 bp, Rattus norvegicus
aaccatcctcactttattttcttca

SEQ ID NO: 24411 - DNA, 25 bp, Rattus norvegicus
aaccatcctcgaacgcatgagggtg

SEQ ID NO: 24412 - DNA, 25 bp, Rattus norvegicus
aaccatcctcgatcgcatgagggtg

SEQ ID NO: 24413 - DNA, 25 bp, Rattus norvegicus
aaccatcctgacattttagatctta

SEQ ID NO: 24414 - DNA, 25 bp, Rattus norvegicus
aaccatcctgactttttagatctta

SEQ ID NO: 24415 - DNA, 25 bp, Rattus norvegicus
aaccatcctggtcgatgtggacccc

SEQ ID NO: 24416 - DNA, 25 bp, Rattus norvegicus
aaccatcctggtggatgtggacccc

SEQ ID NO: 24417 - DNA, 25 bp, Rattus norvegicus
aaccatcctgtaatgaaccgttcct

SEQ ID NO: 24418 - DNA, 25 bp, Rattus norvegicus
aaccatcctgtattgaaccgttcct

SEQ ID NO: 24419 - DNA, 25 bp, Rattus norvegicus
aaccatccttccattagacgtcatg

SEQ ID NO: 24420 - DNA, 25 bp, Rattus norvegicus
aaccatccttccattgactcaagag

SEQ ID NO: 24421 - DNA, 25 bp, Rattus norvegicus
aaccatccttcctttagacgtcatg

SEQ ID NO: 24422 - DNA, 25 bp, Rattus norvegicus
aaccatccttcctttgactcaagag

SEQ ID NO: 24423 - DNA, 25 bp, Rattus norvegicus
aaccatccttggaaatcttgccacg

SEQ ID NO: 24424 - DNA, 25 bp, Rattus norvegicus
aaccatccttggtaatcttgccacg

SEQ ID NO: 24425 - DNA, 25 bp, Rattus norvegicus
aaccatcgaagacttttaccgcaag

SEQ ID NO: 24426 - DNA, 25 bp, Rattus norvegicus
aaccatcgaagagttttaccgcaag

SEQ ID NO: 24427 - DNA, 25 bp, Rattus norvegicus
aaccatcggaatatgaattctcttg

SEQ ID NO: 24428 - DNA, 25 bp, Rattus norvegicus
aaccatcggaatttgaattctcttg

SEQ ID NO: 24429 - DNA, 25 bp, Rattus norvegicus
aaccatctcatccaaagtcaccgtg

SEQ ID NO: 24430 - DNA, 25 bp, Rattus norvegicus
aaccatctcatcgaaagtcaccgtg

SEQ ID NO: 24431 - DNA, 25 bp, Rattus norvegicus
aaccatctcccactctcaggaaagt

SEQ ID NO: 24432 - DNA, 25 bp, Rattus norvegicus
aaccatctcccagtctcaggaaagt

SEQ ID NO: 24433 - DNA, 25 bp, Rattus norvegicus
aaccatctctccagcttattttgaa

SEQ ID NO: 24434 - DNA, 25 bp, Rattus norvegicus
aaccatctctcctgcttattttgaa

SEQ ID NO: 24435 - DNA, 25 bp, Rattus norvegicus
aaccatctgagaattgcgcacattt

SEQ ID NO: 24436 - DNA, 25 bp, Rattus norvegicus
aaccatctgagatttgcgcacattt

SEQ ID NO: 24437 - DNA, 25 bp, Rattus norvegicus
aaccatctgcctcgagacctttaag

SEQ ID NO: 24438 - DNA, 25 bp, Rattus norvegicus
aaccatctgcctggagacctttaag

SEQ ID NO: 24439 - DNA, 25 bp, Rattus norvegicus
aaccatctgtaactcactttctatc

SEQ ID NO: 24440 - DNA, 25 bp, Rattus norvegicus
aaccatctgtaagtcactttctatc

SEQ ID NO: 24441 - DNA, 25 bp, Rattus norvegicus
aaccatctgtggctactgtatatcg

SEQ ID NO: 24442 - DNA, 25 bp, Rattus norvegicus
aaccatctgtgggtactgtatatcg

SEQ ID NO: 24443 - DNA, 25 bp, Rattus norvegicus
aaccatcttcagctccactatgtgt

SEQ ID NO: 24444 - DNA, 25 bp, Rattus norvegicus
aaccatcttcaggtccactatgtgt

SEQ ID NO: 24445 - DNA, 25 bp, Rattus norvegicus
aaccatcttgatcaccttgtactcc

SEQ ID NO: 24446 - DNA, 25 bp, Rattus norvegicus
aaccatcttgatgaccttgtactcc

SEQ ID NO: 24447 - DNA, 25 bp, Rattus norvegicus
aaccatgaacatattccagggactg

SEQ ID NO: 24448 - DNA, 25 bp, Rattus norvegicus
aaccatgaacattttccagggactg

SEQ ID NO: 24449 - DNA, 25 bp, Rattus norvegicus
aaccatgaagatacctcgttttgaa

SEQ ID NO: 24450 - DNA, 25 bp, Rattus norvegicus
aaccatgaagattcctcgttttgaa

SEQ ID NO: 24451 - DNA, 25 bp, Rattus norvegicus
aaccatgacattcactatgtgccaa

SEQ ID NO: 24452 - DNA, 25 bp, Rattus norvegicus
aaccatgacattgactatgtgccaa

SEQ ID NO: 24453 - DNA, 25 bp, Rattus norvegicus
aaccatgacgtcatcccagagtatg

SEQ ID NO: 24454 - DNA, 25 bp, Rattus norvegicus
aaccatgacgtcttcccagagtatg

SEQ ID NO: 24455 - DNA, 25 bp, Rattus norvegicus
aaccatgagatcctgcgggaggcct

SEQ ID NO: 24456 - DNA, 25 bp, Rattus norvegicus
aaccatgagatcgtgcgggaggcct

SEQ ID NO: 24457 - DNA, 25 bp, Rattus norvegicus
aaccatgagcgcatgttgcaaaaac

SEQ ID NO: 24458 - DNA, 25 bp, Rattus norvegicus
aaccatgagcgcttgttgcaaaaac

SEQ ID NO: 24459 - DNA, 25 bp, Rattus norvegicus
aaccatgatgacagggcgctgacat

SEQ ID NO: 24460 - DNA, 25 bp, Rattus norvegicus
aaccatgatgactgggcgctgacat

SEQ ID NO: 24461 - DNA, 25 bp, Rattus norvegicus
aaccatgatgcaattcttctcacgc

SEQ ID NO: 24462 - DNA, 25 bp, Rattus norvegicus
aaccatgatgcatttcttctcacgc

SEQ ID NO: 24463 - DNA, 25 bp, Rattus norvegicus
aaccatgatgtgattcatcctgcag

SEQ ID NO: 24464 - DNA, 25 bp, Rattus norvegicus
aaccatgatgtgtttcatcctgcag

SEQ ID NO: 24465 - DNA, 25 bp, Rattus norvegicus
aaccatgcactcaatactgcttggc

SEQ ID NO: 24466 - DNA, 25 bp, Rattus norvegicus
aaccatgcactctatactgcttggc

SEQ ID NO: 24467 - DNA, 25 bp, Rattus norvegicus
aaccatgcaggcatcgtcactgttg

SEQ ID NO: 24468 - DNA, 25 bp, Rattus norvegicus
aaccatgcaggcttcgtcactgttg

SEQ ID NO: 24469 - DNA, 25 bp, Rattus norvegicus
aaccatgcatttacttgattctaag

SEQ ID NO: 24470 - DNA, 25 bp, Rattus norvegicus
aaccatgcattttcttgattctaag

SEQ ID NO: 24471 - DNA, 25 bp, Rattus norvegicus
aaccatgccgtgagctgcactgagg

SEQ ID NO: 24472 - DNA, 25 bp, Rattus norvegicus
aaccatgccgtgtgctgcactgagg

SEQ ID NO: 24473 - DNA, 25 bp, Rattus norvegicus
aaccatgcctttccccagagaggaa

SEQ ID NO: 24474 - DNA, 25 bp, Rattus norvegicus
aaccatgcctttgcccagagaggaa

SEQ ID NO: 24475 - DNA, 25 bp, Rattus norvegicus
aaccatgcggacagtagtgctcaca

SEQ ID NO: 24476 - DNA, 25 bp, Rattus norvegicus
aaccatgcggactgtagtgctcaca

SEQ ID NO: 24477 - DNA, 25 bp, Rattus norvegicus
aaccatgctgaactactcggtagtt

SEQ ID NO: 24478 - DNA, 25 bp, Rattus norvegicus
aaccatgctgaagtactcggtagtt

SEQ ID NO: 24479 - DNA, 25 bp, Rattus norvegicus
aaccatgctgccaggcatgatgata

SEQ ID NO: 24480 - DNA, 25 bp, Rattus norvegicus
aaccatgctgcctggcatgatgata

SEQ ID NO: 24481 - DNA, 25 bp, Rattus norvegicus
aaccatgcttcacgttatccctggt

SEQ ID NO: 24482 - DNA, 25 bp, Rattus norvegicus
aaccatgcttcaggttatccctggt

SEQ ID NO: 24483 - DNA, 25 bp, Rattus norvegicus
aaccatggaaatactgtgctttgca

SEQ ID NO: 24484 - DNA, 25 bp, Rattus norvegicus
aaccatggaaattctgtgctttgca

SEQ ID NO: 24485 - DNA, 25 bp, Rattus norvegicus
aaccatggacaacacagctgactgc

SEQ ID NO: 24486 - DNA, 25 bp, Rattus norvegicus
aaccatggacaacttctttccctga

SEQ ID NO: 24487 - DNA, 25 bp, Rattus norvegicus
aaccatggacaagacagctgactgc

SEQ ID NO: 24488 - DNA, 25 bp, Rattus norvegicus
aaccatggacaagttctttccctga

SEQ ID NO: 24489 - DNA, 25 bp, Rattus norvegicus
aaccatggactacagtgtgagcctt

SEQ ID NO: 24490 - DNA, 25 bp, Rattus norvegicus
aaccatggactagagtgtgagcctt

SEQ ID NO: 24491 - DNA, 25 bp, Rattus norvegicus
aaccatggacttaataagcccgcgt

SEQ ID NO: 24492 - DNA, 25 bp, Rattus norvegicus
aaccatggactttataagcccgcgt

SEQ ID NO: 24493 - DNA, 25 bp, Rattus norvegicus
aaccatggagtcattgatgggagga

SEQ ID NO: 24494 - DNA, 25 bp, Rattus norvegicus
aaccatggagtctttgatgggagga

SEQ ID NO: 24495 - DNA, 25 bp, Rattus norvegicus
aaccatggcataacatctgggcgct

SEQ ID NO: 24496 - DNA, 25 bp, Rattus norvegicus
aaccatggcatatcatctgggcgct

SEQ ID NO: 24497 - DNA, 25 bp, Rattus norvegicus
aaccatggccaaattatgctgcaca

SEQ ID NO: 24498 - DNA, 25 bp, Rattus norvegicus
aaccatggccaatttatgctgcaca

SEQ ID NO: 24499 - DNA, 25 bp, Rattus norvegicus
aaccatgggagcatgtgagcagctt

SEQ ID NO: 24500 - DNA, 25 bp, Rattus norvegicus
aaccatgggagcttgtgagcagctt

SEQ ID NO: 24501 - DNA, 25 bp, Rattus norvegicus
aaccatggttgcatttgtatatttc

SEQ ID NO: 24502 - DNA, 25 bp, Rattus norvegicus
aaccatggttgcttttgtatatttc

SEQ ID NO: 24503 - DNA, 25 bp, Rattus norvegicus
aaccatggttttcaactcttcctgc

SEQ ID NO: 24504 - DNA, 25 bp, Rattus norvegicus
aaccatggttttgaactcttcctgc

SEQ ID NO: 24505 - DNA, 25 bp, Rattus norvegicus
aaccatgtacttagtgtgtgccatt

SEQ ID NO: 24506 - DNA, 25 bp, Rattus norvegicus
aaccatgtactttgtgtgtgccatt

SEQ ID NO: 24507 - DNA, 25 bp, Rattus norvegicus
aaccatgtaggactgctcacaacca

SEQ ID NO: 24508 - DNA, 25 bp, Rattus norvegicus
aaccatgtaggagtgctcacaacca

SEQ ID NO: 24509 - DNA, 25 bp, Rattus norvegicus
aaccatgtcagaagctcacaactgc

SEQ ID NO: 24510 - DNA, 25 bp, Rattus norvegicus
aaccatgtcagatgctcacaactgc

SEQ ID NO: 24511 - DNA, 25 bp, Rattus norvegicus
aaccatgtcagtccctttgaagcca

SEQ ID NO: 24512 - DNA, 25 bp, Rattus norvegicus
aaccatgtcagtgcctttgaagcca

SEQ ID NO: 24513 - DNA, 25 bp, Rattus norvegicus
aaccatgtccatctgactgggaaac

SEQ ID NO: 24514 - DNA, 25 bp, Rattus norvegicus
aaccatgtccatgtgactgggaaac

SEQ ID NO: 24515 - DNA, 25 bp, Rattus norvegicus
aaccatgtccgacttgaccaacgaa

SEQ ID NO: 24516 - DNA, 25 bp, Rattus norvegicus
aaccatgtccgagttgaccaacgaa

SEQ ID NO: 24517 - DNA, 25 bp, Rattus norvegicus
aaccatgtcgaaagcaagcccgtta

SEQ ID NO: 24518 - DNA, 25 bp, Rattus norvegicus
aaccatgtcgaatgcaagcccgtta

SEQ ID NO: 24519 - DNA, 25 bp, Rattus norvegicus
aaccatgtgaccaattatcctgaga

SEQ ID NO: 24520 - DNA, 25 bp, Rattus norvegicus
aaccatgtgacctattatcctgaga

SEQ ID NO: 24521 - DNA, 25 bp, Rattus norvegicus
aaccatgtggacatctgagcacggc

SEQ ID NO: 24522 - DNA, 25 bp, Rattus norvegicus
aaccatgtggacttctgagcacggc

SEQ ID NO: 24523 - DNA, 25 bp, Rattus norvegicus
aaccatgtgtgtcaggctggaccaa

SEQ ID NO: 24524 - DNA, 25 bp, Rattus norvegicus
aaccatgtgtgtgaggctggaccaa

SEQ ID NO: 24525 - DNA, 25 bp, Rattus norvegicus
aaccatgttccgatggaggcagcat

SEQ ID NO: 24526 - DNA, 25 bp, Rattus norvegicus
aaccatgttccgttggaggcagcat

SEQ ID NO: 24527 - DNA, 25 bp, Rattus norvegicus
aaccatgttgctactttatctcttc

SEQ ID NO: 24528 - DNA, 25 bp, Rattus norvegicus
aaccatgttgcttctttatctcttc

SEQ ID NO: 24529 - DNA, 25 bp, Rattus norvegicus
aaccatgttggtaagtatcagcaat

SEQ ID NO: 24530 - DNA, 25 bp, Rattus norvegicus
aaccatgttggttagtatcagcaat

SEQ ID NO: 24531 - DNA, 25 bp, Rattus norvegicus
aaccatgtttacattgaagcccatt

SEQ ID NO: 24532 - DNA, 25 bp, Rattus norvegicus
aaccatgtttactttgaagcccatt

SEQ ID NO: 24533 - DNA, 25 bp, Rattus norvegicus
aaccattcagcgatagctacagaga

SEQ ID NO: 24534 - DNA, 25 bp, Rattus norvegicus
aaccattcagcgttagctacagaga

SEQ ID NO: 24535 - DNA, 25 bp, Rattus norvegicus
aaccattcagtcatcatccatcatt

SEQ ID NO: 24536 - DNA, 25 bp, Rattus norvegicus
aaccattcagtcttcatccatcatt

SEQ ID NO: 24537 - DNA, 25 bp, Rattus norvegicus
aaccattcattgactgaaccccact

SEQ ID NO: 24538 - DNA, 25 bp, Rattus norvegicus
aaccattcattgtctgaaccccact

SEQ ID NO: 24539 - DNA, 25 bp, Rattus norvegicus
aaccattcccatcagttcctgagga

SEQ ID NO: 24540 - DNA, 25 bp, Rattus norvegicus
aaccattcccatgagttcctgagga

SEQ ID NO: 24541 - DNA, 25 bp, Rattus norvegicus
aaccattccttacactccagtagta

SEQ ID NO: 24542 - DNA, 25 bp, Rattus norvegicus
aaccattccttagactccagtagta

SEQ ID NO: 24543 - DNA, 25 bp, Rattus norvegicus
aaccattctgagctggatacggtgc

SEQ ID NO: 24544 - DNA, 25 bp, Rattus norvegicus
aaccattctgaggtggatacggtgc

SEQ ID NO: 24545 - DNA, 25 bp, Rattus norvegicus
aaccattctgggacttaactgtaat

SEQ ID NO: 24546 - DNA, 25 bp, Rattus norvegicus
aaccattctgggtcttaactgtaat

SEQ ID NO: 24547 - DNA, 25 bp, Rattus norvegicus
aaccattctgtgaagggtccctaga

SEQ ID NO: 24548 - DNA, 25 bp, Rattus norvegicus
aaccattctgtgtagggtccctaga

SEQ ID NO: 24549 - DNA, 25 bp, Rattus norvegicus
aaccattctgttcgtatagttccca

SEQ ID NO: 24550 - DNA, 25 bp, Rattus norvegicus
aaccattctgttggtatagttccca

SEQ ID NO: 24551 - DNA, 25 bp, Rattus norvegicus
aaccattgcagaaagtcagttttct

SEQ ID NO: 24552 - DNA, 25 bp, Rattus norvegicus
aaccattgcagatagtcagttttct

SEQ ID NO: 24553 - DNA, 25 bp, Rattus norvegicus
aaccattgcatgattgctttcggtg

SEQ ID NO: 24554 - DNA, 25 bp, Rattus norvegicus
aaccattgcatgtttgctttcggtg

SEQ ID NO: 24555 - DNA, 25 bp, Rattus norvegicus
aaccattggctgatcttgggtttgg

SEQ ID NO: 24556 - DNA, 25 bp, Rattus norvegicus
aaccattggctgttcttgggtttgg

SEQ ID NO: 24557 - DNA, 25 bp, Rattus norvegicus
aaccattgtgagagttattagtcaa

SEQ ID NO: 24558 - DNA, 25 bp, Rattus norvegicus
aaccattgtgagtgttattagtcaa

SEQ ID NO: 24559 - DNA, 25 bp, Rattus norvegicus
aaccattgtgatcatcaccaccatc

SEQ ID NO: 24560 - DNA, 25 bp, Rattus norvegicus
aaccattgtgatgatcaccaccatc

SEQ ID NO: 24561 - DNA, 25 bp, Rattus norvegicus
aaccattgtgtcatgctccggaaga

SEQ ID NO: 24562 - DNA, 25 bp, Rattus norvegicus
aaccattgtgtcttgctccggaaga

SEQ ID NO: 24563 - DNA, 25 bp, Rattus norvegicus
aaccattgttgaactgcccagacca

SEQ ID NO: 24564 - DNA, 25 bp, Rattus norvegicus
aaccattgttgatctgcccagacca

SEQ ID NO: 24565 - DNA, 25 bp, Rattus norvegicus
aaccattgtttaattatagccactc

SEQ ID NO: 24566 - DNA, 25 bp, Rattus norvegicus
aaccattgtttatttatagccactc

SEQ ID NO: 24567 - DNA, 25 bp, Rattus norvegicus
aaccattgtttgaaagactcctcta

SEQ ID NO: 24568 - DNA, 25 bp, Rattus norvegicus
aaccattgtttgtaagactcctcta

SEQ ID NO: 24569 - DNA, 25 bp, Rattus norvegicus
aaccatttaaaacgtctgtgcaatt

SEQ ID NO: 24570 - DNA, 25 bp, Rattus norvegicus
aaccatttaaaaggtctgtgcaatt

SEQ ID NO: 24571 - DNA, 25 bp, Rattus norvegicus
aaccatttaaccactcagcttttat

SEQ ID NO: 24572 - DNA, 25 bp, Rattus norvegicus
aaccatttaacctctcagcttttat

SEQ ID NO: 24573 - DNA, 25 bp, Rattus norvegicus
aaccatttaagaccctcatttctct

SEQ ID NO: 24574 - DNA, 25 bp, Rattus norvegicus
aaccatttaagagcctcatttctct

SEQ ID NO: 24575 - DNA, 25 bp, Rattus norvegicus
aaccatttaggcaccaagtcttcgg

SEQ ID NO: 24576 - DNA, 25 bp, Rattus norvegicus
aaccatttaggctccaagtcttcgg

SEQ ID NO: 24577 - DNA, 25 bp, Rattus norvegicus
aaccatttcacacgtacactactga

SEQ ID NO: 24578 - DNA, 25 bp, Rattus norvegicus
aaccatttcacaggtacactactga

SEQ ID NO: 24579 - DNA, 25 bp, Rattus norvegicus
aaccatttctgcagtgtccttagga

SEQ ID NO: 24580 - DNA, 25 bp, Rattus norvegicus
aaccatttctgctgtgtccttagga

SEQ ID NO: 24581 - DNA, 25 bp, Rattus norvegicus
aaccatttcttcctgttgctttgaa

SEQ ID NO: 24582 - DNA, 25 bp, Rattus norvegicus
aaccatttcttcgtgttgctttgaa

SEQ ID NO: 24583 - DNA, 25 bp, Rattus norvegicus
aaccatttggaacaccgagtgaaca

SEQ ID NO: 24584 - DNA, 25 bp, Rattus norvegicus
aaccatttggaagaccgagtgaaca

SEQ ID NO: 24585 - DNA, 25 bp, Rattus norvegicus
aaccatttgtctatctgctttttcc

SEQ ID NO: 24586 - DNA, 25 bp, Rattus norvegicus
aaccatttgtctttctgctttttcc

SEQ ID NO: 24587 - DNA, 25 bp, Rattus norvegicus
aaccattttcatctgagatctccaa

SEQ ID NO: 24588 - DNA, 25 bp, Rattus norvegicus
aaccattttcatgtgagatctccaa

SEQ ID NO: 24589 - DNA, 25 bp, Rattus norvegicus
aaccattttgtcactcaagttgctg

SEQ ID NO: 24590 - DNA, 25 bp, Rattus norvegicus
aaccattttgtctctcaagttgctg

SEQ ID NO: 24591 - DNA, 25 bp, Rattus norvegicus
aacccaaagcatcctgtgacctgat

SEQ ID NO: 24592 - DNA, 25 bp, Rattus norvegicus
aacccaaagcatgctgtgacctgat

SEQ ID NO: 24593 - DNA, 25 bp, Rattus norvegicus
aacccaaagccaatctgacctgacg

SEQ ID NO: 24594 - DNA, 25 bp, Rattus norvegicus
aacccaaagccattctgacctgacg

SEQ ID NO: 24595 - DNA, 25 bp, Rattus norvegicus
aacccaaatagcagtaagcccatct

SEQ ID NO: 24596 - DNA, 25 bp, Rattus norvegicus
aacccaaatagctgtaagcccatct

SEQ ID NO: 24597 - DNA, 25 bp, Rattus norvegicus
aacccaaatatcagaatgccacttc

SEQ ID NO: 24598 - DNA, 25 bp, Rattus norvegicus
aacccaaatatcctgaactgtgcgt

SEQ ID NO: 24599 - DNA, 25 bp, Rattus norvegicus
aacccaaatatcgtgaactgtgcgt

SEQ ID NO: 24600 - DNA, 25 bp, Rattus norvegicus
aacccaaatatctgaatgccacttc

SEQ ID NO: 24601 - DNA, 25 bp, Rattus norvegicus
aacccaaatctcagctgacgtttaa

SEQ ID NO: 24602 - DNA, 25 bp, Rattus norvegicus
aacccaaatctctgctgacgtttaa

SEQ ID NO: 24603 - DNA, 25 bp, Rattus norvegicus
aacccaaatgccagaggcctcgctg

SEQ ID NO: 24604 - DNA, 25 bp, Rattus norvegicus
aacccaaatgcctgaggcctcgctg

SEQ ID NO: 24605 - DNA, 25 bp, Rattus norvegicus
aacccaaatgctcgtctcagtgacc

SEQ ID NO: 24606 - DNA, 25 bp, Rattus norvegicus
aacccaaatgctggtctcagtgacc

SEQ ID NO: 24607 - DNA, 25 bp, Rattus norvegicus
aacccaaatggtcttagtaatgcta

SEQ ID NO: 24608 - DNA, 25 bp, Rattus norvegicus
aacccaaatggtgttagtaatgcta

SEQ ID NO: 24609 - DNA, 25 bp, Rattus norvegicus
aacccaacacccatcagtgaactga

SEQ ID NO: 24610 - DNA, 25 bp, Rattus norvegicus
aacccaacacccttcagtgaactga

SEQ ID NO: 24611 - DNA, 25 bp, Rattus norvegicus
aacccaacaggtcaagctccaataa

SEQ ID NO: 24612 - DNA, 25 bp, Rattus norvegicus
aacccaacaggtgaagctccaataa

SEQ ID NO: 24613 - DNA, 25 bp, Rattus norvegicus
aacccaaccaagctgtgatacgtgg

SEQ ID NO: 24614 - DNA, 25 bp, Rattus norvegicus
aacccaaccaaggtgtgatacgtgg

SEQ ID NO: 24615 - DNA, 25 bp, Rattus norvegicus
aacccaacctatctaattctgcagt

SEQ ID NO: 24616 - DNA, 25 bp, Rattus norvegicus
aacccaacctatgtaattctgcagt

SEQ ID NO: 24617 - DNA, 25 bp, Rattus norvegicus
aacccaacctgcattaccggatgag

SEQ ID NO: 24618 - DNA, 25 bp, Rattus norvegicus
aacccaacctgctttaccggatgag

SEQ ID NO: 24619 - DNA, 25 bp, Rattus norvegicus
aacccaactactcttggtgtccaag

SEQ ID NO: 24620 - DNA, 25 bp, Rattus norvegicus
aacccaactactgttggtgtccaag

SEQ ID NO: 24621 - DNA, 25 bp, Rattus norvegicus
aacccaactctgaagtatttccagt

SEQ ID NO: 24622 - DNA, 25 bp, Rattus norvegicus
aacccaactctgtagtatttccagt

SEQ ID NO: 24623 - DNA, 25 bp, Rattus norvegicus
aacccaagagcgagattgctttcag

SEQ ID NO: 24624 - DNA, 25 bp, Rattus norvegicus
aacccaagagcgtgattgctttcag

SEQ ID NO: 24625 - DNA, 25 bp, Rattus norvegicus
aacccaagctagcaggagttgcaga

SEQ ID NO: 24626 - DNA, 25 bp, Rattus norvegicus
aacccaagctaggaggagttgcaga

SEQ ID NO: 24627 - DNA, 25 bp, Rattus norvegicus
aacccaaggctaattccaggtacat

SEQ ID NO: 24628 - DNA, 25 bp, Rattus norvegicus
aacccaaggctatttccaggtacat

SEQ ID NO: 24629 - DNA, 25 bp, Rattus norvegicus
aacccaaggttgctgcagggctttg

SEQ ID NO: 24630 - DNA, 25 bp, Rattus norvegicus
aacccaaggttggtgcagggctttg

SEQ ID NO: 24631 - DNA, 25 bp, Rattus norvegicus
aacccaagtgtgatccacattggtg

SEQ ID NO: 24632 - DNA, 25 bp, Rattus norvegicus
aacccaagtgtgttccacattggtg

SEQ ID NO: 24633 - DNA, 25 bp, Rattus norvegicus
aacccaagtgttctgctacatttaa

SEQ ID NO: 24634 - DNA, 25 bp, Rattus norvegicus
aacccaagtgttgtgctacatttaa

SEQ ID NO: 24635 - DNA, 25 bp, Rattus norvegicus
aacccaataagcagcagtgctgcca

SEQ ID NO: 24636 - DNA, 25 bp, Rattus norvegicus
aacccaataagctgcagtgctgcca

SEQ ID NO: 24637 - DNA, 25 bp, Rattus norvegicus
aacccaatatggcagcggcggtagc

SEQ ID NO: 24638 - DNA, 25 bp, Rattus norvegicus
aacccaatatgggagcggcggtagc

SEQ ID NO: 24639 - DNA, 25 bp, Rattus norvegicus
aacccaatctagcaaaggtgacatt

SEQ ID NO: 24640 - DNA, 25 bp, Rattus norvegicus
aacccaatctaggaaaggtgacatt

SEQ ID NO: 24641 - DNA, 25 bp, Rattus norvegicus
aacccaatggagaggctgaacagcc

SEQ ID NO: 24642 - DNA, 25 bp, Rattus norvegicus
aacccaatggagtggctgaacagcc

SEQ ID NO: 24643 - DNA, 25 bp, Rattus norvegicus
aacccaatgggcagatcactgagaa

SEQ ID NO: 24644 - DNA, 25 bp, Rattus norvegicus
aacccaatgggctgatcactgagaa

SEQ ID NO: 24645 - DNA, 25 bp, Rattus norvegicus
aacccaatgtcaccgttgcatgatt

SEQ ID NO: 24646 - DNA, 25 bp, Rattus norvegicus
aacccaatgtcagcgttgcatgatt

SEQ ID NO: 24647 - DNA, 25 bp, Rattus norvegicus
aacccacaagagctcttcgttcgct

SEQ ID NO: 24648 - DNA, 25 bp, Rattus norvegicus
aacccacaagaggtcttcgttcgct

SEQ ID NO: 24649 - DNA, 25 bp, Rattus norvegicus
aacccacaagctctcattgcacata

SEQ ID NO: 24650 - DNA, 25 bp, Rattus norvegicus
aacccacaagctgtcattgcacata

SEQ ID NO: 24651 - DNA, 25 bp, Rattus norvegicus
aacccacacataattgtccatgctg

SEQ ID NO: 24652 - DNA, 25 bp, Rattus norvegicus
aacccacacatatttgtccatgctg

SEQ ID NO: 24653 - DNA, 25 bp, Rattus norvegicus
aacccacactgaactggatggagag

SEQ ID NO: 24654 - DNA, 25 bp, Rattus norvegicus
aacccacactgatctggatggagag

SEQ ID NO: 24655 - DNA, 25 bp, Rattus norvegicus
aacccacattctaaaacaccggctg

SEQ ID NO: 24656 - DNA, 25 bp, Rattus norvegicus
aacccacattcttaaacaccggctg

SEQ ID NO: 24657 - DNA, 25 bp, Rattus norvegicus
aacccaccagagctttgtatttttg

SEQ ID NO: 24658 - DNA, 25 bp, Rattus norvegicus
aacccaccagaggtttgtatttttg

SEQ ID NO: 24659 - DNA, 25 bp, Rattus norvegicus
aacccacctgagaatgctaaaagat

SEQ ID NO: 24660 - DNA, 25 bp, Rattus norvegicus
aacccacctgagtatgctaaaagat

SEQ ID NO: 24661 - DNA, 25 bp, Rattus norvegicus
aacccaccttgtcccaggagctata

SEQ ID NO: 24662 - DNA, 25 bp, Rattus norvegicus
aacccaccttgtgccaggagctata

SEQ ID NO: 24663 - DNA, 25 bp, Rattus norvegicus
aacccactagcacgttgctgggtcc

SEQ ID NO: 24664 - DNA, 25 bp, Rattus norvegicus
aacccactagcaggttgctgggtcc

SEQ ID NO: 24665 - DNA, 25 bp, Rattus norvegicus
aacccactcattatggtcagcttag

SEQ ID NO: 24666 - DNA, 25 bp, Rattus norvegicus
aacccactcattttggtcagcttag

SEQ ID NO: 24667 - DNA, 25 bp, Rattus norvegicus
aacccactctacagatcacttttga

SEQ ID NO: 24668 - DNA, 25 bp, Rattus norvegicus
aacccactctactgatcacttttga

SEQ ID NO: 24669 - DNA, 25 bp, Rattus norvegicus
aacccactctgtcagttttctaagg

SEQ ID NO: 24670 - DNA, 25 bp, Rattus norvegicus
aacccactctgtgagttttctaagg

SEQ ID NO: 24671 - DNA, 25 bp, Rattus norvegicus
aacccactcttcagatttcaccaat

SEQ ID NO: 24672 - DNA, 25 bp, Rattus norvegicus
aacccactcttctgatttcaccaat

SEQ ID NO: 24673 - DNA, 25 bp, Rattus norvegicus
aacccactcttgcttgagggtcata

SEQ ID NO: 24674 - DNA, 25 bp, Rattus norvegicus
aacccactcttggttgagggtcata

SEQ ID NO: 24675 - DNA, 25 bp, Rattus norvegicus
aacccactgcatagatattcttcct

SEQ ID NO: 24676 - DNA, 25 bp, Rattus norvegicus
aacccactgcattgatattcttcct

SEQ ID NO: 24677 - DNA, 25 bp, Rattus norvegicus
aacccactgcgtattgatgtttgcc

SEQ ID NO: 24678 - DNA, 25 bp, Rattus norvegicus
aacccactgcgttttgatgtttgcc

SEQ ID NO: 24679 - DNA, 25 bp, Rattus norvegicus
aacccactggatattgctgtgctcc

SEQ ID NO: 24680 - DNA, 25 bp, Rattus norvegicus
aacccactggattttgctgtgctcc

SEQ ID NO: 24681 - DNA, 25 bp, Rattus norvegicus
aacccactggctctgagaattcttt

SEQ ID NO: 24682 - DNA, 25 bp, Rattus norvegicus
aacccactggctgtgagaattcttt

SEQ ID NO: 24683 - DNA, 25 bp, Rattus norvegicus
aacccacttccaataaacttgacag

SEQ ID NO: 24684 - DNA, 25 bp, Rattus norvegicus
aacccacttccattaaacttgacag

SEQ ID NO: 24685 - DNA, 25 bp, Rattus norvegicus
aacccacttcccacagtggagattg

SEQ ID NO: 24686 - DNA, 25 bp, Rattus norvegicus
aacccacttccctcagtggagattg

SEQ ID NO: 24687 - DNA, 25 bp, Rattus norvegicus
aacccactttgtatatactgaagct

SEQ ID NO: 24688 - DNA, 25 bp, Rattus norvegicus
aacccactttgtttatactgaagct

SEQ ID NO: 24689 - DNA, 25 bp, Rattus norvegicus
aacccagaaatacagctgcttcgcc

SEQ ID NO: 24690 - DNA, 25 bp, Rattus norvegicus
aacccagaaatagagctgcttcgcc

SEQ ID NO: 24691 - DNA, 25 bp, Rattus norvegicus
aacccagaacagcataacagtttat

SEQ ID NO: 24692 - DNA, 25 bp, Rattus norvegicus
aacccagaacaggataacagtttat

SEQ ID NO: 24693 - DNA, 25 bp, Rattus norvegicus
aacccagaacccagggcttgagcca

SEQ ID NO: 24694 - DNA, 25 bp, Rattus norvegicus
aacccagaaccctgggcttgagcca

SEQ ID NO: 24695 - DNA, 25 bp, Rattus norvegicus
aacccagaactgaattttgaggtgg

SEQ ID NO: 24696 - DNA, 25 bp, Rattus norvegicus
aacccagaactgtattttgaggtgg

SEQ ID NO: 24697 - DNA, 25 bp, Rattus norvegicus
aacccagaaggccacactcggatta

SEQ ID NO: 24698 - DNA, 25 bp, Rattus norvegicus
aacccagaaggcgacactcggatta

SEQ ID NO: 24699 - DNA, 25 bp, Rattus norvegicus
aacccagaaggtagcagcacatttg

SEQ ID NO: 24700 - DNA, 25 bp, Rattus norvegicus
aacccagaaggttgcagcacatttg

SEQ ID NO: 24701 - DNA, 25 bp, Rattus norvegicus
aacccagacaccactgactaggtct

SEQ ID NO: 24702 - DNA, 25 bp, Rattus norvegicus
aacccagacacctctgactaggtct

SEQ ID NO: 24703 - DNA, 25 bp, Rattus norvegicus
aacccagacagtattatctatccca

SEQ ID NO: 24704 - DNA, 25 bp, Rattus norvegicus
aacccagacagttttatctatccca

SEQ ID NO: 24705 - DNA, 25 bp, Rattus norvegicus
aacccagactaaaggctacagtgac

SEQ ID NO: 24706 - DNA, 25 bp, Rattus norvegicus
aacccagactaatggctacagtgac

SEQ ID NO: 24707 - DNA, 25 bp, Rattus norvegicus
aacccagactgtagcatatttgtac

SEQ ID NO: 24708 - DNA, 25 bp, Rattus norvegicus
aacccagactgttgcatatttgtac

SEQ ID NO: 24709 - DNA, 25 bp, Rattus norvegicus
aacccagagcttagtacgctaggca

SEQ ID NO: 24710 - DNA, 25 bp, Rattus norvegicus
aacccagagcttcagtagttccaaa

SEQ ID NO: 24711 - DNA, 25 bp, Rattus norvegicus
aacccagagcttgagtagttccaaa

SEQ ID NO: 24712 - DNA, 25 bp, Rattus norvegicus
aacccagagctttgtacgctaggca

SEQ ID NO: 24713 - DNA, 25 bp, Rattus norvegicus
aacccagagggcagtgttctaaaca

SEQ ID NO: 24714 - DNA, 25 bp, Rattus norvegicus
aacccagagggcctgatagcgtctt

SEQ ID NO: 24715 - DNA, 25 bp, Rattus norvegicus
aacccagagggcgtgatagcgtctt

SEQ ID NO: 24716 - DNA, 25 bp, Rattus norvegicus
aacccagagggctgtgttctaaaca

SEQ ID NO: 24717 - DNA, 25 bp, Rattus norvegicus
aacccagagggtcttgctgaagcca

SEQ ID NO: 24718 - DNA, 25 bp, Rattus norvegicus
aacccagagggtgttgctgaagcca

SEQ ID NO: 24719 - DNA, 25 bp, Rattus norvegicus
aacccagagttcaagagcctggtta

SEQ ID NO: 24720 - DNA, 25 bp, Rattus norvegicus
aacccagagttctagagcctggtta

SEQ ID NO: 24721 - DNA, 25 bp, Rattus norvegicus
aacccagataataaaagcctagcag

SEQ ID NO: 24722 - DNA, 25 bp, Rattus norvegicus
aacccagataattaaagcctagcag

SEQ ID NO: 24723 - DNA, 25 bp, Rattus norvegicus
aacccagatatactgctctgcggaa

SEQ ID NO: 24724 - DNA, 25 bp, Rattus norvegicus
aacccagatatagtgctctgcggaa

SEQ ID NO: 24725 - DNA, 25 bp, Rattus norvegicus
aacccagatcatactaagtccagca

SEQ ID NO: 24726 - DNA, 25 bp, Rattus norvegicus
aacccagatcattctaagtccagca

SEQ ID NO: 24727 - DNA, 25 bp, Rattus norvegicus
aacccagatgacagccttaagaatt

SEQ ID NO: 24728 - DNA, 25 bp, Rattus norvegicus
aacccagatgactgccttaagaatt

SEQ ID NO: 24729 - DNA, 25 bp, Rattus norvegicus
aacccagatgcaaaactcggagtca

SEQ ID NO: 24730 - DNA, 25 bp, Rattus norvegicus
aacccagatgcataactcggagtca

SEQ ID NO: 24731 - DNA, 25 bp, Rattus norvegicus
aacccagatgctagtcagtcgagga

SEQ ID NO: 24732 - DNA, 25 bp, Rattus norvegicus
aacccagatgcttgtcagtcgagga

SEQ ID NO: 24733 - DNA, 25 bp, Rattus norvegicus
aacccagatggtaatcatgttcctg

SEQ ID NO: 24734 - DNA, 25 bp, Rattus norvegicus
aacccagatggttatcatgttcctg

SEQ ID NO: 24735 - DNA, 25 bp, Rattus norvegicus
aacccagatgtgatgatagaagcct

SEQ ID NO: 24736 - DNA, 25 bp, Rattus norvegicus
aacccagatgtgttgatagaagcct

SEQ ID NO: 24737 - DNA, 25 bp, Rattus norvegicus
aacccagcaagtagatcacatgaca

SEQ ID NO: 24738 - DNA, 25 bp, Rattus norvegicus
aacccagcaagttgatcacatgaca

SEQ ID NO: 24739 - DNA, 25 bp, Rattus norvegicus
aacccagcacacactcgggagttta

SEQ ID NO: 24740 - DNA, 25 bp, Rattus norvegicus
aacccagcacactctcgggagttta

SEQ ID NO: 24741 - DNA, 25 bp, Rattus norvegicus
aacccagcagctactgacgagcaga

SEQ ID NO: 24742 - DNA, 25 bp, Rattus norvegicus
aacccagcagcttctgacgagcaga

SEQ ID NO: 24743 - DNA, 25 bp, Rattus norvegicus
aacccagcagggagacagctcatga

SEQ ID NO: 24744 - DNA, 25 bp, Rattus norvegicus
aacccagcagggtgacagctcatga

SEQ ID NO: 24745 - DNA, 25 bp, Rattus norvegicus
aacccagcatttctcctgtgggaca

SEQ ID NO: 24746 - DNA, 25 bp, Rattus norvegicus
aacccagcatttgtcctgtgggaca

SEQ ID NO: 24747 - DNA, 25 bp, Rattus norvegicus
aacccagccatgcttcataacattg

SEQ ID NO: 24748 - DNA, 25 bp, Rattus norvegicus
aacccagccatggttcataacattg

SEQ ID NO: 24749 - DNA, 25 bp, Rattus norvegicus
aacccagcccgtactaagagatgct

SEQ ID NO: 24750 - DNA, 25 bp, Rattus norvegicus
aacccagcccgttctaagagatgct

SEQ ID NO: 24751 - DNA, 25 bp, Rattus norvegicus
aacccagcctacagtgcagtcaaga

SEQ ID NO: 24752 - DNA, 25 bp, Rattus norvegicus
aacccagcctactgtgcagtcaaga

SEQ ID NO: 24753 - DNA, 25 bp, Rattus norvegicus
aacccagcctgaagttcttgtacta

SEQ ID NO: 24754 - DNA, 25 bp, Rattus norvegicus
aacccagcctgatgttcttgtacta

SEQ ID NO: 24755 - DNA, 25 bp, Rattus norvegicus
aacccagccttgcatgggtctgtgg

SEQ ID NO: 24756 - DNA, 25 bp, Rattus norvegicus
aacccagccttggatgggtctgtgg

SEQ ID NO: 24757 - DNA, 25 bp, Rattus norvegicus
aacccagcgagccagccttttgggt

SEQ ID NO: 24758 - DNA, 25 bp, Rattus norvegicus
aacccagcgagcgagccttttgggt

SEQ ID NO: 24759 - DNA, 25 bp, Rattus norvegicus
aacccagcgcccatgttagtgaaga

SEQ ID NO: 24760 - DNA, 25 bp, Rattus norvegicus
aacccagcgcccttgttagtgaaga

SEQ ID NO: 24761 - DNA, 25 bp, Rattus norvegicus
aacccagctaagatcctaagtcgga

SEQ ID NO: 24762 - DNA, 25 bp, Rattus norvegicus
aacccagctaagttcctaagtcgga

SEQ ID NO: 24763 - DNA, 25 bp, Rattus norvegicus
aacccagctagtcctgacctaaagg

SEQ ID NO: 24764 - DNA, 25 bp, Rattus norvegicus
aacccagctagtgctgacctaaagg

SEQ ID NO: 24765 - DNA, 25 bp, Rattus norvegicus
aacccagctggcatttccagaaaga

SEQ ID NO: 24766 - DNA, 25 bp, Rattus norvegicus
aacccagctggcttttccagaaaga

SEQ ID NO: 24767 - DNA, 25 bp, Rattus norvegicus
aacccagctgggaggtgtgattctt

SEQ ID NO: 24768 - DNA, 25 bp, Rattus norvegicus
aacccagctgggtggtgtgattctt

SEQ ID NO: 24769 - DNA, 25 bp, Rattus norvegicus
aacccagcttatactcttcagacta

SEQ ID NO: 24770 - DNA, 25 bp, Rattus norvegicus
aacccagcttattctcttcagacta

SEQ ID NO: 24771 - DNA, 25 bp, Rattus norvegicus
aacccaggaatgctctttcattaga

SEQ ID NO: 24772 - DNA, 25 bp, Rattus norvegicus
aacccaggaatggtctttcattaga

SEQ ID NO: 24773 - DNA, 25 bp, Rattus norvegicus
aacccaggacctacaagatcaacta

SEQ ID NO: 24774 - DNA, 25 bp, Rattus norvegicus
aacccaggaccttcaagatcaacta

SEQ ID NO: 24775 - DNA, 25 bp, Rattus norvegicus
aacccaggcagtctcaccagtgact

SEQ ID NO: 24776 - DNA, 25 bp, Rattus norvegicus
aacccaggcagtgtcaccagtgact

SEQ ID NO: 24777 - DNA, 25 bp, Rattus norvegicus
aacccaggccagagaaagtgcagct

SEQ ID NO: 24778 - DNA, 25 bp, Rattus norvegicus
aacccaggccagtgaaagtgcagct

SEQ ID NO: 24779 - DNA, 25 bp, Rattus norvegicus
aacccaggcgagagaggagcagatc

SEQ ID NO: 24780 - DNA, 25 bp, Rattus norvegicus
aacccaggcgagtgaggagcagatc

SEQ ID NO: 24781 - DNA, 25 bp, Rattus norvegicus
aacccaggcgcgcacagtaggtatg

SEQ ID NO: 24782 - DNA, 25 bp, Rattus norvegicus
aacccaggcgcggacagtaggtatg

SEQ ID NO: 24783 - DNA, 25 bp, Rattus norvegicus
aacccaggcggtaccagtgagcagt

SEQ ID NO: 24784 - DNA, 25 bp, Rattus norvegicus
aacccaggcggttccagtgagcagt

SEQ ID NO: 24785 - DNA, 25 bp, Rattus norvegicus
aacccaggcgtcagccaggagaagt

SEQ ID NO: 24786 - DNA, 25 bp, Rattus norvegicus
aacccaggcgtctgccaggagaagt

SEQ ID NO: 24787 - DNA, 25 bp, Rattus norvegicus
aacccagggcctaggatttgcttag

SEQ ID NO: 24788 - DNA, 25 bp, Rattus norvegicus
aacccagggccttggatttgcttag

SEQ ID NO: 24789 - DNA, 25 bp, Rattus norvegicus
aacccagggcttagaacatgtacat

SEQ ID NO: 24790 - DNA, 25 bp, Rattus norvegicus
aacccagggctttgaacatgtacat

SEQ ID NO: 24791 - DNA, 25 bp, Rattus norvegicus
aacccagggtgtccgtctggccact

SEQ ID NO: 24792 - DNA, 25 bp, Rattus norvegicus
aacccagggtgtgcgtctggccact

SEQ ID NO: 24793 - DNA, 25 bp, Rattus norvegicus
aacccaggtcatcgctgttgtaaaa

SEQ ID NO: 24794 - DNA, 25 bp, Rattus norvegicus
aacccaggtcatggctgttgtaaaa

SEQ ID NO: 24795 - DNA, 25 bp, Rattus norvegicus
aacccaggtccacagttagcatcac

SEQ ID NO: 24796 - DNA, 25 bp, Rattus norvegicus
aacccaggtccagagttagcatcac

SEQ ID NO: 24797 - DNA, 25 bp, Rattus norvegicus
aacccaggtcccattgggccatgtg

SEQ ID NO: 24798 - DNA, 25 bp, Rattus norvegicus
aacccaggtccctttgggccatgtg

SEQ ID NO: 24799 - DNA, 25 bp, Rattus norvegicus
aacccaggtcctagtatttcactga

SEQ ID NO: 24800 - DNA, 25 bp, Rattus norvegicus
aacccaggtccttgtatttcactga

SEQ ID NO: 24801 - DNA, 25 bp, Rattus norvegicus
aacccaggtcttaccatgttagtca

SEQ ID NO: 24802 - DNA, 25 bp, Rattus norvegicus
aacccaggtctttccatgttagtca

SEQ ID NO: 24803 - DNA, 25 bp, Rattus norvegicus
aacccaggtgtcagtggtatgcata

SEQ ID NO: 24804 - DNA, 25 bp, Rattus norvegicus
aacccaggtgtctgtggtatgcata

SEQ ID NO: 24805 - DNA, 25 bp, Rattus norvegicus
aacccaggttgcagagcccggaaga

SEQ ID NO: 24806 - DNA, 25 bp, Rattus norvegicus
aacccaggttgctgagcccggaaga

SEQ ID NO: 24807 - DNA, 25 bp, Rattus norvegicus
aacccagtagccattagtcattgta

SEQ ID NO: 24808 - DNA, 25 bp, Rattus norvegicus
aacccagtagcctttagtcattgta

SEQ ID NO: 24809 - DNA, 25 bp, Rattus norvegicus
aacccagtatacaaggtcaggaggc

SEQ ID NO: 24810 - DNA, 25 bp, Rattus norvegicus
aacccagtatacagttccagctgcc

SEQ ID NO: 24811 - DNA, 25 bp, Rattus norvegicus
aacccagtatactaggtcaggaggc

SEQ ID NO: 24812 - DNA, 25 bp, Rattus norvegicus
aacccagtatactgttccagctgcc

SEQ ID NO: 24813 - DNA, 25 bp, Rattus norvegicus
aacccagtatcactctgcggtgatg

SEQ ID NO: 24814 - DNA, 25 bp, Rattus norvegicus
aacccagtatcagtctgcggtgatg

SEQ ID NO: 24815 - DNA, 25 bp, Rattus norvegicus
aacccagtatccatttgtgatataa

SEQ ID NO: 24816 - DNA, 25 bp, Rattus norvegicus
aacccagtatccttttgtgatataa

SEQ ID NO: 24817 - DNA, 25 bp, Rattus norvegicus
aacccagtccatccgtactaggtga

SEQ ID NO: 24818 - DNA, 25 bp, Rattus norvegicus
aacccagtccatgcgtactaggtga

SEQ ID NO: 24819 - DNA, 25 bp, Rattus norvegicus
aacccagtcgtgaaagccgtcagga

SEQ ID NO: 24820 - DNA, 25 bp, Rattus norvegicus
aacccagtcgtgtaagccgtcagga

SEQ ID NO: 24821 - DNA, 25 bp, Rattus norvegicus
aacccagtctccaaagatctcacaa

SEQ ID NO: 24822 - DNA, 25 bp, Rattus norvegicus
aacccagtctcctaagatctcacaa

SEQ ID NO: 24823 - DNA, 25 bp, Rattus norvegicus
aacccagtctctacttatcacaaat

SEQ ID NO: 24824 - DNA, 25 bp, Rattus norvegicus
aacccagtctcttcttatcacaaat

SEQ ID NO: 24825 - DNA, 25 bp, Rattus norvegicus
aacccagtctttctaggattccaat

SEQ ID NO: 24826 - DNA, 25 bp, Rattus norvegicus
aacccagtctttgtaggattccaat

SEQ ID NO: 24827 - DNA, 25 bp, Rattus norvegicus
aacccagtgactcagtttactctct

SEQ ID NO: 24828 - DNA, 25 bp, Rattus norvegicus
aacccagtgactgagtttactctct

SEQ ID NO: 24829 - DNA, 25 bp, Rattus norvegicus
aacccagtgaggaggaagattctgc

SEQ ID NO: 24830 - DNA, 25 bp, Rattus norvegicus
aacccagtgaggtggaagattctgc

SEQ ID NO: 24831 - DNA, 25 bp, Rattus norvegicus
aacccagtggctcttatggtcctca

SEQ ID NO: 24832 - DNA, 25 bp, Rattus norvegicus
aacccagtggctgttatggtcctca

SEQ ID NO: 24833 - DNA, 25 bp, Rattus norvegicus
aacccagtgggtaatccattggcct

SEQ ID NO: 24834 - DNA, 25 bp, Rattus norvegicus
aacccagtgggttatccattggcct

SEQ ID NO: 24835 - DNA, 25 bp, Rattus norvegicus
aacccagtgtgacgcgtaacttcct

SEQ ID NO: 24836 - DNA, 25 bp, Rattus norvegicus
aacccagtgtgaggcgtaacttcct

SEQ ID NO: 24837 - DNA, 25 bp, Rattus norvegicus
aacccagttgtgatgagcctatgcg

SEQ ID NO: 24838 - DNA, 25 bp, Rattus norvegicus
aacccagttgtgttgagcctatgcg

SEQ ID NO: 24839 - DNA, 25 bp, Rattus norvegicus
aacccataccaaagtctgttctgtt

SEQ ID NO: 24840 - DNA, 25 bp, Rattus norvegicus
aacccataccaatgtctgttctgtt

SEQ ID NO: 24841 - DNA, 25 bp, Rattus norvegicus
aacccatactggaattcgccgactg

SEQ ID NO: 24842 - DNA, 25 bp, Rattus norvegicus
aacccatactggtattcgccgactg

SEQ ID NO: 24843 - DNA, 25 bp, Rattus norvegicus
aacccatagcctaaagttgtgtgct

SEQ ID NO: 24844 - DNA, 25 bp, Rattus norvegicus
aacccatagccttaagttgtgtgct

SEQ ID NO: 24845 - DNA, 25 bp, Rattus norvegicus
aacccatagtatatatgcccctcta

SEQ ID NO: 24846 - DNA, 25 bp, Rattus norvegicus
aacccatagtatttatgcccctcta

SEQ ID NO: 24847 - DNA, 25 bp, Rattus norvegicus
aacccatagtctccttaccagaggt

SEQ ID NO: 24848 - DNA, 25 bp, Rattus norvegicus
aacccatagtctgcttaccagaggt

SEQ ID NO: 24849 - DNA, 25 bp, Rattus norvegicus
aacccatatgttattatgagctggt

SEQ ID NO: 24850 - DNA, 25 bp, Rattus norvegicus
aacccatatgtttttatgagctggt

SEQ ID NO: 24851 - DNA, 25 bp, Rattus norvegicus
aacccatccaagcactggccaggag

SEQ ID NO: 24852 - DNA, 25 bp, Rattus norvegicus
aacccatccaaggactggccaggag

SEQ ID NO: 24853 - DNA, 25 bp, Rattus norvegicus
aacccatccagacaggtgtgtccaa

SEQ ID NO: 24854 - DNA, 25 bp, Rattus norvegicus
aacccatccagagaggtgtgtccaa

SEQ ID NO: 24855 - DNA, 25 bp, Rattus norvegicus
aacccatctcacatcagtttgatct

SEQ ID NO: 24856 - DNA, 25 bp, Rattus norvegicus
aacccatctcacttcagtttgatct

SEQ ID NO: 24857 - DNA, 25 bp, Rattus norvegicus
aacccatgctccatcgacagtgatt

SEQ ID NO: 24858 - DNA, 25 bp, Rattus norvegicus
aacccatgctccttcgacagtgatt

SEQ ID NO: 24859 - DNA, 25 bp, Rattus norvegicus
aacccatggagaatgtgtgaaggtc

SEQ ID NO: 24860 - DNA, 25 bp, Rattus norvegicus
aacccatggagattgtgtgaaggtc

SEQ ID NO: 24861 - DNA, 25 bp, Rattus norvegicus
aacccatggctgaatctgctgatga

SEQ ID NO: 24862 - DNA, 25 bp, Rattus norvegicus
aacccatggctgtatctgctgatga

SEQ ID NO: 24863 - DNA, 25 bp, Rattus norvegicus
aacccatgtatccagcgtctagaaa

SEQ ID NO: 24864 - DNA, 25 bp, Rattus norvegicus
aacccatgtatcgagcgtctagaaa

SEQ ID NO: 24865 - DNA, 25 bp, Rattus norvegicus
aacccatgtgagcagaatatttcct

SEQ ID NO: 24866 - DNA, 25 bp, Rattus norvegicus
aacccatgtgagctggcactggact

SEQ ID NO: 24867 - DNA, 25 bp, Rattus norvegicus
aacccatgtgaggagaatatttcct

SEQ ID NO: 24868 - DNA, 25 bp, Rattus norvegicus
aacccatgtgaggtggcactggact

SEQ ID NO: 24869 - DNA, 25 bp, Rattus norvegicus
aacccattcaccaacacaaaaacag

SEQ ID NO: 24870 - DNA, 25 bp, Rattus norvegicus
aacccattcacctacacaaaaacag

SEQ ID NO: 24871 - DNA, 25 bp, Rattus norvegicus
aacccattcattcctgattctgatc

SEQ ID NO: 24872 - DNA, 25 bp, Rattus norvegicus
aacccattcattgctgattctgatc

SEQ ID NO: 24873 - DNA, 25 bp, Rattus norvegicus
aacccattccacagtatgaggccaa

SEQ ID NO: 24874 - DNA, 25 bp, Rattus norvegicus
aacccattccactgtatgaggccaa

SEQ ID NO: 24875 - DNA, 25 bp, Rattus norvegicus
aacccattccagcactggctggaag

SEQ ID NO: 24876 - DNA, 25 bp, Rattus norvegicus
aacccattccaggactggctggaag

SEQ ID NO: 24877 - DNA, 25 bp, Rattus norvegicus
aacccattccgaaccattgtctatt

SEQ ID NO: 24878 - DNA, 25 bp, Rattus norvegicus
aacccattccgatccattgtctatt

SEQ ID NO: 24879 - DNA, 25 bp, Rattus norvegicus
aacccattcctcataatttgtcttg

SEQ ID NO: 24880 - DNA, 25 bp, Rattus norvegicus
aacccattcctcttaatttgtcttg

SEQ ID NO: 24881 - DNA, 25 bp, Rattus norvegicus
aacccatttaagcatttgtccatct

SEQ ID NO: 24882 - DNA, 25 bp, Rattus norvegicus
aacccatttaaggatttgtccatct

SEQ ID NO: 24883 - DNA, 25 bp, Rattus norvegicus
aacccatttcccacttaatctgtag

SEQ ID NO: 24884 - DNA, 25 bp, Rattus norvegicus
aacccatttccctcttaatctgtag

SEQ ID NO: 24885 - DNA, 25 bp, Rattus norvegicus
aacccatttctcatcccaggagtat

SEQ ID NO: 24886 - DNA, 25 bp, Rattus norvegicus
aacccatttctcttcccaggagtat

SEQ ID NO: 24887 - DNA, 25 bp, Rattus norvegicus
aacccatttgaactttctactcagt

SEQ ID NO: 24888 - DNA, 25 bp, Rattus norvegicus
aacccatttgaagtttctactcagt

SEQ ID NO: 24889 - DNA, 25 bp, Rattus norvegicus
aacccattttgtctcttttctcagt

SEQ ID NO: 24890 - DNA, 25 bp, Rattus norvegicus
aacccattttgtgtcttttctcagt

SEQ ID NO: 24891 - DNA, 25 bp, Rattus norvegicus
aaccccaaatcccttaggatgcaga

SEQ ID NO: 24892 - DNA, 25 bp, Rattus norvegicus
aaccccaaatccgttaggatgcaga

SEQ ID NO: 24893 - DNA, 25 bp, Rattus norvegicus
aaccccaacagtagctttcaaagtg

SEQ ID NO: 24894 - DNA, 25 bp, Rattus norvegicus
aaccccaacagttgctttcaaagtg

SEQ ID NO: 24895 - DNA, 25 bp, Rattus norvegicus
aaccccaacgtcatggcctgttata

SEQ ID NO: 24896 - DNA, 25 bp, Rattus norvegicus
aaccccaacgtcttggcctgttata

SEQ ID NO: 24897 - DNA, 25 bp, Rattus norvegicus
aaccccaagaacatggcctacactg

SEQ ID NO: 24898 - DNA, 25 bp, Rattus norvegicus
aaccccaagaacttggcctacactg

SEQ ID NO: 24899 - DNA, 25 bp, Rattus norvegicus
aaccccaagaggattgctcaggctg

SEQ ID NO: 24900 - DNA, 25 bp, Rattus norvegicus
aaccccaagaggtttgctcaggctg

SEQ ID NO: 24901 - DNA, 25 bp, Rattus norvegicus
aaccccaagccacctgagttctttg

SEQ ID NO: 24902 - DNA, 25 bp, Rattus norvegicus
aaccccaagccagctgagttctttg

SEQ ID NO: 24903 - DNA, 25 bp, Rattus norvegicus
aaccccaagtcgcagcctttgaagg

SEQ ID NO: 24904 - DNA, 25 bp, Rattus norvegicus
aaccccaagtcggagcctttgaagg

SEQ ID NO: 24905 - DNA, 25 bp, Rattus norvegicus
aaccccaatcagatgtgtgccaaac

SEQ ID NO: 24906 - DNA, 25 bp, Rattus norvegicus
aaccccaatcagttgtgtgccaaac

SEQ ID NO: 24907 - DNA, 25 bp, Rattus norvegicus
aaccccaatgagaggaaggctactg

SEQ ID NO: 24908 - DNA, 25 bp, Rattus norvegicus
aaccccaatgagtggaaggctactg

SEQ ID NO: 24909 - DNA, 25 bp, Rattus norvegicus
aaccccacaaggagacgcagtacaa

SEQ ID NO: 24910 - DNA, 25 bp, Rattus norvegicus
aaccccacaaggtgacgcagtacaa

SEQ ID NO: 24911 - DNA, 25 bp, Rattus norvegicus
aaccccacaagtctagtcgtcattc

SEQ ID NO: 24912 - DNA, 25 bp, Rattus norvegicus
aaccccacaagtgtagtcgtcattc

SEQ ID NO: 24913 - DNA, 25 bp, Rattus norvegicus
aaccccacattgcagttctttgtag

SEQ ID NO: 24914 - DNA, 25 bp, Rattus norvegicus
aaccccacattggagttctttgtag

SEQ ID NO: 24915 - DNA, 25 bp, Rattus norvegicus
aaccccaccataccttgtgtatgta

SEQ ID NO: 24916 - DNA, 25 bp, Rattus norvegicus
aaccccaccatagcttgtgtatgta

SEQ ID NO: 24917 - DNA, 25 bp, Rattus norvegicus
aaccccaccattcagggcgaatttg

SEQ ID NO: 24918 - DNA, 25 bp, Rattus norvegicus
aaccccaccattgagggcgaatttg

SEQ ID NO: 24919 - DNA, 25 bp, Rattus norvegicus
aaccccacgtccatctgaatggaag

SEQ ID NO: 24920 - DNA, 25 bp, Rattus norvegicus
aaccccacgtccttctgaatggaag

SEQ ID NO: 24921 - DNA, 25 bp, Rattus norvegicus
aaccccactactcattttctgaact

SEQ ID NO: 24922 - DNA, 25 bp, Rattus norvegicus
aaccccactactgattttctgaact

SEQ ID NO: 24923 - DNA, 25 bp, Rattus norvegicus
aaccccactcttatgttttgctgag

SEQ ID NO: 24924 - DNA, 25 bp, Rattus norvegicus
aaccccactcttttgttttgctgag

SEQ ID NO: 24925 - DNA, 25 bp, Rattus norvegicus
aaccccactgccagatggtctagaa

SEQ ID NO: 24926 - DNA, 25 bp, Rattus norvegicus
aaccccactgcctgatggtctagaa

SEQ ID NO: 24927 - DNA, 25 bp, Rattus norvegicus
aaccccactgttctaaatgtgccca

SEQ ID NO: 24928 - DNA, 25 bp, Rattus norvegicus
aaccccactgttgtaaatgtgccca

SEQ ID NO: 24929 - DNA, 25 bp, Rattus norvegicus
aaccccagaacaaagatcaaatcgg

SEQ ID NO: 24930 - DNA, 25 bp, Rattus norvegicus
aaccccagaacatagatcaaatcgg

SEQ ID NO: 24931 - DNA, 25 bp, Rattus norvegicus
aaccccagaagcaatacctctaggg

SEQ ID NO: 24932 - DNA, 25 bp, Rattus norvegicus
aaccccagaagctatacctctaggg

SEQ ID NO: 24933 - DNA, 25 bp, Rattus norvegicus
aaccccagagacaccaagaatagca

SEQ ID NO: 24934 - DNA, 25 bp, Rattus norvegicus
aaccccagagactccaagaatagca

SEQ ID NO: 24935 - DNA, 25 bp, Rattus norvegicus
aaccccagatggccccaggcaggga

SEQ ID NO: 24936 - DNA, 25 bp, Rattus norvegicus
aaccccagatgggcccaggcaggga

SEQ ID NO: 24937 - DNA, 25 bp, Rattus norvegicus
aaccccagcagtccctaaagctagt

SEQ ID NO: 24938 - DNA, 25 bp, Rattus norvegicus
aaccccagcagtgcctaaagctagt

SEQ ID NO: 24939 - DNA, 25 bp, Rattus norvegicus
aaccccagcccaccatgggaagtgg

SEQ ID NO: 24940 - DNA, 25 bp, Rattus norvegicus
aaccccagcccagcatgggaagtgg

SEQ ID NO: 24941 - DNA, 25 bp, Rattus norvegicus
aaccccagcctaactgatcgttact

SEQ ID NO: 24942 - DNA, 25 bp, Rattus norvegicus
aaccccagcctatctgatcgttact

SEQ ID NO: 24943 - DNA, 25 bp, Rattus norvegicus
aaccccagccttcgaaacttgctga

SEQ ID NO: 24944 - DNA, 25 bp, Rattus norvegicus
aaccccagccttggaaacttgctga

SEQ ID NO: 24945 - DNA, 25 bp, Rattus norvegicus
aaccccagcgaccatgatgacctga

SEQ ID NO: 24946 - DNA, 25 bp, Rattus norvegicus
aaccccagcgacgatgatgacctga

SEQ ID NO: 24947 - DNA, 25 bp, Rattus norvegicus
aaccccagctggcagatcttctcag

SEQ ID NO: 24948 - DNA, 25 bp, Rattus norvegicus
aaccccagctgggagatcttctcag

SEQ ID NO: 24949 - DNA, 25 bp, Rattus norvegicus
aaccccagtagtaggcacggctatt

SEQ ID NO: 24950 - DNA, 25 bp, Rattus norvegicus
aaccccagtagttggcacggctatt

SEQ ID NO: 24951 - DNA, 25 bp, Rattus norvegicus
aaccccagtgacctatgctggatgg

SEQ ID NO: 24952 - DNA, 25 bp, Rattus norvegicus
aaccccagtgacgtatgctggatgg

SEQ ID NO: 24953 - DNA, 25 bp, Rattus norvegicus
aaccccagtgcgctgaggtgtgaat

SEQ ID NO: 24954 - DNA, 25 bp, Rattus norvegicus
aaccccagtgcggtgaggtgtgaat

SEQ ID NO: 24955 - DNA, 25 bp, Rattus norvegicus
aaccccagtgttctagattgtgtga

SEQ ID NO: 24956 - DNA, 25 bp, Rattus norvegicus
aaccccagtgttctctgaggtgagc

SEQ ID NO: 24957 - DNA, 25 bp, Rattus norvegicus
aaccccagtgttgtagattgtgtga

SEQ ID NO: 24958 - DNA, 25 bp, Rattus norvegicus
aaccccagtgttgtctgaggtgagc

SEQ ID NO: 24959 - DNA, 25 bp, Rattus norvegicus
aaccccagtttcaagagcgggccat

SEQ ID NO: 24960 - DNA, 25 bp, Rattus norvegicus
aaccccagtttctagagcgggccat

SEQ ID NO: 24961 - DNA, 25 bp, Rattus norvegicus
aaccccagttttcatggtgtcctgg

SEQ ID NO: 24962 - DNA, 25 bp, Rattus norvegicus
aaccccagttttgatggtgtcctgg

SEQ ID NO: 24963 - DNA, 25 bp, Rattus norvegicus
aaccccataggtctgtagctaaggc

SEQ ID NO: 24964 - DNA, 25 bp, Rattus norvegicus
aaccccataggtgtgtagctaaggc

SEQ ID NO: 24965 - DNA, 25 bp, Rattus norvegicus
aaccccatagtgatgaaactgctag

SEQ ID NO: 24966 - DNA, 25 bp, Rattus norvegicus
aaccccatagtgttgaaactgctag

SEQ ID NO: 24967 - DNA, 25 bp, Rattus norvegicus
aaccccatcacaactttcttgagaa

SEQ ID NO: 24968 - DNA, 25 bp, Rattus norvegicus
aaccccatcacatctttcttgagaa

SEQ ID NO: 24969 - DNA, 25 bp, Rattus norvegicus
aaccccatctcaagggtggttatga

SEQ ID NO: 24970 - DNA, 25 bp, Rattus norvegicus
aaccccatctcatgggtggttatga

SEQ ID NO: 24971 - DNA, 25 bp, Rattus norvegicus
aaccccatgcgcatggatcaataaa

SEQ ID NO: 24972 - DNA, 25 bp, Rattus norvegicus
aaccccatgcgcttggatcaataaa

SEQ ID NO: 24973 - DNA, 25 bp, Rattus norvegicus
aaccccatggcgatcctaaatatat

SEQ ID NO: 24974 - DNA, 25 bp, Rattus norvegicus
aaccccatggcgttcctaaatatat

SEQ ID NO: 24975 - DNA, 25 bp, Rattus norvegicus
aaccccattgccagtgttagtgtgg

SEQ ID NO: 24976 - DNA, 25 bp, Rattus norvegicus
aaccccattgcctgtgttagtgtgg

SEQ ID NO: 24977 - DNA, 25 bp, Rattus norvegicus
aaccccgaagacagagaatagcaat

SEQ ID NO: 24978 - DNA, 25 bp, Rattus norvegicus
aaccccgaagactgagaatagcaat

SEQ ID NO: 24979 - DNA, 25 bp, Rattus norvegicus
aaccccgcagttcctgatgtgatgt

SEQ ID NO: 24980 - DNA, 25 bp, Rattus norvegicus
aaccccgcagttgctgatgtgatgt

SEQ ID NO: 24981 - DNA, 25 bp, Rattus norvegicus
aaccccgcggcaagttgtgcttcaa

SEQ ID NO: 24982 - DNA, 25 bp, Rattus norvegicus
aaccccgcggcatgttgtgcttcaa

SEQ ID NO: 24983 - DNA, 25 bp, Rattus norvegicus
aaccccgggatgagtcatctgttga

SEQ ID NO: 24984 - DNA, 25 bp, Rattus norvegicus
aaccccgggatgtgtcatctgttga

SEQ ID NO: 24985 - DNA, 25 bp, Rattus norvegicus
aaccccgtagatctgtgactccatg

SEQ ID NO: 24986 - DNA, 25 bp, Rattus norvegicus
aaccccgtagatgtgtgactccatg

SEQ ID NO: 24987 - DNA, 25 bp, Rattus norvegicus
aaccccgtctttccagagcattaat

SEQ ID NO: 24988 - DNA, 25 bp, Rattus norvegicus
aaccccgtctttgcagagcattaat

SEQ ID NO: 24989 - DNA, 25 bp, Rattus norvegicus
aaccccgtgactacattaaacagat

SEQ ID NO: 24990 - DNA, 25 bp, Rattus norvegicus
aaccccgtgacttcattaaacagat

SEQ ID NO: 24991 - DNA, 25 bp, Rattus norvegicus
aaccccgtgttgaatgccttcattg

SEQ ID NO: 24992 - DNA, 25 bp, Rattus norvegicus
aaccccgtgttgtatgccttcattg

SEQ ID NO: 24993 - DNA, 25 bp, Rattus norvegicus
aaccccgttgtcactgagcgataca

SEQ ID NO: 24994 - DNA, 25 bp, Rattus norvegicus
aaccccgttgtctctgagcgataca

SEQ ID NO: 24995 - DNA, 25 bp, Rattus norvegicus
aacccctaaactcaatgctgcaagt

SEQ ID NO: 24996 - DNA, 25 bp, Rattus norvegicus
aacccctaaactgaatgctgcaagt

SEQ ID NO: 24997 - DNA, 25 bp, Rattus norvegicus
aacccctacaatatatgctctcgtg

SEQ ID NO: 24998 - DNA, 25 bp, Rattus norvegicus
aacccctacaatttatgctctcgtg

SEQ ID NO: 24999 - DNA, 25 bp, Rattus norvegicus
aacccctaccatctaccaaggattg

SEQ ID NO: 25000 - DNA, 25 bp, Rattus norvegicus
aacccctaccatgtaccaaggattg

SEQ ID NO: 25001 - DNA, 25 bp, Rattus norvegicus
aacccctaccctctgtgaagacatg

SEQ ID NO: 25002 - DNA, 25 bp, Rattus norvegicus
aacccctaccctgtgtgaagacatg

SEQ ID NO: 25003 - DNA, 25 bp, Rattus norvegicus
aacccctagactcatctttcttaat

SEQ ID NO: 25004 - DNA, 25 bp, Rattus norvegicus
aacccctagactgatctttcttaat

SEQ ID NO: 25005 - DNA, 25 bp, Rattus norvegicus
aacccctagagcacggatgacaaat

SEQ ID NO: 25006 - DNA, 25 bp, Rattus norvegicus
aacccctagagctcggatgacaaat

SEQ ID NO: 25007 - DNA, 25 bp, Rattus norvegicus
aacccctagaggagcttcgagatga

SEQ ID NO: 25008 - DNA, 25 bp, Rattus norvegicus
aacccctagaggtgcttcgagatga

SEQ ID NO: 25009 - DNA, 25 bp, Rattus norvegicus
aacccctatcagctgtgcactgttg

SEQ ID NO: 25010 - DNA, 25 bp, Rattus norvegicus
aacccctatcaggtgtgcactgttg

SEQ ID NO: 25011 - DNA, 25 bp, Rattus norvegicus
aacccctatgccctgtgttttctga

SEQ ID NO: 25012 - DNA, 25 bp, Rattus norvegicus
aacccctatgccgtgtgttttctga

SEQ ID NO: 25013 - DNA, 25 bp, Rattus norvegicus
aacccctattatatgcgtgtgcgaa

SEQ ID NO: 25014 - DNA, 25 bp, Rattus norvegicus
aacccctattatttgcgtgtgcgaa

SEQ ID NO: 25015 - DNA, 25 bp, Rattus norvegicus
aacccctcactcaaagacagttgga

SEQ ID NO: 25016 - DNA, 25 bp, Rattus norvegicus
aacccctcactctaagacagttgga

SEQ ID NO: 25017 - DNA, 25 bp, Rattus norvegicus
aacccctcagagctttcttttgaga

SEQ ID NO: 25018 - DNA, 25 bp, Rattus norvegicus
aacccctcagaggtttcttttgaga

SEQ ID NO: 25019 - DNA, 25 bp, Rattus norvegicus
aacccctcagttcggtgtagatgac

SEQ ID NO: 25020 - DNA, 25 bp, Rattus norvegicus
aacccctcagttgggtgtagatgac

SEQ ID NO: 25021 - DNA, 25 bp, Rattus norvegicus
aacccctcatgaaagaagcagctgt

SEQ ID NO: 25022 - DNA, 25 bp, Rattus norvegicus
aacccctcatgatagaagcagctgt

SEQ ID NO: 25023 - DNA, 25 bp, Rattus norvegicus
aacccctcccagagtggagattcgt

SEQ ID NO: 25024 - DNA, 25 bp, Rattus norvegicus
aacccctcccagtgtggagattcgt

SEQ ID NO: 25025 - DNA, 25 bp, Rattus norvegicus
aacccctcctgactggtatgctttt

SEQ ID NO: 25026 - DNA, 25 bp, Rattus norvegicus
aacccctcctgagtggtatgctttt

SEQ ID NO: 25027 - DNA, 25 bp, Rattus norvegicus
aacccctctaatctggtcagcgaga

SEQ ID NO: 25028 - DNA, 25 bp, Rattus norvegicus
aacccctctaatgtggtcagcgaga

SEQ ID NO: 25029 - DNA, 25 bp, Rattus norvegicus
aacccctctcctactaaggatagct

SEQ ID NO: 25030 - DNA, 25 bp, Rattus norvegicus
aacccctctccttctaaggatagct

SEQ ID NO: 25031 - DNA, 25 bp, Rattus norvegicus
aacccctctgagagggaattccctg

SEQ ID NO: 25032 - DNA, 25 bp, Rattus norvegicus
aacccctctgagatgaaattaagtc

SEQ ID NO: 25033 - DNA, 25 bp, Rattus norvegicus
aacccctctgagatggtagtaagtc

SEQ ID NO: 25034 - DNA, 25 bp, Rattus norvegicus
aacccctctgagtgggaattccctg

SEQ ID NO: 25035 - DNA, 25 bp, Rattus norvegicus
aacccctctgagttgaaattaagtc

SEQ ID NO: 25036 - DNA, 25 bp, Rattus norvegicus
aacccctctgagttggtagtaagtc

SEQ ID NO: 25037 - DNA, 25 bp, Rattus norvegicus
aacccctctttcatcaatatcgtgt

SEQ ID NO: 25038 - DNA, 25 bp, Rattus norvegicus
aacccctctttcttcaatatcgtgt

SEQ ID NO: 25039 - DNA, 25 bp, Rattus norvegicus
aacccctgaactactgtagcttcat

SEQ ID NO: 25040 - DNA, 25 bp, Rattus norvegicus
aacccctgaacttctgtagcttcat

SEQ ID NO: 25041 - DNA, 25 bp, Rattus norvegicus
aacccctgacttctgcagagatgga

SEQ ID NO: 25042 - DNA, 25 bp, Rattus norvegicus
aacccctgacttgtgcagagatgga

SEQ ID NO: 25043 - DNA, 25 bp, Rattus norvegicus
aacccctgcagtccctgagaaagga

SEQ ID NO: 25044 - DNA, 25 bp, Rattus norvegicus
aacccctgcagtgcctgagaaagga

SEQ ID NO: 25045 - DNA, 25 bp, Rattus norvegicus
aacccctgcataatatccatgggca

SEQ ID NO: 25046 - DNA, 25 bp, Rattus norvegicus
aacccctgcatattatccatgggca

SEQ ID NO: 25047 - DNA, 25 bp, Rattus norvegicus
aacccctgccatctatatactacta

SEQ ID NO: 25048 - DNA, 25 bp, Rattus norvegicus
aacccctgccatgtatatactacta

SEQ ID NO: 25049 - DNA, 25 bp, Rattus norvegicus
aacccctggaggcaagctggcagct

SEQ ID NO: 25050 - DNA, 25 bp, Rattus norvegicus
aacccctggagggaagctggcagct

SEQ ID NO: 25051 - DNA, 25 bp, Rattus norvegicus
aacccctgggatcactggactagac

SEQ ID NO: 25052 - DNA, 25 bp, Rattus norvegicus
aacccctgggatgactggactagac

SEQ ID NO: 25053 - DNA, 25 bp, Rattus norvegicus
aacccctgggtaattgcactgactt

SEQ ID NO: 25054 - DNA, 25 bp, Rattus norvegicus
aacccctgggtatttgcactgactt

SEQ ID NO: 25055 - DNA, 25 bp, Rattus norvegicus
aacccctgtacgatgtagcatagac

SEQ ID NO: 25056 - DNA, 25 bp, Rattus norvegicus
aacccctgtacgttgtagcatagac

SEQ ID NO: 25057 - DNA, 25 bp, Rattus norvegicus
aacccctgtgatcctcccaaaggaa

SEQ ID NO: 25058 - DNA, 25 bp, Rattus norvegicus
aacccctgtgatgctcccaaaggaa

SEQ ID NO: 25059 - DNA, 25 bp, Rattus norvegicus
aaccccttagagatcctctgtgtga

SEQ ID NO: 25060 - DNA, 25 bp, Rattus norvegicus
aaccccttagagttcctctgtgtga

SEQ ID NO: 25061 - DNA, 25 bp, Rattus norvegicus
aaccccttagatcctgtccaaacaa

SEQ ID NO: 25062 - DNA, 25 bp, Rattus norvegicus
aaccccttagatgctgtccaaacaa

SEQ ID NO: 25063 - DNA, 25 bp, Rattus norvegicus
aaccccttctgccaggaaacactgt

SEQ ID NO: 25064 - DNA, 25 bp, Rattus norvegicus
aaccccttctgcgaggaaacactgt

SEQ ID NO: 25065 - DNA, 25 bp, Rattus norvegicus
aaccccttcttgacaggtctgagtg

SEQ ID NO: 25066 - DNA, 25 bp, Rattus norvegicus
aaccccttcttgtcaggtctgagtg

SEQ ID NO: 25067 - DNA, 25 bp, Rattus norvegicus
aaccccttgctaacacttctgtgaa

SEQ ID NO: 25068 - DNA, 25 bp, Rattus norvegicus
aaccccttgctatcacttctgtgaa

SEQ ID NO: 25069 - DNA, 25 bp, Rattus norvegicus
aacccctttcagacatggctgatgt

SEQ ID NO: 25070 - DNA, 25 bp, Rattus norvegicus
aacccctttcagtcatggctgatgt

SEQ ID NO: 25071 - DNA, 25 bp, Rattus norvegicus
aacccctttgacatggatcagacgg

SEQ ID NO: 25072 - DNA, 25 bp, Rattus norvegicus
aacccctttgacttggatcagacgg

SEQ ID NO: 25073 - DNA, 25 bp, Rattus norvegicus
aacccctttgcaataagctttatgg

SEQ ID NO: 25074 - DNA, 25 bp, Rattus norvegicus
aacccctttgcactcagtaggagaa

SEQ ID NO: 25075 - DNA, 25 bp, Rattus norvegicus
aacccctttgcagtcagtaggagaa

SEQ ID NO: 25076 - DNA, 25 bp, Rattus norvegicus
aacccctttgcattaagctttatgg

SEQ ID NO: 25077 - DNA, 25 bp, Rattus norvegicus
aaccccttttctagtgtacagtctg

SEQ ID NO: 25078 - DNA, 25 bp, Rattus norvegicus
aaccccttttcttgtgtacagtctg

SEQ ID NO: 25079 - DNA, 25 bp, Rattus norvegicus
aacccgacaattactttgccactgg

SEQ ID NO: 25080 - DNA, 25 bp, Rattus norvegicus
aacccgacaatttctttgccactgg

SEQ ID NO: 25081 - DNA, 25 bp, Rattus norvegicus
aacccgaccggaagatggtgcagct

SEQ ID NO: 25082 - DNA, 25 bp, Rattus norvegicus
aacccgaccggatgatggtgcagct

SEQ ID NO: 25083 - DNA, 25 bp, Rattus norvegicus
aacccgacctgcaaagtggcacagc

SEQ ID NO: 25084 - DNA, 25 bp, Rattus norvegicus
aacccgacctgctaagtggcacagc

SEQ ID NO: 25085 - DNA, 25 bp, Rattus norvegicus
aacccgactgttcatcttcttgaca

SEQ ID NO: 25086 - DNA, 25 bp, Rattus norvegicus
aacccgactgttgatcttcttgaca

SEQ ID NO: 25087 - DNA, 25 bp, Rattus norvegicus
aacccgagatttcgctcctacaaag

SEQ ID NO: 25088 - DNA, 25 bp, Rattus norvegicus
aacccgagatttggctcctacaaag

SEQ ID NO: 25089 - DNA, 25 bp, Rattus norvegicus
aacccgaggctgaagagcgactgcc

SEQ ID NO: 25090 - DNA, 25 bp, Rattus norvegicus
aacccgaggctgtagagcgactgcc

SEQ ID NO: 25091 - DNA, 25 bp, Rattus norvegicus
aacccgatgtgcctgtctacgatgg

SEQ ID NO: 25092 - DNA, 25 bp, Rattus norvegicus
aacccgatgtgcgtgtctacgatgg

SEQ ID NO: 25093 - DNA, 25 bp, Rattus norvegicus
aacccgattggtcacctagctattg

SEQ ID NO: 25094 - DNA, 25 bp, Rattus norvegicus
aacccgattggtgacctagctattg

SEQ ID NO: 25095 - DNA, 25 bp, Rattus norvegicus
aacccgcacataactcgtcaaatcg

SEQ ID NO: 25096 - DNA, 25 bp, Rattus norvegicus
aacccgcacatatctcgtcaaatcg

SEQ ID NO: 25097 - DNA, 25 bp, Rattus norvegicus
aacccgcacattctctaatagtatc

SEQ ID NO: 25098 - DNA, 25 bp, Rattus norvegicus
aacccgcacattgtctaatagtatc

SEQ ID NO: 25099 - DNA, 25 bp, Rattus norvegicus
aacccgcaggcaagagttcactctg

SEQ ID NO: 25100 - DNA, 25 bp, Rattus norvegicus
aacccgcaggcatgagttcactctg

SEQ ID NO: 25101 - DNA, 25 bp, Rattus norvegicus
aacccgccagggaagctttggatat

SEQ ID NO: 25102 - DNA, 25 bp, Rattus norvegicus
aacccgccagggtagctttggatat

SEQ ID NO: 25103 - DNA, 25 bp, Rattus norvegicus
aacccgccatagatagctttgtaat

SEQ ID NO: 25104 - DNA, 25 bp, Rattus norvegicus
aacccgccatagttagctttgtaat

SEQ ID NO: 25105 - DNA, 25 bp, Rattus norvegicus
aacccgctatggcttttgaactatt

SEQ ID NO: 25106 - DNA, 25 bp, Rattus norvegicus
aacccgctatgggttttgaactatt

SEQ ID NO: 25107 - DNA, 25 bp, Rattus norvegicus
aacccgctcttcatagtaaaccaca

SEQ ID NO: 25108 - DNA, 25 bp, Rattus norvegicus
aacccgctcttcttagtaaaccaca

SEQ ID NO: 25109 - DNA, 25 bp, Rattus norvegicus
aacccgctggtgaacgtgattgtgg

SEQ ID NO: 25110 - DNA, 25 bp, Rattus norvegicus
aacccgctggtgtacgtgattgtgg

SEQ ID NO: 25111 - DNA, 25 bp, Rattus norvegicus
aacccgcttttgcacttaactatat

SEQ ID NO: 25112 - DNA, 25 bp, Rattus norvegicus
aacccgcttttggacttaactatat

SEQ ID NO: 25113 - DNA, 25 bp, Rattus norvegicus
aacccggaagccatcactgaagtca

SEQ ID NO: 25114 - DNA, 25 bp, Rattus norvegicus
aacccggaagccttcactgaagtca

SEQ ID NO: 25115 - DNA, 25 bp, Rattus norvegicus
aacccggagttcagatcatgcccta

SEQ ID NO: 25116 - DNA, 25 bp, Rattus norvegicus
aacccggagttctgatcatgcccta

SEQ ID NO: 25117 - DNA, 25 bp, Rattus norvegicus
aacccggatctgcagaagcgacgca

SEQ ID NO: 25118 - DNA, 25 bp, Rattus norvegicus
aacccggatctggagaagcgacgca

SEQ ID NO: 25119 - DNA, 25 bp, Rattus norvegicus
aacccggctccaaacagaatgctgt

SEQ ID NO: 25120 - DNA, 25 bp, Rattus norvegicus
aacccggctccatacagaatgctgt

SEQ ID NO: 25121 - DNA, 25 bp, Rattus norvegicus
aacccggctgctcatctggaagact

SEQ ID NO: 25122 - DNA, 25 bp, Rattus norvegicus
aacccggctgctgatctggaagact

SEQ ID NO: 25123 - DNA, 25 bp, Rattus norvegicus
aacccggtcatcaatactgtcttca

SEQ ID NO: 25124 - DNA, 25 bp, Rattus norvegicus
aacccggtcatctatactgtcttca

SEQ ID NO: 25125 - DNA, 25 bp, Rattus norvegicus
aacccggtgtccctgtacgagtgat

SEQ ID NO: 25126 - DNA, 25 bp, Rattus norvegicus
aacccggtgtccgtgtacgagtgat

SEQ ID NO: 25127 - DNA, 25 bp, Rattus norvegicus
aacccggtgtggcagaccttctcca

SEQ ID NO: 25128 - DNA, 25 bp, Rattus norvegicus
aacccggtgtgggagaccttctcca

SEQ ID NO: 25129 - DNA, 25 bp, Rattus norvegicus
aacccgtacttcatccaggaggctg

SEQ ID NO: 25130 - DNA, 25 bp, Rattus norvegicus
aacccgtacttcttccaggaggctg

SEQ ID NO: 25131 - DNA, 25 bp, Rattus norvegicus
aacccgtagctaatatgtcagccgt

SEQ ID NO: 25132 - DNA, 25 bp, Rattus norvegicus
aacccgtagctattatgtcagccgt

SEQ ID NO: 25133 - DNA, 25 bp, Rattus norvegicus
aacccgtcagctcttgtcactgaga

SEQ ID NO: 25134 - DNA, 25 bp, Rattus norvegicus
aacccgtcagctgttgtcactgaga

SEQ ID NO: 25135 - DNA, 25 bp, Rattus norvegicus
aacccgtctgacatgctgctatgaa

SEQ ID NO: 25136 - DNA, 25 bp, Rattus norvegicus
aacccgtctgacttgctgctatgaa

SEQ ID NO: 25137 - DNA, 25 bp, Rattus norvegicus
aacccgtgagatcggatcaacattg

SEQ ID NO: 25138 - DNA, 25 bp, Rattus norvegicus
aacccgtgagatgggatcaacattg

SEQ ID NO: 25139 - DNA, 25 bp, Rattus norvegicus
aacccgtggcttctgggacttgcac

SEQ ID NO: 25140 - DNA, 25 bp, Rattus norvegicus
aacccgtggcttgtgggacttgcac

SEQ ID NO: 25141 - DNA, 25 bp, Rattus norvegicus
aacccgttagcaattctctatagcc

SEQ ID NO: 25142 - DNA, 25 bp, Rattus norvegicus
aacccgttagcatttctctatagcc

SEQ ID NO: 25143 - DNA, 25 bp, Rattus norvegicus
aacccgttctgtcttctgcaagctg

SEQ ID NO: 25144 - DNA, 25 bp, Rattus norvegicus
aacccgttctgtgttctgcaagctg

SEQ ID NO: 25145 - DNA, 25 bp, Rattus norvegicus
aacccgttcttcagatactgcattg

SEQ ID NO: 25146 - DNA, 25 bp, Rattus norvegicus
aacccgttcttctgatactgcattg

SEQ ID NO: 25147 - DNA, 25 bp, Rattus norvegicus
aacccgttgatcaccatcttttggg

SEQ ID NO: 25148 - DNA, 25 bp, Rattus norvegicus
aacccgttgatctccatcttttggg

SEQ ID NO: 25149 - DNA, 25 bp, Rattus norvegicus
aaccctaaaagtaagcagcttcctg

SEQ ID NO: 25150 - DNA, 25 bp, Rattus norvegicus
aaccctaaaagttagcagcttcctg

SEQ ID NO: 25151 - DNA, 25 bp, Rattus norvegicus
aaccctaacctcatattgttgctga

SEQ ID NO: 25152 - DNA, 25 bp, Rattus norvegicus
aaccctaacctcttattgttgctga

SEQ ID NO: 25153 - DNA, 25 bp, Rattus norvegicus
aaccctaactttctcttgtcagaag

SEQ ID NO: 25154 - DNA, 25 bp, Rattus norvegicus
aaccctaactttgtcttgtcagaag

SEQ ID NO: 25155 - DNA, 25 bp, Rattus norvegicus
aaccctaagcctacattagctcata

SEQ ID NO: 25156 - DNA, 25 bp, Rattus norvegicus
aaccctaagccttcattagctcata

SEQ ID NO: 25157 - DNA, 25 bp, Rattus norvegicus
aaccctacaatacgtagcttcttag

SEQ ID NO: 25158 - DNA, 25 bp, Rattus norvegicus
aaccctacaataggtagcttcttag

SEQ ID NO: 25159 - DNA, 25 bp, Rattus norvegicus
aaccctagctgaactggaactcact

SEQ ID NO: 25160 - DNA, 25 bp, Rattus norvegicus
aaccctagctgatctggaactcact

SEQ ID NO: 25161 - DNA, 25 bp, Rattus norvegicus
aaccctaggcccaggagagcgggat

SEQ ID NO: 25162 - DNA, 25 bp, Rattus norvegicus
aaccctaggccctggagagcgggat

SEQ ID NO: 25163 - DNA, 25 bp, Rattus norvegicus
aaccctagggcgctataaataattg

SEQ ID NO: 25164 - DNA, 25 bp, Rattus norvegicus
aaccctagggcggtataaataattg

SEQ ID NO: 25165 - DNA, 25 bp, Rattus norvegicus
aaccctaggtgtactcagttgtgga

SEQ ID NO: 25166 - DNA, 25 bp, Rattus norvegicus
aaccctaggtgttctcagttgtgga

SEQ ID NO: 25167 - DNA, 25 bp, Rattus norvegicus
aaccctagtcccagtcactgagtgc

SEQ ID NO: 25168 - DNA, 25 bp, Rattus norvegicus
aaccctagtccctgtcactgagtgc

SEQ ID NO: 25169 - DNA, 25 bp, Rattus norvegicus
aaccctataaatccgtggactgcgg

SEQ ID NO: 25170 - DNA, 25 bp, Rattus norvegicus
aaccctataaatgcgtggactgcgg

SEQ ID NO: 25171 - DNA, 25 bp, Rattus norvegicus
aaccctatactgagaggtatgcgcc

SEQ ID NO: 25172 - DNA, 25 bp, Rattus norvegicus
aaccctatactgtgaggtatgcgcc

SEQ ID NO: 25173 - DNA, 25 bp, Rattus norvegicus
aaccctatcgtcatggtacggtatg

SEQ ID NO: 25174 - DNA, 25 bp, Rattus norvegicus
aaccctatcgtcttggtacggtatg

SEQ ID NO: 25175 - DNA, 25 bp, Rattus norvegicus
aaccctatgaaaaggctggctatgt

SEQ ID NO: 25176 - DNA, 25 bp, Rattus norvegicus
aaccctatgaaatggctggctatgt

SEQ ID NO: 25177 - DNA, 25 bp, Rattus norvegicus
aaccctattccactaggtcctgaat

SEQ ID NO: 25178 - DNA, 25 bp, Rattus norvegicus
aaccctattccagtaggtcctgaat

SEQ ID NO: 25179 - DNA, 25 bp, Rattus norvegicus
aaccctatttctacagtgtcttaag

SEQ ID NO: 25180 - DNA, 25 bp, Rattus norvegicus
aaccctatttcttcagtgtcttaag

SEQ ID NO: 25181 - DNA, 25 bp, Rattus norvegicus
aaccctattttgcagccacacgcaa

SEQ ID NO: 25182 - DNA, 25 bp, Rattus norvegicus
aaccctattttggagccacacgcaa

SEQ ID NO: 25183 - DNA, 25 bp, Rattus norvegicus
aaccctcaagagattgcacacacgc

SEQ ID NO: 25184 - DNA, 25 bp, Rattus norvegicus
aaccctcaagagtttgcacacacgc

SEQ ID NO: 25185 - DNA, 25 bp, Rattus norvegicus
aaccctcaaggccaatatggtgctt

SEQ ID NO: 25186 - DNA, 25 bp, Rattus norvegicus
aaccctcaaggcgaatatggtgctt

SEQ ID NO: 25187 - DNA, 25 bp, Rattus norvegicus
aaccctcaatgaattttgttttatg

SEQ ID NO: 25188 - DNA, 25 bp, Rattus norvegicus
aaccctcaatgatttttgttttatg

SEQ ID NO: 25189 - DNA, 25 bp, Rattus norvegicus
aaccctcacgatctgaaattccttt

SEQ ID NO: 25190 - DNA, 25 bp, Rattus norvegicus
aaccctcacgatgtgaaattccttt

SEQ ID NO: 25191 - DNA, 25 bp, Rattus norvegicus
aaccctcagcgtctcagatgtgagt

SEQ ID NO: 25192 - DNA, 25 bp, Rattus norvegicus
aaccctcagcgtgtcagatgtgagt

SEQ ID NO: 25193 - DNA, 25 bp, Rattus norvegicus
aaccctcagctcagtagacctgtgt

SEQ ID NO: 25194 - DNA, 25 bp, Rattus norvegicus
aaccctcagctctgtagacctgtgt

SEQ ID NO: 25195 - DNA, 25 bp, Rattus norvegicus
aaccctcagttaaagagttcccagg

SEQ ID NO: 25196 - DNA, 25 bp, Rattus norvegicus
aaccctcagttatagagttcccagg

SEQ ID NO: 25197 - DNA, 25 bp, Rattus norvegicus
aaccctcagttgcattttgcttcat

SEQ ID NO: 25198 - DNA, 25 bp, Rattus norvegicus
aaccctcagttggattttgcttcat

SEQ ID NO: 25199 - DNA, 25 bp, Rattus norvegicus
aaccctccagaaagccatcgatctg

SEQ ID NO: 25200 - DNA, 25 bp, Rattus norvegicus
aaccctccagaatgccatcgatctg

SEQ ID NO: 25201 - DNA, 25 bp, Rattus norvegicus
aaccctccagatccacacagtgaag

SEQ ID NO: 25202 - DNA, 25 bp, Rattus norvegicus
aaccctccagatgcacacagtgaag

SEQ ID NO: 25203 - DNA, 25 bp, Rattus norvegicus
aaccctcctagactcattctgtaat

SEQ ID NO: 25204 - DNA, 25 bp, Rattus norvegicus
aaccctcctagagtcattctgtaat

SEQ ID NO: 25205 - DNA, 25 bp, Rattus norvegicus
aaccctcctgtaaatacctattgcg

SEQ ID NO: 25206 - DNA, 25 bp, Rattus norvegicus
aaccctcctgtatatacctattgcg

SEQ ID NO: 25207 - DNA, 25 bp, Rattus norvegicus
aaccctcgaactaggcgcttgttag

SEQ ID NO: 25208 - DNA, 25 bp, Rattus norvegicus
aaccctcgaacttggcgcttgttag

SEQ ID NO: 25209 - DNA, 25 bp, Rattus norvegicus
aaccctcggagaagacaggcagcct

SEQ ID NO: 25210 - DNA, 25 bp, Rattus norvegicus
aaccctcggagatgacaggcagcct

SEQ ID NO: 25211 - DNA, 25 bp, Rattus norvegicus
aaccctcggcgcagatgatatcatg

SEQ ID NO: 25212 - DNA, 25 bp, Rattus norvegicus
aaccctcggcgctgatgatatcatg

SEQ ID NO: 25213 - DNA, 25 bp, Rattus norvegicus
aaccctctcaaacgcaggctgcttt

SEQ ID NO: 25214 - DNA, 25 bp, Rattus norvegicus
aaccctctcaaaggcaggctgcttt

SEQ ID NO: 25215 - DNA, 25 bp, Rattus norvegicus
aaccctctcaacagaattgctagtg

SEQ ID NO: 25216 - DNA, 25 bp, Rattus norvegicus
aaccctctcaactgaattgctagtg

SEQ ID NO: 25217 - DNA, 25 bp, Rattus norvegicus
aaccctctcagaatgacagccttcg

SEQ ID NO: 25218 - DNA, 25 bp, Rattus norvegicus
aaccctctcagattgacagccttcg

SEQ ID NO: 25219 - DNA, 25 bp, Rattus norvegicus
aaccctctcgagaatttgctgtctg

SEQ ID NO: 25220 - DNA, 25 bp, Rattus norvegicus
aaccctctcgagtatttgctgtctg

SEQ ID NO: 25221 - DNA, 25 bp, Rattus norvegicus
aaccctctctgtactgtgcgtgtgt

SEQ ID NO: 25222 - DNA, 25 bp, Rattus norvegicus
aaccctctctgttctgtgcgtgtgt

SEQ ID NO: 25223 - DNA, 25 bp, Rattus norvegicus
aaccctctcttgatgtctgcagaag

SEQ ID NO: 25224 - DNA, 25 bp, Rattus norvegicus
aaccctctcttgttgtctgcagaag

SEQ ID NO: 25225 - DNA, 25 bp, Rattus norvegicus
aaccctctgcagattcactttgaaa

SEQ ID NO: 25226 - DNA, 25 bp, Rattus norvegicus
aaccctctgcagtttcactttgaaa

SEQ ID NO: 25227 - DNA, 25 bp, Rattus norvegicus
aaccctctgggtcgccgggcagaca

SEQ ID NO: 25228 - DNA, 25 bp, Rattus norvegicus
aaccctctgggtggccgggcagaca

SEQ ID NO: 25229 - DNA, 25 bp, Rattus norvegicus
aaccctctgttcaacggctttctgg

SEQ ID NO: 25230 - DNA, 25 bp, Rattus norvegicus
aaccctctgttctacggctttctgg

SEQ ID NO: 25231 - DNA, 25 bp, Rattus norvegicus
aaccctcttatcaagtctggatgag

SEQ ID NO: 25232 - DNA, 25 bp, Rattus norvegicus
aaccctcttatctagtctggatgag

SEQ ID NO: 25233 - DNA, 25 bp, Rattus norvegicus
aaccctcttgctattctgtctttaa

SEQ ID NO: 25234 - DNA, 25 bp, Rattus norvegicus
aaccctcttgcttttctgtctttaa

SEQ ID NO: 25235 - DNA, 25 bp, Rattus norvegicus
aaccctcttgtaattccttgattat

SEQ ID NO: 25236 - DNA, 25 bp, Rattus norvegicus
aaccctcttgtatttccttgattat

SEQ ID NO: 25237 - DNA, 25 bp, Rattus norvegicus
aaccctgaaaccctttgtcttgatg

SEQ ID NO: 25238 - DNA, 25 bp, Rattus norvegicus
aaccctgaaaccgtttgtcttgatg

SEQ ID NO: 25239 - DNA, 25 bp, Rattus norvegicus
aaccctgaaagaccatctatccatc

SEQ ID NO: 25240 - DNA, 25 bp, Rattus norvegicus
aaccctgaaagagcatctatccatc

SEQ ID NO: 25241 - DNA, 25 bp, Rattus norvegicus
aaccctgaaggtctcagttgttgct

SEQ ID NO: 25242 - DNA, 25 bp, Rattus norvegicus
aaccctgaaggtgtcagttgttgct

SEQ ID NO: 25243 - DNA, 25 bp, Rattus norvegicus
aaccctgaagtgaagtggctctata

SEQ ID NO: 25244 - DNA, 25 bp, Rattus norvegicus
aaccctgaagtgtagtggctctata

SEQ ID NO: 25245 - DNA, 25 bp, Rattus norvegicus
aaccctgaatgtattgccacacttg

SEQ ID NO: 25246 - DNA, 25 bp, Rattus norvegicus
aaccctgaatgttttgccacacttg

SEQ ID NO: 25247 - DNA, 25 bp, Rattus norvegicus
aaccctgactgcagttctgtagata

SEQ ID NO: 25248 - DNA, 25 bp, Rattus norvegicus
aaccctgactgctgttctgtagata

SEQ ID NO: 25249 - DNA, 25 bp, Rattus norvegicus
aaccctgacttactgatgcactgtg

SEQ ID NO: 25250 - DNA, 25 bp, Rattus norvegicus
aaccctgacttagtgatgcactgtg

SEQ ID NO: 25251 - DNA, 25 bp, Rattus norvegicus
aaccctgactttcataacctggaca

SEQ ID NO: 25252 - DNA, 25 bp, Rattus norvegicus
aaccctgactttgataacctggaca

SEQ ID NO: 25253 - DNA, 25 bp, Rattus norvegicus
aaccctgagaacctgctgccaaatg

SEQ ID NO: 25254 - DNA, 25 bp, Rattus norvegicus
aaccctgagaacgtgctgccaaatg

SEQ ID NO: 25255 - DNA, 25 bp, Rattus norvegicus
aaccctgaggttagcaagtgacaag

SEQ ID NO: 25256 - DNA, 25 bp, Rattus norvegicus
aaccctgaggtttgcaagtgacaag

SEQ ID NO: 25257 - DNA, 25 bp, Rattus norvegicus
aaccctgagttgatgagtgcctgaa

SEQ ID NO: 25258 - DNA, 25 bp, Rattus norvegicus
aaccctgagttgttgagtgcctgaa

SEQ ID NO: 25259 - DNA, 25 bp, Rattus norvegicus
aaccctgataacatgtactgcctgc

SEQ ID NO: 25260 - DNA, 25 bp, Rattus norvegicus
aaccctgataacttgtactgcctgc

SEQ ID NO: 25261 - DNA, 25 bp, Rattus norvegicus
aaccctgatcctatcgagttgctaa

SEQ ID NO: 25262 - DNA, 25 bp, Rattus norvegicus
aaccctgatcctttcgagttgctaa

SEQ ID NO: 25263 - DNA, 25 bp, Rattus norvegicus
aaccctgatgaacgctgagatccac

SEQ ID NO: 25264 - DNA, 25 bp, Rattus norvegicus
aaccctgatgaaggctgagatccac

SEQ ID NO: 25265 - DNA, 25 bp, Rattus norvegicus
aaccctgatgtaatgattccgtgaa

SEQ ID NO: 25266 - DNA, 25 bp, Rattus norvegicus
aaccctgatgtattgattccgtgaa

SEQ ID NO: 25267 - DNA, 25 bp, Rattus norvegicus
aaccctgatgtgctcagtttccgct

SEQ ID NO: 25268 - DNA, 25 bp, Rattus norvegicus
aaccctgatgtggtcagtttccgct

SEQ ID NO: 25269 - DNA, 25 bp, Rattus norvegicus
aaccctgatttgagttttcagcccg

SEQ ID NO: 25270 - DNA, 25 bp, Rattus norvegicus
aaccctgatttgtgttttcagcccg

SEQ ID NO: 25271 - DNA, 25 bp, Rattus norvegicus
aaccctgcagatctgtattaatgat

SEQ ID NO: 25272 - DNA, 25 bp, Rattus norvegicus
aaccctgcagatgtgtattaatgat

SEQ ID NO: 25273 - DNA, 25 bp, Rattus norvegicus
aaccctgcaggtatctaagcaccta

SEQ ID NO: 25274 - DNA, 25 bp, Rattus norvegicus
aaccctgcaggtttctaagcaccta

SEQ ID NO: 25275 - DNA, 25 bp, Rattus norvegicus
aaccctgccaagacttaatggtgct

SEQ ID NO: 25276 - DNA, 25 bp, Rattus norvegicus
aaccctgccaagtcttaatggtgct

SEQ ID NO: 25277 - DNA, 25 bp, Rattus norvegicus
aaccctgccactaactgaaacttag

SEQ ID NO: 25278 - DNA, 25 bp, Rattus norvegicus
aaccctgccacttactgaaacttag

SEQ ID NO: 25279 - DNA, 25 bp, Rattus norvegicus
aaccctgccatgctggttcaatgaa

SEQ ID NO: 25280 - DNA, 25 bp, Rattus norvegicus
aaccctgccatggtggttcaatgaa

SEQ ID NO: 25281 - DNA, 25 bp, Rattus norvegicus
aaccctgctctcatctttgaagttg

SEQ ID NO: 25282 - DNA, 25 bp, Rattus norvegicus
aaccctgctctcttctttgaagttg

SEQ ID NO: 25283 - DNA, 25 bp, Rattus norvegicus
aaccctgctgacacgtgaacggaag

SEQ ID NO: 25284 - DNA, 25 bp, Rattus norvegicus
aaccctgctgactcgtgaacggaag

SEQ ID NO: 25285 - DNA, 25 bp, Rattus norvegicus
aaccctgctgccatccaagaggagg

SEQ ID NO: 25286 - DNA, 25 bp, Rattus norvegicus
aaccctgctgccttccaagaggagg

SEQ ID NO: 25287 - DNA, 25 bp, Rattus norvegicus
aaccctgctgctcttgataaccata

SEQ ID NO: 25288 - DNA, 25 bp, Rattus norvegicus
aaccctgctgctgttgataaccata

SEQ ID NO: 25289 - DNA, 25 bp, Rattus norvegicus
aaccctgctgggagctaccaataca

SEQ ID NO: 25290 - DNA, 25 bp, Rattus norvegicus
aaccctgctgggtgctaccaataca

SEQ ID NO: 25291 - DNA, 25 bp, Rattus norvegicus
aaccctgctgtgaccaattcggatg

SEQ ID NO: 25292 - DNA, 25 bp, Rattus norvegicus
aaccctgctgtgtccaattcggatg

SEQ ID NO: 25293 - DNA, 25 bp, Rattus norvegicus
aaccctggacccagtgtgggtgaat

SEQ ID NO: 25294 - DNA, 25 bp, Rattus norvegicus
aaccctggaccctgtgtgggtgaat

SEQ ID NO: 25295 - DNA, 25 bp, Rattus norvegicus
aaccctggagctaggtcactggaga

SEQ ID NO: 25296 - DNA, 25 bp, Rattus norvegicus
aaccctggagcttggtcactggaga

SEQ ID NO: 25297 - DNA, 25 bp, Rattus norvegicus
aaccctggagtgacagtgtcgccaa

SEQ ID NO: 25298 - DNA, 25 bp, Rattus norvegicus
aaccctggagtgtcagtgtcgccaa

SEQ ID NO: 25299 - DNA, 25 bp, Rattus norvegicus
aaccctggcattagctgcttactac

SEQ ID NO: 25300 - DNA, 25 bp, Rattus norvegicus
aaccctggcatttgctgcttactac

SEQ ID NO: 25301 - DNA, 25 bp, Rattus norvegicus
aaccctggcctcagatcttatatgg

SEQ ID NO: 25302 - DNA, 25 bp, Rattus norvegicus
aaccctggcctctgatcttatatgg

SEQ ID NO: 25303 - DNA, 25 bp, Rattus norvegicus
aaccctggcctgacagacagctgtg

SEQ ID NO: 25304 - DNA, 25 bp, Rattus norvegicus
aaccctggcctgtcagacagctgtg

SEQ ID NO: 25305 - DNA, 25 bp, Rattus norvegicus
aaccctggctcccttgagaatggtg

SEQ ID NO: 25306 - DNA, 25 bp, Rattus norvegicus
aaccctggctccgttgagaatggtg

SEQ ID NO: 25307 - DNA, 25 bp, Rattus norvegicus
aaccctggctgtagtgtgtgatgat

SEQ ID NO: 25308 - DNA, 25 bp, Rattus norvegicus
aaccctggctgttgtgtgtgatgat

SEQ ID NO: 25309 - DNA, 25 bp, Rattus norvegicus
aaccctggcttgaggtaagttgctc

SEQ ID NO: 25310 - DNA, 25 bp, Rattus norvegicus
aaccctggcttgtggtaagttgctc

SEQ ID NO: 25311 - DNA, 25 bp, Rattus norvegicus
aaccctgggcctctagaggatctaa

SEQ ID NO: 25312 - DNA, 25 bp, Rattus norvegicus
aaccctgggcctgtagaggatctaa

SEQ ID NO: 25313 - DNA, 25 bp, Rattus norvegicus
aaccctgggctgaacttgtggtcag

SEQ ID NO: 25314 - DNA, 25 bp, Rattus norvegicus
aaccctgggctgtacttgtggtcag

SEQ ID NO: 25315 - DNA, 25 bp, Rattus norvegicus
aaccctgggcttagtggcgagctgt

SEQ ID NO: 25316 - DNA, 25 bp, Rattus norvegicus
aaccctgggctttgtggcgagctgt

SEQ ID NO: 25317 - DNA, 25 bp, Rattus norvegicus
aaccctgggtgcagctgttggcata

SEQ ID NO: 25318 - DNA, 25 bp, Rattus norvegicus
aaccctgggtgctgctgttggcata

SEQ ID NO: 25319 - DNA, 25 bp, Rattus norvegicus
aaccctgggtgtccacttctaagta

SEQ ID NO: 25320 - DNA, 25 bp, Rattus norvegicus
aaccctgggtgtgcacttctaagta

SEQ ID NO: 25321 - DNA, 25 bp, Rattus norvegicus
aaccctgggttcatttgtatgctgt

SEQ ID NO: 25322 - DNA, 25 bp, Rattus norvegicus
aaccctgggttcttttgtatgctgt

SEQ ID NO: 25323 - DNA, 25 bp, Rattus norvegicus
aaccctggtcttctacaagaacagc

SEQ ID NO: 25324 - DNA, 25 bp, Rattus norvegicus
aaccctggtcttgtacaagaacagc

SEQ ID NO: 25325 - DNA, 25 bp, Rattus norvegicus
aaccctggtgttagaggtggaactg

SEQ ID NO: 25326 - DNA, 25 bp, Rattus norvegicus
aaccctggtgtttgaggtggaactg

SEQ ID NO: 25327 - DNA, 25 bp, Rattus norvegicus
aaccctggttgtcagggagcagcct

SEQ ID NO: 25328 - DNA, 25 bp, Rattus norvegicus
aaccctggttgtgagggagcagcct

SEQ ID NO: 25329 - DNA, 25 bp, Rattus norvegicus
aaccctgtaacgcactatctattca

SEQ ID NO: 25330 - DNA, 25 bp, Rattus norvegicus
aaccctgtaacggactatctattca

SEQ ID NO: 25331 - DNA, 25 bp, Rattus norvegicus
aaccctgtaattatgtgcatagagc

SEQ ID NO: 25332 - DNA, 25 bp, Rattus norvegicus
aaccctgtaattttgtgcatagagc

SEQ ID NO: 25333 - DNA, 25 bp, Rattus norvegicus
aaccctgtacagaggcatagtcccc

SEQ ID NO: 25334 - DNA, 25 bp, Rattus norvegicus
aaccctgtacagtggcatagtcccc

SEQ ID NO: 25335 - DNA, 25 bp, Rattus norvegicus
aaccctgtaggtccccagtgtggga

SEQ ID NO: 25336 - DNA, 25 bp, Rattus norvegicus
aaccctgtaggtgcccagtgtggga

SEQ ID NO: 25337 - DNA, 25 bp, Rattus norvegicus
aaccctgtcaagctgagcaacctgg

SEQ ID NO: 25338 - DNA, 25 bp, Rattus norvegicus
aaccctgtcaaggtgagcaacctgg

SEQ ID NO: 25339 - DNA, 25 bp, Rattus norvegicus
aaccctgtcagtataggagcaccga

SEQ ID NO: 25340 - DNA, 25 bp, Rattus norvegicus
aaccctgtcagtttaggagcaccga

SEQ ID NO: 25341 - DNA, 25 bp, Rattus norvegicus
aaccctgtcataaatgctttcagaa

SEQ ID NO: 25342 - DNA, 25 bp, Rattus norvegicus
aaccctgtcatatatgctttcagaa

SEQ ID NO: 25343 - DNA, 25 bp, Rattus norvegicus
aaccctgtcatcaatacatggcgta

SEQ ID NO: 25344 - DNA, 25 bp, Rattus norvegicus
aaccctgtcatcagcaatgctttta

SEQ ID NO: 25345 - DNA, 25 bp, Rattus norvegicus
aaccctgtcatctatacatggcgta

SEQ ID NO: 25346 - DNA, 25 bp, Rattus norvegicus
aaccctgtcatctgcaatgctttta

SEQ ID NO: 25347 - DNA, 25 bp, Rattus norvegicus
aaccctgtccgcagatgtctgttct

SEQ ID NO: 25348 - DNA, 25 bp, Rattus norvegicus
aaccctgtccgctgatgtctgttct

SEQ ID NO: 25349 - DNA, 25 bp, Rattus norvegicus
aaccctgtcttgctcttccaatgta

SEQ ID NO: 25350 - DNA, 25 bp, Rattus norvegicus
aaccctgtcttggtcttccaatgta

SEQ ID NO: 25351 - DNA, 25 bp, Rattus norvegicus
aaccctgtgactctttagtatcttt

SEQ ID NO: 25352 - DNA, 25 bp, Rattus norvegicus
aaccctgtgactgtttagtatcttt

SEQ ID NO: 25353 - DNA, 25 bp, Rattus norvegicus
aaccctgtgcatcgcggtgtaaaag

SEQ ID NO: 25354 - DNA, 25 bp, Rattus norvegicus
aaccctgtgcatggcggtgtaaaag

SEQ ID NO: 25355 - DNA, 25 bp, Rattus norvegicus
aaccctgtgcttactaagtgtggaa

SEQ ID NO: 25356 - DNA, 25 bp, Rattus norvegicus
aaccctgtgctttctaagtgtggaa

SEQ ID NO: 25357 - DNA, 25 bp, Rattus norvegicus
aaccctgtggaaatgtaccggctgt

SEQ ID NO: 25358 - DNA, 25 bp, Rattus norvegicus
aaccctgtggaattgtaccggctgt

SEQ ID NO: 25359 - DNA, 25 bp, Rattus norvegicus
aaccctgtgggaatttccatcggtg

SEQ ID NO: 25360 - DNA, 25 bp, Rattus norvegicus
aaccctgtgggattttccatcggtg

SEQ ID NO: 25361 - DNA, 25 bp, Rattus norvegicus
aaccctgtgtgcagatcttatgtgt

SEQ ID NO: 25362 - DNA, 25 bp, Rattus norvegicus
aaccctgtgtgctgatcttatgtgt

SEQ ID NO: 25363 - DNA, 25 bp, Rattus norvegicus
aaccctgttatgagcactgttgcct

SEQ ID NO: 25364 - DNA, 25 bp, Rattus norvegicus
aaccctgttatgtgcactgttgcct

SEQ ID NO: 25365 - DNA, 25 bp, Rattus norvegicus
aaccctgttcatcatcattttccaa

SEQ ID NO: 25366 - DNA, 25 bp, Rattus norvegicus
aaccctgttcatgatcattttccaa

SEQ ID NO: 25367 - DNA, 25 bp, Rattus norvegicus
aacccttaacacatgtccttcaaga

SEQ ID NO: 25368 - DNA, 25 bp, Rattus norvegicus
aacccttaacacttgtccttcaaga

SEQ ID NO: 25369 - DNA, 25 bp, Rattus norvegicus
aacccttaactgacatgggcctctg

SEQ ID NO: 25370 - DNA, 25 bp, Rattus norvegicus
aacccttaactgtcatgggcctctg

SEQ ID NO: 25371 - DNA, 25 bp, Rattus norvegicus
aacccttagggaatgctgcgacact

SEQ ID NO: 25372 - DNA, 25 bp, Rattus norvegicus
aacccttagggattgctgcgacact

SEQ ID NO: 25373 - DNA, 25 bp, Rattus norvegicus
aacccttagtttcaagctcatgatt

SEQ ID NO: 25374 - DNA, 25 bp, Rattus norvegicus
aacccttagtttgaagctcatgatt

SEQ ID NO: 25375 - DNA, 25 bp, Rattus norvegicus
aacccttatcacagagccattagac

SEQ ID NO: 25376 - DNA, 25 bp, Rattus norvegicus
aacccttatcactgagccattagac

SEQ ID NO: 25377 - DNA, 25 bp, Rattus norvegicus
aacccttcaccccaagtgcatgaag

SEQ ID NO: 25378 - DNA, 25 bp, Rattus norvegicus
aacccttcacccgaagtgcatgaag

SEQ ID NO: 25379 - DNA, 25 bp, Rattus norvegicus
aacccttcagataagtactggctac

SEQ ID NO: 25380 - DNA, 25 bp, Rattus norvegicus
aacccttcagattagtactggctac

SEQ ID NO: 25381 - DNA, 25 bp, Rattus norvegicus
aacccttccaagatctctgcgaagt

SEQ ID NO: 25382 - DNA, 25 bp, Rattus norvegicus
aacccttccaagttctctgcgaagt

SEQ ID NO: 25383 - DNA, 25 bp, Rattus norvegicus
aacccttccctgaatactgcctgtt

SEQ ID NO: 25384 - DNA, 25 bp, Rattus norvegicus
aacccttccctgtatactgcctgtt

SEQ ID NO: 25385 - DNA, 25 bp, Rattus norvegicus
aacccttccttaaggtctatctttg

SEQ ID NO: 25386 - DNA, 25 bp, Rattus norvegicus
aacccttccttatggtctatctttg

SEQ ID NO: 25387 - DNA, 25 bp, Rattus norvegicus
aacccttccttgacaatgcactttt

SEQ ID NO: 25388 - DNA, 25 bp, Rattus norvegicus
aacccttccttgagtgtgctagcag

SEQ ID NO: 25389 - DNA, 25 bp, Rattus norvegicus
aacccttccttgtcaatgcactttt

SEQ ID NO: 25390 - DNA, 25 bp, Rattus norvegicus
aacccttccttgtgtgtgctagcag

SEQ ID NO: 25391 - DNA, 25 bp, Rattus norvegicus
aacccttcgttgacctgtgggatag

SEQ ID NO: 25392 - DNA, 25 bp, Rattus norvegicus
aacccttcgttgtcctgtgggatag

SEQ ID NO: 25393 - DNA, 25 bp, Rattus norvegicus
aacccttctgccaattcagttttca

SEQ ID NO: 25394 - DNA, 25 bp, Rattus norvegicus
aacccttctgcctattcagttttca

SEQ ID NO: 25395 - DNA, 25 bp, Rattus norvegicus
aacccttctgtacgtagagcacttg

SEQ ID NO: 25396 - DNA, 25 bp, Rattus norvegicus
aacccttctgtaggtagagcacttg

SEQ ID NO: 25397 - DNA, 25 bp, Rattus norvegicus
aacccttgaaccaaggctttgcatc

SEQ ID NO: 25398 - DNA, 25 bp, Rattus norvegicus
aacccttgaaccagtgattgtgacc

SEQ ID NO: 25399 - DNA, 25 bp, Rattus norvegicus
aacccttgaacctaggctttgcatc

SEQ ID NO: 25400 - DNA, 25 bp, Rattus norvegicus
aacccttgaacctgtgattgtgacc

SEQ ID NO: 25401 - DNA, 25 bp, Rattus norvegicus
aacccttggcagagtggcagtgacc

SEQ ID NO: 25402 - DNA, 25 bp, Rattus norvegicus
aacccttggcagtgtggcagtgacc

SEQ ID NO: 25403 - DNA, 25 bp, Rattus norvegicus
aacccttgggttcatcatttctgag

SEQ ID NO: 25404 - DNA, 25 bp, Rattus norvegicus
aacccttgggttgatcatttctgag

SEQ ID NO: 25405 - DNA, 25 bp, Rattus norvegicus
aacccttggtcactgttgtgtccca

SEQ ID NO: 25406 - DNA, 25 bp, Rattus norvegicus
aacccttggtcagtgttgtgtccca

SEQ ID NO: 25407 - DNA, 25 bp, Rattus norvegicus
aacccttgtactaactcagtaatct

SEQ ID NO: 25408 - DNA, 25 bp, Rattus norvegicus
aacccttgtacttactcagtaatct

SEQ ID NO: 25409 - DNA, 25 bp, Rattus norvegicus
aacccttgtatgctctgtcatgaaa

SEQ ID NO: 25410 - DNA, 25 bp, Rattus norvegicus
aacccttgtatggtctgtcatgaaa

SEQ ID NO: 25411 - DNA, 25 bp, Rattus norvegicus
aacccttgtctaaaccttgtacata

SEQ ID NO: 25412 - DNA, 25 bp, Rattus norvegicus
aacccttgtctataccttgtacata

SEQ ID NO: 25413 - DNA, 25 bp, Rattus norvegicus
aacccttgttctatctgtggtagca

SEQ ID NO: 25414 - DNA, 25 bp, Rattus norvegicus
aacccttgttctttctgtggtagca

SEQ ID NO: 25415 - DNA, 25 bp, Rattus norvegicus
aaccctttagtaagtgaggcactct

SEQ ID NO: 25416 - DNA, 25 bp, Rattus norvegicus
aaccctttagtatgtgaggcactct

SEQ ID NO: 25417 - DNA, 25 bp, Rattus norvegicus
aaccctttcaaaaagaacgactctg

SEQ ID NO: 25418 - DNA, 25 bp, Rattus norvegicus
aaccctttcaaatagaacgactctg

SEQ ID NO: 25419 - DNA, 25 bp, Rattus norvegicus
aaccctttcaagattgcatttctgc

SEQ ID NO: 25420 - DNA, 25 bp, Rattus norvegicus
aaccctttcaagtttgcatttctgc

SEQ ID NO: 25421 - DNA, 25 bp, Rattus norvegicus
aaccctttcatgcaaatacgtcctt

SEQ ID NO: 25422 - DNA, 25 bp, Rattus norvegicus
aaccctttcatggaaatacgtcctt

SEQ ID NO: 25423 - DNA, 25 bp, Rattus norvegicus
aaccctttctccagtgatgcacaga

SEQ ID NO: 25424 - DNA, 25 bp, Rattus norvegicus
aaccctttctcctgtgatgcacaga

SEQ ID NO: 25425 - DNA, 25 bp, Rattus norvegicus
aaccctttctgtatcaggtcggagc

SEQ ID NO: 25426 - DNA, 25 bp, Rattus norvegicus
aaccctttctgtttcaggtcggagc

SEQ ID NO: 25427 - DNA, 25 bp, Rattus norvegicus
aaccctttcttcacggatgtatgca

SEQ ID NO: 25428 - DNA, 25 bp, Rattus norvegicus
aaccctttcttctcggatgtatgca

SEQ ID NO: 25429 - DNA, 25 bp, Rattus norvegicus
aaccctttgcggctctgtacacatt

SEQ ID NO: 25430 - DNA, 25 bp, Rattus norvegicus
aaccctttgcgggtctgtacacatt

SEQ ID NO: 25431 - DNA, 25 bp, Rattus norvegicus
aaccctttgcttattggatgaatct

SEQ ID NO: 25432 - DNA, 25 bp, Rattus norvegicus
aaccctttgcttcttataatgagtg

SEQ ID NO: 25433 - DNA, 25 bp, Rattus norvegicus
aaccctttgcttgttataatgagtg

SEQ ID NO: 25434 - DNA, 25 bp, Rattus norvegicus
aaccctttgctttttggatgaatct

SEQ ID NO: 25435 - DNA, 25 bp, Rattus norvegicus
aaccctttggagctgcctgtgagga

SEQ ID NO: 25436 - DNA, 25 bp, Rattus norvegicus
aaccctttggaggtgcctgtgagga

SEQ ID NO: 25437 - DNA, 25 bp, Rattus norvegicus
aaccctttggccatgtgatcataaa

SEQ ID NO: 25438 - DNA, 25 bp, Rattus norvegicus
aaccctttggccttgtgatcataaa

SEQ ID NO: 25439 - DNA, 25 bp, Rattus norvegicus
aaccctttgtctagatgtttctgat

SEQ ID NO: 25440 - DNA, 25 bp, Rattus norvegicus
aaccctttgtcttgatgtttctgat

SEQ ID NO: 25441 - DNA, 25 bp, Rattus norvegicus
aaccctttgtgcattctgtggatga

SEQ ID NO: 25442 - DNA, 25 bp, Rattus norvegicus
aaccctttgtgctttctgtggatga

SEQ ID NO: 25443 - DNA, 25 bp, Rattus norvegicus
aaccctttgttcacagactcagaag

SEQ ID NO: 25444 - DNA, 25 bp, Rattus norvegicus
aaccctttgttctcagactcagaag

SEQ ID NO: 25445 - DNA, 25 bp, Rattus norvegicus
aacccttttaatctgtcagtctgta

SEQ ID NO: 25446 - DNA, 25 bp, Rattus norvegicus
aacccttttaatgtgtcagtctgta

SEQ ID NO: 25447 - DNA, 25 bp, Rattus norvegicus
aacccttttcatctccactgttcat

SEQ ID NO: 25448 - DNA, 25 bp, Rattus norvegicus
aacccttttcatgtccactgttcat

SEQ ID NO: 25449 - DNA, 25 bp, Rattus norvegicus
aacccttttgtaaatgcaactctga

SEQ ID NO: 25450 - DNA, 25 bp, Rattus norvegicus
aacccttttgtatatgcaactctga

SEQ ID NO: 25451 - DNA, 25 bp, Rattus norvegicus
aaccgaaaacagctggccatgctct

SEQ ID NO: 25452 - DNA, 25 bp, Rattus norvegicus
aaccgaaaacaggtggccatgctct

SEQ ID NO: 25453 - DNA, 25 bp, Rattus norvegicus
aaccgaaatcgccaacctgctgaaa

SEQ ID NO: 25454 - DNA, 25 bp, Rattus norvegicus
aaccgaaatcgcgaacctgctgaaa

SEQ ID NO: 25455 - DNA, 25 bp, Rattus norvegicus
aaccgaacagctcgtgcctctctgt

SEQ ID NO: 25456 - DNA, 25 bp, Rattus norvegicus
aaccgaacagctggtgcctctctgt

SEQ ID NO: 25457 - DNA, 25 bp, Rattus norvegicus
aaccgaagcattacaattcacttga

SEQ ID NO: 25458 - DNA, 25 bp, Rattus norvegicus
aaccgaagcatttcaattcacttga

SEQ ID NO: 25459 - DNA, 25 bp, Rattus norvegicus
aaccgaagccgactgttcaggaaca

SEQ ID NO: 25460 - DNA, 25 bp, Rattus norvegicus
aaccgaagccgagtgttcaggaaca

SEQ ID NO: 25461 - DNA, 25 bp, Rattus norvegicus
aaccgaaggaggatgtattctactg

SEQ ID NO: 25462 - DNA, 25 bp, Rattus norvegicus
aaccgaaggaggttgtattctactg

SEQ ID NO: 25463 - DNA, 25 bp, Rattus norvegicus
aaccgaagtcggctatgctgacaca

SEQ ID NO: 25464 - DNA, 25 bp, Rattus norvegicus
aaccgaagtcgggtatgctgacaca

SEQ ID NO: 25465 - DNA, 25 bp, Rattus norvegicus
aaccgaatttcgcatcatcctttga

SEQ ID NO: 25466 - DNA, 25 bp, Rattus norvegicus
aaccgaatttcggatcatcctttga

SEQ ID NO: 25467 - DNA, 25 bp, Rattus norvegicus
aaccgaccttggacctctgcaagag

SEQ ID NO: 25468 - DNA, 25 bp, Rattus norvegicus
aaccgaccttggtcctctgcaagag

SEQ ID NO: 25469 - DNA, 25 bp, Rattus norvegicus
aaccgactcgctactgaggtgctgg

SEQ ID NO: 25470 - DNA, 25 bp, Rattus norvegicus
aaccgactcgcttctgaggtgctgg

SEQ ID NO: 25471 - DNA, 25 bp, Rattus norvegicus
aaccgactctgaaatactgttagtg

SEQ ID NO: 25472 - DNA, 25 bp, Rattus norvegicus
aaccgactctgatatactgttagtg

SEQ ID NO: 25473 - DNA, 25 bp, Rattus norvegicus
aaccgactgggtagactggagcgcc

SEQ ID NO: 25474 - DNA, 25 bp, Rattus norvegicus
aaccgactgggttgactggagcgcc

SEQ ID NO: 25475 - DNA, 25 bp, Rattus norvegicus
aaccgactggtgaccgatgtggact

SEQ ID NO: 25476 - DNA, 25 bp, Rattus norvegicus
aaccgactggtgtccgatgtggact

SEQ ID NO: 25477 - DNA, 25 bp, Rattus norvegicus
aaccgagaggttcatgctgtcttga

SEQ ID NO: 25478 - DNA, 25 bp, Rattus norvegicus
aaccgagaggttgatgctgtcttga

SEQ ID NO: 25479 - DNA, 25 bp, Rattus norvegicus
aaccgagcactgcagaacccagagg

SEQ ID NO: 25480 - DNA, 25 bp, Rattus norvegicus
aaccgagcactggagaacccagagg

SEQ ID NO: 25481 - DNA, 25 bp, Rattus norvegicus
aaccgagctgttcctgtatacccaa

SEQ ID NO: 25482 - DNA, 25 bp, Rattus norvegicus
aaccgagctgttctgtctattagag

SEQ ID NO: 25483 - DNA, 25 bp, Rattus norvegicus
aaccgagctgttgctgtatacccaa

SEQ ID NO: 25484 - DNA, 25 bp, Rattus norvegicus
aaccgagctgttgtgtctattagag

SEQ ID NO: 25485 - DNA, 25 bp, Rattus norvegicus
aaccgaggaacactcatagctgcaa

SEQ ID NO: 25486 - DNA, 25 bp, Rattus norvegicus
aaccgaggaacagtcatagctgcaa

SEQ ID NO: 25487 - DNA, 25 bp, Rattus norvegicus
aaccgaggcagacgcgtcgatagtc

SEQ ID NO: 25488 - DNA, 25 bp, Rattus norvegicus
aaccgaggcagaggcgtcgatagtc

SEQ ID NO: 25489 - DNA, 25 bp, Rattus norvegicus
aaccgaggtattatattctgcacgc

SEQ ID NO: 25490 - DNA, 25 bp, Rattus norvegicus
aaccgaggtattttattctgcacgc

SEQ ID NO: 25491 - DNA, 25 bp, Rattus norvegicus
aaccgagtgacaaaccagaggctga

SEQ ID NO: 25492 - DNA, 25 bp, Rattus norvegicus
aaccgagtgacataccagaggctga

SEQ ID NO: 25493 - DNA, 25 bp, Rattus norvegicus
aaccgagtgcgcagccgacgaccgg

SEQ ID NO: 25494 - DNA, 25 bp, Rattus norvegicus
aaccgagtgcgctgccgacgaccgg

SEQ ID NO: 25495 - DNA, 25 bp, Rattus norvegicus
aaccgagtgttcacatgcagctgaa

SEQ ID NO: 25496 - DNA, 25 bp, Rattus norvegicus
aaccgagtgttcatcaagttcctgc

SEQ ID NO: 25497 - DNA, 25 bp, Rattus norvegicus
aaccgagtgttctcatgcagctgaa

SEQ ID NO: 25498 - DNA, 25 bp, Rattus norvegicus
aaccgagtgttcttcaagttcctgc

SEQ ID NO: 25499 - DNA, 25 bp, Rattus norvegicus
aaccgatatcgtagacatctgcaaa

SEQ ID NO: 25500 - DNA, 25 bp, Rattus norvegicus
aaccgatatcgttgacatctgcaaa

SEQ ID NO: 25501 - DNA, 25 bp, Rattus norvegicus
aaccgatgcgccctttggatggatt

SEQ ID NO: 25502 - DNA, 25 bp, Rattus norvegicus
aaccgatgcgccgtttggatggatt

SEQ ID NO: 25503 - DNA, 25 bp, Rattus norvegicus
aaccgattcctaatcatacagattg

SEQ ID NO: 25504 - DNA, 25 bp, Rattus norvegicus
aaccgattcctattcatacagattg

SEQ ID NO: 25505 - DNA, 25 bp, Rattus norvegicus
aaccgattgcgtcaccttggctgat

SEQ ID NO: 25506 - DNA, 25 bp, Rattus norvegicus
aaccgattgcgtgaccttggctgat

SEQ ID NO: 25507 - DNA, 25 bp, Rattus norvegicus
aaccgcaagttcaaccagatgactg

SEQ ID NO: 25508 - DNA, 25 bp, Rattus norvegicus
aaccgcaagttctaccagatgactg

SEQ ID NO: 25509 - DNA, 25 bp, Rattus norvegicus
aaccgcacacccctgagttctgagt

SEQ ID NO: 25510 - DNA, 25 bp, Rattus norvegicus
aaccgcacacccgtgagttctgagt

SEQ ID NO: 25511 - DNA, 25 bp, Rattus norvegicus
aaccgcacagccagaatcatagaca

SEQ ID NO: 25512 - DNA, 25 bp, Rattus norvegicus
aaccgcacagcctgaatcatagaca

SEQ ID NO: 25513 - DNA, 25 bp, Rattus norvegicus
aaccgcaccatgaaggcatctgcat

SEQ ID NO: 25514 - DNA, 25 bp, Rattus norvegicus
aaccgcaccatgtaggcatctgcat

SEQ ID NO: 25515 - DNA, 25 bp, Rattus norvegicus
aaccgcactaggaggcttcagcgcg

SEQ ID NO: 25516 - DNA, 25 bp, Rattus norvegicus
aaccgcactaggtggcttcagcgcg

SEQ ID NO: 25517 - DNA, 25 bp, Rattus norvegicus
aaccgcagaggaaagccacgtacat

SEQ ID NO: 25518 - DNA, 25 bp, Rattus norvegicus
aaccgcagaggatagccacgtacat

SEQ ID NO: 25519 - DNA, 25 bp, Rattus norvegicus
aaccgcagcgatcacttacatgggc

SEQ ID NO: 25520 - DNA, 25 bp, Rattus norvegicus
aaccgcagcgatgacttacatgggc

SEQ ID NO: 25521 - DNA, 25 bp, Rattus norvegicus
aaccgcatattcatctctttagacg

SEQ ID NO: 25522 - DNA, 25 bp, Rattus norvegicus
aaccgcatattcttctctttagacg

SEQ ID NO: 25523 - DNA, 25 bp, Rattus norvegicus
aaccgcatcagtcatgcccagaaat

SEQ ID NO: 25524 - DNA, 25 bp, Rattus norvegicus
aaccgcatcagtgatgcccagaaat

SEQ ID NO: 25525 - DNA, 25 bp, Rattus norvegicus
aaccgcattggcatggtagtaccca

SEQ ID NO: 25526 - DNA, 25 bp, Rattus norvegicus
aaccgcattggcttggtagtaccca

SEQ ID NO: 25527 - DNA, 25 bp, Rattus norvegicus
aaccgccaagtccaattcattctct

SEQ ID NO: 25528 - DNA, 25 bp, Rattus norvegicus
aaccgccaagtcgaattcattctct

SEQ ID NO: 25529 - DNA, 25 bp, Rattus norvegicus
aaccgcccacttactgatgaggaat

SEQ ID NO: 25530 - DNA, 25 bp, Rattus norvegicus
aaccgcccactttctgatgaggaat

SEQ ID NO: 25531 - DNA, 25 bp, Rattus norvegicus
aaccgcccatcacttgttcttggaa

SEQ ID NO: 25532 - DNA, 25 bp, Rattus norvegicus
aaccgcccatcagttgttcttggaa

SEQ ID NO: 25533 - DNA, 25 bp, Rattus norvegicus
aaccgccctggcagtgagatgtgta

SEQ ID NO: 25534 - DNA, 25 bp, Rattus norvegicus
aaccgccctggctgtgagatgtgta

SEQ ID NO: 25535 - DNA, 25 bp, Rattus norvegicus
aaccgccctgttctggatattttgt

SEQ ID NO: 25536 - DNA, 25 bp, Rattus norvegicus
aaccgccctgttgtggatattttgt

SEQ ID NO: 25537 - DNA, 25 bp, Rattus norvegicus
aaccgcccttgaattacacttcttg

SEQ ID NO: 25538 - DNA, 25 bp, Rattus norvegicus
aaccgcccttgatttacacttcttg

SEQ ID NO: 25539 - DNA, 25 bp, Rattus norvegicus
aaccgcctatcaatgctttctaaag

SEQ ID NO: 25540 - DNA, 25 bp, Rattus norvegicus
aaccgcctatcattgctttctaaag

SEQ ID NO: 25541 - DNA, 25 bp, Rattus norvegicus
aaccgcctctgtaagctgggttatt

SEQ ID NO: 25542 - DNA, 25 bp, Rattus norvegicus
aaccgcctctgttagctgggttatt

SEQ ID NO: 25543 - DNA, 25 bp, Rattus norvegicus
aaccgcctcttgctggtggaacgag

SEQ ID NO: 25544 - DNA, 25 bp, Rattus norvegicus
aaccgcctcttggtggtggaacgag

SEQ ID NO: 25545 - DNA, 25 bp, Rattus norvegicus
aaccgcctgcggcacaacaagggca

SEQ ID NO: 25546 - DNA, 25 bp, Rattus norvegicus
aaccgcctgcgggacaacaagggca

SEQ ID NO: 25547 - DNA, 25 bp, Rattus norvegicus
aaccgccttctcagacaaatgcaag

SEQ ID NO: 25548 - DNA, 25 bp, Rattus norvegicus
aaccgccttctctgacaaatgcaag

SEQ ID NO: 25549 - DNA, 25 bp, Rattus norvegicus
aaccgcgaagctactgagatgggat

SEQ ID NO: 25550 - DNA, 25 bp, Rattus norvegicus
aaccgcgaagcttctgagatgggat

SEQ ID NO: 25551 - DNA, 25 bp, Rattus norvegicus
aaccgcgagcctccagccatgggat

SEQ ID NO: 25552 - DNA, 25 bp, Rattus norvegicus
aaccgcgagcctgcagccatgggat

SEQ ID NO: 25553 - DNA, 25 bp, Rattus norvegicus
aaccgcggagcgaattcgaagagat

SEQ ID NO: 25554 - DNA, 25 bp, Rattus norvegicus
aaccgcggagcgtattcgaagagat

SEQ ID NO: 25555 - DNA, 25 bp, Rattus norvegicus
aaccgcgtggttagctgcttttcta

SEQ ID NO: 25556 - DNA, 25 bp, Rattus norvegicus
aaccgcgtggtttgctgcttttcta

SEQ ID NO: 25557 - DNA, 25 bp, Rattus norvegicus
aaccgcgttgtacaatacccttgct

SEQ ID NO: 25558 - DNA, 25 bp, Rattus norvegicus
aaccgcgttgtagaatacccttgct

SEQ ID NO: 25559 - DNA, 25 bp, Rattus norvegicus
aaccgctaaaaaccgcacctgtgag

SEQ ID NO: 25560 - DNA, 25 bp, Rattus norvegicus
aaccgctaaaaagcgcacctgtgag

SEQ ID NO: 25561 - DNA, 25 bp, Rattus norvegicus
aaccgctaattactcagtgctagaa

SEQ ID NO: 25562 - DNA, 25 bp, Rattus norvegicus
aaccgctaattagtcagtgctagaa

SEQ ID NO: 25563 - DNA, 25 bp, Rattus norvegicus
aaccgctacctcctcaagagtggag

SEQ ID NO: 25564 - DNA, 25 bp, Rattus norvegicus
aaccgctacctcgtcaagagtggag

SEQ ID NO: 25565 - DNA, 25 bp, Rattus norvegicus
aaccgctactggctctgtgctgcca

SEQ ID NO: 25566 - DNA, 25 bp, Rattus norvegicus
aaccgctactgggtctgtgctgcca

SEQ ID NO: 25567 - DNA, 25 bp, Rattus norvegicus
aaccgctccgggagccggtgacact

SEQ ID NO: 25568 - DNA, 25 bp, Rattus norvegicus
aaccgctccgggtgccggtgacact

SEQ ID NO: 25569 - DNA, 25 bp, Rattus norvegicus
aaccgctctcctaaaaagttggctg

SEQ ID NO: 25570 - DNA, 25 bp, Rattus norvegicus
aaccgctctccttaaaagttggctg

SEQ ID NO: 25571 - DNA, 25 bp, Rattus norvegicus
aaccgctctgggactgaaggagaat

SEQ ID NO: 25572 - DNA, 25 bp, Rattus norvegicus
aaccgctctgggtctgaaggagaat

SEQ ID NO: 25573 - DNA, 25 bp, Rattus norvegicus
aaccgctgaccaagtgttctgctag

SEQ ID NO: 25574 - DNA, 25 bp, Rattus norvegicus
aaccgctgaccatgtgttctgctag

SEQ ID NO: 25575 - DNA, 25 bp, Rattus norvegicus
aaccgctgagatattacctgacttt

SEQ ID NO: 25576 - DNA, 25 bp, Rattus norvegicus
aaccgctgagattttacctgacttt

SEQ ID NO: 25577 - DNA, 25 bp, Rattus norvegicus
aaccgctgagcacagtgacctcaca

SEQ ID NO: 25578 - DNA, 25 bp, Rattus norvegicus
aaccgctgagcagagtgacctcaca

SEQ ID NO: 25579 - DNA, 25 bp, Rattus norvegicus
aaccgctgatgacggaaactgtatt

SEQ ID NO: 25580 - DNA, 25 bp, Rattus norvegicus
aaccgctgatgagggaaactgtatt

SEQ ID NO: 25581 - DNA, 25 bp, Rattus norvegicus
aaccgctgctcactgctgatatgtt

SEQ ID NO: 25582 - DNA, 25 bp, Rattus norvegicus
aaccgctgctcagtgctgatatgtt

SEQ ID NO: 25583 - DNA, 25 bp, Rattus norvegicus
aaccgctggtatcgctttcttgaag

SEQ ID NO: 25584 - DNA, 25 bp, Rattus norvegicus
aaccgctggtatggctttcttgaag

SEQ ID NO: 25585 - DNA, 25 bp, Rattus norvegicus
aaccgcttctttctggacgatggag

SEQ ID NO: 25586 - DNA, 25 bp, Rattus norvegicus
aaccgcttctttgtggacgatggag

SEQ ID NO: 25587 - DNA, 25 bp, Rattus norvegicus
aaccgcttgccaaagctgctgggaa

SEQ ID NO: 25588 - DNA, 25 bp, Rattus norvegicus
aaccgcttgccatagctgctgggaa

SEQ ID NO: 25589 - DNA, 25 bp, Rattus norvegicus
aaccgcttggccagacggagttatc

SEQ ID NO: 25590 - DNA, 25 bp, Rattus norvegicus
aaccgcttggcctgacggagttatc

SEQ ID NO: 25591 - DNA, 25 bp, Rattus norvegicus
aaccgcttggcgattggtgtcctgt

SEQ ID NO: 25592 - DNA, 25 bp, Rattus norvegicus
aaccgcttggcgtttggtgtcctgt

SEQ ID NO: 25593 - DNA, 25 bp, Rattus norvegicus
aaccggaacacaagaggccagcgca

SEQ ID NO: 25594 - DNA, 25 bp, Rattus norvegicus
aaccggaacacatgaggccagcgca

SEQ ID NO: 25595 - DNA, 25 bp, Rattus norvegicus
aaccggaagatgaaagcaggctgaa

SEQ ID NO: 25596 - DNA, 25 bp, Rattus norvegicus
aaccggaagatgtaagcaggctgaa

SEQ ID NO: 25597 - DNA, 25 bp, Rattus norvegicus
aaccggaaggaccattgctctgccc

SEQ ID NO: 25598 - DNA, 25 bp, Rattus norvegicus
aaccggaaggacgattgctctgccc

SEQ ID NO: 25599 - DNA, 25 bp, Rattus norvegicus
aaccggaagtgtctcagcgtgcaga

SEQ ID NO: 25600 - DNA, 25 bp, Rattus norvegicus
aaccggaagtgtgtcagcgtgcaga

SEQ ID NO: 25601 - DNA, 25 bp, Rattus norvegicus
aaccggacaagacgtaggagtcatc

SEQ ID NO: 25602 - DNA, 25 bp, Rattus norvegicus
aaccggacaagaggtaggagtcatc

SEQ ID NO: 25603 - DNA, 25 bp, Rattus norvegicus
aaccggaccagacacagcaccatag

SEQ ID NO: 25604 - DNA, 25 bp, Rattus norvegicus
aaccggaccagagacagcaccatag

SEQ ID NO: 25605 - DNA, 25 bp, Rattus norvegicus
aaccggagcacgacatctctcaggg

SEQ ID NO: 25606 - DNA, 25 bp, Rattus norvegicus
aaccggagcacgtcatctctcaggg

SEQ ID NO: 25607 - DNA, 25 bp, Rattus norvegicus
aaccggagcccgatgcagtaggact

SEQ ID NO: 25608 - DNA, 25 bp, Rattus norvegicus
aaccggagcccgttgcagtaggact

SEQ ID NO: 25609 - DNA, 25 bp, Rattus norvegicus
aaccggagcctaagtgggattccct

SEQ ID NO: 25610 - DNA, 25 bp, Rattus norvegicus
aaccggagcctatgtgggattccct

SEQ ID NO: 25611 - DNA, 25 bp, Rattus norvegicus
aaccggagcggacctgtggctcgga

SEQ ID NO: 25612 - DNA, 25 bp, Rattus norvegicus
aaccggagcggagctgtggctcgga

SEQ ID NO: 25613 - DNA, 25 bp, Rattus norvegicus
aaccggagcgtgacggcgctgaatc

SEQ ID NO: 25614 - DNA, 25 bp, Rattus norvegicus
aaccggagcgtgtcggcgctgaatc

SEQ ID NO: 25615 - DNA, 25 bp, Rattus norvegicus
aaccggagctacacgagagaccctg

SEQ ID NO: 25616 - DNA, 25 bp, Rattus norvegicus
aaccggagctactcgagagaccctg

SEQ ID NO: 25617 - DNA, 25 bp, Rattus norvegicus
aaccggaggcggatcttcgcaatgc

SEQ ID NO: 25618 - DNA, 25 bp, Rattus norvegicus
aaccggaggcggttcttcgcaatgc

SEQ ID NO: 25619 - DNA, 25 bp, Rattus norvegicus
aaccggagtccccagagtactggcg

SEQ ID NO: 25620 - DNA, 25 bp, Rattus norvegicus
aaccggagtcccgagagtactggcg

SEQ ID NO: 25621 - DNA, 25 bp, Rattus norvegicus
aaccggatgggcatttgcagcattg

SEQ ID NO: 25622 - DNA, 25 bp, Rattus norvegicus
aaccggatgggcttttgcagcattg

SEQ ID NO: 25623 - DNA, 25 bp, Rattus norvegicus
aaccggatgtttcgtcctgccagag

SEQ ID NO: 25624 - DNA, 25 bp, Rattus norvegicus
aaccggatgtttggtcctgccagag

SEQ ID NO: 25625 - DNA, 25 bp, Rattus norvegicus
aaccggattcctatattctggctgc

SEQ ID NO: 25626 - DNA, 25 bp, Rattus norvegicus
aaccggattcctttattctggctgc

SEQ ID NO: 25627 - DNA, 25 bp, Rattus norvegicus
aaccggcaccaacagctgcctggga

SEQ ID NO: 25628 - DNA, 25 bp, Rattus norvegicus
aaccggcaccaagagctgcctggga

SEQ ID NO: 25629 - DNA, 25 bp, Rattus norvegicus
aaccggcaccttaactcagtagatg

SEQ ID NO: 25630 - DNA, 25 bp, Rattus norvegicus
aaccggcacctttactcagtagatg

SEQ ID NO: 25631 - DNA, 25 bp, Rattus norvegicus
aaccggcagacgcacctgctgcagg

SEQ ID NO: 25632 - DNA, 25 bp, Rattus norvegicus
aaccggcagacggacctgctgcagg

SEQ ID NO: 25633 - DNA, 25 bp, Rattus norvegicus
aaccggcagggcctagtcatggtca

SEQ ID NO: 25634 - DNA, 25 bp, Rattus norvegicus
aaccggcagggcgtagtcatggtca

SEQ ID NO: 25635 - DNA, 25 bp, Rattus norvegicus
aaccggcatggaaaagtctggctca

SEQ ID NO: 25636 - DNA, 25 bp, Rattus norvegicus
aaccggcatggataagtctggctca

SEQ ID NO: 25637 - DNA, 25 bp, Rattus norvegicus
aaccggcccttcatggtgatattgt

SEQ ID NO: 25638 - DNA, 25 bp, Rattus norvegicus
aaccggcccttcttggtgatattgt

SEQ ID NO: 25639 - DNA, 25 bp, Rattus norvegicus
aaccggcttatgcatccagagtcct

SEQ ID NO: 25640 - DNA, 25 bp, Rattus norvegicus
aaccggcttatggatccagagtcct

SEQ ID NO: 25641 - DNA, 25 bp, Rattus norvegicus
aaccggctttatctccattttactg

SEQ ID NO: 25642 - DNA, 25 bp, Rattus norvegicus
aaccggctttatgtccattttactg

SEQ ID NO: 25643 - DNA, 25 bp, Rattus norvegicus
aaccgggagctgagggactgtttca

SEQ ID NO: 25644 - DNA, 25 bp, Rattus norvegicus
aaccgggagctgtgggactgtttca

SEQ ID NO: 25645 - DNA, 25 bp, Rattus norvegicus
aaccgggcaataatgtgttcagttc

SEQ ID NO: 25646 - DNA, 25 bp, Rattus norvegicus
aaccgggcaatattgtgttcagttc

SEQ ID NO: 25647 - DNA, 25 bp, Rattus norvegicus
aaccgggccaccaagtgtgccgagg

SEQ ID NO: 25648 - DNA, 25 bp, Rattus norvegicus
aaccgggccacctagtgtgccgagg

SEQ ID NO: 25649 - DNA, 25 bp, Rattus norvegicus
aaccgggcgcccaggcattcagagt

SEQ ID NO: 25650 - DNA, 25 bp, Rattus norvegicus
aaccgggcgccctggcattcagagt

SEQ ID NO: 25651 - DNA, 25 bp, Rattus norvegicus
aaccgggctgcacagtcttttgaca

SEQ ID NO: 25652 - DNA, 25 bp, Rattus norvegicus
aaccgggctgcagagtcttttgaca

SEQ ID NO: 25653 - DNA, 25 bp, Rattus norvegicus
aaccgggtcaccattgttgatgtgt

SEQ ID NO: 25654 - DNA, 25 bp, Rattus norvegicus
aaccgggtcacctttgttgatgtgt

SEQ ID NO: 25655 - DNA, 25 bp, Rattus norvegicus
aaccgggtcatcaacttctatgcag

SEQ ID NO: 25656 - DNA, 25 bp, Rattus norvegicus
aaccgggtcatctacttctatgcag

SEQ ID NO: 25657 - DNA, 25 bp, Rattus norvegicus
aaccgggtgactatactctgtgaca

SEQ ID NO: 25658 - DNA, 25 bp, Rattus norvegicus
aaccgggtgactttactctgtgaca

SEQ ID NO: 25659 - DNA, 25 bp, Rattus norvegicus
aaccgggtgattcgactctcgagtg

SEQ ID NO: 25660 - DNA, 25 bp, Rattus norvegicus
aaccgggtgattggactctcgagtg

SEQ ID NO: 25661 - DNA, 25 bp, Rattus norvegicus
aaccggtaccaccaggacatctttg

SEQ ID NO: 25662 - DNA, 25 bp, Rattus norvegicus
aaccggtaccacgaggacatctttg

SEQ ID NO: 25663 - DNA, 25 bp, Rattus norvegicus
aaccggtgaccgagactgggcatgt

SEQ ID NO: 25664 - DNA, 25 bp, Rattus norvegicus
aaccggtgaccgtgactgggcatgt

SEQ ID NO: 25665 - DNA, 25 bp, Rattus norvegicus
aaccggttaatcaatcgtggcctcg

SEQ ID NO: 25666 - DNA, 25 bp, Rattus norvegicus
aaccggttaatctatcgtggcctcg

SEQ ID NO: 25667 - DNA, 25 bp, Rattus norvegicus
aaccggttcatcacagtgggtccag

SEQ ID NO: 25668 - DNA, 25 bp, Rattus norvegicus
aaccggttcatctcagtgggtccag

SEQ ID NO: 25669 - DNA, 25 bp, Rattus norvegicus
aaccggttccttactcagcatagaa

SEQ ID NO: 25670 - DNA, 25 bp, Rattus norvegicus
aaccggttcctttctcagcatagaa

SEQ ID NO: 25671 - DNA, 25 bp, Rattus norvegicus
aaccgtacagctacaggtgacctga

SEQ ID NO: 25672 - DNA, 25 bp, Rattus norvegicus
aaccgtacagcttcaggtgacctga

SEQ ID NO: 25673 - DNA, 25 bp, Rattus norvegicus
aaccgtacatggcagtgagattcat

SEQ ID NO: 25674 - DNA, 25 bp, Rattus norvegicus
aaccgtacatgggagtgagattcat

SEQ ID NO: 25675 - DNA, 25 bp, Rattus norvegicus
aaccgtaccccacttctagcatgga

SEQ ID NO: 25676 - DNA, 25 bp, Rattus norvegicus
aaccgtaccccagttctagcatgga

SEQ ID NO: 25677 - DNA, 25 bp, Rattus norvegicus
aaccgtacctcaacgatgcagtatt

SEQ ID NO: 25678 - DNA, 25 bp, Rattus norvegicus
aaccgtacctcatcgatgcagtatt

SEQ ID NO: 25679 - DNA, 25 bp, Rattus norvegicus
aaccgtagagtcacatcagctgctg

SEQ ID NO: 25680 - DNA, 25 bp, Rattus norvegicus
aaccgtagagtctcatcagctgctg

SEQ ID NO: 25681 - DNA, 25 bp, Rattus norvegicus
aaccgtatccggaagcaggattctc

SEQ ID NO: 25682 - DNA, 25 bp, Rattus norvegicus
aaccgtatccggtagcaggattctc

SEQ ID NO: 25683 - DNA, 25 bp, Rattus norvegicus
aaccgtatggaaatgtgatctaagc

SEQ ID NO: 25684 - DNA, 25 bp, Rattus norvegicus
aaccgtatggaattgtgatctaagc

SEQ ID NO: 25685 - DNA, 25 bp, Rattus norvegicus
aaccgtattcacattttcttctgaa

SEQ ID NO: 25686 - DNA, 25 bp, Rattus norvegicus
aaccgtattcactttttcttctgaa

SEQ ID NO: 25687 - DNA, 25 bp, Rattus norvegicus
aaccgtattgtacaaatgaatctgt

SEQ ID NO: 25688 - DNA, 25 bp, Rattus norvegicus
aaccgtattgtagaaatgaatctgt

SEQ ID NO: 25689 - DNA, 25 bp, Rattus norvegicus
aaccgtcatggaccccgattgtcta

SEQ ID NO: 25690 - DNA, 25 bp, Rattus norvegicus
aaccgtcatggagcccgattgtcta

SEQ ID NO: 25691 - DNA, 25 bp, Rattus norvegicus
aaccgtccagcccaagatcaaagga

SEQ ID NO: 25692 - DNA, 25 bp, Rattus norvegicus
aaccgtccagccgaagatcaaagga

SEQ ID NO: 25693 - DNA, 25 bp, Rattus norvegicus
aaccgtcccagccattggtaatgta

SEQ ID NO: 25694 - DNA, 25 bp, Rattus norvegicus
aaccgtcccagcgattggtaatgta

SEQ ID NO: 25695 - DNA, 25 bp, Rattus norvegicus
aaccgtccctgtcgaaagtgacaca

SEQ ID NO: 25696 - DNA, 25 bp, Rattus norvegicus
aaccgtccctgtggaaagtgacaca

SEQ ID NO: 25697 - DNA, 25 bp, Rattus norvegicus
aaccgtccgtcgacttgtctgtctg

SEQ ID NO: 25698 - DNA, 25 bp, Rattus norvegicus
aaccgtccgtcgtcttgtctgtctg

SEQ ID NO: 25699 - DNA, 25 bp, Rattus norvegicus
aaccgtccttgtagttaactgagag

SEQ ID NO: 25700 - DNA, 25 bp, Rattus norvegicus
aaccgtccttgttgttaactgagag

SEQ ID NO: 25701 - DNA, 25 bp, Rattus norvegicus
aaccgtcgaggaagtctgctcaaaa

SEQ ID NO: 25702 - DNA, 25 bp, Rattus norvegicus
aaccgtcgaggatgtctgctcaaaa

SEQ ID NO: 25703 - DNA, 25 bp, Rattus norvegicus
aaccgtgaacgccaaggacactcga

SEQ ID NO: 25704 - DNA, 25 bp, Rattus norvegicus
aaccgtgaacgcgaaggacactcga

SEQ ID NO: 25705 - DNA, 25 bp, Rattus norvegicus
aaccgtgactgaacttactcttttt

SEQ ID NO: 25706 - DNA, 25 bp, Rattus norvegicus
aaccgtgactgatcttactcttttt

SEQ ID NO: 25707 - DNA, 25 bp, Rattus norvegicus
aaccgtgagcagaaaggtctcgcct

SEQ ID NO: 25708 - DNA, 25 bp, Rattus norvegicus
aaccgtgagcagtaaggtctcgcct

SEQ ID NO: 25709 - DNA, 25 bp, Rattus norvegicus
aaccgtgagccacgtcagacatctt

SEQ ID NO: 25710 - DNA, 25 bp, Rattus norvegicus
aaccgtgagccaggtcagacatctt

SEQ ID NO: 25711 - DNA, 25 bp, Rattus norvegicus
aaccgtgaggctaatctagctgcta

SEQ ID NO: 25712 - DNA, 25 bp, Rattus norvegicus
aaccgtgaggcttatctagctgcta

SEQ ID NO: 25713 - DNA, 25 bp, Rattus norvegicus
aaccgtgcagcgaattctggcaaca

SEQ ID NO: 25714 - DNA, 25 bp, Rattus norvegicus
aaccgtgcagcgtattctggcaaca

SEQ ID NO: 25715 - DNA, 25 bp, Rattus norvegicus
aaccgtgcatgtaaaggcgccagtc

SEQ ID NO: 25716 - DNA, 25 bp, Rattus norvegicus
aaccgtgcatgttaaggcgccagtc

SEQ ID NO: 25717 - DNA, 25 bp, Rattus norvegicus
aaccgtgccaaaaatcctacatagt

SEQ ID NO: 25718 - DNA, 25 bp, Rattus norvegicus
aaccgtgccaaatatcctacatagt

SEQ ID NO: 25719 - DNA, 25 bp, Rattus norvegicus
aaccgtgctcccatgtggtgtagag

SEQ ID NO: 25720 - DNA, 25 bp, Rattus norvegicus
aaccgtgctcccttgtggtgtagag

SEQ ID NO: 25721 - DNA, 25 bp, Rattus norvegicus
aaccgtgctcctacgggagagtaat

SEQ ID NO: 25722 - DNA, 25 bp, Rattus norvegicus
aaccgtgctccttcgggagagtaat

SEQ ID NO: 25723 - DNA, 25 bp, Rattus norvegicus
aaccgtgctctcaaatttatcggca

SEQ ID NO: 25724 - DNA, 25 bp, Rattus norvegicus
aaccgtgctctctaatttatcggca

SEQ ID NO: 25725 - DNA, 25 bp, Rattus norvegicus
aaccgtggaccaaaggaactatgca

SEQ ID NO: 25726 - DNA, 25 bp, Rattus norvegicus
aaccgtggaccataggaactatgca

SEQ ID NO: 25727 - DNA, 25 bp, Rattus norvegicus
aaccgtggagatcttgccgtccaga

SEQ ID NO: 25728 - DNA, 25 bp, Rattus norvegicus
aaccgtggagatgttgccgtccaga

SEQ ID NO: 25729 - DNA, 25 bp, Rattus norvegicus
aaccgtggatcgagacgactcgaaa

SEQ ID NO: 25730 - DNA, 25 bp, Rattus norvegicus
aaccgtggatcgtgacgactcgaaa

SEQ ID NO: 25731 - DNA, 25 bp, Rattus norvegicus
aaccgtggctcacaggcccaagaat

SEQ ID NO: 25732 - DNA, 25 bp, Rattus norvegicus
aaccgtggctcagaggcccaagaat

SEQ ID NO: 25733 - DNA, 25 bp, Rattus norvegicus
aaccgtggctgcctaaggccagtta

SEQ ID NO: 25734 - DNA, 25 bp, Rattus norvegicus
aaccgtggctgcgtaaggccagtta

SEQ ID NO: 25735 - DNA, 25 bp, Rattus norvegicus
aaccgtggctggagtctgtagttgt

SEQ ID NO: 25736 - DNA, 25 bp, Rattus norvegicus
aaccgtggctggtgtctgtagttgt

SEQ ID NO: 25737 - DNA, 25 bp, Rattus norvegicus
aaccgtgggtggcttccgcatatat

SEQ ID NO: 25738 - DNA, 25 bp, Rattus norvegicus
aaccgtgggtgggttccgcatatat

SEQ ID NO: 25739 - DNA, 25 bp, Rattus norvegicus
aaccgtgtactgctgggaaagcctc

SEQ ID NO: 25740 - DNA, 25 bp, Rattus norvegicus
aaccgtgtactggtgggaaagcctc

SEQ ID NO: 25741 - DNA, 25 bp, Rattus norvegicus
aaccgtgtggtcagagatggcagca

SEQ ID NO: 25742 - DNA, 25 bp, Rattus norvegicus
aaccgtgtggtctgagatggcagca

SEQ ID NO: 25743 - DNA, 25 bp, Rattus norvegicus
aaccgtgtgttgactgagcaggtca

SEQ ID NO: 25744 - DNA, 25 bp, Rattus norvegicus
aaccgtgtgttgtctgagcaggtca

SEQ ID NO: 25745 - DNA, 25 bp, Rattus norvegicus
aaccgttagcagcacaagaacgcaa

SEQ ID NO: 25746 - DNA, 25 bp, Rattus norvegicus
aaccgttagcaggacaagaacgcaa

SEQ ID NO: 25747 - DNA, 25 bp, Rattus norvegicus
aaccgttcgaagatgcatcgtttgc

SEQ ID NO: 25748 - DNA, 25 bp, Rattus norvegicus
aaccgttcgaagttgcatcgtttgc

SEQ ID NO: 25749 - DNA, 25 bp, Rattus norvegicus
aaccgttgagctctagttagaatac

SEQ ID NO: 25750 - DNA, 25 bp, Rattus norvegicus
aaccgttgagctgtagttagaatac

SEQ ID NO: 25751 - DNA, 25 bp, Rattus norvegicus
aaccgttgtgaaatgcaagctgctg

SEQ ID NO: 25752 - DNA, 25 bp, Rattus norvegicus
aaccgttgtgaattgcaagctgctg

SEQ ID NO: 25753 - DNA, 25 bp, Rattus norvegicus
aaccgttgtgttagctatttttcat

SEQ ID NO: 25754 - DNA, 25 bp, Rattus norvegicus
aaccgttgtgtttgctatttttcat

SEQ ID NO: 25755 - DNA, 25 bp, Rattus norvegicus
aaccgttttgttaagcgatgccagt

SEQ ID NO: 25756 - DNA, 25 bp, Rattus norvegicus
aaccgttttgtttagcgatgccagt

SEQ ID NO: 25757 - DNA, 25 bp, Rattus norvegicus
aaccgttttttcacatgcagctatg

SEQ ID NO: 25758 - DNA, 25 bp, Rattus norvegicus
aaccgttttttctcatgcagctatg

SEQ ID NO: 25759 - DNA, 25 bp, Rattus norvegicus
aacctaaagtgtagttgtctgccct

SEQ ID NO: 25760 - DNA, 25 bp, Rattus norvegicus
aacctaaagtgttgttgtctgccct

SEQ ID NO: 25761 - DNA, 25 bp, Rattus norvegicus
aacctaaatggccaatgcatgtgca

SEQ ID NO: 25762 - DNA, 25 bp, Rattus norvegicus
aacctaaatggcgaatgcatgtgca

SEQ ID NO: 25763 - DNA, 25 bp, Rattus norvegicus
aacctaacctctccagctggtacaa

SEQ ID NO: 25764 - DNA, 25 bp, Rattus norvegicus
aacctaacctctgcagctggtacaa

SEQ ID NO: 25765 - DNA, 25 bp, Rattus norvegicus
aacctaactatgagtctttggacaa

SEQ ID NO: 25766 - DNA, 25 bp, Rattus norvegicus
aacctaactatgtgtctttggacaa

SEQ ID NO: 25767 - DNA, 25 bp, Rattus norvegicus
aacctaagctgtcttctcctgagtg

SEQ ID NO: 25768 - DNA, 25 bp, Rattus norvegicus
aacctaagctgtgttctcctgagtg

SEQ ID NO: 25769 - DNA, 25 bp, Rattus norvegicus
aacctaaggaccatgtgaccagtga

SEQ ID NO: 25770 - DNA, 25 bp, Rattus norvegicus
aacctaaggaccttgtgaccagtga

SEQ ID NO: 25771 - DNA, 25 bp, Rattus norvegicus
aacctaaggagtcggtagcaccaga

SEQ ID NO: 25772 - DNA, 25 bp, Rattus norvegicus
aacctaaggagtgggtagcaccaga

SEQ ID NO: 25773 - DNA, 25 bp, Rattus norvegicus
aacctaattcttcgcttcacacatg

SEQ ID NO: 25774 - DNA, 25 bp, Rattus norvegicus
aacctaattcttggcttcacacatg

SEQ ID NO: 25775 - DNA, 25 bp, Rattus norvegicus
aacctacaggtcagactgactttcg

SEQ ID NO: 25776 - DNA, 25 bp, Rattus norvegicus
aacctacaggtctgactgactttcg

SEQ ID NO: 25777 - DNA, 25 bp, Rattus norvegicus
aacctacagtccatccctgaagaag

SEQ ID NO: 25778 - DNA, 25 bp, Rattus norvegicus
aacctacagtccttccctgaagaag

SEQ ID NO: 25779 - DNA, 25 bp, Rattus norvegicus
aacctacataggcttggcattccca

SEQ ID NO: 25780 - DNA, 25 bp, Rattus norvegicus
aacctacatagggttggcattccca

SEQ ID NO: 25781 - DNA, 25 bp, Rattus norvegicus
aacctacccgatacaatttgccaag

SEQ ID NO: 25782 - DNA, 25 bp, Rattus norvegicus
aacctacccgattcaatttgccaag

SEQ ID NO: 25783 - DNA, 25 bp, Rattus norvegicus
aacctaccctcacctgtatgtgaga

SEQ ID NO: 25784 - DNA, 25 bp, Rattus norvegicus
aacctaccctcagctgtatgtgaga

SEQ ID NO: 25785 - DNA, 25 bp, Rattus norvegicus
aacctaccctgcaaagtccatagta

SEQ ID NO: 25786 - DNA, 25 bp, Rattus norvegicus
aacctaccctgctaagtccatagta

SEQ ID NO: 25787 - DNA, 25 bp, Rattus norvegicus
aacctacgaagaagcatgggcagtg

SEQ ID NO: 25788 - DNA, 25 bp, Rattus norvegicus
aacctacgaagatgcatgggcagtg

SEQ ID NO: 25789 - DNA, 25 bp, Rattus norvegicus
aacctactgcagaaccaacaggagg

SEQ ID NO: 25790 - DNA, 25 bp, Rattus norvegicus
aacctactgcagtaccaacaggagg

SEQ ID NO: 25791 - DNA, 25 bp, Rattus norvegicus
aacctactgctgacggacaagatga

SEQ ID NO: 25792 - DNA, 25 bp, Rattus norvegicus
aacctactgctgtcggacaagatga

SEQ ID NO: 25793 - DNA, 25 bp, Rattus norvegicus
aacctactgggaacaagtactcaga

SEQ ID NO: 25794 - DNA, 25 bp, Rattus norvegicus
aacctactgggatcaagtactcaga

SEQ ID NO: 25795 - DNA, 25 bp, Rattus norvegicus
aacctactggttcaccttctgaagt

SEQ ID NO: 25796 - DNA, 25 bp, Rattus norvegicus
aacctactggttgaccttctgaagt

SEQ ID NO: 25797 - DNA, 25 bp, Rattus norvegicus
aacctagaagccacacattagagaa

SEQ ID NO: 25798 - DNA, 25 bp, Rattus norvegicus
aacctagaagcctcacattagagaa

SEQ ID NO: 25799 - DNA, 25 bp, Rattus norvegicus
aacctagactatccaaacactggaa

SEQ ID NO: 25800 - DNA, 25 bp, Rattus norvegicus
aacctagactatgcaaacactggaa

SEQ ID NO: 25801 - DNA, 25 bp, Rattus norvegicus
aacctagaggtaatggccacgtcac

SEQ ID NO: 25802 - DNA, 25 bp, Rattus norvegicus
aacctagaggtattggccacgtcac

SEQ ID NO: 25803 - DNA, 25 bp, Rattus norvegicus
aacctagcatctcaggatcccacag

SEQ ID NO: 25804 - DNA, 25 bp, Rattus norvegicus
aacctagcatctgaggatcccacag

SEQ ID NO: 25805 - DNA, 25 bp, Rattus norvegicus
aacctagcctcgatgtcctttgaaa

SEQ ID NO: 25806 - DNA, 25 bp, Rattus norvegicus
aacctagcctcgttgtcctttgaaa

SEQ ID NO: 25807 - DNA, 25 bp, Rattus norvegicus
aacctagcgtttcctccaagcagat

SEQ ID NO: 25808 - DNA, 25 bp, Rattus norvegicus
aacctagcgtttgctccaagcagat

SEQ ID NO: 25809 - DNA, 25 bp, Rattus norvegicus
aacctagcttaactagactctgcag

SEQ ID NO: 25810 - DNA, 25 bp, Rattus norvegicus
aacctagcttaagtagactctgcag

SEQ ID NO: 25811 - DNA, 25 bp, Rattus norvegicus
aacctagcttatctacccaggtcga

SEQ ID NO: 25812 - DNA, 25 bp, Rattus norvegicus
aacctagcttatgtacccaggtcga

SEQ ID NO: 25813 - DNA, 25 bp, Rattus norvegicus
aacctaggaagacagtacctggcaa

SEQ ID NO: 25814 - DNA, 25 bp, Rattus norvegicus
aacctaggaagagagtacctggcaa

SEQ ID NO: 25815 - DNA, 25 bp, Rattus norvegicus
aacctaggaggtaccatgtctttct

SEQ ID NO: 25816 - DNA, 25 bp, Rattus norvegicus
aacctaggaggttccatgtctttct

SEQ ID NO: 25817 - DNA, 25 bp, Rattus norvegicus
aacctaggcacacagctgttaacat

SEQ ID NO: 25818 - DNA, 25 bp, Rattus norvegicus
aacctaggcacagagctgttaacat

SEQ ID NO: 25819 - DNA, 25 bp, Rattus norvegicus
aacctaggcctacactgcgatgaac

SEQ ID NO: 25820 - DNA, 25 bp, Rattus norvegicus
aacctaggcctacgactgccagagt

SEQ ID NO: 25821 - DNA, 25 bp, Rattus norvegicus
aacctaggcctagactgcgatgaac

SEQ ID NO: 25822 - DNA, 25 bp, Rattus norvegicus
aacctaggcctaggactgccagagt

SEQ ID NO: 25823 - DNA, 25 bp, Rattus norvegicus
aacctaggctggatcctgtgtcaga

SEQ ID NO: 25824 - DNA, 25 bp, Rattus norvegicus
aacctaggctggttcctgtgtcaga

SEQ ID NO: 25825 - DNA, 25 bp, Rattus norvegicus
aacctaggctttatgccacaatctt

SEQ ID NO: 25826 - DNA, 25 bp, Rattus norvegicus
aacctaggctttttgccacaatctt

SEQ ID NO: 25827 - DNA, 25 bp, Rattus norvegicus
aacctagggcctagtgattgctaag

SEQ ID NO: 25828 - DNA, 25 bp, Rattus norvegicus
aacctagggccttgtgattgctaag

SEQ ID NO: 25829 - DNA, 25 bp, Rattus norvegicus
aacctaggtatactggctgtctccc

SEQ ID NO: 25830 - DNA, 25 bp, Rattus norvegicus
aacctaggtatagtggctgtctccc

SEQ ID NO: 25831 - DNA, 25 bp, Rattus norvegicus
aacctaggtcttctgtgagactagc

SEQ ID NO: 25832 - DNA, 25 bp, Rattus norvegicus
aacctaggtcttgtgtgagactagc

SEQ ID NO: 25833 - DNA, 25 bp, Rattus norvegicus
aacctagtaaatctgcctcttggct

SEQ ID NO: 25834 - DNA, 25 bp, Rattus norvegicus
aacctagtaaatgtgcctcttggct

SEQ ID NO: 25835 - DNA, 25 bp, Rattus norvegicus
aacctagtaactctttcctatgcac

SEQ ID NO: 25836 - DNA, 25 bp, Rattus norvegicus
aacctagtaactgtttcctatgcac

SEQ ID NO: 25837 - DNA, 25 bp, Rattus norvegicus
aacctagttcttccgtgtactttga

SEQ ID NO: 25838 - DNA, 25 bp, Rattus norvegicus
aacctagttcttgcgtgtactttga

SEQ ID NO: 25839 - DNA, 25 bp, Rattus norvegicus
aacctataacagctgtgacgctcct

SEQ ID NO: 25840 - DNA, 25 bp, Rattus norvegicus
aacctataacaggtgtgacgctcct

SEQ ID NO: 25841 - DNA, 25 bp, Rattus norvegicus
aacctataataaactccttctgcaa

SEQ ID NO: 25842 - DNA, 25 bp, Rattus norvegicus
aacctataataatctccttctgcaa

SEQ ID NO: 25843 - DNA, 25 bp, Rattus norvegicus
aacctatacggcctcactgaagcga

SEQ ID NO: 25844 - DNA, 25 bp, Rattus norvegicus
aacctatacggcgtcactgaagcga

SEQ ID NO: 25845 - DNA, 25 bp, Rattus norvegicus
aacctatagacgacacacatcactg

SEQ ID NO: 25846 - DNA, 25 bp, Rattus norvegicus
aacctatagacgtcacacatcactg

SEQ ID NO: 25847 - DNA, 25 bp, Rattus norvegicus
aacctatagtttactccttgatgtg

SEQ ID NO: 25848 - DNA, 25 bp, Rattus norvegicus
aacctatagttttctccttgatgtg

SEQ ID NO: 25849 - DNA, 25 bp, Rattus norvegicus
aacctatcagccaccattactatga

SEQ ID NO: 25850 - DNA, 25 bp, Rattus norvegicus
aacctatcagcctccattactatga

SEQ ID NO: 25851 - DNA, 25 bp, Rattus norvegicus
aacctatcggttagggactactgtg

SEQ ID NO: 25852 - DNA, 25 bp, Rattus norvegicus
aacctatcggtttgggactactgtg

SEQ ID NO: 25853 - DNA, 25 bp, Rattus norvegicus
aacctatcttgtaacctctggcagt

SEQ ID NO: 25854 - DNA, 25 bp, Rattus norvegicus
aacctatcttgttacctctggcagt

SEQ ID NO: 25855 - DNA, 25 bp, Rattus norvegicus
aacctatgaaatatgccagtcagca

SEQ ID NO: 25856 - DNA, 25 bp, Rattus norvegicus
aacctatgaaatttgccagtcagca

SEQ ID NO: 25857 - DNA, 25 bp, Rattus norvegicus
aacctatggcggctatttccgagac

SEQ ID NO: 25858 - DNA, 25 bp, Rattus norvegicus
aacctatggcgggtatttccgagac

SEQ ID NO: 25859 - DNA, 25 bp, Rattus norvegicus
aacctatgtcaaaatgtctgcagca

SEQ ID NO: 25860 - DNA, 25 bp, Rattus norvegicus
aacctatgtcaatatgtctgcagca

SEQ ID NO: 25861 - DNA, 25 bp, Rattus norvegicus
aacctattaatgagtgtgtccaatg

SEQ ID NO: 25862 - DNA, 25 bp, Rattus norvegicus
aacctattaatgtgtgtgtccaatg

SEQ ID NO: 25863 - DNA, 25 bp, Rattus norvegicus
aacctattaggtcacttccgaagat

SEQ ID NO: 25864 - DNA, 25 bp, Rattus norvegicus
aacctattaggtgacttccgaagat

SEQ ID NO: 25865 - DNA, 25 bp, Rattus norvegicus
aacctattagtaaacattcatcggg

SEQ ID NO: 25866 - DNA, 25 bp, Rattus norvegicus
aacctattagtatacattcatcggg

SEQ ID NO: 25867 - DNA, 25 bp, Rattus norvegicus
aacctattcttgcaacaggcccatg

SEQ ID NO: 25868 - DNA, 25 bp, Rattus norvegicus
aacctattcttggaacaggcccatg

SEQ ID NO: 25869 - DNA, 25 bp, Rattus norvegicus
aacctattgcaccattctctggtag

SEQ ID NO: 25870 - DNA, 25 bp, Rattus norvegicus
aacctattgcacgattctctggtag

SEQ ID NO: 25871 - DNA, 25 bp, Rattus norvegicus
aacctattgcagaggatacccgggc

SEQ ID NO: 25872 - DNA, 25 bp, Rattus norvegicus
aacctattgcagtggatacccgggc

SEQ ID NO: 25873 - DNA, 25 bp, Rattus norvegicus
aacctatttacaccgtcttcactta

SEQ ID NO: 25874 - DNA, 25 bp, Rattus norvegicus
aacctatttacagcgtcttcactta

SEQ ID NO: 25875 - DNA, 25 bp, Rattus norvegicus
aacctatttcggcattacattgcta

SEQ ID NO: 25876 - DNA, 25 bp, Rattus norvegicus
aacctatttcgggattacattgcta

SEQ ID NO: 25877 - DNA, 25 bp, Rattus norvegicus
aacctatttgctctccacactgcat

SEQ ID NO: 25878 - DNA, 25 bp, Rattus norvegicus
aacctatttgctgtccacactgcat

SEQ ID NO: 25879 - DNA, 25 bp, Rattus norvegicus
aacctcaagagaagggagctatcca

SEQ ID NO: 25880 - DNA, 25 bp, Rattus norvegicus
aacctcaagagatgggagctatcca

SEQ ID NO: 25881 - DNA, 25 bp, Rattus norvegicus
aacctcaagcccatgcagcagatta

SEQ ID NO: 25882 - DNA, 25 bp, Rattus norvegicus
aacctcaagcccttgcagcagatta

SEQ ID NO: 25883 - DNA, 25 bp, Rattus norvegicus
aacctcaaggctatcgcctttacag

SEQ ID NO: 25884 - DNA, 25 bp, Rattus norvegicus
aacctcaaggctttcgcctttacag

SEQ ID NO: 25885 - DNA, 25 bp, Rattus norvegicus
aacctcaagggcattttcacaccat

SEQ ID NO: 25886 - DNA, 25 bp, Rattus norvegicus
aacctcaagggctttttcacaccat

SEQ ID NO: 25887 - DNA, 25 bp, Rattus norvegicus
aacctcaatcccagatttgttctgt

SEQ ID NO: 25888 - DNA, 25 bp, Rattus norvegicus
aacctcaatccctgatttgttctgt

SEQ ID NO: 25889 - DNA, 25 bp, Rattus norvegicus
aacctcaatgtgaatcagcccacag

SEQ ID NO: 25890 - DNA, 25 bp, Rattus norvegicus
aacctcaatgtgtatcagcccacag

SEQ ID NO: 25891 - DNA, 25 bp, Rattus norvegicus
aacctcacaaacctagcttcttagt

SEQ ID NO: 25892 - DNA, 25 bp, Rattus norvegicus
aacctcacaaacgtagcttcttagt

SEQ ID NO: 25893 - DNA, 25 bp, Rattus norvegicus
aacctcacaagaatgttggaagatg

SEQ ID NO: 25894 - DNA, 25 bp, Rattus norvegicus
aacctcacaagattgttggaagatg

SEQ ID NO: 25895 - DNA, 25 bp, Rattus norvegicus
aacctcacacacataattctttata

SEQ ID NO: 25896 - DNA, 25 bp, Rattus norvegicus
aacctcacacacttaattctttata

SEQ ID NO: 25897 - DNA, 25 bp, Rattus norvegicus
aacctcacagacagaaggctctctt

SEQ ID NO: 25898 - DNA, 25 bp, Rattus norvegicus
aacctcacagactgaaggctctctt

SEQ ID NO: 25899 - DNA, 25 bp, Rattus norvegicus
aacctcacagagcaccaggccagag

SEQ ID NO: 25900 - DNA, 25 bp, Rattus norvegicus
aacctcacagaggaccaggccagag

SEQ ID NO: 25901 - DNA, 25 bp, Rattus norvegicus
aacctcacagtcctcagtatgcaga

SEQ ID NO: 25902 - DNA, 25 bp, Rattus norvegicus
aacctcacagtcgtcagtatgcaga

SEQ ID NO: 25903 - DNA, 25 bp, Rattus norvegicus
aacctcacgaacaagtcgcttctgt

SEQ ID NO: 25904 - DNA, 25 bp, Rattus norvegicus
aacctcacgaactagtcgcttctgt

SEQ ID NO: 25905 - DNA, 25 bp, Rattus norvegicus
aacctcacgagaactttaatagtga

SEQ ID NO: 25906 - DNA, 25 bp, Rattus norvegicus
aacctcacgagatctttaatagtga

SEQ ID NO: 25907 - DNA, 25 bp, Rattus norvegicus
aacctcacgctcacagatctacaat

SEQ ID NO: 25908 - DNA, 25 bp, Rattus norvegicus
aacctcacgctctcagatctacaat

SEQ ID NO: 25909 - DNA, 25 bp, Rattus norvegicus
aacctcacgtggaagaaaatgccgt

SEQ ID NO: 25910 - DNA, 25 bp, Rattus norvegicus
aacctcacgtggtagaaaatgccgt

SEQ ID NO: 25911 - DNA, 25 bp, Rattus norvegicus
aacctcactacccacagaaagttgt

SEQ ID NO: 25912 - DNA, 25 bp, Rattus norvegicus
aacctcactaccgacagaaagttgt

SEQ ID NO: 25913 - DNA, 25 bp, Rattus norvegicus
aacctcactgtgcaagctgaactca

SEQ ID NO: 25914 - DNA, 25 bp, Rattus norvegicus
aacctcactgtggaagctgaactca

SEQ ID NO: 25915 - DNA, 25 bp, Rattus norvegicus
aacctcacttgccagttgtcatcaa

SEQ ID NO: 25916 - DNA, 25 bp, Rattus norvegicus
aacctcacttgcgagttgtcatcaa

SEQ ID NO: 25917 - DNA, 25 bp, Rattus norvegicus
aacctcagatgtcgacttggacttg

SEQ ID NO: 25918 - DNA, 25 bp, Rattus norvegicus
aacctcagatgtggacttggacttg

SEQ ID NO: 25919 - DNA, 25 bp, Rattus norvegicus
aacctcagcaagatcatgcctagtt

SEQ ID NO: 25920 - DNA, 25 bp, Rattus norvegicus
aacctcagcaagttcatgcctagtt

SEQ ID NO: 25921 - DNA, 25 bp, Rattus norvegicus
aacctcagcaggcattttgattggc

SEQ ID NO: 25922 - DNA, 25 bp, Rattus norvegicus
aacctcagcagggattttgattggc

SEQ ID NO: 25923 - DNA, 25 bp, Rattus norvegicus
aacctcagcatcaggttaacctgac

SEQ ID NO: 25924 - DNA, 25 bp, Rattus norvegicus
aacctcagcatctggttaacctgac

SEQ ID NO: 25925 - DNA, 25 bp, Rattus norvegicus
aacctcagccccagagtgttggaat

SEQ ID NO: 25926 - DNA, 25 bp, Rattus norvegicus
aacctcagcccctgagtgttggaat

SEQ ID NO: 25927 - DNA, 25 bp, Rattus norvegicus
aacctcagcctcagaatgtggcatc

SEQ ID NO: 25928 - DNA, 25 bp, Rattus norvegicus
aacctcagcctctgaatgtggcatc

SEQ ID NO: 25929 - DNA, 25 bp, Rattus norvegicus
aacctcagcttgcatgtctggctac

SEQ ID NO: 25930 - DNA, 25 bp, Rattus norvegicus
aacctcagcttggatgtctggctac

SEQ ID NO: 25931 - DNA, 25 bp, Rattus norvegicus
aacctcaggctgaagaaccggattc

SEQ ID NO: 25932 - DNA, 25 bp, Rattus norvegicus
aacctcaggctgtagaaccggattc

SEQ ID NO: 25933 - DNA, 25 bp, Rattus norvegicus
aacctcagggccacaaggatgacaa

SEQ ID NO: 25934 - DNA, 25 bp, Rattus norvegicus
aacctcagggcctcaaggatgacaa

SEQ ID NO: 25935 - DNA, 25 bp, Rattus norvegicus
aacctcagtcccaaggatggtccga

SEQ ID NO: 25936 - DNA, 25 bp, Rattus norvegicus
aacctcagtccctaggatggtccga

SEQ ID NO: 25937 - DNA, 25 bp, Rattus norvegicus
aacctcagtcctccatggtaggtga

SEQ ID NO: 25938 - DNA, 25 bp, Rattus norvegicus
aacctcagtcctgcatggtaggtga

SEQ ID NO: 25939 - DNA, 25 bp, Rattus norvegicus
aacctcagtgccatgtttctccagg

SEQ ID NO: 25940 - DNA, 25 bp, Rattus norvegicus
aacctcagtgccttgtttctccagg

SEQ ID NO: 25941 - DNA, 25 bp, Rattus norvegicus
aacctcagtggacctaagtgtcttc

SEQ ID NO: 25942 - DNA, 25 bp, Rattus norvegicus
aacctcagtggagctaagtgtcttc

SEQ ID NO: 25943 - DNA, 25 bp, Rattus norvegicus
aacctcataattcatactaggctga

SEQ ID NO: 25944 - DNA, 25 bp, Rattus norvegicus
aacctcataattgatactaggctga

SEQ ID NO: 25945 - DNA, 25 bp, Rattus norvegicus
aacctcataggacccatgtatttat

SEQ ID NO: 25946 - DNA, 25 bp, Rattus norvegicus
aacctcataggagccatgtatttat

SEQ ID NO: 25947 - DNA, 25 bp, Rattus norvegicus
aacctcatagttcctgccatagatg

SEQ ID NO: 25948 - DNA, 25 bp, Rattus norvegicus
aacctcatagttgctgccatagatg

SEQ ID NO: 25949 - DNA, 25 bp, Rattus norvegicus
aacctcatccggagattttggactg

SEQ ID NO: 25950 - DNA, 25 bp, Rattus norvegicus
aacctcatccggtgattttggactg

SEQ ID NO: 25951 - DNA, 25 bp, Rattus norvegicus
aacctcatcgtaagacagctgtttg

SEQ ID NO: 25952 - DNA, 25 bp, Rattus norvegicus
aacctcatcgtatgacagctgtttg

SEQ ID NO: 25953 - DNA, 25 bp, Rattus norvegicus
aacctcatgcacaacttcatcttaa

SEQ ID NO: 25954 - DNA, 25 bp, Rattus norvegicus
aacctcatgcactacttcatcttaa

SEQ ID NO: 25955 - DNA, 25 bp, Rattus norvegicus
aacctcatggacattctgcagtcgc

SEQ ID NO: 25956 - DNA, 25 bp, Rattus norvegicus
aacctcatggactttctgcagtcgc

SEQ ID NO: 25957 - DNA, 25 bp, Rattus norvegicus
aacctcatgggtcctgcttgtgtgg

SEQ ID NO: 25958 - DNA, 25 bp, Rattus norvegicus
aacctcatgggtgctgcttgtgtgg

SEQ ID NO: 25959 - DNA, 25 bp, Rattus norvegicus
aacctcattaggaagtgctgtacac

SEQ ID NO: 25960 - DNA, 25 bp, Rattus norvegicus
aacctcattaggtagtgctgtacac

SEQ ID NO: 25961 - DNA, 25 bp, Rattus norvegicus
aacctcatttagatgtcttgaatta

SEQ ID NO: 25962 - DNA, 25 bp, Rattus norvegicus
aacctcatttagttgtcttgaatta

SEQ ID NO: 25963 - DNA, 25 bp, Rattus norvegicus
aacctcattttaactcagcctttaa

SEQ ID NO: 25964 - DNA, 25 bp, Rattus norvegicus
aacctcattttatctcagcctttaa

SEQ ID NO: 25965 - DNA, 25 bp, Rattus norvegicus
aacctcattttgaattctctcgtga

SEQ ID NO: 25966 - DNA, 25 bp, Rattus norvegicus
aacctcattttgtattctctcgtga

SEQ ID NO: 25967 - DNA, 25 bp, Rattus norvegicus
aacctccaacagaatgatctcactt

SEQ ID NO: 25968 - DNA, 25 bp, Rattus norvegicus
aacctccaacagtatgatctcactt

SEQ ID NO: 25969 - DNA, 25 bp, Rattus norvegicus
aacctccaagtcatacctttctggt

SEQ ID NO: 25970 - DNA, 25 bp, Rattus norvegicus
aacctccaagtcttacctttctggt

SEQ ID NO: 25971 - DNA, 25 bp, Rattus norvegicus
aacctccaatcaccctgagtcacct

SEQ ID NO: 25972 - DNA, 25 bp, Rattus norvegicus
aacctccaatcagcctgagtcacct

SEQ ID NO: 25973 - DNA, 25 bp, Rattus norvegicus
aacctccacagtacattggctgttt

SEQ ID NO: 25974 - DNA, 25 bp, Rattus norvegicus
aacctccacagttcattggctgttt

SEQ ID NO: 25975 - DNA, 25 bp, Rattus norvegicus
aacctccactttccactgtataaaa

SEQ ID NO: 25976 - DNA, 25 bp, Rattus norvegicus
aacctccactttgcactgtataaaa

SEQ ID NO: 25977 - DNA, 25 bp, Rattus norvegicus
aacctccagacccagcaaaatgtgg

SEQ ID NO: 25978 - DNA, 25 bp, Rattus norvegicus
aacctccagaccgagcaaaatgtgg

SEQ ID NO: 25979 - DNA, 25 bp, Rattus norvegicus
aacctccagaggagccctcagttct

SEQ ID NO: 25980 - DNA, 25 bp, Rattus norvegicus
aacctccagaggtgccctcagttct

SEQ ID NO: 25981 - DNA, 25 bp, Rattus norvegicus
aacctccatcctactcaaagtgtgg

SEQ ID NO: 25982 - DNA, 25 bp, Rattus norvegicus
aacctccatcctcacatgctgtgtt

SEQ ID NO: 25983 - DNA, 25 bp, Rattus norvegicus
aacctccatcctgacatgctgtgtt

SEQ ID NO: 25984 - DNA, 25 bp, Rattus norvegicus
aacctccatccttctcaaagtgtgg

SEQ ID NO: 25985 - DNA, 25 bp, Rattus norvegicus
aacctccatttcaatcactgcttgg

SEQ ID NO: 25986 - DNA, 25 bp, Rattus norvegicus
aacctccatttctatcactgcttgg

SEQ ID NO: 25987 - DNA, 25 bp, Rattus norvegicus
aacctcccagcactacagtattctt

SEQ ID NO: 25988 - DNA, 25 bp, Rattus norvegicus
aacctcccagcagtacagtattctt

SEQ ID NO: 25989 - DNA, 25 bp, Rattus norvegicus
aacctccccatgcacaagatgatga

SEQ ID NO: 25990 - DNA, 25 bp, Rattus norvegicus
aacctccccatggacaagatgatga

SEQ ID NO: 25991 - DNA, 25 bp, Rattus norvegicus
aacctcccgaggatgtgaggatgac

SEQ ID NO: 25992 - DNA, 25 bp, Rattus norvegicus
aacctcccgaggttgtgaggatgac

SEQ ID NO: 25993 - DNA, 25 bp, Rattus norvegicus
aacctccggcacctgagggtgtttg

SEQ ID NO: 25994 - DNA, 25 bp, Rattus norvegicus
aacctccggcacgtgagggtgtttg

SEQ ID NO: 25995 - DNA, 25 bp, Rattus norvegicus
aacctccggcagaagttcaggcagt

SEQ ID NO: 25996 - DNA, 25 bp, Rattus norvegicus
aacctccggcagtagttcaggcagt

SEQ ID NO: 25997 - DNA, 25 bp, Rattus norvegicus
aacctccgtgcactcgaaaaccatt

SEQ ID NO: 25998 - DNA, 25 bp, Rattus norvegicus
aacctccgtgcagtcgaaaaccatt

SEQ ID NO: 25999 - DNA, 25 bp, Rattus norvegicus
aacctccgtggtcggaaggactcat

SEQ ID NO: 26000 - DNA, 25 bp, Rattus norvegicus
aacctccgtggtgggaaggactcat

SEQ ID NO: 26001 - DNA, 25 bp, Rattus norvegicus
aacctcctggctagatctgatgtag

SEQ ID NO: 26002 - DNA, 25 bp, Rattus norvegicus
aacctcctggcttgatctgatgtag

SEQ ID NO: 26003 - DNA, 25 bp, Rattus norvegicus
aacctcctgggcaaagtatctgaca

SEQ ID NO: 26004 - DNA, 25 bp, Rattus norvegicus
aacctcctgggctaagtatctgaca

SEQ ID NO: 26005 - DNA, 25 bp, Rattus norvegicus
aacctccttgatattggcaagtagc

SEQ ID NO: 26006 - DNA, 25 bp, Rattus norvegicus
aacctccttgattttggcaagtagc

SEQ ID NO: 26007 - DNA, 25 bp, Rattus norvegicus
aacctccttgtgagtctgagttctt

SEQ ID NO: 26008 - DNA, 25 bp, Rattus norvegicus
aacctccttgtgtgtctgagttctt

SEQ ID NO: 26009 - DNA, 25 bp, Rattus norvegicus
aacctcctttgccatgacatcatgt

SEQ ID NO: 26010 - DNA, 25 bp, Rattus norvegicus
aacctcctttgcgatgacatcatgt

SEQ ID NO: 26011 - DNA, 25 bp, Rattus norvegicus
aacctcgaaccacctgagctttcta

SEQ ID NO: 26012 - DNA, 25 bp, Rattus norvegicus
aacctcgaaccagctgagctttcta

SEQ ID NO: 26013 - DNA, 25 bp, Rattus norvegicus
aacctcgaccacatactttgatttc

SEQ ID NO: 26014 - DNA, 25 bp, Rattus norvegicus
aacctcgaccacttactttgatttc

SEQ ID NO: 26015 - DNA, 25 bp, Rattus norvegicus
aacctcggcaatacaggctgttgaa

SEQ ID NO: 26016 - DNA, 25 bp, Rattus norvegicus
aacctcggcaattcaggctgttgaa

SEQ ID NO: 26017 - DNA, 25 bp, Rattus norvegicus
aacctcggctggcatgctcagggaa

SEQ ID NO: 26018 - DNA, 25 bp, Rattus norvegicus
aacctcggctgggatgctcagggaa

SEQ ID NO: 26019 - DNA, 25 bp, Rattus norvegicus
aacctcgggactatatcatccttgc

SEQ ID NO: 26020 - DNA, 25 bp, Rattus norvegicus
aacctcgggactttatcatccttgc

SEQ ID NO: 26021 - DNA, 25 bp, Rattus norvegicus
aacctcgtattacatgatgcagaag

SEQ ID NO: 26022 - DNA, 25 bp, Rattus norvegicus
aacctcgtattagatgatgcagaag

SEQ ID NO: 26023 - DNA, 25 bp, Rattus norvegicus
aacctcgtgggccagtttcagcatg

SEQ ID NO: 26024 - DNA, 25 bp, Rattus norvegicus
aacctcgtgggcgagtttcagcatg

SEQ ID NO: 26025 - DNA, 25 bp, Rattus norvegicus
aacctcgttcaccatgctgcacagg

SEQ ID NO: 26026 - DNA, 25 bp, Rattus norvegicus
aacctcgttcacgatgctgcacagg

SEQ ID NO: 26027 - DNA, 25 bp, Rattus norvegicus
aacctctaaaagatgttgctgtaca

SEQ ID NO: 26028 - DNA, 25 bp, Rattus norvegicus
aacctctaaaagttgttgctgtaca

SEQ ID NO: 26029 - DNA, 25 bp, Rattus norvegicus
aacctctacagtagcaactcttggg

SEQ ID NO: 26030 - DNA, 25 bp, Rattus norvegicus
aacctctacagttgcaactcttggg

SEQ ID NO: 26031 - DNA, 25 bp, Rattus norvegicus
aacctctacggtcttgaactactgg

SEQ ID NO: 26032 - DNA, 25 bp, Rattus norvegicus
aacctctacggtgttgaactactgg

SEQ ID NO: 26033 - DNA, 25 bp, Rattus norvegicus
aacctctacttgactttgtatctgt

SEQ ID NO: 26034 - DNA, 25 bp, Rattus norvegicus
aacctctacttgtctttgtatctgt

SEQ ID NO: 26035 - DNA, 25 bp, Rattus norvegicus
aacctctagcttctctttttggagc

SEQ ID NO: 26036 - DNA, 25 bp, Rattus norvegicus
aacctctagcttgtctttttggagc

SEQ ID NO: 26037 - DNA, 25 bp, Rattus norvegicus
aacctctaggttaaaatggctcatt

SEQ ID NO: 26038 - DNA, 25 bp, Rattus norvegicus
aacctctaggtttaaatggctcatt

SEQ ID NO: 26039 - DNA, 25 bp, Rattus norvegicus
aacctctcagaaccaggcagacatt

SEQ ID NO: 26040 - DNA, 25 bp, Rattus norvegicus
aacctctcagaagcaggcagacatt

SEQ ID NO: 26041 - DNA, 25 bp, Rattus norvegicus
aacctctcatacctcacacagtggg

SEQ ID NO: 26042 - DNA, 25 bp, Rattus norvegicus
aacctctcatacgtcacacagtggg

SEQ ID NO: 26043 - DNA, 25 bp, Rattus norvegicus
aacctctcattcactgacaccagat

SEQ ID NO: 26044 - DNA, 25 bp, Rattus norvegicus
aacctctcattctctgacaccagat

SEQ ID NO: 26045 - DNA, 25 bp, Rattus norvegicus
aacctctccagtaattgctttgcag

SEQ ID NO: 26046 - DNA, 25 bp, Rattus norvegicus
aacctctccagttattgctttgcag

SEQ ID NO: 26047 - DNA, 25 bp, Rattus norvegicus
aacctctctagtaaagggcttagct

SEQ ID NO: 26048 - DNA, 25 bp, Rattus norvegicus
aacctctctagttaagggcttagct

SEQ ID NO: 26049 - DNA, 25 bp, Rattus norvegicus
aacctctctgctccattatcgatag

SEQ ID NO: 26050 - DNA, 25 bp, Rattus norvegicus
aacctctctgctgcattatcgatag

SEQ ID NO: 26051 - DNA, 25 bp, Rattus norvegicus
aacctctctggtcctttgactaagt

SEQ ID NO: 26052 - DNA, 25 bp, Rattus norvegicus
aacctctctggtgctttgactaagt

SEQ ID NO: 26053 - DNA, 25 bp, Rattus norvegicus
aacctctcttgtattgtctgcttag

SEQ ID NO: 26054 - DNA, 25 bp, Rattus norvegicus
aacctctcttgttttgtctgcttag

SEQ ID NO: 26055 - DNA, 25 bp, Rattus norvegicus
aacctctggatcaacgagctgaaga

SEQ ID NO: 26056 - DNA, 25 bp, Rattus norvegicus
aacctctggatctacgagctgaaga

SEQ ID NO: 26057 - DNA, 25 bp, Rattus norvegicus
aacctctggcacaatatacttggat

SEQ ID NO: 26058 - DNA, 25 bp, Rattus norvegicus
aacctctggcactatatacttggat

SEQ ID NO: 26059 - DNA, 25 bp, Rattus norvegicus
aacctctgtaataggtacactttga

SEQ ID NO: 26060 - DNA, 25 bp, Rattus norvegicus
aacctctgtaattggtacactttga

SEQ ID NO: 26061 - DNA, 25 bp, Rattus norvegicus
aacctctgtggcaacagactggtga

SEQ ID NO: 26062 - DNA, 25 bp, Rattus norvegicus
aacctctgtggctacagactggtga

SEQ ID NO: 26063 - DNA, 25 bp, Rattus norvegicus
aacctcttaactccgttgaactgat

SEQ ID NO: 26064 - DNA, 25 bp, Rattus norvegicus
aacctcttaactgcgttgaactgat

SEQ ID NO: 26065 - DNA, 25 bp, Rattus norvegicus
aacctcttactgctttcaatacaca

SEQ ID NO: 26066 - DNA, 25 bp, Rattus norvegicus
aacctcttactggtttcaatacaca

SEQ ID NO: 26067 - DNA, 25 bp, Rattus norvegicus
aacctcttagaactgtgtttcgtgt

SEQ ID NO: 26068 - DNA, 25 bp, Rattus norvegicus
aacctcttagaagtgtgtttcgtgt

SEQ ID NO: 26069 - DNA, 25 bp, Rattus norvegicus
aacctcttagacatggcttgtggac

SEQ ID NO: 26070 - DNA, 25 bp, Rattus norvegicus
aacctcttagacttggcttgtggac

SEQ ID NO: 26071 - DNA, 25 bp, Rattus norvegicus
aacctcttcaacctgaggacgctgg

SEQ ID NO: 26072 - DNA, 25 bp, Rattus norvegicus
aacctcttcaacgtgaggacgctgg

SEQ ID NO: 26073 - DNA, 25 bp, Rattus norvegicus
aacctcttgagaagcacgtttgatc

SEQ ID NO: 26074 - DNA, 25 bp, Rattus norvegicus
aacctcttgagatgcacgtttgatc

SEQ ID NO: 26075 - DNA, 25 bp, Rattus norvegicus
aacctcttggccagcgcgttggaaa

SEQ ID NO: 26076 - DNA, 25 bp, Rattus norvegicus
aacctcttggcctgcgcgttggaaa

SEQ ID NO: 26077 - DNA, 25 bp, Rattus norvegicus
aacctcttggtacctctggcatgag

SEQ ID NO: 26078 - DNA, 25 bp, Rattus norvegicus
aacctcttggtagctctggcatgag

SEQ ID NO: 26079 - DNA, 25 bp, Rattus norvegicus
aacctcttgtttcggtaagcaatct

SEQ ID NO: 26080 - DNA, 25 bp, Rattus norvegicus
aacctcttgtttgggtaagcaatct

SEQ ID NO: 26081 - DNA, 25 bp, Rattus norvegicus
aacctctttgagctgctgaaccttc

SEQ ID NO: 26082 - DNA, 25 bp, Rattus norvegicus
aacctctttgaggtgctgaaccttc

SEQ ID NO: 26083 - DNA, 25 bp, Rattus norvegicus
aacctctttgggacacagttgccat

SEQ ID NO: 26084 - DNA, 25 bp, Rattus norvegicus
aacctctttgggtcacagttgccat

SEQ ID NO: 26085 - DNA, 25 bp, Rattus norvegicus
aacctctttttaacagcctaagcag

SEQ ID NO: 26086 - DNA, 25 bp, Rattus norvegicus
aacctctttttatcagcctaagcag

SEQ ID NO: 26087 - DNA, 25 bp, Rattus norvegicus
aacctgaaaactctgcttataaaca

SEQ ID NO: 26088 - DNA, 25 bp, Rattus norvegicus
aacctgaaaactgtgcttataaaca

SEQ ID NO: 26089 - DNA, 25 bp, Rattus norvegicus
aacctgaaacgccatcccaagtgag

SEQ ID NO: 26090 - DNA, 25 bp, Rattus norvegicus
aacctgaaacgcgatcccaagtgag

SEQ ID NO: 26091 - DNA, 25 bp, Rattus norvegicus
aacctgaaagcaacgagtaaatatc

SEQ ID NO: 26092 - DNA, 25 bp, Rattus norvegicus
aacctgaaagcatcgagtaaatatc

SEQ ID NO: 26093 - DNA, 25 bp, Rattus norvegicus
aacctgaagctactgcacatcgcct

SEQ ID NO: 26094 - DNA, 25 bp, Rattus norvegicus
aacctgaagctagtgcacatcgcct

SEQ ID NO: 26095 - DNA, 25 bp, Rattus norvegicus
aacctgaaggacatcgtggctcggt

SEQ ID NO: 26096 - DNA, 25 bp, Rattus norvegicus
aacctgaaggacttcgtggctcggt

SEQ ID NO: 26097 - DNA, 25 bp, Rattus norvegicus
aacctgaaggtcattgagttccact

SEQ ID NO: 26098 - DNA, 25 bp, Rattus norvegicus
aacctgaaggtctttgagttccact

SEQ ID NO: 26099 - DNA, 25 bp, Rattus norvegicus
aacctgaagtgtctgagtgctgctg

SEQ ID NO: 26100 - DNA, 25 bp, Rattus norvegicus
aacctgaagtgtgtgagtgctgctg

SEQ ID NO: 26101 - DNA, 25 bp, Rattus norvegicus
aacctgaatgccatgtgtccgtgta

SEQ ID NO: 26102 - DNA, 25 bp, Rattus norvegicus
aacctgaatgccttgtgtccgtgta

SEQ ID NO: 26103 - DNA, 25 bp, Rattus norvegicus
aacctgacacgtcgatgcttctgca

SEQ ID NO: 26104 - DNA, 25 bp, Rattus norvegicus
aacctgacacgtggatgcttctgca

SEQ ID NO: 26105 - DNA, 25 bp, Rattus norvegicus
aacctgacagtaaatgagcacttct

SEQ ID NO: 26106 - DNA, 25 bp, Rattus norvegicus
aacctgacagtatatgagcacttct

SEQ ID NO: 26107 - DNA, 25 bp, Rattus norvegicus
aacctgacccacagggaaggcccag

SEQ ID NO: 26108 - DNA, 25 bp, Rattus norvegicus
aacctgacccactgggaaggcccag

SEQ ID NO: 26109 - DNA, 25 bp, Rattus norvegicus
aacctgaccgtcagctgtacaaaga

SEQ ID NO: 26110 - DNA, 25 bp, Rattus norvegicus
aacctgaccgtctgctgtacaaaga

SEQ ID NO: 26111 - DNA, 25 bp, Rattus norvegicus
aacctgaccttcagttcacaatgct

SEQ ID NO: 26112 - DNA, 25 bp, Rattus norvegicus
aacctgaccttctgttcacaatgct

SEQ ID NO: 26113 - DNA, 25 bp, Rattus norvegicus
aacctgacgaccagaatttgatcct

SEQ ID NO: 26114 - DNA, 25 bp, Rattus norvegicus
aacctgacgacctgaatttgatcct

SEQ ID NO: 26115 - DNA, 25 bp, Rattus norvegicus
aacctgacgccccataaatgcttaa

SEQ ID NO: 26116 - DNA, 25 bp, Rattus norvegicus
aacctgacgcccgataaatgcttaa

SEQ ID NO: 26117 - DNA, 25 bp, Rattus norvegicus
aacctgacgtgcaggcagtctgaga

SEQ ID NO: 26118 - DNA, 25 bp, Rattus norvegicus
aacctgacgtgctggcagtctgaga

SEQ ID NO: 26119 - DNA, 25 bp, Rattus norvegicus
aacctgacttacatgcactgtgatc

SEQ ID NO: 26120 - DNA, 25 bp, Rattus norvegicus
aacctgacttacttgcactgtgatc

SEQ ID NO: 26121 - DNA, 25 bp, Rattus norvegicus
aacctgagaaggctggtctagcaga

SEQ ID NO: 26122 - DNA, 25 bp, Rattus norvegicus
aacctgagaagggtggtctagcaga

SEQ ID NO: 26123 - DNA, 25 bp, Rattus norvegicus
aacctgagagggaggcttgccctac

SEQ ID NO: 26124 - DNA, 25 bp, Rattus norvegicus
aacctgagagggtggcttgccctac

SEQ ID NO: 26125 - DNA, 25 bp, Rattus norvegicus
aacctgagcacaccgtggttgataa

SEQ ID NO: 26126 - DNA, 25 bp, Rattus norvegicus
aacctgagcacagcgtggttgataa

SEQ ID NO: 26127 - DNA, 25 bp, Rattus norvegicus
aacctgagcactcctcggaagtagt

SEQ ID NO: 26128 - DNA, 25 bp, Rattus norvegicus
aacctgagcactgctcggaagtagt

SEQ ID NO: 26129 - DNA, 25 bp, Rattus norvegicus
aacctgaggaagcttgcctgggtcc

SEQ ID NO: 26130 - DNA, 25 bp, Rattus norvegicus
aacctgaggaaggttgcctgggtcc

SEQ ID NO: 26131 - DNA, 25 bp, Rattus norvegicus
aacctgaggaccagtggtgtcagac

SEQ ID NO: 26132 - DNA, 25 bp, Rattus norvegicus
aacctgaggacctgtggtgtcagac

SEQ ID NO: 26133 - DNA, 25 bp, Rattus norvegicus
aacctgaggcttctaggtctgcaag

SEQ ID NO: 26134 - DNA, 25 bp, Rattus norvegicus
aacctgaggcttgtaggtctgcaag

SEQ ID NO: 26135 - DNA, 25 bp, Rattus norvegicus
aacctgagggtaagcagtgttttca

SEQ ID NO: 26136 - DNA, 25 bp, Rattus norvegicus
aacctgagggtatgcagtgttttca

SEQ ID NO: 26137 - DNA, 25 bp, Rattus norvegicus
aacctgaggttcaggtgagtcctgt

SEQ ID NO: 26138 - DNA, 25 bp, Rattus norvegicus
aacctgaggttctggtgagtcctgt

SEQ ID NO: 26139 - DNA, 25 bp, Rattus norvegicus
aacctgagtcctctgcgggaacaat

SEQ ID NO: 26140 - DNA, 25 bp, Rattus norvegicus
aacctgagtcctgtgcgggaacaat

SEQ ID NO: 26141 - DNA, 25 bp, Rattus norvegicus
aacctgagtgaaagcttcccagcaa

SEQ ID NO: 26142 - DNA, 25 bp, Rattus norvegicus
aacctgagtgaatgcttcccagcaa

SEQ ID NO: 26143 - DNA, 25 bp, Rattus norvegicus
aacctgagtggcacttggtgggtca

SEQ ID NO: 26144 - DNA, 25 bp, Rattus norvegicus
aacctgagtggctcttggtgggtca

SEQ ID NO: 26145 - DNA, 25 bp, Rattus norvegicus
aacctgagtttacatacctgaggca

SEQ ID NO: 26146 - DNA, 25 bp, Rattus norvegicus
aacctgagtttagatacctgaggca

SEQ ID NO: 26147 - DNA, 25 bp, Rattus norvegicus
aacctgatcctgagcgcggaacaca

SEQ ID NO: 26148 - DNA, 25 bp, Rattus norvegicus
aacctgatcctgagtcagcggcatt

SEQ ID NO: 26149 - DNA, 25 bp, Rattus norvegicus
aacctgatcctgtgcgcggaacaca

SEQ ID NO: 26150 - DNA, 25 bp, Rattus norvegicus
aacctgatcctgtgtcagcggcatt

SEQ ID NO: 26151 - DNA, 25 bp, Rattus norvegicus
aacctgatgattaccgagcttgcct

SEQ ID NO: 26152 - DNA, 25 bp, Rattus norvegicus
aacctgatgatttccgagcttgcct

SEQ ID NO: 26153 - DNA, 25 bp, Rattus norvegicus
aacctgatgcagcaagctggaccgt

SEQ ID NO: 26154 - DNA, 25 bp, Rattus norvegicus
aacctgatgcaggaagctggaccgt

SEQ ID NO: 26155 - DNA, 25 bp, Rattus norvegicus
aacctgatggccaggacgtgtctga

SEQ ID NO: 26156 - DNA, 25 bp, Rattus norvegicus
aacctgatggccagtttctgaagac

SEQ ID NO: 26157 - DNA, 25 bp, Rattus norvegicus
aacctgatggcctggacgtgtctga

SEQ ID NO: 26158 - DNA, 25 bp, Rattus norvegicus
aacctgatggcctgtttctgaagac

SEQ ID NO: 26159 - DNA, 25 bp, Rattus norvegicus
aacctgatggtgaccggcaagcggc

SEQ ID NO: 26160 - DNA, 25 bp, Rattus norvegicus
aacctgatggtgtccggcaagcggc

SEQ ID NO: 26161 - DNA, 25 bp, Rattus norvegicus
aacctgattctgaattcttgcacca

SEQ ID NO: 26162 - DNA, 25 bp, Rattus norvegicus
aacctgattctgtattcttgcacca

SEQ ID NO: 26163 - DNA, 25 bp, Rattus norvegicus
aacctgattgtacgaagattctggg

SEQ ID NO: 26164 - DNA, 25 bp, Rattus norvegicus
aacctgattgtaggaagattctggg

SEQ ID NO: 26165 - DNA, 25 bp, Rattus norvegicus
aacctgattgttctgtggtcttaat

SEQ ID NO: 26166 - DNA, 25 bp, Rattus norvegicus
aacctgattgttgtgtggtcttaat

SEQ ID NO: 26167 - DNA, 25 bp, Rattus norvegicus
aacctgcaaaccactaggtgagtga

SEQ ID NO: 26168 - DNA, 25 bp, Rattus norvegicus
aacctgcaaacctctaggtgagtga

SEQ ID NO: 26169 - DNA, 25 bp, Rattus norvegicus
aacctgcaaagcacggttctacttt

SEQ ID NO: 26170 - DNA, 25 bp, Rattus norvegicus
aacctgcaaagctcggttctacttt

SEQ ID NO: 26171 - DNA, 25 bp, Rattus norvegicus
aacctgcaaagtcctatcagtaagt

SEQ ID NO: 26172 - DNA, 25 bp, Rattus norvegicus
aacctgcaaagtgctatcagtaagt

SEQ ID NO: 26173 - DNA, 25 bp, Rattus norvegicus
aacctgcaaatacgccttgggctgg

SEQ ID NO: 26174 - DNA, 25 bp, Rattus norvegicus
aacctgcaaataggccttgggctgg

SEQ ID NO: 26175 - DNA, 25 bp, Rattus norvegicus
aacctgcaatggaggtcaagcccga

SEQ ID NO: 26176 - DNA, 25 bp, Rattus norvegicus
aacctgcaatggtggtcaagcccga

SEQ ID NO: 26177 - DNA, 25 bp, Rattus norvegicus
aacctgcacagcctgatgacagtgg

SEQ ID NO: 26178 - DNA, 25 bp, Rattus norvegicus
aacctgcacagcgtgatgacagtgg

SEQ ID NO: 26179 - DNA, 25 bp, Rattus norvegicus
aacctgcacaggctcagcagcagag

SEQ ID NO: 26180 - DNA, 25 bp, Rattus norvegicus
aacctgcacagggtcagcagcagag

SEQ ID NO: 26181 - DNA, 25 bp, Rattus norvegicus
aacctgcagagccaaaccactttta

SEQ ID NO: 26182 - DNA, 25 bp, Rattus norvegicus
aacctgcagagcgaaaccactttta

SEQ ID NO: 26183 - DNA, 25 bp, Rattus norvegicus
aacctgcagcaaaaagaggcccctg

SEQ ID NO: 26184 - DNA, 25 bp, Rattus norvegicus
aacctgcagcaataagaggcccctg

SEQ ID NO: 26185 - DNA, 25 bp, Rattus norvegicus
aacctgcagcacatctgatgtactg

SEQ ID NO: 26186 - DNA, 25 bp, Rattus norvegicus
aacctgcagcacttctgatgtactg

SEQ ID NO: 26187 - DNA, 25 bp, Rattus norvegicus
aacctgcagcttaaacaattgtaat

SEQ ID NO: 26188 - DNA, 25 bp, Rattus norvegicus
aacctgcagctttaacaattgtaat

SEQ ID NO: 26189 - DNA, 25 bp, Rattus norvegicus
aacctgcaggttattttgatgaatg

SEQ ID NO: 26190 - DNA, 25 bp, Rattus norvegicus
aacctgcaggtttttttgatgaatg

SEQ ID NO: 26191 - DNA, 25 bp, Rattus norvegicus
aacctgccaattagctccggatgtt

SEQ ID NO: 26192 - DNA, 25 bp, Rattus norvegicus
aacctgccaatttgctccggatgtt

SEQ ID NO: 26193 - DNA, 25 bp, Rattus norvegicus
aacctgccacatccggtgacctgtg

SEQ ID NO: 26194 - DNA, 25 bp, Rattus norvegicus
aacctgccacatgcggtgacctgtg

SEQ ID NO: 26195 - DNA, 25 bp, Rattus norvegicus
aacctgccagaaaggctagccatgg

SEQ ID NO: 26196 - DNA, 25 bp, Rattus norvegicus
aacctgccagaatggctagccatgg

SEQ ID NO: 26197 - DNA, 25 bp, Rattus norvegicus
aacctgccatgcatgctgtgtctgt

SEQ ID NO: 26198 - DNA, 25 bp, Rattus norvegicus
aacctgccatgcttgctgtgtctgt

SEQ ID NO: 26199 - DNA, 25 bp, Rattus norvegicus
aacctgcccagcagatgtactgtgt

SEQ ID NO: 26200 - DNA, 25 bp, Rattus norvegicus
aacctgcccagctgatgtactgtgt

SEQ ID NO: 26201 - DNA, 25 bp, Rattus norvegicus
aacctgcccaggactatgctgtcat

SEQ ID NO: 26202 - DNA, 25 bp, Rattus norvegicus
aacctgcccaggtctatgctgtcat

SEQ ID NO: 26203 - DNA, 25 bp, Rattus norvegicus
aacctgcccatcatggtgacggatt

SEQ ID NO: 26204 - DNA, 25 bp, Rattus norvegicus
aacctgcccatcttggtgacggatt

SEQ ID NO: 26205 - DNA, 25 bp, Rattus norvegicus
aacctgccccagattaggaacatgt

SEQ ID NO: 26206 - DNA, 25 bp, Rattus norvegicus
aacctgccccagtttaggaacatgt

SEQ ID NO: 26207 - DNA, 25 bp, Rattus norvegicus
aacctgccctgaacggagatgcatt

SEQ ID NO: 26208 - DNA, 25 bp, Rattus norvegicus
aacctgccctgatcggagatgcatt

SEQ ID NO: 26209 - DNA, 25 bp, Rattus norvegicus
aacctgcctcttcatgtttcataaa

SEQ ID NO: 26210 - DNA, 25 bp, Rattus norvegicus
aacctgcctcttgatgtttcataaa

SEQ ID NO: 26211 - DNA, 25 bp, Rattus norvegicus
aacctgcctgcacttgtacactgtg

SEQ ID NO: 26212 - DNA, 25 bp, Rattus norvegicus
aacctgcctgcagttgtacactgtg

SEQ ID NO: 26213 - DNA, 25 bp, Rattus norvegicus
aacctgcctgtcagtgggtggacca

SEQ ID NO: 26214 - DNA, 25 bp, Rattus norvegicus
aacctgcctgtctgtgggtggacca

SEQ ID NO: 26215 - DNA, 25 bp, Rattus norvegicus
aacctgcctgtgctatgcaactctg

SEQ ID NO: 26216 - DNA, 25 bp, Rattus norvegicus
aacctgcctgtggtatgcaactctg

SEQ ID NO: 26217 - DNA, 25 bp, Rattus norvegicus
aacctgcgggagctgattccttctc

SEQ ID NO: 26218 - DNA, 25 bp, Rattus norvegicus
aacctgcgggaggtgattccttctc

SEQ ID NO: 26219 - DNA, 25 bp, Rattus norvegicus
aacctgctacaaattctaaccaaag

SEQ ID NO: 26220 - DNA, 25 bp, Rattus norvegicus
aacctgctacaatttctaaccaaag

SEQ ID NO: 26221 - DNA, 25 bp, Rattus norvegicus
aacctgctcatgacgctaaggctgt

SEQ ID NO: 26222 - DNA, 25 bp, Rattus norvegicus
aacctgctcatgtcgctaaggctgt

SEQ ID NO: 26223 - DNA, 25 bp, Rattus norvegicus
aacctgctctgtcagtattagcact

SEQ ID NO: 26224 - DNA, 25 bp, Rattus norvegicus
aacctgctctgtgagtattagcact

SEQ ID NO: 26225 - DNA, 25 bp, Rattus norvegicus
aacctgctcttaaaatcgagttttg

SEQ ID NO: 26226 - DNA, 25 bp, Rattus norvegicus
aacctgctcttataatcgagttttg

SEQ ID NO: 26227 - DNA, 25 bp, Rattus norvegicus
aacctgctgcacaggtggactgagg

SEQ ID NO: 26228 - DNA, 25 bp, Rattus norvegicus
aacctgctgcactggtggactgagg

SEQ ID NO: 26229 - DNA, 25 bp, Rattus norvegicus
aacctgctggagctttatttttaat

SEQ ID NO: 26230 - DNA, 25 bp, Rattus norvegicus
aacctgctggaggtttatttttaat

SEQ ID NO: 26231 - DNA, 25 bp, Rattus norvegicus
aacctgctggctacgactatgttgg

SEQ ID NO: 26232 - DNA, 25 bp, Rattus norvegicus
aacctgctggcttcgactatgttgg

SEQ ID NO: 26233 - DNA, 25 bp, Rattus norvegicus
aacctgctgggtcctactgtgctca

SEQ ID NO: 26234 - DNA, 25 bp, Rattus norvegicus
aacctgctgggtgctactgtgctca

SEQ ID NO: 26235 - DNA, 25 bp, Rattus norvegicus
aacctgctggtcatcttccattggg

SEQ ID NO: 26236 - DNA, 25 bp, Rattus norvegicus
aacctgctggtcttcttccattggg

SEQ ID NO: 26237 - DNA, 25 bp, Rattus norvegicus
aacctgctgtggctttatatccctt

SEQ ID NO: 26238 - DNA, 25 bp, Rattus norvegicus
aacctgctgtgggtttatatccctt

SEQ ID NO: 26239 - DNA, 25 bp, Rattus norvegicus
aacctgctgtgtctaaactatcccc

SEQ ID NO: 26240 - DNA, 25 bp, Rattus norvegicus
aacctgctgtgtgtaaactatcccc

SEQ ID NO: 26241 - DNA, 25 bp, Rattus norvegicus
aacctgctgtttactccaattgtac

SEQ ID NO: 26242 - DNA, 25 bp, Rattus norvegicus
aacctgctgttttctccaattgtac

SEQ ID NO: 26243 - DNA, 25 bp, Rattus norvegicus
aacctgcttcagaatggaccccact

SEQ ID NO: 26244 - DNA, 25 bp, Rattus norvegicus
aacctgcttcagtatggaccccact

SEQ ID NO: 26245 - DNA, 25 bp, Rattus norvegicus
aacctgcttctgatggaggcgcgga

SEQ ID NO: 26246 - DNA, 25 bp, Rattus norvegicus
aacctgcttctgttggaggcgcgga

SEQ ID NO: 26247 - DNA, 25 bp, Rattus norvegicus
aacctgcttgaaatccttattgctt

SEQ ID NO: 26248 - DNA, 25 bp, Rattus norvegicus
aacctgcttgaattccttattgctt

SEQ ID NO: 26249 - DNA, 25 bp, Rattus norvegicus
aacctgcttggtctttgatgctgct

SEQ ID NO: 26250 - DNA, 25 bp, Rattus norvegicus
aacctgcttggtgtttgatgctgct

SEQ ID NO: 26251 - DNA, 25 bp, Rattus norvegicus
aacctgcttgtgaccattggcttag

SEQ ID NO: 26252 - DNA, 25 bp, Rattus norvegicus
aacctgcttgtgtccattggcttag

SEQ ID NO: 26253 - DNA, 25 bp, Rattus norvegicus
aacctgctttacagctacgttgctt

SEQ ID NO: 26254 - DNA, 25 bp, Rattus norvegicus
aacctgctttactgctacgttgctt

SEQ ID NO: 26255 - DNA, 25 bp, Rattus norvegicus
aacctggaagtgcaccagcgcacac

SEQ ID NO: 26256 - DNA, 25 bp, Rattus norvegicus
aacctggaagtggaccagcgcacac

SEQ ID NO: 26257 - DNA, 25 bp, Rattus norvegicus
aacctggacattagttccacctgac

SEQ ID NO: 26258 - DNA, 25 bp, Rattus norvegicus
aacctggacatttgttccacctgac

SEQ ID NO: 26259 - DNA, 25 bp, Rattus norvegicus
aacctggacgacagtaccgggtgat

SEQ ID NO: 26260 - DNA, 25 bp, Rattus norvegicus
aacctggacgactgtaccgggtgat

SEQ ID NO: 26261 - DNA, 25 bp, Rattus norvegicus
aacctggactataccttacattctc

SEQ ID NO: 26262 - DNA, 25 bp, Rattus norvegicus
aacctggactattccttacattctc

SEQ ID NO: 26263 - DNA, 25 bp, Rattus norvegicus
aacctggactgtaaggtgccttcac

SEQ ID NO: 26264 - DNA, 25 bp, Rattus norvegicus
aacctggactgttaggtgccttcac

SEQ ID NO: 26265 - DNA, 25 bp, Rattus norvegicus
aacctggagagcaagttcttgtggg

SEQ ID NO: 26266 - DNA, 25 bp, Rattus norvegicus
aacctggagagctagttcttgtggg

SEQ ID NO: 26267 - DNA, 25 bp, Rattus norvegicus
aacctggagtatatattgtctacac

SEQ ID NO: 26268 - DNA, 25 bp, Rattus norvegicus
aacctggagtatttattgtctacac

SEQ ID NO: 26269 - DNA, 25 bp, Rattus norvegicus
aacctggagttcctgggtctcatga

SEQ ID NO: 26270 - DNA, 25 bp, Rattus norvegicus
aacctggagttcgtgggtctcatga

SEQ ID NO: 26271 - DNA, 25 bp, Rattus norvegicus
aacctggatttgaagcttgcatact

SEQ ID NO: 26272 - DNA, 25 bp, Rattus norvegicus
aacctggatttgtagcttgcatact

SEQ ID NO: 26273 - DNA, 25 bp, Rattus norvegicus
aacctggcagacctagtcatgtttg

SEQ ID NO: 26274 - DNA, 25 bp, Rattus norvegicus
aacctggcagacgtagtcatgtttg

SEQ ID NO: 26275 - DNA, 25 bp, Rattus norvegicus
aacctggcctgcagaagtggctgaa

SEQ ID NO: 26276 - DNA, 25 bp, Rattus norvegicus
aacctggcctgctgaagtggctgaa

SEQ ID NO: 26277 - DNA, 25 bp, Rattus norvegicus
aacctggccttgcatactgagttct

SEQ ID NO: 26278 - DNA, 25 bp, Rattus norvegicus
aacctggccttggatactgagttct

SEQ ID NO: 26279 - DNA, 25 bp, Rattus norvegicus
aacctggcgtttctgtctgttcttg

SEQ ID NO: 26280 - DNA, 25 bp, Rattus norvegicus
aacctggcgtttgtgtctgttcttg

SEQ ID NO: 26281 - DNA, 25 bp, Rattus norvegicus
aacctggctaatacatatgctgaga

SEQ ID NO: 26282 - DNA, 25 bp, Rattus norvegicus
aacctggctaattcatatgctgaga

SEQ ID NO: 26283 - DNA, 25 bp, Rattus norvegicus
aacctgggacagagctctaagctca

SEQ ID NO: 26284 - DNA, 25 bp, Rattus norvegicus
aacctgggacagtgctctaagctca

SEQ ID NO: 26285 - DNA, 25 bp, Rattus norvegicus
aacctgggagcgctcctgtttccta

SEQ ID NO: 26286 - DNA, 25 bp, Rattus norvegicus
aacctgggagcggtcctgtttccta

SEQ ID NO: 26287 - DNA, 25 bp, Rattus norvegicus
aacctgggatcaagataaaccgttg

SEQ ID NO: 26288 - DNA, 25 bp, Rattus norvegicus
aacctgggatcatgataaaccgttg

SEQ ID NO: 26289 - DNA, 25 bp, Rattus norvegicus
aacctgggccacatgcagagtctgc

SEQ ID NO: 26290 - DNA, 25 bp, Rattus norvegicus
aacctgggccacttgcagagtctgc

SEQ ID NO: 26291 - DNA, 25 bp, Rattus norvegicus
aacctgggccagatccttgctagtg

SEQ ID NO: 26292 - DNA, 25 bp, Rattus norvegicus
aacctgggccagttccttgctagtg

SEQ ID NO: 26293 - DNA, 25 bp, Rattus norvegicus
aacctgggcctcagttacaggcaga

SEQ ID NO: 26294 - DNA, 25 bp, Rattus norvegicus
aacctgggcctctgttacaggcaga

SEQ ID NO: 26295 - DNA, 25 bp, Rattus norvegicus
aacctgggtgctattgccagtgggt

SEQ ID NO: 26296 - DNA, 25 bp, Rattus norvegicus
aacctgggtgcttttgccagtgggt

SEQ ID NO: 26297 - DNA, 25 bp, Rattus norvegicus
aacctgggtgtcacatctgtatgta

SEQ ID NO: 26298 - DNA, 25 bp, Rattus norvegicus
aacctgggtgtctcatctgtatgta

SEQ ID NO: 26299 - DNA, 25 bp, Rattus norvegicus
aacctgggttacagagtgagttcaa

SEQ ID NO: 26300 - DNA, 25 bp, Rattus norvegicus
aacctgggttactgagtgagttcaa

SEQ ID NO: 26301 - DNA, 25 bp, Rattus norvegicus
aacctggtattcagctcaaggccgt

SEQ ID NO: 26302 - DNA, 25 bp, Rattus norvegicus
aacctggtattctgctcaaggccgt

SEQ ID NO: 26303 - DNA, 25 bp, Rattus norvegicus
aacctggtccacactgctgggaggt

SEQ ID NO: 26304 - DNA, 25 bp, Rattus norvegicus
aacctggtccactctgctgggaggt

SEQ ID NO: 26305 - DNA, 25 bp, Rattus norvegicus
aacctggtcctcctgagacctattg

SEQ ID NO: 26306 - DNA, 25 bp, Rattus norvegicus
aacctggtcctcgtgagacctattg

SEQ ID NO: 26307 - DNA, 25 bp, Rattus norvegicus
aacctggtgcctcaggtatagccgt

SEQ ID NO: 26308 - DNA, 25 bp, Rattus norvegicus
aacctggtgcctgaggtatagccgt

SEQ ID NO: 26309 - DNA, 25 bp, Rattus norvegicus
aacctggtgctacggcctggacaag

SEQ ID NO: 26310 - DNA, 25 bp, Rattus norvegicus
aacctggtgctagggcctggacaag

SEQ ID NO: 26311 - DNA, 25 bp, Rattus norvegicus
aacctggtgtacacatgctttcatt

SEQ ID NO: 26312 - DNA, 25 bp, Rattus norvegicus
aacctggtgtactcatgctttcatt

SEQ ID NO: 26313 - DNA, 25 bp, Rattus norvegicus
aacctggttaatcatttcctcctgc

SEQ ID NO: 26314 - DNA, 25 bp, Rattus norvegicus
aacctggttaatgatttcctcctgc

SEQ ID NO: 26315 - DNA, 25 bp, Rattus norvegicus
aacctggttactacctggttgcagc

SEQ ID NO: 26316 - DNA, 25 bp, Rattus norvegicus
aacctggttacttcctggttgcagc

SEQ ID NO: 26317 - DNA, 25 bp, Rattus norvegicus
aacctggttctcactatatcctaag

SEQ ID NO: 26318 - DNA, 25 bp, Rattus norvegicus
aacctggttctctctatatcctaag

SEQ ID NO: 26319 - DNA, 25 bp, Rattus norvegicus
aacctggtttcacaagcttgcaccc

SEQ ID NO: 26320 - DNA, 25 bp, Rattus norvegicus
aacctggtttcagaagcttgcaccc

SEQ ID NO: 26321 - DNA, 25 bp, Rattus norvegicus
aacctgtaaggaatcatggataaac

SEQ ID NO: 26322 - DNA, 25 bp, Rattus norvegicus
aacctgtaaggattcatggataaac

SEQ ID NO: 26323 - DNA, 25 bp, Rattus norvegicus
aacctgtacggcagctcagagtgta

SEQ ID NO: 26324 - DNA, 25 bp, Rattus norvegicus
aacctgtacggctgctcagagtgta

SEQ ID NO: 26325 - DNA, 25 bp, Rattus norvegicus
aacctgtactttagtaatggcgaca

SEQ ID NO: 26326 - DNA, 25 bp, Rattus norvegicus
aacctgtacttttgtaatggcgaca

SEQ ID NO: 26327 - DNA, 25 bp, Rattus norvegicus
aacctgtaggatcccagaggccaga

SEQ ID NO: 26328 - DNA, 25 bp, Rattus norvegicus
aacctgtaggatgccagaggccaga

SEQ ID NO: 26329 - DNA, 25 bp, Rattus norvegicus
aacctgtaggttacgtttgagcctg

SEQ ID NO: 26330 - DNA, 25 bp, Rattus norvegicus
aacctgtaggtttcgtttgagcctg

SEQ ID NO: 26331 - DNA, 25 bp, Rattus norvegicus
aacctgtatcagagttcaatcctcc

SEQ ID NO: 26332 - DNA, 25 bp, Rattus norvegicus
aacctgtatcagtgttcaatcctcc

SEQ ID NO: 26333 - DNA, 25 bp, Rattus norvegicus
aacctgtatgttactgttctcaatg

SEQ ID NO: 26334 - DNA, 25 bp, Rattus norvegicus
aacctgtatgttagtgtcgttctct

SEQ ID NO: 26335 - DNA, 25 bp, Rattus norvegicus
aacctgtatgtttctgttctcaatg

SEQ ID NO: 26336 - DNA, 25 bp, Rattus norvegicus
aacctgtatgtttgtgtcgttctct

SEQ ID NO: 26337 - DNA, 25 bp, Rattus norvegicus
aacctgtcacccagatcatcagtta

SEQ ID NO: 26338 - DNA, 25 bp, Rattus norvegicus
aacctgtcaccctgatcatcagtta

SEQ ID NO: 26339 - DNA, 25 bp, Rattus norvegicus
aacctgtcagctattgtcatcgtaa

SEQ ID NO: 26340 - DNA, 25 bp, Rattus norvegicus
aacctgtcagctcttactcagactt

SEQ ID NO: 26341 - DNA, 25 bp, Rattus norvegicus
aacctgtcagctgttactcagactt

SEQ ID NO: 26342 - DNA, 25 bp, Rattus norvegicus
aacctgtcagcttttgtcatcgtaa

SEQ ID NO: 26343 - DNA, 25 bp, Rattus norvegicus
aacctgtccaggacttgtgcatgct

SEQ ID NO: 26344 - DNA, 25 bp, Rattus norvegicus
aacctgtccaggtcttgtgcatgct

SEQ ID NO: 26345 - DNA, 25 bp, Rattus norvegicus
aacctgtccagtcctgagcagactt

SEQ ID NO: 26346 - DNA, 25 bp, Rattus norvegicus
aacctgtccagtgctgagcagactt

SEQ ID NO: 26347 - DNA, 25 bp, Rattus norvegicus
aacctgtccccaccagcggcagcgg

SEQ ID NO: 26348 - DNA, 25 bp, Rattus norvegicus
aacctgtccccagcagcggcagcgg

SEQ ID NO: 26349 - DNA, 25 bp, Rattus norvegicus
aacctgtccctcagatttggatttg

SEQ ID NO: 26350 - DNA, 25 bp, Rattus norvegicus
aacctgtccctctgatttggatttg

SEQ ID NO: 26351 - DNA, 25 bp, Rattus norvegicus
aacctgtcctgcctaggagcaataa

SEQ ID NO: 26352 - DNA, 25 bp, Rattus norvegicus
aacctgtcctgcgtaggagcaataa

SEQ ID NO: 26353 - DNA, 25 bp, Rattus norvegicus
aacctgtcggtcactttcacgggca

SEQ ID NO: 26354 - DNA, 25 bp, Rattus norvegicus
aacctgtcggtctctttcacgggca

SEQ ID NO: 26355 - DNA, 25 bp, Rattus norvegicus
aacctgtcgtgtaagcgcacacttt

SEQ ID NO: 26356 - DNA, 25 bp, Rattus norvegicus
aacctgtcgtgttagcgcacacttt

SEQ ID NO: 26357 - DNA, 25 bp, Rattus norvegicus
aacctgtctgaccttatctatacct

SEQ ID NO: 26358 - DNA, 25 bp, Rattus norvegicus
aacctgtctgacgttatctatacct

SEQ ID NO: 26359 - DNA, 25 bp, Rattus norvegicus
aacctgtcttctctttagatttcct

SEQ ID NO: 26360 - DNA, 25 bp, Rattus norvegicus
aacctgtcttctgtttagatttcct

SEQ ID NO: 26361 - DNA, 25 bp, Rattus norvegicus
aacctgtgaagaacactgctgctgt

SEQ ID NO: 26362 - DNA, 25 bp, Rattus norvegicus
aacctgtgaagatcactgctgctgt

SEQ ID NO: 26363 - DNA, 25 bp, Rattus norvegicus
aacctgtgagccctctcctaagaga

SEQ ID NO: 26364 - DNA, 25 bp, Rattus norvegicus
aacctgtgagccgtctcctaagaga

SEQ ID NO: 26365 - DNA, 25 bp, Rattus norvegicus
aacctgtgaggtctcgtcagcagaa

SEQ ID NO: 26366 - DNA, 25 bp, Rattus norvegicus
aacctgtgaggtgtcgtcagcagaa

SEQ ID NO: 26367 - DNA, 25 bp, Rattus norvegicus
aacctgtgcttcagagtttgtggag

SEQ ID NO: 26368 - DNA, 25 bp, Rattus norvegicus
aacctgtgcttctgagtttgtggag

SEQ ID NO: 26369 - DNA, 25 bp, Rattus norvegicus
aacctgtggcatctagaagatctct

SEQ ID NO: 26370 - DNA, 25 bp, Rattus norvegicus
aacctgtggcatgtagaagatctct

SEQ ID NO: 26371 - DNA, 25 bp, Rattus norvegicus
aacctgtgggttcttgcctaggcca

SEQ ID NO: 26372 - DNA, 25 bp, Rattus norvegicus
aacctgtgggttgttgcctaggcca

SEQ ID NO: 26373 - DNA, 25 bp, Rattus norvegicus
aacctgtggtttctctagattggaa

SEQ ID NO: 26374 - DNA, 25 bp, Rattus norvegicus
aacctgtggtttgtctagattggaa

SEQ ID NO: 26375 - DNA, 25 bp, Rattus norvegicus
aacctgtgtaccagacagtctgata

SEQ ID NO: 26376 - DNA, 25 bp, Rattus norvegicus
aacctgtgtacctgacagtctgata

SEQ ID NO: 26377 - DNA, 25 bp, Rattus norvegicus
aacctgtgtatgcttatgcctgggc

SEQ ID NO: 26378 - DNA, 25 bp, Rattus norvegicus
aacctgtgtatggttatgcctgggc

SEQ ID NO: 26379 - DNA, 25 bp, Rattus norvegicus
aacctgtgtcgtctagtgtgagtga

SEQ ID NO: 26380 - DNA, 25 bp, Rattus norvegicus
aacctgtgtcgtgtagtgtgagtga

SEQ ID NO: 26381 - DNA, 25 bp, Rattus norvegicus
aacctgtgtggcaggtgatgcagta

SEQ ID NO: 26382 - DNA, 25 bp, Rattus norvegicus
aacctgtgtggctggtgatgcagta

SEQ ID NO: 26383 - DNA, 25 bp, Rattus norvegicus
aacctgtgtgggacaagacgccctg

SEQ ID NO: 26384 - DNA, 25 bp, Rattus norvegicus
aacctgtgtgggtcaagacgccctg

SEQ ID NO: 26385 - DNA, 25 bp, Rattus norvegicus
aacctgtgtggtaacgacaatttat

SEQ ID NO: 26386 - DNA, 25 bp, Rattus norvegicus
aacctgtgtggttacgacaatttat

SEQ ID NO: 26387 - DNA, 25 bp, Rattus norvegicus
aacctgtgtgtgagcggaaatccca

SEQ ID NO: 26388 - DNA, 25 bp, Rattus norvegicus
aacctgtgtgtgtgcggaaatccca

SEQ ID NO: 26389 - DNA, 25 bp, Rattus norvegicus
aacctgtgttctagaccctcagatg

SEQ ID NO: 26390 - DNA, 25 bp, Rattus norvegicus
aacctgtgttcttgaccctcagatg

SEQ ID NO: 26391 - DNA, 25 bp, Rattus norvegicus
aacctgttaatcagtgactgatcct

SEQ ID NO: 26392 - DNA, 25 bp, Rattus norvegicus
aacctgttaatctgtgactgatcct

SEQ ID NO: 26393 - DNA, 25 bp, Rattus norvegicus
aacctgttacatcggattcctggag

SEQ ID NO: 26394 - DNA, 25 bp, Rattus norvegicus
aacctgttacatgggattcctggag

SEQ ID NO: 26395 - DNA, 25 bp, Rattus norvegicus
aacctgttaggccttttgttgctgg

SEQ ID NO: 26396 - DNA, 25 bp, Rattus norvegicus
aacctgttaggcgttttgttgctgg

SEQ ID NO: 26397 - DNA, 25 bp, Rattus norvegicus
aacctgttcaatctgtgagtgcctg

SEQ ID NO: 26398 - DNA, 25 bp, Rattus norvegicus
aacctgttcaatgtgtgagtgcctg

SEQ ID NO: 26399 - DNA, 25 bp, Rattus norvegicus
aacctgttcggtcaacaagctctga

SEQ ID NO: 26400 - DNA, 25 bp, Rattus norvegicus
aacctgttcggtgaacaagctctga

SEQ ID NO: 26401 - DNA, 25 bp, Rattus norvegicus
aacctgttcgtgatgtagcctccaa

SEQ ID NO: 26402 - DNA, 25 bp, Rattus norvegicus
aacctgttcgtgttgtagcctccaa

SEQ ID NO: 26403 - DNA, 25 bp, Rattus norvegicus
aacctgttctccctgaaaaagactg

SEQ ID NO: 26404 - DNA, 25 bp, Rattus norvegicus
aacctgttctccgtgaaaaagactg

SEQ ID NO: 26405 - DNA, 25 bp, Rattus norvegicus
aacctgttctctagggacacttttg

SEQ ID NO: 26406 - DNA, 25 bp, Rattus norvegicus
aacctgttctcttgggacacttttg

SEQ ID NO: 26407 - DNA, 25 bp, Rattus norvegicus
aacctgttggccagtgtatgcacaa

SEQ ID NO: 26408 - DNA, 25 bp, Rattus norvegicus
aacctgttggcctgtgtatgcacaa

SEQ ID NO: 26409 - DNA, 25 bp, Rattus norvegicus
aacctgttgggcctgttgatttcca

SEQ ID NO: 26410 - DNA, 25 bp, Rattus norvegicus
aacctgttgggcgtgttgatttcca

SEQ ID NO: 26411 - DNA, 25 bp, Rattus norvegicus
aacctgttgtccaaccttctgagtg

SEQ ID NO: 26412 - DNA, 25 bp, Rattus norvegicus
aacctgttgtcctaccttctgagtg

SEQ ID NO: 26413 - DNA, 25 bp, Rattus norvegicus
aacctgttgtgtctttgcagaacct

SEQ ID NO: 26414 - DNA, 25 bp, Rattus norvegicus
aacctgttgtgtgtttgcagaacct

SEQ ID NO: 26415 - DNA, 25 bp, Rattus norvegicus
aacctgtttgctaccacttgtgatg

SEQ ID NO: 26416 - DNA, 25 bp, Rattus norvegicus
aacctgtttgcttccacttgtgatg

SEQ ID NO: 26417 - DNA, 25 bp, Rattus norvegicus
aacctgtttgtcacagtgtttcttg

SEQ ID NO: 26418 - DNA, 25 bp, Rattus norvegicus
aacctgtttgtctcagtgtttcttg

SEQ ID NO: 26419 - DNA, 25 bp, Rattus norvegicus
aacctgtttttaacttgtaccagat

SEQ ID NO: 26420 - DNA, 25 bp, Rattus norvegicus
aacctgtttttatcttgtaccagat

SEQ ID NO: 26421 - DNA, 25 bp, Rattus norvegicus
aaccttaaacacctatgcagtcctg

SEQ ID NO: 26422 - DNA, 25 bp, Rattus norvegicus
aaccttaaacacgtatgcagtcctg

SEQ ID NO: 26423 - DNA, 25 bp, Rattus norvegicus
aaccttaaatctccagcacatactg

SEQ ID NO: 26424 - DNA, 25 bp, Rattus norvegicus
aaccttaaatctgcagcacatactg

SEQ ID NO: 26425 - DNA, 25 bp, Rattus norvegicus
aaccttaaatgcactttccttcctg

SEQ ID NO: 26426 - DNA, 25 bp, Rattus norvegicus
aaccttaaatgctctttccttcctg

SEQ ID NO: 26427 - DNA, 25 bp, Rattus norvegicus
aaccttaacatcatacctgtggaca

SEQ ID NO: 26428 - DNA, 25 bp, Rattus norvegicus
aaccttaacatcttacctgtggaca

SEQ ID NO: 26429 - DNA, 25 bp, Rattus norvegicus
aaccttaaccttcctcttcagagac

SEQ ID NO: 26430 - DNA, 25 bp, Rattus norvegicus
aaccttaaccttgctcttcagagac

SEQ ID NO: 26431 - DNA, 25 bp, Rattus norvegicus
aaccttacataccatagctattctg

SEQ ID NO: 26432 - DNA, 25 bp, Rattus norvegicus
aaccttacatacgatagctattctg

SEQ ID NO: 26433 - DNA, 25 bp, Rattus norvegicus
aaccttacccaactgtgcgtgtgat

SEQ ID NO: 26434 - DNA, 25 bp, Rattus norvegicus
aaccttacccaagtgtgcgtgtgat

SEQ ID NO: 26435 - DNA, 25 bp, Rattus norvegicus
aaccttacgagtctagcgaatgcga

SEQ ID NO: 26436 - DNA, 25 bp, Rattus norvegicus
aaccttacgagtgtagcgaatgcga

SEQ ID NO: 26437 - DNA, 25 bp, Rattus norvegicus
aaccttagattcacctaggaccagg

SEQ ID NO: 26438 - DNA, 25 bp, Rattus norvegicus
aaccttagattctcctaggaccagg

SEQ ID NO: 26439 - DNA, 25 bp, Rattus norvegicus
aaccttagcctccagtctattcaat

SEQ ID NO: 26440 - DNA, 25 bp, Rattus norvegicus
aaccttagcctcgagtctattcaat

SEQ ID NO: 26441 - DNA, 25 bp, Rattus norvegicus
aaccttaggaccattcttgctgtaa

SEQ ID NO: 26442 - DNA, 25 bp, Rattus norvegicus
aaccttaggacctttcttgctgtaa

SEQ ID NO: 26443 - DNA, 25 bp, Rattus norvegicus
aaccttagggtgattccagactgga

SEQ ID NO: 26444 - DNA, 25 bp, Rattus norvegicus
aaccttagggtgtttccagactgga

SEQ ID NO: 26445 - DNA, 25 bp, Rattus norvegicus
aaccttaggtttctattgcttgtga

SEQ ID NO: 26446 - DNA, 25 bp, Rattus norvegicus
aaccttaggtttgtattgcttgtga

SEQ ID NO: 26447 - DNA, 25 bp, Rattus norvegicus
aaccttagtgtaaattgctgccagc

SEQ ID NO: 26448 - DNA, 25 bp, Rattus norvegicus
aaccttagtgtatattgctgccagc

SEQ ID NO: 26449 - DNA, 25 bp, Rattus norvegicus
aaccttagtttgctgtggattttca

SEQ ID NO: 26450 - DNA, 25 bp, Rattus norvegicus
aaccttagtttggtgtggattttca

SEQ ID NO: 26451 - DNA, 25 bp, Rattus norvegicus
aaccttatacatacagtcctcatca

SEQ ID NO: 26452 - DNA, 25 bp, Rattus norvegicus
aaccttatacattcagtcctcatca

SEQ ID NO: 26453 - DNA, 25 bp, Rattus norvegicus
aaccttatctggagcgatgctgctg

SEQ ID NO: 26454 - DNA, 25 bp, Rattus norvegicus
aaccttatctggtgcgatgctgctg

SEQ ID NO: 26455 - DNA, 25 bp, Rattus norvegicus
aaccttatgcttcctacgtacatgc

SEQ ID NO: 26456 - DNA, 25 bp, Rattus norvegicus
aaccttatgcttgctacgtacatgc

SEQ ID NO: 26457 - DNA, 25 bp, Rattus norvegicus
aaccttatttttagcatgtacttag

SEQ ID NO: 26458 - DNA, 25 bp, Rattus norvegicus
aaccttattttttgcatgtacttag

SEQ ID NO: 26459 - DNA, 25 bp, Rattus norvegicus
aaccttcaagccagcattatcttca

SEQ ID NO: 26460 - DNA, 25 bp, Rattus norvegicus
aaccttcaagcctgcattatcttca

SEQ ID NO: 26461 - DNA, 25 bp, Rattus norvegicus
aaccttcaatttcctattgtcaatg

SEQ ID NO: 26462 - DNA, 25 bp, Rattus norvegicus
aaccttcaatttgctattgtcaatg

SEQ ID NO: 26463 - DNA, 25 bp, Rattus norvegicus
aaccttcactgacgaggctgtggaa

SEQ ID NO: 26464 - DNA, 25 bp, Rattus norvegicus
aaccttcactgaggaggctgtggaa

SEQ ID NO: 26465 - DNA, 25 bp, Rattus norvegicus
aaccttcagtccattcctaagaaga

SEQ ID NO: 26466 - DNA, 25 bp, Rattus norvegicus
aaccttcagtcctttcctaagaaga

SEQ ID NO: 26467 - DNA, 25 bp, Rattus norvegicus
aaccttcagtgaaacagctggtgca

SEQ ID NO: 26468 - DNA, 25 bp, Rattus norvegicus
aaccttcagtgatacagctggtgca

SEQ ID NO: 26469 - DNA, 25 bp, Rattus norvegicus
aaccttcagtgcatgcaacaccaaa

SEQ ID NO: 26470 - DNA, 25 bp, Rattus norvegicus
aaccttcagtgcttgcaacaccaaa

SEQ ID NO: 26471 - DNA, 25 bp, Rattus norvegicus
aaccttcagtggagttggccagcag

SEQ ID NO: 26472 - DNA, 25 bp, Rattus norvegicus
aaccttcagtggtgttggccagcag

SEQ ID NO: 26473 - DNA, 25 bp, Rattus norvegicus
aaccttccaaggctgccaagctgta

SEQ ID NO: 26474 - DNA, 25 bp, Rattus norvegicus
aaccttccaagggtgccaagctgta

SEQ ID NO: 26475 - DNA, 25 bp, Rattus norvegicus
aaccttccagaacatgtgcttgccc

SEQ ID NO: 26476 - DNA, 25 bp, Rattus norvegicus
aaccttccagaagatgtgcttgccc

SEQ ID NO: 26477 - DNA, 25 bp, Rattus norvegicus
aaccttccagtcaggagcgactgca

SEQ ID NO: 26478 - DNA, 25 bp, Rattus norvegicus
aaccttccagtctggagcgactgca

SEQ ID NO: 26479 - DNA, 25 bp, Rattus norvegicus
aaccttccctgtcaattgagctgta

SEQ ID NO: 26480 - DNA, 25 bp, Rattus norvegicus
aaccttccctgtgaattgagctgta

SEQ ID NO: 26481 - DNA, 25 bp, Rattus norvegicus
aaccttccgattaccattggttatg

SEQ ID NO: 26482 - DNA, 25 bp, Rattus norvegicus
aaccttccgatttccattggttatg

SEQ ID NO: 26483 - DNA, 25 bp, Rattus norvegicus
aaccttcctataaagtttgtaggtg

SEQ ID NO: 26484 - DNA, 25 bp, Rattus norvegicus
aaccttcctatatagtttgtaggtg

SEQ ID NO: 26485 - DNA, 25 bp, Rattus norvegicus
aaccttcctcccatgtcaagtgaat

SEQ ID NO: 26486 - DNA, 25 bp, Rattus norvegicus
aaccttcctcccttgtcaagtgaat

SEQ ID NO: 26487 - DNA, 25 bp, Rattus norvegicus
aaccttcctgcaagcttcatttgtg

SEQ ID NO: 26488 - DNA, 25 bp, Rattus norvegicus
aaccttcctgcatgcttcatttgtg

SEQ ID NO: 26489 - DNA, 25 bp, Rattus norvegicus
aaccttcctggaagtcagagcactg

SEQ ID NO: 26490 - DNA, 25 bp, Rattus norvegicus
aaccttcctggatgtcagagcactg

SEQ ID NO: 26491 - DNA, 25 bp, Rattus norvegicus
aaccttcctgtccatctcagaagag

SEQ ID NO: 26492 - DNA, 25 bp, Rattus norvegicus
aaccttcctgtcgatctcagaagag

SEQ ID NO: 26493 - DNA, 25 bp, Rattus norvegicus
aaccttcgaaggacagttcagccaa

SEQ ID NO: 26494 - DNA, 25 bp, Rattus norvegicus
aaccttcgaaggtcagttcagccaa

SEQ ID NO: 26495 - DNA, 25 bp, Rattus norvegicus
aaccttcgaggcctgctcagcaatg

SEQ ID NO: 26496 - DNA, 25 bp, Rattus norvegicus
aaccttcgaggcgtgctcagcaatg

SEQ ID NO: 26497 - DNA, 25 bp, Rattus norvegicus
aaccttcggcagattaatttcttcg

SEQ ID NO: 26498 - DNA, 25 bp, Rattus norvegicus
aaccttcggcagtttaatttcttcg

SEQ ID NO: 26499 - DNA, 25 bp, Rattus norvegicus
aaccttcgggcacacaggcagcagt

SEQ ID NO: 26500 - DNA, 25 bp, Rattus norvegicus
aaccttcgggcagacaggcagcagt

SEQ ID NO: 26501 - DNA, 25 bp, Rattus norvegicus
aaccttctaaggagagctgagacta

SEQ ID NO: 26502 - DNA, 25 bp, Rattus norvegicus
aaccttctaaggtgagctgagacta

SEQ ID NO: 26503 - DNA, 25 bp, Rattus norvegicus
aaccttctacacagactctcaagag

SEQ ID NO: 26504 - DNA, 25 bp, Rattus norvegicus
aaccttctacactgactctcaagag

SEQ ID NO: 26505 - DNA, 25 bp, Rattus norvegicus
aaccttctcagcaactgtgtttgca

SEQ ID NO: 26506 - DNA, 25 bp, Rattus norvegicus
aaccttctcagctactgtgtttgca

SEQ ID NO: 26507 - DNA, 25 bp, Rattus norvegicus
aaccttctcattatgggttgcctgt

SEQ ID NO: 26508 - DNA, 25 bp, Rattus norvegicus
aaccttctcattttgggttgcctgt

SEQ ID NO: 26509 - DNA, 25 bp, Rattus norvegicus
aaccttctccgcaagggtcgcgacg

SEQ ID NO: 26510 - DNA, 25 bp, Rattus norvegicus
aaccttctccgctagggtcgcgacg

SEQ ID NO: 26511 - DNA, 25 bp, Rattus norvegicus
aaccttctctgaattgttccccaag

SEQ ID NO: 26512 - DNA, 25 bp, Rattus norvegicus
aaccttctctgatttgttccccaag

SEQ ID NO: 26513 - DNA, 25 bp, Rattus norvegicus
aaccttctctggaaagacattacta

SEQ ID NO: 26514 - DNA, 25 bp, Rattus norvegicus
aaccttctctggtaagacattacta

SEQ ID NO: 26515 - DNA, 25 bp, Rattus norvegicus
aaccttctctttcgctaagttggtg

SEQ ID NO: 26516 - DNA, 25 bp, Rattus norvegicus
aaccttctctttggctaagttggtg

SEQ ID NO: 26517 - DNA, 25 bp, Rattus norvegicus
aaccttctggaaccggagtcccaca

SEQ ID NO: 26518 - DNA, 25 bp, Rattus norvegicus
aaccttctggaagcggagtcccaca

SEQ ID NO: 26519 - DNA, 25 bp, Rattus norvegicus
aaccttctggtcaacctggatgaga

SEQ ID NO: 26520 - DNA, 25 bp, Rattus norvegicus
aaccttctggtctacctggatgaga

SEQ ID NO: 26521 - DNA, 25 bp, Rattus norvegicus
aaccttctgttaattattagggctg

SEQ ID NO: 26522 - DNA, 25 bp, Rattus norvegicus
aaccttctgttatttattagggctg

SEQ ID NO: 26523 - DNA, 25 bp, Rattus norvegicus
aaccttcttacaatgagagcacccc

SEQ ID NO: 26524 - DNA, 25 bp, Rattus norvegicus
aaccttcttacattgagagcacccc

SEQ ID NO: 26525 - DNA, 25 bp, Rattus norvegicus
aaccttcttcacatttgtgtccttg

SEQ ID NO: 26526 - DNA, 25 bp, Rattus norvegicus
aaccttcttcacttttgtgtccttg

SEQ ID NO: 26527 - DNA, 25 bp, Rattus norvegicus
aaccttcttgttagtaagcatctat

SEQ ID NO: 26528 - DNA, 25 bp, Rattus norvegicus
aaccttcttgtttgtaagcatctat

SEQ ID NO: 26529 - DNA, 25 bp, Rattus norvegicus
aaccttgaccctatggactggagat

SEQ ID NO: 26530 - DNA, 25 bp, Rattus norvegicus
aaccttgaccctttggactggagat

SEQ ID NO: 26531 - DNA, 25 bp, Rattus norvegicus
aaccttgactccaggatcatcttaa

SEQ ID NO: 26532 - DNA, 25 bp, Rattus norvegicus
aaccttgactcctggatcatcttaa

SEQ ID NO: 26533 - DNA, 25 bp, Rattus norvegicus
aaccttgagagtcagctttctgccc

SEQ ID NO: 26534 - DNA, 25 bp, Rattus norvegicus
aaccttgagagtgagctttctgccc

SEQ ID NO: 26535 - DNA, 25 bp, Rattus norvegicus
aaccttgagatcctgctccaggctg

SEQ ID NO: 26536 - DNA, 25 bp, Rattus norvegicus
aaccttgagatcgtgctccaggctg

SEQ ID NO: 26537 - DNA, 25 bp, Rattus norvegicus
aaccttgaggttctcagggccaggc

SEQ ID NO: 26538 - DNA, 25 bp, Rattus norvegicus
aaccttgaggttgtcagggccaggc

SEQ ID NO: 26539 - DNA, 25 bp, Rattus norvegicus
aaccttgagtatcactccagcatga

SEQ ID NO: 26540 - DNA, 25 bp, Rattus norvegicus
aaccttgagtatgactccagcatga

SEQ ID NO: 26541 - DNA, 25 bp, Rattus norvegicus
aaccttgataccaatctccttttct

SEQ ID NO: 26542 - DNA, 25 bp, Rattus norvegicus
aaccttgatacctatctccttttct

SEQ ID NO: 26543 - DNA, 25 bp, Rattus norvegicus
aaccttgatggcatccagatctgta

SEQ ID NO: 26544 - DNA, 25 bp, Rattus norvegicus
aaccttgatggcttccagatctgta

SEQ ID NO: 26545 - DNA, 25 bp, Rattus norvegicus
aaccttgatgttattgaccctcatg

SEQ ID NO: 26546 - DNA, 25 bp, Rattus norvegicus
aaccttgatgtttttgaccctcatg

SEQ ID NO: 26547 - DNA, 25 bp, Rattus norvegicus
aaccttgcagcgacattcagtgtgt

SEQ ID NO: 26548 - DNA, 25 bp, Rattus norvegicus
aaccttgcagcgtcattcagtgtgt

SEQ ID NO: 26549 - DNA, 25 bp, Rattus norvegicus
aaccttgcatttagtacgcttgcca

SEQ ID NO: 26550 - DNA, 25 bp, Rattus norvegicus
aaccttgcattttgtacgcttgcca

SEQ ID NO: 26551 - DNA, 25 bp, Rattus norvegicus
aaccttgccgttatgaaactcagtg

SEQ ID NO: 26552 - DNA, 25 bp, Rattus norvegicus
aaccttgccgttttgaaactcagtg

SEQ ID NO: 26553 - DNA, 25 bp, Rattus norvegicus
aaccttgcggtcactctttatctaa

SEQ ID NO: 26554 - DNA, 25 bp, Rattus norvegicus
aaccttgcggtctctctttatctaa

SEQ ID NO: 26555 - DNA, 25 bp, Rattus norvegicus
aaccttgctagccacactcaagctg

SEQ ID NO: 26556 - DNA, 25 bp, Rattus norvegicus
aaccttgctagcgacactcaagctg

SEQ ID NO: 26557 - DNA, 25 bp, Rattus norvegicus
aaccttgcttgtatcgttgagccac

SEQ ID NO: 26558 - DNA, 25 bp, Rattus norvegicus
aaccttgcttgtttcgttgagccac

SEQ ID NO: 26559 - DNA, 25 bp, Rattus norvegicus
aaccttggaagcactttgtctgcac

SEQ ID NO: 26560 - DNA, 25 bp, Rattus norvegicus
aaccttggaagctctttgtctgcac

SEQ ID NO: 26561 - DNA, 25 bp, Rattus norvegicus
aaccttggacgcacatcattgattt

SEQ ID NO: 26562 - DNA, 25 bp, Rattus norvegicus
aaccttggacgctcatcattgattt

SEQ ID NO: 26563 - DNA, 25 bp, Rattus norvegicus
aaccttggaggacttgtattttctg

SEQ ID NO: 26564 - DNA, 25 bp, Rattus norvegicus
aaccttggaggagttgtattttctg

SEQ ID NO: 26565 - DNA, 25 bp, Rattus norvegicus
aaccttggaggtatctgtcatctgc

SEQ ID NO: 26566 - DNA, 25 bp, Rattus norvegicus
aaccttggaggtttctgtcatctgc

SEQ ID NO: 26567 - DNA, 25 bp, Rattus norvegicus
aaccttggatacctctagtctacag

SEQ ID NO: 26568 - DNA, 25 bp, Rattus norvegicus
aaccttggatacgtctagtctacag

SEQ ID NO: 26569 - DNA, 25 bp, Rattus norvegicus
aaccttggatgacttgatcatggca

SEQ ID NO: 26570 - DNA, 25 bp, Rattus norvegicus
aaccttggatgagttgatcatggca

SEQ ID NO: 26571 - DNA, 25 bp, Rattus norvegicus
aaccttggcgagatggtggcccagc

SEQ ID NO: 26572 - DNA, 25 bp, Rattus norvegicus
aaccttggcgagttggtggcccagc

SEQ ID NO: 26573 - DNA, 25 bp, Rattus norvegicus
aaccttggcttaaccagatcatctg

SEQ ID NO: 26574 - DNA, 25 bp, Rattus norvegicus
aaccttggcttatccagatcatctg

SEQ ID NO: 26575 - DNA, 25 bp, Rattus norvegicus
aaccttgggaacaggtatatctcaa

SEQ ID NO: 26576 - DNA, 25 bp, Rattus norvegicus
aaccttgggaactggtatatctcaa

SEQ ID NO: 26577 - DNA, 25 bp, Rattus norvegicus
aaccttgggactagtctctaagact

SEQ ID NO: 26578 - DNA, 25 bp, Rattus norvegicus
aaccttgggacttgtctctaagact

SEQ ID NO: 26579 - DNA, 25 bp, Rattus norvegicus
aaccttgggcaaacgtagctggctg

SEQ ID NO: 26580 - DNA, 25 bp, Rattus norvegicus
aaccttgggcaatcgtagctggctg

SEQ ID NO: 26581 - DNA, 25 bp, Rattus norvegicus
aaccttggtgcacagttcgtttaag

SEQ ID NO: 26582 - DNA, 25 bp, Rattus norvegicus
aaccttggtgcagagttcgtttaag

SEQ ID NO: 26583 - DNA, 25 bp, Rattus norvegicus
aaccttggtgccacttaggcttaag

SEQ ID NO: 26584 - DNA, 25 bp, Rattus norvegicus
aaccttggtgcctcttaggcttaag

SEQ ID NO: 26585 - DNA, 25 bp, Rattus norvegicus
aaccttggttctcaaatctgcttac

SEQ ID NO: 26586 - DNA, 25 bp, Rattus norvegicus
aaccttggttctgaaatctgcttac

SEQ ID NO: 26587 - DNA, 25 bp, Rattus norvegicus
aaccttgtaagactgcaaaccctga

SEQ ID NO: 26588 - DNA, 25 bp, Rattus norvegicus
aaccttgtaagagtgcaaaccctga

SEQ ID NO: 26589 - DNA, 25 bp, Rattus norvegicus
aaccttgtcaaacctctggtggcaa

SEQ ID NO: 26590 - DNA, 25 bp, Rattus norvegicus
aaccttgtcaaagctctggtggcaa

SEQ ID NO: 26591 - DNA, 25 bp, Rattus norvegicus
aaccttgtcatcaagttcacagtgg

SEQ ID NO: 26592 - DNA, 25 bp, Rattus norvegicus
aaccttgtcatctagttcacagtgg

SEQ ID NO: 26593 - DNA, 25 bp, Rattus norvegicus
aaccttgtgacacggcatgctctgt

SEQ ID NO: 26594 - DNA, 25 bp, Rattus norvegicus
aaccttgtgacagggcatgctctgt

SEQ ID NO: 26595 - DNA, 25 bp, Rattus norvegicus
aaccttgtgctgagattttccttta

SEQ ID NO: 26596 - DNA, 25 bp, Rattus norvegicus
aaccttgtgctgtgattttccttta

SEQ ID NO: 26597 - DNA, 25 bp, Rattus norvegicus
aaccttgtggaaagctcacttgtgt

SEQ ID NO: 26598 - DNA, 25 bp, Rattus norvegicus
aaccttgtggaatgctcacttgtgt

SEQ ID NO: 26599 - DNA, 25 bp, Rattus norvegicus
aaccttgtggatcgcttctaggaca

SEQ ID NO: 26600 - DNA, 25 bp, Rattus norvegicus
aaccttgtggatggcttctaggaca

SEQ ID NO: 26601 - DNA, 25 bp, Rattus norvegicus
aaccttgtgggcaatcttggcattg

SEQ ID NO: 26602 - DNA, 25 bp, Rattus norvegicus
aaccttgtgggctatcttggcattg

SEQ ID NO: 26603 - DNA, 25 bp, Rattus norvegicus
aaccttgtggtcaacatccagccag

SEQ ID NO: 26604 - DNA, 25 bp, Rattus norvegicus
aaccttgtggtctacatccagccag

SEQ ID NO: 26605 - DNA, 25 bp, Rattus norvegicus
aaccttgttatcaattctgaggctg

SEQ ID NO: 26606 - DNA, 25 bp, Rattus norvegicus
aaccttgttatctattctgaggctg

SEQ ID NO: 26607 - DNA, 25 bp, Rattus norvegicus
aaccttgttctcaacagtgttccag

SEQ ID NO: 26608 - DNA, 25 bp, Rattus norvegicus
aaccttgttctctacagtgttccag

SEQ ID NO: 26609 - DNA, 25 bp, Rattus norvegicus
aaccttgtttatcccaagagctggg

SEQ ID NO: 26610 - DNA, 25 bp, Rattus norvegicus
aaccttgtttatgccaagagctggg

SEQ ID NO: 26611 - DNA, 25 bp, Rattus norvegicus
aaccttgtttctctaagcattaaga

SEQ ID NO: 26612 - DNA, 25 bp, Rattus norvegicus
aaccttgtttctgtaagcattaaga

SEQ ID NO: 26613 - DNA, 25 bp, Rattus norvegicus
aaccttgttttcagagagtgcttca

SEQ ID NO: 26614 - DNA, 25 bp, Rattus norvegicus
aaccttgttttctgagagtgcttca

SEQ ID NO: 26615 - DNA, 25 bp, Rattus norvegicus
aacctttaaggtagacatgggctca

SEQ ID NO: 26616 - DNA, 25 bp, Rattus norvegicus
aacctttaaggttgacatgggctca

SEQ ID NO: 26617 - DNA, 25 bp, Rattus norvegicus
aacctttacagactggagctggact

SEQ ID NO: 26618 - DNA, 25 bp, Rattus norvegicus
aacctttacagagtggagctggact

SEQ ID NO: 26619 - DNA, 25 bp, Rattus norvegicus
aacctttacatgatcatgagaggtc

SEQ ID NO: 26620 - DNA, 25 bp, Rattus norvegicus
aacctttacatgttcatgagaggtc

SEQ ID NO: 26621 - DNA, 25 bp, Rattus norvegicus
aacctttacgcactttccaagtcag

SEQ ID NO: 26622 - DNA, 25 bp, Rattus norvegicus
aacctttacgcagtttccaagtcag

SEQ ID NO: 26623 - DNA, 25 bp, Rattus norvegicus
aacctttactggaactggcaggctc

SEQ ID NO: 26624 - DNA, 25 bp, Rattus norvegicus
aacctttactggtactggcaggctc

SEQ ID NO: 26625 - DNA, 25 bp, Rattus norvegicus
aacctttagacgacaaattgcacaa

SEQ ID NO: 26626 - DNA, 25 bp, Rattus norvegicus
aacctttagacgtcaaattgcacaa

SEQ ID NO: 26627 - DNA, 25 bp, Rattus norvegicus
aacctttatatcatctactgctacc

SEQ ID NO: 26628 - DNA, 25 bp, Rattus norvegicus
aacctttatatcttctactgctacc

SEQ ID NO: 26629 - DNA, 25 bp, Rattus norvegicus
aacctttatgttccttcggatgatc

SEQ ID NO: 26630 - DNA, 25 bp, Rattus norvegicus
aacctttatgttgcttcggatgatc

SEQ ID NO: 26631 - DNA, 25 bp, Rattus norvegicus
aacctttattaactgactggctggg

SEQ ID NO: 26632 - DNA, 25 bp, Rattus norvegicus
aacctttattaagtgactggctggg

SEQ ID NO: 26633 - DNA, 25 bp, Rattus norvegicus
aacctttcaaaaagtattcagtggc

SEQ ID NO: 26634 - DNA, 25 bp, Rattus norvegicus
aacctttcaaaatgtattcagtggc

SEQ ID NO: 26635 - DNA, 25 bp, Rattus norvegicus
aacctttcaagaagtcatactcctg

SEQ ID NO: 26636 - DNA, 25 bp, Rattus norvegicus
aacctttcaagatgtcatactcctg

SEQ ID NO: 26637 - DNA, 25 bp, Rattus norvegicus
aacctttcacccagctgcgggatga

SEQ ID NO: 26638 - DNA, 25 bp, Rattus norvegicus
aacctttcaccctgctgcgggatga

SEQ ID NO: 26639 - DNA, 25 bp, Rattus norvegicus
aacctttcacttattactgctggct

SEQ ID NO: 26640 - DNA, 25 bp, Rattus norvegicus
aacctttcactttttactgctggct

SEQ ID NO: 26641 - DNA, 25 bp, Rattus norvegicus
aacctttcagtcacgcttttgtagc

SEQ ID NO: 26642 - DNA, 25 bp, Rattus norvegicus
aacctttcagtctcgcttttgtagc

SEQ ID NO: 26643 - DNA, 25 bp, Rattus norvegicus
aacctttcatgaaattcccgtggcc

SEQ ID NO: 26644 - DNA, 25 bp, Rattus norvegicus
aacctttcatgatattcccgtggcc

SEQ ID NO: 26645 - DNA, 25 bp, Rattus norvegicus
aacctttcattcatcaggactcaaa

SEQ ID NO: 26646 - DNA, 25 bp, Rattus norvegicus
aacctttcattcttcaggactcaaa

SEQ ID NO: 26647 - DNA, 25 bp, Rattus norvegicus
aacctttcattgaataccttgggca

SEQ ID NO: 26648 - DNA, 25 bp, Rattus norvegicus
aacctttcattgtataccttgggca

SEQ ID NO: 26649 - DNA, 25 bp, Rattus norvegicus
aacctttcctctatagccaactgat

SEQ ID NO: 26650 - DNA, 25 bp, Rattus norvegicus
aacctttcctctttagccaactgat

SEQ ID NO: 26651 - DNA, 25 bp, Rattus norvegicus
aacctttctcttccatatgactatc

SEQ ID NO: 26652 - DNA, 25 bp, Rattus norvegicus
aacctttctcttgcatatgactatc

SEQ ID NO: 26653 - DNA, 25 bp, Rattus norvegicus
aacctttctgataggctggaagcca

SEQ ID NO: 26654 - DNA, 25 bp, Rattus norvegicus
aacctttctgattggctggaagcca

SEQ ID NO: 26655 - DNA, 25 bp, Rattus norvegicus
aacctttggcagaacagcaagctcc

SEQ ID NO: 26656 - DNA, 25 bp, Rattus norvegicus
aacctttggcagtacagcaagctcc

SEQ ID NO: 26657 - DNA, 25 bp, Rattus norvegicus
aacctttgtaccaaactatctgcta

SEQ ID NO: 26658 - DNA, 25 bp, Rattus norvegicus
aacctttgtacctaactatctgcta

SEQ ID NO: 26659 - DNA, 25 bp, Rattus norvegicus
aacctttgtagtcgcaggcttccgg

SEQ ID NO: 26660 - DNA, 25 bp, Rattus norvegicus
aacctttgtagtggcaggcttccgg

SEQ ID NO: 26661 - DNA, 25 bp, Rattus norvegicus
aacctttgtgacaattcttgctcta

SEQ ID NO: 26662 - DNA, 25 bp, Rattus norvegicus
aacctttgtgactattcttgctcta

SEQ ID NO: 26663 - DNA, 25 bp, Rattus norvegicus
aacctttgtgtgcttttatgtgtca

SEQ ID NO: 26664 - DNA, 25 bp, Rattus norvegicus
aacctttgtgtggttttatgtgtca

SEQ ID NO: 26665 - DNA, 25 bp, Rattus norvegicus
aacctttgtttgctaagtgtcttca

SEQ ID NO: 26666 - DNA, 25 bp, Rattus norvegicus
aacctttgtttggtaagtgtcttca

SEQ ID NO: 26667 - DNA, 25 bp, Rattus norvegicus
aaccttttaaagactggcaattgtg

SEQ ID NO: 26668 - DNA, 25 bp, Rattus norvegicus
aaccttttaaagtctggcaattgtg

SEQ ID NO: 26669 - DNA, 25 bp, Rattus norvegicus
aaccttttaataattctccatgaca

SEQ ID NO: 26670 - DNA, 25 bp, Rattus norvegicus
aaccttttaatatttctccatgaca

SEQ ID NO: 26671 - DNA, 25 bp, Rattus norvegicus
aaccttttgaatctagggcgtgcaa

SEQ ID NO: 26672 - DNA, 25 bp, Rattus norvegicus
aaccttttgaatgtagggcgtgcaa

SEQ ID NO: 26673 - DNA, 25 bp, Rattus norvegicus
aaccttttgtgtatactcttatgta

SEQ ID NO: 26674 - DNA, 25 bp, Rattus norvegicus
aaccttttgtgtcccatgtctgcag

SEQ ID NO: 26675 - DNA, 25 bp, Rattus norvegicus
aaccttttgtgtgccatgtctgcag

SEQ ID NO: 26676 - DNA, 25 bp, Rattus norvegicus
aaccttttgtgtttactcttatgta

SEQ ID NO: 26677 - DNA, 25 bp, Rattus norvegicus
aacctttttatcaagctgggcagtg

SEQ ID NO: 26678 - DNA, 25 bp, Rattus norvegicus
aacctttttatctagctgggcagtg

SEQ ID NO: 26679 - DNA, 25 bp, Rattus norvegicus
aacctttttccgatcctgttctgat

SEQ ID NO: 26680 - DNA, 25 bp, Rattus norvegicus
aacctttttccgttcctgttctgat

SEQ ID NO: 26681 - DNA, 25 bp, Rattus norvegicus
aacgaaaacgctcgttagcaccgca

SEQ ID NO: 26682 - DNA, 25 bp, Rattus norvegicus
aacgaaaacgctggttagcaccgca

SEQ ID NO: 26683 - DNA, 25 bp, Rattus norvegicus
aacgaaacctgcctccaacgtgtga

SEQ ID NO: 26684 - DNA, 25 bp, Rattus norvegicus
aacgaaacctgcgtccaacgtgtga

SEQ ID NO: 26685 - DNA, 25 bp, Rattus norvegicus
aacgaaatctgtaggagttccgcgc

SEQ ID NO: 26686 - DNA, 25 bp, Rattus norvegicus
aacgaaatctgttggagttccgcgc

SEQ ID NO: 26687 - DNA, 25 bp, Rattus norvegicus
aacgaacaccgccaagacaagtcca

SEQ ID NO: 26688 - DNA, 25 bp, Rattus norvegicus
aacgaacaccgcgaagacaagtcca

SEQ ID NO: 26689 - DNA, 25 bp, Rattus norvegicus
aacgaacaggcgctggcatctggcc

SEQ ID NO: 26690 - DNA, 25 bp, Rattus norvegicus
aacgaacaggcggtggcatctggcc

SEQ ID NO: 26691 - DNA, 25 bp, Rattus norvegicus
aacgaaccaggaatgcacgcaacgc

SEQ ID NO: 26692 - DNA, 25 bp, Rattus norvegicus
aacgaaccaggattgcacgcaacgc

SEQ ID NO: 26693 - DNA, 25 bp, Rattus norvegicus
aacgaaccttgtatactcagctgta

SEQ ID NO: 26694 - DNA, 25 bp, Rattus norvegicus
aacgaaccttgtttactcagctgta

SEQ ID NO: 26695 - DNA, 25 bp, Rattus norvegicus
aacgaactcttgagtctacttttat

SEQ ID NO: 26696 - DNA, 25 bp, Rattus norvegicus
aacgaactcttgtgtctacttttat

SEQ ID NO: 26697 - DNA, 25 bp, Rattus norvegicus
aacgaactgcgtaatggagtccctc

SEQ ID NO: 26698 - DNA, 25 bp, Rattus norvegicus
aacgaactgcgttatggagtccctc

SEQ ID NO: 26699 - DNA, 25 bp, Rattus norvegicus
aacgaagacagacctggctggccga

SEQ ID NO: 26700 - DNA, 25 bp, Rattus norvegicus
aacgaagacagagctggctggccga

SEQ ID NO: 26701 - DNA, 25 bp, Rattus norvegicus
aacgaagactgtaccataccctatg

SEQ ID NO: 26702 - DNA, 25 bp, Rattus norvegicus
aacgaagactgttccataccctatg

SEQ ID NO: 26703 - DNA, 25 bp, Rattus norvegicus
aacgaagaggctcgacacatctaaa

SEQ ID NO: 26704 - DNA, 25 bp, Rattus norvegicus
aacgaagaggctggacacatctaaa

SEQ ID NO: 26705 - DNA, 25 bp, Rattus norvegicus
aacgaagccactcttttgacatggg

SEQ ID NO: 26706 - DNA, 25 bp, Rattus norvegicus
aacgaagccactgttttgacatggg

SEQ ID NO: 26707 - DNA, 25 bp, Rattus norvegicus
aacgaagcctggattctctgtggtt

SEQ ID NO: 26708 - DNA, 25 bp, Rattus norvegicus
aacgaagcctggtttctctgtggtt

SEQ ID NO: 26709 - DNA, 25 bp, Rattus norvegicus
aacgaagcgtacaggatcgcgccca

SEQ ID NO: 26710 - DNA, 25 bp, Rattus norvegicus
aacgaagcgtactggatcgcgccca

SEQ ID NO: 26711 - DNA, 25 bp, Rattus norvegicus
aacgaagtacctcgcaccacctggt

SEQ ID NO: 26712 - DNA, 25 bp, Rattus norvegicus
aacgaagtacctggcaccacctggt

SEQ ID NO: 26713 - DNA, 25 bp, Rattus norvegicus
aacgaagtccagaagagtgtgccag

SEQ ID NO: 26714 - DNA, 25 bp, Rattus norvegicus
aacgaagtccagtagagtgtgccag

SEQ ID NO: 26715 - DNA, 25 bp, Rattus norvegicus
aacgaagtcgcgctgctccggagcc

SEQ ID NO: 26716 - DNA, 25 bp, Rattus norvegicus
aacgaagtcgcggtgctccggagcc

SEQ ID NO: 26717 - DNA, 25 bp, Rattus norvegicus
aacgaagtgcgtcgtgttggctccc

SEQ ID NO: 26718 - DNA, 25 bp, Rattus norvegicus
aacgaagtgcgtggtgttggctccc

SEQ ID NO: 26719 - DNA, 25 bp, Rattus norvegicus
aacgaagtggtcaagttctctgcct

SEQ ID NO: 26720 - DNA, 25 bp, Rattus norvegicus
aacgaagtggtctagttctctgcct

SEQ ID NO: 26721 - DNA, 25 bp, Rattus norvegicus
aacgaatccttcctcacttaagttg

SEQ ID NO: 26722 - DNA, 25 bp, Rattus norvegicus
aacgaatccttcgtcacttaagttg

SEQ ID NO: 26723 - DNA, 25 bp, Rattus norvegicus
aacgaatgcgttagaccgggatatc

SEQ ID NO: 26724 - DNA, 25 bp, Rattus norvegicus
aacgaatgcgtttgaccgggatatc

SEQ ID NO: 26725 - DNA, 25 bp, Rattus norvegicus
aacgaatgtaagatcctgggctgct

SEQ ID NO: 26726 - DNA, 25 bp, Rattus norvegicus
aacgaatgtaagttcctgggctgct

SEQ ID NO: 26727 - DNA, 25 bp, Rattus norvegicus
aacgacaactcgagtggcctcttat

SEQ ID NO: 26728 - DNA, 25 bp, Rattus norvegicus
aacgacaactcgtgtggcctcttat

SEQ ID NO: 26729 - DNA, 25 bp, Rattus norvegicus
aacgacaatgccattgcactggtgc

SEQ ID NO: 26730 - DNA, 25 bp, Rattus norvegicus
aacgacaatgcctttgcactggtgc

SEQ ID NO: 26731 - DNA, 25 bp, Rattus norvegicus
aacgacacctgactgtggttctaca

SEQ ID NO: 26732 - DNA, 25 bp, Rattus norvegicus
aacgacacctgagtgtggttctaca

SEQ ID NO: 26733 - DNA, 25 bp, Rattus norvegicus
aacgacacgtttccattggaaattt

SEQ ID NO: 26734 - DNA, 25 bp, Rattus norvegicus
aacgacacgtttgcattggaaattt

SEQ ID NO: 26735 - DNA, 25 bp, Rattus norvegicus
aacgacagagggagtgggccccaca

SEQ ID NO: 26736 - DNA, 25 bp, Rattus norvegicus
aacgacagagggtgtgggccccaca

SEQ ID NO: 26737 - DNA, 25 bp, Rattus norvegicus
aacgacagtctgagcgatttctctt

SEQ ID NO: 26738 - DNA, 25 bp, Rattus norvegicus
aacgacagtctgtgcgatttctctt

SEQ ID NO: 26739 - DNA, 25 bp, Rattus norvegicus
aacgacatcgacaccatgctgactg

SEQ ID NO: 26740 - DNA, 25 bp, Rattus norvegicus
aacgacatcgactccatgctgactg

SEQ ID NO: 26741 - DNA, 25 bp, Rattus norvegicus
aacgacatggagacgatctacccct

SEQ ID NO: 26742 - DNA, 25 bp, Rattus norvegicus
aacgacatggagtcgatctacccct

SEQ ID NO: 26743 - DNA, 25 bp, Rattus norvegicus
aacgacattctgaaactgccttaca

SEQ ID NO: 26744 - DNA, 25 bp, Rattus norvegicus
aacgacattctgtaactgccttaca

SEQ ID NO: 26745 - DNA, 25 bp, Rattus norvegicus
aacgacattgaccagtcatccccag

SEQ ID NO: 26746 - DNA, 25 bp, Rattus norvegicus
aacgacattgacgagtcatccccag

SEQ ID NO: 26747 - DNA, 25 bp, Rattus norvegicus
aacgacatttctaaatctcctagga

SEQ ID NO: 26748 - DNA, 25 bp, Rattus norvegicus
aacgacatttcttaatctcctagga

SEQ ID NO: 26749 - DNA, 25 bp, Rattus norvegicus
aacgaccaacttctgttattgtgtg

SEQ ID NO: 26750 - DNA, 25 bp, Rattus norvegicus
aacgaccaacttgtgttattgtgtg

SEQ ID NO: 26751 - DNA, 25 bp, Rattus norvegicus
aacgaccaagttactgagatctaga

SEQ ID NO: 26752 - DNA, 25 bp, Rattus norvegicus
aacgaccaagtttctgagatctaga

SEQ ID NO: 26753 - DNA, 25 bp, Rattus norvegicus
aacgaccagattaggtggccagcca

SEQ ID NO: 26754 - DNA, 25 bp, Rattus norvegicus
aacgaccagatttggtggccagcca

SEQ ID NO: 26755 - DNA, 25 bp, Rattus norvegicus
aacgacccattaacagagctgtcca

SEQ ID NO: 26756 - DNA, 25 bp, Rattus norvegicus
aacgacccattatcagagctgtcca

SEQ ID NO: 26757 - DNA, 25 bp, Rattus norvegicus
aacgaccccacccaggatgagatgt

SEQ ID NO: 26758 - DNA, 25 bp, Rattus norvegicus
aacgaccccaccgaggatgagatgt

SEQ ID NO: 26759 - DNA, 25 bp, Rattus norvegicus
aacgaccctgctctagatgccttag

SEQ ID NO: 26760 - DNA, 25 bp, Rattus norvegicus
aacgaccctgctgtagatgccttag

SEQ ID NO: 26761 - DNA, 25 bp, Rattus norvegicus
aacgacctcagaaaacttcataagt

SEQ ID NO: 26762 - DNA, 25 bp, Rattus norvegicus
aacgacctcagataacttcataagt

SEQ ID NO: 26763 - DNA, 25 bp, Rattus norvegicus
aacgacctcccgctgcacttgaagg

SEQ ID NO: 26764 - DNA, 25 bp, Rattus norvegicus
aacgacctcccggtgcacttgaagg

SEQ ID NO: 26765 - DNA, 25 bp, Rattus norvegicus
aacgacctctatcccactgtgaaag

SEQ ID NO: 26766 - DNA, 25 bp, Rattus norvegicus
aacgacctctatgccactgtgaaag

SEQ ID NO: 26767 - DNA, 25 bp, Rattus norvegicus
aacgacctgaagatctttccacatg

SEQ ID NO: 26768 - DNA, 25 bp, Rattus norvegicus
aacgacctgaagttctttccacatg

SEQ ID NO: 26769 - DNA, 25 bp, Rattus norvegicus
aacgacctgcagaaggagcgccaga

SEQ ID NO: 26770 - DNA, 25 bp, Rattus norvegicus
aacgacctgcagtaggagcgccaga

SEQ ID NO: 26771 - DNA, 25 bp, Rattus norvegicus
aacgacctgtctatctctgataaaa

SEQ ID NO: 26772 - DNA, 25 bp, Rattus norvegicus
aacgacctgtctttctctgataaaa

SEQ ID NO: 26773 - DNA, 25 bp, Rattus norvegicus
aacgacctgtgtatgttcactgtac

SEQ ID NO: 26774 - DNA, 25 bp, Rattus norvegicus
aacgacctgtgtttgttcactgtac

SEQ ID NO: 26775 - DNA, 25 bp, Rattus norvegicus
aacgaccttccgcagacagctgtga

SEQ ID NO: 26776 - DNA, 25 bp, Rattus norvegicus
aacgaccttccggagacagctgtga

SEQ ID NO: 26777 - DNA, 25 bp, Rattus norvegicus
aacgacgcctcgcacgtggagtgac

SEQ ID NO: 26778 - DNA, 25 bp, Rattus norvegicus
aacgacgcctcggacgtggagtgac

SEQ ID NO: 26779 - DNA, 25 bp, Rattus norvegicus
aacgacgcgattcacctgatgaacc

SEQ ID NO: 26780 - DNA, 25 bp, Rattus norvegicus
aacgacgcgattgacctgatgaacc

SEQ ID NO: 26781 - DNA, 25 bp, Rattus norvegicus
aacgacggccggcagtagcaccagc

SEQ ID NO: 26782 - DNA, 25 bp, Rattus norvegicus
aacgacggccgggagtagcaccagc

SEQ ID NO: 26783 - DNA, 25 bp, Rattus norvegicus
aacgacggtgagaaacgcagtggct

SEQ ID NO: 26784 - DNA, 25 bp, Rattus norvegicus
aacgacggtgagtaacgcagtggct

SEQ ID NO: 26785 - DNA, 25 bp, Rattus norvegicus
aacgactattacatcctgggcttga

SEQ ID NO: 26786 - DNA, 25 bp, Rattus norvegicus
aacgactattacttcctgggcttga

SEQ ID NO: 26787 - DNA, 25 bp, Rattus norvegicus
aacgactccatcaatgaggcatcca

SEQ ID NO: 26788 - DNA, 25 bp, Rattus norvegicus
aacgactccatctatgaggcatcca

SEQ ID NO: 26789 - DNA, 25 bp, Rattus norvegicus
aacgactctggacggagacactata

SEQ ID NO: 26790 - DNA, 25 bp, Rattus norvegicus
aacgactctggagggagacactata

SEQ ID NO: 26791 - DNA, 25 bp, Rattus norvegicus
aacgactcttgcctgttcgtgcagc

SEQ ID NO: 26792 - DNA, 25 bp, Rattus norvegicus
aacgactcttgcgtgttcgtgcagc

SEQ ID NO: 26793 - DNA, 25 bp, Rattus norvegicus
aacgactgttgacactggactgctc

SEQ ID NO: 26794 - DNA, 25 bp, Rattus norvegicus
aacgactgttgagactggactgctc

SEQ ID NO: 26795 - DNA, 25 bp, Rattus norvegicus
aacgagaaccagagtggcctgcaga

SEQ ID NO: 26796 - DNA, 25 bp, Rattus norvegicus
aacgagaaccagtgtggcctgcaga

SEQ ID NO: 26797 - DNA, 25 bp, Rattus norvegicus
aacgagacagacaatgtgccgctgc

SEQ ID NO: 26798 - DNA, 25 bp, Rattus norvegicus
aacgagacagactatgtgccgctgc

SEQ ID NO: 26799 - DNA, 25 bp, Rattus norvegicus
aacgagaccaagcagcgccaggcag

SEQ ID NO: 26800 - DNA, 25 bp, Rattus norvegicus
aacgagaccaaggagcgccaggcag

SEQ ID NO: 26801 - DNA, 25 bp, Rattus norvegicus
aacgagaccacaccactgacagagc

SEQ ID NO: 26802 - DNA, 25 bp, Rattus norvegicus
aacgagaccacagcactgacagagc

SEQ ID NO: 26803 - DNA, 25 bp, Rattus norvegicus
aacgagaccctgcttctgtgggaga

SEQ ID NO: 26804 - DNA, 25 bp, Rattus norvegicus
aacgagaccctggttctgtgggaga

SEQ ID NO: 26805 - DNA, 25 bp, Rattus norvegicus
aacgagacggttacactgcgccaga

SEQ ID NO: 26806 - DNA, 25 bp, Rattus norvegicus
aacgagacggtttcactgcgccaga

SEQ ID NO: 26807 - DNA, 25 bp, Rattus norvegicus
aacgagacttttcatttcctcctgg

SEQ ID NO: 26808 - DNA, 25 bp, Rattus norvegicus
aacgagacttttgatttcctcctgg

SEQ ID NO: 26809 - DNA, 25 bp, Rattus norvegicus
aacgagagatctctgttctctgcct

SEQ ID NO: 26810 - DNA, 25 bp, Rattus norvegicus
aacgagagatctgtgttctctgcct

SEQ ID NO: 26811 - DNA, 25 bp, Rattus norvegicus
aacgagataaatctggcaggctctg

SEQ ID NO: 26812 - DNA, 25 bp, Rattus norvegicus
aacgagataaatgtggcaggctctg

SEQ ID NO: 26813 - DNA, 25 bp, Rattus norvegicus
aacgagatgtagaccttccccatcc

SEQ ID NO: 26814 - DNA, 25 bp, Rattus norvegicus
aacgagatgtagtccttccccatcc

SEQ ID NO: 26815 - DNA, 25 bp, Rattus norvegicus
aacgagcagaccactattcagtgga

SEQ ID NO: 26816 - DNA, 25 bp, Rattus norvegicus
aacgagcagacctctattcagtgga

SEQ ID NO: 26817 - DNA, 25 bp, Rattus norvegicus
aacgagccaagtacaagcgcaaata

SEQ ID NO: 26818 - DNA, 25 bp, Rattus norvegicus
aacgagccaagttcaagcgcaaata

SEQ ID NO: 26819 - DNA, 25 bp, Rattus norvegicus
aacgagcccatgatgtacacatacg

SEQ ID NO: 26820 - DNA, 25 bp, Rattus norvegicus
aacgagcccatgttgtacacatacg

SEQ ID NO: 26821 - DNA, 25 bp, Rattus norvegicus
aacgagcgggagagtcccatgtgca

SEQ ID NO: 26822 - DNA, 25 bp, Rattus norvegicus
aacgagcgggagtgtcccatgtgca

SEQ ID NO: 26823 - DNA, 25 bp, Rattus norvegicus
aacgagcgtagcatcggctgagcaa

SEQ ID NO: 26824 - DNA, 25 bp, Rattus norvegicus
aacgagcgtagcttcggctgagcaa

SEQ ID NO: 26825 - DNA, 25 bp, Rattus norvegicus
aacgagcgtgtcaacaagtgtatca

SEQ ID NO: 26826 - DNA, 25 bp, Rattus norvegicus
aacgagcgtgtctacaagtgtatca

SEQ ID NO: 26827 - DNA, 25 bp, Rattus norvegicus
aacgagcgttccacaggtcaattca

SEQ ID NO: 26828 - DNA, 25 bp, Rattus norvegicus
aacgagcgttcctcaggtcaattca

SEQ ID NO: 26829 - DNA, 25 bp, Rattus norvegicus
aacgagctaacgagcgtgcgaacga

SEQ ID NO: 26830 - DNA, 25 bp, Rattus norvegicus
aacgagctaacgtgcgtgcgaacga

SEQ ID NO: 26831 - DNA, 25 bp, Rattus norvegicus
aacgagctccacctccaatgagaga

SEQ ID NO: 26832 - DNA, 25 bp, Rattus norvegicus
aacgagctccacgtccaatgagaga

SEQ ID NO: 26833 - DNA, 25 bp, Rattus norvegicus
aacgagctgcctatgtgtggtgaaa

SEQ ID NO: 26834 - DNA, 25 bp, Rattus norvegicus
aacgagctgcctttgtgtggtgaaa

SEQ ID NO: 26835 - DNA, 25 bp, Rattus norvegicus
aacgagctgctgcaggctgtcaaca

SEQ ID NO: 26836 - DNA, 25 bp, Rattus norvegicus
aacgagctgctggaggctgtcaaca

SEQ ID NO: 26837 - DNA, 25 bp, Rattus norvegicus
aacgagcttcctcaagacaaccagg

SEQ ID NO: 26838 - DNA, 25 bp, Rattus norvegicus
aacgagcttcctgaagacaaccagg

SEQ ID NO: 26839 - DNA, 25 bp, Rattus norvegicus
aacgagcttgttatcctgtgagtca

SEQ ID NO: 26840 - DNA, 25 bp, Rattus norvegicus
aacgagcttgttttcctgtgagtca

SEQ ID NO: 26841 - DNA, 25 bp, Rattus norvegicus
aacgaggaaacaaggagctggagaa

SEQ ID NO: 26842 - DNA, 25 bp, Rattus norvegicus
aacgaggaaacatggagctggagaa

SEQ ID NO: 26843 - DNA, 25 bp, Rattus norvegicus
aacgaggaaacgctgatgtcagcta

SEQ ID NO: 26844 - DNA, 25 bp, Rattus norvegicus
aacgaggaaacggtgatgtcagcta

SEQ ID NO: 26845 - DNA, 25 bp, Rattus norvegicus
aacgaggaacatctggcccttgagc

SEQ ID NO: 26846 - DNA, 25 bp, Rattus norvegicus
aacgaggaacatgtggcccttgagc

SEQ ID NO: 26847 - DNA, 25 bp, Rattus norvegicus
aacgaggaatatccccaggacctgg

SEQ ID NO: 26848 - DNA, 25 bp, Rattus norvegicus
aacgaggaatatgcccaggacctgg

SEQ ID NO: 26849 - DNA, 25 bp, Rattus norvegicus
aacgaggaccagaccatgggcaact

SEQ ID NO: 26850 - DNA, 25 bp, Rattus norvegicus
aacgaggaccagtccatgggcaact

SEQ ID NO: 26851 - DNA, 25 bp, Rattus norvegicus
aacgaggaggcgctttacactgtac

SEQ ID NO: 26852 - DNA, 25 bp, Rattus norvegicus
aacgaggaggcggtttacactgtac

SEQ ID NO: 26853 - DNA, 25 bp, Rattus norvegicus
aacgaggcactgagcagagcttgca

SEQ ID NO: 26854 - DNA, 25 bp, Rattus norvegicus
aacgaggcactgtgcagagcttgca

SEQ ID NO: 26855 - DNA, 25 bp, Rattus norvegicus
aacgaggctgccctgtttgaacaga

SEQ ID NO: 26856 - DNA, 25 bp, Rattus norvegicus
aacgaggctgccgtgtttgaacaga

SEQ ID NO: 26857 - DNA, 25 bp, Rattus norvegicus
aacgagggacctccggttcagactc

SEQ ID NO: 26858 - DNA, 25 bp, Rattus norvegicus
aacgagggacctgcggttcagactc

SEQ ID NO: 26859 - DNA, 25 bp, Rattus norvegicus
aacgaggtctggacttcgtctgtac

SEQ ID NO: 26860 - DNA, 25 bp, Rattus norvegicus
aacgaggtctggtcttcgtctgtac

SEQ ID NO: 26861 - DNA, 25 bp, Rattus norvegicus
aacgaggtgaatattgacccatcag

SEQ ID NO: 26862 - DNA, 25 bp, Rattus norvegicus
aacgaggtgaattttgacccatcag

SEQ ID NO: 26863 - DNA, 25 bp, Rattus norvegicus
aacgagtatcgcattttattttcta

SEQ ID NO: 26864 - DNA, 25 bp, Rattus norvegicus
aacgagtatcgctttttattttcta

SEQ ID NO: 26865 - DNA, 25 bp, Rattus norvegicus
aacgagtcagtacgcatccgtgtcg

SEQ ID NO: 26866 - DNA, 25 bp, Rattus norvegicus
aacgagtcagtaggcatccgtgtcg

SEQ ID NO: 26867 - DNA, 25 bp, Rattus norvegicus
aacgagtcccggcttcgagtagcga

SEQ ID NO: 26868 - DNA, 25 bp, Rattus norvegicus
aacgagtcccgggttcgagtagcga

SEQ ID NO: 26869 - DNA, 25 bp, Rattus norvegicus
aacgagtcctcaaacaaccgagatc

SEQ ID NO: 26870 - DNA, 25 bp, Rattus norvegicus
aacgagtcctcatacaaccgagatc

SEQ ID NO: 26871 - DNA, 25 bp, Rattus norvegicus
aacgagtccttcagcctgtgcgatt

SEQ ID NO: 26872 - DNA, 25 bp, Rattus norvegicus
aacgagtccttctgcctgtgcgatt

SEQ ID NO: 26873 - DNA, 25 bp, Rattus norvegicus
aacgagtctcttctgaaacctgtca

SEQ ID NO: 26874 - DNA, 25 bp, Rattus norvegicus
aacgagtctcttgtgaaacctgtca

SEQ ID NO: 26875 - DNA, 25 bp, Rattus norvegicus
aacgagtgcgcgcagacttagctca

SEQ ID NO: 26876 - DNA, 25 bp, Rattus norvegicus
aacgagtgcgcggagacttagctca

SEQ ID NO: 26877 - DNA, 25 bp, Rattus norvegicus
aacgagtggcccaggcgctgctgtc

SEQ ID NO: 26878 - DNA, 25 bp, Rattus norvegicus
aacgagtggccctggcgctgctgtc

SEQ ID NO: 26879 - DNA, 25 bp, Rattus norvegicus
aacgagtgtccaatctgtgcgagca

SEQ ID NO: 26880 - DNA, 25 bp, Rattus norvegicus
aacgagtgtccattctgtgcgagca

SEQ ID NO: 26881 - DNA, 25 bp, Rattus norvegicus
aacgagttggttctccagtgttgaa

SEQ ID NO: 26882 - DNA, 25 bp, Rattus norvegicus
aacgagttggttgtccagtgttgaa

SEQ ID NO: 26883 - DNA, 25 bp, Rattus norvegicus
aacgagttgttcctgatcgcaattt

SEQ ID NO: 26884 - DNA, 25 bp, Rattus norvegicus
aacgagttgttcgtgatcgcaattt

SEQ ID NO: 26885 - DNA, 25 bp, Rattus norvegicus
aacgagtttagcaaggtctgggaat

SEQ ID NO: 26886 - DNA, 25 bp, Rattus norvegicus
aacgagtttagctaggtctgggaat

SEQ ID NO: 26887 - DNA, 25 bp, Rattus norvegicus
aacgatagcatcatgaacgaccttc

SEQ ID NO: 26888 - DNA, 25 bp, Rattus norvegicus
aacgatagcatcttgaacgaccttc

SEQ ID NO: 26889 - DNA, 25 bp, Rattus norvegicus
aacgatatctctcaaaccaacctta

SEQ ID NO: 26890 - DNA, 25 bp, Rattus norvegicus
aacgatatctctgaaaccaacctta

SEQ ID NO: 26891 - DNA, 25 bp, Rattus norvegicus
aacgatcagtctatctctacttttt

SEQ ID NO: 26892 - DNA, 25 bp, Rattus norvegicus
aacgatcagtctttctctacttttt

SEQ ID NO: 26893 - DNA, 25 bp, Rattus norvegicus
aacgatcatatcatgctttcacata

SEQ ID NO: 26894 - DNA, 25 bp, Rattus norvegicus
aacgatcatatcttgctttcacata

SEQ ID NO: 26895 - DNA, 25 bp, Rattus norvegicus
aacgatccaatcaaagctacctttt

SEQ ID NO: 26896 - DNA, 25 bp, Rattus norvegicus
aacgatccaatctaagctacctttt

SEQ ID NO: 26897 - DNA, 25 bp, Rattus norvegicus
aacgatccatccacgtggatacgga

SEQ ID NO: 26898 - DNA, 25 bp, Rattus norvegicus
aacgatccatcctcgtggatacgga

SEQ ID NO: 26899 - DNA, 25 bp, Rattus norvegicus
aacgatcccttgagcttagcgtagc

SEQ ID NO: 26900 - DNA, 25 bp, Rattus norvegicus
aacgatcccttgtgcttagcgtagc

SEQ ID NO: 26901 - DNA, 25 bp, Rattus norvegicus
aacgatccgccacttgagggaacga

SEQ ID NO: 26902 - DNA, 25 bp, Rattus norvegicus
aacgatccgccagttgagggaacga

SEQ ID NO: 26903 - DNA, 25 bp, Rattus norvegicus
aacgatcctccacgcgtggtgagaa

SEQ ID NO: 26904 - DNA, 25 bp, Rattus norvegicus
aacgatcctccaggcgtggtgagaa

SEQ ID NO: 26905 - DNA, 25 bp, Rattus norvegicus
aacgatcctggacgctgacgcagtt

SEQ ID NO: 26906 - DNA, 25 bp, Rattus norvegicus
aacgatcctggaggctgacgcagtt

SEQ ID NO: 26907 - DNA, 25 bp, Rattus norvegicus
aacgatcggcagattgtccacgacg

SEQ ID NO: 26908 - DNA, 25 bp, Rattus norvegicus
aacgatcggcagtttgtccacgacg

SEQ ID NO: 26909 - DNA, 25 bp, Rattus norvegicus
aacgatctctttcagtggtcagtga

SEQ ID NO: 26910 - DNA, 25 bp, Rattus norvegicus
aacgatctctttgagtggtcagtga

SEQ ID NO: 26911 - DNA, 25 bp, Rattus norvegicus
aacgatctgttcagtccacttagaa

SEQ ID NO: 26912 - DNA, 25 bp, Rattus norvegicus
aacgatctgttctgtccacttagaa

SEQ ID NO: 26913 - DNA, 25 bp, Rattus norvegicus
aacgatcttatgctatcttgccaaa

SEQ ID NO: 26914 - DNA, 25 bp, Rattus norvegicus
aacgatcttatggtatcttgccaaa

SEQ ID NO: 26915 - DNA, 25 bp, Rattus norvegicus
aacgatgacctgagcatactggctc

SEQ ID NO: 26916 - DNA, 25 bp, Rattus norvegicus
aacgatgacctgtgcatactggctc

SEQ ID NO: 26917 - DNA, 25 bp, Rattus norvegicus
aacgatgcctgaaagacaacctgag

SEQ ID NO: 26918 - DNA, 25 bp, Rattus norvegicus
aacgatgcctgatagacaacctgag

SEQ ID NO: 26919 - DNA, 25 bp, Rattus norvegicus
aacgatgcggaacactgctgcctgt

SEQ ID NO: 26920 - DNA, 25 bp, Rattus norvegicus
aacgatgcggaagactgctgcctgt

SEQ ID NO: 26921 - DNA, 25 bp, Rattus norvegicus
aacgatgctctgaagatccagctga

SEQ ID NO: 26922 - DNA, 25 bp, Rattus norvegicus
aacgatgctctgtagatccagctga

SEQ ID NO: 26923 - DNA, 25 bp, Rattus norvegicus
aacgatggaggcaccagagccatcc

SEQ ID NO: 26924 - DNA, 25 bp, Rattus norvegicus
aacgatggaggctccagagccatcc

SEQ ID NO: 26925 - DNA, 25 bp, Rattus norvegicus
aacgatggcaatcaacaggtctttg

SEQ ID NO: 26926 - DNA, 25 bp, Rattus norvegicus
aacgatggcaatgaacaggtctttg

SEQ ID NO: 26927 - DNA, 25 bp, Rattus norvegicus
aacgatggctcgattgggtcttttg

SEQ ID NO: 26928 - DNA, 25 bp, Rattus norvegicus
aacgatggctcgtttgggtcttttg

SEQ ID NO: 26929 - DNA, 25 bp, Rattus norvegicus
aacgatgtcagtagtcttgattcaa

SEQ ID NO: 26930 - DNA, 25 bp, Rattus norvegicus
aacgatgtcagttgtcttgattcaa

SEQ ID NO: 26931 - DNA, 25 bp, Rattus norvegicus
aacgatgtctgtcagcacacagctg

SEQ ID NO: 26932 - DNA, 25 bp, Rattus norvegicus
aacgatgtctgtgagcacacagctg

SEQ ID NO: 26933 - DNA, 25 bp, Rattus norvegicus
aacgatgttttcatcattcttgtaa

SEQ ID NO: 26934 - DNA, 25 bp, Rattus norvegicus
aacgatgttttcttcattcttgtaa

SEQ ID NO: 26935 - DNA, 25 bp, Rattus norvegicus
aacgattaaaatcagctgcctcccc

SEQ ID NO: 26936 - DNA, 25 bp, Rattus norvegicus
aacgattaaaatgagctgcctcccc

SEQ ID NO: 26937 - DNA, 25 bp, Rattus norvegicus
aacgattccagcaggaggagttctc

SEQ ID NO: 26938 - DNA, 25 bp, Rattus norvegicus
aacgattccagctggaggagttctc

SEQ ID NO: 26939 - DNA, 25 bp, Rattus norvegicus
aacgattgtggcatcaccttgttga

SEQ ID NO: 26940 - DNA, 25 bp, Rattus norvegicus
aacgattgtggcttcaccttgttga

SEQ ID NO: 26941 - DNA, 25 bp, Rattus norvegicus
aacgatttacaaacccactctacag

SEQ ID NO: 26942 - DNA, 25 bp, Rattus norvegicus
aacgatttacaaagccctaggctgc

SEQ ID NO: 26943 - DNA, 25 bp, Rattus norvegicus
aacgatttacaatcccactctacag

SEQ ID NO: 26944 - DNA, 25 bp, Rattus norvegicus
aacgatttacaatgccctaggctgc

SEQ ID NO: 26945 - DNA, 25 bp, Rattus norvegicus
aacgatttacacagactgttgctgt

SEQ ID NO: 26946 - DNA, 25 bp, Rattus norvegicus
aacgatttacactgactgttgctgt

SEQ ID NO: 26947 - DNA, 25 bp, Rattus norvegicus
aacgatttcctgaattttaagcatt

SEQ ID NO: 26948 - DNA, 25 bp, Rattus norvegicus
aacgatttcctgtattttaagcatt

SEQ ID NO: 26949 - DNA, 25 bp, Rattus norvegicus
aacgatttgcaaactcttctctgtc

SEQ ID NO: 26950 - DNA, 25 bp, Rattus norvegicus
aacgatttgcaatctcttctctgtc

SEQ ID NO: 26951 - DNA, 25 bp, Rattus norvegicus
aacgatttgctaccgtgttcatctg

SEQ ID NO: 26952 - DNA, 25 bp, Rattus norvegicus
aacgatttgctagcgtgttcatctg

SEQ ID NO: 26953 - DNA, 25 bp, Rattus norvegicus
aacgcaaactccattgtgccaggtt

SEQ ID NO: 26954 - DNA, 25 bp, Rattus norvegicus
aacgcaaactcctttgtgccaggtt

SEQ ID NO: 26955 - DNA, 25 bp, Rattus norvegicus
aacgcaaagggcagctggcttcatc

SEQ ID NO: 26956 - DNA, 25 bp, Rattus norvegicus
aacgcaaagggctgctggcttcatc

SEQ ID NO: 26957 - DNA, 25 bp, Rattus norvegicus
aacgcaaccttcagtcattttctag

SEQ ID NO: 26958 - DNA, 25 bp, Rattus norvegicus
aacgcaaccttctgtcattttctag

SEQ ID NO: 26959 - DNA, 25 bp, Rattus norvegicus
aacgcaactaacatcgagctggcca

SEQ ID NO: 26960 - DNA, 25 bp, Rattus norvegicus
aacgcaactaacttcgagctggcca

SEQ ID NO: 26961 - DNA, 25 bp, Rattus norvegicus
aacgcaagacttccttttctctggg

SEQ ID NO: 26962 - DNA, 25 bp, Rattus norvegicus
aacgcaagacttgcttttctctggg

SEQ ID NO: 26963 - DNA, 25 bp, Rattus norvegicus
aacgcaagcaaaaccctgacagtga

SEQ ID NO: 26964 - DNA, 25 bp, Rattus norvegicus
aacgcaagcaaatccctgacagtga

SEQ ID NO: 26965 - DNA, 25 bp, Rattus norvegicus
aacgcaagttccagtcattccaggt

SEQ ID NO: 26966 - DNA, 25 bp, Rattus norvegicus
aacgcaagttcctgtcattccaggt

SEQ ID NO: 26967 - DNA, 25 bp, Rattus norvegicus
aacgcaagtttgctgcctgctagga

SEQ ID NO: 26968 - DNA, 25 bp, Rattus norvegicus
aacgcaagtttggtgcctgctagga

SEQ ID NO: 26969 - DNA, 25 bp, Rattus norvegicus
aacgcaatactacaccaactggcct

SEQ ID NO: 26970 - DNA, 25 bp, Rattus norvegicus
aacgcaatactagaccaactggcct

SEQ ID NO: 26971 - DNA, 25 bp, Rattus norvegicus
aacgcacagacacttttggagaccg

SEQ ID NO: 26972 - DNA, 25 bp, Rattus norvegicus
aacgcacagacagttttggagaccg

SEQ ID NO: 26973 - DNA, 25 bp, Rattus norvegicus
aacgcacagggaccatttctatcat

SEQ ID NO: 26974 - DNA, 25 bp, Rattus norvegicus
aacgcacagggagcatttctatcat

SEQ ID NO: 26975 - DNA, 25 bp, Rattus norvegicus
aacgcaccagacaagccatgagcaa

SEQ ID NO: 26976 - DNA, 25 bp, Rattus norvegicus
aacgcaccagactagccatgagcaa

SEQ ID NO: 26977 - DNA, 25 bp, Rattus norvegicus
aacgcactcagtaccatctacgtag

SEQ ID NO: 26978 - DNA, 25 bp, Rattus norvegicus
aacgcactcagttccatctacgtag

SEQ ID NO: 26979 - DNA, 25 bp, Rattus norvegicus
aacgcactcgcaatgtaagatccac

SEQ ID NO: 26980 - DNA, 25 bp, Rattus norvegicus
aacgcactcgcattgtaagatccac

SEQ ID NO: 26981 - DNA, 25 bp, Rattus norvegicus
aacgcagacatacggcacagcagct

SEQ ID NO: 26982 - DNA, 25 bp, Rattus norvegicus
aacgcagacatagggcacagcagct

SEQ ID NO: 26983 - DNA, 25 bp, Rattus norvegicus
aacgcagagtggaggtctaacgaaa

SEQ ID NO: 26984 - DNA, 25 bp, Rattus norvegicus
aacgcagagtggtggtctaacgaaa

SEQ ID NO: 26985 - DNA, 25 bp, Rattus norvegicus
aacgcagatattctcattagtggca

SEQ ID NO: 26986 - DNA, 25 bp, Rattus norvegicus
aacgcagatattgtcattagtggca

SEQ ID NO: 26987 - DNA, 25 bp, Rattus norvegicus
aacgcagatgtgatgaccgcactgt

SEQ ID NO: 26988 - DNA, 25 bp, Rattus norvegicus
aacgcagatgtgttgaccgcactgt

SEQ ID NO: 26989 - DNA, 25 bp, Rattus norvegicus
aacgcagccataagcactgggccag

SEQ ID NO: 26990 - DNA, 25 bp, Rattus norvegicus
aacgcagccatatgcactgggccag

SEQ ID NO: 26991 - DNA, 25 bp, Rattus norvegicus
aacgcagccattacaagcatgcagg

SEQ ID NO: 26992 - DNA, 25 bp, Rattus norvegicus
aacgcagccatttcaagcatgcagg

SEQ ID NO: 26993 - DNA, 25 bp, Rattus norvegicus
aacgcagggcgacgtctggatacca

SEQ ID NO: 26994 - DNA, 25 bp, Rattus norvegicus
aacgcagggcgaggtctggatacca

SEQ ID NO: 26995 - DNA, 25 bp, Rattus norvegicus
aacgcagggtggactttgggctaca

SEQ ID NO: 26996 - DNA, 25 bp, Rattus norvegicus
aacgcagggtggtctttgggctaca

SEQ ID NO: 26997 - DNA, 25 bp, Rattus norvegicus
aacgcagtacatagtgtcgcgaact

SEQ ID NO: 26998 - DNA, 25 bp, Rattus norvegicus
aacgcagtacattgtgtcgcgaact

SEQ ID NO: 26999 - DNA, 25 bp, Rattus norvegicus
aacgcagtctttactccaaagggca

SEQ ID NO: 27000 - DNA, 25 bp, Rattus norvegicus
aacgcagtcttttctccaaagggca

SEQ ID NO: 27001 - DNA, 25 bp, Rattus norvegicus
aacgcagtgcacattcagtccgtgt

SEQ ID NO: 27002 - DNA, 25 bp, Rattus norvegicus
aacgcagtgcactttcagtccgtgt

SEQ ID NO: 27003 - DNA, 25 bp, Rattus norvegicus
aacgcagtggccatggtcttggaaa

SEQ ID NO: 27004 - DNA, 25 bp, Rattus norvegicus
aacgcagtggccttggtcttggaaa

SEQ ID NO: 27005 - DNA, 25 bp, Rattus norvegicus
aacgcagttctgcttgtcgaagcaa

SEQ ID NO: 27006 - DNA, 25 bp, Rattus norvegicus
aacgcagttctggttgtcgaagcaa

SEQ ID NO: 27007 - DNA, 25 bp, Rattus norvegicus
aacgcataccatccccaagtgggtg

SEQ ID NO: 27008 - DNA, 25 bp, Rattus norvegicus
aacgcataccatgcccaagtgggtg

SEQ ID NO: 27009 - DNA, 25 bp, Rattus norvegicus
aacgcatagttgacacttagtattc

SEQ ID NO: 27010 - DNA, 25 bp, Rattus norvegicus
aacgcatagttgtcacttagtattc

SEQ ID NO: 27011 - DNA, 25 bp, Rattus norvegicus
aacgcatattttctccaggtcaaca

SEQ ID NO: 27012 - DNA, 25 bp, Rattus norvegicus
aacgcatattttgtccaggtcaaca

SEQ ID NO: 27013 - DNA, 25 bp, Rattus norvegicus
aacgcatcacgcagctggagcagga

SEQ ID NO: 27014 - DNA, 25 bp, Rattus norvegicus
aacgcatcacgctgctggagcagga

SEQ ID NO: 27015 - DNA, 25 bp, Rattus norvegicus
aacgcatccactagagttcatcact

SEQ ID NO: 27016 - DNA, 25 bp, Rattus norvegicus
aacgcatccacttgagttcatcact

SEQ ID NO: 27017 - DNA, 25 bp, Rattus norvegicus
aacgcatccatgcagtgggcttcaa

SEQ ID NO: 27018 - DNA, 25 bp, Rattus norvegicus
aacgcatccatggagtgggcttcaa

SEQ ID NO: 27019 - DNA, 25 bp, Rattus norvegicus
aacgcatggagaacttgtgtagcac

SEQ ID NO: 27020 - DNA, 25 bp, Rattus norvegicus
aacgcatggagatcttgtgtagcac

SEQ ID NO: 27021 - DNA, 25 bp, Rattus norvegicus
aacgcattgtagagtttttgacagt

SEQ ID NO: 27022 - DNA, 25 bp, Rattus norvegicus
aacgcattgtagtgtttttgacagt

SEQ ID NO: 27023 - DNA, 25 bp, Rattus norvegicus
aacgcatttctaactagtttcctgg

SEQ ID NO: 27024 - DNA, 25 bp, Rattus norvegicus
aacgcatttctatctagtttcctgg

SEQ ID NO: 27025 - DNA, 25 bp, Rattus norvegicus
aacgcattttaccataagccgaaag

SEQ ID NO: 27026 - DNA, 25 bp, Rattus norvegicus
aacgcattttacgataagccgaaag

SEQ ID NO: 27027 - DNA, 25 bp, Rattus norvegicus
aacgccaacgcaccagcctggatat

SEQ ID NO: 27028 - DNA, 25 bp, Rattus norvegicus
aacgccaacgcagcagcctggatat

SEQ ID NO: 27029 - DNA, 25 bp, Rattus norvegicus
aacgccaagtggcttttgtgaacaa

SEQ ID NO: 27030 - DNA, 25 bp, Rattus norvegicus
aacgccaagtgggttttgtgaacaa

SEQ ID NO: 27031 - DNA, 25 bp, Rattus norvegicus
aacgccacaatgcagctgctctgta

SEQ ID NO: 27032 - DNA, 25 bp, Rattus norvegicus
aacgccacaatggagctgctctgta

SEQ ID NO: 27033 - DNA, 25 bp, Rattus norvegicus
aacgccacgagtcggcaaagtgttc

SEQ ID NO: 27034 - DNA, 25 bp, Rattus norvegicus
aacgccacgagtgggcaaagtgttc

SEQ ID NO: 27035 - DNA, 25 bp, Rattus norvegicus
aacgccacgccgagtgcggtgctgc

SEQ ID NO: 27036 - DNA, 25 bp, Rattus norvegicus
aacgccacgccgtgtgcggtgctgc

SEQ ID NO: 27037 - DNA, 25 bp, Rattus norvegicus
aacgccacgggccagggtaacatct

SEQ ID NO: 27038 - DNA, 25 bp, Rattus norvegicus
aacgccacgggcgagggtaacatct

SEQ ID NO: 27039 - DNA, 25 bp, Rattus norvegicus
aacgccacggtgcacgttcatgtgg

SEQ ID NO: 27040 - DNA, 25 bp, Rattus norvegicus
aacgccacggtggacgttcatgtgg

SEQ ID NO: 27041 - DNA, 25 bp, Rattus norvegicus
aacgccactatgagtagggagttgc

SEQ ID NO: 27042 - DNA, 25 bp, Rattus norvegicus
aacgccactatgtgtagggagttgc

SEQ ID NO: 27043 - DNA, 25 bp, Rattus norvegicus
aacgccactgtcagtatcctaggtg

SEQ ID NO: 27044 - DNA, 25 bp, Rattus norvegicus
aacgccactgtctgtatcctaggtg

SEQ ID NO: 27045 - DNA, 25 bp, Rattus norvegicus
aacgccaggctacgcagcgaagaga

SEQ ID NO: 27046 - DNA, 25 bp, Rattus norvegicus
aacgccaggctaggcagcgaagaga

SEQ ID NO: 27047 - DNA, 25 bp, Rattus norvegicus
aacgccagtggtcttttggactttg

SEQ ID NO: 27048 - DNA, 25 bp, Rattus norvegicus
aacgccagtggtgttttggactttg

SEQ ID NO: 27049 - DNA, 25 bp, Rattus norvegicus
aacgccatagaacagcaggcccttg

SEQ ID NO: 27050 - DNA, 25 bp, Rattus norvegicus
aacgccatagaagagcaggcccttg

SEQ ID NO: 27051 - DNA, 25 bp, Rattus norvegicus
aacgccatcgttcttccagaaggga

SEQ ID NO: 27052 - DNA, 25 bp, Rattus norvegicus
aacgccatcgttgttccagaaggga

SEQ ID NO: 27053 - DNA, 25 bp, Rattus norvegicus
aacgccatctgcagatgagcatcga

SEQ ID NO: 27054 - DNA, 25 bp, Rattus norvegicus
aacgccatctgctgatgagcatcga

SEQ ID NO: 27055 - DNA, 25 bp, Rattus norvegicus
aacgccatgtctctctttaaactga

SEQ ID NO: 27056 - DNA, 25 bp, Rattus norvegicus
aacgccatgtctgtctttaaactga

SEQ ID NO: 27057 - DNA, 25 bp, Rattus norvegicus
aacgccattgcacgtgtgtcagcct

SEQ ID NO: 27058 - DNA, 25 bp, Rattus norvegicus
aacgccattgcaggtgtgtcagcct

SEQ ID NO: 27059 - DNA, 25 bp, Rattus norvegicus
aacgccattgtaatctcctttggag

SEQ ID NO: 27060 - DNA, 25 bp, Rattus norvegicus
aacgccattgtattctcctttggag

SEQ ID NO: 27061 - DNA, 25 bp, Rattus norvegicus
aacgcccaagtgactctaggatcta

SEQ ID NO: 27062 - DNA, 25 bp, Rattus norvegicus
aacgcccaagtgtctctaggatcta

SEQ ID NO: 27063 - DNA, 25 bp, Rattus norvegicus
aacgccccaccgaggtcacaagagg

SEQ ID NO: 27064 - DNA, 25 bp, Rattus norvegicus
aacgccccaccgtggtcacaagagg

SEQ ID NO: 27065 - DNA, 25 bp, Rattus norvegicus
aacgccccatgaacctcatttgagt

SEQ ID NO: 27066 - DNA, 25 bp, Rattus norvegicus
aacgccccatgatcctcatttgagt

SEQ ID NO: 27067 - DNA, 25 bp, Rattus norvegicus
aacgccccgggaagctgccttgaag

SEQ ID NO: 27068 - DNA, 25 bp, Rattus norvegicus
aacgccccgggatgctgccttgaag

SEQ ID NO: 27069 - DNA, 25 bp, Rattus norvegicus
aacgcccgttatattcatgtggtca

SEQ ID NO: 27070 - DNA, 25 bp, Rattus norvegicus
aacgcccgttattttcatgtggtca

SEQ ID NO: 27071 - DNA, 25 bp, Rattus norvegicus
aacgccctagggaaccaggctctat

SEQ ID NO: 27072 - DNA, 25 bp, Rattus norvegicus
aacgccctagggtaccaggctctat

SEQ ID NO: 27073 - DNA, 25 bp, Rattus norvegicus
aacgccctatgtctgcatggtgtgc

SEQ ID NO: 27074 - DNA, 25 bp, Rattus norvegicus
aacgccctatgtgtgcatggtgtgc

SEQ ID NO: 27075 - DNA, 25 bp, Rattus norvegicus
aacgccctccaaaattcagagcgca

SEQ ID NO: 27076 - DNA, 25 bp, Rattus norvegicus
aacgccctccaatattcagagcgca

SEQ ID NO: 27077 - DNA, 25 bp, Rattus norvegicus
aacgccctgagtactgccattacta

SEQ ID NO: 27078 - DNA, 25 bp, Rattus norvegicus
aacgccctgagttctgccattacta

SEQ ID NO: 27079 - DNA, 25 bp, Rattus norvegicus
aacgcccttaaaactgtcatcaata

SEQ ID NO: 27080 - DNA, 25 bp, Rattus norvegicus
aacgcccttaaatctgtcatcaata

SEQ ID NO: 27081 - DNA, 25 bp, Rattus norvegicus
aacgccgacatccacgtgttggagg

SEQ ID NO: 27082 - DNA, 25 bp, Rattus norvegicus
aacgccgacatcgacgtgttggagg

SEQ ID NO: 27083 - DNA, 25 bp, Rattus norvegicus
aacgccgacctgcactgaaaattca

SEQ ID NO: 27084 - DNA, 25 bp, Rattus norvegicus
aacgccgacctggactgaaaattca

SEQ ID NO: 27085 - DNA, 25 bp, Rattus norvegicus
aacgccgagacgctgccgtggatct

SEQ ID NO: 27086 - DNA, 25 bp, Rattus norvegicus
aacgccgagacggtgccgtggatct

SEQ ID NO: 27087 - DNA, 25 bp, Rattus norvegicus
aacgccgagggacctccggtgtcaa

SEQ ID NO: 27088 - DNA, 25 bp, Rattus norvegicus
aacgccgagggagctccggtgtcaa

SEQ ID NO: 27089 - DNA, 25 bp, Rattus norvegicus
aacgccggccacatcgtgggctcag

SEQ ID NO: 27090 - DNA, 25 bp, Rattus norvegicus
aacgccggccacttcgtgggctcag

SEQ ID NO: 27091 - DNA, 25 bp, Rattus norvegicus
aacgccggctgcagcgcagtcctgt

SEQ ID NO: 27092 - DNA, 25 bp, Rattus norvegicus
aacgccggctgctgcgcagtcctgt

SEQ ID NO: 27093 - DNA, 25 bp, Rattus norvegicus
aacgccgtgcgtatggacgaggcta

SEQ ID NO: 27094 - DNA, 25 bp, Rattus norvegicus
aacgccgtgcgtttggacgaggcta

SEQ ID NO: 27095 - DNA, 25 bp, Rattus norvegicus
aacgccgtggcaatggagtcgcaga

SEQ ID NO: 27096 - DNA, 25 bp, Rattus norvegicus
aacgccgtggcattggagtcgcaga

SEQ ID NO: 27097 - DNA, 25 bp, Rattus norvegicus
aacgccgttacgaaagcatgcggaa

SEQ ID NO: 27098 - DNA, 25 bp, Rattus norvegicus
aacgccgttacgtaagcatgcggaa

SEQ ID NO: 27099 - DNA, 25 bp, Rattus norvegicus
aacgccgttgtcacatctctgtgag

SEQ ID NO: 27100 - DNA, 25 bp, Rattus norvegicus
aacgccgttgtctcatctctgtgag

SEQ ID NO: 27101 - DNA, 25 bp, Rattus norvegicus
aacgcctagtgaccacatttctgag

SEQ ID NO: 27102 - DNA, 25 bp, Rattus norvegicus
aacgcctagtgagcacatttctgag

SEQ ID NO: 27103 - DNA, 25 bp, Rattus norvegicus
aacgcctatagccaatatcatctcg

SEQ ID NO: 27104 - DNA, 25 bp, Rattus norvegicus
aacgcctatagcgaatatcatctcg

SEQ ID NO: 27105 - DNA, 25 bp, Rattus norvegicus
aacgcctcatttcctctgtggatga

SEQ ID NO: 27106 - DNA, 25 bp, Rattus norvegicus
aacgcctcatttgctctgtggatga

SEQ ID NO: 27107 - DNA, 25 bp, Rattus norvegicus
aacgcctccatcagattgcttgttg

SEQ ID NO: 27108 - DNA, 25 bp, Rattus norvegicus
aacgcctccatctgattgcttgttg

SEQ ID NO: 27109 - DNA, 25 bp, Rattus norvegicus
aacgcctctgggacattgcttgtta

SEQ ID NO: 27110 - DNA, 25 bp, Rattus norvegicus
aacgcctctgggtcattgcttgtta

SEQ ID NO: 27111 - DNA, 25 bp, Rattus norvegicus
aacgcctcttatcttccttctaact

SEQ ID NO: 27112 - DNA, 25 bp, Rattus norvegicus
aacgcctcttatgttccttctaact

SEQ ID NO: 27113 - DNA, 25 bp, Rattus norvegicus
aacgcctgaacgactggtggtgaca

SEQ ID NO: 27114 - DNA, 25 bp, Rattus norvegicus
aacgcctgaacgtctggtggtgaca

SEQ ID NO: 27115 - DNA, 25 bp, Rattus norvegicus
aacgcctgcctcaacttcaagtcat

SEQ ID NO: 27116 - DNA, 25 bp, Rattus norvegicus
aacgcctgcctctacttcaagtcat

SEQ ID NO: 27117 - DNA, 25 bp, Rattus norvegicus
aacgcctgctgaccattgtgaatgt

SEQ ID NO: 27118 - DNA, 25 bp, Rattus norvegicus
aacgcctgctgagcattgtgaatgt

SEQ ID NO: 27119 - DNA, 25 bp, Rattus norvegicus
aacgcctgctgtccaatttttagag

SEQ ID NO: 27120 - DNA, 25 bp, Rattus norvegicus
aacgcctgctgtgcaatttttagag

SEQ ID NO: 27121 - DNA, 25 bp, Rattus norvegicus
aacgcctggagaacagctgacccaa

SEQ ID NO: 27122 - DNA, 25 bp, Rattus norvegicus
aacgcctggagatcagctgacccaa

SEQ ID NO: 27123 - DNA, 25 bp, Rattus norvegicus
aacgcctgggctcctttggaagcat

SEQ ID NO: 27124 - DNA, 25 bp, Rattus norvegicus
aacgcctgggctgctttggaagcat

SEQ ID NO: 27125 - DNA, 25 bp, Rattus norvegicus
aacgccttatggcactttacatgat

SEQ ID NO: 27126 - DNA, 25 bp, Rattus norvegicus
aacgccttatgggactttacatgat

SEQ ID NO: 27127 - DNA, 25 bp, Rattus norvegicus
aacgccttcaaacagtgcacgcagt

SEQ ID NO: 27128 - DNA, 25 bp, Rattus norvegicus
aacgccttcaaagagtgcacgcagt

SEQ ID NO: 27129 - DNA, 25 bp, Rattus norvegicus
aacgccttcaatcatggcctgaaac

SEQ ID NO: 27130 - DNA, 25 bp, Rattus norvegicus
aacgccttcaatgatggcctgaaac

SEQ ID NO: 27131 - DNA, 25 bp, Rattus norvegicus
aacgccttcaggagacggccacact

SEQ ID NO: 27132 - DNA, 25 bp, Rattus norvegicus
aacgccttcaggtgacggccacact

SEQ ID NO: 27133 - DNA, 25 bp, Rattus norvegicus
aacgccttcctcagaagactagttt

SEQ ID NO: 27134 - DNA, 25 bp, Rattus norvegicus
aacgccttcctctgaagactagttt

SEQ ID NO: 27135 - DNA, 25 bp, Rattus norvegicus
aacgccttctttaacagatgcacct

SEQ ID NO: 27136 - DNA, 25 bp, Rattus norvegicus
aacgccttcttttacagatgcacct

SEQ ID NO: 27137 - DNA, 25 bp, Rattus norvegicus
aacgccttgtacattgtgcgagcaa

SEQ ID NO: 27138 - DNA, 25 bp, Rattus norvegicus
aacgccttgtactttgtgcgagcaa

SEQ ID NO: 27139 - DNA, 25 bp, Rattus norvegicus
aacgcctttatgactttatactttg

SEQ ID NO: 27140 - DNA, 25 bp, Rattus norvegicus
aacgcctttatgtctttatactttg

SEQ ID NO: 27141 - DNA, 25 bp, Rattus norvegicus
aacgccttttttctatgttgatgga

SEQ ID NO: 27142 - DNA, 25 bp, Rattus norvegicus
aacgccttttttgtatgttgatgga

SEQ ID NO: 27143 - DNA, 25 bp, Rattus norvegicus
aacgcgaaggccacagtcacagaga

SEQ ID NO: 27144 - DNA, 25 bp, Rattus norvegicus
aacgcgaaggcctcagtcacagaga

SEQ ID NO: 27145 - DNA, 25 bp, Rattus norvegicus
aacgcgacctgacgcggctctaggt

SEQ ID NO: 27146 - DNA, 25 bp, Rattus norvegicus
aacgcgacctgaggcggctctaggt

SEQ ID NO: 27147 - DNA, 25 bp, Rattus norvegicus
aacgcgaggcctccggcgaaggcga

SEQ ID NO: 27148 - DNA, 25 bp, Rattus norvegicus
aacgcgaggcctgcggcgaaggcga

SEQ ID NO: 27149 - DNA, 25 bp, Rattus norvegicus
aacgcgcagattcgcttcaggatca

SEQ ID NO: 27150 - DNA, 25 bp, Rattus norvegicus
aacgcgcagattggcttcaggatca

SEQ ID NO: 27151 - DNA, 25 bp, Rattus norvegicus
aacgcgcagcgaagacacaggagga

SEQ ID NO: 27152 - DNA, 25 bp, Rattus norvegicus
aacgcgcagcgatgacacaggagga

SEQ ID NO: 27153 - DNA, 25 bp, Rattus norvegicus
aacgcgcatgcccaaacaagagaaa

SEQ ID NO: 27154 - DNA, 25 bp, Rattus norvegicus
aacgcgcatgccgaaacaagagaaa

SEQ ID NO: 27155 - DNA, 25 bp, Rattus norvegicus
aacgcgcatggcacggattcacgga

SEQ ID NO: 27156 - DNA, 25 bp, Rattus norvegicus
aacgcgcatggctcggattcacgga

SEQ ID NO: 27157 - DNA, 25 bp, Rattus norvegicus
aacgcgcccgatctcgtctgatctc

SEQ ID NO: 27158 - DNA, 25 bp, Rattus norvegicus
aacgcgcccgatgtcgtctgatctc

SEQ ID NO: 27159 - DNA, 25 bp, Rattus norvegicus
aacgcgcgccccagttaaggcctgt

SEQ ID NO: 27160 - DNA, 25 bp, Rattus norvegicus
aacgcgcgcccctgttaaggcctgt

SEQ ID NO: 27161 - DNA, 25 bp, Rattus norvegicus
aacgcgctgctgatggcgccagcct

SEQ ID NO: 27162 - DNA, 25 bp, Rattus norvegicus
aacgcgctgctgttggcgccagcct

SEQ ID NO: 27163 - DNA, 25 bp, Rattus norvegicus
aacgcggcattgagcgcaaggtcaa

SEQ ID NO: 27164 - DNA, 25 bp, Rattus norvegicus
aacgcggcattgtgcgcaaggtcaa

SEQ ID NO: 27165 - DNA, 25 bp, Rattus norvegicus
aacgcggctggtatctagctgggaa

SEQ ID NO: 27166 - DNA, 25 bp, Rattus norvegicus
aacgcggctggtttctagctgggaa

SEQ ID NO: 27167 - DNA, 25 bp, Rattus norvegicus
aacgcgggtcagacgtgaacagcaa

SEQ ID NO: 27168 - DNA, 25 bp, Rattus norvegicus
aacgcgggtcagtcgtgaacagcaa

SEQ ID NO: 27169 - DNA, 25 bp, Rattus norvegicus
aacgcggttgagctcactgagcatc

SEQ ID NO: 27170 - DNA, 25 bp, Rattus norvegicus
aacgcggttgaggtcactgagcatc

SEQ ID NO: 27171 - DNA, 25 bp, Rattus norvegicus
aacgcgtcacacatttgccaagatt

SEQ ID NO: 27172 - DNA, 25 bp, Rattus norvegicus
aacgcgtcacacttttgccaagatt

SEQ ID NO: 27173 - DNA, 25 bp, Rattus norvegicus
aacgcgtccatgctgtatggcagcc

SEQ ID NO: 27174 - DNA, 25 bp, Rattus norvegicus
aacgcgtccatggtgtatggcagcc

SEQ ID NO: 27175 - DNA, 25 bp, Rattus norvegicus
aacgcgttctgaagctctttgccta

SEQ ID NO: 27176 - DNA, 25 bp, Rattus norvegicus
aacgcgttctgatgctctttgccta

SEQ ID NO: 27177 - DNA, 25 bp, Rattus norvegicus
aacgcgttttcaagggagctctact

SEQ ID NO: 27178 - DNA, 25 bp, Rattus norvegicus
aacgcgttttcatgggagctctact

SEQ ID NO: 27179 - DNA, 25 bp, Rattus norvegicus
aacgctaaaaccaggctgagcatag

SEQ ID NO: 27180 - DNA, 25 bp, Rattus norvegicus
aacgctaaaacctggctgagcatag

SEQ ID NO: 27181 - DNA, 25 bp, Rattus norvegicus
aacgctaactacatttgaggtacag

SEQ ID NO: 27182 - DNA, 25 bp, Rattus norvegicus
aacgctaactacttttgaggtacag

SEQ ID NO: 27183 - DNA, 25 bp, Rattus norvegicus
aacgctagacttcaggcacttctta

SEQ ID NO: 27184 - DNA, 25 bp, Rattus norvegicus
aacgctagacttgaggcacttctta

SEQ ID NO: 27185 - DNA, 25 bp, Rattus norvegicus
aacgctagagaaacagttccctcct

SEQ ID NO: 27186 - DNA, 25 bp, Rattus norvegicus
aacgctagagaatcagttccctcct

SEQ ID NO: 27187 - DNA, 25 bp, Rattus norvegicus
aacgctagctgtctgtgctcaatca

SEQ ID NO: 27188 - DNA, 25 bp, Rattus norvegicus
aacgctagctgtgtgtgctcaatca

SEQ ID NO: 27189 - DNA, 25 bp, Rattus norvegicus
aacgctagttggagttcctggaact

SEQ ID NO: 27190 - DNA, 25 bp, Rattus norvegicus
aacgctagttggtgttcctggaact

SEQ ID NO: 27191 - DNA, 25 bp, Rattus norvegicus
aacgctcacgtaagacaaggccaaa

SEQ ID NO: 27192 - DNA, 25 bp, Rattus norvegicus
aacgctcacgtatgacaaggccaaa

SEQ ID NO: 27193 - DNA, 25 bp, Rattus norvegicus
aacgctcagattatcacggtaactt

SEQ ID NO: 27194 - DNA, 25 bp, Rattus norvegicus
aacgctcagattttcacggtaactt

SEQ ID NO: 27195 - DNA, 25 bp, Rattus norvegicus
aacgctcagcctataagtacttttg

SEQ ID NO: 27196 - DNA, 25 bp, Rattus norvegicus
aacgctcagcctttaagtacttttg

SEQ ID NO: 27197 - DNA, 25 bp, Rattus norvegicus
aacgctcaggacagaagctcacttt

SEQ ID NO: 27198 - DNA, 25 bp, Rattus norvegicus
aacgctcaggactgaagctcacttt

SEQ ID NO: 27199 - DNA, 25 bp, Rattus norvegicus
aacgctcattggagggagccctagt

SEQ ID NO: 27200 - DNA, 25 bp, Rattus norvegicus
aacgctcattggcttggatggcgat

SEQ ID NO: 27201 - DNA, 25 bp, Rattus norvegicus
aacgctcattgggttggatggcgat

SEQ ID NO: 27202 - DNA, 25 bp, Rattus norvegicus
aacgctcattggtgggagccctagt

SEQ ID NO: 27203 - DNA, 25 bp, Rattus norvegicus
aacgctcctgtcatctatttttaac

SEQ ID NO: 27204 - DNA, 25 bp, Rattus norvegicus
aacgctcctgtcatttacccaacgg

SEQ ID NO: 27205 - DNA, 25 bp, Rattus norvegicus
aacgctcctgtcttctatttttaac

SEQ ID NO: 27206 - DNA, 25 bp, Rattus norvegicus
aacgctcctgtcttttacccaacgg

SEQ ID NO: 27207 - DNA, 25 bp, Rattus norvegicus
aacgctcgcccaccatgcagagata

SEQ ID NO: 27208 - DNA, 25 bp, Rattus norvegicus
aacgctcgcccagcatgcagagata

SEQ ID NO: 27209 - DNA, 25 bp, Rattus norvegicus
aacgctctccatcgttttctggatg

SEQ ID NO: 27210 - DNA, 25 bp, Rattus norvegicus
aacgctctccatggttttctggatg

SEQ ID NO: 27211 - DNA, 25 bp, Rattus norvegicus
aacgctctctgaaagccacatctat

SEQ ID NO: 27212 - DNA, 25 bp, Rattus norvegicus
aacgctctctgatagccacatctat

SEQ ID NO: 27213 - DNA, 25 bp, Rattus norvegicus
aacgctctgacaccagcttctgagg

SEQ ID NO: 27214 - DNA, 25 bp, Rattus norvegicus
aacgctctgacagcagcttctgagg

SEQ ID NO: 27215 - DNA, 25 bp, Rattus norvegicus
aacgctctgatcaccagggttttaa

SEQ ID NO: 27216 - DNA, 25 bp, Rattus norvegicus
aacgctctgatctccagggttttaa

SEQ ID NO: 27217 - DNA, 25 bp, Rattus norvegicus
aacgctctgctgataaagacaccca

SEQ ID NO: 27218 - DNA, 25 bp, Rattus norvegicus
aacgctctgctgttaaagacaccca

SEQ ID NO: 27219 - DNA, 25 bp, Rattus norvegicus
aacgctctggtaactggagcagttc

SEQ ID NO: 27220 - DNA, 25 bp, Rattus norvegicus
aacgctctggtatctggagcagttc

SEQ ID NO: 27221 - DNA, 25 bp, Rattus norvegicus
aacgctgaagacatgatgccctcac

SEQ ID NO: 27222 - DNA, 25 bp, Rattus norvegicus
aacgctgaagacttgatgccctcac

SEQ ID NO: 27223 - DNA, 25 bp, Rattus norvegicus
aacgctgaagtcactgcaggtgcgg

SEQ ID NO: 27224 - DNA, 25 bp, Rattus norvegicus
aacgctgaagtcatggtgcctaatt

SEQ ID NO: 27225 - DNA, 25 bp, Rattus norvegicus
aacgctgaagtctctgcaggtgcgg

SEQ ID NO: 27226 - DNA, 25 bp, Rattus norvegicus
aacgctgaagtcttggtgcctaatt

SEQ ID NO: 27227 - DNA, 25 bp, Rattus norvegicus
aacgctgagaaactatggccttgct

SEQ ID NO: 27228 - DNA, 25 bp, Rattus norvegicus
aacgctgagaaagtatggccttgct

SEQ ID NO: 27229 - DNA, 25 bp, Rattus norvegicus
aacgctgatggcaacattgacttgg

SEQ ID NO: 27230 - DNA, 25 bp, Rattus norvegicus
aacgctgatggctacattgacttgg

SEQ ID NO: 27231 - DNA, 25 bp, Rattus norvegicus
aacgctgcagcacaaccttggttgt

SEQ ID NO: 27232 - DNA, 25 bp, Rattus norvegicus
aacgctgcagcagaaccttggttgt

SEQ ID NO: 27233 - DNA, 25 bp, Rattus norvegicus
aacgctgcagggagttgtggcacct

SEQ ID NO: 27234 - DNA, 25 bp, Rattus norvegicus
aacgctgcagggtgttgtggcacct

SEQ ID NO: 27235 - DNA, 25 bp, Rattus norvegicus
aacgctgcctgcacgtaaacatcct

SEQ ID NO: 27236 - DNA, 25 bp, Rattus norvegicus
aacgctgcctgctcgtaaacatcct

SEQ ID NO: 27237 - DNA, 25 bp, Rattus norvegicus
aacgctgctgctcgaaatttctaat

SEQ ID NO: 27238 - DNA, 25 bp, Rattus norvegicus
aacgctgctgctggaaatttctaat

SEQ ID NO: 27239 - DNA, 25 bp, Rattus norvegicus
aacgctgctgtcaaaggctgatcca

SEQ ID NO: 27240 - DNA, 25 bp, Rattus norvegicus
aacgctgctgtctaaggctgatcca

SEQ ID NO: 27241 - DNA, 25 bp, Rattus norvegicus
aacgctggacttcgcttcttagaaa

SEQ ID NO: 27242 - DNA, 25 bp, Rattus norvegicus
aacgctggacttggcttcttagaaa

SEQ ID NO: 27243 - DNA, 25 bp, Rattus norvegicus
aacgctggagttccctctgctatgg

SEQ ID NO: 27244 - DNA, 25 bp, Rattus norvegicus
aacgctggagttgcctctgctatgg

SEQ ID NO: 27245 - DNA, 25 bp, Rattus norvegicus
aacgctggcattactgccgtgatgg

SEQ ID NO: 27246 - DNA, 25 bp, Rattus norvegicus
aacgctggcattagcctcagtggat

SEQ ID NO: 27247 - DNA, 25 bp, Rattus norvegicus
aacgctggcatttctgccgtgatgg

SEQ ID NO: 27248 - DNA, 25 bp, Rattus norvegicus
aacgctggcatttgcctcagtggat

SEQ ID NO: 27249 - DNA, 25 bp, Rattus norvegicus
aacgctggccctctgaagatgacat

SEQ ID NO: 27250 - DNA, 25 bp, Rattus norvegicus
aacgctggccctgtgaagatgacat

SEQ ID NO: 27251 - DNA, 25 bp, Rattus norvegicus
aacgctgggtccaggctatgtggca

SEQ ID NO: 27252 - DNA, 25 bp, Rattus norvegicus
aacgctgggtcctggctatgtggca

SEQ ID NO: 27253 - DNA, 25 bp, Rattus norvegicus
aacgctggtctgacagccagacatg

SEQ ID NO: 27254 - DNA, 25 bp, Rattus norvegicus
aacgctggtctgtcagccagacatg

SEQ ID NO: 27255 - DNA, 25 bp, Rattus norvegicus
aacgctggttctcctagctgactaa

SEQ ID NO: 27256 - DNA, 25 bp, Rattus norvegicus
aacgctggttctgctagctgactaa

SEQ ID NO: 27257 - DNA, 25 bp, Rattus norvegicus
aacgctgtctaccagtccaagatgg

SEQ ID NO: 27258 - DNA, 25 bp, Rattus norvegicus
aacgctgtctacgagtccaagatgg

SEQ ID NO: 27259 - DNA, 25 bp, Rattus norvegicus
aacgctgtgaatctcttcctgggaa

SEQ ID NO: 27260 - DNA, 25 bp, Rattus norvegicus
aacgctgtgaatgtcttcctgggaa

SEQ ID NO: 27261 - DNA, 25 bp, Rattus norvegicus
aacgctgtgtttctaatcctgcttg

SEQ ID NO: 27262 - DNA, 25 bp, Rattus norvegicus
aacgctgtgtttgtaatcctgcttg

SEQ ID NO: 27263 - DNA, 25 bp, Rattus norvegicus
aacgctgtttaaaaccttgcctggc

SEQ ID NO: 27264 - DNA, 25 bp, Rattus norvegicus
aacgctgtttaataccttgcctggc

SEQ ID NO: 27265 - DNA, 25 bp, Rattus norvegicus
aacgctgtttccaaattgttcatca

SEQ ID NO: 27266 - DNA, 25 bp, Rattus norvegicus
aacgctgtttcctaattgttcatca

SEQ ID NO: 27267 - DNA, 25 bp, Rattus norvegicus
aacgctgtttgtaaaaggtggtcat

SEQ ID NO: 27268 - DNA, 25 bp, Rattus norvegicus
aacgctgtttgttaaaggtggtcat

SEQ ID NO: 27269 - DNA, 25 bp, Rattus norvegicus
aacgctgtttttctgtcagaaccat

SEQ ID NO: 27270 - DNA, 25 bp, Rattus norvegicus
aacgctgtttttgtgtcagaaccat

SEQ ID NO: 27271 - DNA, 25 bp, Rattus norvegicus
aacgcttataaaacaggcaacttct

SEQ ID NO: 27272 - DNA, 25 bp, Rattus norvegicus
aacgcttataaatcaggcaacttct

SEQ ID NO: 27273 - DNA, 25 bp, Rattus norvegicus
aacgcttcaaccagctcaaagcatg

SEQ ID NO: 27274 - DNA, 25 bp, Rattus norvegicus
aacgcttcaacctgctcaaagcatg

SEQ ID NO: 27275 - DNA, 25 bp, Rattus norvegicus
aacgcttcactgagtagtgggccca

SEQ ID NO: 27276 - DNA, 25 bp, Rattus norvegicus
aacgcttcactgtgtagtgggccca

SEQ ID NO: 27277 - DNA, 25 bp, Rattus norvegicus
aacgcttcctgactatgttctggag

SEQ ID NO: 27278 - DNA, 25 bp, Rattus norvegicus
aacgcttcctgagtatgttctggag

SEQ ID NO: 27279 - DNA, 25 bp, Rattus norvegicus
aacgcttccttcattgcatgagatg

SEQ ID NO: 27280 - DNA, 25 bp, Rattus norvegicus
aacgcttccttctttgcatgagatg

SEQ ID NO: 27281 - DNA, 25 bp, Rattus norvegicus
aacgcttcgttcctgtgtgatgctg

SEQ ID NO: 27282 - DNA, 25 bp, Rattus norvegicus
aacgcttcgttcgtgtgtgatgctg

SEQ ID NO: 27283 - DNA, 25 bp, Rattus norvegicus
aacgcttctctcaacttggcattta

SEQ ID NO: 27284 - DNA, 25 bp, Rattus norvegicus
aacgcttctctctacttggcattta

SEQ ID NO: 27285 - DNA, 25 bp, Rattus norvegicus
aacgcttctggcatgatacagctct

SEQ ID NO: 27286 - DNA, 25 bp, Rattus norvegicus
aacgcttctggcttgatacagctct

SEQ ID NO: 27287 - DNA, 25 bp, Rattus norvegicus
aacgcttctgtactataatgtaacc

SEQ ID NO: 27288 - DNA, 25 bp, Rattus norvegicus
aacgcttctgtagtataatgtaacc

SEQ ID NO: 27289 - DNA, 25 bp, Rattus norvegicus
aacgcttgcttgatcaccatcaaca

SEQ ID NO: 27290 - DNA, 25 bp, Rattus norvegicus
aacgcttgcttgttcaccatcaaca

SEQ ID NO: 27291 - DNA, 25 bp, Rattus norvegicus
aacgcttgggatacggtctgtgtaa

SEQ ID NO: 27292 - DNA, 25 bp, Rattus norvegicus
aacgcttgggattcggtctgtgtaa

SEQ ID NO: 27293 - DNA, 25 bp, Rattus norvegicus
aacgcttgtggcattaacagagaca

SEQ ID NO: 27294 - DNA, 25 bp, Rattus norvegicus
aacgcttgtggctttaacagagaca

SEQ ID NO: 27295 - DNA, 25 bp, Rattus norvegicus
aacgctttgcaacaggaaagtgttt

SEQ ID NO: 27296 - DNA, 25 bp, Rattus norvegicus
aacgctttgcaagaggaaagtgttt

SEQ ID NO: 27297 - DNA, 25 bp, Rattus norvegicus
aacgctttggaactttctgctccgt

SEQ ID NO: 27298 - DNA, 25 bp, Rattus norvegicus
aacgctttggaagtttctgctccgt

SEQ ID NO: 27299 - DNA, 25 bp, Rattus norvegicus
aacgctttttcaccttggctttgat

SEQ ID NO: 27300 - DNA, 25 bp, Rattus norvegicus
aacgctttttcagcttggctttgat

SEQ ID NO: 27301 - DNA, 25 bp, Rattus norvegicus
aacggaaaagatctcagggccacat

SEQ ID NO: 27302 - DNA, 25 bp, Rattus norvegicus
aacggaaaagatgtcagggccacat

SEQ ID NO: 27303 - DNA, 25 bp, Rattus norvegicus
aacggaacagacaactgtcctgccc

SEQ ID NO: 27304 - DNA, 25 bp, Rattus norvegicus
aacggaacagactactgtcctgccc

SEQ ID NO: 27305 - DNA, 25 bp, Rattus norvegicus
aacggaacctgtactcagatctgca

SEQ ID NO: 27306 - DNA, 25 bp, Rattus norvegicus
aacggaacctgttctcagatctgca

SEQ ID NO: 27307 - DNA, 25 bp, Rattus norvegicus
aacggaagacagaagctcctccagg

SEQ ID NO: 27308 - DNA, 25 bp, Rattus norvegicus
aacggaagacagcaggccccaggcg

SEQ ID NO: 27309 - DNA, 25 bp, Rattus norvegicus
aacggaagacaggaggccccaggcg

SEQ ID NO: 27310 - DNA, 25 bp, Rattus norvegicus
aacggaagacagtagctcctccagg

SEQ ID NO: 27311 - DNA, 25 bp, Rattus norvegicus
aacggaagagcacccgagttcatcc

SEQ ID NO: 27312 - DNA, 25 bp, Rattus norvegicus
aacggaagagcagccgagttcatcc

SEQ ID NO: 27313 - DNA, 25 bp, Rattus norvegicus
aacggaagcggccatacaactccca

SEQ ID NO: 27314 - DNA, 25 bp, Rattus norvegicus
aacggaagcggcgatacaactccca

SEQ ID NO: 27315 - DNA, 25 bp, Rattus norvegicus
aacggaagctggcaactcttcggac

SEQ ID NO: 27316 - DNA, 25 bp, Rattus norvegicus
aacggaagctgggaactcttcggac

SEQ ID NO: 27317 - DNA, 25 bp, Rattus norvegicus
aacggaatgggtatgcctagcagcc

SEQ ID NO: 27318 - DNA, 25 bp, Rattus norvegicus
aacggaatgggtttgcctagcagcc

SEQ ID NO: 27319 - DNA, 25 bp, Rattus norvegicus
aacggaattttcacgatgcatggtg

SEQ ID NO: 27320 - DNA, 25 bp, Rattus norvegicus
aacggaattttctcgatgcatggtg

SEQ ID NO: 27321 - DNA, 25 bp, Rattus norvegicus
aacggacaacatacacagtacagtg

SEQ ID NO: 27322 - DNA, 25 bp, Rattus norvegicus
aacggacaacattcacagtacagtg

SEQ ID NO: 27323 - DNA, 25 bp, Rattus norvegicus
aacggacacagcagatggagcccaa

SEQ ID NO: 27324 - DNA, 25 bp, Rattus norvegicus
aacggacacagctgatggagcccaa

SEQ ID NO: 27325 - DNA, 25 bp, Rattus norvegicus
aacggacatcgaccaatcattgctg

SEQ ID NO: 27326 - DNA, 25 bp, Rattus norvegicus
aacggacatcgagcaatcattgctg

SEQ ID NO: 27327 - DNA, 25 bp, Rattus norvegicus
aacggaccgctgaagttctcggaga

SEQ ID NO: 27328 - DNA, 25 bp, Rattus norvegicus
aacggaccgctgtagttctcggaga

SEQ ID NO: 27329 - DNA, 25 bp, Rattus norvegicus
aacggacctttaatctttgacagct

SEQ ID NO: 27330 - DNA, 25 bp, Rattus norvegicus
aacggacctttattctttgacagct

SEQ ID NO: 27331 - DNA, 25 bp, Rattus norvegicus
aacggacgccagagtgtgttctcat

SEQ ID NO: 27332 - DNA, 25 bp, Rattus norvegicus
aacggacgccagtgtgtgttctcat

SEQ ID NO: 27333 - DNA, 25 bp, Rattus norvegicus
aacggacggaccatagcagtgctct

SEQ ID NO: 27334 - DNA, 25 bp, Rattus norvegicus
aacggacggaccttagcagtgctct

SEQ ID NO: 27335 - DNA, 25 bp, Rattus norvegicus
aacggactcagtcattcagctcctg

SEQ ID NO: 27336 - DNA, 25 bp, Rattus norvegicus
aacggactcagtgattcagctcctg

SEQ ID NO: 27337 - DNA, 25 bp, Rattus norvegicus
aacggactggtccatgtgcctgtga

SEQ ID NO: 27338 - DNA, 25 bp, Rattus norvegicus
aacggactggtcgatgtgcctgtga

SEQ ID NO: 27339 - DNA, 25 bp, Rattus norvegicus
aacggactgtgactctcttggttca

SEQ ID NO: 27340 - DNA, 25 bp, Rattus norvegicus
aacggactgtgagtctcttggttca

SEQ ID NO: 27341 - DNA, 25 bp, Rattus norvegicus
aacggagactgtagctacatgagag

SEQ ID NO: 27342 - DNA, 25 bp, Rattus norvegicus
aacggagactgttgctacatgagag

SEQ ID NO: 27343 - DNA, 25 bp, Rattus norvegicus
aacggagagtctccatgccaggaaa

SEQ ID NO: 27344 - DNA, 25 bp, Rattus norvegicus
aacggagagtctgcatgccaggaaa

SEQ ID NO: 27345 - DNA, 25 bp, Rattus norvegicus
aacggagatccccagatgatgagct

SEQ ID NO: 27346 - DNA, 25 bp, Rattus norvegicus
aacggagatcccgagatgatgagct

SEQ ID NO: 27347 - DNA, 25 bp, Rattus norvegicus
aacggagcagctagcctatgcttgt

SEQ ID NO: 27348 - DNA, 25 bp, Rattus norvegicus
aacggagcagcttgcctatgcttgt

SEQ ID NO: 27349 - DNA, 25 bp, Rattus norvegicus
aacggagcctgtatgaccagtatgg

SEQ ID NO: 27350 - DNA, 25 bp, Rattus norvegicus
aacggagcctgtttgaccagtatgg

SEQ ID NO: 27351 - DNA, 25 bp, Rattus norvegicus
aacggagcgcgtatctaacactgat

SEQ ID NO: 27352 - DNA, 25 bp, Rattus norvegicus
aacggagcgcgtttctaacactgat

SEQ ID NO: 27353 - DNA, 25 bp, Rattus norvegicus
aacggagctgagacactagtgacgg

SEQ ID NO: 27354 - DNA, 25 bp, Rattus norvegicus
aacggagctgagtcactagtgacgg

SEQ ID NO: 27355 - DNA, 25 bp, Rattus norvegicus
aacggaggagccaccggccacacga

SEQ ID NO: 27356 - DNA, 25 bp, Rattus norvegicus
aacggaggagcctccggccacacga

SEQ ID NO: 27357 - DNA, 25 bp, Rattus norvegicus
aacggaggcctaagtgaggacccag

SEQ ID NO: 27358 - DNA, 25 bp, Rattus norvegicus
aacggaggcctatgtgaggacccag

SEQ ID NO: 27359 - DNA, 25 bp, Rattus norvegicus
aacggagggagtcgcacttctgcct

SEQ ID NO: 27360 - DNA, 25 bp, Rattus norvegicus
aacggagggagtggcacttctgcct

SEQ ID NO: 27361 - DNA, 25 bp, Rattus norvegicus
aacggagtccatcttcagaaaatct

SEQ ID NO: 27362 - DNA, 25 bp, Rattus norvegicus
aacggagtccatgttcagaaaatct

SEQ ID NO: 27363 - DNA, 25 bp, Rattus norvegicus
aacggagtgtcgatgccagggccct

SEQ ID NO: 27364 - DNA, 25 bp, Rattus norvegicus
aacggagtgtcgttgccagggccct

SEQ ID NO: 27365 - DNA, 25 bp, Rattus norvegicus
aacggagtgttcagacgtcctctca

SEQ ID NO: 27366 - DNA, 25 bp, Rattus norvegicus
aacggagtgttctgacgtcctctca

SEQ ID NO: 27367 - DNA, 25 bp, Rattus norvegicus
aacggagttcatagagtgtcagctc

SEQ ID NO: 27368 - DNA, 25 bp, Rattus norvegicus
aacggagttcattgagtgtcagctc

SEQ ID NO: 27369 - DNA, 25 bp, Rattus norvegicus
aacggagttttcactagtggatcta

SEQ ID NO: 27370 - DNA, 25 bp, Rattus norvegicus
aacggagttttctctagtggatcta

SEQ ID NO: 27371 - DNA, 25 bp, Rattus norvegicus
aacggatcaagtacgcgagcggacc

SEQ ID NO: 27372 - DNA, 25 bp, Rattus norvegicus
aacggatcaagttcgcgagcggacc

SEQ ID NO: 27373 - DNA, 25 bp, Rattus norvegicus
aacggatcctctctgacttgaatct

SEQ ID NO: 27374 - DNA, 25 bp, Rattus norvegicus
aacggatcctctgtgacttgaatct

SEQ ID NO: 27375 - DNA, 25 bp, Rattus norvegicus
aacggatcgctgagtgtctgaaagg

SEQ ID NO: 27376 - DNA, 25 bp, Rattus norvegicus
aacggatcgctgtgtgtctgaaagg

SEQ ID NO: 27377 - DNA, 25 bp, Rattus norvegicus
aacggatcgggaaagcctgctcctg

SEQ ID NO: 27378 - DNA, 25 bp, Rattus norvegicus
aacggatcgggatagcctgctcctg

SEQ ID NO: 27379 - DNA, 25 bp, Rattus norvegicus
aacggatgcgaacgcttatggctga

SEQ ID NO: 27380 - DNA, 25 bp, Rattus norvegicus
aacggatgcgaaggcttatggctga

SEQ ID NO: 27381 - DNA, 25 bp, Rattus norvegicus
aacggatgtctgatatgtaggagaa

SEQ ID NO: 27382 - DNA, 25 bp, Rattus norvegicus
aacggatgtctgttatgtaggagaa

SEQ ID NO: 27383 - DNA, 25 bp, Rattus norvegicus
aacggattcaccagtttcttgagct

SEQ ID NO: 27384 - DNA, 25 bp, Rattus norvegicus
aacggattcacctgtttcttgagct

SEQ ID NO: 27385 - DNA, 25 bp, Rattus norvegicus
aacggcaaagcaattcccagtgtct

SEQ ID NO: 27386 - DNA, 25 bp, Rattus norvegicus
aacggcaaagcatttcccagtgtct

SEQ ID NO: 27387 - DNA, 25 bp, Rattus norvegicus
aacggcaaagcccatcttggtgcag

SEQ ID NO: 27388 - DNA, 25 bp, Rattus norvegicus
aacggcaaagccgatcttggtgcag

SEQ ID NO: 27389 - DNA, 25 bp, Rattus norvegicus
aacggcaaagggagctctctcagct

SEQ ID NO: 27390 - DNA, 25 bp, Rattus norvegicus
aacggcaaagggtgctctctcagct

SEQ ID NO: 27391 - DNA, 25 bp, Rattus norvegicus
aacggcaacatcaacatcgcgcaga

SEQ ID NO: 27392 - DNA, 25 bp, Rattus norvegicus
aacggcaacatctacatcgcgcaga

SEQ ID NO: 27393 - DNA, 25 bp, Rattus norvegicus
aacggcaaccttagtatttccatat

SEQ ID NO: 27394 - DNA, 25 bp, Rattus norvegicus
aacggcaacctttgtatttccatat

SEQ ID NO: 27395 - DNA, 25 bp, Rattus norvegicus
aacggcaacgagcttggcaggtttc

SEQ ID NO: 27396 - DNA, 25 bp, Rattus norvegicus
aacggcaacgaggttggcaggtttc

SEQ ID NO: 27397 - DNA, 25 bp, Rattus norvegicus
aacggcaagaagctcatgactgtac

SEQ ID NO: 27398 - DNA, 25 bp, Rattus norvegicus
aacggcaagaaggtcatgactgtac

SEQ ID NO: 27399 - DNA, 25 bp, Rattus norvegicus
aacggcacctggacaccctgagaga

SEQ ID NO: 27400 - DNA, 25 bp, Rattus norvegicus
aacggcacctggtcaccctgagaga

SEQ ID NO: 27401 - DNA, 25 bp, Rattus norvegicus
aacggcacgctactggactccagag

SEQ ID NO: 27402 - DNA, 25 bp, Rattus norvegicus
aacggcacgctagtggactccagag

SEQ ID NO: 27403 - DNA, 25 bp, Rattus norvegicus
aacggcagaagcaggtaacacgtct

SEQ ID NO: 27404 - DNA, 25 bp, Rattus norvegicus
aacggcagaagctggtaacacgtct

SEQ ID NO: 27405 - DNA, 25 bp, Rattus norvegicus
aacggcagacaacacagtcctgtgt

SEQ ID NO: 27406 - DNA, 25 bp, Rattus norvegicus
aacggcagacaagacagtcctgtgt

SEQ ID NO: 27407 - DNA, 25 bp, Rattus norvegicus
aacggcagcttcagctttggctact

SEQ ID NO: 27408 - DNA, 25 bp, Rattus norvegicus
aacggcagcttcataatctatgcat

SEQ ID NO: 27409 - DNA, 25 bp, Rattus norvegicus
aacggcagcttctgctttggctact

SEQ ID NO: 27410 - DNA, 25 bp, Rattus norvegicus
aacggcagcttcttaatctatgcat

SEQ ID NO: 27411 - DNA, 25 bp, Rattus norvegicus
aacggcaggcatcctggcaggccaa

SEQ ID NO: 27412 - DNA, 25 bp, Rattus norvegicus
aacggcaggcatgctggcaggccaa

SEQ ID NO: 27413 - DNA, 25 bp, Rattus norvegicus
aacggcaggcgcagcagcgctttca

SEQ ID NO: 27414 - DNA, 25 bp, Rattus norvegicus
aacggcaggcgctgcagcgctttca

SEQ ID NO: 27415 - DNA, 25 bp, Rattus norvegicus
aacggcatatagatccaagtgcaat

SEQ ID NO: 27416 - DNA, 25 bp, Rattus norvegicus
aacggcatatagttccaagtgcaat

SEQ ID NO: 27417 - DNA, 25 bp, Rattus norvegicus
aacggcatgtatctcttttcagtct

SEQ ID NO: 27418 - DNA, 25 bp, Rattus norvegicus
aacggcatgtatgtcttttcagtct

SEQ ID NO: 27419 - DNA, 25 bp, Rattus norvegicus
aacggcatgttgagctttttggctc

SEQ ID NO: 27420 - DNA, 25 bp, Rattus norvegicus
aacggcatgttgtgctttttggctc

SEQ ID NO: 27421 - DNA, 25 bp, Rattus norvegicus
aacggcattattagcagcctgctgc

SEQ ID NO: 27422 - DNA, 25 bp, Rattus norvegicus
aacggcattatttgcagcctgctgc

SEQ ID NO: 27423 - DNA, 25 bp, Rattus norvegicus
aacggcattccactcacaagtcgag

SEQ ID NO: 27424 - DNA, 25 bp, Rattus norvegicus
aacggcattccagtcacaagtcgag

SEQ ID NO: 27425 - DNA, 25 bp, Rattus norvegicus
aacggcattcttaacgtcactgctg

SEQ ID NO: 27426 - DNA, 25 bp, Rattus norvegicus
aacggcattctttacgtcactgctg

SEQ ID NO: 27427 - DNA, 25 bp, Rattus norvegicus
aacggcattgatcactccgtttccc

SEQ ID NO: 27428 - DNA, 25 bp, Rattus norvegicus
aacggcattgatgactccgtttccc

SEQ ID NO: 27429 - DNA, 25 bp, Rattus norvegicus
aacggcattgctattagtaagtgtg

SEQ ID NO: 27430 - DNA, 25 bp, Rattus norvegicus
aacggcattgcttttagtaagtgtg

SEQ ID NO: 27431 - DNA, 25 bp, Rattus norvegicus
aacggccaaggcagctcgaaacgat

SEQ ID NO: 27432 - DNA, 25 bp, Rattus norvegicus
aacggccaaggctgctcgaaacgat

SEQ ID NO: 27433 - DNA, 25 bp, Rattus norvegicus
aacggccaccatattggacaaattg

SEQ ID NO: 27434 - DNA, 25 bp, Rattus norvegicus
aacggccaccattttggacaaattg

SEQ ID NO: 27435 - DNA, 25 bp, Rattus norvegicus
aacggccatgacaaatcccagagga

SEQ ID NO: 27436 - DNA, 25 bp, Rattus norvegicus
aacggccatgactaatcccagagga

SEQ ID NO: 27437 - DNA, 25 bp, Rattus norvegicus
aacggcccaaacaagtgacgactag

SEQ ID NO: 27438 - DNA, 25 bp, Rattus norvegicus
aacggcccaaactagtgacgactag

SEQ ID NO: 27439 - DNA, 25 bp, Rattus norvegicus
aacggccgagaacatttcatagttg

SEQ ID NO: 27440 - DNA, 25 bp, Rattus norvegicus
aacggccgagaagatttcatagttg

SEQ ID NO: 27441 - DNA, 25 bp, Rattus norvegicus
aacggcctaacaaccagactttcag

SEQ ID NO: 27442 - DNA, 25 bp, Rattus norvegicus
aacggcctaacatccagactttcag

SEQ ID NO: 27443 - DNA, 25 bp, Rattus norvegicus
aacggcctcagacacacagtggctt

SEQ ID NO: 27444 - DNA, 25 bp, Rattus norvegicus
aacggcctcagagacacagtggctt

SEQ ID NO: 27445 - DNA, 25 bp, Rattus norvegicus
aacggcctctaaaaagcttcatgtc

SEQ ID NO: 27446 - DNA, 25 bp, Rattus norvegicus
aacggcctctaataagcttcatgtc

SEQ ID NO: 27447 - DNA, 25 bp, Rattus norvegicus
aacggcctgctgacctggacaactt

SEQ ID NO: 27448 - DNA, 25 bp, Rattus norvegicus
aacggcctgctgtcctggacaactt

SEQ ID NO: 27449 - DNA, 25 bp, Rattus norvegicus
aacggcctgtgaatactacaaaaag

SEQ ID NO: 27450 - DNA, 25 bp, Rattus norvegicus
aacggcctgtgattactacaaaaag

SEQ ID NO: 27451 - DNA, 25 bp, Rattus norvegicus
aacggcctttagagttgctgttcct

SEQ ID NO: 27452 - DNA, 25 bp, Rattus norvegicus
aacggcctttagtgttgctgttcct

SEQ ID NO: 27453 - DNA, 25 bp, Rattus norvegicus
aacggcctttgtcatggtggtcatg

SEQ ID NO: 27454 - DNA, 25 bp, Rattus norvegicus
aacggcctttgtgatggtggtcatg

SEQ ID NO: 27455 - DNA, 25 bp, Rattus norvegicus
aacggcgagcttattcttttatgca

SEQ ID NO: 27456 - DNA, 25 bp, Rattus norvegicus
aacggcgagctttttcttttatgca

SEQ ID NO: 27457 - DNA, 25 bp, Rattus norvegicus
aacggcgatcgacggaacgtgcaac

SEQ ID NO: 27458 - DNA, 25 bp, Rattus norvegicus
aacggcgatcgagggaacgtgcaac

SEQ ID NO: 27459 - DNA, 25 bp, Rattus norvegicus
aacggcgcaagcctgtaacctcagt

SEQ ID NO: 27460 - DNA, 25 bp, Rattus norvegicus
aacggcgcaagcgtgtaacctcagt

SEQ ID NO: 27461 - DNA, 25 bp, Rattus norvegicus
aacggcgcagttcctacggctcatc

SEQ ID NO: 27462 - DNA, 25 bp, Rattus norvegicus
aacggcgcagttgctacggctcatc

SEQ ID NO: 27463 - DNA, 25 bp, Rattus norvegicus
aacggcgctgccaacaagaagatga

SEQ ID NO: 27464 - DNA, 25 bp, Rattus norvegicus
aacggcgctgcctacaagaagatga

SEQ ID NO: 27465 - DNA, 25 bp, Rattus norvegicus
aacggcgggacgaccactgtggaca

SEQ ID NO: 27466 - DNA, 25 bp, Rattus norvegicus
aacggcgggacgtccactgtggaca

SEQ ID NO: 27467 - DNA, 25 bp, Rattus norvegicus
aacggcggtcttcgaaatagagctc

SEQ ID NO: 27468 - DNA, 25 bp, Rattus norvegicus
aacggcggtcttggaaatagagctc

SEQ ID NO: 27469 - DNA, 25 bp, Rattus norvegicus
aacggcgtagtcaaaggccagccct

SEQ ID NO: 27470 - DNA, 25 bp, Rattus norvegicus
aacggcgtagtctaaggccagccct

SEQ ID NO: 27471 - DNA, 25 bp, Rattus norvegicus
aacggcgtcgagatggcagttttgc

SEQ ID NO: 27472 - DNA, 25 bp, Rattus norvegicus
aacggcgtcgagttggcagttttgc

SEQ ID NO: 27473 - DNA, 25 bp, Rattus norvegicus
aacggcgtgccaatggaacgagact

SEQ ID NO: 27474 - DNA, 25 bp, Rattus norvegicus
aacggcgtgccattggaacgagact

SEQ ID NO: 27475 - DNA, 25 bp, Rattus norvegicus
aacggcgtgtccactcgggtcgacg

SEQ ID NO: 27476 - DNA, 25 bp, Rattus norvegicus
aacggcgtgtcctctcgggtcgacg

SEQ ID NO: 27477 - DNA, 25 bp, Rattus norvegicus
aacggctccactactgaagacgaag

SEQ ID NO: 27478 - DNA, 25 bp, Rattus norvegicus
aacggctccacttctgaagacgaag

SEQ ID NO: 27479 - DNA, 25 bp, Rattus norvegicus
aacggctctgtcagcactgacagga

SEQ ID NO: 27480 - DNA, 25 bp, Rattus norvegicus
aacggctctgtctgcactgacagga

SEQ ID NO: 27481 - DNA, 25 bp, Rattus norvegicus
aacggctgcctacggtgcaaggatc

SEQ ID NO: 27482 - DNA, 25 bp, Rattus norvegicus
aacggctgcctagggtgcaaggatc

SEQ ID NO: 27483 - DNA, 25 bp, Rattus norvegicus
aacggctgggacatttgctttatct

SEQ ID NO: 27484 - DNA, 25 bp, Rattus norvegicus
aacggctgggacttttgctttatct

SEQ ID NO: 27485 - DNA, 25 bp, Rattus norvegicus
aacggcttcagcacgggattggtat

SEQ ID NO: 27486 - DNA, 25 bp, Rattus norvegicus
aacggcttcagctcgggattggtat

SEQ ID NO: 27487 - DNA, 25 bp, Rattus norvegicus
aacggcttgcacatttgtttaatat

SEQ ID NO: 27488 - DNA, 25 bp, Rattus norvegicus
aacggcttgcacttttgtttaatat

SEQ ID NO: 27489 - DNA, 25 bp, Rattus norvegicus
aacggctttgcactaatgtgtatca

SEQ ID NO: 27490 - DNA, 25 bp, Rattus norvegicus
aacggctttgcagtaatgtgtatca

SEQ ID NO: 27491 - DNA, 25 bp, Rattus norvegicus
aacgggaagctcactggcatggcct

SEQ ID NO: 27492 - DNA, 25 bp, Rattus norvegicus
aacgggaagctctctggcatggcct

SEQ ID NO: 27493 - DNA, 25 bp, Rattus norvegicus
aacgggacaccacatctgcaaattt

SEQ ID NO: 27494 - DNA, 25 bp, Rattus norvegicus
aacgggacaccagatctgcaaattt

SEQ ID NO: 27495 - DNA, 25 bp, Rattus norvegicus
aacgggacatcgaacgcgaggctca

SEQ ID NO: 27496 - DNA, 25 bp, Rattus norvegicus
aacgggacatcgtacgcgaggctca

SEQ ID NO: 27497 - DNA, 25 bp, Rattus norvegicus
aacgggaccaatacatacacagctt

SEQ ID NO: 27498 - DNA, 25 bp, Rattus norvegicus
aacgggaccaattcatacacagctt

SEQ ID NO: 27499 - DNA, 25 bp, Rattus norvegicus
aacgggaccgcaaacagtctctgga

SEQ ID NO: 27500 - DNA, 25 bp, Rattus norvegicus
aacgggaccgcatacagtctctgga

SEQ ID NO: 27501 - DNA, 25 bp, Rattus norvegicus
aacgggactattccccagaatgcaa

SEQ ID NO: 27502 - DNA, 25 bp, Rattus norvegicus
aacgggactattgcccagaatgcaa

SEQ ID NO: 27503 - DNA, 25 bp, Rattus norvegicus
aacgggactccacagctcctgggaa

SEQ ID NO: 27504 - DNA, 25 bp, Rattus norvegicus
aacgggactccagagctcctgggaa

SEQ ID NO: 27505 - DNA, 25 bp, Rattus norvegicus
aacgggactccgaattcatcatggc

SEQ ID NO: 27506 - DNA, 25 bp, Rattus norvegicus
aacgggactccgtattcatcatggc

SEQ ID NO: 27507 - DNA, 25 bp, Rattus norvegicus
aacgggactttcagtcattgttcga

SEQ ID NO: 27508 - DNA, 25 bp, Rattus norvegicus
aacgggactttctgtcattgttcga

SEQ ID NO: 27509 - DNA, 25 bp, Rattus norvegicus
aacgggagaaccactgattcagcgt

SEQ ID NO: 27510 - DNA, 25 bp, Rattus norvegicus
aacgggagaacctctgattcagcgt

SEQ ID NO: 27511 - DNA, 25 bp, Rattus norvegicus
aacgggagcttgctgaacgtccatg

SEQ ID NO: 27512 - DNA, 25 bp, Rattus norvegicus
aacgggagcttggtgaacgtccatg

SEQ ID NO: 27513 - DNA, 25 bp, Rattus norvegicus
aacgggaggcctacatggagcagtt

SEQ ID NO: 27514 - DNA, 25 bp, Rattus norvegicus
aacgggaggccttcatggagcagtt

SEQ ID NO: 27515 - DNA, 25 bp, Rattus norvegicus
aacgggaggttcagacatcctagaa

SEQ ID NO: 27516 - DNA, 25 bp, Rattus norvegicus
aacgggaggttctgacatcctagaa

SEQ ID NO: 27517 - DNA, 25 bp, Rattus norvegicus
aacgggatgcacaggtgtttgctta

SEQ ID NO: 27518 - DNA, 25 bp, Rattus norvegicus
aacgggatgcactggtgtttgctta

SEQ ID NO: 27519 - DNA, 25 bp, Rattus norvegicus
aacgggatggccagatgctgtcatg

SEQ ID NO: 27520 - DNA, 25 bp, Rattus norvegicus
aacgggatggcctgatgctgtcatg

SEQ ID NO: 27521 - DNA, 25 bp, Rattus norvegicus
aacgggattcaaccagacaactgga

SEQ ID NO: 27522 - DNA, 25 bp, Rattus norvegicus
aacgggattcaagcagacaactgga

SEQ ID NO: 27523 - DNA, 25 bp, Rattus norvegicus
aacgggcaccatcgtgctgctgcag

SEQ ID NO: 27524 - DNA, 25 bp, Rattus norvegicus
aacgggcaccatggtgctgctgcag

SEQ ID NO: 27525 - DNA, 25 bp, Rattus norvegicus
aacgggcacgttccatggacataga

SEQ ID NO: 27526 - DNA, 25 bp, Rattus norvegicus
aacgggcacgttgcatggacataga

SEQ ID NO: 27527 - DNA, 25 bp, Rattus norvegicus
aacgggcactgcagtgttcagtaga

SEQ ID NO: 27528 - DNA, 25 bp, Rattus norvegicus
aacgggcactgctgtgttcagtaga

SEQ ID NO: 27529 - DNA, 25 bp, Rattus norvegicus
aacgggcacttgaaccttgtagact

SEQ ID NO: 27530 - DNA, 25 bp, Rattus norvegicus
aacgggcacttgtaccttgtagact

SEQ ID NO: 27531 - DNA, 25 bp, Rattus norvegicus
aacgggcctttgaacattggtatgt

SEQ ID NO: 27532 - DNA, 25 bp, Rattus norvegicus
aacgggcctttgtacattggtatgt

SEQ ID NO: 27533 - DNA, 25 bp, Rattus norvegicus
aacgggctaacgctattggagactg

SEQ ID NO: 27534 - DNA, 25 bp, Rattus norvegicus
aacgggctaacggtattggagactg

SEQ ID NO: 27535 - DNA, 25 bp, Rattus norvegicus
aacgggctcaccataatgcactgga

SEQ ID NO: 27536 - DNA, 25 bp, Rattus norvegicus
aacgggctcaccttaatgcactgga

SEQ ID NO: 27537 - DNA, 25 bp, Rattus norvegicus
aacgggctcgcacgctacagacgga

SEQ ID NO: 27538 - DNA, 25 bp, Rattus norvegicus
aacgggctcgcaggctacagacgga

SEQ ID NO: 27539 - DNA, 25 bp, Rattus norvegicus
aacgggctctgtccggttgagacaa

SEQ ID NO: 27540 - DNA, 25 bp, Rattus norvegicus
aacgggctctgtgcggttgagacaa

SEQ ID NO: 27541 - DNA, 25 bp, Rattus norvegicus
aacgggctgataagggcattcctga

SEQ ID NO: 27542 - DNA, 25 bp, Rattus norvegicus
aacgggctgatatgggcattcctga

SEQ ID NO: 27543 - DNA, 25 bp, Rattus norvegicus
aacgggctgcacagttcaactagga

SEQ ID NO: 27544 - DNA, 25 bp, Rattus norvegicus
aacgggctgcactgttcaactagga

SEQ ID NO: 27545 - DNA, 25 bp, Rattus norvegicus
aacgggcttgcaagcagcacagcaa

SEQ ID NO: 27546 - DNA, 25 bp, Rattus norvegicus
aacgggcttgcatgcagcacagcaa

SEQ ID NO: 27547 - DNA, 25 bp, Rattus norvegicus
aacgggtcagcccattcctggaaga

SEQ ID NO: 27548 - DNA, 25 bp, Rattus norvegicus
aacgggtcagccgattcctggaaga

SEQ ID NO: 27549 - DNA, 25 bp, Rattus norvegicus
aacgggtccgaacagctctttgtgc

SEQ ID NO: 27550 - DNA, 25 bp, Rattus norvegicus
aacgggtccgaagagctctttgtgc

SEQ ID NO: 27551 - DNA, 25 bp, Rattus norvegicus
aacgggtctaatcagcccatgatca

SEQ ID NO: 27552 - DNA, 25 bp, Rattus norvegicus
aacgggtctaatgagcccatgatca

SEQ ID NO: 27553 - DNA, 25 bp, Rattus norvegicus
aacgggtctgccattggaaatcatc

SEQ ID NO: 27554 - DNA, 25 bp, Rattus norvegicus
aacgggtctgcctttggaaatcatc

SEQ ID NO: 27555 - DNA, 25 bp, Rattus norvegicus
aacgggtttgccaggtattcagcca

SEQ ID NO: 27556 - DNA, 25 bp, Rattus norvegicus
aacgggtttgcctggtattcagcca

SEQ ID NO: 27557 - DNA, 25 bp, Rattus norvegicus
aacggtaaattcagctgtttgcata

SEQ ID NO: 27558 - DNA, 25 bp, Rattus norvegicus
aacggtaaattctgctgtttgcata

SEQ ID NO: 27559 - DNA, 25 bp, Rattus norvegicus
aacggtagtcttctgtgttggctgc

SEQ ID NO: 27560 - DNA, 25 bp, Rattus norvegicus
aacggtagtcttgtgtgttggctgc

SEQ ID NO: 27561 - DNA, 25 bp, Rattus norvegicus
aacggtagtgcgagtgcaccaccaa

SEQ ID NO: 27562 - DNA, 25 bp, Rattus norvegicus
aacggtagtgcgtgtgcaccaccaa

SEQ ID NO: 27563 - DNA, 25 bp, Rattus norvegicus
aacggtatgtctcctgcggtgtgtc

SEQ ID NO: 27564 - DNA, 25 bp, Rattus norvegicus
aacggtatgtctgctgcggtgtgtc

SEQ ID NO: 27565 - DNA, 25 bp, Rattus norvegicus
aacggtattgtgcatttgtggcatt

SEQ ID NO: 27566 - DNA, 25 bp, Rattus norvegicus
aacggtattgtggatttgtggcatt

SEQ ID NO: 27567 - DNA, 25 bp, Rattus norvegicus
aacggtccactgagcccaaatccaa

SEQ ID NO: 27568 - DNA, 25 bp, Rattus norvegicus
aacggtccactgtgcccaaatccaa

SEQ ID NO: 27569 - DNA, 25 bp, Rattus norvegicus
aacggtcctttcctgagacattgag

SEQ ID NO: 27570 - DNA, 25 bp, Rattus norvegicus
aacggtcctttcgtgagacattgag

SEQ ID NO: 27571 - DNA, 25 bp, Rattus norvegicus
aacggtcgaataccgcgtcttgcaa

SEQ ID NO: 27572 - DNA, 25 bp, Rattus norvegicus
aacggtcgaatagcgcgtcttgcaa

SEQ ID NO: 27573 - DNA, 25 bp, Rattus norvegicus
aacggtctacaactggagtggctac

SEQ ID NO: 27574 - DNA, 25 bp, Rattus norvegicus
aacggtctacaagtggagtggctac

SEQ ID NO: 27575 - DNA, 25 bp, Rattus norvegicus
aacggtctctggcagttgagtgtca

SEQ ID NO: 27576 - DNA, 25 bp, Rattus norvegicus
aacggtctctgggagttgagtgtca

SEQ ID NO: 27577 - DNA, 25 bp, Rattus norvegicus
aacggtctgaccaggacgggaagct

SEQ ID NO: 27578 - DNA, 25 bp, Rattus norvegicus
aacggtctgacctggacgggaagct

SEQ ID NO: 27579 - DNA, 25 bp, Rattus norvegicus
aacggtctgggaactcactcggtag

SEQ ID NO: 27580 - DNA, 25 bp, Rattus norvegicus
aacggtctgggatctcactcggtag

SEQ ID NO: 27581 - DNA, 25 bp, Rattus norvegicus
aacggtctgtatccagctctaggtg

SEQ ID NO: 27582 - DNA, 25 bp, Rattus norvegicus
aacggtctgtatgcagctctaggtg

SEQ ID NO: 27583 - DNA, 25 bp, Rattus norvegicus
aacggtctttcacatgtttgcttta

SEQ ID NO: 27584 - DNA, 25 bp, Rattus norvegicus
aacggtctttcagatgtttgcttta

SEQ ID NO: 27585 - DNA, 25 bp, Rattus norvegicus
aacggtgaaagccacggtcatctcg

SEQ ID NO: 27586 - DNA, 25 bp, Rattus norvegicus
aacggtgaaagcgacggtcatctcg

SEQ ID NO: 27587 - DNA, 25 bp, Rattus norvegicus
aacggtgaattgctacctatactga

SEQ ID NO: 27588 - DNA, 25 bp, Rattus norvegicus
aacggtgaattggtacctatactga

SEQ ID NO: 27589 - DNA, 25 bp, Rattus norvegicus
aacggtgacagtctcgtacgtgaca

SEQ ID NO: 27590 - DNA, 25 bp, Rattus norvegicus
aacggtgacagtgtcgtacgtgaca

SEQ ID NO: 27591 - DNA, 25 bp, Rattus norvegicus
aacggtgaccccagacaaaggcaca

SEQ ID NO: 27592 - DNA, 25 bp, Rattus norvegicus
aacggtgacccctgacaaaggcaca

SEQ ID NO: 27593 - DNA, 25 bp, Rattus norvegicus
aacggtgcatgacattaatcccagc

SEQ ID NO: 27594 - DNA, 25 bp, Rattus norvegicus
aacggtgcatgagattaatcccagc

SEQ ID NO: 27595 - DNA, 25 bp, Rattus norvegicus
aacggtgccatgagtgactaagtcc

SEQ ID NO: 27596 - DNA, 25 bp, Rattus norvegicus
aacggtgccatgtgtgactaagtcc

SEQ ID NO: 27597 - DNA, 25 bp, Rattus norvegicus
aacggtggaatactgtctgcttgct

SEQ ID NO: 27598 - DNA, 25 bp, Rattus norvegicus
aacggtggaatagtgtctgcttgct

SEQ ID NO: 27599 - DNA, 25 bp, Rattus norvegicus
aacggtggagctaggctgcctgcca

SEQ ID NO: 27600 - DNA, 25 bp, Rattus norvegicus
aacggtggagcttggctgcctgcca

SEQ ID NO: 27601 - DNA, 25 bp, Rattus norvegicus
aacggtggaggaagccctgaccatc

SEQ ID NO: 27602 - DNA, 25 bp, Rattus norvegicus
aacggtggaggatgccctgaccatc

SEQ ID NO: 27603 - DNA, 25 bp, Rattus norvegicus
aacggtggagttagcactgcctgga

SEQ ID NO: 27604 - DNA, 25 bp, Rattus norvegicus
aacggtggagtttgcactgcctgga

SEQ ID NO: 27605 - DNA, 25 bp, Rattus norvegicus
aacggtggcatcaacgtcttcacac

SEQ ID NO: 27606 - DNA, 25 bp, Rattus norvegicus
aacggtggcatctacgtcttcacac

SEQ ID NO: 27607 - DNA, 25 bp, Rattus norvegicus
aacggtggccggataactattgtat

SEQ ID NO: 27608 - DNA, 25 bp, Rattus norvegicus
aacggtggccggttaactattgtat

SEQ ID NO: 27609 - DNA, 25 bp, Rattus norvegicus
aacggtggctgaagtctgcgacgac

SEQ ID NO: 27610 - DNA, 25 bp, Rattus norvegicus
aacggtggctgatgtctgcgacgac

SEQ ID NO: 27611 - DNA, 25 bp, Rattus norvegicus
aacggtgtgaatctcaagcgctatt

SEQ ID NO: 27612 - DNA, 25 bp, Rattus norvegicus
aacggtgtgaatgtcaagcgctatt

SEQ ID NO: 27613 - DNA, 25 bp, Rattus norvegicus
aacggtgtgactcctttctaacctc

SEQ ID NO: 27614 - DNA, 25 bp, Rattus norvegicus
aacggtgtgactgctttctaacctc

SEQ ID NO: 27615 - DNA, 25 bp, Rattus norvegicus
aacggtgtggttaatgctttgtgat

SEQ ID NO: 27616 - DNA, 25 bp, Rattus norvegicus
aacggtgtggtttatgctttgtgat

SEQ ID NO: 27617 - DNA, 25 bp, Rattus norvegicus
aacggttacaatccctttccagaag

SEQ ID NO: 27618 - DNA, 25 bp, Rattus norvegicus
aacggttacaatgcctttccagaag

SEQ ID NO: 27619 - DNA, 25 bp, Rattus norvegicus
aacggttcacagagcctcgcagagt

SEQ ID NO: 27620 - DNA, 25 bp, Rattus norvegicus
aacggttcacagtgcctcgcagagt

SEQ ID NO: 27621 - DNA, 25 bp, Rattus norvegicus
aacggttcagtaagcgggtctcctc

SEQ ID NO: 27622 - DNA, 25 bp, Rattus norvegicus
aacggttcagtatgcgggtctcctc

SEQ ID NO: 27623 - DNA, 25 bp, Rattus norvegicus
aacggttcatttctgtggacattgg

SEQ ID NO: 27624 - DNA, 25 bp, Rattus norvegicus
aacggttcatttgtgtggacattgg

SEQ ID NO: 27625 - DNA, 25 bp, Rattus norvegicus
aacggttctccaagctgtcactttt

SEQ ID NO: 27626 - DNA, 25 bp, Rattus norvegicus
aacggttctccatgctgtcactttt

SEQ ID NO: 27627 - DNA, 25 bp, Rattus norvegicus
aacggttgcaagattcttgagcttt

SEQ ID NO: 27628 - DNA, 25 bp, Rattus norvegicus
aacggttgcaagtttcttgagcttt

SEQ ID NO: 27629 - DNA, 25 bp, Rattus norvegicus
aacggttggttcagtaaagcgactg

SEQ ID NO: 27630 - DNA, 25 bp, Rattus norvegicus
aacggttggttctgtaaagcgactg

SEQ ID NO: 27631 - DNA, 25 bp, Rattus norvegicus
aacggttgttgtagtctctgatgtc

SEQ ID NO: 27632 - DNA, 25 bp, Rattus norvegicus
aacggttgttgttgtctctgatgtc

SEQ ID NO: 27633 - DNA, 25 bp, Rattus norvegicus
aacggtttaccgctggaatatcaag

SEQ ID NO: 27634 - DNA, 25 bp, Rattus norvegicus
aacggtttaccggtggaatatcaag

SEQ ID NO: 27635 - DNA, 25 bp, Rattus norvegicus
aacgtaaagtgtactgctttgtgaa

SEQ ID NO: 27636 - DNA, 25 bp, Rattus norvegicus
aacgtaaagtgttctgctttgtgaa

SEQ ID NO: 27637 - DNA, 25 bp, Rattus norvegicus
aacgtaactgctattgaaatcacta

SEQ ID NO: 27638 - DNA, 25 bp, Rattus norvegicus
aacgtaactgcttttgaaatcacta

SEQ ID NO: 27639 - DNA, 25 bp, Rattus norvegicus
aacgtaagatccaccattttcagca

SEQ ID NO: 27640 - DNA, 25 bp, Rattus norvegicus
aacgtaagatcctccattttcagca

SEQ ID NO: 27641 - DNA, 25 bp, Rattus norvegicus
aacgtaatccataccactcagtatt

SEQ ID NO: 27642 - DNA, 25 bp, Rattus norvegicus
aacgtaatccattccactcagtatt

SEQ ID NO: 27643 - DNA, 25 bp, Rattus norvegicus
aacgtaatctgtcacccttaggtag

SEQ ID NO: 27644 - DNA, 25 bp, Rattus norvegicus
aacgtaatctgtgacccttaggtag

SEQ ID NO: 27645 - DNA, 25 bp, Rattus norvegicus
aacgtaatgccaatgtagtctctgg

SEQ ID NO: 27646 - DNA, 25 bp, Rattus norvegicus
aacgtaatgccattgtagtctctgg

SEQ ID NO: 27647 - DNA, 25 bp, Rattus norvegicus
aacgtaccacgacctggcgtgtaga

SEQ ID NO: 27648 - DNA, 25 bp, Rattus norvegicus
aacgtaccacgagctggcgtgtaga

SEQ ID NO: 27649 - DNA, 25 bp, Rattus norvegicus
aacgtacgagtgattctgcatcaga

SEQ ID NO: 27650 - DNA, 25 bp, Rattus norvegicus
aacgtacgagtgtttctgcatcaga

SEQ ID NO: 27651 - DNA, 25 bp, Rattus norvegicus
aacgtacgctggcactttggataca

SEQ ID NO: 27652 - DNA, 25 bp, Rattus norvegicus
aacgtacgctgggactttggataca

SEQ ID NO: 27653 - DNA, 25 bp, Rattus norvegicus
aacgtactgcctcgtgccttttgta

SEQ ID NO: 27654 - DNA, 25 bp, Rattus norvegicus
aacgtactgcctggtgccttttgta

SEQ ID NO: 27655 - DNA, 25 bp, Rattus norvegicus
aacgtagacgctaccaagatgtggc

SEQ ID NO: 27656 - DNA, 25 bp, Rattus norvegicus
aacgtagacgcttccaagatgtggc

SEQ ID NO: 27657 - DNA, 25 bp, Rattus norvegicus
aacgtagacttcctctgtgaagaca

SEQ ID NO: 27658 - DNA, 25 bp, Rattus norvegicus
aacgtagacttcgtctgtgaagaca

SEQ ID NO: 27659 - DNA, 25 bp, Rattus norvegicus
aacgtagagcccagcaacagagtca

SEQ ID NO: 27660 - DNA, 25 bp, Rattus norvegicus
aacgtagagccctgcaacagagtca

SEQ ID NO: 27661 - DNA, 25 bp, Rattus norvegicus
aacgtagatgctcatctctgctctc

SEQ ID NO: 27662 - DNA, 25 bp, Rattus norvegicus
aacgtagatgctgatctctgctctc

SEQ ID NO: 27663 - DNA, 25 bp, Rattus norvegicus
aacgtagcccttctggccagagtgg

SEQ ID NO: 27664 - DNA, 25 bp, Rattus norvegicus
aacgtagcccttgtggccagagtgg

SEQ ID NO: 27665 - DNA, 25 bp, Rattus norvegicus
aacgtagggaagattcatggcattg

SEQ ID NO: 27666 - DNA, 25 bp, Rattus norvegicus
aacgtagggaagtttcatggcattg

SEQ ID NO: 27667 - DNA, 25 bp, Rattus norvegicus
aacgtagttgctctgactcacactc

SEQ ID NO: 27668 - DNA, 25 bp, Rattus norvegicus
aacgtagttgctgtgactcacactc

SEQ ID NO: 27669 - DNA, 25 bp, Rattus norvegicus
aacgtatgcggtatatcacttatac

SEQ ID NO: 27670 - DNA, 25 bp, Rattus norvegicus
aacgtatgcggtttatcacttatac

SEQ ID NO: 27671 - DNA, 25 bp, Rattus norvegicus
aacgtatgtttcactaagcctaagg

SEQ ID NO: 27672 - DNA, 25 bp, Rattus norvegicus
aacgtatgtttctctaagcctaagg

SEQ ID NO: 27673 - DNA, 25 bp, Rattus norvegicus
aacgtattctggaaacagttggcca

SEQ ID NO: 27674 - DNA, 25 bp, Rattus norvegicus
aacgtattctggtaacagttggcca

SEQ ID NO: 27675 - DNA, 25 bp, Rattus norvegicus
aacgtattgattccccttaaatatt

SEQ ID NO: 27676 - DNA, 25 bp, Rattus norvegicus
aacgtattgattgcccttaaatatt

SEQ ID NO: 27677 - DNA, 25 bp, Rattus norvegicus
aacgtcaaacatatgcgccagctac

SEQ ID NO: 27678 - DNA, 25 bp, Rattus norvegicus
aacgtcaaacatttgcgccagctac

SEQ ID NO: 27679 - DNA, 25 bp, Rattus norvegicus
aacgtcaagcccatggcatacgcca

SEQ ID NO: 27680 - DNA, 25 bp, Rattus norvegicus
aacgtcaagcccttggcatacgcca

SEQ ID NO: 27681 - DNA, 25 bp, Rattus norvegicus
aacgtcaagttgatctaagtaccag

SEQ ID NO: 27682 - DNA, 25 bp, Rattus norvegicus
aacgtcaagttgttctaagtaccag

SEQ ID NO: 27683 - DNA, 25 bp, Rattus norvegicus
aacgtcacggctaatgttaggcata

SEQ ID NO: 27684 - DNA, 25 bp, Rattus norvegicus
aacgtcacggcttatgttaggcata

SEQ ID NO: 27685 - DNA, 25 bp, Rattus norvegicus
aacgtcagcaaactatcgggtcaac

SEQ ID NO: 27686 - DNA, 25 bp, Rattus norvegicus
aacgtcagcaaagtatcgggtcaac

SEQ ID NO: 27687 - DNA, 25 bp, Rattus norvegicus
aacgtcagggacagtctcaggtact

SEQ ID NO: 27688 - DNA, 25 bp, Rattus norvegicus
aacgtcagggactgtctcaggtact

SEQ ID NO: 27689 - DNA, 25 bp, Rattus norvegicus
aacgtcagtagtcatctctgtggca

SEQ ID NO: 27690 - DNA, 25 bp, Rattus norvegicus
aacgtcagtagtgatctctgtggca

SEQ ID NO: 27691 - DNA, 25 bp, Rattus norvegicus
aacgtcatatgcatggaacagttat

SEQ ID NO: 27692 - DNA, 25 bp, Rattus norvegicus
aacgtcatatgcttggaacagttat

SEQ ID NO: 27693 - DNA, 25 bp, Rattus norvegicus
aacgtcatcaaaaaggtctccagtg

SEQ ID NO: 27694 - DNA, 25 bp, Rattus norvegicus
aacgtcatcaaataggtctccagtg

SEQ ID NO: 27695 - DNA, 25 bp, Rattus norvegicus
aacgtccacctgagtgagttgtatc

SEQ ID NO: 27696 - DNA, 25 bp, Rattus norvegicus
aacgtccacctgtgtgagttgtatc

SEQ ID NO: 27697 - DNA, 25 bp, Rattus norvegicus
aacgtccactggagttaagttccag

SEQ ID NO: 27698 - DNA, 25 bp, Rattus norvegicus
aacgtccactggtgttaagttccag

SEQ ID NO: 27699 - DNA, 25 bp, Rattus norvegicus
aacgtccagtccaagtgtggctcaa

SEQ ID NO: 27700 - DNA, 25 bp, Rattus norvegicus
aacgtccagtcctagtgtggctcaa

SEQ ID NO: 27701 - DNA, 25 bp, Rattus norvegicus
aacgtcccactgagcaggagctgag

SEQ ID NO: 27702 - DNA, 25 bp, Rattus norvegicus
aacgtcccactgtgcaggagctgag

SEQ ID NO: 27703 - DNA, 25 bp, Rattus norvegicus
aacgtccgagctaacattttggtct

SEQ ID NO: 27704 - DNA, 25 bp, Rattus norvegicus
aacgtccgagcttacattttggtct

SEQ ID NO: 27705 - DNA, 25 bp, Rattus norvegicus
aacgtccgcgcgaggcgccttctgg

SEQ ID NO: 27706 - DNA, 25 bp, Rattus norvegicus
aacgtccgcgcgtggcgccttctgg

SEQ ID NO: 27707 - DNA, 25 bp, Rattus norvegicus
aacgtcctagccagcttttgaacac

SEQ ID NO: 27708 - DNA, 25 bp, Rattus norvegicus
aacgtcctagcctgcttttgaacac

SEQ ID NO: 27709 - DNA, 25 bp, Rattus norvegicus
aacgtcctcctcagaacaatgggaa

SEQ ID NO: 27710 - DNA, 25 bp, Rattus norvegicus
aacgtcctcctctgaacaatgggaa

SEQ ID NO: 27711 - DNA, 25 bp, Rattus norvegicus
aacgtcctcgttcttcctagttgca

SEQ ID NO: 27712 - DNA, 25 bp, Rattus norvegicus
aacgtcctcgttgttcctagttgca

SEQ ID NO: 27713 - DNA, 25 bp, Rattus norvegicus
aacgtcctgcttattgttaggccat

SEQ ID NO: 27714 - DNA, 25 bp, Rattus norvegicus
aacgtcctgctttttgttaggccat

SEQ ID NO: 27715 - DNA, 25 bp, Rattus norvegicus
aacgtcgagtggagtcagtaccctt

SEQ ID NO: 27716 - DNA, 25 bp, Rattus norvegicus
aacgtcgagtggtgtcagtaccctt

SEQ ID NO: 27717 - DNA, 25 bp, Rattus norvegicus
aacgtcgatggtccaagggctgcca

SEQ ID NO: 27718 - DNA, 25 bp, Rattus norvegicus
aacgtcgatggtgcaagggctgcca

SEQ ID NO: 27719 - DNA, 25 bp, Rattus norvegicus
aacgtcgcactgcagctacaacagg

SEQ ID NO: 27720 - DNA, 25 bp, Rattus norvegicus
aacgtcgcactggagctacaacagg

SEQ ID NO: 27721 - DNA, 25 bp, Rattus norvegicus
aacgtcgccaatcctctggtatatt

SEQ ID NO: 27722 - DNA, 25 bp, Rattus norvegicus
aacgtcgccaatgctctggtatatt

SEQ ID NO: 27723 - DNA, 25 bp, Rattus norvegicus
aacgtcgcctgccaaactgtaaatc

SEQ ID NO: 27724 - DNA, 25 bp, Rattus norvegicus
aacgtcgcctgcgaaactgtaaatc

SEQ ID NO: 27725 - DNA, 25 bp, Rattus norvegicus
aacgtcggactcaacatgcaatatt

SEQ ID NO: 27726 - DNA, 25 bp, Rattus norvegicus
aacgtcggactctacatgcaatatt

SEQ ID NO: 27727 - DNA, 25 bp, Rattus norvegicus
aacgtcggccttatcgatcagtact

SEQ ID NO: 27728 - DNA, 25 bp, Rattus norvegicus
aacgtcggccttttcgatcagtact

SEQ ID NO: 27729 - DNA, 25 bp, Rattus norvegicus
aacgtcgtagctccatccgggaaaa

SEQ ID NO: 27730 - DNA, 25 bp, Rattus norvegicus
aacgtcgtagctgcatccgggaaaa

SEQ ID NO: 27731 - DNA, 25 bp, Rattus norvegicus
aacgtcgtcagccaggcctcatgtt

SEQ ID NO: 27732 - DNA, 25 bp, Rattus norvegicus
aacgtcgtcagcgaggcctcatgtt

SEQ ID NO: 27733 - DNA, 25 bp, Rattus norvegicus
aacgtcgtcgctatgaagatcccac

SEQ ID NO: 27734 - DNA, 25 bp, Rattus norvegicus
aacgtcgtcgctttgaagatcccac

SEQ ID NO: 27735 - DNA, 25 bp, Rattus norvegicus
aacgtcgtgatcctgtattgctgta

SEQ ID NO: 27736 - DNA, 25 bp, Rattus norvegicus
aacgtcgtgatcgtgtattgctgta

SEQ ID NO: 27737 - DNA, 25 bp, Rattus norvegicus
aacgtctactgcagtttattccagt

SEQ ID NO: 27738 - DNA, 25 bp, Rattus norvegicus
aacgtctactgctgtttattccagt

SEQ ID NO: 27739 - DNA, 25 bp, Rattus norvegicus
aacgtctagtttctggtgtcactga

SEQ ID NO: 27740 - DNA, 25 bp, Rattus norvegicus
aacgtctagtttgtggtgtcactga

SEQ ID NO: 27741 - DNA, 25 bp, Rattus norvegicus
aacgtctatggacgtcctaagggag

SEQ ID NO: 27742 - DNA, 25 bp, Rattus norvegicus
aacgtctatggaggtcctaagggag

SEQ ID NO: 27743 - DNA, 25 bp, Rattus norvegicus
aacgtctcctcaactgatctcacgg

SEQ ID NO: 27744 - DNA, 25 bp, Rattus norvegicus
aacgtctcctcatctgatctcacgg

SEQ ID NO: 27745 - DNA, 25 bp, Rattus norvegicus
aacgtctcctgtcaatatgtctatg

SEQ ID NO: 27746 - DNA, 25 bp, Rattus norvegicus
aacgtctcctgtgaatatgtctatg

SEQ ID NO: 27747 - DNA, 25 bp, Rattus norvegicus
aacgtctctcatcagtgccttgttg

SEQ ID NO: 27748 - DNA, 25 bp, Rattus norvegicus
aacgtctctcatgagtgccttgttg

SEQ ID NO: 27749 - DNA, 25 bp, Rattus norvegicus
aacgtctcttctcaatactttgatt

SEQ ID NO: 27750 - DNA, 25 bp, Rattus norvegicus
aacgtctcttctgaatactttgatt

SEQ ID NO: 27751 - DNA, 25 bp, Rattus norvegicus
aacgtctcttgccaccgttgtcttt

SEQ ID NO: 27752 - DNA, 25 bp, Rattus norvegicus
aacgtctcttgcgaccgttgtcttt

SEQ ID NO: 27753 - DNA, 25 bp, Rattus norvegicus
aacgtctgctatcacaagtccttcc

SEQ ID NO: 27754 - DNA, 25 bp, Rattus norvegicus
aacgtctgctatgacaagtccttcc

SEQ ID NO: 27755 - DNA, 25 bp, Rattus norvegicus
aacgtctggcagattttgtttctta

SEQ ID NO: 27756 - DNA, 25 bp, Rattus norvegicus
aacgtctggcagtttttgtttctta

SEQ ID NO: 27757 - DNA, 25 bp, Rattus norvegicus
aacgtctgggtcagcctattgttct

SEQ ID NO: 27758 - DNA, 25 bp, Rattus norvegicus
aacgtctgggtctgcctattgttct

SEQ ID NO: 27759 - DNA, 25 bp, Rattus norvegicus
aacgtctgtcaaactcggtaggctt

SEQ ID NO: 27760 - DNA, 25 bp, Rattus norvegicus
aacgtctgtcaatctcggtaggctt

SEQ ID NO: 27761 - DNA, 25 bp, Rattus norvegicus
aacgtctgtccaacctgcaggagag

SEQ ID NO: 27762 - DNA, 25 bp, Rattus norvegicus
aacgtctgtccatcctgcaggagag

SEQ ID NO: 27763 - DNA, 25 bp, Rattus norvegicus
aacgtcttcatgatgcttgtagtca

SEQ ID NO: 27764 - DNA, 25 bp, Rattus norvegicus
aacgtcttcatgttgcttgtagtca

SEQ ID NO: 27765 - DNA, 25 bp, Rattus norvegicus
aacgtctttgagatctttttgtcag

SEQ ID NO: 27766 - DNA, 25 bp, Rattus norvegicus
aacgtctttgagttctttttgtcag

SEQ ID NO: 27767 - DNA, 25 bp, Rattus norvegicus
aacgtctttgccacagttgattcaa

SEQ ID NO: 27768 - DNA, 25 bp, Rattus norvegicus
aacgtctttgcctcagttgattcaa

SEQ ID NO: 27769 - DNA, 25 bp, Rattus norvegicus
aacgtgaatgaaccagcctctgaca

SEQ ID NO: 27770 - DNA, 25 bp, Rattus norvegicus
aacgtgaatgaagcagcctctgaca

SEQ ID NO: 27771 - DNA, 25 bp, Rattus norvegicus
aacgtgaccacaaatatctcagccc

SEQ ID NO: 27772 - DNA, 25 bp, Rattus norvegicus
aacgtgaccacatatatctcagccc

SEQ ID NO: 27773 - DNA, 25 bp, Rattus norvegicus
aacgtgaccggcaccaatgcggtga

SEQ ID NO: 27774 - DNA, 25 bp, Rattus norvegicus
aacgtgaccggctccaatgcggtga

SEQ ID NO: 27775 - DNA, 25 bp, Rattus norvegicus
aacgtgactgggaaggcctggatat

SEQ ID NO: 27776 - DNA, 25 bp, Rattus norvegicus
aacgtgactgggtaggcctggatat

SEQ ID NO: 27777 - DNA, 25 bp, Rattus norvegicus
aacgtgagaggccacagcttgctcc

SEQ ID NO: 27778 - DNA, 25 bp, Rattus norvegicus
aacgtgagaggcgacagcttgctcc

SEQ ID NO: 27779 - DNA, 25 bp, Rattus norvegicus
aacgtgagatcaagcattccaggaa

SEQ ID NO: 27780 - DNA, 25 bp, Rattus norvegicus
aacgtgagatcatgcattccaggaa

SEQ ID NO: 27781 - DNA, 25 bp, Rattus norvegicus
aacgtgagccgtattcatgcagaca

SEQ ID NO: 27782 - DNA, 25 bp, Rattus norvegicus
aacgtgagccgttttcatgcagaca

SEQ ID NO: 27783 - DNA, 25 bp, Rattus norvegicus
aacgtgagcctgactgtacatcttt

SEQ ID NO: 27784 - DNA, 25 bp, Rattus norvegicus
aacgtgagcctgtctgtacatcttt

SEQ ID NO: 27785 - DNA, 25 bp, Rattus norvegicus
aacgtgagctgacctggaaccaggc

SEQ ID NO: 27786 - DNA, 25 bp, Rattus norvegicus
aacgtgagctgagctggaaccaggc

SEQ ID NO: 27787 - DNA, 25 bp, Rattus norvegicus
aacgtgaggaaaagagacaggctgt

SEQ ID NO: 27788 - DNA, 25 bp, Rattus norvegicus
aacgtgaggaaatgagacaggctgt

SEQ ID NO: 27789 - DNA, 25 bp, Rattus norvegicus
aacgtgaggaccagaggcagaataa

SEQ ID NO: 27790 - DNA, 25 bp, Rattus norvegicus
aacgtgaggacctgaggcagaataa

SEQ ID NO: 27791 - DNA, 25 bp, Rattus norvegicus
aacgtgagttccaagacatccaggg

SEQ ID NO: 27792 - DNA, 25 bp, Rattus norvegicus
aacgtgagttcctagacatccaggg

SEQ ID NO: 27793 - DNA, 25 bp, Rattus norvegicus
aacgtgataccaccagccgaagttc

SEQ ID NO: 27794 - DNA, 25 bp, Rattus norvegicus
aacgtgataccagcagccgaagttc

SEQ ID NO: 27795 - DNA, 25 bp, Rattus norvegicus
aacgtgatcgttacgcttggcgaga

SEQ ID NO: 27796 - DNA, 25 bp, Rattus norvegicus
aacgtgatcgtttcgcttggcgaga

SEQ ID NO: 27797 - DNA, 25 bp, Rattus norvegicus
aacgtgattgcaatctattaaccga

SEQ ID NO: 27798 - DNA, 25 bp, Rattus norvegicus
aacgtgattgcattctattaaccga

SEQ ID NO: 27799 - DNA, 25 bp, Rattus norvegicus
aacgtgcaatgcatgttgtccagcc

SEQ ID NO: 27800 - DNA, 25 bp, Rattus norvegicus
aacgtgcaatgcttgttgtccagcc

SEQ ID NO: 27801 - DNA, 25 bp, Rattus norvegicus
aacgtgcagaaaagtctccccaggc

SEQ ID NO: 27802 - DNA, 25 bp, Rattus norvegicus
aacgtgcagaaatgtctccccaggc

SEQ ID NO: 27803 - DNA, 25 bp, Rattus norvegicus
aacgtgcagcgcctgaaggagtacc

SEQ ID NO: 27804 - DNA, 25 bp, Rattus norvegicus
aacgtgcagcgcgtgaaggagtacc

SEQ ID NO: 27805 - DNA, 25 bp, Rattus norvegicus
aacgtgcatcctaactaccacaaag

SEQ ID NO: 27806 - DNA, 25 bp, Rattus norvegicus
aacgtgcatccttactaccacaaag

SEQ ID NO: 27807 - DNA, 25 bp, Rattus norvegicus
aacgtgcatgaaatactttgacctc

SEQ ID NO: 27808 - DNA, 25 bp, Rattus norvegicus
aacgtgcatgaattactttgacctc

SEQ ID NO: 27809 - DNA, 25 bp, Rattus norvegicus
aacgtgcattgcagggaagccgctg

SEQ ID NO: 27810 - DNA, 25 bp, Rattus norvegicus
aacgtgcattgctgggaagccgctg

SEQ ID NO: 27811 - DNA, 25 bp, Rattus norvegicus
aacgtgccaagtctcccatgggaac

SEQ ID NO: 27812 - DNA, 25 bp, Rattus norvegicus
aacgtgccaagtgtcccatgggaac

SEQ ID NO: 27813 - DNA, 25 bp, Rattus norvegicus
aacgtgccaatccttatcttgggaa

SEQ ID NO: 27814 - DNA, 25 bp, Rattus norvegicus
aacgtgccaatcgttatcttgggaa

SEQ ID NO: 27815 - DNA, 25 bp, Rattus norvegicus
aacgtgcgcgttcacgtagcagccc

SEQ ID NO: 27816 - DNA, 25 bp, Rattus norvegicus
aacgtgcgcgttgacgtagcagccc

SEQ ID NO: 27817 - DNA, 25 bp, Rattus norvegicus
aacgtgctcaccagcttttcttttt

SEQ ID NO: 27818 - DNA, 25 bp, Rattus norvegicus
aacgtgctcacctgcttttcttttt

SEQ ID NO: 27819 - DNA, 25 bp, Rattus norvegicus
aacgtgctcagtacgctgttttaat

SEQ ID NO: 27820 - DNA, 25 bp, Rattus norvegicus
aacgtgctcagttcgctgttttaat

SEQ ID NO: 27821 - DNA, 25 bp, Rattus norvegicus
aacgtgctccacaggaaggtccagt

SEQ ID NO: 27822 - DNA, 25 bp, Rattus norvegicus
aacgtgctccactggaaggtccagt

SEQ ID NO: 27823 - DNA, 25 bp, Rattus norvegicus
aacgtgctgcacataagcctctggg

SEQ ID NO: 27824 - DNA, 25 bp, Rattus norvegicus
aacgtgctgcacttaagcctctggg

SEQ ID NO: 27825 - DNA, 25 bp, Rattus norvegicus
aacgtgctggacagtctgtgtctgt

SEQ ID NO: 27826 - DNA, 25 bp, Rattus norvegicus
aacgtgctggactgtctgtgtctgt

SEQ ID NO: 27827 - DNA, 25 bp, Rattus norvegicus
aacgtgctggtcactgagtctctca

SEQ ID NO: 27828 - DNA, 25 bp, Rattus norvegicus
aacgtgctggtctctgagtctctca

SEQ ID NO: 27829 - DNA, 25 bp, Rattus norvegicus
aacgtgctggtgactgagttccatt

SEQ ID NO: 27830 - DNA, 25 bp, Rattus norvegicus
aacgtgctggtgtctgagttccatt

SEQ ID NO: 27831 - DNA, 25 bp, Rattus norvegicus
aacgtgcttagccaggtcagaacca

SEQ ID NO: 27832 - DNA, 25 bp, Rattus norvegicus
aacgtgcttagcgaggtcagaacca

SEQ ID NO: 27833 - DNA, 25 bp, Rattus norvegicus
aacgtgctttgtaagccttcgggca

SEQ ID NO: 27834 - DNA, 25 bp, Rattus norvegicus
aacgtgctttgttagccttcgggca

SEQ ID NO: 27835 - DNA, 25 bp, Rattus norvegicus
aacgtggaattgacgttcttgccca

SEQ ID NO: 27836 - DNA, 25 bp, Rattus norvegicus
aacgtggaattgtcgttcttgccca

SEQ ID NO: 27837 - DNA, 25 bp, Rattus norvegicus
aacgtggacagacgccaggccagac

SEQ ID NO: 27838 - DNA, 25 bp, Rattus norvegicus
aacgtggacagaggccaggccagac

SEQ ID NO: 27839 - DNA, 25 bp, Rattus norvegicus
aacgtggaccacctagcgcagctca

SEQ ID NO: 27840 - DNA, 25 bp, Rattus norvegicus
aacgtggaccacgtagcgcagctca

SEQ ID NO: 27841 - DNA, 25 bp, Rattus norvegicus
aacgtggacgccacggtgatgtaca

SEQ ID NO: 27842 - DNA, 25 bp, Rattus norvegicus
aacgtggacgcctcggtgatgtaca

SEQ ID NO: 27843 - DNA, 25 bp, Rattus norvegicus
aacgtggagcacatacaagtacgat

SEQ ID NO: 27844 - DNA, 25 bp, Rattus norvegicus
aacgtggagcacttacaagtacgat

SEQ ID NO: 27845 - DNA, 25 bp, Rattus norvegicus
aacgtggagctcaaatacgccttat

SEQ ID NO: 27846 - DNA, 25 bp, Rattus norvegicus
aacgtggagctctaatacgccttat

SEQ ID NO: 27847 - DNA, 25 bp, Rattus norvegicus
aacgtggagtcaagattccctccct

SEQ ID NO: 27848 - DNA, 25 bp, Rattus norvegicus
aacgtggagtcatgattccctccct

SEQ ID NO: 27849 - DNA, 25 bp, Rattus norvegicus
aacgtggagttccttaagtctcaga

SEQ ID NO: 27850 - DNA, 25 bp, Rattus norvegicus
aacgtggagttcgttaagtctcaga

SEQ ID NO: 27851 - DNA, 25 bp, Rattus norvegicus
aacgtggcctccatgtggctgaagt

SEQ ID NO: 27852 - DNA, 25 bp, Rattus norvegicus
aacgtggcctccttgtggctgaagt

SEQ ID NO: 27853 - DNA, 25 bp, Rattus norvegicus
aacgtgggacctctgatcatcaaga

SEQ ID NO: 27854 - DNA, 25 bp, Rattus norvegicus
aacgtgggacctgtgatcatcaaga

SEQ ID NO: 27855 - DNA, 25 bp, Rattus norvegicus
aacgtgggatgcagagatttcctga

SEQ ID NO: 27856 - DNA, 25 bp, Rattus norvegicus
aacgtgggatgctgagatttcctga

SEQ ID NO: 27857 - DNA, 25 bp, Rattus norvegicus
aacgtgggccataagcactctgcta

SEQ ID NO: 27858 - DNA, 25 bp, Rattus norvegicus
aacgtgggccattagcactctgcta

SEQ ID NO: 27859 - DNA, 25 bp, Rattus norvegicus
aacgtgggcggcacgctgcactaca

SEQ ID NO: 27860 - DNA, 25 bp, Rattus norvegicus
aacgtgggcggctcgctgcactaca

SEQ ID NO: 27861 - DNA, 25 bp, Rattus norvegicus
aacgtgggcttcctagaggcactga

SEQ ID NO: 27862 - DNA, 25 bp, Rattus norvegicus
aacgtgggcttccttcttggttctg

SEQ ID NO: 27863 - DNA, 25 bp, Rattus norvegicus
aacgtgggcttcgtagaggcactga

SEQ ID NO: 27864 - DNA, 25 bp, Rattus norvegicus
aacgtgggcttcgttcttggttctg

SEQ ID NO: 27865 - DNA, 25 bp, Rattus norvegicus
aacgtgggtctcagtatcgcagtgg

SEQ ID NO: 27866 - DNA, 25 bp, Rattus norvegicus
aacgtgggtctctgtatcgcagtgg

SEQ ID NO: 27867 - DNA, 25 bp, Rattus norvegicus
aacgtgggtgtcaagttcttagcct

SEQ ID NO: 27868 - DNA, 25 bp, Rattus norvegicus
aacgtgggtgtctagttcttagcct

SEQ ID NO: 27869 - DNA, 25 bp, Rattus norvegicus
aacgtgggttaaactctcatctgtt

SEQ ID NO: 27870 - DNA, 25 bp, Rattus norvegicus
aacgtgggttaatctctcatctgtt

SEQ ID NO: 27871 - DNA, 25 bp, Rattus norvegicus
aacgtggtagagaatgtgtaacaat

SEQ ID NO: 27872 - DNA, 25 bp, Rattus norvegicus
aacgtggtagagtatgtgtaacaat

SEQ ID NO: 27873 - DNA, 25 bp, Rattus norvegicus
aacgtggtcaccatcgagtagagaa

SEQ ID NO: 27874 - DNA, 25 bp, Rattus norvegicus
aacgtggtcaccttcgagtagagaa

SEQ ID NO: 27875 - DNA, 25 bp, Rattus norvegicus
aacgtggtgtcaagagtcatcaact

SEQ ID NO: 27876 - DNA, 25 bp, Rattus norvegicus
aacgtggtgtcatgagtcatcaact

SEQ ID NO: 27877 - DNA, 25 bp, Rattus norvegicus
aacgtgtaccggcttatcctgtgct

SEQ ID NO: 27878 - DNA, 25 bp, Rattus norvegicus
aacgtgtaccgggttatcctgtgct

SEQ ID NO: 27879 - DNA, 25 bp, Rattus norvegicus
aacgtgtagccgacactggactcga

SEQ ID NO: 27880 - DNA, 25 bp, Rattus norvegicus
aacgtgtagccgtcactggactcga

SEQ ID NO: 27881 - DNA, 25 bp, Rattus norvegicus
aacgtgtaggtcaattagtaaggat

SEQ ID NO: 27882 - DNA, 25 bp, Rattus norvegicus
aacgtgtaggtcattgtctgctaac

SEQ ID NO: 27883 - DNA, 25 bp, Rattus norvegicus
aacgtgtaggtctattagtaaggat

SEQ ID NO: 27884 - DNA, 25 bp, Rattus norvegicus
aacgtgtaggtctttgtctgctaac

SEQ ID NO: 27885 - DNA, 25 bp, Rattus norvegicus
aacgtgtatttgaagcccttcatgc

SEQ ID NO: 27886 - DNA, 25 bp, Rattus norvegicus
aacgtgtatttgtagcccttcatgc

SEQ ID NO: 27887 - DNA, 25 bp, Rattus norvegicus
aacgtgtcacttcgtctgagcttta

SEQ ID NO: 27888 - DNA, 25 bp, Rattus norvegicus
aacgtgtcacttggtctgagcttta

SEQ ID NO: 27889 - DNA, 25 bp, Rattus norvegicus
aacgtgtcagagcacccaatgtgtt

SEQ ID NO: 27890 - DNA, 25 bp, Rattus norvegicus
aacgtgtcagaggacccaatgtgtt

SEQ ID NO: 27891 - DNA, 25 bp, Rattus norvegicus
aacgtgtccttgagaactgcttggc

SEQ ID NO: 27892 - DNA, 25 bp, Rattus norvegicus
aacgtgtccttgtgaactgcttggc

SEQ ID NO: 27893 - DNA, 25 bp, Rattus norvegicus
aacgtgtgactcactgatagctggg

SEQ ID NO: 27894 - DNA, 25 bp, Rattus norvegicus
aacgtgtgactctctgatagctggg

SEQ ID NO: 27895 - DNA, 25 bp, Rattus norvegicus
aacgtgtgagccctcagctaggctt

SEQ ID NO: 27896 - DNA, 25 bp, Rattus norvegicus
aacgtgtgagccgtcagctaggctt

SEQ ID NO: 27897 - DNA, 25 bp, Rattus norvegicus
aacgtgtgctgtctgattgtggcct

SEQ ID NO: 27898 - DNA, 25 bp, Rattus norvegicus
aacgtgtgctgtgtgattgtggcct

SEQ ID NO: 27899 - DNA, 25 bp, Rattus norvegicus
aacgtgtggcaccacctctcagact

SEQ ID NO: 27900 - DNA, 25 bp, Rattus norvegicus
aacgtgtggcacgacctctcagact

SEQ ID NO: 27901 - DNA, 25 bp, Rattus norvegicus
aacgtgtgggccatgtttctcagta

SEQ ID NO: 27902 - DNA, 25 bp, Rattus norvegicus
aacgtgtgggccttgtttctcagta

SEQ ID NO: 27903 - DNA, 25 bp, Rattus norvegicus
aacgtgtgtggaacaacttttgcaa

SEQ ID NO: 27904 - DNA, 25 bp, Rattus norvegicus
aacgtgtgtggatcaacttttgcaa

SEQ ID NO: 27905 - DNA, 25 bp, Rattus norvegicus
aacgtgtgttacaggacgcatgtcc

SEQ ID NO: 27906 - DNA, 25 bp, Rattus norvegicus
aacgtgtgttactggacgcatgtcc

SEQ ID NO: 27907 - DNA, 25 bp, Rattus norvegicus
aacgtgtgtttgcagtttgtttgac

SEQ ID NO: 27908 - DNA, 25 bp, Rattus norvegicus
aacgtgtgtttggagtttgtttgac

SEQ ID NO: 27909 - DNA, 25 bp, Rattus norvegicus
aacgtgttccagcttccaggaggcc

SEQ ID NO: 27910 - DNA, 25 bp, Rattus norvegicus
aacgtgttccaggttccaggaggcc

SEQ ID NO: 27911 - DNA, 25 bp, Rattus norvegicus
aacgtgttcctgattacgctggcta

SEQ ID NO: 27912 - DNA, 25 bp, Rattus norvegicus
aacgtgttcctgtttacgctggcta

SEQ ID NO: 27913 - DNA, 25 bp, Rattus norvegicus
aacgtgttctccctgtgccaagtag

SEQ ID NO: 27914 - DNA, 25 bp, Rattus norvegicus
aacgtgttctccgtgtgccaagtag

SEQ ID NO: 27915 - DNA, 25 bp, Rattus norvegicus
aacgtgttctttcacagtgttggac

SEQ ID NO: 27916 - DNA, 25 bp, Rattus norvegicus
aacgtgttctttgacagtgttggac

SEQ ID NO: 27917 - DNA, 25 bp, Rattus norvegicus
aacgtgttgtatagctcctatcgaa

SEQ ID NO: 27918 - DNA, 25 bp, Rattus norvegicus
aacgtgttgtattgctcctatcgaa

SEQ ID NO: 27919 - DNA, 25 bp, Rattus norvegicus
aacgtgtttcctagctgggaccagg

SEQ ID NO: 27920 - DNA, 25 bp, Rattus norvegicus
aacgtgtttccttgctgggaccagg

SEQ ID NO: 27921 - DNA, 25 bp, Rattus norvegicus
aacgttaagcatctttcagcattta

SEQ ID NO: 27922 - DNA, 25 bp, Rattus norvegicus
aacgttaagcatgtttcagcattta

SEQ ID NO: 27923 - DNA, 25 bp, Rattus norvegicus
aacgttacaggccagctttataatt

SEQ ID NO: 27924 - DNA, 25 bp, Rattus norvegicus
aacgttacaggcgagctttataatt

SEQ ID NO: 27925 - DNA, 25 bp, Rattus norvegicus
aacgttaccagaacaaggccatcct

SEQ ID NO: 27926 - DNA, 25 bp, Rattus norvegicus
aacgttaccagatcaaggccatcct

SEQ ID NO: 27927 - DNA, 25 bp, Rattus norvegicus
aacgttacgtgaatgggtgccccag

SEQ ID NO: 27928 - DNA, 25 bp, Rattus norvegicus
aacgttacgtgattgggtgccccag

SEQ ID NO: 27929 - DNA, 25 bp, Rattus norvegicus
aacgttactttacagtcgcctgcca

SEQ ID NO: 27930 - DNA, 25 bp, Rattus norvegicus
aacgttactttagagtcgcctgcca

SEQ ID NO: 27931 - DNA, 25 bp, Rattus norvegicus
aacgttagaagaatcactccagggc

SEQ ID NO: 27932 - DNA, 25 bp, Rattus norvegicus
aacgttagaagattcactccagggc

SEQ ID NO: 27933 - DNA, 25 bp, Rattus norvegicus
aacgttatgatgacctgcgaagaca

SEQ ID NO: 27934 - DNA, 25 bp, Rattus norvegicus
aacgttatgatgtcctgcgaagaca

SEQ ID NO: 27935 - DNA, 25 bp, Rattus norvegicus
aacgttatttacaacctgatggcag

SEQ ID NO: 27936 - DNA, 25 bp, Rattus norvegicus
aacgttatttactacctgatggcag

SEQ ID NO: 27937 - DNA, 25 bp, Rattus norvegicus
aacgttcagttactaatgagttgat

SEQ ID NO: 27938 - DNA, 25 bp, Rattus norvegicus
aacgttcagttagtaatgagttgat

SEQ ID NO: 27939 - DNA, 25 bp, Rattus norvegicus
aacgttcatccacggacaagttgga

SEQ ID NO: 27940 - DNA, 25 bp, Rattus norvegicus
aacgttcatccagggacaagttgga

SEQ ID NO: 27941 - DNA, 25 bp, Rattus norvegicus
aacgttccagggatcttggagccac

SEQ ID NO: 27942 - DNA, 25 bp, Rattus norvegicus
aacgttccagggttcttggagccac

SEQ ID NO: 27943 - DNA, 25 bp, Rattus norvegicus
aacgttccagtgctccaatatcgat

SEQ ID NO: 27944 - DNA, 25 bp, Rattus norvegicus
aacgttccagtggtccaatatcgat

SEQ ID NO: 27945 - DNA, 25 bp, Rattus norvegicus
aacgttccctttcatcttctgataa

SEQ ID NO: 27946 - DNA, 25 bp, Rattus norvegicus
aacgttccctttgatcttctgataa

SEQ ID NO: 27947 - DNA, 25 bp, Rattus norvegicus
aacgttctgcttaacaacctcatca

SEQ ID NO: 27948 - DNA, 25 bp, Rattus norvegicus
aacgttctgctttacaacctcatca

SEQ ID NO: 27949 - DNA, 25 bp, Rattus norvegicus
aacgttcttgctactaatgtccatc

SEQ ID NO: 27950 - DNA, 25 bp, Rattus norvegicus
aacgttcttgcttctaatgtccatc

SEQ ID NO: 27951 - DNA, 25 bp, Rattus norvegicus
aacgttcttggtcctattgaaacat

SEQ ID NO: 27952 - DNA, 25 bp, Rattus norvegicus
aacgttcttggtgctattgaaacat

SEQ ID NO: 27953 - DNA, 25 bp, Rattus norvegicus
aacgttgacttgatagggcttcggc

SEQ ID NO: 27954 - DNA, 25 bp, Rattus norvegicus
aacgttgacttgttagggcttcggc

SEQ ID NO: 27955 - DNA, 25 bp, Rattus norvegicus
aacgttgccgaacgcgtgtgctgct

SEQ ID NO: 27956 - DNA, 25 bp, Rattus norvegicus
aacgttgccgaaggcgtgtgctgct

SEQ ID NO: 27957 - DNA, 25 bp, Rattus norvegicus
aacgttgccgcccaacaatttggcg

SEQ ID NO: 27958 - DNA, 25 bp, Rattus norvegicus
aacgttgccgccgaacaatttggcg

SEQ ID NO: 27959 - DNA, 25 bp, Rattus norvegicus
aacgttgccttaaagcacatgcctc

SEQ ID NO: 27960 - DNA, 25 bp, Rattus norvegicus
aacgttgccttatagcacatgcctc

SEQ ID NO: 27961 - DNA, 25 bp, Rattus norvegicus
aacgttgctcacattgtctcttaca

SEQ ID NO: 27962 - DNA, 25 bp, Rattus norvegicus
aacgttgctcactttgtctcttaca

SEQ ID NO: 27963 - DNA, 25 bp, Rattus norvegicus
aacgttgctcttagggaccagcatt

SEQ ID NO: 27964 - DNA, 25 bp, Rattus norvegicus
aacgttgctctttgggaccagcatt

SEQ ID NO: 27965 - DNA, 25 bp, Rattus norvegicus
aacgttgctttaatatacaggccca

SEQ ID NO: 27966 - DNA, 25 bp, Rattus norvegicus
aacgttgctttattatacaggccca

SEQ ID NO: 27967 - DNA, 25 bp, Rattus norvegicus
aacgttggtcgaagagggctttgct

SEQ ID NO: 27968 - DNA, 25 bp, Rattus norvegicus
aacgttggtcgatgagggctttgct

SEQ ID NO: 27969 - DNA, 25 bp, Rattus norvegicus
aacgttggtgagaagcacagaaacc

SEQ ID NO: 27970 - DNA, 25 bp, Rattus norvegicus
aacgttggtgagtagcacagaaacc

SEQ ID NO: 27971 - DNA, 25 bp, Rattus norvegicus
aacgttggtggcacttatgaacatc

SEQ ID NO: 27972 - DNA, 25 bp, Rattus norvegicus
aacgttggtggctcttatgaacatc

SEQ ID NO: 27973 - DNA, 25 bp, Rattus norvegicus
aacgttgtaataccatgctctacgg

SEQ ID NO: 27974 - DNA, 25 bp, Rattus norvegicus
aacgttgtaatagcatgctctacgg

SEQ ID NO: 27975 - DNA, 25 bp, Rattus norvegicus
aacgttgtcccacagagctgtttgt

SEQ ID NO: 27976 - DNA, 25 bp, Rattus norvegicus
aacgttgtcccagagagctgtttgt

SEQ ID NO: 27977 - DNA, 25 bp, Rattus norvegicus
aacgttgtttgcaccgacttcttct

SEQ ID NO: 27978 - DNA, 25 bp, Rattus norvegicus
aacgttgtttgctccgacttcttct

SEQ ID NO: 27979 - DNA, 25 bp, Rattus norvegicus
aacgtttcaccgagcgtcgctcctg

SEQ ID NO: 27980 - DNA, 25 bp, Rattus norvegicus
aacgtttcaccgtgcgtcgctcctg

SEQ ID NO: 27981 - DNA, 25 bp, Rattus norvegicus
aacgtttcgagcaggtggtggacct

SEQ ID NO: 27982 - DNA, 25 bp, Rattus norvegicus
aacgtttcgagctggtggtggacct

SEQ ID NO: 27983 - DNA, 25 bp, Rattus norvegicus
aacgtttcttttctgtatgatgtgc

SEQ ID NO: 27984 - DNA, 25 bp, Rattus norvegicus
aacgtttcttttgtgtatgatgtgc

SEQ ID NO: 27985 - DNA, 25 bp, Rattus norvegicus
aacgtttgaacaacactgctccagt

SEQ ID NO: 27986 - DNA, 25 bp, Rattus norvegicus
aacgtttgaacatcactgctccagt

SEQ ID NO: 27987 - DNA, 25 bp, Rattus norvegicus
aacgtttgagttcggatgctaggca

SEQ ID NO: 27988 - DNA, 25 bp, Rattus norvegicus
aacgtttgagttctgtcagtgctgt

SEQ ID NO: 27989 - DNA, 25 bp, Rattus norvegicus
aacgtttgagttgggatgctaggca

SEQ ID NO: 27990 - DNA, 25 bp, Rattus norvegicus
aacgtttgagttgtgtcagtgctgt

SEQ ID NO: 27991 - DNA, 25 bp, Rattus norvegicus
aacgtttgcagtcttgagtccccaa

SEQ ID NO: 27992 - DNA, 25 bp, Rattus norvegicus
aacgtttgcagtgttgagtccccaa

SEQ ID NO: 27993 - DNA, 25 bp, Rattus norvegicus
aacgtttgcctcaaaaagccatctc

SEQ ID NO: 27994 - DNA, 25 bp, Rattus norvegicus
aacgtttgcctctaaaagccatctc

SEQ ID NO: 27995 - DNA, 25 bp, Rattus norvegicus
aacgtttgcgtgaacctgctggata

SEQ ID NO: 27996 - DNA, 25 bp, Rattus norvegicus
aacgtttgcgtgtacctgctggata

SEQ ID NO: 27997 - DNA, 25 bp, Rattus norvegicus
aacgttttcatcactcttgtctttt

SEQ ID NO: 27998 - DNA, 25 bp, Rattus norvegicus
aacgttttcatctctcttgtctttt

SEQ ID NO: 27999 - DNA, 25 bp, Rattus norvegicus
aacgttttctacactcatgcttttg

SEQ ID NO: 28000 - DNA, 25 bp, Rattus norvegicus
aacgttttctactctcatgcttttg

SEQ ID NO: 28001 - DNA, 25 bp, Rattus norvegicus
aacgttttggaaacggatggtctca

SEQ ID NO: 28002 - DNA, 25 bp, Rattus norvegicus
aacgttttggaatcggatggtctca

SEQ ID NO: 28003 - DNA, 25 bp, Rattus norvegicus
aactaaaacattccatgctgtaagg

SEQ ID NO: 28004 - DNA, 25 bp, Rattus norvegicus
aactaaaacattgcatgctgtaagg

SEQ ID NO: 28005 - DNA, 25 bp, Rattus norvegicus
aactaaacatcccaactgctctgta

SEQ ID NO: 28006 - DNA, 25 bp, Rattus norvegicus
aactaaacatccgaactgctctgta

SEQ ID NO: 28007 - DNA, 25 bp, Rattus norvegicus
aactaaaccaagctcccatgctggg

SEQ ID NO: 28008 - DNA, 25 bp, Rattus norvegicus
aactaaaccaaggtcccatgctggg

SEQ ID NO: 28009 - DNA, 25 bp, Rattus norvegicus
aactaaaccagcattctcagatctc

SEQ ID NO: 28010 - DNA, 25 bp, Rattus norvegicus
aactaaaccagctttctcagatctc

SEQ ID NO: 28011 - DNA, 25 bp, Rattus norvegicus
aactaaactccacatcacacgtgct

SEQ ID NO: 28012 - DNA, 25 bp, Rattus norvegicus
aactaaactccagatcacacgtgct

SEQ ID NO: 28013 - DNA, 25 bp, Rattus norvegicus
aactaaagccggagcgtgtgccgcg

SEQ ID NO: 28014 - DNA, 25 bp, Rattus norvegicus
aactaaagccggtgcgtgtgccgcg

SEQ ID NO: 28015 - DNA, 25 bp, Rattus norvegicus
aactaaagcctgagtatttcttgtt

SEQ ID NO: 28016 - DNA, 25 bp, Rattus norvegicus
aactaaagcctgtgtatttcttgtt

SEQ ID NO: 28017 - DNA, 25 bp, Rattus norvegicus
aactaaaggtatcagccgccaccac

SEQ ID NO: 28018 - DNA, 25 bp, Rattus norvegicus
aactaaaggtatgagccgccaccac

SEQ ID NO: 28019 - DNA, 25 bp, Rattus norvegicus
aactaaagtaccagtcctcctggag

SEQ ID NO: 28020 - DNA, 25 bp, Rattus norvegicus
aactaaagtacctgtcctcctggag

SEQ ID NO: 28021 - DNA, 25 bp, Rattus norvegicus
aactaaagtgctcggcaggaccgga

SEQ ID NO: 28022 - DNA, 25 bp, Rattus norvegicus
aactaaagtgctgggcaggaccgga

SEQ ID NO: 28023 - DNA, 25 bp, Rattus norvegicus
aactaacacgggacgtttcactcag

SEQ ID NO: 28024 - DNA, 25 bp, Rattus norvegicus
aactaacacgggtcgtttcactcag

SEQ ID NO: 28025 - DNA, 25 bp, Rattus norvegicus
aactaacacgtccaagcacacttgt

SEQ ID NO: 28026 - DNA, 25 bp, Rattus norvegicus
aactaacacgtcgaagcacacttgt

SEQ ID NO: 28027 - DNA, 25 bp, Rattus norvegicus
aactaacatagcctttgcagcaagt

SEQ ID NO: 28028 - DNA, 25 bp, Rattus norvegicus
aactaacatagcgtttgcagcaagt

SEQ ID NO: 28029 - DNA, 25 bp, Rattus norvegicus
aactaacattctcctcagttctgcc

SEQ ID NO: 28030 - DNA, 25 bp, Rattus norvegicus
aactaacattctgctcagttctgcc

SEQ ID NO: 28031 - DNA, 25 bp, Rattus norvegicus
aactaacctcaccacggtttcagtg

SEQ ID NO: 28032 - DNA, 25 bp, Rattus norvegicus
aactaacctcacgacggtttcagtg

SEQ ID NO: 28033 - DNA, 25 bp, Rattus norvegicus
aactaacctggtacatttatgagct

SEQ ID NO: 28034 - DNA, 25 bp, Rattus norvegicus
aactaacctggttcatttatgagct

SEQ ID NO: 28035 - DNA, 25 bp, Rattus norvegicus
aactaactactgctctcttgtgctg

SEQ ID NO: 28036 - DNA, 25 bp, Rattus norvegicus
aactaactactggtctcttgtgctg

SEQ ID NO: 28037 - DNA, 25 bp, Rattus norvegicus
aactaactccatcggcacacccttc

SEQ ID NO: 28038 - DNA, 25 bp, Rattus norvegicus
aactaactccatgggcacacccttc

SEQ ID NO: 28039 - DNA, 25 bp, Rattus norvegicus
aactaactctaccagccaggagtag

SEQ ID NO: 28040 - DNA, 25 bp, Rattus norvegicus
aactaactctacgagccaggagtag

SEQ ID NO: 28041 - DNA, 25 bp, Rattus norvegicus
aactaactctgaaaggctccactgc

SEQ ID NO: 28042 - DNA, 25 bp, Rattus norvegicus
aactaactctgataggctccactgc

SEQ ID NO: 28043 - DNA, 25 bp, Rattus norvegicus
aactaactctgcaaacagctcttcc

SEQ ID NO: 28044 - DNA, 25 bp, Rattus norvegicus
aactaactctgctaacagctcttcc

SEQ ID NO: 28045 - DNA, 25 bp, Rattus norvegicus
aactaactcttccactgtatgtctt

SEQ ID NO: 28046 - DNA, 25 bp, Rattus norvegicus
aactaactcttcgactgtatgtctt

SEQ ID NO: 28047 - DNA, 25 bp, Rattus norvegicus
aactaactgaccaattctttgccct

SEQ ID NO: 28048 - DNA, 25 bp, Rattus norvegicus
aactaactgacctattctttgccct

SEQ ID NO: 28049 - DNA, 25 bp, Rattus norvegicus
aactaactggagagactgctgggtt

SEQ ID NO: 28050 - DNA, 25 bp, Rattus norvegicus
aactaactggagtgactgctgggtt

SEQ ID NO: 28051 - DNA, 25 bp, Rattus norvegicus
aactaactgtgaaggccaatccctg

SEQ ID NO: 28052 - DNA, 25 bp, Rattus norvegicus
aactaactgtgatggccaatccctg

SEQ ID NO: 28053 - DNA, 25 bp, Rattus norvegicus
aactaacttggcaaccactgagtct

SEQ ID NO: 28054 - DNA, 25 bp, Rattus norvegicus
aactaacttggctaccactgagtct

SEQ ID NO: 28055 - DNA, 25 bp, Rattus norvegicus
aactaagactggcttccatcacaga

SEQ ID NO: 28056 - DNA, 25 bp, Rattus norvegicus
aactaagactgggttccatcacaga

SEQ ID NO: 28057 - DNA, 25 bp, Rattus norvegicus
aactaagataccagtgtcctatcag

SEQ ID NO: 28058 - DNA, 25 bp, Rattus norvegicus
aactaagatacctgtgtcctatcag

SEQ ID NO: 28059 - DNA, 25 bp, Rattus norvegicus
aactaagatgctctcttccctgtaa

SEQ ID NO: 28060 - DNA, 25 bp, Rattus norvegicus
aactaagatgctgtcttccctgtaa

SEQ ID NO: 28061 - DNA, 25 bp, Rattus norvegicus
aactaagcagttctcgctttccctg

SEQ ID NO: 28062 - DNA, 25 bp, Rattus norvegicus
aactaagcagttgtcgctttccctg

SEQ ID NO: 28063 - DNA, 25 bp, Rattus norvegicus
aactaaggagtactggctatgaact

SEQ ID NO: 28064 - DNA, 25 bp, Rattus norvegicus
aactaaggagtagtggctatgaact

SEQ ID NO: 28065 - DNA, 25 bp, Rattus norvegicus
aactaaggcactacccatagactgg

SEQ ID NO: 28066 - DNA, 25 bp, Rattus norvegicus
aactaaggcacttcccatagactgg

SEQ ID NO: 28067 - DNA, 25 bp, Rattus norvegicus
aactaaggctgcaagatgctgctca

SEQ ID NO: 28068 - DNA, 25 bp, Rattus norvegicus
aactaaggctgctagatgctgctca

SEQ ID NO: 28069 - DNA, 25 bp, Rattus norvegicus
aactaaggtgacatggtgagatcca

SEQ ID NO: 28070 - DNA, 25 bp, Rattus norvegicus
aactaaggtgacttggtgagatcca

SEQ ID NO: 28071 - DNA, 25 bp, Rattus norvegicus
aactaagtcactatgtttgctttga

SEQ ID NO: 28072 - DNA, 25 bp, Rattus norvegicus
aactaagtcactttgtttgctttga

SEQ ID NO: 28073 - DNA, 25 bp, Rattus norvegicus
aactaagtctatacctgtctgttta

SEQ ID NO: 28074 - DNA, 25 bp, Rattus norvegicus
aactaagtctattcctgtctgttta

SEQ ID NO: 28075 - DNA, 25 bp, Rattus norvegicus
aactaagtctctatccagatcagta

SEQ ID NO: 28076 - DNA, 25 bp, Rattus norvegicus
aactaagtctctttccagatcagta

SEQ ID NO: 28077 - DNA, 25 bp, Rattus norvegicus
aactaagtgcttccagatccttctg

SEQ ID NO: 28078 - DNA, 25 bp, Rattus norvegicus
aactaagtgcttgcagatccttctg

SEQ ID NO: 28079 - DNA, 25 bp, Rattus norvegicus
aactaagttgtgagtggcgtgtttt

SEQ ID NO: 28080 - DNA, 25 bp, Rattus norvegicus
aactaagttgtgtgtggcgtgtttt

SEQ ID NO: 28081 - DNA, 25 bp, Rattus norvegicus
aactaatcaatgctgaggtggctaa

SEQ ID NO: 28082 - DNA, 25 bp, Rattus norvegicus
aactaatcaatggtgaggtggctaa

SEQ ID NO: 28083 - DNA, 25 bp, Rattus norvegicus
aactaatcacaacaatcgcggcggc

SEQ ID NO: 28084 - DNA, 25 bp, Rattus norvegicus
aactaatcacaagaatcgcggcggc

SEQ ID NO: 28085 - DNA, 25 bp, Rattus norvegicus
aactaatccatgcactcactccaag

SEQ ID NO: 28086 - DNA, 25 bp, Rattus norvegicus
aactaatccatggactcactccaag

SEQ ID NO: 28087 - DNA, 25 bp, Rattus norvegicus
aactaatcctggaggctgtgatccc

SEQ ID NO: 28088 - DNA, 25 bp, Rattus norvegicus
aactaatcctggtggctgtgatccc

SEQ ID NO: 28089 - DNA, 25 bp, Rattus norvegicus
aactaatcttttacgacaacagcaa

SEQ ID NO: 28090 - DNA, 25 bp, Rattus norvegicus
aactaatctttttcgacaacagcaa

SEQ ID NO: 28091 - DNA, 25 bp, Rattus norvegicus
aactaatgagtaactgctgcagcag

SEQ ID NO: 28092 - DNA, 25 bp, Rattus norvegicus
aactaatgagtatctgctgcagcag

SEQ ID NO: 28093 - DNA, 25 bp, Rattus norvegicus
aactaatggactctgacgattcaat

SEQ ID NO: 28094 - DNA, 25 bp, Rattus norvegicus
aactaatggactgtgacgattcaat

SEQ ID NO: 28095 - DNA, 25 bp, Rattus norvegicus
aactaattacagaggtcatcacaga

SEQ ID NO: 28096 - DNA, 25 bp, Rattus norvegicus
aactaattacagtggtcatcacaga

SEQ ID NO: 28097 - DNA, 25 bp, Rattus norvegicus
aactaattacttccactctctttct

SEQ ID NO: 28098 - DNA, 25 bp, Rattus norvegicus
aactaattacttgcactctctttct

SEQ ID NO: 28099 - DNA, 25 bp, Rattus norvegicus
aactaattattcagccctgccaggg

SEQ ID NO: 28100 - DNA, 25 bp, Rattus norvegicus
aactaattattctgccctgccaggg

SEQ ID NO: 28101 - DNA, 25 bp, Rattus norvegicus
aactaattcgcaactaaccggtgaa

SEQ ID NO: 28102 - DNA, 25 bp, Rattus norvegicus
aactaattcgcatctaaccggtgaa

SEQ ID NO: 28103 - DNA, 25 bp, Rattus norvegicus
aactaatttataaactctggaggct

SEQ ID NO: 28104 - DNA, 25 bp, Rattus norvegicus
aactaatttatatactctggaggct

SEQ ID NO: 28105 - DNA, 25 bp, Rattus norvegicus
aactaatttgatagcgttgagccgc

SEQ ID NO: 28106 - DNA, 25 bp, Rattus norvegicus
aactaatttgattgcgttgagccgc

SEQ ID NO: 28107 - DNA, 25 bp, Rattus norvegicus
aactaattttccctgcttaatgtga

SEQ ID NO: 28108 - DNA, 25 bp, Rattus norvegicus
aactaattttccgtgcttaatgtga

SEQ ID NO: 28109 - DNA, 25 bp, Rattus norvegicus
aactacaactgcagctaatgcttga

SEQ ID NO: 28110 - DNA, 25 bp, Rattus norvegicus
aactacaactgctgctaatgcttga

SEQ ID NO: 28111 - DNA, 25 bp, Rattus norvegicus
aactacacagtccatcatgttttga

SEQ ID NO: 28112 - DNA, 25 bp, Rattus norvegicus
aactacacagtcgatcatgttttga

SEQ ID NO: 28113 - DNA, 25 bp, Rattus norvegicus
aactacacattcacaggccttgagc

SEQ ID NO: 28114 - DNA, 25 bp, Rattus norvegicus
aactacacattctcaggccttgagc

SEQ ID NO: 28115 - DNA, 25 bp, Rattus norvegicus
aactacaccattcaggcgacagaca

SEQ ID NO: 28116 - DNA, 25 bp, Rattus norvegicus
aactacaccattgaggcgacagaca

SEQ ID NO: 28117 - DNA, 25 bp, Rattus norvegicus
aactacacctggaccatagtgcttg

SEQ ID NO: 28118 - DNA, 25 bp, Rattus norvegicus
aactacacctggtccatagtgcttg

SEQ ID NO: 28119 - DNA, 25 bp, Rattus norvegicus
aactacacgctacatgtggctgaga

SEQ ID NO: 28120 - DNA, 25 bp, Rattus norvegicus
aactacacgctagatgtggctgaga

SEQ ID NO: 28121 - DNA, 25 bp, Rattus norvegicus
aactacacgttaagacttactggag

SEQ ID NO: 28122 - DNA, 25 bp, Rattus norvegicus
aactacacgttatgacttactggag

SEQ ID NO: 28123 - DNA, 25 bp, Rattus norvegicus
aactacactgtgcagccctaggaaa

SEQ ID NO: 28124 - DNA, 25 bp, Rattus norvegicus
aactacactgtggagccctaggaaa

SEQ ID NO: 28125 - DNA, 25 bp, Rattus norvegicus
aactacagacagcagagcctctcgg

SEQ ID NO: 28126 - DNA, 25 bp, Rattus norvegicus
aactacagacaggagagcctctcgg

SEQ ID NO: 28127 - DNA, 25 bp, Rattus norvegicus
aactacagagtaagatggtggctat

SEQ ID NO: 28128 - DNA, 25 bp, Rattus norvegicus
aactacagagtatgatggtggctat

SEQ ID NO: 28129 - DNA, 25 bp, Rattus norvegicus
aactacaggctgagactgaggcccc

SEQ ID NO: 28130 - DNA, 25 bp, Rattus norvegicus
aactacaggctgtgactgaggcccc

SEQ ID NO: 28131 - DNA, 25 bp, Rattus norvegicus
aactacaggtccctattgccatacc

SEQ ID NO: 28132 - DNA, 25 bp, Rattus norvegicus
aactacaggtccgtattgccatacc

SEQ ID NO: 28133 - DNA, 25 bp, Rattus norvegicus
aactacatagccaagaccgtgtctc

SEQ ID NO: 28134 - DNA, 25 bp, Rattus norvegicus
aactacatagcctagaccgtgtctc

SEQ ID NO: 28135 - DNA, 25 bp, Rattus norvegicus
aactacatccaactaacacctcagg

SEQ ID NO: 28136 - DNA, 25 bp, Rattus norvegicus
aactacatccaagtaacacctcagg

SEQ ID NO: 28137 - DNA, 25 bp, Rattus norvegicus
aactacatcttacgactggagctac

SEQ ID NO: 28138 - DNA, 25 bp, Rattus norvegicus
aactacatcttaggactggagctac

SEQ ID NO: 28139 - DNA, 25 bp, Rattus norvegicus
aactacatgggtctctgtgaccttc

SEQ ID NO: 28140 - DNA, 25 bp, Rattus norvegicus
aactacatgggtgtctgtgaccttc

SEQ ID NO: 28141 - DNA, 25 bp, Rattus norvegicus
aactaccaacaaacagctctacaag

SEQ ID NO: 28142 - DNA, 25 bp, Rattus norvegicus
aactaccaacaatcagctctacaag

SEQ ID NO: 28143 - DNA, 25 bp, Rattus norvegicus
aactaccaaggcacatttctcatac

SEQ ID NO: 28144 - DNA, 25 bp, Rattus norvegicus
aactaccaaggctcatttctcatac

SEQ ID NO: 28145 - DNA, 25 bp, Rattus norvegicus
aactaccaagttattcacagggcaa

SEQ ID NO: 28146 - DNA, 25 bp, Rattus norvegicus
aactaccaagtttttcacagggcaa

SEQ ID NO: 28147 - DNA, 25 bp, Rattus norvegicus
aactaccacatgattctcagataca

SEQ ID NO: 28148 - DNA, 25 bp, Rattus norvegicus
aactaccacatgtttctcagataca

SEQ ID NO: 28149 - DNA, 25 bp, Rattus norvegicus
aactaccacctcatgagcggactga

SEQ ID NO: 28150 - DNA, 25 bp, Rattus norvegicus
aactaccacctcttgagcggactga

SEQ ID NO: 28151 - DNA, 25 bp, Rattus norvegicus
aactaccagaggaacacgtgatgca

SEQ ID NO: 28152 - DNA, 25 bp, Rattus norvegicus
aactaccagaggtacacgtgatgca

SEQ ID NO: 28153 - DNA, 25 bp, Rattus norvegicus
aactaccagcctctgatgccggttt

SEQ ID NO: 28154 - DNA, 25 bp, Rattus norvegicus
aactaccagcctgtgatgccggttt

SEQ ID NO: 28155 - DNA, 25 bp, Rattus norvegicus
aactaccagtgcctatggttccttc

SEQ ID NO: 28156 - DNA, 25 bp, Rattus norvegicus
aactaccagtgcgtatggttccttc

SEQ ID NO: 28157 - DNA, 25 bp, Rattus norvegicus
aactaccatatactcttgtgtctta

SEQ ID NO: 28158 - DNA, 25 bp, Rattus norvegicus
aactaccatatagtcttgtgtctta

SEQ ID NO: 28159 - DNA, 25 bp, Rattus norvegicus
aactaccatgttccagagggagatg

SEQ ID NO: 28160 - DNA, 25 bp, Rattus norvegicus
aactaccatgttgcagagggagatg

SEQ ID NO: 28161 - DNA, 25 bp, Rattus norvegicus
aactacccagctacggtccatggtg

SEQ ID NO: 28162 - DNA, 25 bp, Rattus norvegicus
aactacccagcttcggtccatggtg

SEQ ID NO: 28163 - DNA, 25 bp, Rattus norvegicus
aactaccgatatcctactgctcgta

SEQ ID NO: 28164 - DNA, 25 bp, Rattus norvegicus
aactaccgatatgctactgctcgta

SEQ ID NO: 28165 - DNA, 25 bp, Rattus norvegicus
aactacctaggcagggcacttatgc

SEQ ID NO: 28166 - DNA, 25 bp, Rattus norvegicus
aactacctaggctgggcacttatgc

SEQ ID NO: 28167 - DNA, 25 bp, Rattus norvegicus
aactacctcggtctgcgccaggttt

SEQ ID NO: 28168 - DNA, 25 bp, Rattus norvegicus
aactacctcggtgtgcgccaggttt

SEQ ID NO: 28169 - DNA, 25 bp, Rattus norvegicus
aactacctctatctgcctgagtttt

SEQ ID NO: 28170 - DNA, 25 bp, Rattus norvegicus
aactacctctatgtgcctgagtttt

SEQ ID NO: 28171 - DNA, 25 bp, Rattus norvegicus
aactacctgcagaacgtgctggctg

SEQ ID NO: 28172 - DNA, 25 bp, Rattus norvegicus
aactacctgcagtacgtgctggctg

SEQ ID NO: 28173 - DNA, 25 bp, Rattus norvegicus
aactacctggacaacgtgagcgcgc

SEQ ID NO: 28174 - DNA, 25 bp, Rattus norvegicus
aactacctggactacgtgagcgcgc

SEQ ID NO: 28175 - DNA, 25 bp, Rattus norvegicus
aactacctgggacacctcatcatgg

SEQ ID NO: 28176 - DNA, 25 bp, Rattus norvegicus
aactacctgggagacctcatcatgg

SEQ ID NO: 28177 - DNA, 25 bp, Rattus norvegicus
aactacctgtaactaaccagtcaca

SEQ ID NO: 28178 - DNA, 25 bp, Rattus norvegicus
aactacctgtaagtaaccagtcaca

SEQ ID NO: 28179 - DNA, 25 bp, Rattus norvegicus
aactaccttggaattcagccagaaa

SEQ ID NO: 28180 - DNA, 25 bp, Rattus norvegicus
aactaccttggatttcagccagaaa

SEQ ID NO: 28181 - DNA, 25 bp, Rattus norvegicus
aactacctttccagtcataagacac

SEQ ID NO: 28182 - DNA, 25 bp, Rattus norvegicus
aactacctttcctgtcataagacac

SEQ ID NO: 28183 - DNA, 25 bp, Rattus norvegicus
aactaccttttaatgcggctgcgcg

SEQ ID NO: 28184 - DNA, 25 bp, Rattus norvegicus
aactaccttttattgcggctgcgcg

SEQ ID NO: 28185 - DNA, 25 bp, Rattus norvegicus
aactacgaactgaaccacctgattg

SEQ ID NO: 28186 - DNA, 25 bp, Rattus norvegicus
aactacgaactgtaccacctgattg

SEQ ID NO: 28187 - DNA, 25 bp, Rattus norvegicus
aactacgacctcagttacactgaaa

SEQ ID NO: 28188 - DNA, 25 bp, Rattus norvegicus
aactacgacctctgttacactgaaa

SEQ ID NO: 28189 - DNA, 25 bp, Rattus norvegicus
aactacggacctcaaacttactcag

SEQ ID NO: 28190 - DNA, 25 bp, Rattus norvegicus
aactacggacctgaaacttactcag

SEQ ID NO: 28191 - DNA, 25 bp, Rattus norvegicus
aactacggagtgctggttagaccaa

SEQ ID NO: 28192 - DNA, 25 bp, Rattus norvegicus
aactacggagtggtggttagaccaa

SEQ ID NO: 28193 - DNA, 25 bp, Rattus norvegicus
aactacggcttgatcgttaagcgat

SEQ ID NO: 28194 - DNA, 25 bp, Rattus norvegicus
aactacggcttgttcgttaagcgat

SEQ ID NO: 28195 - DNA, 25 bp, Rattus norvegicus
aactacgtcttcatctgcttcagga

SEQ ID NO: 28196 - DNA, 25 bp, Rattus norvegicus
aactacgtcttcttctgcttcagga

SEQ ID NO: 28197 - DNA, 25 bp, Rattus norvegicus
aactacgtgctccagggaacacaag

SEQ ID NO: 28198 - DNA, 25 bp, Rattus norvegicus
aactacgtgctcgagggaacacaag

SEQ ID NO: 28199 - DNA, 25 bp, Rattus norvegicus
aactacgtgtggaaagccgaaatct

SEQ ID NO: 28200 - DNA, 25 bp, Rattus norvegicus
aactacgtgtggtaagccgaaatct

SEQ ID NO: 28201 - DNA, 25 bp, Rattus norvegicus
aactactaaggaacacgcggcaagg

SEQ ID NO: 28202 - DNA, 25 bp, Rattus norvegicus
aactactaaggatcacgcggcaagg

SEQ ID NO: 28203 - DNA, 25 bp, Rattus norvegicus
aactactacaacataaagctctcga

SEQ ID NO: 28204 - DNA, 25 bp, Rattus norvegicus
aactactacaacttaaagctctcga

SEQ ID NO: 28205 - DNA, 25 bp, Rattus norvegicus
aactactagtgtactgtgtccctcg

SEQ ID NO: 28206 - DNA, 25 bp, Rattus norvegicus
aactactagtgttctgtgtccctcg

SEQ ID NO: 28207 - DNA, 25 bp, Rattus norvegicus
aactactatgccatcttcaagctgc

SEQ ID NO: 28208 - DNA, 25 bp, Rattus norvegicus
aactactatgccttcttcaagctgc

SEQ ID NO: 28209 - DNA, 25 bp, Rattus norvegicus
aactactcagcacgggtggccttgt

SEQ ID NO: 28210 - DNA, 25 bp, Rattus norvegicus
aactactcagcaggggtggccttgt

SEQ ID NO: 28211 - DNA, 25 bp, Rattus norvegicus
aactactccctcaagtacaagctga

SEQ ID NO: 28212 - DNA, 25 bp, Rattus norvegicus
aactactccctctagtacaagctga

SEQ ID NO: 28213 - DNA, 25 bp, Rattus norvegicus
aactactcctatctgcactgtgaat

SEQ ID NO: 28214 - DNA, 25 bp, Rattus norvegicus
aactactcctatgtgcactgtgaat

SEQ ID NO: 28215 - DNA, 25 bp, Rattus norvegicus
aactactctagaactgattttgcag

SEQ ID NO: 28216 - DNA, 25 bp, Rattus norvegicus
aactactctagatctgattttgcag

SEQ ID NO: 28217 - DNA, 25 bp, Rattus norvegicus
aactactctgataattctcaactta

SEQ ID NO: 28218 - DNA, 25 bp, Rattus norvegicus
aactactctgattattctcaactta

SEQ ID NO: 28219 - DNA, 25 bp, Rattus norvegicus
aactactctgcaaggagccaagaaa

SEQ ID NO: 28220 - DNA, 25 bp, Rattus norvegicus
aactactctgcatggagccaagaaa

SEQ ID NO: 28221 - DNA, 25 bp, Rattus norvegicus
aactactgactgaccgggttggaga

SEQ ID NO: 28222 - DNA, 25 bp, Rattus norvegicus
aactactgactgtccgggttggaga

SEQ ID NO: 28223 - DNA, 25 bp, Rattus norvegicus
aactactgcaacaaggcccaccact

SEQ ID NO: 28224 - DNA, 25 bp, Rattus norvegicus
aactactgcaactaggcccaccact

SEQ ID NO: 28225 - DNA, 25 bp, Rattus norvegicus
aactactgcataacatccagctcct

SEQ ID NO: 28226 - DNA, 25 bp, Rattus norvegicus
aactactgcatatcatccagctcct

SEQ ID NO: 28227 - DNA, 25 bp, Rattus norvegicus
aactactgcctgaccagggctgtga

SEQ ID NO: 28228 - DNA, 25 bp, Rattus norvegicus
aactactgcctgtccagggctgtga

SEQ ID NO: 28229 - DNA, 25 bp, Rattus norvegicus
aactactggacgctcgatcccgcgg

SEQ ID NO: 28230 - DNA, 25 bp, Rattus norvegicus
aactactggacggtcgatcccgcgg

SEQ ID NO: 28231 - DNA, 25 bp, Rattus norvegicus
aactactggtttcctgtgtacatgg

SEQ ID NO: 28232 - DNA, 25 bp, Rattus norvegicus
aactactggtttgctgtgtacatgg

SEQ ID NO: 28233 - DNA, 25 bp, Rattus norvegicus
aactactgtgacaactgtgcgggca

SEQ ID NO: 28234 - DNA, 25 bp, Rattus norvegicus
aactactgtgactactgtgcgggca

SEQ ID NO: 28235 - DNA, 25 bp, Rattus norvegicus
aactacttaaagaatgccctggatt

SEQ ID NO: 28236 - DNA, 25 bp, Rattus norvegicus
aactacttaaagtatgccctggatt

SEQ ID NO: 28237 - DNA, 25 bp, Rattus norvegicus
aactacttatccctgattgttttct

SEQ ID NO: 28238 - DNA, 25 bp, Rattus norvegicus
aactacttatccgtgattgttttct

SEQ ID NO: 28239 - DNA, 25 bp, Rattus norvegicus
aactacttcaacagacaccggcaaa

SEQ ID NO: 28240 - DNA, 25 bp, Rattus norvegicus
aactacttcaactgacaccggcaaa

SEQ ID NO: 28241 - DNA, 25 bp, Rattus norvegicus
aactacttgacaccctgtgcgggtc

SEQ ID NO: 28242 - DNA, 25 bp, Rattus norvegicus
aactacttgacagcctgtgcgggtc

SEQ ID NO: 28243 - DNA, 25 bp, Rattus norvegicus
aactactttctcattcttagtcttg

SEQ ID NO: 28244 - DNA, 25 bp, Rattus norvegicus
aactactttctctttcttagtcttg

SEQ ID NO: 28245 - DNA, 25 bp, Rattus norvegicus
aactactttgtacggctctgatgtc

SEQ ID NO: 28246 - DNA, 25 bp, Rattus norvegicus
aactactttgtagggctctgatgtc

SEQ ID NO: 28247 - DNA, 25 bp, Rattus norvegicus
aactactttgttaggctggcatata

SEQ ID NO: 28248 - DNA, 25 bp, Rattus norvegicus
aactactttgtttggctggcatata

SEQ ID NO: 28249 - DNA, 25 bp, Rattus norvegicus
aactactttttcatatggactcatg

SEQ ID NO: 28250 - DNA, 25 bp, Rattus norvegicus
aactactttttcttatggactcatg

SEQ ID NO: 28251 - DNA, 25 bp, Rattus norvegicus
aactagaaatctctcctgtggcatg

SEQ ID NO: 28252 - DNA, 25 bp, Rattus norvegicus
aactagaaatctgtcctgtggcatg

SEQ ID NO: 28253 - DNA, 25 bp, Rattus norvegicus
aactagaacaagaacgacagcgtca

SEQ ID NO: 28254 - DNA, 25 bp, Rattus norvegicus
aactagaacaagtacgacagcgtca

SEQ ID NO: 28255 - DNA, 25 bp, Rattus norvegicus
aactagaactgacgccccgagtggt

SEQ ID NO: 28256 - DNA, 25 bp, Rattus norvegicus
aactagaactgaggccccgagtggt

SEQ ID NO: 28257 - DNA, 25 bp, Rattus norvegicus
aactagaagatgaggctgcaaggaa

SEQ ID NO: 28258 - DNA, 25 bp, Rattus norvegicus
aactagaagatgtggctgcaaggaa

SEQ ID NO: 28259 - DNA, 25 bp, Rattus norvegicus
aactagaagctgctcttcactgtgc

SEQ ID NO: 28260 - DNA, 25 bp, Rattus norvegicus
aactagaagctggtcttcactgtgc

SEQ ID NO: 28261 - DNA, 25 bp, Rattus norvegicus
aactagaaggaaatcctgccgcttc

SEQ ID NO: 28262 - DNA, 25 bp, Rattus norvegicus
aactagaaggaattcctgccgcttc

SEQ ID NO: 28263 - DNA, 25 bp, Rattus norvegicus
aactagaaggccactgtcacttcct

SEQ ID NO: 28264 - DNA, 25 bp, Rattus norvegicus
aactagaaggcctctgtcacttcct

SEQ ID NO: 28265 - DNA, 25 bp, Rattus norvegicus
aactagaattgtctgtcctggcgcc

SEQ ID NO: 28266 - DNA, 25 bp, Rattus norvegicus
aactagaattgtgtgtcctggcgcc

SEQ ID NO: 28267 - DNA, 25 bp, Rattus norvegicus
aactagacagacatgcctttgggcc

SEQ ID NO: 28268 - DNA, 25 bp, Rattus norvegicus
aactagacagacttgcctttgggcc

SEQ ID NO: 28269 - DNA, 25 bp, Rattus norvegicus
aactagacccgtcattatttctgag

SEQ ID NO: 28270 - DNA, 25 bp, Rattus norvegicus
aactagacccgtgattatttctgag

SEQ ID NO: 28271 - DNA, 25 bp, Rattus norvegicus
aactagacttacctgttcactgtcc

SEQ ID NO: 28272 - DNA, 25 bp, Rattus norvegicus
aactagacttacgtgttcactgtcc

SEQ ID NO: 28273 - DNA, 25 bp, Rattus norvegicus
aactagagctgccattcttttcatc

SEQ ID NO: 28274 - DNA, 25 bp, Rattus norvegicus
aactagagctgcgattcttttcatc

SEQ ID NO: 28275 - DNA, 25 bp, Rattus norvegicus
aactagataaacagacctcgcggcg

SEQ ID NO: 28276 - DNA, 25 bp, Rattus norvegicus
aactagataaactgacctcgcggcg

SEQ ID NO: 28277 - DNA, 25 bp, Rattus norvegicus
aactagatccttcccttaggcaagc

SEQ ID NO: 28278 - DNA, 25 bp, Rattus norvegicus
aactagatccttgccttaggcaagc

SEQ ID NO: 28279 - DNA, 25 bp, Rattus norvegicus
aactagatgtgtcgtgcgtgacccc

SEQ ID NO: 28280 - DNA, 25 bp, Rattus norvegicus
aactagatgtgtggtgcgtgacccc

SEQ ID NO: 28281 - DNA, 25 bp, Rattus norvegicus
aactagcaacaaagccagcccatgt

SEQ ID NO: 28282 - DNA, 25 bp, Rattus norvegicus
aactagcaacaatgccagcccatgt

SEQ ID NO: 28283 - DNA, 25 bp, Rattus norvegicus
aactagcacttgaattctttcttgt

SEQ ID NO: 28284 - DNA, 25 bp, Rattus norvegicus
aactagcacttgtattctttcttgt

SEQ ID NO: 28285 - DNA, 25 bp, Rattus norvegicus
aactagcagattatcgttagcgcgt

SEQ ID NO: 28286 - DNA, 25 bp, Rattus norvegicus
aactagcagattttcgttagcgcgt

SEQ ID NO: 28287 - DNA, 25 bp, Rattus norvegicus
aactagcagccaagttctgtgaact

SEQ ID NO: 28288 - DNA, 25 bp, Rattus norvegicus
aactagcagccatgttctgtgaact

SEQ ID NO: 28289 - DNA, 25 bp, Rattus norvegicus
aactagcatgctagcagccttaggc

SEQ ID NO: 28290 - DNA, 25 bp, Rattus norvegicus
aactagcatgcttgcagccttaggc

SEQ ID NO: 28291 - DNA, 25 bp, Rattus norvegicus
aactagcattttacaagcctttatt

SEQ ID NO: 28292 - DNA, 25 bp, Rattus norvegicus
aactagcatttttcaagcctttatt

SEQ ID NO: 28293 - DNA, 25 bp, Rattus norvegicus
aactagccagctctttgttggaaaa

SEQ ID NO: 28294 - DNA, 25 bp, Rattus norvegicus
aactagccagctgtttgttggaaaa

SEQ ID NO: 28295 - DNA, 25 bp, Rattus norvegicus
aactagccgaatacgagaggccccg

SEQ ID NO: 28296 - DNA, 25 bp, Rattus norvegicus
aactagccgaattcgagaggccccg

SEQ ID NO: 28297 - DNA, 25 bp, Rattus norvegicus
aactagccgcagcatgtcacataaa

SEQ ID NO: 28298 - DNA, 25 bp, Rattus norvegicus
aactagccgcaggatgtcacataaa

SEQ ID NO: 28299 - DNA, 25 bp, Rattus norvegicus
aactagcctctgagatttgctgcag

SEQ ID NO: 28300 - DNA, 25 bp, Rattus norvegicus
aactagcctctgtgatttgctgcag

SEQ ID NO: 28301 - DNA, 25 bp, Rattus norvegicus
aactagccttgaaagtgtgagccag

SEQ ID NO: 28302 - DNA, 25 bp, Rattus norvegicus
aactagccttgatagtgtgagccag

SEQ ID NO: 28303 - DNA, 25 bp, Rattus norvegicus
aactagctactaagcattactgaat

SEQ ID NO: 28304 - DNA, 25 bp, Rattus norvegicus
aactagctactatgcattactgaat

SEQ ID NO: 28305 - DNA, 25 bp, Rattus norvegicus
aactagctagagctggccatcggct

SEQ ID NO: 28306 - DNA, 25 bp, Rattus norvegicus
aactagctagaggtggccatcggct

SEQ ID NO: 28307 - DNA, 25 bp, Rattus norvegicus
aactagctagttaatttcctagaga

SEQ ID NO: 28308 - DNA, 25 bp, Rattus norvegicus
aactagctagtttatttcctagaga

SEQ ID NO: 28309 - DNA, 25 bp, Rattus norvegicus
aactagctcgctatcagttgaccca

SEQ ID NO: 28310 - DNA, 25 bp, Rattus norvegicus
aactagctcgctttcagttgaccca

SEQ ID NO: 28311 - DNA, 25 bp, Rattus norvegicus
aactagctgctaacaggtgctggga

SEQ ID NO: 28312 - DNA, 25 bp, Rattus norvegicus
aactagctgctatcaggtgctggga

SEQ ID NO: 28313 - DNA, 25 bp, Rattus norvegicus
aactagctgttaacttctgacgtga

SEQ ID NO: 28314 - DNA, 25 bp, Rattus norvegicus
aactagctgttatcttctgacgtga

SEQ ID NO: 28315 - DNA, 25 bp, Rattus norvegicus
aactagcttttcaacacctgtgcag

SEQ ID NO: 28316 - DNA, 25 bp, Rattus norvegicus
aactagcttttctacacctgtgcag

SEQ ID NO: 28317 - DNA, 25 bp, Rattus norvegicus
aactaggataggctggctagctcca

SEQ ID NO: 28318 - DNA, 25 bp, Rattus norvegicus
aactaggatagggtggctagctcca

SEQ ID NO: 28319 - DNA, 25 bp, Rattus norvegicus
aactaggcactaaacttgggcaact

SEQ ID NO: 28320 - DNA, 25 bp, Rattus norvegicus
aactaggcactatacttgggcaact

SEQ ID NO: 28321 - DNA, 25 bp, Rattus norvegicus
aactaggcatgtaccagtggctctc

SEQ ID NO: 28322 - DNA, 25 bp, Rattus norvegicus
aactaggcatgttccagtggctctc

SEQ ID NO: 28323 - DNA, 25 bp, Rattus norvegicus
aactaggcatttatgagcttctgca

SEQ ID NO: 28324 - DNA, 25 bp, Rattus norvegicus
aactaggcatttttgagcttctgca

SEQ ID NO: 28325 - DNA, 25 bp, Rattus norvegicus
aactaggcccagcttcaatcagaaa

SEQ ID NO: 28326 - DNA, 25 bp, Rattus norvegicus
aactaggcccaggttcaatcagaaa

SEQ ID NO: 28327 - DNA, 25 bp, Rattus norvegicus
aactaggctattcctatcttgggaa

SEQ ID NO: 28328 - DNA, 25 bp, Rattus norvegicus
aactaggctattgctatcttgggaa

SEQ ID NO: 28329 - DNA, 25 bp, Rattus norvegicus
aactaggtagttctcatggcccaga

SEQ ID NO: 28330 - DNA, 25 bp, Rattus norvegicus
aactaggtagttgtcatggcccaga

SEQ ID NO: 28331 - DNA, 25 bp, Rattus norvegicus
aactaggtctgcagacttcagatgt

SEQ ID NO: 28332 - DNA, 25 bp, Rattus norvegicus
aactaggtctgctgacttcagatgt

SEQ ID NO: 28333 - DNA, 25 bp, Rattus norvegicus
aactaggtggagcttttgtctcagt

SEQ ID NO: 28334 - DNA, 25 bp, Rattus norvegicus
aactaggtggaggttttgtctcagt

SEQ ID NO: 28335 - DNA, 25 bp, Rattus norvegicus
aactaggtggtgagttccctgtgca

SEQ ID NO: 28336 - DNA, 25 bp, Rattus norvegicus
aactaggtggtgtgttccctgtgca

SEQ ID NO: 28337 - DNA, 25 bp, Rattus norvegicus
aactaggtgtttctgagcgcaagga

SEQ ID NO: 28338 - DNA, 25 bp, Rattus norvegicus
aactaggtgtttgtgagcgcaagga

SEQ ID NO: 28339 - DNA, 25 bp, Rattus norvegicus
aactaggttcaaatgagagggcaac

SEQ ID NO: 28340 - DNA, 25 bp, Rattus norvegicus
aactaggttcaattgagagggcaac

SEQ ID NO: 28341 - DNA, 25 bp, Rattus norvegicus
aactaggttctaccggatctgtcac

SEQ ID NO: 28342 - DNA, 25 bp, Rattus norvegicus
aactaggttctagcggatctgtcac

SEQ ID NO: 28343 - DNA, 25 bp, Rattus norvegicus
aactagtaccacattagctgcactt

SEQ ID NO: 28344 - DNA, 25 bp, Rattus norvegicus
aactagtaccactttagctgcactt

SEQ ID NO: 28345 - DNA, 25 bp, Rattus norvegicus
aactagtagcttagttctggtccaa

SEQ ID NO: 28346 - DNA, 25 bp, Rattus norvegicus
aactagtagctttgttctggtccaa

SEQ ID NO: 28347 - DNA, 25 bp, Rattus norvegicus
aactagtagtttctgtggtccagca

SEQ ID NO: 28348 - DNA, 25 bp, Rattus norvegicus
aactagtagtttgtgtggtccagca

SEQ ID NO: 28349 - DNA, 25 bp, Rattus norvegicus
aactagtctagaagtcttctttttt

SEQ ID NO: 28350 - DNA, 25 bp, Rattus norvegicus
aactagtctagatgtcttctttttt

SEQ ID NO: 28351 - DNA, 25 bp, Rattus norvegicus
aactagtctccgaaacattcgctgg

SEQ ID NO: 28352 - DNA, 25 bp, Rattus norvegicus
aactagtctccgtaacattcgctgg

SEQ ID NO: 28353 - DNA, 25 bp, Rattus norvegicus
aactagtcttgccagtctctttaag

SEQ ID NO: 28354 - DNA, 25 bp, Rattus norvegicus
aactagtcttgcgagtctctttaag

SEQ ID NO: 28355 - DNA, 25 bp, Rattus norvegicus
aactagtctttcaccattgtaaatc

SEQ ID NO: 28356 - DNA, 25 bp, Rattus norvegicus
aactagtctttctccattgtaaatc

SEQ ID NO: 28357 - DNA, 25 bp, Rattus norvegicus
aactagtgagcgactctgttcagtt

SEQ ID NO: 28358 - DNA, 25 bp, Rattus norvegicus
aactagtgagcgtctctgttcagtt

SEQ ID NO: 28359 - DNA, 25 bp, Rattus norvegicus
aactagtgagctccaagctcgccga

SEQ ID NO: 28360 - DNA, 25 bp, Rattus norvegicus
aactagtgagctgcaagctcgccga

SEQ ID NO: 28361 - DNA, 25 bp, Rattus norvegicus
aactagtgctgtcttctgcagggct

SEQ ID NO: 28362 - DNA, 25 bp, Rattus norvegicus
aactagtgctgtgttctgcagggct

SEQ ID NO: 28363 - DNA, 25 bp, Rattus norvegicus
aactagtgcttactggtttccattt

SEQ ID NO: 28364 - DNA, 25 bp, Rattus norvegicus
aactagtgcttagtggtttccattt

SEQ ID NO: 28365 - DNA, 25 bp, Rattus norvegicus
aactagttcaacaacccacaggtca

SEQ ID NO: 28366 - DNA, 25 bp, Rattus norvegicus
aactagttcaactacccacaggtca

SEQ ID NO: 28367 - DNA, 25 bp, Rattus norvegicus
aactagttgcatattccttgtggag

SEQ ID NO: 28368 - DNA, 25 bp, Rattus norvegicus
aactagttgcattttccttgtggag

SEQ ID NO: 28369 - DNA, 25 bp, Rattus norvegicus
aactagtttgctctctcattagcgt

SEQ ID NO: 28370 - DNA, 25 bp, Rattus norvegicus
aactagtttgctgtctcattagcgt

SEQ ID NO: 28371 - DNA, 25 bp, Rattus norvegicus
aactagtttgtcacgctttagagct

SEQ ID NO: 28372 - DNA, 25 bp, Rattus norvegicus
aactagtttgtctcgctttagagct

SEQ ID NO: 28373 - DNA, 25 bp, Rattus norvegicus
aactagtttttcattcctgcaggca

SEQ ID NO: 28374 - DNA, 25 bp, Rattus norvegicus
aactagtttttctttcctgcaggca

SEQ ID NO: 28375 - DNA, 25 bp, Rattus norvegicus
aactataaccagaagaccttcatat

SEQ ID NO: 28376 - DNA, 25 bp, Rattus norvegicus
aactataaccagtagaccttcatat

SEQ ID NO: 28377 - DNA, 25 bp, Rattus norvegicus
aactataacgtaacaggctaggatt

SEQ ID NO: 28378 - DNA, 25 bp, Rattus norvegicus
aactataacgtatcaggctaggatt

SEQ ID NO: 28379 - DNA, 25 bp, Rattus norvegicus
aactataagtgcaatctgccgggaa

SEQ ID NO: 28380 - DNA, 25 bp, Rattus norvegicus
aactataagtgctatctgccgggaa

SEQ ID NO: 28381 - DNA, 25 bp, Rattus norvegicus
aactatacctttcttcttcactaag

SEQ ID NO: 28382 - DNA, 25 bp, Rattus norvegicus
aactatacctttgttcttcactaag

SEQ ID NO: 28383 - DNA, 25 bp, Rattus norvegicus
aactatacgcccaggaagattccct

SEQ ID NO: 28384 - DNA, 25 bp, Rattus norvegicus
aactatacgccctggaagattccct

SEQ ID NO: 28385 - DNA, 25 bp, Rattus norvegicus
aactatagagtgctgccgactgcgt

SEQ ID NO: 28386 - DNA, 25 bp, Rattus norvegicus
aactatagagtggtgccgactgcgt

SEQ ID NO: 28387 - DNA, 25 bp, Rattus norvegicus
aactatagtggtcaggagtcccgct

SEQ ID NO: 28388 - DNA, 25 bp, Rattus norvegicus
aactatagtggtgaggagtcccgct

SEQ ID NO: 28389 - DNA, 25 bp, Rattus norvegicus
aactatatagtccaggcaggtctta

SEQ ID NO: 28390 - DNA, 25 bp, Rattus norvegicus
aactatatagtcgaggcaggtctta

SEQ ID NO: 28391 - DNA, 25 bp, Rattus norvegicus
aactatatctggaggcatgggtaac

SEQ ID NO: 28392 - DNA, 25 bp, Rattus norvegicus
aactatatctggtggcatgggtaac

SEQ ID NO: 28393 - DNA, 25 bp, Rattus norvegicus
aactatatgtgtactctttaaactg

SEQ ID NO: 28394 - DNA, 25 bp, Rattus norvegicus
aactatatgtgttctctttaaactg

SEQ ID NO: 28395 - DNA, 25 bp, Rattus norvegicus
aactatattccacttgttcagatgg

SEQ ID NO: 28396 - DNA, 25 bp, Rattus norvegicus
aactatattccagttgttcagatgg

SEQ ID NO: 28397 - DNA, 25 bp, Rattus norvegicus
aactatcaataacctttgggcccat

SEQ ID NO: 28398 - DNA, 25 bp, Rattus norvegicus
aactatcaataagctttgggcccat

SEQ ID NO: 28399 - DNA, 25 bp, Rattus norvegicus
aactatcaccagacttcggaggtcg

SEQ ID NO: 28400 - DNA, 25 bp, Rattus norvegicus
aactatcaccagtcttcggaggtcg

SEQ ID NO: 28401 - DNA, 25 bp, Rattus norvegicus
aactatcccaggatctctgttccct

SEQ ID NO: 28402 - DNA, 25 bp, Rattus norvegicus
aactatcccaggttctctgttccct

SEQ ID NO: 28403 - DNA, 25 bp, Rattus norvegicus
aactatccccatactgcttgtggta

SEQ ID NO: 28404 - DNA, 25 bp, Rattus norvegicus
aactatccccattctgcttgtggta

SEQ ID NO: 28405 - DNA, 25 bp, Rattus norvegicus
aactatcggcagcacctacatggcg

SEQ ID NO: 28406 - DNA, 25 bp, Rattus norvegicus
aactatcggcaggacctacatggcg

SEQ ID NO: 28407 - DNA, 25 bp, Rattus norvegicus
aactatcgggataggctgggccttc

SEQ ID NO: 28408 - DNA, 25 bp, Rattus norvegicus
aactatcgggattggctgggccttc

SEQ ID NO: 28409 - DNA, 25 bp, Rattus norvegicus
aactatcgtgttactattcttgcaa

SEQ ID NO: 28410 - DNA, 25 bp, Rattus norvegicus
aactatcgtgtttctattcttgcaa

SEQ ID NO: 28411 - DNA, 25 bp, Rattus norvegicus
aactatctaacgctgaaactactat

SEQ ID NO: 28412 - DNA, 25 bp, Rattus norvegicus
aactatctaacggtgaaactactat

SEQ ID NO: 28413 - DNA, 25 bp, Rattus norvegicus
aactatctcattctagctcttggca

SEQ ID NO: 28414 - DNA, 25 bp, Rattus norvegicus
aactatctcattgtagctcttggca

SEQ ID NO: 28415 - DNA, 25 bp, Rattus norvegicus
aactatctgcctcgagacgtttaaa

SEQ ID NO: 28416 - DNA, 25 bp, Rattus norvegicus
aactatctgcctggagacgtttaaa

SEQ ID NO: 28417 - DNA, 25 bp, Rattus norvegicus
aactatctggtacttttgggttcag

SEQ ID NO: 28418 - DNA, 25 bp, Rattus norvegicus
aactatctggtagttttgggttcag

SEQ ID NO: 28419 - DNA, 25 bp, Rattus norvegicus
aactatctgtatcctgtgagggacc

SEQ ID NO: 28420 - DNA, 25 bp, Rattus norvegicus
aactatctgtatgctgtgagggacc

SEQ ID NO: 28421 - DNA, 25 bp, Rattus norvegicus
aactatcttgatcccggtagacact

SEQ ID NO: 28422 - DNA, 25 bp, Rattus norvegicus
aactatcttgatgccggtagacact

SEQ ID NO: 28423 - DNA, 25 bp, Rattus norvegicus
aactatcttgttaggctcgattggg

SEQ ID NO: 28424 - DNA, 25 bp, Rattus norvegicus
aactatcttgtttggctcgattggg

SEQ ID NO: 28425 - DNA, 25 bp, Rattus norvegicus
aactatgacctcacgggatctgaaa

SEQ ID NO: 28426 - DNA, 25 bp, Rattus norvegicus
aactatgacctctcgggatctgaaa

SEQ ID NO: 28427 - DNA, 25 bp, Rattus norvegicus
aactatgactctacagcacatgcag

SEQ ID NO: 28428 - DNA, 25 bp, Rattus norvegicus
aactatgactcttcagcacatgcag

SEQ ID NO: 28429 - DNA, 25 bp, Rattus norvegicus
aactatgactttacttctgccttta

SEQ ID NO: 28430 - DNA, 25 bp, Rattus norvegicus
aactatgacttttcttctgccttta

SEQ ID NO: 28431 - DNA, 25 bp, Rattus norvegicus
aactatgagagtatcccacgggtct

SEQ ID NO: 28432 - DNA, 25 bp, Rattus norvegicus
aactatgagagtttcccacgggtct

SEQ ID NO: 28433 - DNA, 25 bp, Rattus norvegicus
aactatgaggccctgccagctgcca

SEQ ID NO: 28434 - DNA, 25 bp, Rattus norvegicus
aactatgaggccgtgccagctgcca

SEQ ID NO: 28435 - DNA, 25 bp, Rattus norvegicus
aactatgcacatcctttgatttctt

SEQ ID NO: 28436 - DNA, 25 bp, Rattus norvegicus
aactatgcacatgctttgatttctt

SEQ ID NO: 28437 - DNA, 25 bp, Rattus norvegicus
aactatgccaagagctaccatcatg

SEQ ID NO: 28438 - DNA, 25 bp, Rattus norvegicus
aactatgccaagtgctaccatcatg

SEQ ID NO: 28439 - DNA, 25 bp, Rattus norvegicus
aactatgccgctcgcgatgtggctg

SEQ ID NO: 28440 - DNA, 25 bp, Rattus norvegicus
aactatgccgctggcgatgtggctg

SEQ ID NO: 28441 - DNA, 25 bp, Rattus norvegicus
aactatggaactctgtcatctgcaa

SEQ ID NO: 28442 - DNA, 25 bp, Rattus norvegicus
aactatggaactgtgtcatctgcaa

SEQ ID NO: 28443 - DNA, 25 bp, Rattus norvegicus
aactatggacaaaaccgtgtgcgta

SEQ ID NO: 28444 - DNA, 25 bp, Rattus norvegicus
aactatggacaataccgtgtgcgta

SEQ ID NO: 28445 - DNA, 25 bp, Rattus norvegicus
aactatggccccaatgttgtttagt

SEQ ID NO: 28446 - DNA, 25 bp, Rattus norvegicus
aactatggcccctatgttgtttagt

SEQ ID NO: 28447 - DNA, 25 bp, Rattus norvegicus
aactatggcggaaactggctgacga

SEQ ID NO: 28448 - DNA, 25 bp, Rattus norvegicus
aactatggcggatactggctgacga

SEQ ID NO: 28449 - DNA, 25 bp, Rattus norvegicus
aactatggctttcctagtctaccca

SEQ ID NO: 28450 - DNA, 25 bp, Rattus norvegicus
aactatggctttgctagtctaccca

SEQ ID NO: 28451 - DNA, 25 bp, Rattus norvegicus
aactatgggcaactggtggtcacac

SEQ ID NO: 28452 - DNA, 25 bp, Rattus norvegicus
aactatgggcaagtggtggtcacac

SEQ ID NO: 28453 - DNA, 25 bp, Rattus norvegicus
aactatggtctcaatcttaggagtg

SEQ ID NO: 28454 - DNA, 25 bp, Rattus norvegicus
aactatggtctctatcttaggagtg

SEQ ID NO: 28455 - DNA, 25 bp, Rattus norvegicus
aactatggtggtaccgcatggtgac

SEQ ID NO: 28456 - DNA, 25 bp, Rattus norvegicus
aactatggtggttccgcatggtgac

SEQ ID NO: 28457 - DNA, 25 bp, Rattus norvegicus
aactatgtagacagggctgggctca

SEQ ID NO: 28458 - DNA, 25 bp, Rattus norvegicus
aactatgtagactgggctgggctca

SEQ ID NO: 28459 - DNA, 25 bp, Rattus norvegicus
aactatgtctcaatgtctggtggcc

SEQ ID NO: 28460 - DNA, 25 bp, Rattus norvegicus
aactatgtctcattgtctggtggcc

SEQ ID NO: 28461 - DNA, 25 bp, Rattus norvegicus
aactatgtgcagcacttccaggccc

SEQ ID NO: 28462 - DNA, 25 bp, Rattus norvegicus
aactatgtgcaggacttccaggccc

SEQ ID NO: 28463 - DNA, 25 bp, Rattus norvegicus
aactatgtgcttaccctggcaagga

SEQ ID NO: 28464 - DNA, 25 bp, Rattus norvegicus
aactatgtgctttccctggcaagga

SEQ ID NO: 28465 - DNA, 25 bp, Rattus norvegicus
aactatgtggctctaacatgcatcc

SEQ ID NO: 28466 - DNA, 25 bp, Rattus norvegicus
aactatgtggctgtaacatgcatcc

SEQ ID NO: 28467 - DNA, 25 bp, Rattus norvegicus
aactatgtgtttcatgcttaccttc

SEQ ID NO: 28468 - DNA, 25 bp, Rattus norvegicus
aactatgtgtttgatgcttaccttc

SEQ ID NO: 28469 - DNA, 25 bp, Rattus norvegicus
aactatgttactcgcgagtggatct

SEQ ID NO: 28470 - DNA, 25 bp, Rattus norvegicus
aactatgttactggcgagtggatct

SEQ ID NO: 28471 - DNA, 25 bp, Rattus norvegicus
aactatgttctcaccttagaccttt

SEQ ID NO: 28472 - DNA, 25 bp, Rattus norvegicus
aactatgttctctccttagaccttt

SEQ ID NO: 28473 - DNA, 25 bp, Rattus norvegicus
aactatgttggtagcccatttgaaa

SEQ ID NO: 28474 - DNA, 25 bp, Rattus norvegicus
aactatgttggttgcccatttgaaa

SEQ ID NO: 28475 - DNA, 25 bp, Rattus norvegicus
aactatgttgtaaatgctacttcat

SEQ ID NO: 28476 - DNA, 25 bp, Rattus norvegicus
aactatgttgtatatgctacttcat

SEQ ID NO: 28477 - DNA, 25 bp, Rattus norvegicus
aactatgtttgcctggaatgccagc

SEQ ID NO: 28478 - DNA, 25 bp, Rattus norvegicus
aactatgtttgcgtggaatgccagc

SEQ ID NO: 28479 - DNA, 25 bp, Rattus norvegicus
aactattagccaagcagttactgtg

SEQ ID NO: 28480 - DNA, 25 bp, Rattus norvegicus
aactattagccatgcagttactgtg

SEQ ID NO: 28481 - DNA, 25 bp, Rattus norvegicus
aactattaggttagctgggtgtgag

SEQ ID NO: 28482 - DNA, 25 bp, Rattus norvegicus
aactattaggtttgctgggtgtgag

SEQ ID NO: 28483 - DNA, 25 bp, Rattus norvegicus
aactattatattagggagtccctca

SEQ ID NO: 28484 - DNA, 25 bp, Rattus norvegicus
aactattatatttgggagtccctca

SEQ ID NO: 28485 - DNA, 25 bp, Rattus norvegicus
aactattatctgacacactggtgct

SEQ ID NO: 28486 - DNA, 25 bp, Rattus norvegicus
aactattatctgtcacactggtgct

SEQ ID NO: 28487 - DNA, 25 bp, Rattus norvegicus
aactattatgtgctcgatgctttgt

SEQ ID NO: 28488 - DNA, 25 bp, Rattus norvegicus
aactattatgtggtcgatgctttgt

SEQ ID NO: 28489 - DNA, 25 bp, Rattus norvegicus
aactattcatagctcataggcccct

SEQ ID NO: 28490 - DNA, 25 bp, Rattus norvegicus
aactattcataggtcataggcccct

SEQ ID NO: 28491 - DNA, 25 bp, Rattus norvegicus
aactattccttacccagctttgtag

SEQ ID NO: 28492 - DNA, 25 bp, Rattus norvegicus
aactattccttagccagctttgtag

SEQ ID NO: 28493 - DNA, 25 bp, Rattus norvegicus
aactattccttgacacctgttgggt

SEQ ID NO: 28494 - DNA, 25 bp, Rattus norvegicus
aactattccttgtcacctgttgggt

SEQ ID NO: 28495 - DNA, 25 bp, Rattus norvegicus
aactattcgacaccctacatgcctg

SEQ ID NO: 28496 - DNA, 25 bp, Rattus norvegicus
aactattcgacagcctacatgcctg

SEQ ID NO: 28497 - DNA, 25 bp, Rattus norvegicus
aactattctcgcatgttcttgggaa

SEQ ID NO: 28498 - DNA, 25 bp, Rattus norvegicus
aactattctcgcttgttcttgggaa

SEQ ID NO: 28499 - DNA, 25 bp, Rattus norvegicus
aactattcttctctttatttgtagg

SEQ ID NO: 28500 - DNA, 25 bp, Rattus norvegicus
aactattcttctgtttatttgtagg

SEQ ID NO: 28501 - DNA, 25 bp, Rattus norvegicus
aactattcttgaacgtgctgctata

SEQ ID NO: 28502 - DNA, 25 bp, Rattus norvegicus
aactattcttgatcgtgctgctata

SEQ ID NO: 28503 - DNA, 25 bp, Rattus norvegicus
aactattgaaatcctacttccagtg

SEQ ID NO: 28504 - DNA, 25 bp, Rattus norvegicus
aactattgaaatgctacttccagtg

SEQ ID NO: 28505 - DNA, 25 bp, Rattus norvegicus
aactattggaccactgaaattctag

SEQ ID NO: 28506 - DNA, 25 bp, Rattus norvegicus
aactattggacctctgaaattctag

SEQ ID NO: 28507 - DNA, 25 bp, Rattus norvegicus
aactatttcccaagagcctgatcaa

SEQ ID NO: 28508 - DNA, 25 bp, Rattus norvegicus
aactatttcccatgagcctgatcaa

SEQ ID NO: 28509 - DNA, 25 bp, Rattus norvegicus
aactatttctacagcctttgaatga

SEQ ID NO: 28510 - DNA, 25 bp, Rattus norvegicus
aactatttctactgcctttgaatga

SEQ ID NO: 28511 - DNA, 25 bp, Rattus norvegicus
aactatttggcgagttttgggctgc

SEQ ID NO: 28512 - DNA, 25 bp, Rattus norvegicus
aactatttggcgtgttttgggctgc

SEQ ID NO: 28513 - DNA, 25 bp, Rattus norvegicus
aactattttagtaggtatcagcaag

SEQ ID NO: 28514 - DNA, 25 bp, Rattus norvegicus
aactattttagttggtatcagcaag

SEQ ID NO: 28515 - DNA, 25 bp, Rattus norvegicus
aactattttcccaggcacgtacaag

SEQ ID NO: 28516 - DNA, 25 bp, Rattus norvegicus
aactattttccctggcacgtacaag

SEQ ID NO: 28517 - DNA, 25 bp, Rattus norvegicus
aactcaaaacccacctgctgcggtg

SEQ ID NO: 28518 - DNA, 25 bp, Rattus norvegicus
aactcaaaaccctcctgctgcggtg

SEQ ID NO: 28519 - DNA, 25 bp, Rattus norvegicus
aactcaaagagcctgctgctgtctc

SEQ ID NO: 28520 - DNA, 25 bp, Rattus norvegicus
aactcaaagagcgtgctgctgtctc

SEQ ID NO: 28521 - DNA, 25 bp, Rattus norvegicus
aactcaaagtcgagattcagccgta

SEQ ID NO: 28522 - DNA, 25 bp, Rattus norvegicus
aactcaaagtcgtgattcagccgta

SEQ ID NO: 28523 - DNA, 25 bp, Rattus norvegicus
aactcaaatggcataccttctcttg

SEQ ID NO: 28524 - DNA, 25 bp, Rattus norvegicus
aactcaaatggcttaccttctcttg

SEQ ID NO: 28525 - DNA, 25 bp, Rattus norvegicus
aactcaaatgtcctgtgtctctgaa

SEQ ID NO: 28526 - DNA, 25 bp, Rattus norvegicus
aactcaaatgtcgtgtgtctctgaa

SEQ ID NO: 28527 - DNA, 25 bp, Rattus norvegicus
aactcaaattataatgcctttcagg

SEQ ID NO: 28528 - DNA, 25 bp, Rattus norvegicus
aactcaaattattatgcctttcagg

SEQ ID NO: 28529 - DNA, 25 bp, Rattus norvegicus
aactcaacacagcaccacttgaaga

SEQ ID NO: 28530 - DNA, 25 bp, Rattus norvegicus
aactcaacacaggaccacttgaaga

SEQ ID NO: 28531 - DNA, 25 bp, Rattus norvegicus
aactcaacaccaaggacttttcctt

SEQ ID NO: 28532 - DNA, 25 bp, Rattus norvegicus
aactcaacaccatggacttttcctt

SEQ ID NO: 28533 - DNA, 25 bp, Rattus norvegicus
aactcaacattgattgcggccttca

SEQ ID NO: 28534 - DNA, 25 bp, Rattus norvegicus
aactcaacattgtttgcggccttca

SEQ ID NO: 28535 - DNA, 25 bp, Rattus norvegicus
aactcaacgcttcctgtgccaaaga

SEQ ID NO: 28536 - DNA, 25 bp, Rattus norvegicus
aactcaacgcttgctgtgccaaaga

SEQ ID NO: 28537 - DNA, 25 bp, Rattus norvegicus
aactcaactcaacgtaggagtggct

SEQ ID NO: 28538 - DNA, 25 bp, Rattus norvegicus
aactcaactcaaggtaggagtggct

SEQ ID NO: 28539 - DNA, 25 bp, Rattus norvegicus
aactcaactcatcgtcttaatttct

SEQ ID NO: 28540 - DNA, 25 bp, Rattus norvegicus
aactcaactcatggtcttaatttct

SEQ ID NO: 28541 - DNA, 25 bp, Rattus norvegicus
aactcaactgagagtgcatcggaac

SEQ ID NO: 28542 - DNA, 25 bp, Rattus norvegicus
aactcaactgagtgtgcatcggaac

SEQ ID NO: 28543 - DNA, 25 bp, Rattus norvegicus
aactcaacttctcactttctgaaca

SEQ ID NO: 28544 - DNA, 25 bp, Rattus norvegicus
aactcaacttctgactttctgaaca

SEQ ID NO: 28545 - DNA, 25 bp, Rattus norvegicus
aactcaactttgcttctgttttctc

SEQ ID NO: 28546 - DNA, 25 bp, Rattus norvegicus
aactcaactttggttctgttttctc

SEQ ID NO: 28547 - DNA, 25 bp, Rattus norvegicus
aactcaacttttacatccacaacct

SEQ ID NO: 28548 - DNA, 25 bp, Rattus norvegicus
aactcaactttttcatccacaacct

SEQ ID NO: 28549 - DNA, 25 bp, Rattus norvegicus
aactcaagaagcagggcgtcccgat

SEQ ID NO: 28550 - DNA, 25 bp, Rattus norvegicus
aactcaagaagctgggcgtcccgat

SEQ ID NO: 28551 - DNA, 25 bp, Rattus norvegicus
aactcaagagccctgtggacaacaa

SEQ ID NO: 28552 - DNA, 25 bp, Rattus norvegicus
aactcaagagccgtgtggacaacaa

SEQ ID NO: 28553 - DNA, 25 bp, Rattus norvegicus
aactcaaggaggagcaaggcttggt

SEQ ID NO: 28554 - DNA, 25 bp, Rattus norvegicus
aactcaaggaggtgcaaggcttggt

SEQ ID NO: 28555 - DNA, 25 bp, Rattus norvegicus
aactcaaggcttattcactgaccag

SEQ ID NO: 28556 - DNA, 25 bp, Rattus norvegicus
aactcaaggctttttcactgaccag

SEQ ID NO: 28557 - DNA, 25 bp, Rattus norvegicus
aactcaagggtgcaagcatccggaa

SEQ ID NO: 28558 - DNA, 25 bp, Rattus norvegicus
aactcaagggtggaagcatccggaa

SEQ ID NO: 28559 - DNA, 25 bp, Rattus norvegicus
aactcaagtcttcctttgggtctag

SEQ ID NO: 28560 - DNA, 25 bp, Rattus norvegicus
aactcaagtcttgctttgggtctag

SEQ ID NO: 28561 - DNA, 25 bp, Rattus norvegicus
aactcaagtgtaagttatgctcagt

SEQ ID NO: 28562 - DNA, 25 bp, Rattus norvegicus
aactcaagtgtatgttatgctcagt

SEQ ID NO: 28563 - DNA, 25 bp, Rattus norvegicus
aactcaagtgtgagtattctggtca

SEQ ID NO: 28564 - DNA, 25 bp, Rattus norvegicus
aactcaagtgtgctttctgcagctc

SEQ ID NO: 28565 - DNA, 25 bp, Rattus norvegicus
aactcaagtgtggtttctgcagctc

SEQ ID NO: 28566 - DNA, 25 bp, Rattus norvegicus
aactcaagtgtgtgtattctggtca

SEQ ID NO: 28567 - DNA, 25 bp, Rattus norvegicus
aactcaatagccatagattttgtat

SEQ ID NO: 28568 - DNA, 25 bp, Rattus norvegicus
aactcaatagccttagattttgtat

SEQ ID NO: 28569 - DNA, 25 bp, Rattus norvegicus
aactcaatagtcatgggttcagaag

SEQ ID NO: 28570 - DNA, 25 bp, Rattus norvegicus
aactcaatagtcttgggttcagaag

SEQ ID NO: 28571 - DNA, 25 bp, Rattus norvegicus
aactcaatattcacttgtggacgac

SEQ ID NO: 28572 - DNA, 25 bp, Rattus norvegicus
aactcaatattctcttgtggacgac

SEQ ID NO: 28573 - DNA, 25 bp, Rattus norvegicus
aactcaatgtcaaaggatcacctgt

SEQ ID NO: 28574 - DNA, 25 bp, Rattus norvegicus
aactcaatgtcataggatcacctgt

SEQ ID NO: 28575 - DNA, 25 bp, Rattus norvegicus
aactcaatgtctcttcaactttcaa

SEQ ID NO: 28576 - DNA, 25 bp, Rattus norvegicus
aactcaatgtctgttcaactttcaa

SEQ ID NO: 28577 - DNA, 25 bp, Rattus norvegicus
aactcaatgtgactgctgacgtgct

SEQ ID NO: 28578 - DNA, 25 bp, Rattus norvegicus
aactcaatgtgagtgctgacgtgct

SEQ ID NO: 28579 - DNA, 25 bp, Rattus norvegicus
aactcaattctcatccttttccagg

SEQ ID NO: 28580 - DNA, 25 bp, Rattus norvegicus
aactcaattctcttccttttccagg

SEQ ID NO: 28581 - DNA, 25 bp, Rattus norvegicus
aactcaattgccatacgcacacttt

SEQ ID NO: 28582 - DNA, 25 bp, Rattus norvegicus
aactcaattgccttacgcacacttt

SEQ ID NO: 28583 - DNA, 25 bp, Rattus norvegicus
aactcacaatttagctatgccactt

SEQ ID NO: 28584 - DNA, 25 bp, Rattus norvegicus
aactcacaattttgctatgccactt

SEQ ID NO: 28585 - DNA, 25 bp, Rattus norvegicus
aactcacacagcaagtgactcccgg

SEQ ID NO: 28586 - DNA, 25 bp, Rattus norvegicus
aactcacacagctagtgactcccgg

SEQ ID NO: 28587 - DNA, 25 bp, Rattus norvegicus
aactcacaccgacagcatcaaaatg

SEQ ID NO: 28588 - DNA, 25 bp, Rattus norvegicus
aactcacaccgagagcatcaaaatg

SEQ ID NO: 28589 - DNA, 25 bp, Rattus norvegicus
aactcacagaagattgccttccact

SEQ ID NO: 28590 - DNA, 25 bp, Rattus norvegicus
aactcacagaagtttgccttccact

SEQ ID NO: 28591 - DNA, 25 bp, Rattus norvegicus
aactcacagaatagtctgcctcttc

SEQ ID NO: 28592 - DNA, 25 bp, Rattus norvegicus
aactcacagaattgtctgcctcttc

SEQ ID NO: 28593 - DNA, 25 bp, Rattus norvegicus
aactcacagctgcaaggaacacaca

SEQ ID NO: 28594 - DNA, 25 bp, Rattus norvegicus
aactcacagctggaaggaacacaca

SEQ ID NO: 28595 - DNA, 25 bp, Rattus norvegicus
aactcacaggagatgtcccctgatc

SEQ ID NO: 28596 - DNA, 25 bp, Rattus norvegicus
aactcacaggagttgtcccctgatc

SEQ ID NO: 28597 - DNA, 25 bp, Rattus norvegicus
aactcacagtttatggtcaggcaga

SEQ ID NO: 28598 - DNA, 25 bp, Rattus norvegicus
aactcacagtttttggtcaggcaga

SEQ ID NO: 28599 - DNA, 25 bp, Rattus norvegicus
aactcacatcaacgtggtagcccct

SEQ ID NO: 28600 - DNA, 25 bp, Rattus norvegicus
aactcacatcaaggtggtagcccct

SEQ ID NO: 28601 - DNA, 25 bp, Rattus norvegicus
aactcacatgctcgctcggcaagtg

SEQ ID NO: 28602 - DNA, 25 bp, Rattus norvegicus
aactcacatgctggctcggcaagtg

SEQ ID NO: 28603 - DNA, 25 bp, Rattus norvegicus
aactcacatggaactcggagcctgt

SEQ ID NO: 28604 - DNA, 25 bp, Rattus norvegicus
aactcacatggatctcggagcctgt

SEQ ID NO: 28605 - DNA, 25 bp, Rattus norvegicus
aactcacatgttctcatatttcaca

SEQ ID NO: 28606 - DNA, 25 bp, Rattus norvegicus
aactcacatgttgtcatatttcaca

SEQ ID NO: 28607 - DNA, 25 bp, Rattus norvegicus
aactcaccagctcggtggcatcctg

SEQ ID NO: 28608 - DNA, 25 bp, Rattus norvegicus
aactcaccagctgggtggcatcctg

SEQ ID NO: 28609 - DNA, 25 bp, Rattus norvegicus
aactcaccccatatgggccctgaga

SEQ ID NO: 28610 - DNA, 25 bp, Rattus norvegicus
aactcaccccatttgggccctgaga

SEQ ID NO: 28611 - DNA, 25 bp, Rattus norvegicus
aactcaccctcacaatccgattgaa

SEQ ID NO: 28612 - DNA, 25 bp, Rattus norvegicus
aactcaccctcagaatccgattgaa

SEQ ID NO: 28613 - DNA, 25 bp, Rattus norvegicus
aactcaccttgaatttctgcatatt

SEQ ID NO: 28614 - DNA, 25 bp, Rattus norvegicus
aactcaccttgattttctgcatatt

SEQ ID NO: 28615 - DNA, 25 bp, Rattus norvegicus
aactcacgcagaccactttgagcct

SEQ ID NO: 28616 - DNA, 25 bp, Rattus norvegicus
aactcacgcagagcactttgagcct

SEQ ID NO: 28617 - DNA, 25 bp, Rattus norvegicus
aactcacggctcagggtggcgtttc

SEQ ID NO: 28618 - DNA, 25 bp, Rattus norvegicus
aactcacggctctgggtggcgtttc

SEQ ID NO: 28619 - DNA, 25 bp, Rattus norvegicus
aactcacggtgaccagtcacttcag

SEQ ID NO: 28620 - DNA, 25 bp, Rattus norvegicus
aactcacggtgagcagtcacttcag

SEQ ID NO: 28621 - DNA, 25 bp, Rattus norvegicus
aactcacgttttcttggcatactcc

SEQ ID NO: 28622 - DNA, 25 bp, Rattus norvegicus
aactcacgttttgttggcatactcc

SEQ ID NO: 28623 - DNA, 25 bp, Rattus norvegicus
aactcactattgaagatgcaaaggc

SEQ ID NO: 28624 - DNA, 25 bp, Rattus norvegicus
aactcactattgtagatgcaaaggc

SEQ ID NO: 28625 - DNA, 25 bp, Rattus norvegicus
aactcactcactctgaagctgatag

SEQ ID NO: 28626 - DNA, 25 bp, Rattus norvegicus
aactcactcactgtgaagctgatag

SEQ ID NO: 28627 - DNA, 25 bp, Rattus norvegicus
aactcactcggcatggacagtgtcc

SEQ ID NO: 28628 - DNA, 25 bp, Rattus norvegicus
aactcactcggcttggacagtgtcc

SEQ ID NO: 28629 - DNA, 25 bp, Rattus norvegicus
aactcactgacaaacaattcctttg

SEQ ID NO: 28630 - DNA, 25 bp, Rattus norvegicus
aactcactgacatacaattcctttg

SEQ ID NO: 28631 - DNA, 25 bp, Rattus norvegicus
aactcactgatgactacccattggc

SEQ ID NO: 28632 - DNA, 25 bp, Rattus norvegicus
aactcactgatgtctacccattggc

SEQ ID NO: 28633 - DNA, 25 bp, Rattus norvegicus
aactcactgcagaccagattgccat

SEQ ID NO: 28634 - DNA, 25 bp, Rattus norvegicus
aactcactgcagtccagattgccat

SEQ ID NO: 28635 - DNA, 25 bp, Rattus norvegicus
aactcactgctgctgtctaaagaga

SEQ ID NO: 28636 - DNA, 25 bp, Rattus norvegicus
aactcactgctggtgtctaaagaga

SEQ ID NO: 28637 - DNA, 25 bp, Rattus norvegicus
aactcactggatatctcctctgttt

SEQ ID NO: 28638 - DNA, 25 bp, Rattus norvegicus
aactcactggatttctcctctgttt

SEQ ID NO: 28639 - DNA, 25 bp, Rattus norvegicus
aactcacttgtgaacagaaaggaga

SEQ ID NO: 28640 - DNA, 25 bp, Rattus norvegicus
aactcacttgtgtacagaaaggaga

SEQ ID NO: 28641 - DNA, 25 bp, Rattus norvegicus
aactcactttccaaaggcttgtggt

SEQ ID NO: 28642 - DNA, 25 bp, Rattus norvegicus
aactcactttcctaaggcttgtggt

SEQ ID NO: 28643 - DNA, 25 bp, Rattus norvegicus
aactcagaaatccagcagcgaccaa

SEQ ID NO: 28644 - DNA, 25 bp, Rattus norvegicus
aactcagaaatcgagcagcgaccaa

SEQ ID NO: 28645 - DNA, 25 bp, Rattus norvegicus
aactcagaacggagcttttgggact

SEQ ID NO: 28646 - DNA, 25 bp, Rattus norvegicus
aactcagaacggtgcttttgggact

SEQ ID NO: 28647 - DNA, 25 bp, Rattus norvegicus
aactcagaactccatgattcatgtg

SEQ ID NO: 28648 - DNA, 25 bp, Rattus norvegicus
aactcagaactcgatgattcatgtg

SEQ ID NO: 28649 - DNA, 25 bp, Rattus norvegicus
aactcagacctgcaagacgcttcgg

SEQ ID NO: 28650 - DNA, 25 bp, Rattus norvegicus
aactcagacctggaagacgcttcgg

SEQ ID NO: 28651 - DNA, 25 bp, Rattus norvegicus
aactcagacgatattgaccctgctt

SEQ ID NO: 28652 - DNA, 25 bp, Rattus norvegicus
aactcagacgattttgaccctgctt

SEQ ID NO: 28653 - DNA, 25 bp, Rattus norvegicus
aactcagactgtctttgttgaacca

SEQ ID NO: 28654 - DNA, 25 bp, Rattus norvegicus
aactcagactgtgtttgttgaacca

SEQ ID NO: 28655 - DNA, 25 bp, Rattus norvegicus
aactcagagacaccatccagacaga

SEQ ID NO: 28656 - DNA, 25 bp, Rattus norvegicus
aactcagagacagcatccagacaga

SEQ ID NO: 28657 - DNA, 25 bp, Rattus norvegicus
aactcagagagtaccatgtcaagat

SEQ ID NO: 28658 - DNA, 25 bp, Rattus norvegicus
aactcagagagttccatgtcaagat

SEQ ID NO: 28659 - DNA, 25 bp, Rattus norvegicus
aactcagagctgatgaagccccacc

SEQ ID NO: 28660 - DNA, 25 bp, Rattus norvegicus
aactcagagctgttgaagccccacc

SEQ ID NO: 28661 - DNA, 25 bp, Rattus norvegicus
aactcagaggcacatctgggccttt

SEQ ID NO: 28662 - DNA, 25 bp, Rattus norvegicus
aactcagaggcagatctgggccttt

SEQ ID NO: 28663 - DNA, 25 bp, Rattus norvegicus
aactcagatgtcctctgtgagggac

SEQ ID NO: 28664 - DNA, 25 bp, Rattus norvegicus
aactcagatgtcgtctgtgagggac

SEQ ID NO: 28665 - DNA, 25 bp, Rattus norvegicus
aactcagcaagtctaatttctagaa

SEQ ID NO: 28666 - DNA, 25 bp, Rattus norvegicus
aactcagcaagtgtaatttctagaa

SEQ ID NO: 28667 - DNA, 25 bp, Rattus norvegicus
aactcagcaatgactggtctctgcc

SEQ ID NO: 28668 - DNA, 25 bp, Rattus norvegicus
aactcagcaatgtctggtctctgcc

SEQ ID NO: 28669 - DNA, 25 bp, Rattus norvegicus
aactcagccaccagccacttgaggg

SEQ ID NO: 28670 - DNA, 25 bp, Rattus norvegicus
aactcagccacctgccacttgaggg

SEQ ID NO: 28671 - DNA, 25 bp, Rattus norvegicus
aactcagccagtatccatatatgtg

SEQ ID NO: 28672 - DNA, 25 bp, Rattus norvegicus
aactcagccagtttccatatatgtg

SEQ ID NO: 28673 - DNA, 25 bp, Rattus norvegicus
aactcagccataactcagggtgtga

SEQ ID NO: 28674 - DNA, 25 bp, Rattus norvegicus
aactcagccatatctcagggtgtga

SEQ ID NO: 28675 - DNA, 25 bp, Rattus norvegicus
aactcagcccctagcaactcttggg

SEQ ID NO: 28676 - DNA, 25 bp, Rattus norvegicus
aactcagccccttgcaactcttggg

SEQ ID NO: 28677 - DNA, 25 bp, Rattus norvegicus
aactcagccctcagcggtgtttggt

SEQ ID NO: 28678 - DNA, 25 bp, Rattus norvegicus
aactcagccctctgcggtgtttggt

SEQ ID NO: 28679 - DNA, 25 bp, Rattus norvegicus
aactcagcctcaccgtctatgtgga

SEQ ID NO: 28680 - DNA, 25 bp, Rattus norvegicus
aactcagcctcagcgtctatgtgga

SEQ ID NO: 28681 - DNA, 25 bp, Rattus norvegicus
aactcagcgaacattttgtcgtgaa

SEQ ID NO: 28682 - DNA, 25 bp, Rattus norvegicus
aactcagcgaactttttgtcgtgaa

SEQ ID NO: 28683 - DNA, 25 bp, Rattus norvegicus
aactcagcggacagtacctttagaa

SEQ ID NO: 28684 - DNA, 25 bp, Rattus norvegicus
aactcagcggactgtacctttagaa

SEQ ID NO: 28685 - DNA, 25 bp, Rattus norvegicus
aactcagctaggctgggagccttca

SEQ ID NO: 28686 - DNA, 25 bp, Rattus norvegicus
aactcagctagggtgggagccttca

SEQ ID NO: 28687 - DNA, 25 bp, Rattus norvegicus
aactcagctgccacccactggatgg

SEQ ID NO: 28688 - DNA, 25 bp, Rattus norvegicus
aactcagctgcctcccactggatgg

SEQ ID NO: 28689 - DNA, 25 bp, Rattus norvegicus
aactcagctggaaggtctgtcagta

SEQ ID NO: 28690 - DNA, 25 bp, Rattus norvegicus
aactcagctggatggtctgtcagta

SEQ ID NO: 28691 - DNA, 25 bp, Rattus norvegicus
aactcagcttttactcagcagacta

SEQ ID NO: 28692 - DNA, 25 bp, Rattus norvegicus
aactcagcttttccctatctgtcct

SEQ ID NO: 28693 - DNA, 25 bp, Rattus norvegicus
aactcagcttttgcctatctgtcct

SEQ ID NO: 28694 - DNA, 25 bp, Rattus norvegicus
aactcagctttttctcagcagacta

SEQ ID NO: 28695 - DNA, 25 bp, Rattus norvegicus
aactcaggaaatcggtgctcgggcc

SEQ ID NO: 28696 - DNA, 25 bp, Rattus norvegicus
aactcaggaaatgggtgctcgggcc

SEQ ID NO: 28697 - DNA, 25 bp, Rattus norvegicus
aactcaggagcaacagtccgcacat

SEQ ID NO: 28698 - DNA, 25 bp, Rattus norvegicus
aactcaggagcatcagtccgcacat

SEQ ID NO: 28699 - DNA, 25 bp, Rattus norvegicus
aactcaggagtcaaggttgcaggca

SEQ ID NO: 28700 - DNA, 25 bp, Rattus norvegicus
aactcaggagtctaggttgcaggca

SEQ ID NO: 28701 - DNA, 25 bp, Rattus norvegicus
aactcaggattcatgctgtcaggaa

SEQ ID NO: 28702 - DNA, 25 bp, Rattus norvegicus
aactcaggattcttgctgtcaggaa

SEQ ID NO: 28703 - DNA, 25 bp, Rattus norvegicus
aactcaggcacaccatgtcttcaga

SEQ ID NO: 28704 - DNA, 25 bp, Rattus norvegicus
aactcaggcacagcatgtcttcaga

SEQ ID NO: 28705 - DNA, 25 bp, Rattus norvegicus
aactcaggcggcaccgtggtggtct

SEQ ID NO: 28706 - DNA, 25 bp, Rattus norvegicus
aactcaggcggctccgtggtggtct

SEQ ID NO: 28707 - DNA, 25 bp, Rattus norvegicus
aactcaggctaacccagcagcagag

SEQ ID NO: 28708 - DNA, 25 bp, Rattus norvegicus
aactcaggctaagccagcagcagag

SEQ ID NO: 28709 - DNA, 25 bp, Rattus norvegicus
aactcagggtctatgcagaattgct

SEQ ID NO: 28710 - DNA, 25 bp, Rattus norvegicus
aactcagggtctttgcagaattgct

SEQ ID NO: 28711 - DNA, 25 bp, Rattus norvegicus
aactcagggttgcaagtctctgtcc

SEQ ID NO: 28712 - DNA, 25 bp, Rattus norvegicus
aactcagggttggaagtctctgtcc

SEQ ID NO: 28713 - DNA, 25 bp, Rattus norvegicus
aactcaggtccaagggtcgtttgat

SEQ ID NO: 28714 - DNA, 25 bp, Rattus norvegicus
aactcaggtccatgggtcgtttgat

SEQ ID NO: 28715 - DNA, 25 bp, Rattus norvegicus
aactcaggtcctcaagcttgtgaaa

SEQ ID NO: 28716 - DNA, 25 bp, Rattus norvegicus
aactcaggtcctgaagcttgtgaaa

SEQ ID NO: 28717 - DNA, 25 bp, Rattus norvegicus
aactcaggtctgacatccaagccta

SEQ ID NO: 28718 - DNA, 25 bp, Rattus norvegicus
aactcaggtctgtcatccaagccta

SEQ ID NO: 28719 - DNA, 25 bp, Rattus norvegicus
aactcaggtcttcagacttgggtca

SEQ ID NO: 28720 - DNA, 25 bp, Rattus norvegicus
aactcaggtcttgagacttgggtca

SEQ ID NO: 28721 - DNA, 25 bp, Rattus norvegicus
aactcaggtgtcatgtcacggtagt

SEQ ID NO: 28722 - DNA, 25 bp, Rattus norvegicus
aactcaggtgtcttgtcacggtagt

SEQ ID NO: 28723 - DNA, 25 bp, Rattus norvegicus
aactcaggttgccagatttaggact

SEQ ID NO: 28724 - DNA, 25 bp, Rattus norvegicus
aactcaggttgcgagatttaggact

SEQ ID NO: 28725 - DNA, 25 bp, Rattus norvegicus
aactcagtaagtcggctgtctgtga

SEQ ID NO: 28726 - DNA, 25 bp, Rattus norvegicus
aactcagtaagtgggctgtctgtga

SEQ ID NO: 28727 - DNA, 25 bp, Rattus norvegicus
aactcagtacccacctggtcgtggg

SEQ ID NO: 28728 - DNA, 25 bp, Rattus norvegicus
aactcagtaccctcctggtcgtggg

SEQ ID NO: 28729 - DNA, 25 bp, Rattus norvegicus
aactcagtagagagctcctgcaact

SEQ ID NO: 28730 - DNA, 25 bp, Rattus norvegicus
aactcagtagagtgctcctgcaact

SEQ ID NO: 28731 - DNA, 25 bp, Rattus norvegicus
aactcagtgatgcagtgcttcctct

SEQ ID NO: 28732 - DNA, 25 bp, Rattus norvegicus
aactcagtgatggagtgcttcctct

SEQ ID NO: 28733 - DNA, 25 bp, Rattus norvegicus
aactcagtgattcagcacttgcctg

SEQ ID NO: 28734 - DNA, 25 bp, Rattus norvegicus
aactcagtgattcgtacttacaaga

SEQ ID NO: 28735 - DNA, 25 bp, Rattus norvegicus
aactcagtgattcgtcattagctcc

SEQ ID NO: 28736 - DNA, 25 bp, Rattus norvegicus
aactcagtgattgagcacttgcctg

SEQ ID NO: 28737 - DNA, 25 bp, Rattus norvegicus
aactcagtgattggtacttacaaga

SEQ ID NO: 28738 - DNA, 25 bp, Rattus norvegicus
aactcagtgattggtcattagctcc

SEQ ID NO: 28739 - DNA, 25 bp, Rattus norvegicus
aactcagtgcagcagattgctcagc

SEQ ID NO: 28740 - DNA, 25 bp, Rattus norvegicus
aactcagtgcaggagattgctcagc

SEQ ID NO: 28741 - DNA, 25 bp, Rattus norvegicus
aactcagtgctccagatctacatga

SEQ ID NO: 28742 - DNA, 25 bp, Rattus norvegicus
aactcagtgctcgagatctacatga

SEQ ID NO: 28743 - DNA, 25 bp, Rattus norvegicus
aactcagtgcttagccaggatgccc

SEQ ID NO: 28744 - DNA, 25 bp, Rattus norvegicus
aactcagtgcttcctaggtgtttga

SEQ ID NO: 28745 - DNA, 25 bp, Rattus norvegicus
aactcagtgcttgctaggtgtttga

SEQ ID NO: 28746 - DNA, 25 bp, Rattus norvegicus
aactcagtgctttgccaggatgccc

SEQ ID NO: 28747 - DNA, 25 bp, Rattus norvegicus
aactcagtggacacacttgtcttca

SEQ ID NO: 28748 - DNA, 25 bp, Rattus norvegicus
aactcagtggactcacttgtcttca

SEQ ID NO: 28749 - DNA, 25 bp, Rattus norvegicus
aactcagtgtgaattccttggtctt

SEQ ID NO: 28750 - DNA, 25 bp, Rattus norvegicus
aactcagtgtgatttccttggtctt

SEQ ID NO: 28751 - DNA, 25 bp, Rattus norvegicus
aactcagttggcatgatgacctcat

SEQ ID NO: 28752 - DNA, 25 bp, Rattus norvegicus
aactcagttggcttgatgacctcat

SEQ ID NO: 28753 - DNA, 25 bp, Rattus norvegicus
aactcagtttgaacctttggcagca

SEQ ID NO: 28754 - DNA, 25 bp, Rattus norvegicus
aactcagtttgatcctttggcagca

SEQ ID NO: 28755 - DNA, 25 bp, Rattus norvegicus
aactcagtttggctgcctcgggaga

SEQ ID NO: 28756 - DNA, 25 bp, Rattus norvegicus
aactcagtttgggtgcctcgggaga

SEQ ID NO: 28757 - DNA, 25 bp, Rattus norvegicus
aactcataaactctcacagcacttt

SEQ ID NO: 28758 - DNA, 25 bp, Rattus norvegicus
aactcataaactgtcacagcacttt

SEQ ID NO: 28759 - DNA, 25 bp, Rattus norvegicus
aactcatagattctttcttggacca

SEQ ID NO: 28760 - DNA, 25 bp, Rattus norvegicus
aactcatagattgtttcttggacca

SEQ ID NO: 28761 - DNA, 25 bp, Rattus norvegicus
aactcatagcagatctcctgtttca

SEQ ID NO: 28762 - DNA, 25 bp, Rattus norvegicus
aactcatagcagttctcctgtttca

SEQ ID NO: 28763 - DNA, 25 bp, Rattus norvegicus
aactcatagcttaccttgatttcat

SEQ ID NO: 28764 - DNA, 25 bp, Rattus norvegicus
aactcatagctttccttgatttcat

SEQ ID NO: 28765 - DNA, 25 bp, Rattus norvegicus
aactcatataaacagctggccacaa

SEQ ID NO: 28766 - DNA, 25 bp, Rattus norvegicus
aactcatataaagagctggccacaa

SEQ ID NO: 28767 - DNA, 25 bp, Rattus norvegicus
aactcatatacaattttgcaggtac

SEQ ID NO: 28768 - DNA, 25 bp, Rattus norvegicus
aactcatatacatttttgcaggtac

SEQ ID NO: 28769 - DNA, 25 bp, Rattus norvegicus
aactcatatcggcatttgttgcaaa

SEQ ID NO: 28770 - DNA, 25 bp, Rattus norvegicus
aactcatatcgggatttgttgcaaa

SEQ ID NO: 28771 - DNA, 25 bp, Rattus norvegicus
aactcatattccatccagcatgtaa

SEQ ID NO: 28772 - DNA, 25 bp, Rattus norvegicus
aactcatattccttccagcatgtaa

SEQ ID NO: 28773 - DNA, 25 bp, Rattus norvegicus
aactcatcagagcagctggtgccac

SEQ ID NO: 28774 - DNA, 25 bp, Rattus norvegicus
aactcatcagaggagctggtgccac

SEQ ID NO: 28775 - DNA, 25 bp, Rattus norvegicus
aactcatcagtaatagtctttctaa

SEQ ID NO: 28776 - DNA, 25 bp, Rattus norvegicus
aactcatcagtattagtctttctaa

SEQ ID NO: 28777 - DNA, 25 bp, Rattus norvegicus
aactcatcatggacattggccatag

SEQ ID NO: 28778 - DNA, 25 bp, Rattus norvegicus
aactcatcatggtcattggccatag

SEQ ID NO: 28779 - DNA, 25 bp, Rattus norvegicus
aactcatccgggaatgtcttactgg

SEQ ID NO: 28780 - DNA, 25 bp, Rattus norvegicus
aactcatccgggtatgtcttactgg

SEQ ID NO: 28781 - DNA, 25 bp, Rattus norvegicus
aactcatcgagtagcgggtgcggcc

SEQ ID NO: 28782 - DNA, 25 bp, Rattus norvegicus
aactcatcgagttgcgggtgcggcc

SEQ ID NO: 28783 - DNA, 25 bp, Rattus norvegicus
aactcatctctcatcataaacgcaa

SEQ ID NO: 28784 - DNA, 25 bp, Rattus norvegicus
aactcatctctcttcataaacgcaa

SEQ ID NO: 28785 - DNA, 25 bp, Rattus norvegicus
aactcatctgcccagtcgaattaga

SEQ ID NO: 28786 - DNA, 25 bp, Rattus norvegicus
aactcatctgccgagtcgaattaga

SEQ ID NO: 28787 - DNA, 25 bp, Rattus norvegicus
aactcatcttgtaatttcatcttaa

SEQ ID NO: 28788 - DNA, 25 bp, Rattus norvegicus
aactcatcttgttatttcatcttaa

SEQ ID NO: 28789 - DNA, 25 bp, Rattus norvegicus
aactcatgagtgaggtggctgccca

SEQ ID NO: 28790 - DNA, 25 bp, Rattus norvegicus
aactcatgagtgtggtggctgccca

SEQ ID NO: 28791 - DNA, 25 bp, Rattus norvegicus
aactcatgatggatggagacctcct

SEQ ID NO: 28792 - DNA, 25 bp, Rattus norvegicus
aactcatgatggttggagacctcct

SEQ ID NO: 28793 - DNA, 25 bp, Rattus norvegicus
aactcatgatgtatgtgtgaccgct

SEQ ID NO: 28794 - DNA, 25 bp, Rattus norvegicus
aactcatgatgtttgtgtgaccgct

SEQ ID NO: 28795 - DNA, 25 bp, Rattus norvegicus
aactcatgcgctatgatgatcctct

SEQ ID NO: 28796 - DNA, 25 bp, Rattus norvegicus
aactcatgcgctttgatgatcctct

SEQ ID NO: 28797 - DNA, 25 bp, Rattus norvegicus
aactcatgctagactgctggcacaa

SEQ ID NO: 28798 - DNA, 25 bp, Rattus norvegicus
aactcatgctagtctgctggcacaa

SEQ ID NO: 28799 - DNA, 25 bp, Rattus norvegicus
aactcatgctgtacctgagggactc

SEQ ID NO: 28800 - DNA, 25 bp, Rattus norvegicus
aactcatgctgtagccaaaggctgt

SEQ ID NO: 28801 - DNA, 25 bp, Rattus norvegicus
aactcatgctgttcctgagggactc

SEQ ID NO: 28802 - DNA, 25 bp, Rattus norvegicus
aactcatgctgttgccaaaggctgt

SEQ ID NO: 28803 - DNA, 25 bp, Rattus norvegicus
aactcatggcatagtagggtagggt

SEQ ID NO: 28804 - DNA, 25 bp, Rattus norvegicus
aactcatggcattgtagggtagggt

SEQ ID NO: 28805 - DNA, 25 bp, Rattus norvegicus
aactcatgggtgcatgccctgggac

SEQ ID NO: 28806 - DNA, 25 bp, Rattus norvegicus
aactcatgggtgctggtgcttgaat

SEQ ID NO: 28807 - DNA, 25 bp, Rattus norvegicus
aactcatgggtggatgccctgggac

SEQ ID NO: 28808 - DNA, 25 bp, Rattus norvegicus
aactcatgggtggtggtgcttgaat

SEQ ID NO: 28809 - DNA, 25 bp, Rattus norvegicus
aactcatggttgaagctggctttgg

SEQ ID NO: 28810 - DNA, 25 bp, Rattus norvegicus
aactcatggttgtagctggctttgg

SEQ ID NO: 28811 - DNA, 25 bp, Rattus norvegicus
aactcatgtataatattgcctctgt

SEQ ID NO: 28812 - DNA, 25 bp, Rattus norvegicus
aactcatgtatattattgcctctgt

SEQ ID NO: 28813 - DNA, 25 bp, Rattus norvegicus
aactcatgtgttaattcaggtgcaa

SEQ ID NO: 28814 - DNA, 25 bp, Rattus norvegicus
aactcatgtgtttattcaggtgcaa

SEQ ID NO: 28815 - DNA, 25 bp, Rattus norvegicus
aactcattaaacacactgggcaaca

SEQ ID NO: 28816 - DNA, 25 bp, Rattus norvegicus
aactcattaaactcactgggcaaca

SEQ ID NO: 28817 - DNA, 25 bp, Rattus norvegicus
aactcattccacaactcagtactgt

SEQ ID NO: 28818 - DNA, 25 bp, Rattus norvegicus
aactcattccactactcagtactgt

SEQ ID NO: 28819 - DNA, 25 bp, Rattus norvegicus
aactcatttctgattgggcacaaag

SEQ ID NO: 28820 - DNA, 25 bp, Rattus norvegicus
aactcatttctgtttgggcacaaag

SEQ ID NO: 28821 - DNA, 25 bp, Rattus norvegicus
aactcatttcttccgatctgttttc

SEQ ID NO: 28822 - DNA, 25 bp, Rattus norvegicus
aactcatttcttgcgatctgttttc

SEQ ID NO: 28823 - DNA, 25 bp, Rattus norvegicus
aactcatttgtccttttactttgct

SEQ ID NO: 28824 - DNA, 25 bp, Rattus norvegicus
aactcatttgtcgttttactttgct

SEQ ID NO: 28825 - DNA, 25 bp, Rattus norvegicus
aactcattttcccatcattggcggt

SEQ ID NO: 28826 - DNA, 25 bp, Rattus norvegicus
aactcattttccgatcattggcggt

SEQ ID NO: 28827 - DNA, 25 bp, Rattus norvegicus
aactcattttgtattgaagataggt

SEQ ID NO: 28828 - DNA, 25 bp, Rattus norvegicus
aactcattttgttttgaagataggt

SEQ ID NO: 28829 - DNA, 25 bp, Rattus norvegicus
aactcatttttcaagacttttctcg

SEQ ID NO: 28830 - DNA, 25 bp, Rattus norvegicus
aactcatttttctagacttttctcg

SEQ ID NO: 28831 - DNA, 25 bp, Rattus norvegicus
aactccaaaaggccaactcatgtag

SEQ ID NO: 28832 - DNA, 25 bp, Rattus norvegicus
aactccaaaagggcaactcatgtag

SEQ ID NO: 28833 - DNA, 25 bp, Rattus norvegicus
aactccaaagcgctccttttgctga

SEQ ID NO: 28834 - DNA, 25 bp, Rattus norvegicus
aactccaaagcggtccttttgctga

SEQ ID NO: 28835 - DNA, 25 bp, Rattus norvegicus
aactccaaatatcgcaagcagattt

SEQ ID NO: 28836 - DNA, 25 bp, Rattus norvegicus
aactccaaatatggcaagcagattt

SEQ ID NO: 28837 - DNA, 25 bp, Rattus norvegicus
aactccaacggtacctctatgagaa

SEQ ID NO: 28838 - DNA, 25 bp, Rattus norvegicus
aactccaacggttcctctatgagaa

SEQ ID NO: 28839 - DNA, 25 bp, Rattus norvegicus
aactccaagaccctttggtgcagaa

SEQ ID NO: 28840 - DNA, 25 bp, Rattus norvegicus
aactccaagaccgtttggtgcagaa

SEQ ID NO: 28841 - DNA, 25 bp, Rattus norvegicus
aactccaagagcatcatgcaccaag

SEQ ID NO: 28842 - DNA, 25 bp, Rattus norvegicus
aactccaagagcttcatgcaccaag

SEQ ID NO: 28843 - DNA, 25 bp, Rattus norvegicus
aactccaagcgtcagatcgtggacc

SEQ ID NO: 28844 - DNA, 25 bp, Rattus norvegicus
aactccaagcgtgagatcgtggacc

SEQ ID NO: 28845 - DNA, 25 bp, Rattus norvegicus
aactccaagtcaagtctttaaaaca

SEQ ID NO: 28846 - DNA, 25 bp, Rattus norvegicus
aactccaagtcatgtctttaaaaca

SEQ ID NO: 28847 - DNA, 25 bp, Rattus norvegicus
aactccaatggccaataaagatcta

SEQ ID NO: 28848 - DNA, 25 bp, Rattus norvegicus
aactccaatggcgaataaagatcta

SEQ ID NO: 28849 - DNA, 25 bp, Rattus norvegicus
aactccaattccagattgaagccat

SEQ ID NO: 28850 - DNA, 25 bp, Rattus norvegicus
aactccaattcccagggtctgtagg

SEQ ID NO: 28851 - DNA, 25 bp, Rattus norvegicus
aactccaattccgagggtctgtagg

SEQ ID NO: 28852 - DNA, 25 bp, Rattus norvegicus
aactccaattcctgattgaagccat

SEQ ID NO: 28853 - DNA, 25 bp, Rattus norvegicus
aactccacagaaatggctggggcct

SEQ ID NO: 28854 - DNA, 25 bp, Rattus norvegicus
aactccacagaattggctggggcct

SEQ ID NO: 28855 - DNA, 25 bp, Rattus norvegicus
aactccacagtacactcaggagaga

SEQ ID NO: 28856 - DNA, 25 bp, Rattus norvegicus
aactccacagtagactcaggagaga

SEQ ID NO: 28857 - DNA, 25 bp, Rattus norvegicus
aactccacatccacagagacagtta

SEQ ID NO: 28858 - DNA, 25 bp, Rattus norvegicus
aactccacatcctcagagacagtta

SEQ ID NO: 28859 - DNA, 25 bp, Rattus norvegicus
aactccaccaaaatctgcatgtctt

SEQ ID NO: 28860 - DNA, 25 bp, Rattus norvegicus
aactccaccaaattctgcatgtctt

SEQ ID NO: 28861 - DNA, 25 bp, Rattus norvegicus
aactccaccacgatgttcatcgcga

SEQ ID NO: 28862 - DNA, 25 bp, Rattus norvegicus
aactccaccacgttgttcatcgcga

SEQ ID NO: 28863 - DNA, 25 bp, Rattus norvegicus
aactccacgaggacagaacttcaga

SEQ ID NO: 28864 - DNA, 25 bp, Rattus norvegicus
aactccacgaggtcagaacttcaga

SEQ ID NO: 28865 - DNA, 25 bp, Rattus norvegicus
aactccactctgattttaacttcct

SEQ ID NO: 28866 - DNA, 25 bp, Rattus norvegicus
aactccactctgtttttaacttcct

SEQ ID NO: 28867 - DNA, 25 bp, Rattus norvegicus
aactccactgtaacatagctgtgca

SEQ ID NO: 28868 - DNA, 25 bp, Rattus norvegicus
aactccactgtatcatagctgtgca

SEQ ID NO: 28869 - DNA, 25 bp, Rattus norvegicus
aactccactgtcctttgttggatga

SEQ ID NO: 28870 - DNA, 25 bp, Rattus norvegicus
aactccactgtcgtttgttggatga

SEQ ID NO: 28871 - DNA, 25 bp, Rattus norvegicus
aactccagactgatccaaagaattt

SEQ ID NO: 28872 - DNA, 25 bp, Rattus norvegicus
aactccagactgttccaaagaattt

SEQ ID NO: 28873 - DNA, 25 bp, Rattus norvegicus
aactccagagggaacccgaaggctg

SEQ ID NO: 28874 - DNA, 25 bp, Rattus norvegicus
aactccagagggtacccgaaggctg

SEQ ID NO: 28875 - DNA, 25 bp, Rattus norvegicus
aactccagagtaagcccactgggta

SEQ ID NO: 28876 - DNA, 25 bp, Rattus norvegicus
aactccagagtatgcccactgggta

SEQ ID NO: 28877 - DNA, 25 bp, Rattus norvegicus
aactccagagttatgtcttgcctgc

SEQ ID NO: 28878 - DNA, 25 bp, Rattus norvegicus
aactccagagttttgtcttgcctgc

SEQ ID NO: 28879 - DNA, 25 bp, Rattus norvegicus
aactccagatggactggctctccta

SEQ ID NO: 28880 - DNA, 25 bp, Rattus norvegicus
aactccagatggtctggctctccta

SEQ ID NO: 28881 - DNA, 25 bp, Rattus norvegicus
aactccagcatcagccgtcgatggg

SEQ ID NO: 28882 - DNA, 25 bp, Rattus norvegicus
aactccagcatctgccgtcgatggg

SEQ ID NO: 28883 - DNA, 25 bp, Rattus norvegicus
aactccagccagctgagtgggctat

SEQ ID NO: 28884 - DNA, 25 bp, Rattus norvegicus
aactccagccaggtgagtgggctat

SEQ ID NO: 28885 - DNA, 25 bp, Rattus norvegicus
aactccagcccaagtgtaagggcac

SEQ ID NO: 28886 - DNA, 25 bp, Rattus norvegicus
aactccagcccatgtgtaagggcac

SEQ ID NO: 28887 - DNA, 25 bp, Rattus norvegicus
aactccagccttacctgaggcatgg

SEQ ID NO: 28888 - DNA, 25 bp, Rattus norvegicus
aactccagcctttcctgaggcatgg

SEQ ID NO: 28889 - DNA, 25 bp, Rattus norvegicus
aactccagcgagaacatgtacacca

SEQ ID NO: 28890 - DNA, 25 bp, Rattus norvegicus
aactccagcgagcaattgcccaaag

SEQ ID NO: 28891 - DNA, 25 bp, Rattus norvegicus
aactccagcgaggaattgcccaaag

SEQ ID NO: 28892 - DNA, 25 bp, Rattus norvegicus
aactccagcgagtacatgtacacca

SEQ ID NO: 28893 - DNA, 25 bp, Rattus norvegicus
aactccagctctccaggtgggagga

SEQ ID NO: 28894 - DNA, 25 bp, Rattus norvegicus
aactccagctctgcaggtgggagga

SEQ ID NO: 28895 - DNA, 25 bp, Rattus norvegicus
aactccagctggagacaagatgtag

SEQ ID NO: 28896 - DNA, 25 bp, Rattus norvegicus
aactccagctggtgacaagatgtag

SEQ ID NO: 28897 - DNA, 25 bp, Rattus norvegicus
aactccaggaccattgtgcaggact

SEQ ID NO: 28898 - DNA, 25 bp, Rattus norvegicus
aactccaggacctttgtgcaggact

SEQ ID NO: 28899 - DNA, 25 bp, Rattus norvegicus
aactccaggaggatgcagcaggctt

SEQ ID NO: 28900 - DNA, 25 bp, Rattus norvegicus
aactccaggaggttgcagcaggctt

SEQ ID NO: 28901 - DNA, 25 bp, Rattus norvegicus
aactccaggctgagcttgaaaagta

SEQ ID NO: 28902 - DNA, 25 bp, Rattus norvegicus
aactccaggctgtgcttgaaaagta

SEQ ID NO: 28903 - DNA, 25 bp, Rattus norvegicus
aactccagtatacagatgccgttca

SEQ ID NO: 28904 - DNA, 25 bp, Rattus norvegicus
aactccagtatagagatgccgttca

SEQ ID NO: 28905 - DNA, 25 bp, Rattus norvegicus
aactccagtgctcttggcccatggg

SEQ ID NO: 28906 - DNA, 25 bp, Rattus norvegicus
aactccagtgctgttggcccatggg

SEQ ID NO: 28907 - DNA, 25 bp, Rattus norvegicus
aactccatagcgacgagcatctgtc

SEQ ID NO: 28908 - DNA, 25 bp, Rattus norvegicus
aactccatagcgtcgagcatctgtc

SEQ ID NO: 28909 - DNA, 25 bp, Rattus norvegicus
aactccataggccaaagtactgttg

SEQ ID NO: 28910 - DNA, 25 bp, Rattus norvegicus
aactccataggcgaaagtactgttg

SEQ ID NO: 28911 - DNA, 25 bp, Rattus norvegicus
aactccatatctcagctgtttttat

SEQ ID NO: 28912 - DNA, 25 bp, Rattus norvegicus
aactccatatctgagctgtttttat

SEQ ID NO: 28913 - DNA, 25 bp, Rattus norvegicus
aactccatcaccaggcgtgggtaag

SEQ ID NO: 28914 - DNA, 25 bp, Rattus norvegicus
aactccatcacctggcgtgggtaag

SEQ ID NO: 28915 - DNA, 25 bp, Rattus norvegicus
aactccatcattcttatgtgactag

SEQ ID NO: 28916 - DNA, 25 bp, Rattus norvegicus
aactccatcattgttatgtgactag

SEQ ID NO: 28917 - DNA, 25 bp, Rattus norvegicus
aactccatcccgatgaagaggaagc

SEQ ID NO: 28918 - DNA, 25 bp, Rattus norvegicus
aactccatcccgttgaagaggaagc

SEQ ID NO: 28919 - DNA, 25 bp, Rattus norvegicus
aactccatgatgatgtccaccgcgg

SEQ ID NO: 28920 - DNA, 25 bp, Rattus norvegicus
aactccatgatgttgtccaccgcgg

SEQ ID NO: 28921 - DNA, 25 bp, Rattus norvegicus
aactccatgttacggctgccgggaa

SEQ ID NO: 28922 - DNA, 25 bp, Rattus norvegicus
aactccatgttagggctgccgggaa

SEQ ID NO: 28923 - DNA, 25 bp, Rattus norvegicus
aactccattcctcatattaaaccct

SEQ ID NO: 28924 - DNA, 25 bp, Rattus norvegicus
aactccattcctgatattaaaccct

SEQ ID NO: 28925 - DNA, 25 bp, Rattus norvegicus
aactccattggaaagctttgcattt

SEQ ID NO: 28926 - DNA, 25 bp, Rattus norvegicus
aactccattggatagctttgcattt

SEQ ID NO: 28927 - DNA, 25 bp, Rattus norvegicus
aactccattgtcactttgacaggat

SEQ ID NO: 28928 - DNA, 25 bp, Rattus norvegicus
aactccattgtctctttgacaggat

SEQ ID NO: 28929 - DNA, 25 bp, Rattus norvegicus
aactccatttgcattattagcctct

SEQ ID NO: 28930 - DNA, 25 bp, Rattus norvegicus
aactccatttgctttattagcctct

SEQ ID NO: 28931 - DNA, 25 bp, Rattus norvegicus
aactccatttggactctgttcttta

SEQ ID NO: 28932 - DNA, 25 bp, Rattus norvegicus
aactccatttggtctctgttcttta

SEQ ID NO: 28933 - DNA, 25 bp, Rattus norvegicus
aactccattttcaagacctttcatg

SEQ ID NO: 28934 - DNA, 25 bp, Rattus norvegicus
aactccattttctagacctttcatg

SEQ ID NO: 28935 - DNA, 25 bp, Rattus norvegicus
aactcccaacttagtggttccagat

SEQ ID NO: 28936 - DNA, 25 bp, Rattus norvegicus
aactcccaactttgtggttccagat

SEQ ID NO: 28937 - DNA, 25 bp, Rattus norvegicus
aactcccaagtgaccacctggaata

SEQ ID NO: 28938 - DNA, 25 bp, Rattus norvegicus
aactcccaagtgtccacctggaata

SEQ ID NO: 28939 - DNA, 25 bp, Rattus norvegicus
aactcccaatagatgagggttgctg

SEQ ID NO: 28940 - DNA, 25 bp, Rattus norvegicus
aactcccaatagttgagggttgctg

SEQ ID NO: 28941 - DNA, 25 bp, Rattus norvegicus
aactcccacaagatgtcttctgacc

SEQ ID NO: 28942 - DNA, 25 bp, Rattus norvegicus
aactcccacaagttgtcttctgacc

SEQ ID NO: 28943 - DNA, 25 bp, Rattus norvegicus
aactcccacggacgtgaccatggtc

SEQ ID NO: 28944 - DNA, 25 bp, Rattus norvegicus
aactcccacggaggtgaccatggtc

SEQ ID NO: 28945 - DNA, 25 bp, Rattus norvegicus
aactcccagaataatcagcgcgctt

SEQ ID NO: 28946 - DNA, 25 bp, Rattus norvegicus
aactcccagaattatcagcgcgctt

SEQ ID NO: 28947 - DNA, 25 bp, Rattus norvegicus
aactcccagattacttgcattgtgc

SEQ ID NO: 28948 - DNA, 25 bp, Rattus norvegicus
aactcccagatttcttgcattgtgc

SEQ ID NO: 28949 - DNA, 25 bp, Rattus norvegicus
aactcccagcctattgttaagcaat

SEQ ID NO: 28950 - DNA, 25 bp, Rattus norvegicus
aactcccagccttttgttaagcaat

SEQ ID NO: 28951 - DNA, 25 bp, Rattus norvegicus
aactcccagctcaatggcaatgaca

SEQ ID NO: 28952 - DNA, 25 bp, Rattus norvegicus
aactcccagctctatggcaatgaca

SEQ ID NO: 28953 - DNA, 25 bp, Rattus norvegicus
aactcccaggagagtgtcacagagc

SEQ ID NO: 28954 - DNA, 25 bp, Rattus norvegicus
aactcccaggagtgtgtcacagagc

SEQ ID NO: 28955 - DNA, 25 bp, Rattus norvegicus
aactcccattggagcactatacaat

SEQ ID NO: 28956 - DNA, 25 bp, Rattus norvegicus
aactcccattggtgcactatacaat

SEQ ID NO: 28957 - DNA, 25 bp, Rattus norvegicus
aactccccaatcaagatctgatcta

SEQ ID NO: 28958 - DNA, 25 bp, Rattus norvegicus
aactccccaatctagatctgatcta

SEQ ID NO: 28959 - DNA, 25 bp, Rattus norvegicus
aactccccagagacaacatttttat

SEQ ID NO: 28960 - DNA, 25 bp, Rattus norvegicus
aactccccagagtcaacatttttat

SEQ ID NO: 28961 - DNA, 25 bp, Rattus norvegicus
aactccccagtcaacttcaaagagg

SEQ ID NO: 28962 - DNA, 25 bp, Rattus norvegicus
aactccccagtctacttcaaagagg

SEQ ID NO: 28963 - DNA, 25 bp, Rattus norvegicus
aactccccagttctgagtgctgtta

SEQ ID NO: 28964 - DNA, 25 bp, Rattus norvegicus
aactccccagttgtgagtgctgtta

SEQ ID NO: 28965 - DNA, 25 bp, Rattus norvegicus
aactcccctaagagcagcattttca

SEQ ID NO: 28966 - DNA, 25 bp, Rattus norvegicus
aactcccctaagtgcagcattttca

SEQ ID NO: 28967 - DNA, 25 bp, Rattus norvegicus
aactcccgacatcagtgtggttcag

SEQ ID NO: 28968 - DNA, 25 bp, Rattus norvegicus
aactcccgacatgagtgtggttcag

SEQ ID NO: 28969 - DNA, 25 bp, Rattus norvegicus
aactcccgcgagagactagactgtc

SEQ ID NO: 28970 - DNA, 25 bp, Rattus norvegicus
aactcccgcgagtgactagactgtc

SEQ ID NO: 28971 - DNA, 25 bp, Rattus norvegicus
aactcccgggaaatgagccgcgact

SEQ ID NO: 28972 - DNA, 25 bp, Rattus norvegicus
aactcccgggaattgagccgcgact

SEQ ID NO: 28973 - DNA, 25 bp, Rattus norvegicus
aactccctaaatcgaatgtctcctt

SEQ ID NO: 28974 - DNA, 25 bp, Rattus norvegicus
aactccctaaatggaatgtctcctt

SEQ ID NO: 28975 - DNA, 25 bp, Rattus norvegicus
aactccctagagaggtgccagtcta

SEQ ID NO: 28976 - DNA, 25 bp, Rattus norvegicus
aactccctagagtggtgccagtcta

SEQ ID NO: 28977 - DNA, 25 bp, Rattus norvegicus
aactccctagccagagactgtgttc

SEQ ID NO: 28978 - DNA, 25 bp, Rattus norvegicus
aactccctagcctgagactgtgttc

SEQ ID NO: 28979 - DNA, 25 bp, Rattus norvegicus
aactccctcaagattgtcagcaatg

SEQ ID NO: 28980 - DNA, 25 bp, Rattus norvegicus
aactccctcaagtttgtcagcaatg

SEQ ID NO: 28981 - DNA, 25 bp, Rattus norvegicus
aactccctctaccttgtaattgatg

SEQ ID NO: 28982 - DNA, 25 bp, Rattus norvegicus
aactccctctacgttgtaattgatg

SEQ ID NO: 28983 - DNA, 25 bp, Rattus norvegicus
aactccctctatatcttcattaact

SEQ ID NO: 28984 - DNA, 25 bp, Rattus norvegicus
aactccctctatttcttcattaact

SEQ ID NO: 28985 - DNA, 25 bp, Rattus norvegicus
aactccctcttgctgtagggctaac

SEQ ID NO: 28986 - DNA, 25 bp, Rattus norvegicus
aactccctcttggtgtagggctaac

SEQ ID NO: 28987 - DNA, 25 bp, Rattus norvegicus
aactccctgagcacgtgctgcgagt

SEQ ID NO: 28988 - DNA, 25 bp, Rattus norvegicus
aactccctgagctcgtgctgcgagt

SEQ ID NO: 28989 - DNA, 25 bp, Rattus norvegicus
aactccctgaggctgactgaacctt

SEQ ID NO: 28990 - DNA, 25 bp, Rattus norvegicus
aactccctgagggtgactgaacctt

SEQ ID NO: 28991 - DNA, 25 bp, Rattus norvegicus
aactccctgcttaattctccatggg

SEQ ID NO: 28992 - DNA, 25 bp, Rattus norvegicus
aactccctgctttattctccatggg

SEQ ID NO: 28993 - DNA, 25 bp, Rattus norvegicus
aactccctggatatgttcagcagct

SEQ ID NO: 28994 - DNA, 25 bp, Rattus norvegicus
aactccctggatttgttcagcagct

SEQ ID NO: 28995 - DNA, 25 bp, Rattus norvegicus
aactccctgggtcagtcggtggctt

SEQ ID NO: 28996 - DNA, 25 bp, Rattus norvegicus
aactccctgggtgagtcggtggctt

SEQ ID NO: 28997 - DNA, 25 bp, Rattus norvegicus
aactccgaagcccattggaacctct

SEQ ID NO: 28998 - DNA, 25 bp, Rattus norvegicus
aactccgaagccgattggaacctct

SEQ ID NO: 28999 - DNA, 25 bp, Rattus norvegicus
aactccgagatcattgtccatcaag

SEQ ID NO: 29000 - DNA, 25 bp, Rattus norvegicus
aactccgagatctttgtccatcaag

SEQ ID NO: 29001 - DNA, 25 bp, Rattus norvegicus
aactccgatgggaactgtccttgga

SEQ ID NO: 29002 - DNA, 25 bp, Rattus norvegicus
aactccgatgggtactgtccttgga

SEQ ID NO: 29003 - DNA, 25 bp, Rattus norvegicus
aactccgcaaatacatagtttgcta

SEQ ID NO: 29004 - DNA, 25 bp, Rattus norvegicus
aactccgcaaattcatagtttgcta

SEQ ID NO: 29005 - DNA, 25 bp, Rattus norvegicus
aactccgccgagaatgcggttgaaa

SEQ ID NO: 29006 - DNA, 25 bp, Rattus norvegicus
aactccgccgagtatgcggttgaaa

SEQ ID NO: 29007 - DNA, 25 bp, Rattus norvegicus
aactccgctaatcattcgttgagct

SEQ ID NO: 29008 - DNA, 25 bp, Rattus norvegicus
aactccgctaatgattcgttgagct

SEQ ID NO: 29009 - DNA, 25 bp, Rattus norvegicus
aactccggcgatcctgaaagcaaag

SEQ ID NO: 29010 - DNA, 25 bp, Rattus norvegicus
aactccggcgatgctgaaagcaaag

SEQ ID NO: 29011 - DNA, 25 bp, Rattus norvegicus
aactccggtttgatcatgctattta

SEQ ID NO: 29012 - DNA, 25 bp, Rattus norvegicus
aactccggtttgttcatgctattta

SEQ ID NO: 29013 - DNA, 25 bp, Rattus norvegicus
aactccgtcagtaatgaaaccatag

SEQ ID NO: 29014 - DNA, 25 bp, Rattus norvegicus
aactccgtcagttatgaaaccatag

SEQ ID NO: 29015 - DNA, 25 bp, Rattus norvegicus
aactccgtgaaaaatttgggctcta

SEQ ID NO: 29016 - DNA, 25 bp, Rattus norvegicus
aactccgtgaaatatttgggctcta

SEQ ID NO: 29017 - DNA, 25 bp, Rattus norvegicus
aactccgtggtactaccttgttgca

SEQ ID NO: 29018 - DNA, 25 bp, Rattus norvegicus
aactccgtggtagtaccttgttgca

SEQ ID NO: 29019 - DNA, 25 bp, Rattus norvegicus
aactccgtgtgcaagaggttcgttt

SEQ ID NO: 29020 - DNA, 25 bp, Rattus norvegicus
aactccgtgtgctagaggttcgttt

SEQ ID NO: 29021 - DNA, 25 bp, Rattus norvegicus
aactccgtgtgtagaacccagatga

SEQ ID NO: 29022 - DNA, 25 bp, Rattus norvegicus
aactccgtgtgttgaacccagatga

SEQ ID NO: 29023 - DNA, 25 bp, Rattus norvegicus
aactccgtttctccgtgtgcccatg

SEQ ID NO: 29024 - DNA, 25 bp, Rattus norvegicus
aactccgtttctgcgtgtgcccatg

SEQ ID NO: 29025 - DNA, 25 bp, Rattus norvegicus
aactcctaagaaagtggtaggctga

SEQ ID NO: 29026 - DNA, 25 bp, Rattus norvegicus
aactcctaagaatgtggtaggctga

SEQ ID NO: 29027 - DNA, 25 bp, Rattus norvegicus
aactcctaatttagcactgtccttt

SEQ ID NO: 29028 - DNA, 25 bp, Rattus norvegicus
aactcctaattttgcactgtccttt

SEQ ID NO: 29029 - DNA, 25 bp, Rattus norvegicus
aactcctagactcttgattgtacgt

SEQ ID NO: 29030 - DNA, 25 bp, Rattus norvegicus
aactcctagactgttgattgtacgt

SEQ ID NO: 29031 - DNA, 25 bp, Rattus norvegicus
aactcctaggagatgctttactctg

SEQ ID NO: 29032 - DNA, 25 bp, Rattus norvegicus
aactcctaggagttgctttactctg

SEQ ID NO: 29033 - DNA, 25 bp, Rattus norvegicus
aactcctcacttctgagagactgca

SEQ ID NO: 29034 - DNA, 25 bp, Rattus norvegicus
aactcctcacttgtgagagactgca

SEQ ID NO: 29035 - DNA, 25 bp, Rattus norvegicus
aactcctcagataccatggatcttc

SEQ ID NO: 29036 - DNA, 25 bp, Rattus norvegicus
aactcctcagattccatggatcttc

SEQ ID NO: 29037 - DNA, 25 bp, Rattus norvegicus
aactcctcagtgaacagcatgtctg

SEQ ID NO: 29038 - DNA, 25 bp, Rattus norvegicus
aactcctcagtgtacagcatgtctg

SEQ ID NO: 29039 - DNA, 25 bp, Rattus norvegicus
aactcctccgcgctctgtgagggat

SEQ ID NO: 29040 - DNA, 25 bp, Rattus norvegicus
aactcctccgcggtctgtgagggat

SEQ ID NO: 29041 - DNA, 25 bp, Rattus norvegicus
aactcctccttgaaacaaattgcaa

SEQ ID NO: 29042 - DNA, 25 bp, Rattus norvegicus
aactcctccttgtaacaaattgcaa

SEQ ID NO: 29043 - DNA, 25 bp, Rattus norvegicus
aactcctctgcaatctgagagctga

SEQ ID NO: 29044 - DNA, 25 bp, Rattus norvegicus
aactcctctgcattctgagagctga

SEQ ID NO: 29045 - DNA, 25 bp, Rattus norvegicus
aactcctcttttcattcaagccaca

SEQ ID NO: 29046 - DNA, 25 bp, Rattus norvegicus
aactcctcttttgattcaagccaca

SEQ ID NO: 29047 - DNA, 25 bp, Rattus norvegicus
aactcctgaaggatgctgcctgcat

SEQ ID NO: 29048 - DNA, 25 bp, Rattus norvegicus
aactcctgaaggttgctgcctgcat

SEQ ID NO: 29049 - DNA, 25 bp, Rattus norvegicus
aactcctgactaccattctgatcaa

SEQ ID NO: 29050 - DNA, 25 bp, Rattus norvegicus
aactcctgactagcattctgatcaa

SEQ ID NO: 29051 - DNA, 25 bp, Rattus norvegicus
aactcctgaggaacttgatgctgca

SEQ ID NO: 29052 - DNA, 25 bp, Rattus norvegicus
aactcctgaggatcttgatgctgca

SEQ ID NO: 29053 - DNA, 25 bp, Rattus norvegicus
aactcctgagttccgtgaagaagtg

SEQ ID NO: 29054 - DNA, 25 bp, Rattus norvegicus
aactcctgagttgcgtgaagaagtg

SEQ ID NO: 29055 - DNA, 25 bp, Rattus norvegicus
aactcctgatggaggtttgtaccta

SEQ ID NO: 29056 - DNA, 25 bp, Rattus norvegicus
aactcctgatggtggtttgtaccta

SEQ ID NO: 29057 - DNA, 25 bp, Rattus norvegicus
aactcctggaatcctgttgagcgga

SEQ ID NO: 29058 - DNA, 25 bp, Rattus norvegicus
aactcctggaatgctgttgagcgga

SEQ ID NO: 29059 - DNA, 25 bp, Rattus norvegicus
aactcctggagcactttgaccttgg

SEQ ID NO: 29060 - DNA, 25 bp, Rattus norvegicus
aactcctggagctctttgaccttgg

SEQ ID NO: 29061 - DNA, 25 bp, Rattus norvegicus
aactcctgtcacagcagttctaaga

SEQ ID NO: 29062 - DNA, 25 bp, Rattus norvegicus
aactcctgtcactgcagttctaaga

SEQ ID NO: 29063 - DNA, 25 bp, Rattus norvegicus
aactcctgtcatagggactggctca

SEQ ID NO: 29064 - DNA, 25 bp, Rattus norvegicus
aactcctgtcattgggactggctca

SEQ ID NO: 29065 - DNA, 25 bp, Rattus norvegicus
aactcctgtccgagcataagtaaga

SEQ ID NO: 29066 - DNA, 25 bp, Rattus norvegicus
aactcctgtccgtgcataagtaaga

SEQ ID NO: 29067 - DNA, 25 bp, Rattus norvegicus
aactcctgtcgtcggccttagtgaa

SEQ ID NO: 29068 - DNA, 25 bp, Rattus norvegicus
aactcctgtcgtgggccttagtgaa

SEQ ID NO: 29069 - DNA, 25 bp, Rattus norvegicus
aactcctgtctacgacaccaatgca

SEQ ID NO: 29070 - DNA, 25 bp, Rattus norvegicus
aactcctgtctaggacaccaatgca

SEQ ID NO: 29071 - DNA, 25 bp, Rattus norvegicus
aactcctgtgggatgttttgcgctc

SEQ ID NO: 29072 - DNA, 25 bp, Rattus norvegicus
aactcctgtgggttgttttgcgctc

SEQ ID NO: 29073 - DNA, 25 bp, Rattus norvegicus
aactcctgttgtctcatcctaaaat

SEQ ID NO: 29074 - DNA, 25 bp, Rattus norvegicus
aactcctgttgtgtcatcctaaaat

SEQ ID NO: 29075 - DNA, 25 bp, Rattus norvegicus
aactccttatgaagaaaccctctgg

SEQ ID NO: 29076 - DNA, 25 bp, Rattus norvegicus
aactccttatgatgaaaccctctgg

SEQ ID NO: 29077 - DNA, 25 bp, Rattus norvegicus
aactccttcattattatctcccaat

SEQ ID NO: 29078 - DNA, 25 bp, Rattus norvegicus
aactccttcatttttatctcccaat

SEQ ID NO: 29079 - DNA, 25 bp, Rattus norvegicus
aactccttccaaattagaagaccag

SEQ ID NO: 29080 - DNA, 25 bp, Rattus norvegicus
aactccttccaatttagaagaccag

SEQ ID NO: 29081 - DNA, 25 bp, Rattus norvegicus
aactccttcctgctgcaaacatggg

SEQ ID NO: 29082 - DNA, 25 bp, Rattus norvegicus
aactccttcctggtgcaaacatggg

SEQ ID NO: 29083 - DNA, 25 bp, Rattus norvegicus
aactccttcggcagcacaaagggcg

SEQ ID NO: 29084 - DNA, 25 bp, Rattus norvegicus
aactccttcggctgcacaaagggcg

SEQ ID NO: 29085 - DNA, 25 bp, Rattus norvegicus
aactccttgaagaccaggatcaggt

SEQ ID NO: 29086 - DNA, 25 bp, Rattus norvegicus
aactccttgaagtccaggatcaggt

SEQ ID NO: 29087 - DNA, 25 bp, Rattus norvegicus
aactccttggagacggtgggcacgc

SEQ ID NO: 29088 - DNA, 25 bp, Rattus norvegicus
aactccttggagtcggtgggcacgc

SEQ ID NO: 29089 - DNA, 25 bp, Rattus norvegicus
aactccttgggacctaggcatgttg

SEQ ID NO: 29090 - DNA, 25 bp, Rattus norvegicus
aactccttgggagctaggcatgttg

SEQ ID NO: 29091 - DNA, 25 bp, Rattus norvegicus
aactccttgtaacgctgtctctagc

SEQ ID NO: 29092 - DNA, 25 bp, Rattus norvegicus
aactccttgtaaggctgtctctagc

SEQ ID NO: 29093 - DNA, 25 bp, Rattus norvegicus
aactccttgtgtcccacactgtaaa

SEQ ID NO: 29094 - DNA, 25 bp, Rattus norvegicus
aactccttgtgtgccacactgtaaa

SEQ ID NO: 29095 - DNA, 25 bp, Rattus norvegicus
aactcctttaaacagcatccttggc

SEQ ID NO: 29096 - DNA, 25 bp, Rattus norvegicus
aactcctttaaagagcatccttggc

SEQ ID NO: 29097 - DNA, 25 bp, Rattus norvegicus
aactcctttctgaccacaattacat

SEQ ID NO: 29098 - DNA, 25 bp, Rattus norvegicus
aactcctttctgtccacaattacat

SEQ ID NO: 29099 - DNA, 25 bp, Rattus norvegicus
aactcctttttgctcaattctgtga

SEQ ID NO: 29100 - DNA, 25 bp, Rattus norvegicus
aactcctttttggtcaattctgtga

SEQ ID NO: 29101 - DNA, 25 bp, Rattus norvegicus
aactcgaacggaagtgaccctcaca

SEQ ID NO: 29102 - DNA, 25 bp, Rattus norvegicus
aactcgaacggatgtgaccctcaca

SEQ ID NO: 29103 - DNA, 25 bp, Rattus norvegicus
aactcgacctcccacggagtgggat

SEQ ID NO: 29104 - DNA, 25 bp, Rattus norvegicus
aactcgacctccgacggagtgggat

SEQ ID NO: 29105 - DNA, 25 bp, Rattus norvegicus
aactcgagagccacctttggatgtt

SEQ ID NO: 29106 - DNA, 25 bp, Rattus norvegicus
aactcgagagcctcctttggatgtt

SEQ ID NO: 29107 - DNA, 25 bp, Rattus norvegicus
aactcgaggcagattggacaggtca

SEQ ID NO: 29108 - DNA, 25 bp, Rattus norvegicus
aactcgaggcagtttggacaggtca

SEQ ID NO: 29109 - DNA, 25 bp, Rattus norvegicus
aactcgaggcgaccacttcaaactt

SEQ ID NO: 29110 - DNA, 25 bp, Rattus norvegicus
aactcgaggcgagcacttcaaactt

SEQ ID NO: 29111 - DNA, 25 bp, Rattus norvegicus
aactcgaggtgcacatgtgcgggac

SEQ ID NO: 29112 - DNA, 25 bp, Rattus norvegicus
aactcgaggtgcatctgcctgcttt

SEQ ID NO: 29113 - DNA, 25 bp, Rattus norvegicus
aactcgaggtgctcatgtgcgggac

SEQ ID NO: 29114 - DNA, 25 bp, Rattus norvegicus
aactcgaggtgcttctgcctgcttt

SEQ ID NO: 29115 - DNA, 25 bp, Rattus norvegicus
aactcgaggtgtccgcgctgctgct

SEQ ID NO: 29116 - DNA, 25 bp, Rattus norvegicus
aactcgaggtgtgcgcgctgctgct

SEQ ID NO: 29117 - DNA, 25 bp, Rattus norvegicus
aactcgagtaagcaacctggaagca

SEQ ID NO: 29118 - DNA, 25 bp, Rattus norvegicus
aactcgagtaaggaacctggaagca

SEQ ID NO: 29119 - DNA, 25 bp, Rattus norvegicus
aactcgatgccaattttggacaggt

SEQ ID NO: 29120 - DNA, 25 bp, Rattus norvegicus
aactcgatgccatttttggacaggt

SEQ ID NO: 29121 - DNA, 25 bp, Rattus norvegicus
aactcgatggcgctgaagaccctgg

SEQ ID NO: 29122 - DNA, 25 bp, Rattus norvegicus
aactcgatggcggtgaagaccctgg

SEQ ID NO: 29123 - DNA, 25 bp, Rattus norvegicus
aactcgatggttattatgcctttct

SEQ ID NO: 29124 - DNA, 25 bp, Rattus norvegicus
aactcgatggtttttatgcctttct

SEQ ID NO: 29125 - DNA, 25 bp, Rattus norvegicus
aactcgcaccagcactggcagacag

SEQ ID NO: 29126 - DNA, 25 bp, Rattus norvegicus
aactcgcaccaggactggcagacag

SEQ ID NO: 29127 - DNA, 25 bp, Rattus norvegicus
aactcgcagatcaacaaagcctttg

SEQ ID NO: 29128 - DNA, 25 bp, Rattus norvegicus
aactcgcagatctacaaagcctttg

SEQ ID NO: 29129 - DNA, 25 bp, Rattus norvegicus
aactcgccattcaaggtcccaggaa

SEQ ID NO: 29130 - DNA, 25 bp, Rattus norvegicus
aactcgccattctaggtcccaggaa

SEQ ID NO: 29131 - DNA, 25 bp, Rattus norvegicus
aactcgcccatgaagcagctgagct

SEQ ID NO: 29132 - DNA, 25 bp, Rattus norvegicus
aactcgcccatgtagcagctgagct

SEQ ID NO: 29133 - DNA, 25 bp, Rattus norvegicus
aactcgcccctgcagattgatgacg

SEQ ID NO: 29134 - DNA, 25 bp, Rattus norvegicus
aactcgcccctggagattgatgacg

SEQ ID NO: 29135 - DNA, 25 bp, Rattus norvegicus
aactcgccgatgaggtttacaatag

SEQ ID NO: 29136 - DNA, 25 bp, Rattus norvegicus
aactcgccgatgtggtttacaatag

SEQ ID NO: 29137 - DNA, 25 bp, Rattus norvegicus
aactcgctaattaccctaggcatgt

SEQ ID NO: 29138 - DNA, 25 bp, Rattus norvegicus
aactcgctaatttccctaggcatgt

SEQ ID NO: 29139 - DNA, 25 bp, Rattus norvegicus
aactcgctcaagctgtcatgtacgg

SEQ ID NO: 29140 - DNA, 25 bp, Rattus norvegicus
aactcgctcaaggtgtcatgtacgg

SEQ ID NO: 29141 - DNA, 25 bp, Rattus norvegicus
aactcgctcacgcttttttctttct

SEQ ID NO: 29142 - DNA, 25 bp, Rattus norvegicus
aactcgctcacggttttttctttct

SEQ ID NO: 29143 - DNA, 25 bp, Rattus norvegicus
aactcgctgctgagtgcgctgtgac

SEQ ID NO: 29144 - DNA, 25 bp, Rattus norvegicus
aactcgctgctgtgtgcgctgtgac

SEQ ID NO: 29145 - DNA, 25 bp, Rattus norvegicus
aactcgctggccactgacggaaaac

SEQ ID NO: 29146 - DNA, 25 bp, Rattus norvegicus
aactcgctggcctctgacggaaaac

SEQ ID NO: 29147 - DNA, 25 bp, Rattus norvegicus
aactcggaacgaatcccagcatttt

SEQ ID NO: 29148 - DNA, 25 bp, Rattus norvegicus
aactcggaacgattcccagcatttt

SEQ ID NO: 29149 - DNA, 25 bp, Rattus norvegicus
aactcggaatcactgaactatctaa

SEQ ID NO: 29150 - DNA, 25 bp, Rattus norvegicus
aactcggaatcagtgaactatctaa

SEQ ID NO: 29151 - DNA, 25 bp, Rattus norvegicus
aactcggaggctctgaatctggtca

SEQ ID NO: 29152 - DNA, 25 bp, Rattus norvegicus
aactcggaggctgtgaatctggtca

SEQ ID NO: 29153 - DNA, 25 bp, Rattus norvegicus
aactcggagtccatgagagcgctga

SEQ ID NO: 29154 - DNA, 25 bp, Rattus norvegicus
aactcggagtccttgagagcgctga

SEQ ID NO: 29155 - DNA, 25 bp, Rattus norvegicus
aactcggatatactcggtgctacca

SEQ ID NO: 29156 - DNA, 25 bp, Rattus norvegicus
aactcggatatagtcggtgctacca

SEQ ID NO: 29157 - DNA, 25 bp, Rattus norvegicus
aactcggcagggagcactgtctgga

SEQ ID NO: 29158 - DNA, 25 bp, Rattus norvegicus
aactcggcagggtgcactgtctgga

SEQ ID NO: 29159 - DNA, 25 bp, Rattus norvegicus
aactcggccacacagagtgcagaca

SEQ ID NO: 29160 - DNA, 25 bp, Rattus norvegicus
aactcggccacagagagtgcagaca

SEQ ID NO: 29161 - DNA, 25 bp, Rattus norvegicus
aactcggcccgcactgcgatggaga

SEQ ID NO: 29162 - DNA, 25 bp, Rattus norvegicus
aactcggcccgctctgcgatggaga

SEQ ID NO: 29163 - DNA, 25 bp, Rattus norvegicus
aactcggcctcaccctgagagagta

SEQ ID NO: 29164 - DNA, 25 bp, Rattus norvegicus
aactcggcctcagcctgagagagta

SEQ ID NO: 29165 - DNA, 25 bp, Rattus norvegicus
aactcggccttgagccttgcctggt

SEQ ID NO: 29166 - DNA, 25 bp, Rattus norvegicus
aactcggccttgtgccttgcctggt

SEQ ID NO: 29167 - DNA, 25 bp, Rattus norvegicus
aactcggctgtaataatcacgcgat

SEQ ID NO: 29168 - DNA, 25 bp, Rattus norvegicus
aactcggctgtattaatcacgcgat

SEQ ID NO: 29169 - DNA, 25 bp, Rattus norvegicus
aactcgggaggcacacagcaggaaa

SEQ ID NO: 29170 - DNA, 25 bp, Rattus norvegicus
aactcgggaggctcacagcaggaaa

SEQ ID NO: 29171 - DNA, 25 bp, Rattus norvegicus
aactcgggcccactggagtcaagaa

SEQ ID NO: 29172 - DNA, 25 bp, Rattus norvegicus
aactcgggcccagtggagtcaagaa

SEQ ID NO: 29173 - DNA, 25 bp, Rattus norvegicus
aactcgggcctcaacaacatcaaca

SEQ ID NO: 29174 - DNA, 25 bp, Rattus norvegicus
aactcgggcctctacaacatcaaca

SEQ ID NO: 29175 - DNA, 25 bp, Rattus norvegicus
aactcgggctacacagggaatttca

SEQ ID NO: 29176 - DNA, 25 bp, Rattus norvegicus
aactcgggctactcagggaatttca

SEQ ID NO: 29177 - DNA, 25 bp, Rattus norvegicus
aactcgggtcatcctgaactgggac

SEQ ID NO: 29178 - DNA, 25 bp, Rattus norvegicus
aactcgggtcatgctgaactgggac

SEQ ID NO: 29179 - DNA, 25 bp, Rattus norvegicus
aactcggtgatgaacttcagtcctc

SEQ ID NO: 29180 - DNA, 25 bp, Rattus norvegicus
aactcggtgatgtacttcagtcctc

SEQ ID NO: 29181 - DNA, 25 bp, Rattus norvegicus
aactcggtgattattgtcagaccta

SEQ ID NO: 29182 - DNA, 25 bp, Rattus norvegicus
aactcggtgatttttgtcagaccta

SEQ ID NO: 29183 - DNA, 25 bp, Rattus norvegicus
aactcggtgcggagtattgcgtcac

SEQ ID NO: 29184 - DNA, 25 bp, Rattus norvegicus
aactcggtgcggtgtattgcgtcac

SEQ ID NO: 29185 - DNA, 25 bp, Rattus norvegicus
aactcggtggtaatttctctgtcgg

SEQ ID NO: 29186 - DNA, 25 bp, Rattus norvegicus
aactcggtggtattttctctgtcgg

SEQ ID NO: 29187 - DNA, 25 bp, Rattus norvegicus
aactcggtgtgactgttcgataaaa

SEQ ID NO: 29188 - DNA, 25 bp, Rattus norvegicus
aactcggtgtgagtgttcgataaaa

SEQ ID NO: 29189 - DNA, 25 bp, Rattus norvegicus
aactcggttttactctattatcctg

SEQ ID NO: 29190 - DNA, 25 bp, Rattus norvegicus
aactcggttttagtctattatcctg

SEQ ID NO: 29191 - DNA, 25 bp, Rattus norvegicus
aactcgtcacttaagagtggagcga

SEQ ID NO: 29192 - DNA, 25 bp, Rattus norvegicus
aactcgtcactttagagtggagcga

SEQ ID NO: 29193 - DNA, 25 bp, Rattus norvegicus
aactcgtcgcccaagctcatggcga

SEQ ID NO: 29194 - DNA, 25 bp, Rattus norvegicus
aactcgtcgccctagctcatggcga

SEQ ID NO: 29195 - DNA, 25 bp, Rattus norvegicus
aactcgtctggaaaggcgaactcgc

SEQ ID NO: 29196 - DNA, 25 bp, Rattus norvegicus
aactcgtctggataggcgaactcgc

SEQ ID NO: 29197 - DNA, 25 bp, Rattus norvegicus
aactcgtgactacggtctggcttaa

SEQ ID NO: 29198 - DNA, 25 bp, Rattus norvegicus
aactcgtgactagggtctggcttaa

SEQ ID NO: 29199 - DNA, 25 bp, Rattus norvegicus
aactcgtgatggagcttttggacca

SEQ ID NO: 29200 - DNA, 25 bp, Rattus norvegicus
aactcgtgatggtgcttttggacca

SEQ ID NO: 29201 - DNA, 25 bp, Rattus norvegicus
aactcgtgtgatcatctgacctctc

SEQ ID NO: 29202 - DNA, 25 bp, Rattus norvegicus
aactcgtgtgatgatctgacctctc

SEQ ID NO: 29203 - DNA, 25 bp, Rattus norvegicus
aactcgtgtgttagacgcgttgtgc

SEQ ID NO: 29204 - DNA, 25 bp, Rattus norvegicus
aactcgtgtgtttgacgcgttgtgc

SEQ ID NO: 29205 - DNA, 25 bp, Rattus norvegicus
aactcgttctctcaagttaccaggg

SEQ ID NO: 29206 - DNA, 25 bp, Rattus norvegicus
aactcgttctctgaagttaccaggg

SEQ ID NO: 29207 - DNA, 25 bp, Rattus norvegicus
aactcgttgatcatgcgtatctcat

SEQ ID NO: 29208 - DNA, 25 bp, Rattus norvegicus
aactcgttgatcttgcgtatctcat

SEQ ID NO: 29209 - DNA, 25 bp, Rattus norvegicus
aactcgttggtaaaacttaggatca

SEQ ID NO: 29210 - DNA, 25 bp, Rattus norvegicus
aactcgttggtataacttaggatca

SEQ ID NO: 29211 - DNA, 25 bp, Rattus norvegicus
aactcgttttgaattggatctggga

SEQ ID NO: 29212 - DNA, 25 bp, Rattus norvegicus
aactcgttttgatttggatctggga

SEQ ID NO: 29213 - DNA, 25 bp, Rattus norvegicus
aactctaaacccatgtattgccgtc

SEQ ID NO: 29214 - DNA, 25 bp, Rattus norvegicus
aactctaaacccttgtattgccgtc

SEQ ID NO: 29215 - DNA, 25 bp, Rattus norvegicus
aactctaaagctatctgtatttcag

SEQ ID NO: 29216 - DNA, 25 bp, Rattus norvegicus
aactctaaagctttctgtatttcag

SEQ ID NO: 29217 - DNA, 25 bp, Rattus norvegicus
aactctaatctgaaattcatgtatg

SEQ ID NO: 29218 - DNA, 25 bp, Rattus norvegicus
aactctaatctgtaattcatgtatg

SEQ ID NO: 29219 - DNA, 25 bp, Rattus norvegicus
aactctaattatcacagctacactg

SEQ ID NO: 29220 - DNA, 25 bp, Rattus norvegicus
aactctaattatgacagctacactg

SEQ ID NO: 29221 - DNA, 25 bp, Rattus norvegicus
aactctaattccagtccattctgag

SEQ ID NO: 29222 - DNA, 25 bp, Rattus norvegicus
aactctaattcctgtccattctgag

SEQ ID NO: 29223 - DNA, 25 bp, Rattus norvegicus
aactctaattgaaacttcgtcgtca

SEQ ID NO: 29224 - DNA, 25 bp, Rattus norvegicus
aactctaattgatacttcgtcgtca

SEQ ID NO: 29225 - DNA, 25 bp, Rattus norvegicus
aactctaatttcattgacttgcggg

SEQ ID NO: 29226 - DNA, 25 bp, Rattus norvegicus
aactctaatttctttgacttgcggg

SEQ ID NO: 29227 - DNA, 25 bp, Rattus norvegicus
aactctacaaatctgtcttcgccat

SEQ ID NO: 29228 - DNA, 25 bp, Rattus norvegicus
aactctacaaatgtgtcttcgccat

SEQ ID NO: 29229 - DNA, 25 bp, Rattus norvegicus
aactctaccaaccactaagtaactg

SEQ ID NO: 29230 - DNA, 25 bp, Rattus norvegicus
aactctaccaacgactaagtaactg

SEQ ID NO: 29231 - DNA, 25 bp, Rattus norvegicus
aactctaccgaactggactgctgtg

SEQ ID NO: 29232 - DNA, 25 bp, Rattus norvegicus
aactctaccgaagtggactgctgtg

SEQ ID NO: 29233 - DNA, 25 bp, Rattus norvegicus
aactctacctcaagtgagccaggcg

SEQ ID NO: 29234 - DNA, 25 bp, Rattus norvegicus
aactctacctcatgtgagccaggcg

SEQ ID NO: 29235 - DNA, 25 bp, Rattus norvegicus
aactctaccttacgccttcatacaa

SEQ ID NO: 29236 - DNA, 25 bp, Rattus norvegicus
aactctaccttaggccttcatacaa

SEQ ID NO: 29237 - DNA, 25 bp, Rattus norvegicus
aactctacgaggcaatttctacatc

SEQ ID NO: 29238 - DNA, 25 bp, Rattus norvegicus
aactctacgagggaatttctacatc

SEQ ID NO: 29239 - DNA, 25 bp, Rattus norvegicus
aactctactggacggccaagggcta

SEQ ID NO: 29240 - DNA, 25 bp, Rattus norvegicus
aactctactggagggccaagggcta

SEQ ID NO: 29241 - DNA, 25 bp, Rattus norvegicus
aactctacttcgcagccatcttctt

SEQ ID NO: 29242 - DNA, 25 bp, Rattus norvegicus
aactctacttcggagccatcttctt

SEQ ID NO: 29243 - DNA, 25 bp, Rattus norvegicus
aactctacttgcactgtaaggtcga

SEQ ID NO: 29244 - DNA, 25 bp, Rattus norvegicus
aactctacttgctctgtaaggtcga

SEQ ID NO: 29245 - DNA, 25 bp, Rattus norvegicus
aactctagactcatatcgcatgcca

SEQ ID NO: 29246 - DNA, 25 bp, Rattus norvegicus
aactctagactcttatcgcatgcca

SEQ ID NO: 29247 - DNA, 25 bp, Rattus norvegicus
aactctagcagtaaacattttgggt

SEQ ID NO: 29248 - DNA, 25 bp, Rattus norvegicus
aactctagcagttaacattttgggt

SEQ ID NO: 29249 - DNA, 25 bp, Rattus norvegicus
aactctaggcttctgctgatggaca

SEQ ID NO: 29250 - DNA, 25 bp, Rattus norvegicus
aactctaggcttgtgctgatggaca

SEQ ID NO: 29251 - DNA, 25 bp, Rattus norvegicus
aactctaggtctctcggtcttgctt

SEQ ID NO: 29252 - DNA, 25 bp, Rattus norvegicus
aactctaggtctgtcggtcttgctt

SEQ ID NO: 29253 - DNA, 25 bp, Rattus norvegicus
aactctaggttcctcttccatagaa

SEQ ID NO: 29254 - DNA, 25 bp, Rattus norvegicus
aactctaggttcgtcttccatagaa

SEQ ID NO: 29255 - DNA, 25 bp, Rattus norvegicus
aactctagtttcactttgcccagct

SEQ ID NO: 29256 - DNA, 25 bp, Rattus norvegicus
aactctagtttccatgtctgtcttt

SEQ ID NO: 29257 - DNA, 25 bp, Rattus norvegicus
aactctagtttcgatgtctgtcttt

SEQ ID NO: 29258 - DNA, 25 bp, Rattus norvegicus
aactctagtttctctttgcccagct

SEQ ID NO: 29259 - DNA, 25 bp, Rattus norvegicus
aactctatattgatatgggtccatt

SEQ ID NO: 29260 - DNA, 25 bp, Rattus norvegicus
aactctatattgttatgggtccatt

SEQ ID NO: 29261 - DNA, 25 bp, Rattus norvegicus
aactctatcgctatgtgcctcaatt

SEQ ID NO: 29262 - DNA, 25 bp, Rattus norvegicus
aactctatcgctttgtgcctcaatt

SEQ ID NO: 29263 - DNA, 25 bp, Rattus norvegicus
aactctatggaaacacagctgtgca

SEQ ID NO: 29264 - DNA, 25 bp, Rattus norvegicus
aactctatggaatcacagctgtgca

SEQ ID NO: 29265 - DNA, 25 bp, Rattus norvegicus
aactctatggagctcttttctggtg

SEQ ID NO: 29266 - DNA, 25 bp, Rattus norvegicus
aactctatggaggtcttttctggtg

SEQ ID NO: 29267 - DNA, 25 bp, Rattus norvegicus
aactctattcagaacaccaagaagg

SEQ ID NO: 29268 - DNA, 25 bp, Rattus norvegicus
aactctattcagtacaccaagaagg

SEQ ID NO: 29269 - DNA, 25 bp, Rattus norvegicus
aactctattgatctgacggccaaag

SEQ ID NO: 29270 - DNA, 25 bp, Rattus norvegicus
aactctattgatgtgacggccaaag

SEQ ID NO: 29271 - DNA, 25 bp, Rattus norvegicus
aactctatttggctctgtgaatctg

SEQ ID NO: 29272 - DNA, 25 bp, Rattus norvegicus
aactctatttgggtctgtgaatctg

SEQ ID NO: 29273 - DNA, 25 bp, Rattus norvegicus
aactctatttttcgataggcactat

SEQ ID NO: 29274 - DNA, 25 bp, Rattus norvegicus
aactctatttttggataggcactat

SEQ ID NO: 29275 - DNA, 25 bp, Rattus norvegicus
aactctcacagtctccattatggtc

SEQ ID NO: 29276 - DNA, 25 bp, Rattus norvegicus
aactctcacagtgtccattatggtc

SEQ ID NO: 29277 - DNA, 25 bp, Rattus norvegicus
aactctcaccctaatgttttctttg

SEQ ID NO: 29278 - DNA, 25 bp, Rattus norvegicus
aactctcacccttatgttttctttg

SEQ ID NO: 29279 - DNA, 25 bp, Rattus norvegicus
aactctcaccttaaataccatccag

SEQ ID NO: 29280 - DNA, 25 bp, Rattus norvegicus
aactctcacctttaataccatccag

SEQ ID NO: 29281 - DNA, 25 bp, Rattus norvegicus
aactctcactctaagtcatctgatg

SEQ ID NO: 29282 - DNA, 25 bp, Rattus norvegicus
aactctcactcttagtcatctgatg

SEQ ID NO: 29283 - DNA, 25 bp, Rattus norvegicus
aactctcagacccttgaagatgtag

SEQ ID NO: 29284 - DNA, 25 bp, Rattus norvegicus
aactctcagaccgttgaagatgtag

SEQ ID NO: 29285 - DNA, 25 bp, Rattus norvegicus
aactctcagcttctcttgcacattg

SEQ ID NO: 29286 - DNA, 25 bp, Rattus norvegicus
aactctcagcttgtcttgcacattg

SEQ ID NO: 29287 - DNA, 25 bp, Rattus norvegicus
aactctcaggcccttaacagttgtc

SEQ ID NO: 29288 - DNA, 25 bp, Rattus norvegicus
aactctcaggccgttaacagttgtc

SEQ ID NO: 29289 - DNA, 25 bp, Rattus norvegicus
aactctcagtgacgctggtgacctg

SEQ ID NO: 29290 - DNA, 25 bp, Rattus norvegicus
aactctcagtgaggctggtgacctg

SEQ ID NO: 29291 - DNA, 25 bp, Rattus norvegicus
aactctcagttcctctagtgttatc

SEQ ID NO: 29292 - DNA, 25 bp, Rattus norvegicus
aactctcagttcgtctagtgttatc

SEQ ID NO: 29293 - DNA, 25 bp, Rattus norvegicus
aactctcatgctctgacacttatgt

SEQ ID NO: 29294 - DNA, 25 bp, Rattus norvegicus
aactctcatgctgtgacacttatgt

SEQ ID NO: 29295 - DNA, 25 bp, Rattus norvegicus
aactctcatggcacggaggacctat

SEQ ID NO: 29296 - DNA, 25 bp, Rattus norvegicus
aactctcatggctcggaggacctat

SEQ ID NO: 29297 - DNA, 25 bp, Rattus norvegicus
aactctcatgttcctgctgttacag

SEQ ID NO: 29298 - DNA, 25 bp, Rattus norvegicus
aactctcatgttctcttggatctct

SEQ ID NO: 29299 - DNA, 25 bp, Rattus norvegicus
aactctcatgttgctgctgttacag

SEQ ID NO: 29300 - DNA, 25 bp, Rattus norvegicus
aactctcatgttgtcttggatctct

SEQ ID NO: 29301 - DNA, 25 bp, Rattus norvegicus
aactctccacgaacttcagggttga

SEQ ID NO: 29302 - DNA, 25 bp, Rattus norvegicus
aactctccacgatcttcagggttga

SEQ ID NO: 29303 - DNA, 25 bp, Rattus norvegicus
aactctccagtaactgatcatgtgg

SEQ ID NO: 29304 - DNA, 25 bp, Rattus norvegicus
aactctccagtatctgatcatgtgg

SEQ ID NO: 29305 - DNA, 25 bp, Rattus norvegicus
aactctccagttctgtgtgcttagc

SEQ ID NO: 29306 - DNA, 25 bp, Rattus norvegicus
aactctccagttgtgtgtgcttagc

SEQ ID NO: 29307 - DNA, 25 bp, Rattus norvegicus
aactctccatgcagagcagtggctg

SEQ ID NO: 29308 - DNA, 25 bp, Rattus norvegicus
aactctccatgctgagcagtggctg

SEQ ID NO: 29309 - DNA, 25 bp, Rattus norvegicus
aactctccgtcaaatccttatattc

SEQ ID NO: 29310 - DNA, 25 bp, Rattus norvegicus
aactctccgtcatatccttatattc

SEQ ID NO: 29311 - DNA, 25 bp, Rattus norvegicus
aactctcctgagacatggttctggc

SEQ ID NO: 29312 - DNA, 25 bp, Rattus norvegicus
aactctcctgagtcatggttctggc

SEQ ID NO: 29313 - DNA, 25 bp, Rattus norvegicus
aactctcctgccctggatgctgtgg

SEQ ID NO: 29314 - DNA, 25 bp, Rattus norvegicus
aactctcctgccgtggatgctgtgg

SEQ ID NO: 29315 - DNA, 25 bp, Rattus norvegicus
aactctcctggtatatggtgcttgg

SEQ ID NO: 29316 - DNA, 25 bp, Rattus norvegicus
aactctcctggtttatggtgcttgg

SEQ ID NO: 29317 - DNA, 25 bp, Rattus norvegicus
aactctcctttcaaaccaccatgtt

SEQ ID NO: 29318 - DNA, 25 bp, Rattus norvegicus
aactctcctttctaaccaccatgtt

SEQ ID NO: 29319 - DNA, 25 bp, Rattus norvegicus
aactctcggcatatgggttatctct

SEQ ID NO: 29320 - DNA, 25 bp, Rattus norvegicus
aactctcggcatttgggttatctct

SEQ ID NO: 29321 - DNA, 25 bp, Rattus norvegicus
aactctcggtggacgtctcaagggc

SEQ ID NO: 29322 - DNA, 25 bp, Rattus norvegicus
aactctcggtggtcgtctcaagggc

SEQ ID NO: 29323 - DNA, 25 bp, Rattus norvegicus
aactctctagaaactgttatcctcc

SEQ ID NO: 29324 - DNA, 25 bp, Rattus norvegicus
aactctctagaatctgttatcctcc

SEQ ID NO: 29325 - DNA, 25 bp, Rattus norvegicus
aactctctaggtatggcagtgatag

SEQ ID NO: 29326 - DNA, 25 bp, Rattus norvegicus
aactctctaggtttggcagtgatag

SEQ ID NO: 29327 - DNA, 25 bp, Rattus norvegicus
aactctctagtcctcttaagtattt

SEQ ID NO: 29328 - DNA, 25 bp, Rattus norvegicus
aactctctagtcgtcttaagtattt

SEQ ID NO: 29329 - DNA, 25 bp, Rattus norvegicus
aactctctatgcattctgtaactca

SEQ ID NO: 29330 - DNA, 25 bp, Rattus norvegicus
aactctctatgctttctgtaactca

SEQ ID NO: 29331 - DNA, 25 bp, Rattus norvegicus
aactctctcattaagctagcagagg

SEQ ID NO: 29332 - DNA, 25 bp, Rattus norvegicus
aactctctcatttagctagcagagg

SEQ ID NO: 29333 - DNA, 25 bp, Rattus norvegicus
aactctctccacagttagttcttag

SEQ ID NO: 29334 - DNA, 25 bp, Rattus norvegicus
aactctctccactgttagttcttag

SEQ ID NO: 29335 - DNA, 25 bp, Rattus norvegicus
aactctctccggcatcagaactttt

SEQ ID NO: 29336 - DNA, 25 bp, Rattus norvegicus
aactctctccgggatcagaactttt

SEQ ID NO: 29337 - DNA, 25 bp, Rattus norvegicus
aactctctctagatgggagctggaa

SEQ ID NO: 29338 - DNA, 25 bp, Rattus norvegicus
aactctctctagttgggagctggaa

SEQ ID NO: 29339 - DNA, 25 bp, Rattus norvegicus
aactctctctctagcaccatatatg

SEQ ID NO: 29340 - DNA, 25 bp, Rattus norvegicus
aactctctctcttgcaccatatatg

SEQ ID NO: 29341 - DNA, 25 bp, Rattus norvegicus
aactctctgaccctctagaaatgtt

SEQ ID NO: 29342 - DNA, 25 bp, Rattus norvegicus
aactctctgaccgtctagaaatgtt

SEQ ID NO: 29343 - DNA, 25 bp, Rattus norvegicus
aactctctgcctcttaaagtggtgc

SEQ ID NO: 29344 - DNA, 25 bp, Rattus norvegicus
aactctctgcctgttaaagtggtgc

SEQ ID NO: 29345 - DNA, 25 bp, Rattus norvegicus
aactctctggccagggtgagagaca

SEQ ID NO: 29346 - DNA, 25 bp, Rattus norvegicus
aactctctggcctgggtgagagaca

SEQ ID NO: 29347 - DNA, 25 bp, Rattus norvegicus
aactctctggcgcttactgaggagg

SEQ ID NO: 29348 - DNA, 25 bp, Rattus norvegicus
aactctctggcggttactgaggagg

SEQ ID NO: 29349 - DNA, 25 bp, Rattus norvegicus
aactctctgggaaacttttgcacat

SEQ ID NO: 29350 - DNA, 25 bp, Rattus norvegicus
aactctctgggatacttttgcacat

SEQ ID NO: 29351 - DNA, 25 bp, Rattus norvegicus
aactctctgggtataatcctccaca

SEQ ID NO: 29352 - DNA, 25 bp, Rattus norvegicus
aactctctgggtttaatcctccaca

SEQ ID NO: 29353 - DNA, 25 bp, Rattus norvegicus
aactctctggttatatactgcttat

SEQ ID NO: 29354 - DNA, 25 bp, Rattus norvegicus
aactctctggttttatactgcttat

SEQ ID NO: 29355 - DNA, 25 bp, Rattus norvegicus
aactctcttaagctgagccctgtaa

SEQ ID NO: 29356 - DNA, 25 bp, Rattus norvegicus
aactctcttaaggtgagccctgtaa

SEQ ID NO: 29357 - DNA, 25 bp, Rattus norvegicus
aactctcttacaaagtcagcacagt

SEQ ID NO: 29358 - DNA, 25 bp, Rattus norvegicus
aactctcttacatagtcagcacagt

SEQ ID NO: 29359 - DNA, 25 bp, Rattus norvegicus
aactctcttccacaatttgttcaaa

SEQ ID NO: 29360 - DNA, 25 bp, Rattus norvegicus
aactctcttccagaatttgttcaaa

SEQ ID NO: 29361 - DNA, 25 bp, Rattus norvegicus
aactctcttgagagctacgactaaa

SEQ ID NO: 29362 - DNA, 25 bp, Rattus norvegicus
aactctcttgagtgctacgactaaa

SEQ ID NO: 29363 - DNA, 25 bp, Rattus norvegicus
aactctcttgcacttccctgtaaag

SEQ ID NO: 29364 - DNA, 25 bp, Rattus norvegicus
aactctcttgcagttccctgtaaag

SEQ ID NO: 29365 - DNA, 25 bp, Rattus norvegicus
aactctcttgttacagtcacagcaa

SEQ ID NO: 29366 - DNA, 25 bp, Rattus norvegicus
aactctcttgtttcagtcacagcaa

SEQ ID NO: 29367 - DNA, 25 bp, Rattus norvegicus
aactctgaagagaccacgtttctat

SEQ ID NO: 29368 - DNA, 25 bp, Rattus norvegicus
aactctgaagagtccacgtttctat

SEQ ID NO: 29369 - DNA, 25 bp, Rattus norvegicus
aactctgaaggtcatctggtgacat

SEQ ID NO: 29370 - DNA, 25 bp, Rattus norvegicus
aactctgaaggtgatctggtgacat

SEQ ID NO: 29371 - DNA, 25 bp, Rattus norvegicus
aactctgaatctaccctttgggtga

SEQ ID NO: 29372 - DNA, 25 bp, Rattus norvegicus
aactctgaatcttccctttgggtga

SEQ ID NO: 29373 - DNA, 25 bp, Rattus norvegicus
aactctgaatgtcacattgacttta

SEQ ID NO: 29374 - DNA, 25 bp, Rattus norvegicus
aactctgaatgtgacattgacttta

SEQ ID NO: 29375 - DNA, 25 bp, Rattus norvegicus
aactctgaccacactacagtgttca

SEQ ID NO: 29376 - DNA, 25 bp, Rattus norvegicus
aactctgaccactctacagtgttca

SEQ ID NO: 29377 - DNA, 25 bp, Rattus norvegicus
aactctgaccagcaatgtgactcaa

SEQ ID NO: 29378 - DNA, 25 bp, Rattus norvegicus
aactctgaccaggaatgtgactcaa

SEQ ID NO: 29379 - DNA, 25 bp, Rattus norvegicus
aactctgactgtcacccaggaacga

SEQ ID NO: 29380 - DNA, 25 bp, Rattus norvegicus
aactctgactgtctatctgtttccc

SEQ ID NO: 29381 - DNA, 25 bp, Rattus norvegicus
aactctgactgtgacccaggaacga

SEQ ID NO: 29382 - DNA, 25 bp, Rattus norvegicus
aactctgactgtgtatctgtttccc

SEQ ID NO: 29383 - DNA, 25 bp, Rattus norvegicus
aactctgacttcatagtggtatact

SEQ ID NO: 29384 - DNA, 25 bp, Rattus norvegicus
aactctgacttcttagtggtatact

SEQ ID NO: 29385 - DNA, 25 bp, Rattus norvegicus
aactctgagaaaattttgttctgat

SEQ ID NO: 29386 - DNA, 25 bp, Rattus norvegicus
aactctgagaaatttttgttctgat

SEQ ID NO: 29387 - DNA, 25 bp, Rattus norvegicus
aactctgagcataccacaggactga

SEQ ID NO: 29388 - DNA, 25 bp, Rattus norvegicus
aactctgagcattccacaggactga

SEQ ID NO: 29389 - DNA, 25 bp, Rattus norvegicus
aactctgaggataggccatcctcct

SEQ ID NO: 29390 - DNA, 25 bp, Rattus norvegicus
aactctgaggattggccatcctcct

SEQ ID NO: 29391 - DNA, 25 bp, Rattus norvegicus
aactctgaggccctgaccagaatgt

SEQ ID NO: 29392 - DNA, 25 bp, Rattus norvegicus
aactctgaggccgtgaccagaatgt

SEQ ID NO: 29393 - DNA, 25 bp, Rattus norvegicus
aactctgagtaaaagcgttcatcat

SEQ ID NO: 29394 - DNA, 25 bp, Rattus norvegicus
aactctgagtaatagcgttcatcat

SEQ ID NO: 29395 - DNA, 25 bp, Rattus norvegicus
aactctgatgccatttccagttgag

SEQ ID NO: 29396 - DNA, 25 bp, Rattus norvegicus
aactctgatgccttttccagttgag

SEQ ID NO: 29397 - DNA, 25 bp, Rattus norvegicus
aactctgatgtgcaggtcatgcctg

SEQ ID NO: 29398 - DNA, 25 bp, Rattus norvegicus
aactctgatgtggaggtcatgcctg

SEQ ID NO: 29399 - DNA, 25 bp, Rattus norvegicus
aactctgattagctttatgctgccc

SEQ ID NO: 29400 - DNA, 25 bp, Rattus norvegicus
aactctgattaggtttatgctgccc

SEQ ID NO: 29401 - DNA, 25 bp, Rattus norvegicus
aactctgcagacatttgggcctgta

SEQ ID NO: 29402 - DNA, 25 bp, Rattus norvegicus
aactctgcagacttttgggcctgta

SEQ ID NO: 29403 - DNA, 25 bp, Rattus norvegicus
aactctgcagagcaaccttgtttgt

SEQ ID NO: 29404 - DNA, 25 bp, Rattus norvegicus
aactctgcagaggaaccttgtttgt

SEQ ID NO: 29405 - DNA, 25 bp, Rattus norvegicus
aactctgcaggtcactatgctaacc

SEQ ID NO: 29406 - DNA, 25 bp, Rattus norvegicus
aactctgcaggtgactatgctaacc

SEQ ID NO: 29407 - DNA, 25 bp, Rattus norvegicus
aactctgcatgaccttagctggttc

SEQ ID NO: 29408 - DNA, 25 bp, Rattus norvegicus
aactctgcatgagcttagctggttc

SEQ ID NO: 29409 - DNA, 25 bp, Rattus norvegicus
aactctgccgacagcttggattaca

SEQ ID NO: 29410 - DNA, 25 bp, Rattus norvegicus
aactctgccgactgcttggattaca

SEQ ID NO: 29411 - DNA, 25 bp, Rattus norvegicus
aactctgcctgaagagggcggcacc

SEQ ID NO: 29412 - DNA, 25 bp, Rattus norvegicus
aactctgcctgaccaatcctgagat

SEQ ID NO: 29413 - DNA, 25 bp, Rattus norvegicus
aactctgcctgagcaatcctgagat

SEQ ID NO: 29414 - DNA, 25 bp, Rattus norvegicus
aactctgcctgatgagggcggcacc

SEQ ID NO: 29415 - DNA, 25 bp, Rattus norvegicus
aactctgcgagtaccaggccatcat

SEQ ID NO: 29416 - DNA, 25 bp, Rattus norvegicus
aactctgcgagttccaggccatcat

SEQ ID NO: 29417 - DNA, 25 bp, Rattus norvegicus
aactctgcgcctaaaacccattatg

SEQ ID NO: 29418 - DNA, 25 bp, Rattus norvegicus
aactctgcgccttaaacccattatg

SEQ ID NO: 29419 - DNA, 25 bp, Rattus norvegicus
aactctgcggtgctaactgatgaat

SEQ ID NO: 29420 - DNA, 25 bp, Rattus norvegicus
aactctgcggtggtaactgatgaat

SEQ ID NO: 29421 - DNA, 25 bp, Rattus norvegicus
aactctgctcctcgtgttacagtgc

SEQ ID NO: 29422 - DNA, 25 bp, Rattus norvegicus
aactctgctcctggtgttacagtgc

SEQ ID NO: 29423 - DNA, 25 bp, Rattus norvegicus
aactctgctgaacacccattcattg

SEQ ID NO: 29424 - DNA, 25 bp, Rattus norvegicus
aactctgctgaagacccattcattg

SEQ ID NO: 29425 - DNA, 25 bp, Rattus norvegicus
aactctgctggcaggcttgtggtcc

SEQ ID NO: 29426 - DNA, 25 bp, Rattus norvegicus
aactctgctggctggcttgtggtcc

SEQ ID NO: 29427 - DNA, 25 bp, Rattus norvegicus
aactctgcttccattgctgtgggag

SEQ ID NO: 29428 - DNA, 25 bp, Rattus norvegicus
aactctgcttcctttgctgtgggag

SEQ ID NO: 29429 - DNA, 25 bp, Rattus norvegicus
aactctgcttctcatcatcagctaa

SEQ ID NO: 29430 - DNA, 25 bp, Rattus norvegicus
aactctgcttctgatcatcagctaa

SEQ ID NO: 29431 - DNA, 25 bp, Rattus norvegicus
aactctgcttttcttaatatttcca

SEQ ID NO: 29432 - DNA, 25 bp, Rattus norvegicus
aactctgcttttgttaatatttcca

SEQ ID NO: 29433 - DNA, 25 bp, Rattus norvegicus
aactctggacatcttctgtgtgaga

SEQ ID NO: 29434 - DNA, 25 bp, Rattus norvegicus
aactctggacatgttctgtgtgaga

SEQ ID NO: 29435 - DNA, 25 bp, Rattus norvegicus
aactctggactcagtatatcctgac

SEQ ID NO: 29436 - DNA, 25 bp, Rattus norvegicus
aactctggactctgtatatcctgac

SEQ ID NO: 29437 - DNA, 25 bp, Rattus norvegicus
aactctggagaaacgtgctgagcca

SEQ ID NO: 29438 - DNA, 25 bp, Rattus norvegicus
aactctggagaatcgtgctgagcca

SEQ ID NO: 29439 - DNA, 25 bp, Rattus norvegicus
aactctggagtaatttacagttcga

SEQ ID NO: 29440 - DNA, 25 bp, Rattus norvegicus
aactctggagtattttacagttcga

SEQ ID NO: 29441 - DNA, 25 bp, Rattus norvegicus
aactctggagttctaagctcactta

SEQ ID NO: 29442 - DNA, 25 bp, Rattus norvegicus
aactctggagttgtaagctcactta

SEQ ID NO: 29443 - DNA, 25 bp, Rattus norvegicus
aactctggcaacaatggttggtccg

SEQ ID NO: 29444 - DNA, 25 bp, Rattus norvegicus
aactctggcaactatggttggtccg

SEQ ID NO: 29445 - DNA, 25 bp, Rattus norvegicus
aactctggcacaacccagctttctg

SEQ ID NO: 29446 - DNA, 25 bp, Rattus norvegicus
aactctggcacatcccagctttctg

SEQ ID NO: 29447 - DNA, 25 bp, Rattus norvegicus
aactctggcattagttggccctctt

SEQ ID NO: 29448 - DNA, 25 bp, Rattus norvegicus
aactctggcatttgttggccctctt

SEQ ID NO: 29449 - DNA, 25 bp, Rattus norvegicus
aactctggccttagcggttgttttg

SEQ ID NO: 29450 - DNA, 25 bp, Rattus norvegicus
aactctggcctttgcggttgttttg

SEQ ID NO: 29451 - DNA, 25 bp, Rattus norvegicus
aactctgggaaaagtttcagcttta

SEQ ID NO: 29452 - DNA, 25 bp, Rattus norvegicus
aactctgggaaatgtttcagcttta

SEQ ID NO: 29453 - DNA, 25 bp, Rattus norvegicus
aactctgggaagatcctatcacaca

SEQ ID NO: 29454 - DNA, 25 bp, Rattus norvegicus
aactctgggaagttcctatcacaca

SEQ ID NO: 29455 - DNA, 25 bp, Rattus norvegicus
aactctgggataagcctggctgcca

SEQ ID NO: 29456 - DNA, 25 bp, Rattus norvegicus
aactctgggatatgcctggctgcca

SEQ ID NO: 29457 - DNA, 25 bp, Rattus norvegicus
aactctgggcagctgcatttgtgca

SEQ ID NO: 29458 - DNA, 25 bp, Rattus norvegicus
aactctgggcaggtgcatttgtgca

SEQ ID NO: 29459 - DNA, 25 bp, Rattus norvegicus
aactctgggccgattaactggcagc

SEQ ID NO: 29460 - DNA, 25 bp, Rattus norvegicus
aactctgggccgtttaactggcagc

SEQ ID NO: 29461 - DNA, 25 bp, Rattus norvegicus
aactctgggctcagaaatgtgggca

SEQ ID NO: 29462 - DNA, 25 bp, Rattus norvegicus
aactctgggctctgaaatgtgggca

SEQ ID NO: 29463 - DNA, 25 bp, Rattus norvegicus
aactctgggtcccaagaggacacat

SEQ ID NO: 29464 - DNA, 25 bp, Rattus norvegicus
aactctgggtccgaagaggacacat

SEQ ID NO: 29465 - DNA, 25 bp, Rattus norvegicus
aactctgggtgcatgagctgggcat

SEQ ID NO: 29466 - DNA, 25 bp, Rattus norvegicus
aactctgggtgcttgagctgggcat

SEQ ID NO: 29467 - DNA, 25 bp, Rattus norvegicus
aactctggtcagattgggaagacag

SEQ ID NO: 29468 - DNA, 25 bp, Rattus norvegicus
aactctggtcagtttgggaagacag

SEQ ID NO: 29469 - DNA, 25 bp, Rattus norvegicus
aactctggtccactgttacagcctt

SEQ ID NO: 29470 - DNA, 25 bp, Rattus norvegicus
aactctggtccagtgttacagcctt

SEQ ID NO: 29471 - DNA, 25 bp, Rattus norvegicus
aactctggtgaaagctggtatacta

SEQ ID NO: 29472 - DNA, 25 bp, Rattus norvegicus
aactctggtgaatgctggtatacta

SEQ ID NO: 29473 - DNA, 25 bp, Rattus norvegicus
aactctggtgacagcagtgcctgct

SEQ ID NO: 29474 - DNA, 25 bp, Rattus norvegicus
aactctggtgactgcagtgcctgct

SEQ ID NO: 29475 - DNA, 25 bp, Rattus norvegicus
aactctggtgctaatggcgggtctt

SEQ ID NO: 29476 - DNA, 25 bp, Rattus norvegicus
aactctggtgcttatggcgggtctt

SEQ ID NO: 29477 - DNA, 25 bp, Rattus norvegicus
aactctggtgtcaaaactctgtact

SEQ ID NO: 29478 - DNA, 25 bp, Rattus norvegicus
aactctggtgtctaaactctgtact

SEQ ID NO: 29479 - DNA, 25 bp, Rattus norvegicus
aactctggttctccacagttagaca

SEQ ID NO: 29480 - DNA, 25 bp, Rattus norvegicus
aactctggttctgcacagttagaca

SEQ ID NO: 29481 - DNA, 25 bp, Rattus norvegicus
aactctggtttcataggacttcaca

SEQ ID NO: 29482 - DNA, 25 bp, Rattus norvegicus
aactctggtttcttaggacttcaca

SEQ ID NO: 29483 - DNA, 25 bp, Rattus norvegicus
aactctgtaaaacttctcctctgta

SEQ ID NO: 29484 - DNA, 25 bp, Rattus norvegicus
aactctgtaaaagttctcctctgta

SEQ ID NO: 29485 - DNA, 25 bp, Rattus norvegicus
aactctgtacccacagaagtcagga

SEQ ID NO: 29486 - DNA, 25 bp, Rattus norvegicus
aactctgtaccctcagaagtcagga

SEQ ID NO: 29487 - DNA, 25 bp, Rattus norvegicus
aactctgtagtcagggtcttatttt

SEQ ID NO: 29488 - DNA, 25 bp, Rattus norvegicus
aactctgtagtctgggtcttatttt

SEQ ID NO: 29489 - DNA, 25 bp, Rattus norvegicus
aactctgtagtgcttaacttgggac

SEQ ID NO: 29490 - DNA, 25 bp, Rattus norvegicus
aactctgtagtggttaacttgggac

SEQ ID NO: 29491 - DNA, 25 bp, Rattus norvegicus
aactctgtattcatgccaaagactt

SEQ ID NO: 29492 - DNA, 25 bp, Rattus norvegicus
aactctgtattcttgccaaagactt

SEQ ID NO: 29493 - DNA, 25 bp, Rattus norvegicus
aactctgtcaggcattgtggcattt

SEQ ID NO: 29494 - DNA, 25 bp, Rattus norvegicus
aactctgtcagggattgtggcattt

SEQ ID NO: 29495 - DNA, 25 bp, Rattus norvegicus
aactctgtccagacttcatatcata

SEQ ID NO: 29496 - DNA, 25 bp, Rattus norvegicus
aactctgtccagtcttcatatcata

SEQ ID NO: 29497 - DNA, 25 bp, Rattus norvegicus
aactctgtcctaaaggtattgcctc

SEQ ID NO: 29498 - DNA, 25 bp, Rattus norvegicus
aactctgtcctataggtattgcctc

SEQ ID NO: 29499 - DNA, 25 bp, Rattus norvegicus
aactctgtccttctgtctgtttgtt

SEQ ID NO: 29500 - DNA, 25 bp, Rattus norvegicus
aactctgtccttgtgtctgtttgtt

SEQ ID NO: 29501 - DNA, 25 bp, Rattus norvegicus
aactctgtcgtcctgtcttctggat

SEQ ID NO: 29502 - DNA, 25 bp, Rattus norvegicus
aactctgtcgtcgtgtcttctggat

SEQ ID NO: 29503 - DNA, 25 bp, Rattus norvegicus
aactctgtctcgaacacacacaaag

SEQ ID NO: 29504 - DNA, 25 bp, Rattus norvegicus
aactctgtctcgtacacacacaaag

SEQ ID NO: 29505 - DNA, 25 bp, Rattus norvegicus
aactctgtctctacagggcttagac

SEQ ID NO: 29506 - DNA, 25 bp, Rattus norvegicus
aactctgtctcttcagggcttagac

SEQ ID NO: 29507 - DNA, 25 bp, Rattus norvegicus
aactctgtgataactctggcattcc

SEQ ID NO: 29508 - DNA, 25 bp, Rattus norvegicus
aactctgtgatatctctggcattcc

SEQ ID NO: 29509 - DNA, 25 bp, Rattus norvegicus
aactctgtgatcaccaagctggcgg

SEQ ID NO: 29510 - DNA, 25 bp, Rattus norvegicus
aactctgtgatctccaagctggcgg

SEQ ID NO: 29511 - DNA, 25 bp, Rattus norvegicus
aactctgtgcaaaggtatgatttat

SEQ ID NO: 29512 - DNA, 25 bp, Rattus norvegicus
aactctgtgcaatggtatgatttat

SEQ ID NO: 29513 - DNA, 25 bp, Rattus norvegicus
aactctgtgcagaggctcgctagca

SEQ ID NO: 29514 - DNA, 25 bp, Rattus norvegicus
aactctgtgcagtggctcgctagca

SEQ ID NO: 29515 - DNA, 25 bp, Rattus norvegicus
aactctgtgctaacagatcttcatt

SEQ ID NO: 29516 - DNA, 25 bp, Rattus norvegicus
aactctgtgctatcagatcttcatt

SEQ ID NO: 29517 - DNA, 25 bp, Rattus norvegicus
aactctgtggacatggacacggaca

SEQ ID NO: 29518 - DNA, 25 bp, Rattus norvegicus
aactctgtggacttggacacggaca

SEQ ID NO: 29519 - DNA, 25 bp, Rattus norvegicus
aactctgtgtggactgttccttcct

SEQ ID NO: 29520 - DNA, 25 bp, Rattus norvegicus
aactctgtgtggtctgttccttcct

SEQ ID NO: 29521 - DNA, 25 bp, Rattus norvegicus
aactctgttattactctctagcttc

SEQ ID NO: 29522 - DNA, 25 bp, Rattus norvegicus
aactctgttatttctctctagcttc

SEQ ID NO: 29523 - DNA, 25 bp, Rattus norvegicus
aactctgttcatctattcaattgta

SEQ ID NO: 29524 - DNA, 25 bp, Rattus norvegicus
aactctgttcatgtattcaattgta

SEQ ID NO: 29525 - DNA, 25 bp, Rattus norvegicus
aactctgttcccactggatcctgag

SEQ ID NO: 29526 - DNA, 25 bp, Rattus norvegicus
aactctgttccctctggatcctgag

SEQ ID NO: 29527 - DNA, 25 bp, Rattus norvegicus
aactctgttggaattatattctgta

SEQ ID NO: 29528 - DNA, 25 bp, Rattus norvegicus
aactctgttggatttatattctgta

SEQ ID NO: 29529 - DNA, 25 bp, Rattus norvegicus
aactctgtttagaaaagccaagtca

SEQ ID NO: 29530 - DNA, 25 bp, Rattus norvegicus
aactctgtttagtaaagccaagtca

SEQ ID NO: 29531 - DNA, 25 bp, Rattus norvegicus
aactctgtttctcgtggctaagcaa

SEQ ID NO: 29532 - DNA, 25 bp, Rattus norvegicus
aactctgtttctggtggctaagcaa

SEQ ID NO: 29533 - DNA, 25 bp, Rattus norvegicus
aactcttaaagcagcctctctattt

SEQ ID NO: 29534 - DNA, 25 bp, Rattus norvegicus
aactcttaaagctgcctctctattt

SEQ ID NO: 29535 - DNA, 25 bp, Rattus norvegicus
aactcttaacacatgcagaccaata

SEQ ID NO: 29536 - DNA, 25 bp, Rattus norvegicus
aactcttaacacttgcagaccaata

SEQ ID NO: 29537 - DNA, 25 bp, Rattus norvegicus
aactcttaactgaaacttcctatga

SEQ ID NO: 29538 - DNA, 25 bp, Rattus norvegicus
aactcttaactgtaacttcctatga

SEQ ID NO: 29539 - DNA, 25 bp, Rattus norvegicus
aactcttaagagaaggtccatccct

SEQ ID NO: 29540 - DNA, 25 bp, Rattus norvegicus
aactcttaagagtaggtccatccct

SEQ ID NO: 29541 - DNA, 25 bp, Rattus norvegicus
aactcttaccctccaagtgttatgt

SEQ ID NO: 29542 - DNA, 25 bp, Rattus norvegicus
aactcttaccctgcaagtgttatgt

SEQ ID NO: 29543 - DNA, 25 bp, Rattus norvegicus
aactcttacgttcattggcctgtga

SEQ ID NO: 29544 - DNA, 25 bp, Rattus norvegicus
aactcttacgttgattggcctgtga

SEQ ID NO: 29545 - DNA, 25 bp, Rattus norvegicus
aactcttagcacagtgagcgttcaa

SEQ ID NO: 29546 - DNA, 25 bp, Rattus norvegicus
aactcttagcactgtgagcgttcaa

SEQ ID NO: 29547 - DNA, 25 bp, Rattus norvegicus
aactcttaggtcaccacagttgggt

SEQ ID NO: 29548 - DNA, 25 bp, Rattus norvegicus
aactcttaggtctccacagttgggt

SEQ ID NO: 29549 - DNA, 25 bp, Rattus norvegicus
aactcttagttcatttgttccactg

SEQ ID NO: 29550 - DNA, 25 bp, Rattus norvegicus
aactcttagttcttttgttccactg

SEQ ID NO: 29551 - DNA, 25 bp, Rattus norvegicus
aactcttatgttctgggtaaccgtg

SEQ ID NO: 29552 - DNA, 25 bp, Rattus norvegicus
aactcttatgttgtgggtaaccgtg

SEQ ID NO: 29553 - DNA, 25 bp, Rattus norvegicus
aactcttcaaagacctgctggtgct

SEQ ID NO: 29554 - DNA, 25 bp, Rattus norvegicus
aactcttcaaagtcctgctggtgct

SEQ ID NO: 29555 - DNA, 25 bp, Rattus norvegicus
aactcttcaccgatttttgttgctg

SEQ ID NO: 29556 - DNA, 25 bp, Rattus norvegicus
aactcttcaccgttttttgttgctg

SEQ ID NO: 29557 - DNA, 25 bp, Rattus norvegicus
aactcttcactacagctgagcagta

SEQ ID NO: 29558 - DNA, 25 bp, Rattus norvegicus
aactcttcactagagctgagcagta

SEQ ID NO: 29559 - DNA, 25 bp, Rattus norvegicus
aactcttcactcacctgactaaata

SEQ ID NO: 29560 - DNA, 25 bp, Rattus norvegicus
aactcttcactctcctgactaaata

SEQ ID NO: 29561 - DNA, 25 bp, Rattus norvegicus
aactcttcagacaggtctatcatca

SEQ ID NO: 29562 - DNA, 25 bp, Rattus norvegicus
aactcttcagactggtctatcatca

SEQ ID NO: 29563 - DNA, 25 bp, Rattus norvegicus
aactcttcaggcaacgtgggatcaa

SEQ ID NO: 29564 - DNA, 25 bp, Rattus norvegicus
aactcttcaggcaggattcctgtgg

SEQ ID NO: 29565 - DNA, 25 bp, Rattus norvegicus
aactcttcaggctacgtgggatcaa

SEQ ID NO: 29566 - DNA, 25 bp, Rattus norvegicus
aactcttcaggctggattcctgtgg

SEQ ID NO: 29567 - DNA, 25 bp, Rattus norvegicus
aactcttcataaatgcttgcctgca

SEQ ID NO: 29568 - DNA, 25 bp, Rattus norvegicus
aactcttcataattgcttgcctgca

SEQ ID NO: 29569 - DNA, 25 bp, Rattus norvegicus
aactcttcatatactcttgctctgt

SEQ ID NO: 29570 - DNA, 25 bp, Rattus norvegicus
aactcttcatattctcttgctctgt

SEQ ID NO: 29571 - DNA, 25 bp, Rattus norvegicus
aactcttcatttcagaactggagat

SEQ ID NO: 29572 - DNA, 25 bp, Rattus norvegicus
aactcttcatttgagaactggagat

SEQ ID NO: 29573 - DNA, 25 bp, Rattus norvegicus
aactcttccacactttggttcccag

SEQ ID NO: 29574 - DNA, 25 bp, Rattus norvegicus
aactcttccacagtttggttcccag

SEQ ID NO: 29575 - DNA, 25 bp, Rattus norvegicus
aactcttccagcagttcggctatgg

SEQ ID NO: 29576 - DNA, 25 bp, Rattus norvegicus
aactcttccagctgttcggctatgg

SEQ ID NO: 29577 - DNA, 25 bp, Rattus norvegicus
aactcttccggaatccgcgaggaca

SEQ ID NO: 29578 - DNA, 25 bp, Rattus norvegicus
aactcttccggattccgcgaggaca

SEQ ID NO: 29579 - DNA, 25 bp, Rattus norvegicus
aactcttccggcatggcatagacag

SEQ ID NO: 29580 - DNA, 25 bp, Rattus norvegicus
aactcttccggcttggcatagacag

SEQ ID NO: 29581 - DNA, 25 bp, Rattus norvegicus
aactcttcctatatggtggccctag

SEQ ID NO: 29582 - DNA, 25 bp, Rattus norvegicus
aactcttcctatttggtggccctag

SEQ ID NO: 29583 - DNA, 25 bp, Rattus norvegicus
aactcttcctcaatatcttggtctt

SEQ ID NO: 29584 - DNA, 25 bp, Rattus norvegicus
aactcttcctcattatcttggtctt

SEQ ID NO: 29585 - DNA, 25 bp, Rattus norvegicus
aactcttcctctcgttctgaatgat

SEQ ID NO: 29586 - DNA, 25 bp, Rattus norvegicus
aactcttcctctggttctgaatgat

SEQ ID NO: 29587 - DNA, 25 bp, Rattus norvegicus
aactcttcggacactggctgagcag

SEQ ID NO: 29588 - DNA, 25 bp, Rattus norvegicus
aactcttcggactctggctgagcag

SEQ ID NO: 29589 - DNA, 25 bp, Rattus norvegicus
aactcttcggtcaggataccttcta

SEQ ID NO: 29590 - DNA, 25 bp, Rattus norvegicus
aactcttcggtctggataccttcta

SEQ ID NO: 29591 - DNA, 25 bp, Rattus norvegicus
aactcttctcagagtggcactcaga

SEQ ID NO: 29592 - DNA, 25 bp, Rattus norvegicus
aactcttctcagtgtggcactcaga

SEQ ID NO: 29593 - DNA, 25 bp, Rattus norvegicus
aactcttctccaattctttatgttg

SEQ ID NO: 29594 - DNA, 25 bp, Rattus norvegicus
aactcttctccatttctttatgttg

SEQ ID NO: 29595 - DNA, 25 bp, Rattus norvegicus
aactcttctcctatgcgattctggg

SEQ ID NO: 29596 - DNA, 25 bp, Rattus norvegicus
aactcttctcctttgcgattctggg

SEQ ID NO: 29597 - DNA, 25 bp, Rattus norvegicus
aactcttctgagagatacccatctt

SEQ ID NO: 29598 - DNA, 25 bp, Rattus norvegicus
aactcttctgagtgatacccatctt

SEQ ID NO: 29599 - DNA, 25 bp, Rattus norvegicus
aactcttctgctaattaccaggagg

SEQ ID NO: 29600 - DNA, 25 bp, Rattus norvegicus
aactcttctgcttattaccaggagg

SEQ ID NO: 29601 - DNA, 25 bp, Rattus norvegicus
aactcttctgtacaggtgtcaccta

SEQ ID NO: 29602 - DNA, 25 bp, Rattus norvegicus
aactcttctgtagaggtgtcaccta

SEQ ID NO: 29603 - DNA, 25 bp, Rattus norvegicus
aactcttcttagctatctgctgtgg

SEQ ID NO: 29604 - DNA, 25 bp, Rattus norvegicus
aactcttcttaggtatctgctgtgg

SEQ ID NO: 29605 - DNA, 25 bp, Rattus norvegicus
aactcttgacctatcatgtttaatg

SEQ ID NO: 29606 - DNA, 25 bp, Rattus norvegicus
aactcttgacctttcatgtttaatg

SEQ ID NO: 29607 - DNA, 25 bp, Rattus norvegicus
aactcttgagttaaagcttaggcta

SEQ ID NO: 29608 - DNA, 25 bp, Rattus norvegicus
aactcttgagttccagtccaatcta

SEQ ID NO: 29609 - DNA, 25 bp, Rattus norvegicus
aactcttgagttgcagtccaatcta

SEQ ID NO: 29610 - DNA, 25 bp, Rattus norvegicus
aactcttgagtttaagcttaggcta

SEQ ID NO: 29611 - DNA, 25 bp, Rattus norvegicus
aactcttgccctaggtttacatatg

SEQ ID NO: 29612 - DNA, 25 bp, Rattus norvegicus
aactcttgcccttggtttacatatg

SEQ ID NO: 29613 - DNA, 25 bp, Rattus norvegicus
aactcttgcgctagggaagcagggt

SEQ ID NO: 29614 - DNA, 25 bp, Rattus norvegicus
aactcttgcgcttgggaagcagggt

SEQ ID NO: 29615 - DNA, 25 bp, Rattus norvegicus
aactcttgctggcttgatccttaat

SEQ ID NO: 29616 - DNA, 25 bp, Rattus norvegicus
aactcttgctgggttgatccttaat

SEQ ID NO: 29617 - DNA, 25 bp, Rattus norvegicus
aactcttggctgaggttttggtatt

SEQ ID NO: 29618 - DNA, 25 bp, Rattus norvegicus
aactcttggctgtggttttggtatt

SEQ ID NO: 29619 - DNA, 25 bp, Rattus norvegicus
aactcttggcttagaccatggcttt

SEQ ID NO: 29620 - DNA, 25 bp, Rattus norvegicus
aactcttggcttcatcttcagcagc

SEQ ID NO: 29621 - DNA, 25 bp, Rattus norvegicus
aactcttggcttgatcttcagcagc

SEQ ID NO: 29622 - DNA, 25 bp, Rattus norvegicus
aactcttggctttgaccatggcttt

SEQ ID NO: 29623 - DNA, 25 bp, Rattus norvegicus
aactcttgggagctgacatgcgtcg

SEQ ID NO: 29624 - DNA, 25 bp, Rattus norvegicus
aactcttgggaggtgacatgcgtcg

SEQ ID NO: 29625 - DNA, 25 bp, Rattus norvegicus
aactcttgggctaaaatggctttga

SEQ ID NO: 29626 - DNA, 25 bp, Rattus norvegicus
aactcttgggcttaaatggctttga

SEQ ID NO: 29627 - DNA, 25 bp, Rattus norvegicus
aactcttggtttctaactgaaatcg

SEQ ID NO: 29628 - DNA, 25 bp, Rattus norvegicus
aactcttggtttgtaactgaaatcg

SEQ ID NO: 29629 - DNA, 25 bp, Rattus norvegicus
aactcttgtactactgcactgtgct

SEQ ID NO: 29630 - DNA, 25 bp, Rattus norvegicus
aactcttgtacttctgcactgtgct

SEQ ID NO: 29631 - DNA, 25 bp, Rattus norvegicus
aactcttgtcccagcatgtatgtga

SEQ ID NO: 29632 - DNA, 25 bp, Rattus norvegicus
aactcttgtccctgcatgtatgtga

SEQ ID NO: 29633 - DNA, 25 bp, Rattus norvegicus
aactctttagttatctggctttgct

SEQ ID NO: 29634 - DNA, 25 bp, Rattus norvegicus
aactctttagttttctggctttgct

SEQ ID NO: 29635 - DNA, 25 bp, Rattus norvegicus
aactctttcagaagatcgcccttca

SEQ ID NO: 29636 - DNA, 25 bp, Rattus norvegicus
aactctttcagatgatcgcccttca

SEQ ID NO: 29637 - DNA, 25 bp, Rattus norvegicus
aactctttgaccaccagtgcctggg

SEQ ID NO: 29638 - DNA, 25 bp, Rattus norvegicus
aactctttgacctccagtgcctggg

SEQ ID NO: 29639 - DNA, 25 bp, Rattus norvegicus
aactctttgggcaccaggttcatgg

SEQ ID NO: 29640 - DNA, 25 bp, Rattus norvegicus
aactctttgggctccaggttcatgg

SEQ ID NO: 29641 - DNA, 25 bp, Rattus norvegicus
aactctttggtactaacatgctcca

SEQ ID NO: 29642 - DNA, 25 bp, Rattus norvegicus
aactctttggtagtaacatgctcca

SEQ ID NO: 29643 - DNA, 25 bp, Rattus norvegicus
aactctttgtgaccgtccaggatgc

SEQ ID NO: 29644 - DNA, 25 bp, Rattus norvegicus
aactctttgtgagcgtccaggatgc

SEQ ID NO: 29645 - DNA, 25 bp, Rattus norvegicus
aactcttttcccctcatgtttgaga

SEQ ID NO: 29646 - DNA, 25 bp, Rattus norvegicus
aactcttttcccgtcatgtttgaga

SEQ ID NO: 29647 - DNA, 25 bp, Rattus norvegicus
aactcttttccgaaggctcacttca

SEQ ID NO: 29648 - DNA, 25 bp, Rattus norvegicus
aactcttttccgtaggctcacttca

SEQ ID NO: 29649 - DNA, 25 bp, Rattus norvegicus
aactcttttgccacaccatattgtc

SEQ ID NO: 29650 - DNA, 25 bp, Rattus norvegicus
aactcttttgcctcaccatattgtc

SEQ ID NO: 29651 - DNA, 25 bp, Rattus norvegicus
aactcttttgttcttctttgcctca

SEQ ID NO: 29652 - DNA, 25 bp, Rattus norvegicus
aactcttttgttgttctttgcctca

SEQ ID NO: 29653 - DNA, 25 bp, Rattus norvegicus
aactgaaaagtgattgcggccattg

SEQ ID NO: 29654 - DNA, 25 bp, Rattus norvegicus
aactgaaaagtgtttgcggccattg

SEQ ID NO: 29655 - DNA, 25 bp, Rattus norvegicus
aactgaaacccaatacgtcctaatg

SEQ ID NO: 29656 - DNA, 25 bp, Rattus norvegicus
aactgaaacccattacgtcctaatg

SEQ ID NO: 29657 - DNA, 25 bp, Rattus norvegicus
aactgaaatactctttggttttgat

SEQ ID NO: 29658 - DNA, 25 bp, Rattus norvegicus
aactgaaatactgtttggttttgat

SEQ ID NO: 29659 - DNA, 25 bp, Rattus norvegicus
aactgaaatagcaattacgttcttg

SEQ ID NO: 29660 - DNA, 25 bp, Rattus norvegicus
aactgaaatagctattacgttcttg

SEQ ID NO: 29661 - DNA, 25 bp, Rattus norvegicus
aactgaaatctcagtctgatccaaa

SEQ ID NO: 29662 - DNA, 25 bp, Rattus norvegicus
aactgaaatctctgtctgatccaaa

SEQ ID NO: 29663 - DNA, 25 bp, Rattus norvegicus
aactgaacaccaccagtatttttag

SEQ ID NO: 29664 - DNA, 25 bp, Rattus norvegicus
aactgaacaccagcagtatttttag

SEQ ID NO: 29665 - DNA, 25 bp, Rattus norvegicus
aactgaacactcatccatctgtgct

SEQ ID NO: 29666 - DNA, 25 bp, Rattus norvegicus
aactgaacactcttccatctgtgct

SEQ ID NO: 29667 - DNA, 25 bp, Rattus norvegicus
aactgaacagccacaatttttaaga

SEQ ID NO: 29668 - DNA, 25 bp, Rattus norvegicus
aactgaacagcctcaatttttaaga

SEQ ID NO: 29669 - DNA, 25 bp, Rattus norvegicus
aactgaacagcgcacactggagagt

SEQ ID NO: 29670 - DNA, 25 bp, Rattus norvegicus
aactgaacagcggacactggagagt

SEQ ID NO: 29671 - DNA, 25 bp, Rattus norvegicus
aactgaaccagcacctctgggaggg

SEQ ID NO: 29672 - DNA, 25 bp, Rattus norvegicus
aactgaaccagctcctctgggaggg

SEQ ID NO: 29673 - DNA, 25 bp, Rattus norvegicus
aactgaacccagaaaccgtcatgga

SEQ ID NO: 29674 - DNA, 25 bp, Rattus norvegicus
aactgaacccagtaaccgtcatgga

SEQ ID NO: 29675 - DNA, 25 bp, Rattus norvegicus
aactgaacccgcctgatgagagtgg

SEQ ID NO: 29676 - DNA, 25 bp, Rattus norvegicus
aactgaacccgcgtgatgagagtgg

SEQ ID NO: 29677 - DNA, 25 bp, Rattus norvegicus
aactgaaccgtcacaaggtcgaaga

SEQ ID NO: 29678 - DNA, 25 bp, Rattus norvegicus
aactgaaccgtctcaaggtcgaaga

SEQ ID NO: 29679 - DNA, 25 bp, Rattus norvegicus
aactgaacctggcttcacatggctt

SEQ ID NO: 29680 - DNA, 25 bp, Rattus norvegicus
aactgaacctgggttcacatggctt

SEQ ID NO: 29681 - DNA, 25 bp, Rattus norvegicus
aactgaacgccaatgcttcgaccag

SEQ ID NO: 29682 - DNA, 25 bp, Rattus norvegicus
aactgaacgccattgcttcgaccag

SEQ ID NO: 29683 - DNA, 25 bp, Rattus norvegicus
aactgaacgtacatgagtggctgca

SEQ ID NO: 29684 - DNA, 25 bp, Rattus norvegicus
aactgaacgtacttgagtggctgca

SEQ ID NO: 29685 - DNA, 25 bp, Rattus norvegicus
aactgaactgttaggtcgagtcttt

SEQ ID NO: 29686 - DNA, 25 bp, Rattus norvegicus
aactgaactgttagtgcttctttgt

SEQ ID NO: 29687 - DNA, 25 bp, Rattus norvegicus
aactgaactgtttggtcgagtcttt

SEQ ID NO: 29688 - DNA, 25 bp, Rattus norvegicus
aactgaactgtttgtgcttctttgt

SEQ ID NO: 29689 - DNA, 25 bp, Rattus norvegicus
aactgaactttgaagaccggctgca

SEQ ID NO: 29690 - DNA, 25 bp, Rattus norvegicus
aactgaactttgtagaccggctgca

SEQ ID NO: 29691 - DNA, 25 bp, Rattus norvegicus
aactgaagagacacgtgggcctgaa

SEQ ID NO: 29692 - DNA, 25 bp, Rattus norvegicus
aactgaagagactcgtgggcctgaa

SEQ ID NO: 29693 - DNA, 25 bp, Rattus norvegicus
aactgaagagcactgccccaactga

SEQ ID NO: 29694 - DNA, 25 bp, Rattus norvegicus
aactgaagagcagtgccccaactga

SEQ ID NO: 29695 - DNA, 25 bp, Rattus norvegicus
aactgaagagttaccccaacatcgg

SEQ ID NO: 29696 - DNA, 25 bp, Rattus norvegicus
aactgaagagtttccccaacatcgg

SEQ ID NO: 29697 - DNA, 25 bp, Rattus norvegicus
aactgaagcgccaggaagcccagca

SEQ ID NO: 29698 - DNA, 25 bp, Rattus norvegicus
aactgaagcgcctggaagcccagca

SEQ ID NO: 29699 - DNA, 25 bp, Rattus norvegicus
aactgaagctcgctactttacagaa

SEQ ID NO: 29700 - DNA, 25 bp, Rattus norvegicus
aactgaagctcggtactttacagaa

SEQ ID NO: 29701 - DNA, 25 bp, Rattus norvegicus
aactgaagctgaagggctgcgaaca

SEQ ID NO: 29702 - DNA, 25 bp, Rattus norvegicus
aactgaagctgatgggctgcgaaca

SEQ ID NO: 29703 - DNA, 25 bp, Rattus norvegicus
aactgaaggctgagggaggaccttt

SEQ ID NO: 29704 - DNA, 25 bp, Rattus norvegicus
aactgaaggctgcatctttcttgtc

SEQ ID NO: 29705 - DNA, 25 bp, Rattus norvegicus
aactgaaggctggatctttcttgtc

SEQ ID NO: 29706 - DNA, 25 bp, Rattus norvegicus
aactgaaggctgtgggaggaccttt

SEQ ID NO: 29707 - DNA, 25 bp, Rattus norvegicus
aactgaagggctaggtcgctgagaa

SEQ ID NO: 29708 - DNA, 25 bp, Rattus norvegicus
aactgaagggcttggtcgctgagaa

SEQ ID NO: 29709 - DNA, 25 bp, Rattus norvegicus
aactgaagtagcagtctgcctggac

SEQ ID NO: 29710 - DNA, 25 bp, Rattus norvegicus
aactgaagtagctgtctgcctggac

SEQ ID NO: 29711 - DNA, 25 bp, Rattus norvegicus
aactgaagtcttctgatctgtaaag

SEQ ID NO: 29712 - DNA, 25 bp, Rattus norvegicus
aactgaagtcttgtgatctgtaaag

SEQ ID NO: 29713 - DNA, 25 bp, Rattus norvegicus
aactgaagtgctatgtgtaccaata

SEQ ID NO: 29714 - DNA, 25 bp, Rattus norvegicus
aactgaagtgctttgtgtaccaata

SEQ ID NO: 29715 - DNA, 25 bp, Rattus norvegicus
aactgaagtggcctcttgctgtcaa

SEQ ID NO: 29716 - DNA, 25 bp, Rattus norvegicus
aactgaagtggcgtcttgctgtcaa

SEQ ID NO: 29717 - DNA, 25 bp, Rattus norvegicus
aactgaagtggtagagtatttctct

SEQ ID NO: 29718 - DNA, 25 bp, Rattus norvegicus
aactgaagtggttgagtatttctct

SEQ ID NO: 29719 - DNA, 25 bp, Rattus norvegicus
aactgaagttacagaggccgtgtca

SEQ ID NO: 29720 - DNA, 25 bp, Rattus norvegicus
aactgaagttactgaggccgtgtca

SEQ ID NO: 29721 - DNA, 25 bp, Rattus norvegicus
aactgaagttctcagggtgcttcct

SEQ ID NO: 29722 - DNA, 25 bp, Rattus norvegicus
aactgaagttctgagggtgcttcct

SEQ ID NO: 29723 - DNA, 25 bp, Rattus norvegicus
aactgaagttggatgcgccctacaa

SEQ ID NO: 29724 - DNA, 25 bp, Rattus norvegicus
aactgaagttggttgcgccctacaa

SEQ ID NO: 29725 - DNA, 25 bp, Rattus norvegicus
aactgaagttgtaagctctgtgaga

SEQ ID NO: 29726 - DNA, 25 bp, Rattus norvegicus
aactgaagttgttagctctgtgaga

SEQ ID NO: 29727 - DNA, 25 bp, Rattus norvegicus
aactgaatcagtatctcatgccggc

SEQ ID NO: 29728 - DNA, 25 bp, Rattus norvegicus
aactgaatcagtttctcatgccggc

SEQ ID NO: 29729 - DNA, 25 bp, Rattus norvegicus
aactgaatcggaagctgtagcccac

SEQ ID NO: 29730 - DNA, 25 bp, Rattus norvegicus
aactgaatcggaagctgtcggccca

SEQ ID NO: 29731 - DNA, 25 bp, Rattus norvegicus
aactgaatcggatgctgtagcccac

SEQ ID NO: 29732 - DNA, 25 bp, Rattus norvegicus
aactgaatcggatgctgtcggccca

SEQ ID NO: 29733 - DNA, 25 bp, Rattus norvegicus
aactgaatctacatgctgggttgca

SEQ ID NO: 29734 - DNA, 25 bp, Rattus norvegicus
aactgaatctacttgctgggttgca

SEQ ID NO: 29735 - DNA, 25 bp, Rattus norvegicus
aactgaatgactcgcctgttctcac

SEQ ID NO: 29736 - DNA, 25 bp, Rattus norvegicus
aactgaatgactggcctgttctcac

SEQ ID NO: 29737 - DNA, 25 bp, Rattus norvegicus
aactgaatgcacctgggaccgggct

SEQ ID NO: 29738 - DNA, 25 bp, Rattus norvegicus
aactgaatgcacgtgggaccgggct

SEQ ID NO: 29739 - DNA, 25 bp, Rattus norvegicus
aactgaatgcctcctgttgggaaag

SEQ ID NO: 29740 - DNA, 25 bp, Rattus norvegicus
aactgaatgcctgctgttgggaaag

SEQ ID NO: 29741 - DNA, 25 bp, Rattus norvegicus
aactgaatgtgtcgcttttcctaca

SEQ ID NO: 29742 - DNA, 25 bp, Rattus norvegicus
aactgaatgtgtggcttttcctaca

SEQ ID NO: 29743 - DNA, 25 bp, Rattus norvegicus
aactgaattctgagccaagagcccc

SEQ ID NO: 29744 - DNA, 25 bp, Rattus norvegicus
aactgaattctgtgccaagagcccc

SEQ ID NO: 29745 - DNA, 25 bp, Rattus norvegicus
aactgaatttgcaccagaaagtggt

SEQ ID NO: 29746 - DNA, 25 bp, Rattus norvegicus
aactgaatttgctccagaaagtggt

SEQ ID NO: 29747 - DNA, 25 bp, Rattus norvegicus
aactgaattttgataggcctcccga

SEQ ID NO: 29748 - DNA, 25 bp, Rattus norvegicus
aactgaattttgttaggcctcccga

SEQ ID NO: 29749 - DNA, 25 bp, Rattus norvegicus
aactgacaaactctgccatcgctga

SEQ ID NO: 29750 - DNA, 25 bp, Rattus norvegicus
aactgacaaactgtgccatcgctga

SEQ ID NO: 29751 - DNA, 25 bp, Rattus norvegicus
aactgacaacttaccttcaatcgcc

SEQ ID NO: 29752 - DNA, 25 bp, Rattus norvegicus
aactgacaactttccttcaatcgcc

SEQ ID NO: 29753 - DNA, 25 bp, Rattus norvegicus
aactgacacacgacaacttgttcct

SEQ ID NO: 29754 - DNA, 25 bp, Rattus norvegicus
aactgacacacgtcaacttgttcct

SEQ ID NO: 29755 - DNA, 25 bp, Rattus norvegicus
aactgacacccaagattgtcctctg

SEQ ID NO: 29756 - DNA, 25 bp, Rattus norvegicus
aactgacacccatgattgtcctctg

SEQ ID NO: 29757 - DNA, 25 bp, Rattus norvegicus
aactgacaccgcaggaaatcgttct

SEQ ID NO: 29758 - DNA, 25 bp, Rattus norvegicus
aactgacaccgctggaaatcgttct

SEQ ID NO: 29759 - DNA, 25 bp, Rattus norvegicus
aactgacactgaaaccaccatgtaa

SEQ ID NO: 29760 - DNA, 25 bp, Rattus norvegicus
aactgacactgataccaccatgtaa

SEQ ID NO: 29761 - DNA, 25 bp, Rattus norvegicus
aactgacactttacacactactaga

SEQ ID NO: 29762 - DNA, 25 bp, Rattus norvegicus
aactgacacttttcacactactaga

SEQ ID NO: 29763 - DNA, 25 bp, Rattus norvegicus
aactgacaggtcaggcatacaccta

SEQ ID NO: 29764 - DNA, 25 bp, Rattus norvegicus
aactgacaggtctggcatacaccta

SEQ ID NO: 29765 - DNA, 25 bp, Rattus norvegicus
aactgacatgccatggtgcagctgt

SEQ ID NO: 29766 - DNA, 25 bp, Rattus norvegicus
aactgacatgccttggtgcagctgt

SEQ ID NO: 29767 - DNA, 25 bp, Rattus norvegicus
aactgacattaacttctggatccaa

SEQ ID NO: 29768 - DNA, 25 bp, Rattus norvegicus
aactgacattaagttctggatccaa

SEQ ID NO: 29769 - DNA, 25 bp, Rattus norvegicus
aactgaccaaccctttgtgagcaaa

SEQ ID NO: 29770 - DNA, 25 bp, Rattus norvegicus
aactgaccaaccgtttgtgagcaaa

SEQ ID NO: 29771 - DNA, 25 bp, Rattus norvegicus
aactgaccaggcatgagtgtccaga

SEQ ID NO: 29772 - DNA, 25 bp, Rattus norvegicus
aactgaccaggcttgagtgtccaga

SEQ ID NO: 29773 - DNA, 25 bp, Rattus norvegicus
aactgaccagtgacaagaccccgga

SEQ ID NO: 29774 - DNA, 25 bp, Rattus norvegicus
aactgaccagtgtcaagaccccgga

SEQ ID NO: 29775 - DNA, 25 bp, Rattus norvegicus
aactgaccagttcttcagaacaccc

SEQ ID NO: 29776 - DNA, 25 bp, Rattus norvegicus
aactgaccagttgttcagaacaccc

SEQ ID NO: 29777 - DNA, 25 bp, Rattus norvegicus
aactgacccgataaccttgtggaga

SEQ ID NO: 29778 - DNA, 25 bp, Rattus norvegicus
aactgacccgattaccttgtggaga

SEQ ID NO: 29779 - DNA, 25 bp, Rattus norvegicus
aactgaccctagcttggatacttca

SEQ ID NO: 29780 - DNA, 25 bp, Rattus norvegicus
aactgaccctaggttggatacttca

SEQ ID NO: 29781 - DNA, 25 bp, Rattus norvegicus
aactgacccttccttctacaagtag

SEQ ID NO: 29782 - DNA, 25 bp, Rattus norvegicus
aactgacccttcgttctacaagtag

SEQ ID NO: 29783 - DNA, 25 bp, Rattus norvegicus
aactgaccgaaaaggccactgcgaa

SEQ ID NO: 29784 - DNA, 25 bp, Rattus norvegicus
aactgaccgaaatggccactgcgaa

SEQ ID NO: 29785 - DNA, 25 bp, Rattus norvegicus
aactgaccgctccagtgctgtgatt

SEQ ID NO: 29786 - DNA, 25 bp, Rattus norvegicus
aactgaccgctcgagtgctgtgatt

SEQ ID NO: 29787 - DNA, 25 bp, Rattus norvegicus
aactgaccgggcatgacgtcactgt

SEQ ID NO: 29788 - DNA, 25 bp, Rattus norvegicus
aactgaccgggcttgacgtcactgt

SEQ ID NO: 29789 - DNA, 25 bp, Rattus norvegicus
aactgacctctacacatgcaccatg

SEQ ID NO: 29790 - DNA, 25 bp, Rattus norvegicus
aactgacctctagacatgcaccatg

SEQ ID NO: 29791 - DNA, 25 bp, Rattus norvegicus
aactgaccttatagtctgcgggtgt

SEQ ID NO: 29792 - DNA, 25 bp, Rattus norvegicus
aactgaccttattgtctgcgggtgt

SEQ ID NO: 29793 - DNA, 25 bp, Rattus norvegicus
aactgaccttccagatactcaagag

SEQ ID NO: 29794 - DNA, 25 bp, Rattus norvegicus
aactgaccttcctgatactcaagag

SEQ ID NO: 29795 - DNA, 25 bp, Rattus norvegicus
aactgacgcagtatataccatgaac

SEQ ID NO: 29796 - DNA, 25 bp, Rattus norvegicus
aactgacgcagtttataccatgaac

SEQ ID NO: 29797 - DNA, 25 bp, Rattus norvegicus
aactgacgctgcaggagcccaggga

SEQ ID NO: 29798 - DNA, 25 bp, Rattus norvegicus
aactgacgctgctggagcccaggga

SEQ ID NO: 29799 - DNA, 25 bp, Rattus norvegicus
aactgacggccaccagacagtcctt

SEQ ID NO: 29800 - DNA, 25 bp, Rattus norvegicus
aactgacggccagcagacagtcctt

SEQ ID NO: 29801 - DNA, 25 bp, Rattus norvegicus
aactgacgggatcagcctgcagctc

SEQ ID NO: 29802 - DNA, 25 bp, Rattus norvegicus
aactgacgggatgagcctgcagctc

SEQ ID NO: 29803 - DNA, 25 bp, Rattus norvegicus
aactgacgtctacgttcctgggtgg

SEQ ID NO: 29804 - DNA, 25 bp, Rattus norvegicus
aactgacgtctaggttcctgggtgg

SEQ ID NO: 29805 - DNA, 25 bp, Rattus norvegicus
aactgacgttataccgtgtgccttt

SEQ ID NO: 29806 - DNA, 25 bp, Rattus norvegicus
aactgacgttattccgtgtgccttt

SEQ ID NO: 29807 - DNA, 25 bp, Rattus norvegicus
aactgactacttaccatgagctgca

SEQ ID NO: 29808 - DNA, 25 bp, Rattus norvegicus
aactgactactttccatgagctgca

SEQ ID NO: 29809 - DNA, 25 bp, Rattus norvegicus
aactgactcatgagggttttccctc

SEQ ID NO: 29810 - DNA, 25 bp, Rattus norvegicus
aactgactcatgtgggttttccctc

SEQ ID NO: 29811 - DNA, 25 bp, Rattus norvegicus
aactgactcgtcctcattaacagtc

SEQ ID NO: 29812 - DNA, 25 bp, Rattus norvegicus
aactgactcgtcgtcattaacagtc

SEQ ID NO: 29813 - DNA, 25 bp, Rattus norvegicus
aactgactgaaaacagccgggactg

SEQ ID NO: 29814 - DNA, 25 bp, Rattus norvegicus
aactgactgaaatcagccgggactg

SEQ ID NO: 29815 - DNA, 25 bp, Rattus norvegicus
aactgactgaataccctagcgagta

SEQ ID NO: 29816 - DNA, 25 bp, Rattus norvegicus
aactgactgaattccctagcgagta

SEQ ID NO: 29817 - DNA, 25 bp, Rattus norvegicus
aactgactgcaacgtggtgtccaac

SEQ ID NO: 29818 - DNA, 25 bp, Rattus norvegicus
aactgactgcaaggtggtgtccaac

SEQ ID NO: 29819 - DNA, 25 bp, Rattus norvegicus
aactgactgcagagggtgactatgg

SEQ ID NO: 29820 - DNA, 25 bp, Rattus norvegicus
aactgactgcagcttgctctgtgga

SEQ ID NO: 29821 - DNA, 25 bp, Rattus norvegicus
aactgactgcaggttgctctgtgga

SEQ ID NO: 29822 - DNA, 25 bp, Rattus norvegicus
aactgactgcagtgggtgactatgg

SEQ ID NO: 29823 - DNA, 25 bp, Rattus norvegicus
aactgactgccaacagcaggctgca

SEQ ID NO: 29824 - DNA, 25 bp, Rattus norvegicus
aactgactgccatcagcaggctgca

SEQ ID NO: 29825 - DNA, 25 bp, Rattus norvegicus
aactgactgtaaccctgtctctgtg

SEQ ID NO: 29826 - DNA, 25 bp, Rattus norvegicus
aactgactgtaagcctgtctctgtg

SEQ ID NO: 29827 - DNA, 25 bp, Rattus norvegicus
aactgacttatgaagtattcctatt

SEQ ID NO: 29828 - DNA, 25 bp, Rattus norvegicus
aactgacttatgtagtattcctatt

SEQ ID NO: 29829 - DNA, 25 bp, Rattus norvegicus
aactgacttccaaactatattctcc

SEQ ID NO: 29830 - DNA, 25 bp, Rattus norvegicus
aactgacttccatactatattctcc

SEQ ID NO: 29831 - DNA, 25 bp, Rattus norvegicus
aactgacttcttctaaaacactgga

SEQ ID NO: 29832 - DNA, 25 bp, Rattus norvegicus
aactgacttcttgtaaaacactgga

SEQ ID NO: 29833 - DNA, 25 bp, Rattus norvegicus
aactgacttgtcagggtttgcctgg

SEQ ID NO: 29834 - DNA, 25 bp, Rattus norvegicus
aactgacttgtctgggtttgcctgg

SEQ ID NO: 29835 - DNA, 25 bp, Rattus norvegicus
aactgacttttacatgggattcttt

SEQ ID NO: 29836 - DNA, 25 bp, Rattus norvegicus
aactgacttttagatgggattcttt

SEQ ID NO: 29837 - DNA, 25 bp, Rattus norvegicus
aactgacttttcaaggctccactta

SEQ ID NO: 29838 - DNA, 25 bp, Rattus norvegicus
aactgacttttctaggctccactta

SEQ ID NO: 29839 - DNA, 25 bp, Rattus norvegicus
aactgagaacgcagaggagtagatc

SEQ ID NO: 29840 - DNA, 25 bp, Rattus norvegicus
aactgagaacgctgaggagtagatc

SEQ ID NO: 29841 - DNA, 25 bp, Rattus norvegicus
aactgagacaagatcattctggctt

SEQ ID NO: 29842 - DNA, 25 bp, Rattus norvegicus
aactgagacaagttcattctggctt

SEQ ID NO: 29843 - DNA, 25 bp, Rattus norvegicus
aactgagacaatacactctggctgt

SEQ ID NO: 29844 - DNA, 25 bp, Rattus norvegicus
aactgagacaattcactctggctgt

SEQ ID NO: 29845 - DNA, 25 bp, Rattus norvegicus
aactgagacagcacgggacggcgta

SEQ ID NO: 29846 - DNA, 25 bp, Rattus norvegicus
aactgagacagctcgggacggcgta

SEQ ID NO: 29847 - DNA, 25 bp, Rattus norvegicus
aactgagacatcattctgagaagca

SEQ ID NO: 29848 - DNA, 25 bp, Rattus norvegicus
aactgagacatctttctgagaagca

SEQ ID NO: 29849 - DNA, 25 bp, Rattus norvegicus
aactgagacctacgtcaaccagagt

SEQ ID NO: 29850 - DNA, 25 bp, Rattus norvegicus
aactgagacctaggtcaaccagagt

SEQ ID NO: 29851 - DNA, 25 bp, Rattus norvegicus
aactgagactgcctttttcacaaag

SEQ ID NO: 29852 - DNA, 25 bp, Rattus norvegicus
aactgagactgcgtttttcacaaag

SEQ ID NO: 29853 - DNA, 25 bp, Rattus norvegicus
aactgagagccacagttcctgtgtg

SEQ ID NO: 29854 - DNA, 25 bp, Rattus norvegicus
aactgagagccagagttcctgtgtg

SEQ ID NO: 29855 - DNA, 25 bp, Rattus norvegicus
aactgagaggccactttgacaccgt

SEQ ID NO: 29856 - DNA, 25 bp, Rattus norvegicus
aactgagaggcctctttgacaccgt

SEQ ID NO: 29857 - DNA, 25 bp, Rattus norvegicus
aactgagagtcaagcgttctgttaa

SEQ ID NO: 29858 - DNA, 25 bp, Rattus norvegicus
aactgagagtcatgcgttctgttaa

SEQ ID NO: 29859 - DNA, 25 bp, Rattus norvegicus
aactgagagtttctaggcggccctg

SEQ ID NO: 29860 - DNA, 25 bp, Rattus norvegicus
aactgagagtttgtaggcggccctg

SEQ ID NO: 29861 - DNA, 25 bp, Rattus norvegicus
aactgagatccgaggcttttggcct

SEQ ID NO: 29862 - DNA, 25 bp, Rattus norvegicus
aactgagatccgtggcttttggcct

SEQ ID NO: 29863 - DNA, 25 bp, Rattus norvegicus
aactgagatgctactgggtgaggct

SEQ ID NO: 29864 - DNA, 25 bp, Rattus norvegicus
aactgagatgcttctgggtgaggct

SEQ ID NO: 29865 - DNA, 25 bp, Rattus norvegicus
aactgagattgacactgctgcctct

SEQ ID NO: 29866 - DNA, 25 bp, Rattus norvegicus
aactgagattgagactgctgcctct

SEQ ID NO: 29867 - DNA, 25 bp, Rattus norvegicus
aactgagattgcaggagagccgcct

SEQ ID NO: 29868 - DNA, 25 bp, Rattus norvegicus
aactgagattgcattcttctgtgga

SEQ ID NO: 29869 - DNA, 25 bp, Rattus norvegicus
aactgagattgctggagagccgcct

SEQ ID NO: 29870 - DNA, 25 bp, Rattus norvegicus
aactgagattgctttcttctgtgga

SEQ ID NO: 29871 - DNA, 25 bp, Rattus norvegicus
aactgagcacagagcgcgtcctcca

SEQ ID NO: 29872 - DNA, 25 bp, Rattus norvegicus
aactgagcacagtgcgcgtcctcca

SEQ ID NO: 29873 - DNA, 25 bp, Rattus norvegicus
aactgagcaccaagaggctgagcct

SEQ ID NO: 29874 - DNA, 25 bp, Rattus norvegicus
aactgagcaccatgaggctgagcct

SEQ ID NO: 29875 - DNA, 25 bp, Rattus norvegicus
aactgagcagtgcattctcctgtga

SEQ ID NO: 29876 - DNA, 25 bp, Rattus norvegicus
aactgagcagtggattctcctgtga

SEQ ID NO: 29877 - DNA, 25 bp, Rattus norvegicus
aactgagcccaaacctctacaagag

SEQ ID NO: 29878 - DNA, 25 bp, Rattus norvegicus
aactgagcccaatcctctacaagag

SEQ ID NO: 29879 - DNA, 25 bp, Rattus norvegicus
aactgagcctctcagctagatttaa

SEQ ID NO: 29880 - DNA, 25 bp, Rattus norvegicus
aactgagcctctgagctagatttaa

SEQ ID NO: 29881 - DNA, 25 bp, Rattus norvegicus
aactgagcctgactgggctctgcca

SEQ ID NO: 29882 - DNA, 25 bp, Rattus norvegicus
aactgagcctgagtgggctctgcca

SEQ ID NO: 29883 - DNA, 25 bp, Rattus norvegicus
aactgagcgcaaacttgacatggat

SEQ ID NO: 29884 - DNA, 25 bp, Rattus norvegicus
aactgagcgcaaccctgggttaaat

SEQ ID NO: 29885 - DNA, 25 bp, Rattus norvegicus
aactgagcgcaagcctgggttaaat

SEQ ID NO: 29886 - DNA, 25 bp, Rattus norvegicus
aactgagcgcaatcttgacatggat

SEQ ID NO: 29887 - DNA, 25 bp, Rattus norvegicus
aactgagcgccaattccatgttgta

SEQ ID NO: 29888 - DNA, 25 bp, Rattus norvegicus
aactgagcgccatttccatgttgta

SEQ ID NO: 29889 - DNA, 25 bp, Rattus norvegicus
aactgagctgcaaagaaggttctga

SEQ ID NO: 29890 - DNA, 25 bp, Rattus norvegicus
aactgagctgcatagaaggttctga

SEQ ID NO: 29891 - DNA, 25 bp, Rattus norvegicus
aactgagctgcgaacgtgtgtctcc

SEQ ID NO: 29892 - DNA, 25 bp, Rattus norvegicus
aactgagctgcgtacgtgtgtctcc

SEQ ID NO: 29893 - DNA, 25 bp, Rattus norvegicus
aactgagctgctccaggtgtcccag

SEQ ID NO: 29894 - DNA, 25 bp, Rattus norvegicus
aactgagctgctgcaggtgtcccag

SEQ ID NO: 29895 - DNA, 25 bp, Rattus norvegicus
aactgagctgttacaatgttactgt

SEQ ID NO: 29896 - DNA, 25 bp, Rattus norvegicus
aactgagctgtttcaatgttactgt

SEQ ID NO: 29897 - DNA, 25 bp, Rattus norvegicus
aactgaggaaatactcccatttggg

SEQ ID NO: 29898 - DNA, 25 bp, Rattus norvegicus
aactgaggaaattctcccatttggg

SEQ ID NO: 29899 - DNA, 25 bp, Rattus norvegicus
aactgaggaagcactgcctcgctta

SEQ ID NO: 29900 - DNA, 25 bp, Rattus norvegicus
aactgaggaagctctgcctcgctta

SEQ ID NO: 29901 - DNA, 25 bp, Rattus norvegicus
aactgaggatgcaactccagcagct

SEQ ID NO: 29902 - DNA, 25 bp, Rattus norvegicus
aactgaggatgctactccagcagct

SEQ ID NO: 29903 - DNA, 25 bp, Rattus norvegicus
aactgaggcagacgtcccatgcgca

SEQ ID NO: 29904 - DNA, 25 bp, Rattus norvegicus
aactgaggcagaggtcccatgcgca

SEQ ID NO: 29905 - DNA, 25 bp, Rattus norvegicus
aactgaggccatctagttttcccta

SEQ ID NO: 29906 - DNA, 25 bp, Rattus norvegicus
aactgaggccatgtagttttcccta

SEQ ID NO: 29907 - DNA, 25 bp, Rattus norvegicus
aactgaggccccaagtgacaggacc

SEQ ID NO: 29908 - DNA, 25 bp, Rattus norvegicus
aactgaggcccctagtgacaggacc

SEQ ID NO: 29909 - DNA, 25 bp, Rattus norvegicus
aactgaggcctgaggcatggcagtc

SEQ ID NO: 29910 - DNA, 25 bp, Rattus norvegicus
aactgaggcctgtggcatggcagtc

SEQ ID NO: 29911 - DNA, 25 bp, Rattus norvegicus
aactgaggctcaagacagctccttg

SEQ ID NO: 29912 - DNA, 25 bp, Rattus norvegicus
aactgaggctcatgacagctccttg

SEQ ID NO: 29913 - DNA, 25 bp, Rattus norvegicus
aactgaggctgaccactgtgggctt

SEQ ID NO: 29914 - DNA, 25 bp, Rattus norvegicus
aactgaggctgagcactgtgggctt

SEQ ID NO: 29915 - DNA, 25 bp, Rattus norvegicus
aactgaggctgtctgggatgaccaa

SEQ ID NO: 29916 - DNA, 25 bp, Rattus norvegicus
aactgaggctgtgtgggatgaccaa

SEQ ID NO: 29917 - DNA, 25 bp, Rattus norvegicus
aactgagggaggcaggagcgttgaa

SEQ ID NO: 29918 - DNA, 25 bp, Rattus norvegicus
aactgagggagggaggagcgttgaa

SEQ ID NO: 29919 - DNA, 25 bp, Rattus norvegicus
aactgagggctaagttcctggaggt

SEQ ID NO: 29920 - DNA, 25 bp, Rattus norvegicus
aactgagggctatgttcctggaggt

SEQ ID NO: 29921 - DNA, 25 bp, Rattus norvegicus
aactgagggtctcttggttcaaact

SEQ ID NO: 29922 - DNA, 25 bp, Rattus norvegicus
aactgagggtctgttggttcaaact

SEQ ID NO: 29923 - DNA, 25 bp, Rattus norvegicus
aactgagggttgctgcatcctccct

SEQ ID NO: 29924 - DNA, 25 bp, Rattus norvegicus
aactgagggttggtgcatcctccct

SEQ ID NO: 29925 - DNA, 25 bp, Rattus norvegicus
aactgaggtaggagcagcatcccct

SEQ ID NO: 29926 - DNA, 25 bp, Rattus norvegicus
aactgaggtaggtgcagcatcccct

SEQ ID NO: 29927 - DNA, 25 bp, Rattus norvegicus
aactgaggtcctccgtgttggtcaa

SEQ ID NO: 29928 - DNA, 25 bp, Rattus norvegicus
aactgaggtcctgcgtgttggtcaa

SEQ ID NO: 29929 - DNA, 25 bp, Rattus norvegicus
aactgaggtctgatcctttaggatg

SEQ ID NO: 29930 - DNA, 25 bp, Rattus norvegicus
aactgaggtctgttcctttaggatg

SEQ ID NO: 29931 - DNA, 25 bp, Rattus norvegicus
aactgaggtgacattctctgccaat

SEQ ID NO: 29932 - DNA, 25 bp, Rattus norvegicus
aactgaggtgactttctctgccaat

SEQ ID NO: 29933 - DNA, 25 bp, Rattus norvegicus
aactgaggtggcaaagtgcttccaa

SEQ ID NO: 29934 - DNA, 25 bp, Rattus norvegicus
aactgaggtggctaagtgcttccaa

SEQ ID NO: 29935 - DNA, 25 bp, Rattus norvegicus
aactgagtcctcagggtactggcta

SEQ ID NO: 29936 - DNA, 25 bp, Rattus norvegicus
aactgagtcctctgggtactggcta

SEQ ID NO: 29937 - DNA, 25 bp, Rattus norvegicus
aactgagtcctgaaatgttctgtag

SEQ ID NO: 29938 - DNA, 25 bp, Rattus norvegicus
aactgagtcctgtaatgttctgtag

SEQ ID NO: 29939 - DNA, 25 bp, Rattus norvegicus
aactgagtcttgatgatgtacatag

SEQ ID NO: 29940 - DNA, 25 bp, Rattus norvegicus
aactgagtcttgttgatgtacatag

SEQ ID NO: 29941 - DNA, 25 bp, Rattus norvegicus
aactgagtctttacacacattgtga

SEQ ID NO: 29942 - DNA, 25 bp, Rattus norvegicus
aactgagtcttttcacacattgtga

SEQ ID NO: 29943 - DNA, 25 bp, Rattus norvegicus
aactgagtgaatccctgcttgatcc

SEQ ID NO: 29944 - DNA, 25 bp, Rattus norvegicus
aactgagtgaatgcctgcttgatcc

SEQ ID NO: 29945 - DNA, 25 bp, Rattus norvegicus
aactgagtgagtcaccctggcgaga

SEQ ID NO: 29946 - DNA, 25 bp, Rattus norvegicus
aactgagtgagtgaccctggcgaga

SEQ ID NO: 29947 - DNA, 25 bp, Rattus norvegicus
aactgagtgataatcgtgctgtggt

SEQ ID NO: 29948 - DNA, 25 bp, Rattus norvegicus
aactgagtgatattcgtgctgtggt

SEQ ID NO: 29949 - DNA, 25 bp, Rattus norvegicus
aactgagtgcttcttgcttccgttt

SEQ ID NO: 29950 - DNA, 25 bp, Rattus norvegicus
aactgagtgcttgttgcttccgttt

SEQ ID NO: 29951 - DNA, 25 bp, Rattus norvegicus
aactgagtgggcacaccactgtatt

SEQ ID NO: 29952 - DNA, 25 bp, Rattus norvegicus
aactgagtgggctcaccactgtatt

SEQ ID NO: 29953 - DNA, 25 bp, Rattus norvegicus
aactgagtgtgcatgttggtgctct

SEQ ID NO: 29954 - DNA, 25 bp, Rattus norvegicus
aactgagtgtgcttgttggtgctct

SEQ ID NO: 29955 - DNA, 25 bp, Rattus norvegicus
aactgagtgttcattctgggtacca

SEQ ID NO: 29956 - DNA, 25 bp, Rattus norvegicus
aactgagtgttctttctgggtacca

SEQ ID NO: 29957 - DNA, 25 bp, Rattus norvegicus
aactgagttcaccagaggttgacac

SEQ ID NO: 29958 - DNA, 25 bp, Rattus norvegicus
aactgagttcacgagaggttgacac

SEQ ID NO: 29959 - DNA, 25 bp, Rattus norvegicus
aactgagttctgagagttatcctct

SEQ ID NO: 29960 - DNA, 25 bp, Rattus norvegicus
aactgagttctgtgagttatcctct

SEQ ID NO: 29961 - DNA, 25 bp, Rattus norvegicus
aactgataattgagctctggccctt

SEQ ID NO: 29962 - DNA, 25 bp, Rattus norvegicus
aactgataattgtgctctggccctt

SEQ ID NO: 29963 - DNA, 25 bp, Rattus norvegicus
aactgatatattatcctccctaact

SEQ ID NO: 29964 - DNA, 25 bp, Rattus norvegicus
aactgatatattttcctccctaact

SEQ ID NO: 29965 - DNA, 25 bp, Rattus norvegicus
aactgatattctcaaagccaccata

SEQ ID NO: 29966 - DNA, 25 bp, Rattus norvegicus
aactgatattctgaaagccaccata

SEQ ID NO: 29967 - DNA, 25 bp, Rattus norvegicus
aactgatccgtccttgaagtcacca

SEQ ID NO: 29968 - DNA, 25 bp, Rattus norvegicus
aactgatccgtcgttgaagtcacca

SEQ ID NO: 29969 - DNA, 25 bp, Rattus norvegicus
aactgatcctgcagtgtactgccat

SEQ ID NO: 29970 - DNA, 25 bp, Rattus norvegicus
aactgatcctgctgtgtactgccat

SEQ ID NO: 29971 - DNA, 25 bp, Rattus norvegicus
aactgatccttacgctggtgcacaa

SEQ ID NO: 29972 - DNA, 25 bp, Rattus norvegicus
aactgatccttaggctggtgcacaa

SEQ ID NO: 29973 - DNA, 25 bp, Rattus norvegicus
aactgatcgccaccctttatcataa

SEQ ID NO: 29974 - DNA, 25 bp, Rattus norvegicus
aactgatcgccagcctttatcataa

SEQ ID NO: 29975 - DNA, 25 bp, Rattus norvegicus
aactgatctcggaggtcaggctgca

SEQ ID NO: 29976 - DNA, 25 bp, Rattus norvegicus
aactgatctcggtggtcaggctgca

SEQ ID NO: 29977 - DNA, 25 bp, Rattus norvegicus
aactgatcttggctttcactcttgg

SEQ ID NO: 29978 - DNA, 25 bp, Rattus norvegicus
aactgatcttgggtttcactcttgg

SEQ ID NO: 29979 - DNA, 25 bp, Rattus norvegicus
aactgatgcccacgcaacagaacgc

SEQ ID NO: 29980 - DNA, 25 bp, Rattus norvegicus
aactgatgcccaggcaacagaacgc

SEQ ID NO: 29981 - DNA, 25 bp, Rattus norvegicus
aactgatgccttctttcctcctttt

SEQ ID NO: 29982 - DNA, 25 bp, Rattus norvegicus
aactgatgccttgtttcctcctttt

SEQ ID NO: 29983 - DNA, 25 bp, Rattus norvegicus
aactgatggagcaaggatctgcttt

SEQ ID NO: 29984 - DNA, 25 bp, Rattus norvegicus
aactgatggagctaggatctgcttt

SEQ ID NO: 29985 - DNA, 25 bp, Rattus norvegicus
aactgatggcctcttggtgctgcta

SEQ ID NO: 29986 - DNA, 25 bp, Rattus norvegicus
aactgatggcctgttggtgctgcta

SEQ ID NO: 29987 - DNA, 25 bp, Rattus norvegicus
aactgatgtcaccacacagatgaaa

SEQ ID NO: 29988 - DNA, 25 bp, Rattus norvegicus
aactgatgtcacgacacagatgaaa

SEQ ID NO: 29989 - DNA, 25 bp, Rattus norvegicus
aactgatgtcctcgtgggcctgatg

SEQ ID NO: 29990 - DNA, 25 bp, Rattus norvegicus
aactgatgtcctggtgggcctgatg

SEQ ID NO: 29991 - DNA, 25 bp, Rattus norvegicus
aactgatgtgcaattttggttttgt

SEQ ID NO: 29992 - DNA, 25 bp, Rattus norvegicus
aactgatgtgcatttttggttttgt

SEQ ID NO: 29993 - DNA, 25 bp, Rattus norvegicus
aactgattcaggctcatacctgtaa

SEQ ID NO: 29994 - DNA, 25 bp, Rattus norvegicus
aactgattcagggtcatacctgtaa

SEQ ID NO: 29995 - DNA, 25 bp, Rattus norvegicus
aactgattccaactgatgatcttag

SEQ ID NO: 29996 - DNA, 25 bp, Rattus norvegicus
aactgattccaagtgatgatcttag

SEQ ID NO: 29997 - DNA, 25 bp, Rattus norvegicus
aactgattctggaggtggctgaacc

SEQ ID NO: 29998 - DNA, 25 bp, Rattus norvegicus
aactgattctggtggtggctgaacc

SEQ ID NO: 29999 - DNA, 25 bp, Rattus norvegicus
aactgattgaccaacattgtctcaa

SEQ ID NO: 30000 - DNA, 25 bp, Rattus norvegicus
aactgattgacctacattgtctcaa

SEQ ID NO: 30001 - DNA, 25 bp, Rattus norvegicus
aactgattgattattctctctggat

SEQ ID NO: 30002 - DNA, 25 bp, Rattus norvegicus
aactgattgatttttctctctggat

SEQ ID NO: 30003 - DNA, 25 bp, Rattus norvegicus
aactgattgctgaccttgttagaag

SEQ ID NO: 30004 - DNA, 25 bp, Rattus norvegicus
aactgattgctgtccttgttagaag

SEQ ID NO: 30005 - DNA, 25 bp, Rattus norvegicus
aactgattgcttcctccacctcttg

SEQ ID NO: 30006 - DNA, 25 bp, Rattus norvegicus
aactgattgcttgctccacctcttg

SEQ ID NO: 30007 - DNA, 25 bp, Rattus norvegicus
aactgattggtactcacagcttcat

SEQ ID NO: 30008 - DNA, 25 bp, Rattus norvegicus
aactgattggtagtcacagcttcat

SEQ ID NO: 30009 - DNA, 25 bp, Rattus norvegicus
aactgatttcatctcctatgcaagt

SEQ ID NO: 30010 - DNA, 25 bp, Rattus norvegicus
aactgatttcatgtcctatgcaagt

SEQ ID NO: 30011 - DNA, 25 bp, Rattus norvegicus
aactgatttgagagtattttatcca

SEQ ID NO: 30012 - DNA, 25 bp, Rattus norvegicus
aactgatttgagtgtattttatcca

SEQ ID NO: 30013 - DNA, 25 bp, Rattus norvegicus
aactgattttaaactactgcaggag

SEQ ID NO: 30014 - DNA, 25 bp, Rattus norvegicus
aactgattttaatctactgcaggag

SEQ ID NO: 30015 - DNA, 25 bp, Rattus norvegicus
aactgatttttcctgttcaatgtga

SEQ ID NO: 30016 - DNA, 25 bp, Rattus norvegicus
aactgatttttcgtgttcaatgtga

SEQ ID NO: 30017 - DNA, 25 bp, Rattus norvegicus
aactgatttttgacttgttgccggt

SEQ ID NO: 30018 - DNA, 25 bp, Rattus norvegicus
aactgatttttgtcttgttgccggt

SEQ ID NO: 30019 - DNA, 25 bp, Rattus norvegicus
aactgcaaaagcattgccgggtgct

SEQ ID NO: 30020 - DNA, 25 bp, Rattus norvegicus
aactgcaaaagctttgccgggtgct

SEQ ID NO: 30021 - DNA, 25 bp, Rattus norvegicus
aactgcaaacttaccaccgagatgc

SEQ ID NO: 30022 - DNA, 25 bp, Rattus norvegicus
aactgcaaactttccaccgagatgc

SEQ ID NO: 30023 - DNA, 25 bp, Rattus norvegicus
aactgcaaagcacctttggcttccg

SEQ ID NO: 30024 - DNA, 25 bp, Rattus norvegicus
aactgcaaagcagctttggcttccg

SEQ ID NO: 30025 - DNA, 25 bp, Rattus norvegicus
aactgcaacagacctggcggtagcc

SEQ ID NO: 30026 - DNA, 25 bp, Rattus norvegicus
aactgcaacagagctggcggtagcc

SEQ ID NO: 30027 - DNA, 25 bp, Rattus norvegicus
aactgcaactgcatgttagacgagg

SEQ ID NO: 30028 - DNA, 25 bp, Rattus norvegicus
aactgcaactgcttgttagacgagg

SEQ ID NO: 30029 - DNA, 25 bp, Rattus norvegicus
aactgcaactttactactgagtgtt

SEQ ID NO: 30030 - DNA, 25 bp, Rattus norvegicus
aactgcaacttttctactgagtgtt

SEQ ID NO: 30031 - DNA, 25 bp, Rattus norvegicus
aactgcaaggagattggcctatcta

SEQ ID NO: 30032 - DNA, 25 bp, Rattus norvegicus
aactgcaaggagtttggcctatcta

SEQ ID NO: 30033 - DNA, 25 bp, Rattus norvegicus
aactgcaattccaaagcttctaacc

SEQ ID NO: 30034 - DNA, 25 bp, Rattus norvegicus
aactgcaattcctaagcttctaacc

SEQ ID NO: 30035 - DNA, 25 bp, Rattus norvegicus
aactgcacagccaggacccacggag

SEQ ID NO: 30036 - DNA, 25 bp, Rattus norvegicus
aactgcacagcctggacccacggag

SEQ ID NO: 30037 - DNA, 25 bp, Rattus norvegicus
aactgcacaggcacaggcttgctga

SEQ ID NO: 30038 - DNA, 25 bp, Rattus norvegicus
aactgcacaggctcaggcttgctga

SEQ ID NO: 30039 - DNA, 25 bp, Rattus norvegicus
aactgcacagggaggtgggtccttt

SEQ ID NO: 30040 - DNA, 25 bp, Rattus norvegicus
aactgcacagggtggtgggtccttt

SEQ ID NO: 30041 - DNA, 25 bp, Rattus norvegicus
aactgcacagtgctttgtactgtca

SEQ ID NO: 30042 - DNA, 25 bp, Rattus norvegicus
aactgcacagtggtttgtactgtca

SEQ ID NO: 30043 - DNA, 25 bp, Rattus norvegicus
aactgcacatgtctgtacctgccag

SEQ ID NO: 30044 - DNA, 25 bp, Rattus norvegicus
aactgcacatgtgtgtacctgccag

SEQ ID NO: 30045 - DNA, 25 bp, Rattus norvegicus
aactgcaccaagcttctcgtgtggc

SEQ ID NO: 30046 - DNA, 25 bp, Rattus norvegicus
aactgcaccaaggttctcgtgtggc

SEQ ID NO: 30047 - DNA, 25 bp, Rattus norvegicus
aactgcacccagagttggcctgcta

SEQ ID NO: 30048 - DNA, 25 bp, Rattus norvegicus
aactgcacccagtgttggcctgcta

SEQ ID NO: 30049 - DNA, 25 bp, Rattus norvegicus
aactgcaccctgataatctcctatc

SEQ ID NO: 30050 - DNA, 25 bp, Rattus norvegicus
aactgcaccctgttaatctcctatc

SEQ ID NO: 30051 - DNA, 25 bp, Rattus norvegicus
aactgcacccttcattgcttctgac

SEQ ID NO: 30052 - DNA, 25 bp, Rattus norvegicus
aactgcacccttgattgcttctgac

SEQ ID NO: 30053 - DNA, 25 bp, Rattus norvegicus
aactgcaccgttatgtttagtcgag

SEQ ID NO: 30054 - DNA, 25 bp, Rattus norvegicus
aactgcaccgttttgtttagtcgag

SEQ ID NO: 30055 - DNA, 25 bp, Rattus norvegicus
aactgcaccttactttgttctgatc

SEQ ID NO: 30056 - DNA, 25 bp, Rattus norvegicus
aactgcaccttagtttgttctgatc

SEQ ID NO: 30057 - DNA, 25 bp, Rattus norvegicus
aactgcacggaaaaccatcttccta

SEQ ID NO: 30058 - DNA, 25 bp, Rattus norvegicus
aactgcacggaataccatcttccta

SEQ ID NO: 30059 - DNA, 25 bp, Rattus norvegicus
aactgcactctaaacccatacaatt

SEQ ID NO: 30060 - DNA, 25 bp, Rattus norvegicus
aactgcactctatacccatacaatt

SEQ ID NO: 30061 - DNA, 25 bp, Rattus norvegicus
aactgcactggacacatctgagggt

SEQ ID NO: 30062 - DNA, 25 bp, Rattus norvegicus
aactgcactggagacatctgagggt

SEQ ID NO: 30063 - DNA, 25 bp, Rattus norvegicus
aactgcactgtcaatgtgtgactga

SEQ ID NO: 30064 - DNA, 25 bp, Rattus norvegicus
aactgcactgtctatgtgtgactga

SEQ ID NO: 30065 - DNA, 25 bp, Rattus norvegicus
aactgcactttgctttcagacttta

SEQ ID NO: 30066 - DNA, 25 bp, Rattus norvegicus
aactgcactttggtttcagacttta

SEQ ID NO: 30067 - DNA, 25 bp, Rattus norvegicus
aactgcagacccagcttttgttttt

SEQ ID NO: 30068 - DNA, 25 bp, Rattus norvegicus
aactgcagaccctgcttttgttttt

SEQ ID NO: 30069 - DNA, 25 bp, Rattus norvegicus
aactgcagagcactgggcgccacag

SEQ ID NO: 30070 - DNA, 25 bp, Rattus norvegicus
aactgcagagcagtgggcgccacag

SEQ ID NO: 30071 - DNA, 25 bp, Rattus norvegicus
aactgcagagctctgtctctagcca

SEQ ID NO: 30072 - DNA, 25 bp, Rattus norvegicus
aactgcagagctgtgtctctagcca

SEQ ID NO: 30073 - DNA, 25 bp, Rattus norvegicus
aactgcagagttccacagaggactg

SEQ ID NO: 30074 - DNA, 25 bp, Rattus norvegicus
aactgcagagttgcacagaggactg

SEQ ID NO: 30075 - DNA, 25 bp, Rattus norvegicus
aactgcagattgaagccttccagga

SEQ ID NO: 30076 - DNA, 25 bp, Rattus norvegicus
aactgcagattgtagccttccagga

SEQ ID NO: 30077 - DNA, 25 bp, Rattus norvegicus
aactgcagcatgagccggccaacag

SEQ ID NO: 30078 - DNA, 25 bp, Rattus norvegicus
aactgcagcatgtgccggccaacag

SEQ ID NO: 30079 - DNA, 25 bp, Rattus norvegicus
aactgcagcctgagctagggtctgg

SEQ ID NO: 30080 - DNA, 25 bp, Rattus norvegicus
aactgcagcctgtgctagggtctgg

SEQ ID NO: 30081 - DNA, 25 bp, Rattus norvegicus
aactgcagccttagtagagtgccaa

SEQ ID NO: 30082 - DNA, 25 bp, Rattus norvegicus
aactgcagccttagttgaaggaact

SEQ ID NO: 30083 - DNA, 25 bp, Rattus norvegicus
aactgcagcctttgtagagtgccaa

SEQ ID NO: 30084 - DNA, 25 bp, Rattus norvegicus
aactgcagcctttgttgaaggaact

SEQ ID NO: 30085 - DNA, 25 bp, Rattus norvegicus
aactgcagcgccagtctgcgggagc

SEQ ID NO: 30086 - DNA, 25 bp, Rattus norvegicus
aactgcagcgcctgtctgcgggagc

SEQ ID NO: 30087 - DNA, 25 bp, Rattus norvegicus
aactgcaggagacgtgaccctacaa

SEQ ID NO: 30088 - DNA, 25 bp, Rattus norvegicus
aactgcaggagaggtgaccctacaa

SEQ ID NO: 30089 - DNA, 25 bp, Rattus norvegicus
aactgcaggagcagcttcggcgctg

SEQ ID NO: 30090 - DNA, 25 bp, Rattus norvegicus
aactgcaggagctgcttcggcgctg

SEQ ID NO: 30091 - DNA, 25 bp, Rattus norvegicus
aactgcaggagtatagccagaagtt

SEQ ID NO: 30092 - DNA, 25 bp, Rattus norvegicus
aactgcaggagtttagccagaagtt

SEQ ID NO: 30093 - DNA, 25 bp, Rattus norvegicus
aactgcaggctcaagcaaaggatgc

SEQ ID NO: 30094 - DNA, 25 bp, Rattus norvegicus
aactgcaggctctagcaaaggatgc

SEQ ID NO: 30095 - DNA, 25 bp, Rattus norvegicus
aactgcaggctgcatcagtagttca

SEQ ID NO: 30096 - DNA, 25 bp, Rattus norvegicus
aactgcaggctggatcagtagttca

SEQ ID NO: 30097 - DNA, 25 bp, Rattus norvegicus
aactgcaggtgtatgaacttattca

SEQ ID NO: 30098 - DNA, 25 bp, Rattus norvegicus
aactgcaggtgtttgaacttattca

SEQ ID NO: 30099 - DNA, 25 bp, Rattus norvegicus
aactgcagtaggagccttgctgtgc

SEQ ID NO: 30100 - DNA, 25 bp, Rattus norvegicus
aactgcagtaggtgccttgctgtgc

SEQ ID NO: 30101 - DNA, 25 bp, Rattus norvegicus
aactgcagtcatcttggacctttta

SEQ ID NO: 30102 - DNA, 25 bp, Rattus norvegicus
aactgcagtcatgttggacctttta

SEQ ID NO: 30103 - DNA, 25 bp, Rattus norvegicus
aactgcagtctaaagcaaagctcaa

SEQ ID NO: 30104 - DNA, 25 bp, Rattus norvegicus
aactgcagtctatagcaaagctcaa

SEQ ID NO: 30105 - DNA, 25 bp, Rattus norvegicus
aactgcagtggaacctcactcagat

SEQ ID NO: 30106 - DNA, 25 bp, Rattus norvegicus
aactgcagtggatcctcactcagat

SEQ ID NO: 30107 - DNA, 25 bp, Rattus norvegicus
aactgcagtggtcctggatgctacc

SEQ ID NO: 30108 - DNA, 25 bp, Rattus norvegicus
aactgcagtggtgctggatgctacc

SEQ ID NO: 30109 - DNA, 25 bp, Rattus norvegicus
aactgcagttgcattctctgggatg

SEQ ID NO: 30110 - DNA, 25 bp, Rattus norvegicus
aactgcagttgctttctctgggatg

SEQ ID NO: 30111 - DNA, 25 bp, Rattus norvegicus
aactgcataatcaattgccccgtga

SEQ ID NO: 30112 - DNA, 25 bp, Rattus norvegicus
aactgcataatctattgccccgtga

SEQ ID NO: 30113 - DNA, 25 bp, Rattus norvegicus
aactgcataatgctctggcactgta

SEQ ID NO: 30114 - DNA, 25 bp, Rattus norvegicus
aactgcataatggtctggcactgta

SEQ ID NO: 30115 - DNA, 25 bp, Rattus norvegicus
aactgcatctcaactaagtcttctt

SEQ ID NO: 30116 - DNA, 25 bp, Rattus norvegicus
aactgcatctcatctaagtcttctt

SEQ ID NO: 30117 - DNA, 25 bp, Rattus norvegicus
aactgcatctggagatggtcatcct

SEQ ID NO: 30118 - DNA, 25 bp, Rattus norvegicus
aactgcatctggtgatggtcatcct

SEQ ID NO: 30119 - DNA, 25 bp, Rattus norvegicus
aactgcatgcaacctcagggtgccc

SEQ ID NO: 30120 - DNA, 25 bp, Rattus norvegicus
aactgcatgcaagctcagggtgccc

SEQ ID NO: 30121 - DNA, 25 bp, Rattus norvegicus
aactgcatggctacagggagggctt

SEQ ID NO: 30122 - DNA, 25 bp, Rattus norvegicus
aactgcatggcttcagggagggctt

SEQ ID NO: 30123 - DNA, 25 bp, Rattus norvegicus
aactgcattataatcctaacccttc

SEQ ID NO: 30124 - DNA, 25 bp, Rattus norvegicus
aactgcattatattcctaacccttc

SEQ ID NO: 30125 - DNA, 25 bp, Rattus norvegicus
aactgcattcccatttagacctaga

SEQ ID NO: 30126 - DNA, 25 bp, Rattus norvegicus
aactgcattcccttttagacctaga

SEQ ID NO: 30127 - DNA, 25 bp, Rattus norvegicus
aactgcatttctcaagcacccaatg

SEQ ID NO: 30128 - DNA, 25 bp, Rattus norvegicus
aactgcatttctgaagcacccaatg

SEQ ID NO: 30129 - DNA, 25 bp, Rattus norvegicus
aactgcatttttacagcctagcatg

SEQ ID NO: 30130 - DNA, 25 bp, Rattus norvegicus
aactgcatttttccatttactccca

SEQ ID NO: 30131 - DNA, 25 bp, Rattus norvegicus
aactgcatttttgcatttactccca

SEQ ID NO: 30132 - DNA, 25 bp, Rattus norvegicus
aactgcattttttcagcctagcatg

SEQ ID NO: 30133 - DNA, 25 bp, Rattus norvegicus
aactgccaaagcatagacgctctct

SEQ ID NO: 30134 - DNA, 25 bp, Rattus norvegicus
aactgccaaagcatctccttgataa

SEQ ID NO: 30135 - DNA, 25 bp, Rattus norvegicus
aactgccaaagcttagacgctctct

SEQ ID NO: 30136 - DNA, 25 bp, Rattus norvegicus
aactgccaaagcttctccttgataa

SEQ ID NO: 30137 - DNA, 25 bp, Rattus norvegicus
aactgccaagacagcatgtttatgc

SEQ ID NO: 30138 - DNA, 25 bp, Rattus norvegicus
aactgccaagactgcatgtttatgc

SEQ ID NO: 30139 - DNA, 25 bp, Rattus norvegicus
aactgccacgttctgggcctttggg

SEQ ID NO: 30140 - DNA, 25 bp, Rattus norvegicus
aactgccacgttgtgggcctttggg

SEQ ID NO: 30141 - DNA, 25 bp, Rattus norvegicus
aactgccacttcctgtctttgttag

SEQ ID NO: 30142 - DNA, 25 bp, Rattus norvegicus
aactgccacttcgtgtctttgttag

SEQ ID NO: 30143 - DNA, 25 bp, Rattus norvegicus
aactgccagattatataacgatgta

SEQ ID NO: 30144 - DNA, 25 bp, Rattus norvegicus
aactgccagattttataacgatgta

SEQ ID NO: 30145 - DNA, 25 bp, Rattus norvegicus
aactgccaggccaccgataaagctt

SEQ ID NO: 30146 - DNA, 25 bp, Rattus norvegicus
aactgccaggcccagaatccgagac

SEQ ID NO: 30147 - DNA, 25 bp, Rattus norvegicus
aactgccaggccgagaatccgagac

SEQ ID NO: 30148 - DNA, 25 bp, Rattus norvegicus
aactgccaggcctccgataaagctt

SEQ ID NO: 30149 - DNA, 25 bp, Rattus norvegicus
aactgccagtgcatctgtgttgtgc

SEQ ID NO: 30150 - DNA, 25 bp, Rattus norvegicus
aactgccagtgcttctgtgttgtgc

SEQ ID NO: 30151 - DNA, 25 bp, Rattus norvegicus
aactgccatctccaaatattttctt

SEQ ID NO: 30152 - DNA, 25 bp, Rattus norvegicus
aactgccatctcgaaatattttctt

SEQ ID NO: 30153 - DNA, 25 bp, Rattus norvegicus
aactgccatgcaaaagctccaagta

SEQ ID NO: 30154 - DNA, 25 bp, Rattus norvegicus
aactgccatgcataagctccaagta

SEQ ID NO: 30155 - DNA, 25 bp, Rattus norvegicus
aactgcccaagtacatgtattgtct

SEQ ID NO: 30156 - DNA, 25 bp, Rattus norvegicus
aactgcccaagttcatgtattgtct

SEQ ID NO: 30157 - DNA, 25 bp, Rattus norvegicus
aactgcccaatacaaaggtaccctg

SEQ ID NO: 30158 - DNA, 25 bp, Rattus norvegicus
aactgcccaatagaaaggtaccctg

SEQ ID NO: 30159 - DNA, 25 bp, Rattus norvegicus
aactgcccagaccttgacttggagt

SEQ ID NO: 30160 - DNA, 25 bp, Rattus norvegicus
aactgcccagacgttgacttggagt

SEQ ID NO: 30161 - DNA, 25 bp, Rattus norvegicus
aactgcccagcaattgtgtaaactt

SEQ ID NO: 30162 - DNA, 25 bp, Rattus norvegicus
aactgcccagcatttgtgtaaactt

SEQ ID NO: 30163 - DNA, 25 bp, Rattus norvegicus
aactgcccataactctatctccagg

SEQ ID NO: 30164 - DNA, 25 bp, Rattus norvegicus
aactgcccataagtctatctccagg

SEQ ID NO: 30165 - DNA, 25 bp, Rattus norvegicus
aactgccctggcctatcagaagatt

SEQ ID NO: 30166 - DNA, 25 bp, Rattus norvegicus
aactgccctggcgtatcagaagatt

SEQ ID NO: 30167 - DNA, 25 bp, Rattus norvegicus
aactgcccttacagtagggactcct

SEQ ID NO: 30168 - DNA, 25 bp, Rattus norvegicus
aactgcccttactgtagggactcct

SEQ ID NO: 30169 - DNA, 25 bp, Rattus norvegicus
aactgccggaggatactgaggccaa

SEQ ID NO: 30170 - DNA, 25 bp, Rattus norvegicus
aactgccggaggttactgaggccaa

SEQ ID NO: 30171 - DNA, 25 bp, Rattus norvegicus
aactgccgttacatacctgattata

SEQ ID NO: 30172 - DNA, 25 bp, Rattus norvegicus
aactgccgttacttacctgattata

SEQ ID NO: 30173 - DNA, 25 bp, Rattus norvegicus
aactgcctattccaggaggagcctt

SEQ ID NO: 30174 - DNA, 25 bp, Rattus norvegicus
aactgcctattcgaggaggagcctt

SEQ ID NO: 30175 - DNA, 25 bp, Rattus norvegicus
aactgcctcatgagtttgtcttggt

SEQ ID NO: 30176 - DNA, 25 bp, Rattus norvegicus
aactgcctcatgtgtttgtcttggt

SEQ ID NO: 30177 - DNA, 25 bp, Rattus norvegicus
aactgcctcctgcaatgtgggtatg

SEQ ID NO: 30178 - DNA, 25 bp, Rattus norvegicus
aactgcctcctggaatgtgggtatg

SEQ ID NO: 30179 - DNA, 25 bp, Rattus norvegicus
aactgcctgaaaattcagctctaga

SEQ ID NO: 30180 - DNA, 25 bp, Rattus norvegicus
aactgcctgaaatttcagctctaga

SEQ ID NO: 30181 - DNA, 25 bp, Rattus norvegicus
aactgcctggtgattgtgtattctg

SEQ ID NO: 30182 - DNA, 25 bp, Rattus norvegicus
aactgcctggtgcttccaactgtaa

SEQ ID NO: 30183 - DNA, 25 bp, Rattus norvegicus
aactgcctggtggttccaactgtaa

SEQ ID NO: 30184 - DNA, 25 bp, Rattus norvegicus
aactgcctggtgtttgtgtattctg

SEQ ID NO: 30185 - DNA, 25 bp, Rattus norvegicus
aactgcctgtaaatctaagtccaag

SEQ ID NO: 30186 - DNA, 25 bp, Rattus norvegicus
aactgcctgtaattctaagtccaag

SEQ ID NO: 30187 - DNA, 25 bp, Rattus norvegicus
aactgcctgtacaccagttaaggaa

SEQ ID NO: 30188 - DNA, 25 bp, Rattus norvegicus
aactgcctgtactccagttaaggaa

SEQ ID NO: 30189 - DNA, 25 bp, Rattus norvegicus
aactgccttacacacgtggctcttt

SEQ ID NO: 30190 - DNA, 25 bp, Rattus norvegicus
aactgccttacagacgtggctcttt

SEQ ID NO: 30191 - DNA, 25 bp, Rattus norvegicus
aactgccttcacatttgctactgtt

SEQ ID NO: 30192 - DNA, 25 bp, Rattus norvegicus
aactgccttcacttttgctactgtt

SEQ ID NO: 30193 - DNA, 25 bp, Rattus norvegicus
aactgccttcctcggtgactaagaa

SEQ ID NO: 30194 - DNA, 25 bp, Rattus norvegicus
aactgccttcctgggtgactaagaa

SEQ ID NO: 30195 - DNA, 25 bp, Rattus norvegicus
aactgccttcttccagtcttaagta

SEQ ID NO: 30196 - DNA, 25 bp, Rattus norvegicus
aactgccttcttgcagtcttaagta

SEQ ID NO: 30197 - DNA, 25 bp, Rattus norvegicus
aactgccttgggaggccagatgcaa

SEQ ID NO: 30198 - DNA, 25 bp, Rattus norvegicus
aactgccttgggtggccagatgcaa

SEQ ID NO: 30199 - DNA, 25 bp, Rattus norvegicus
aactgccttgtgagccttccatctt

SEQ ID NO: 30200 - DNA, 25 bp, Rattus norvegicus
aactgccttgtgtgccttccatctt

SEQ ID NO: 30201 - DNA, 25 bp, Rattus norvegicus
aactgcctttacatctgcctcgatt

SEQ ID NO: 30202 - DNA, 25 bp, Rattus norvegicus
aactgcctttacttctgcctcgatt

SEQ ID NO: 30203 - DNA, 25 bp, Rattus norvegicus
aactgcctttataacacacctggtt

SEQ ID NO: 30204 - DNA, 25 bp, Rattus norvegicus
aactgcctttattacacacctggtt

SEQ ID NO: 30205 - DNA, 25 bp, Rattus norvegicus
aactgccttttcagatggtggttca

SEQ ID NO: 30206 - DNA, 25 bp, Rattus norvegicus
aactgccttttctgatggtggttca

SEQ ID NO: 30207 - DNA, 25 bp, Rattus norvegicus
aactgcgaccgtcataatgtgaacc

SEQ ID NO: 30208 - DNA, 25 bp, Rattus norvegicus
aactgcgaccgtgataatgtgaacc

SEQ ID NO: 30209 - DNA, 25 bp, Rattus norvegicus
aactgcgagcgcaggatctgcttca

SEQ ID NO: 30210 - DNA, 25 bp, Rattus norvegicus
aactgcgagcgcagtgttcctggct

SEQ ID NO: 30211 - DNA, 25 bp, Rattus norvegicus
aactgcgagcgctggatctgcttca

SEQ ID NO: 30212 - DNA, 25 bp, Rattus norvegicus
aactgcgagcgctgtgttcctggct

SEQ ID NO: 30213 - DNA, 25 bp, Rattus norvegicus
aactgcgaggtgagtgtggacgtca

SEQ ID NO: 30214 - DNA, 25 bp, Rattus norvegicus
aactgcgaggtgtgtgtggacgtca

SEQ ID NO: 30215 - DNA, 25 bp, Rattus norvegicus
aactgcgatgggatggagccaatca

SEQ ID NO: 30216 - DNA, 25 bp, Rattus norvegicus
aactgcgatgggttggagccaatca

SEQ ID NO: 30217 - DNA, 25 bp, Rattus norvegicus
aactgcgccactcctcatggagaag

SEQ ID NO: 30218 - DNA, 25 bp, Rattus norvegicus
aactgcgccactgctcatggagaag

SEQ ID NO: 30219 - DNA, 25 bp, Rattus norvegicus
aactgcgcccatcttgaggcagagg

SEQ ID NO: 30220 - DNA, 25 bp, Rattus norvegicus
aactgcgcccatgttgaggcagagg

SEQ ID NO: 30221 - DNA, 25 bp, Rattus norvegicus
aactgcgcggcccaaatcatggtgc

SEQ ID NO: 30222 - DNA, 25 bp, Rattus norvegicus
aactgcgcggccgaaatcatggtgc

SEQ ID NO: 30223 - DNA, 25 bp, Rattus norvegicus
aactgcgctgtgcactgctgctgga

SEQ ID NO: 30224 - DNA, 25 bp, Rattus norvegicus
aactgcgctgtggactgctgctgga

SEQ ID NO: 30225 - DNA, 25 bp, Rattus norvegicus
aactgcgcttcacctgtcgtgtgca

SEQ ID NO: 30226 - DNA, 25 bp, Rattus norvegicus
aactgcgcttcagctgtcgtgtgca

SEQ ID NO: 30227 - DNA, 25 bp, Rattus norvegicus
aactgcgcttgcctggtctgcggca

SEQ ID NO: 30228 - DNA, 25 bp, Rattus norvegicus
aactgcgcttgcgtggtctgcggca

SEQ ID NO: 30229 - DNA, 25 bp, Rattus norvegicus
aactgcgcttttctcttgaagctat

SEQ ID NO: 30230 - DNA, 25 bp, Rattus norvegicus
aactgcgcttttgtcttgaagctat

SEQ ID NO: 30231 - DNA, 25 bp, Rattus norvegicus
aactgcggcatcagcaggatggcgt

SEQ ID NO: 30232 - DNA, 25 bp, Rattus norvegicus
aactgcggcatctgcaggatggcgt

SEQ ID NO: 30233 - DNA, 25 bp, Rattus norvegicus
aactgcggcggccaactcaagggac

SEQ ID NO: 30234 - DNA, 25 bp, Rattus norvegicus
aactgcggcggcgaactcaagggac

SEQ ID NO: 30235 - DNA, 25 bp, Rattus norvegicus
aactgcggctacaagttctgcgggc

SEQ ID NO: 30236 - DNA, 25 bp, Rattus norvegicus
aactgcggctactagttctgcgggc

SEQ ID NO: 30237 - DNA, 25 bp, Rattus norvegicus
aactgcgggacgacattgaatctca

SEQ ID NO: 30238 - DNA, 25 bp, Rattus norvegicus
aactgcgggacgtcattgaatctca

SEQ ID NO: 30239 - DNA, 25 bp, Rattus norvegicus
aactgcgtaacgagagcggcggcca

SEQ ID NO: 30240 - DNA, 25 bp, Rattus norvegicus
aactgcgtaacgtgagcggcggcca

SEQ ID NO: 30241 - DNA, 25 bp, Rattus norvegicus
aactgcgtcacaatcgaactagcgt

SEQ ID NO: 30242 - DNA, 25 bp, Rattus norvegicus
aactgcgtcacattcgaactagcgt

SEQ ID NO: 30243 - DNA, 25 bp, Rattus norvegicus
aactgcgtccctagtgcttgagaca

SEQ ID NO: 30244 - DNA, 25 bp, Rattus norvegicus
aactgcgtcccttgtgcttgagaca

SEQ ID NO: 30245 - DNA, 25 bp, Rattus norvegicus
aactgcgtgcagactccaggagttt

SEQ ID NO: 30246 - DNA, 25 bp, Rattus norvegicus
aactgcgtgcagtctccaggagttt

SEQ ID NO: 30247 - DNA, 25 bp, Rattus norvegicus
aactgcgtgtggcatcgcacgcctt

SEQ ID NO: 30248 - DNA, 25 bp, Rattus norvegicus
aactgcgtgtgggatcgcacgcctt

SEQ ID NO: 30249 - DNA, 25 bp, Rattus norvegicus
aactgcgttttcaacttcagtctgc

SEQ ID NO: 30250 - DNA, 25 bp, Rattus norvegicus
aactgcgttttctacttcagtctgc

SEQ ID NO: 30251 - DNA, 25 bp, Rattus norvegicus
aactgctaagaacacggttatgggc

SEQ ID NO: 30252 - DNA, 25 bp, Rattus norvegicus
aactgctaagaagacggttatgggc

SEQ ID NO: 30253 - DNA, 25 bp, Rattus norvegicus
aactgctaccgtcagctacgtgacg

SEQ ID NO: 30254 - DNA, 25 bp, Rattus norvegicus
aactgctaccgtgagctacgtgacg

SEQ ID NO: 30255 - DNA, 25 bp, Rattus norvegicus
aactgctactccagcatcatgcctg

SEQ ID NO: 30256 - DNA, 25 bp, Rattus norvegicus
aactgctactcctgcatcatgcctg

SEQ ID NO: 30257 - DNA, 25 bp, Rattus norvegicus
aactgctactctacgatgtgtctgt

SEQ ID NO: 30258 - DNA, 25 bp, Rattus norvegicus
aactgctactcttcgatgtgtctgt

SEQ ID NO: 30259 - DNA, 25 bp, Rattus norvegicus
aactgctactgtaagggaccacata

SEQ ID NO: 30260 - DNA, 25 bp, Rattus norvegicus
aactgctactgttagggaccacata

SEQ ID NO: 30261 - DNA, 25 bp, Rattus norvegicus
aactgctatgtcctcgattaagacc

SEQ ID NO: 30262 - DNA, 25 bp, Rattus norvegicus
aactgctatgtcgtcgattaagacc

SEQ ID NO: 30263 - DNA, 25 bp, Rattus norvegicus
aactgctattgcaacttgattgaaa

SEQ ID NO: 30264 - DNA, 25 bp, Rattus norvegicus
aactgctattgctacttgattgaaa

SEQ ID NO: 30265 - DNA, 25 bp, Rattus norvegicus
aactgctatttaagacacccatggt

SEQ ID NO: 30266 - DNA, 25 bp, Rattus norvegicus
aactgctatttatgacacccatggt

SEQ ID NO: 30267 - DNA, 25 bp, Rattus norvegicus
aactgctattttcgcttatttctgg

SEQ ID NO: 30268 - DNA, 25 bp, Rattus norvegicus
aactgctattttggcttatttctgg

SEQ ID NO: 30269 - DNA, 25 bp, Rattus norvegicus
aactgctcaaccagctggatggctt

SEQ ID NO: 30270 - DNA, 25 bp, Rattus norvegicus
aactgctcaacctgctggatggctt

SEQ ID NO: 30271 - DNA, 25 bp, Rattus norvegicus
aactgctcaactagtcaaagtgtat

SEQ ID NO: 30272 - DNA, 25 bp, Rattus norvegicus
aactgctcaacttgtcaaagtgtat

SEQ ID NO: 30273 - DNA, 25 bp, Rattus norvegicus
aactgctcactcatgacttagctct

SEQ ID NO: 30274 - DNA, 25 bp, Rattus norvegicus
aactgctcactcttgacttagctct

SEQ ID NO: 30275 - DNA, 25 bp, Rattus norvegicus
aactgctcacttccctaaaatctca

SEQ ID NO: 30276 - DNA, 25 bp, Rattus norvegicus
aactgctcacttgcctaaaatctca

SEQ ID NO: 30277 - DNA, 25 bp, Rattus norvegicus
aactgctcagtgacctctggatgac

SEQ ID NO: 30278 - DNA, 25 bp, Rattus norvegicus
aactgctcagtgtcctctggatgac

SEQ ID NO: 30279 - DNA, 25 bp, Rattus norvegicus
aactgctcatgcacttggttcactg

SEQ ID NO: 30280 - DNA, 25 bp, Rattus norvegicus
aactgctcatgctcttggttcactg

SEQ ID NO: 30281 - DNA, 25 bp, Rattus norvegicus
aactgctccaatatgaacactttcg

SEQ ID NO: 30282 - DNA, 25 bp, Rattus norvegicus
aactgctccaatttgaacactttcg

SEQ ID NO: 30283 - DNA, 25 bp, Rattus norvegicus
aactgctccgctccaagaactgaaa

SEQ ID NO: 30284 - DNA, 25 bp, Rattus norvegicus
aactgctccgctgcaagaactgaaa

SEQ ID NO: 30285 - DNA, 25 bp, Rattus norvegicus
aactgctcctgtcccacagatggat

SEQ ID NO: 30286 - DNA, 25 bp, Rattus norvegicus
aactgctcctgtgccacagatggat

SEQ ID NO: 30287 - DNA, 25 bp, Rattus norvegicus
aactgctcctttcaggacttcacgg

SEQ ID NO: 30288 - DNA, 25 bp, Rattus norvegicus
aactgctcctttgaggacttcacgg

SEQ ID NO: 30289 - DNA, 25 bp, Rattus norvegicus
aactgctcgttgctacctcttaaga

SEQ ID NO: 30290 - DNA, 25 bp, Rattus norvegicus
aactgctcgttggtacctcttaaga

SEQ ID NO: 30291 - DNA, 25 bp, Rattus norvegicus
aactgctctcggaagtggttttgtt

SEQ ID NO: 30292 - DNA, 25 bp, Rattus norvegicus
aactgctctcggtagtggttttgtt

SEQ ID NO: 30293 - DNA, 25 bp, Rattus norvegicus
aactgctctcttagtgtttggtttc

SEQ ID NO: 30294 - DNA, 25 bp, Rattus norvegicus
aactgctctctttgtgtttggtttc

SEQ ID NO: 30295 - DNA, 25 bp, Rattus norvegicus
aactgctctgtgatcgccgacgtga

SEQ ID NO: 30296 - DNA, 25 bp, Rattus norvegicus
aactgctctgtgttcgccgacgtga

SEQ ID NO: 30297 - DNA, 25 bp, Rattus norvegicus
aactgctctgttcgcttttgctggc

SEQ ID NO: 30298 - DNA, 25 bp, Rattus norvegicus
aactgctctgttggcttttgctggc

SEQ ID NO: 30299 - DNA, 25 bp, Rattus norvegicus
aactgctctttactagtggatactg

SEQ ID NO: 30300 - DNA, 25 bp, Rattus norvegicus
aactgctctttagtagtggatactg

SEQ ID NO: 30301 - DNA, 25 bp, Rattus norvegicus
aactgctgaactacacattcttaga

SEQ ID NO: 30302 - DNA, 25 bp, Rattus norvegicus
aactgctgaacttcacattcttaga

SEQ ID NO: 30303 - DNA, 25 bp, Rattus norvegicus
aactgctgacatagacatcgcgggt

SEQ ID NO: 30304 - DNA, 25 bp, Rattus norvegicus
aactgctgacattgacatcgcgggt

SEQ ID NO: 30305 - DNA, 25 bp, Rattus norvegicus
aactgctgagtaatctgccttcaag

SEQ ID NO: 30306 - DNA, 25 bp, Rattus norvegicus
aactgctgagtattctgccttcaag

SEQ ID NO: 30307 - DNA, 25 bp, Rattus norvegicus
aactgctgcagccatggttctacgt

SEQ ID NO: 30308 - DNA, 25 bp, Rattus norvegicus
aactgctgcagcgatggttctacgt

SEQ ID NO: 30309 - DNA, 25 bp, Rattus norvegicus
aactgctgcaggcatgccgtcctga

SEQ ID NO: 30310 - DNA, 25 bp, Rattus norvegicus
aactgctgcagggatgccgtcctga

SEQ ID NO: 30311 - DNA, 25 bp, Rattus norvegicus
aactgctgcatgaatcacacaaggc

SEQ ID NO: 30312 - DNA, 25 bp, Rattus norvegicus
aactgctgcatgaccctgtgggtga

SEQ ID NO: 30313 - DNA, 25 bp, Rattus norvegicus
aactgctgcatgtatcacacaaggc

SEQ ID NO: 30314 - DNA, 25 bp, Rattus norvegicus
aactgctgcatgtccctgtgggtga

SEQ ID NO: 30315 - DNA, 25 bp, Rattus norvegicus
aactgctgctgcaatgctgaatccg

SEQ ID NO: 30316 - DNA, 25 bp, Rattus norvegicus
aactgctgctgctatgctgaatccg

SEQ ID NO: 30317 - DNA, 25 bp, Rattus norvegicus
aactgctgctggaaccaccacagct

SEQ ID NO: 30318 - DNA, 25 bp, Rattus norvegicus
aactgctgctggaaggcctgtggat

SEQ ID NO: 30319 - DNA, 25 bp, Rattus norvegicus
aactgctgctggtaccaccacagct

SEQ ID NO: 30320 - DNA, 25 bp, Rattus norvegicus
aactgctgctggtaggcctgtggat

SEQ ID NO: 30321 - DNA, 25 bp, Rattus norvegicus
aactgctggaatcagagaggacccc

SEQ ID NO: 30322 - DNA, 25 bp, Rattus norvegicus
aactgctggaatgagagaggacccc

SEQ ID NO: 30323 - DNA, 25 bp, Rattus norvegicus
aactgctggagtagtcgcgtgctgt

SEQ ID NO: 30324 - DNA, 25 bp, Rattus norvegicus
aactgctggagttgtcgcgtgctgt

SEQ ID NO: 30325 - DNA, 25 bp, Rattus norvegicus
aactgctggcaactctaaacacccg

SEQ ID NO: 30326 - DNA, 25 bp, Rattus norvegicus
aactgctggcaagtctaaacacccg

SEQ ID NO: 30327 - DNA, 25 bp, Rattus norvegicus
aactgctggcctcgtctgaaagcac

SEQ ID NO: 30328 - DNA, 25 bp, Rattus norvegicus
aactgctggcctggtctgaaagcac

SEQ ID NO: 30329 - DNA, 25 bp, Rattus norvegicus
aactgctggcttaacgaggctgcta

SEQ ID NO: 30330 - DNA, 25 bp, Rattus norvegicus
aactgctggcttactctcacttaga

SEQ ID NO: 30331 - DNA, 25 bp, Rattus norvegicus
aactgctggctttacgaggctgcta

SEQ ID NO: 30332 - DNA, 25 bp, Rattus norvegicus
aactgctggctttctctcacttaga

SEQ ID NO: 30333 - DNA, 25 bp, Rattus norvegicus
aactgctgggcaagatattctgtag

SEQ ID NO: 30334 - DNA, 25 bp, Rattus norvegicus
aactgctgggcatgatattctgtag

SEQ ID NO: 30335 - DNA, 25 bp, Rattus norvegicus
aactgctggtccatcacagacagga

SEQ ID NO: 30336 - DNA, 25 bp, Rattus norvegicus
aactgctggtcccatacactgttca

SEQ ID NO: 30337 - DNA, 25 bp, Rattus norvegicus
aactgctggtccgatacactgttca

SEQ ID NO: 30338 - DNA, 25 bp, Rattus norvegicus
aactgctggtccttcacagacagga

SEQ ID NO: 30339 - DNA, 25 bp, Rattus norvegicus
aactgctgtcacatacaggtgctgt

SEQ ID NO: 30340 - DNA, 25 bp, Rattus norvegicus
aactgctgtcacttacaggtgctgt

SEQ ID NO: 30341 - DNA, 25 bp, Rattus norvegicus
aactgctgtcccaagaattggtgct

SEQ ID NO: 30342 - DNA, 25 bp, Rattus norvegicus
aactgctgtccctagaattggtgct

SEQ ID NO: 30343 - DNA, 25 bp, Rattus norvegicus
aactgctgtcttcaactgcacacat

SEQ ID NO: 30344 - DNA, 25 bp, Rattus norvegicus
aactgctgtcttgaactgcacacat

SEQ ID NO: 30345 - DNA, 25 bp, Rattus norvegicus
aactgctgtgcccagctgatggaca

SEQ ID NO: 30346 - DNA, 25 bp, Rattus norvegicus
aactgctgtgccgagctgatggaca

SEQ ID NO: 30347 - DNA, 25 bp, Rattus norvegicus
aactgctgtgctatctaggttggga

SEQ ID NO: 30348 - DNA, 25 bp, Rattus norvegicus
aactgctgtgctttctaggttggga

SEQ ID NO: 30349 - DNA, 25 bp, Rattus norvegicus
aactgctgtgtacttgggtttcaaa

SEQ ID NO: 30350 - DNA, 25 bp, Rattus norvegicus
aactgctgtgtagttgggtttcaaa

SEQ ID NO: 30351 - DNA, 25 bp, Rattus norvegicus
aactgctgttctctggttgtttgcc

SEQ ID NO: 30352 - DNA, 25 bp, Rattus norvegicus
aactgctgttctgtggttgtttgcc

SEQ ID NO: 30353 - DNA, 25 bp, Rattus norvegicus
aactgctgttttagatacctgcttt

SEQ ID NO: 30354 - DNA, 25 bp, Rattus norvegicus
aactgctgtttttgatacctgcttt

SEQ ID NO: 30355 - DNA, 25 bp, Rattus norvegicus
aactgcttaactactgaatggtcat

SEQ ID NO: 30356 - DNA, 25 bp, Rattus norvegicus
aactgcttaacttctgaatggtcat

SEQ ID NO: 30357 - DNA, 25 bp, Rattus norvegicus
aactgcttaataaatggctcccctt

SEQ ID NO: 30358 - DNA, 25 bp, Rattus norvegicus
aactgcttaatatatggctcccctt

SEQ ID NO: 30359 - DNA, 25 bp, Rattus norvegicus
aactgcttataaccgccatgccaaa

SEQ ID NO: 30360 - DNA, 25 bp, Rattus norvegicus
aactgcttataagcgccatgccaaa

SEQ ID NO: 30361 - DNA, 25 bp, Rattus norvegicus
aactgcttatctattgtttaattca

SEQ ID NO: 30362 - DNA, 25 bp, Rattus norvegicus
aactgcttatcttttgtttaattca

SEQ ID NO: 30363 - DNA, 25 bp, Rattus norvegicus
aactgcttcaacagctggatcctta

SEQ ID NO: 30364 - DNA, 25 bp, Rattus norvegicus
aactgcttcaactgctggatcctta

SEQ ID NO: 30365 - DNA, 25 bp, Rattus norvegicus
aactgcttcaatcgttgggtctgct

SEQ ID NO: 30366 - DNA, 25 bp, Rattus norvegicus
aactgcttcaatggttgggtctgct

SEQ ID NO: 30367 - DNA, 25 bp, Rattus norvegicus
aactgcttcaggattaccatgactc

SEQ ID NO: 30368 - DNA, 25 bp, Rattus norvegicus
aactgcttcaggtttaccatgactc

SEQ ID NO: 30369 - DNA, 25 bp, Rattus norvegicus
aactgcttcagtatgccatctttat

SEQ ID NO: 30370 - DNA, 25 bp, Rattus norvegicus
aactgcttcagtttgccatctttat

SEQ ID NO: 30371 - DNA, 25 bp, Rattus norvegicus
aactgcttccacacctttagggccg

SEQ ID NO: 30372 - DNA, 25 bp, Rattus norvegicus
aactgcttccactcctttagggccg

SEQ ID NO: 30373 - DNA, 25 bp, Rattus norvegicus
aactgcttccagaattttatagata

SEQ ID NO: 30374 - DNA, 25 bp, Rattus norvegicus
aactgcttccagctggaccatggaa

SEQ ID NO: 30375 - DNA, 25 bp, Rattus norvegicus
aactgcttccaggtggaccatggaa

SEQ ID NO: 30376 - DNA, 25 bp, Rattus norvegicus
aactgcttccagtattttatagata

SEQ ID NO: 30377 - DNA, 25 bp, Rattus norvegicus
aactgcttctccctggagtcagcag

SEQ ID NO: 30378 - DNA, 25 bp, Rattus norvegicus
aactgcttctccgtggagtcagcag

SEQ ID NO: 30379 - DNA, 25 bp, Rattus norvegicus
aactgcttgaagctgctgcgaattc

SEQ ID NO: 30380 - DNA, 25 bp, Rattus norvegicus
aactgcttgaaggtgctgcgaattc

SEQ ID NO: 30381 - DNA, 25 bp, Rattus norvegicus
aactgcttgacaacgaagggttgta

SEQ ID NO: 30382 - DNA, 25 bp, Rattus norvegicus
aactgcttgacatcgaagggttgta

SEQ ID NO: 30383 - DNA, 25 bp, Rattus norvegicus
aactgcttgagactctctgctggcc

SEQ ID NO: 30384 - DNA, 25 bp, Rattus norvegicus
aactgcttgagagtctctgctggcc

SEQ ID NO: 30385 - DNA, 25 bp, Rattus norvegicus
aactgcttggccattgggctgggat

SEQ ID NO: 30386 - DNA, 25 bp, Rattus norvegicus
aactgcttggcctttgggctgggat

SEQ ID NO: 30387 - DNA, 25 bp, Rattus norvegicus
aactgcttggctctgattaaattct

SEQ ID NO: 30388 - DNA, 25 bp, Rattus norvegicus
aactgcttggctgtgattaaattct

SEQ ID NO: 30389 - DNA, 25 bp, Rattus norvegicus
aactgcttgtctcacatggctgaat

SEQ ID NO: 30390 - DNA, 25 bp, Rattus norvegicus
aactgcttgtctgacatggctgaat

SEQ ID NO: 30391 - DNA, 25 bp, Rattus norvegicus
aactgcttgttacctcattgcatgg

SEQ ID NO: 30392 - DNA, 25 bp, Rattus norvegicus
aactgcttgttagctcattgcatgg

SEQ ID NO: 30393 - DNA, 25 bp, Rattus norvegicus
aactgcttgttcatgatcctataaa

SEQ ID NO: 30394 - DNA, 25 bp, Rattus norvegicus
aactgcttgttcttgatcctataaa

SEQ ID NO: 30395 - DNA, 25 bp, Rattus norvegicus
aactgctttaatcggctctgtttaa

SEQ ID NO: 30396 - DNA, 25 bp, Rattus norvegicus
aactgctttaatgggctctgtttaa

SEQ ID NO: 30397 - DNA, 25 bp, Rattus norvegicus
aactgctttacgatggagaactttt

SEQ ID NO: 30398 - DNA, 25 bp, Rattus norvegicus
aactgctttacgttggagaactttt

SEQ ID NO: 30399 - DNA, 25 bp, Rattus norvegicus
aactgctttactaccatcacaaatg

SEQ ID NO: 30400 - DNA, 25 bp, Rattus norvegicus
aactgctttactcgatgctgctggg

SEQ ID NO: 30401 - DNA, 25 bp, Rattus norvegicus
aactgctttactggatgctgctggg

SEQ ID NO: 30402 - DNA, 25 bp, Rattus norvegicus
aactgctttacttccatcacaaatg

SEQ ID NO: 30403 - DNA, 25 bp, Rattus norvegicus
aactgctttcaacaatgcccagaag

SEQ ID NO: 30404 - DNA, 25 bp, Rattus norvegicus
aactgctttcaagaatgcccagaag

SEQ ID NO: 30405 - DNA, 25 bp, Rattus norvegicus
aactgctttgttcctttttgcaaga

SEQ ID NO: 30406 - DNA, 25 bp, Rattus norvegicus
aactgctttgttgctttttgcaaga

SEQ ID NO: 30407 - DNA, 25 bp, Rattus norvegicus
aactgctttttaatcttctttggca

SEQ ID NO: 30408 - DNA, 25 bp, Rattus norvegicus
aactgctttttattcttctttggca

SEQ ID NO: 30409 - DNA, 25 bp, Rattus norvegicus
aactgctttttgctgccgcccttgg

SEQ ID NO: 30410 - DNA, 25 bp, Rattus norvegicus
aactgctttttggtgccgcccttgg

SEQ ID NO: 30411 - DNA, 25 bp, Rattus norvegicus
aactggaaaatgatggctggtgcaa

SEQ ID NO: 30412 - DNA, 25 bp, Rattus norvegicus
aactggaaaatgttggctggtgcaa

SEQ ID NO: 30413 - DNA, 25 bp, Rattus norvegicus
aactggaaacatactaactgcttta

SEQ ID NO: 30414 - DNA, 25 bp, Rattus norvegicus
aactggaaacattctaactgcttta

SEQ ID NO: 30415 - DNA, 25 bp, Rattus norvegicus
aactggaaagcgacccctctccata

SEQ ID NO: 30416 - DNA, 25 bp, Rattus norvegicus
aactggaaagcgtcccctctccata

SEQ ID NO: 30417 - DNA, 25 bp, Rattus norvegicus
aactggaaattcacactctgtgaaa

SEQ ID NO: 30418 - DNA, 25 bp, Rattus norvegicus
aactggaaattctcactctgtgaaa

SEQ ID NO: 30419 - DNA, 25 bp, Rattus norvegicus
aactggaaattgactggcttctgca

SEQ ID NO: 30420 - DNA, 25 bp, Rattus norvegicus
aactggaaattgtctggcttctgca

SEQ ID NO: 30421 - DNA, 25 bp, Rattus norvegicus
aactggaactgtcacctggacttgt

SEQ ID NO: 30422 - DNA, 25 bp, Rattus norvegicus
aactggaactgtgacctggacttgt

SEQ ID NO: 30423 - DNA, 25 bp, Rattus norvegicus
aactggaagagaacctgaacaaact

SEQ ID NO: 30424 - DNA, 25 bp, Rattus norvegicus
aactggaagagatcctgaacaaact

SEQ ID NO: 30425 - DNA, 25 bp, Rattus norvegicus
aactggaagcatatcctggcctgta

SEQ ID NO: 30426 - DNA, 25 bp, Rattus norvegicus
aactggaagcatctggctcccgagg

SEQ ID NO: 30427 - DNA, 25 bp, Rattus norvegicus
aactggaagcatgtggctcccgagg

SEQ ID NO: 30428 - DNA, 25 bp, Rattus norvegicus
aactggaagcatttcctggcctgta

SEQ ID NO: 30429 - DNA, 25 bp, Rattus norvegicus
aactggaataaaaccttcttgtcaa

SEQ ID NO: 30430 - DNA, 25 bp, Rattus norvegicus
aactggaataaatccttcttgtcaa

SEQ ID NO: 30431 - DNA, 25 bp, Rattus norvegicus
aactggaatctgatcttcctccgga

SEQ ID NO: 30432 - DNA, 25 bp, Rattus norvegicus
aactggaatctgttcttcctccgga

SEQ ID NO: 30433 - DNA, 25 bp, Rattus norvegicus
aactggaatgccatagtctgcaccc

SEQ ID NO: 30434 - DNA, 25 bp, Rattus norvegicus
aactggaatgccttagtctgcaccc

SEQ ID NO: 30435 - DNA, 25 bp, Rattus norvegicus
aactggaattcgacaagcctctggt

SEQ ID NO: 30436 - DNA, 25 bp, Rattus norvegicus
aactggaattcgtcaagcctctggt

SEQ ID NO: 30437 - DNA, 25 bp, Rattus norvegicus
aactggacaaagaaggaaatgcctg

SEQ ID NO: 30438 - DNA, 25 bp, Rattus norvegicus
aactggacaaagtaggaaatgcctg

SEQ ID NO: 30439 - DNA, 25 bp, Rattus norvegicus
aactggacacagaggctttggccta

SEQ ID NO: 30440 - DNA, 25 bp, Rattus norvegicus
aactggacacagtggctttggccta

SEQ ID NO: 30441 - DNA, 25 bp, Rattus norvegicus
aactggacactgatgtgaggaccca

SEQ ID NO: 30442 - DNA, 25 bp, Rattus norvegicus
aactggacactgttgtgaggaccca

SEQ ID NO: 30443 - DNA, 25 bp, Rattus norvegicus
aactggacagttagaggcgacggca

SEQ ID NO: 30444 - DNA, 25 bp, Rattus norvegicus
aactggacagtttgaggcgacggca

SEQ ID NO: 30445 - DNA, 25 bp, Rattus norvegicus
aactggacatcacagctccttgtaa

SEQ ID NO: 30446 - DNA, 25 bp, Rattus norvegicus
aactggacatcagagctccttgtaa

SEQ ID NO: 30447 - DNA, 25 bp, Rattus norvegicus
aactggacatccagagagactacac

SEQ ID NO: 30448 - DNA, 25 bp, Rattus norvegicus
aactggacatcctgagagactacac

SEQ ID NO: 30449 - DNA, 25 bp, Rattus norvegicus
aactggaccccgatgtgtatggtac

SEQ ID NO: 30450 - DNA, 25 bp, Rattus norvegicus
aactggaccccgttgtgtatggtac

SEQ ID NO: 30451 - DNA, 25 bp, Rattus norvegicus
aactggacctgcagagggttctgga

SEQ ID NO: 30452 - DNA, 25 bp, Rattus norvegicus
aactggacctgctgagggttctgga

SEQ ID NO: 30453 - DNA, 25 bp, Rattus norvegicus
aactggacgtggaattggtgcctga

SEQ ID NO: 30454 - DNA, 25 bp, Rattus norvegicus
aactggacgtggtattggtgcctga

SEQ ID NO: 30455 - DNA, 25 bp, Rattus norvegicus
aactggactataaacctgtgtaatt

SEQ ID NO: 30456 - DNA, 25 bp, Rattus norvegicus
aactggactatatacctgtgtaatt

SEQ ID NO: 30457 - DNA, 25 bp, Rattus norvegicus
aactggactgtgcacttagctcttc

SEQ ID NO: 30458 - DNA, 25 bp, Rattus norvegicus
aactggactgtggacttagctcttc

SEQ ID NO: 30459 - DNA, 25 bp, Rattus norvegicus
aactggagaactactgcaactgagt

SEQ ID NO: 30460 - DNA, 25 bp, Rattus norvegicus
aactggagaactaggcggccatgga

SEQ ID NO: 30461 - DNA, 25 bp, Rattus norvegicus
aactggagaacttctgcaactgagt

SEQ ID NO: 30462 - DNA, 25 bp, Rattus norvegicus
aactggagaacttggcggccatgga

SEQ ID NO: 30463 - DNA, 25 bp, Rattus norvegicus
aactggagactgctaagccctgatg

SEQ ID NO: 30464 - DNA, 25 bp, Rattus norvegicus
aactggagactggtaagccctgatg

SEQ ID NO: 30465 - DNA, 25 bp, Rattus norvegicus
aactggagacttctgtcccctaagg

SEQ ID NO: 30466 - DNA, 25 bp, Rattus norvegicus
aactggagacttgtgtcccctaagg

SEQ ID NO: 30467 - DNA, 25 bp, Rattus norvegicus
aactggagagtcatacgacctgcgg

SEQ ID NO: 30468 - DNA, 25 bp, Rattus norvegicus
aactggagagtcttacgacctgcgg

SEQ ID NO: 30469 - DNA, 25 bp, Rattus norvegicus
aactggagatctagggagaagacac

SEQ ID NO: 30470 - DNA, 25 bp, Rattus norvegicus
aactggagatcttgggagaagacac

SEQ ID NO: 30471 - DNA, 25 bp, Rattus norvegicus
aactggagcctgctgtctcagacca

SEQ ID NO: 30472 - DNA, 25 bp, Rattus norvegicus
aactggagcctggtgtctcagacca

SEQ ID NO: 30473 - DNA, 25 bp, Rattus norvegicus
aactggaggactagagggcacactg

SEQ ID NO: 30474 - DNA, 25 bp, Rattus norvegicus
aactggaggacttgagggcacactg

SEQ ID NO: 30475 - DNA, 25 bp, Rattus norvegicus
aactggaggaggcactctccacgga

SEQ ID NO: 30476 - DNA, 25 bp, Rattus norvegicus
aactggaggagggactctccacgga

SEQ ID NO: 30477 - DNA, 25 bp, Rattus norvegicus
aactggaggcaaagcatccgctgca

SEQ ID NO: 30478 - DNA, 25 bp, Rattus norvegicus
aactggaggcaatgcatccgctgca

SEQ ID NO: 30479 - DNA, 25 bp, Rattus norvegicus
aactggaggctcagctgctgtcact

SEQ ID NO: 30480 - DNA, 25 bp, Rattus norvegicus
aactggaggctctgctgctgtcact

SEQ ID NO: 30481 - DNA, 25 bp, Rattus norvegicus
aactggagggtcatcaggctgagca

SEQ ID NO: 30482 - DNA, 25 bp, Rattus norvegicus
aactggagggtcttcaggctgagca

SEQ ID NO: 30483 - DNA, 25 bp, Rattus norvegicus
aactggagggttactgagcttcatc

SEQ ID NO: 30484 - DNA, 25 bp, Rattus norvegicus
aactggagggtttctgagcttcatc

SEQ ID NO: 30485 - DNA, 25 bp, Rattus norvegicus
aactggagtaccaatgtcccaagcc

SEQ ID NO: 30486 - DNA, 25 bp, Rattus norvegicus
aactggagtacctatgtcccaagcc

SEQ ID NO: 30487 - DNA, 25 bp, Rattus norvegicus
aactggagtcctcaactctatacaa

SEQ ID NO: 30488 - DNA, 25 bp, Rattus norvegicus
aactggagtcctgaactctatacaa

SEQ ID NO: 30489 - DNA, 25 bp, Rattus norvegicus
aactggagtcgtcctgacgtcacac

SEQ ID NO: 30490 - DNA, 25 bp, Rattus norvegicus
aactggagtcgtgctgacgtcacac

SEQ ID NO: 30491 - DNA, 25 bp, Rattus norvegicus
aactggagtgagagacttttgtaac

SEQ ID NO: 30492 - DNA, 25 bp, Rattus norvegicus
aactggagtgagtgacttttgtaac

SEQ ID NO: 30493 - DNA, 25 bp, Rattus norvegicus
aactggagtgtgactcatctgacct

SEQ ID NO: 30494 - DNA, 25 bp, Rattus norvegicus
aactggagtgtgtctcatctgacct

SEQ ID NO: 30495 - DNA, 25 bp, Rattus norvegicus
aactggagttcaacaggttcctgct

SEQ ID NO: 30496 - DNA, 25 bp, Rattus norvegicus
aactggagttcaagtagttcaggtg

SEQ ID NO: 30497 - DNA, 25 bp, Rattus norvegicus
aactggagttcatcaggttcctgct

SEQ ID NO: 30498 - DNA, 25 bp, Rattus norvegicus
aactggagttcatgtagttcaggtg

SEQ ID NO: 30499 - DNA, 25 bp, Rattus norvegicus
aactggagttccaaatgactgtgaa

SEQ ID NO: 30500 - DNA, 25 bp, Rattus norvegicus
aactggagttcctaatgactgtgaa

SEQ ID NO: 30501 - DNA, 25 bp, Rattus norvegicus
aactggagttcgagaggccacagcc

SEQ ID NO: 30502 - DNA, 25 bp, Rattus norvegicus
aactggagttcgtgaggccacagcc

SEQ ID NO: 30503 - DNA, 25 bp, Rattus norvegicus
aactggagttgtccacggtgcgcca

SEQ ID NO: 30504 - DNA, 25 bp, Rattus norvegicus
aactggagttgtgcacggtgcgcca

SEQ ID NO: 30505 - DNA, 25 bp, Rattus norvegicus
aactggatcagcagttaccagggct

SEQ ID NO: 30506 - DNA, 25 bp, Rattus norvegicus
aactggatcagctgttaccagggct

SEQ ID NO: 30507 - DNA, 25 bp, Rattus norvegicus
aactggatcatgattttccctcaag

SEQ ID NO: 30508 - DNA, 25 bp, Rattus norvegicus
aactggatcatgtttttccctcaag

SEQ ID NO: 30509 - DNA, 25 bp, Rattus norvegicus
aactggatccctcaagcttgtgagg

SEQ ID NO: 30510 - DNA, 25 bp, Rattus norvegicus
aactggatccctgaagcttgtgagg

SEQ ID NO: 30511 - DNA, 25 bp, Rattus norvegicus
aactggatctagagtcagcccacat

SEQ ID NO: 30512 - DNA, 25 bp, Rattus norvegicus
aactggatctagtgtcagcccacat

SEQ ID NO: 30513 - DNA, 25 bp, Rattus norvegicus
aactggatctgcataggtaaacgac

SEQ ID NO: 30514 - DNA, 25 bp, Rattus norvegicus
aactggatctgcttaggtaaacgac

SEQ ID NO: 30515 - DNA, 25 bp, Rattus norvegicus
aactggatcttgagaccctaggagc

SEQ ID NO: 30516 - DNA, 25 bp, Rattus norvegicus
aactggatcttgtgaccctaggagc

SEQ ID NO: 30517 - DNA, 25 bp, Rattus norvegicus
aactggatgacactgtcctttggct

SEQ ID NO: 30518 - DNA, 25 bp, Rattus norvegicus
aactggatgacagtgtcctttggct

SEQ ID NO: 30519 - DNA, 25 bp, Rattus norvegicus
aactggatgcccatgggtggcagta

SEQ ID NO: 30520 - DNA, 25 bp, Rattus norvegicus
aactggatgcccttgggtggcagta

SEQ ID NO: 30521 - DNA, 25 bp, Rattus norvegicus
aactggatgcctccacgagtgtttt

SEQ ID NO: 30522 - DNA, 25 bp, Rattus norvegicus
aactggatgcctgcacgagtgtttt

SEQ ID NO: 30523 - DNA, 25 bp, Rattus norvegicus
aactggatggtcagtgtcattataa

SEQ ID NO: 30524 - DNA, 25 bp, Rattus norvegicus
aactggatggtctgtgtcattataa

SEQ ID NO: 30525 - DNA, 25 bp, Rattus norvegicus
aactggatggtgagcgccgacttgc

SEQ ID NO: 30526 - DNA, 25 bp, Rattus norvegicus
aactggatggtgtgcgccgacttgc

SEQ ID NO: 30527 - DNA, 25 bp, Rattus norvegicus
aactggatgtctaaactgggtgcta

SEQ ID NO: 30528 - DNA, 25 bp, Rattus norvegicus
aactggatgtcttaactgggtgcta

SEQ ID NO: 30529 - DNA, 25 bp, Rattus norvegicus
aactggatgttcattcctttggata

SEQ ID NO: 30530 - DNA, 25 bp, Rattus norvegicus
aactggatgttctttcctttggata

SEQ ID NO: 30531 - DNA, 25 bp, Rattus norvegicus
aactggatgtttctcttctgattca

SEQ ID NO: 30532 - DNA, 25 bp, Rattus norvegicus
aactggatgtttgtcttctgattca

SEQ ID NO: 30533 - DNA, 25 bp, Rattus norvegicus
aactggattcaccaggctccaggga

SEQ ID NO: 30534 - DNA, 25 bp, Rattus norvegicus
aactggattcacgaggctccaggga

SEQ ID NO: 30535 - DNA, 25 bp, Rattus norvegicus
aactggattcagacccacattggag

SEQ ID NO: 30536 - DNA, 25 bp, Rattus norvegicus
aactggattcagtcccacattggag

SEQ ID NO: 30537 - DNA, 25 bp, Rattus norvegicus
aactggattcatcagaccattgctg

SEQ ID NO: 30538 - DNA, 25 bp, Rattus norvegicus
aactggattcatgagaccattgctg

SEQ ID NO: 30539 - DNA, 25 bp, Rattus norvegicus
aactggattgcgagctggtgtccac

SEQ ID NO: 30540 - DNA, 25 bp, Rattus norvegicus
aactggattgcgtgctggtgtccac

SEQ ID NO: 30541 - DNA, 25 bp, Rattus norvegicus
aactggatttctatgtgtgccttgg

SEQ ID NO: 30542 - DNA, 25 bp, Rattus norvegicus
aactggatttctttgtgtgccttgg

SEQ ID NO: 30543 - DNA, 25 bp, Rattus norvegicus
aactggattttcaccacactgatcc

SEQ ID NO: 30544 - DNA, 25 bp, Rattus norvegicus
aactggattttctccacactgatcc

SEQ ID NO: 30545 - DNA, 25 bp, Rattus norvegicus
aactggcaaagtctagcgtcaccta

SEQ ID NO: 30546 - DNA, 25 bp, Rattus norvegicus
aactggcaaagtgtagcgtcaccta

SEQ ID NO: 30547 - DNA, 25 bp, Rattus norvegicus
aactggcaattgcatcgatgtttgg

SEQ ID NO: 30548 - DNA, 25 bp, Rattus norvegicus
aactggcaattggatcgatgtttgg

SEQ ID NO: 30549 - DNA, 25 bp, Rattus norvegicus
aactggcacaagctgcaagattctt

SEQ ID NO: 30550 - DNA, 25 bp, Rattus norvegicus
aactggcacaaggtgcaagattctt

SEQ ID NO: 30551 - DNA, 25 bp, Rattus norvegicus
aactggcacacacctgcatgggaaa

SEQ ID NO: 30552 - DNA, 25 bp, Rattus norvegicus
aactggcacacacgttgtcttctga

SEQ ID NO: 30553 - DNA, 25 bp, Rattus norvegicus
aactggcacacagctgcatgggaaa

SEQ ID NO: 30554 - DNA, 25 bp, Rattus norvegicus
aactggcacacaggttgtcttctga

SEQ ID NO: 30555 - DNA, 25 bp, Rattus norvegicus
aactggcacccgctggaataagatc

SEQ ID NO: 30556 - DNA, 25 bp, Rattus norvegicus
aactggcacccggtggaataagatc

SEQ ID NO: 30557 - DNA, 25 bp, Rattus norvegicus
aactggcatccaagagtccttcatt

SEQ ID NO: 30558 - DNA, 25 bp, Rattus norvegicus
aactggcatccatgagtccttcatt

SEQ ID NO: 30559 - DNA, 25 bp, Rattus norvegicus
aactggcatctgattgtatctttac

SEQ ID NO: 30560 - DNA, 25 bp, Rattus norvegicus
aactggcatctgtttgtatctttac

SEQ ID NO: 30561 - DNA, 25 bp, Rattus norvegicus
aactggcatgttctgaggtttccaa

SEQ ID NO: 30562 - DNA, 25 bp, Rattus norvegicus
aactggcatgttgtgaggtttccaa

SEQ ID NO: 30563 - DNA, 25 bp, Rattus norvegicus
aactggcattttaaatcatggcact

SEQ ID NO: 30564 - DNA, 25 bp, Rattus norvegicus
aactggcatttttaatcatggcact

SEQ ID NO: 30565 - DNA, 25 bp, Rattus norvegicus
aactggccaagaatagggaccctga

SEQ ID NO: 30566 - DNA, 25 bp, Rattus norvegicus
aactggccaagattagggaccctga

SEQ ID NO: 30567 - DNA, 25 bp, Rattus norvegicus
aactggccaaggattccaacaccgt

SEQ ID NO: 30568 - DNA, 25 bp, Rattus norvegicus
aactggccaaggtttccaacaccgt

SEQ ID NO: 30569 - DNA, 25 bp, Rattus norvegicus
aactggccagaactgtgtgcagccc

SEQ ID NO: 30570 - DNA, 25 bp, Rattus norvegicus
aactggccagaagtgtgtgcagccc

SEQ ID NO: 30571 - DNA, 25 bp, Rattus norvegicus
aactggccagcaccggaggaaacac

SEQ ID NO: 30572 - DNA, 25 bp, Rattus norvegicus
aactggccagcagcggaggaaacac

SEQ ID NO: 30573 - DNA, 25 bp, Rattus norvegicus
aactggccagggagcagcaagtagc

SEQ ID NO: 30574 - DNA, 25 bp, Rattus norvegicus
aactggccagggtgcagcaagtagc

SEQ ID NO: 30575 - DNA, 25 bp, Rattus norvegicus
aactggcccctgaaagtgggaactg

SEQ ID NO: 30576 - DNA, 25 bp, Rattus norvegicus
aactggcccctgtaagtgggaactg

SEQ ID NO: 30577 - DNA, 25 bp, Rattus norvegicus
aactggccctgaatggaatgaaagc

SEQ ID NO: 30578 - DNA, 25 bp, Rattus norvegicus
aactggccctgattggaatgaaagc

SEQ ID NO: 30579 - DNA, 25 bp, Rattus norvegicus
aactggcctaccacaagtttctgaa

SEQ ID NO: 30580 - DNA, 25 bp, Rattus norvegicus
aactggcctacctcaagtttctgaa

SEQ ID NO: 30581 - DNA, 25 bp, Rattus norvegicus
aactggcctagccactttggctgtg

SEQ ID NO: 30582 - DNA, 25 bp, Rattus norvegicus
aactggcctagcgactttggctgtg

SEQ ID NO: 30583 - DNA, 25 bp, Rattus norvegicus
aactggcctctgacaggcaatgcta

SEQ ID NO: 30584 - DNA, 25 bp, Rattus norvegicus
aactggcctctgcaaagctttttag

SEQ ID NO: 30585 - DNA, 25 bp, Rattus norvegicus
aactggcctctggaaagctttttag

SEQ ID NO: 30586 - DNA, 25 bp, Rattus norvegicus
aactggcctctgtcaggcaatgcta

SEQ ID NO: 30587 - DNA, 25 bp, Rattus norvegicus
aactggcctgcaactacttccttat

SEQ ID NO: 30588 - DNA, 25 bp, Rattus norvegicus
aactggcctgcatctacttccttat

SEQ ID NO: 30589 - DNA, 25 bp, Rattus norvegicus
aactggcctggacgatgtctttcct

SEQ ID NO: 30590 - DNA, 25 bp, Rattus norvegicus
aactggcctggaggatgtctttcct

SEQ ID NO: 30591 - DNA, 25 bp, Rattus norvegicus
aactggcctgggatggacctgctgt

SEQ ID NO: 30592 - DNA, 25 bp, Rattus norvegicus
aactggcctgggttggacctgctgt

SEQ ID NO: 30593 - DNA, 25 bp, Rattus norvegicus
aactggccttgcagagggtgctgtc

SEQ ID NO: 30594 - DNA, 25 bp, Rattus norvegicus
aactggccttgctgagggtgctgtc

SEQ ID NO: 30595 - DNA, 25 bp, Rattus norvegicus
aactggcctttaataatggtcacaa

SEQ ID NO: 30596 - DNA, 25 bp, Rattus norvegicus
aactggcctttattaatggtcacaa

SEQ ID NO: 30597 - DNA, 25 bp, Rattus norvegicus
aactggcgcacgatggcactcttgc

SEQ ID NO: 30598 - DNA, 25 bp, Rattus norvegicus
aactggcgcacgttggcactcttgc

SEQ ID NO: 30599 - DNA, 25 bp, Rattus norvegicus
aactggcgcagacactggctcagga

SEQ ID NO: 30600 - DNA, 25 bp, Rattus norvegicus
aactggcgcagagactggctcagga

SEQ ID NO: 30601 - DNA, 25 bp, Rattus norvegicus
aactggcgctgtatctggctcggaa

SEQ ID NO: 30602 - DNA, 25 bp, Rattus norvegicus
aactggcgctgtttctggctcggaa

SEQ ID NO: 30603 - DNA, 25 bp, Rattus norvegicus
aactggcgcttgcttcatggacgtc

SEQ ID NO: 30604 - DNA, 25 bp, Rattus norvegicus
aactggcgcttggttcatggacgtc

SEQ ID NO: 30605 - DNA, 25 bp, Rattus norvegicus
aactggcggccacgtacatcgactt

SEQ ID NO: 30606 - DNA, 25 bp, Rattus norvegicus
aactggcggccaggtacatcgactt

SEQ ID NO: 30607 - DNA, 25 bp, Rattus norvegicus
aactggctaccaccattcacttttt

SEQ ID NO: 30608 - DNA, 25 bp, Rattus norvegicus
aactggctaccagcattcacttttt

SEQ ID NO: 30609 - DNA, 25 bp, Rattus norvegicus
aactggctcagacctagtcattctc

SEQ ID NO: 30610 - DNA, 25 bp, Rattus norvegicus
aactggctcagagctagtcattctc

SEQ ID NO: 30611 - DNA, 25 bp, Rattus norvegicus
aactggctccaactcaggtggttcc

SEQ ID NO: 30612 - DNA, 25 bp, Rattus norvegicus
aactggctccaagtcaggtggttcc

SEQ ID NO: 30613 - DNA, 25 bp, Rattus norvegicus
aactggctgaggaatcgtcactcct

SEQ ID NO: 30614 - DNA, 25 bp, Rattus norvegicus
aactggctgaggtatcgtcactcct

SEQ ID NO: 30615 - DNA, 25 bp, Rattus norvegicus
aactggctgatgaccagctgtgcta

SEQ ID NO: 30616 - DNA, 25 bp, Rattus norvegicus
aactggctgatgtccagctgtgcta

SEQ ID NO: 30617 - DNA, 25 bp, Rattus norvegicus
aactggctgcttatgggatcctgga

SEQ ID NO: 30618 - DNA, 25 bp, Rattus norvegicus
aactggctgcttttgggatcctgga

SEQ ID NO: 30619 - DNA, 25 bp, Rattus norvegicus
aactggctggtaaactgctgcttcg

SEQ ID NO: 30620 - DNA, 25 bp, Rattus norvegicus
aactggctggtatactgctgcttcg

SEQ ID NO: 30621 - DNA, 25 bp, Rattus norvegicus
aactggcttcagcattcacagtgaa

SEQ ID NO: 30622 - DNA, 25 bp, Rattus norvegicus
aactggcttcaggattcacagtgaa

SEQ ID NO: 30623 - DNA, 25 bp, Rattus norvegicus
aactggctttcaatgaggatctctg

SEQ ID NO: 30624 - DNA, 25 bp, Rattus norvegicus
aactggctttcattgaggatctctg

SEQ ID NO: 30625 - DNA, 25 bp, Rattus norvegicus
aactggctttgaagactctgtccga

SEQ ID NO: 30626 - DNA, 25 bp, Rattus norvegicus
aactggctttgatgactctgtccga

SEQ ID NO: 30627 - DNA, 25 bp, Rattus norvegicus
aactggcttttgcacctgaatattt

SEQ ID NO: 30628 - DNA, 25 bp, Rattus norvegicus
aactggcttttggacctgaatattt

SEQ ID NO: 30629 - DNA, 25 bp, Rattus norvegicus
aactgggaacagagggatacatact

SEQ ID NO: 30630 - DNA, 25 bp, Rattus norvegicus
aactgggaacagtgggatacatact

SEQ ID NO: 30631 - DNA, 25 bp, Rattus norvegicus
aactgggaacccacgtggtctgcaa

SEQ ID NO: 30632 - DNA, 25 bp, Rattus norvegicus
aactgggaaccctcgtggtctgcaa

SEQ ID NO: 30633 - DNA, 25 bp, Rattus norvegicus
aactgggaacctcgtattcgccaat

SEQ ID NO: 30634 - DNA, 25 bp, Rattus norvegicus
aactgggaacctggtattcgccaat

SEQ ID NO: 30635 - DNA, 25 bp, Rattus norvegicus
aactgggaagctcaacaacgtattt

SEQ ID NO: 30636 - DNA, 25 bp, Rattus norvegicus
aactgggaagctgaacaacgtattt

SEQ ID NO: 30637 - DNA, 25 bp, Rattus norvegicus
aactgggaaggcatggaggctgaaa

SEQ ID NO: 30638 - DNA, 25 bp, Rattus norvegicus
aactgggaaggcttggaggctgaaa

SEQ ID NO: 30639 - DNA, 25 bp, Rattus norvegicus
aactgggaagttactgtctagcctt

SEQ ID NO: 30640 - DNA, 25 bp, Rattus norvegicus
aactgggaagtttctgtctagcctt

SEQ ID NO: 30641 - DNA, 25 bp, Rattus norvegicus
aactgggacaacactgtaggtcagg

SEQ ID NO: 30642 - DNA, 25 bp, Rattus norvegicus
aactgggacaactctgtaggtcagg

SEQ ID NO: 30643 - DNA, 25 bp, Rattus norvegicus
aactgggacagtcaatctgcctacc

SEQ ID NO: 30644 - DNA, 25 bp, Rattus norvegicus
aactgggacagtctctatcccaaaa

SEQ ID NO: 30645 - DNA, 25 bp, Rattus norvegicus
aactgggacagtgaatctgcctacc

SEQ ID NO: 30646 - DNA, 25 bp, Rattus norvegicus
aactgggacagtgtctatcccaaaa

SEQ ID NO: 30647 - DNA, 25 bp, Rattus norvegicus
aactgggacttaattgactgctctt

SEQ ID NO: 30648 - DNA, 25 bp, Rattus norvegicus
aactgggacttatttgactgctctt

SEQ ID NO: 30649 - DNA, 25 bp, Rattus norvegicus
aactgggagatgcagcgtttccctt

SEQ ID NO: 30650 - DNA, 25 bp, Rattus norvegicus
aactgggagatggagcgtttccctt

SEQ ID NO: 30651 - DNA, 25 bp, Rattus norvegicus
aactgggagcaaaaatccattctgc

SEQ ID NO: 30652 - DNA, 25 bp, Rattus norvegicus
aactgggagcaactgatcctgggaa

SEQ ID NO: 30653 - DNA, 25 bp, Rattus norvegicus
aactgggagcaagtgatcctgggaa

SEQ ID NO: 30654 - DNA, 25 bp, Rattus norvegicus
aactgggagcaataatccattctgc

SEQ ID NO: 30655 - DNA, 25 bp, Rattus norvegicus
aactgggagtacatctacagcctgc

SEQ ID NO: 30656 - DNA, 25 bp, Rattus norvegicus
aactgggagtacttctacagcctgc

SEQ ID NO: 30657 - DNA, 25 bp, Rattus norvegicus
aactgggataatagattctcctgaa

SEQ ID NO: 30658 - DNA, 25 bp, Rattus norvegicus
aactgggataattgattctcctgaa

SEQ ID NO: 30659 - DNA, 25 bp, Rattus norvegicus
aactgggcaaagactcggcgggcat

SEQ ID NO: 30660 - DNA, 25 bp, Rattus norvegicus
aactgggcaaagtctcggcgggcat

SEQ ID NO: 30661 - DNA, 25 bp, Rattus norvegicus
aactgggcactcaggtcctcaacag

SEQ ID NO: 30662 - DNA, 25 bp, Rattus norvegicus
aactgggcactctggtcctcaacag

SEQ ID NO: 30663 - DNA, 25 bp, Rattus norvegicus
aactgggcactgatgcaggaagatc

SEQ ID NO: 30664 - DNA, 25 bp, Rattus norvegicus
aactgggcactgttgcaggaagatc

SEQ ID NO: 30665 - DNA, 25 bp, Rattus norvegicus
aactgggcagtactcctactgtgta

SEQ ID NO: 30666 - DNA, 25 bp, Rattus norvegicus
aactgggcagtagtcctactgtgta

SEQ ID NO: 30667 - DNA, 25 bp, Rattus norvegicus
aactgggcagtgagctcaattcctg

SEQ ID NO: 30668 - DNA, 25 bp, Rattus norvegicus
aactgggcagtgtgctcaattcctg

SEQ ID NO: 30669 - DNA, 25 bp, Rattus norvegicus
aactgggccactacccaatgagcta

SEQ ID NO: 30670 - DNA, 25 bp, Rattus norvegicus
aactgggccacttcccaatgagcta

SEQ ID NO: 30671 - DNA, 25 bp, Rattus norvegicus
aactgggcctctactaaaagctcat

SEQ ID NO: 30672 - DNA, 25 bp, Rattus norvegicus
aactgggcctcttctaaaagctcat

SEQ ID NO: 30673 - DNA, 25 bp, Rattus norvegicus
aactgggcctggaggtatgagccta

SEQ ID NO: 30674 - DNA, 25 bp, Rattus norvegicus
aactgggcctggtggtatgagccta

SEQ ID NO: 30675 - DNA, 25 bp, Rattus norvegicus
aactgggcctgtatgtagaggatcc

SEQ ID NO: 30676 - DNA, 25 bp, Rattus norvegicus
aactgggcctgtttgtagaggatcc

SEQ ID NO: 30677 - DNA, 25 bp, Rattus norvegicus
aactgggccttgaagtcacctggac

SEQ ID NO: 30678 - DNA, 25 bp, Rattus norvegicus
aactgggccttgtagtcacctggac

SEQ ID NO: 30679 - DNA, 25 bp, Rattus norvegicus
aactgggcctttcagatgtacgacc

SEQ ID NO: 30680 - DNA, 25 bp, Rattus norvegicus
aactgggcctttgagatgtacgacc

SEQ ID NO: 30681 - DNA, 25 bp, Rattus norvegicus
aactgggcgggcagcacccatgagt

SEQ ID NO: 30682 - DNA, 25 bp, Rattus norvegicus
aactgggcgggctgcacccatgagt

SEQ ID NO: 30683 - DNA, 25 bp, Rattus norvegicus
aactgggctgcaagctgtctggaca

SEQ ID NO: 30684 - DNA, 25 bp, Rattus norvegicus
aactgggctgcatgctgtctggaca

SEQ ID NO: 30685 - DNA, 25 bp, Rattus norvegicus
aactgggctgccaactgaggccaca

SEQ ID NO: 30686 - DNA, 25 bp, Rattus norvegicus
aactgggctgcctactgaggccaca

SEQ ID NO: 30687 - DNA, 25 bp, Rattus norvegicus
aactgggcttggaacctcgccctga

SEQ ID NO: 30688 - DNA, 25 bp, Rattus norvegicus
aactgggcttggtacctcgccctga

SEQ ID NO: 30689 - DNA, 25 bp, Rattus norvegicus
aactgggtactgatgcctctgggaa

SEQ ID NO: 30690 - DNA, 25 bp, Rattus norvegicus
aactgggtactgttgcctctgggaa

SEQ ID NO: 30691 - DNA, 25 bp, Rattus norvegicus
aactgggtcagcagtatggctgcga

SEQ ID NO: 30692 - DNA, 25 bp, Rattus norvegicus
aactgggtcagctgtatggctgcga

SEQ ID NO: 30693 - DNA, 25 bp, Rattus norvegicus
aactgggtcatacccttgctgagtg

SEQ ID NO: 30694 - DNA, 25 bp, Rattus norvegicus
aactgggtcatagccttgctgagtg

SEQ ID NO: 30695 - DNA, 25 bp, Rattus norvegicus
aactgggtccacatagcaagttcca

SEQ ID NO: 30696 - DNA, 25 bp, Rattus norvegicus
aactgggtccacttagcaagttcca

SEQ ID NO: 30697 - DNA, 25 bp, Rattus norvegicus
aactgggtccagagcttctggttgc

SEQ ID NO: 30698 - DNA, 25 bp, Rattus norvegicus
aactgggtccagtgcttctggttgc

SEQ ID NO: 30699 - DNA, 25 bp, Rattus norvegicus
aactgggtcctgcagtatgtccaca

SEQ ID NO: 30700 - DNA, 25 bp, Rattus norvegicus
aactgggtcctggagtatgtccaca

SEQ ID NO: 30701 - DNA, 25 bp, Rattus norvegicus
aactgggtctgtactctcatttttc

SEQ ID NO: 30702 - DNA, 25 bp, Rattus norvegicus
aactgggtctgtctgtcctaaatta

SEQ ID NO: 30703 - DNA, 25 bp, Rattus norvegicus
aactgggtctgtgtgtcctaaatta

SEQ ID NO: 30704 - DNA, 25 bp, Rattus norvegicus
aactgggtctgttctctcatttttc

SEQ ID NO: 30705 - DNA, 25 bp, Rattus norvegicus
aactgggtcttccacaggttacagg

SEQ ID NO: 30706 - DNA, 25 bp, Rattus norvegicus
aactgggtcttcgacaggttacagg

SEQ ID NO: 30707 - DNA, 25 bp, Rattus norvegicus
aactgggtggcaattggaataacta

SEQ ID NO: 30708 - DNA, 25 bp, Rattus norvegicus
aactgggtggcatttggaataacta

SEQ ID NO: 30709 - DNA, 25 bp, Rattus norvegicus
aactgggtgtccagcctgttgttac

SEQ ID NO: 30710 - DNA, 25 bp, Rattus norvegicus
aactgggtgtcctgcctgttgttac

SEQ ID NO: 30711 - DNA, 25 bp, Rattus norvegicus
aactgggttattatgatcttcttgc

SEQ ID NO: 30712 - DNA, 25 bp, Rattus norvegicus
aactgggttattttgatcttcttgc

SEQ ID NO: 30713 - DNA, 25 bp, Rattus norvegicus
aactgggttgggagctactcactgt

SEQ ID NO: 30714 - DNA, 25 bp, Rattus norvegicus
aactgggttgggtgctactcactgt

SEQ ID NO: 30715 - DNA, 25 bp, Rattus norvegicus
aactgggttgtgattatatttggag

SEQ ID NO: 30716 - DNA, 25 bp, Rattus norvegicus
aactgggttgtgtttatatttggag

SEQ ID NO: 30717 - DNA, 25 bp, Rattus norvegicus
aactggtaactgatcaagtgcttgt

SEQ ID NO: 30718 - DNA, 25 bp, Rattus norvegicus
aactggtaactgttcaagtgcttgt

SEQ ID NO: 30719 - DNA, 25 bp, Rattus norvegicus
aactggtaccgaatggcacttctct

SEQ ID NO: 30720 - DNA, 25 bp, Rattus norvegicus
aactggtaccgattggcacttctct

SEQ ID NO: 30721 - DNA, 25 bp, Rattus norvegicus
aactggtacttgattcttcgcgtct

SEQ ID NO: 30722 - DNA, 25 bp, Rattus norvegicus
aactggtacttgtttcttcgcgtct

SEQ ID NO: 30723 - DNA, 25 bp, Rattus norvegicus
aactggtactttcaagcctgaccgc

SEQ ID NO: 30724 - DNA, 25 bp, Rattus norvegicus
aactggtactttgaagcctgaccgc

SEQ ID NO: 30725 - DNA, 25 bp, Rattus norvegicus
aactggtagaccctttgctgtcatt

SEQ ID NO: 30726 - DNA, 25 bp, Rattus norvegicus
aactggtagaccgtttgctgtcatt

SEQ ID NO: 30727 - DNA, 25 bp, Rattus norvegicus
aactggtatcccagtatgaagccga

SEQ ID NO: 30728 - DNA, 25 bp, Rattus norvegicus
aactggtatccctgtatgaagccga

SEQ ID NO: 30729 - DNA, 25 bp, Rattus norvegicus
aactggtatggcatcaattattcac

SEQ ID NO: 30730 - DNA, 25 bp, Rattus norvegicus
aactggtatggcttcaattattcac

SEQ ID NO: 30731 - DNA, 25 bp, Rattus norvegicus
aactggtatgtgcagccctcctgtg

SEQ ID NO: 30732 - DNA, 25 bp, Rattus norvegicus
aactggtatgtgcagtgcctgcggg

SEQ ID NO: 30733 - DNA, 25 bp, Rattus norvegicus
aactggtatgtggagccctcctgtg

SEQ ID NO: 30734 - DNA, 25 bp, Rattus norvegicus
aactggtatgtggagtgcctgcggg

SEQ ID NO: 30735 - DNA, 25 bp, Rattus norvegicus
aactggtattgtctggctgtgattc

SEQ ID NO: 30736 - DNA, 25 bp, Rattus norvegicus
aactggtattgtgtggctgtgattc

SEQ ID NO: 30737 - DNA, 25 bp, Rattus norvegicus
aactggtcacgtcatggtctttgca

SEQ ID NO: 30738 - DNA, 25 bp, Rattus norvegicus
aactggtcacgtgatggtctttgca

SEQ ID NO: 30739 - DNA, 25 bp, Rattus norvegicus
aactggtcactgacttgtcacctgg

SEQ ID NO: 30740 - DNA, 25 bp, Rattus norvegicus
aactggtcactgtcttgtcacctgg

SEQ ID NO: 30741 - DNA, 25 bp, Rattus norvegicus
aactggtccagcactgagtacacgc

SEQ ID NO: 30742 - DNA, 25 bp, Rattus norvegicus
aactggtccagctctgagtacacgc

SEQ ID NO: 30743 - DNA, 25 bp, Rattus norvegicus
aactggtccatgaaagtactttcca

SEQ ID NO: 30744 - DNA, 25 bp, Rattus norvegicus
aactggtccatgtaagtactttcca

SEQ ID NO: 30745 - DNA, 25 bp, Rattus norvegicus
aactggtcccagcagatgcaggctc

SEQ ID NO: 30746 - DNA, 25 bp, Rattus norvegicus
aactggtcccaggagatgcaggctc

SEQ ID NO: 30747 - DNA, 25 bp, Rattus norvegicus
aactggtcggagactcctcttcact

SEQ ID NO: 30748 - DNA, 25 bp, Rattus norvegicus
aactggtcggagtctcctcttcact

SEQ ID NO: 30749 - DNA, 25 bp, Rattus norvegicus
aactggtcgttcagctgttccagca

SEQ ID NO: 30750 - DNA, 25 bp, Rattus norvegicus
aactggtcgttctgctgttccagca

SEQ ID NO: 30751 - DNA, 25 bp, Rattus norvegicus
aactggtctccaagtggtacttggc

SEQ ID NO: 30752 - DNA, 25 bp, Rattus norvegicus
aactggtctccatgtggtacttggc

SEQ ID NO: 30753 - DNA, 25 bp, Rattus norvegicus
aactggtctggaagctacttcacag

SEQ ID NO: 30754 - DNA, 25 bp, Rattus norvegicus
aactggtctggatgctacttcacag

SEQ ID NO: 30755 - DNA, 25 bp, Rattus norvegicus
aactggtcttccagcgccgcgaaca

SEQ ID NO: 30756 - DNA, 25 bp, Rattus norvegicus
aactggtcttcctgcgccgcgaaca

SEQ ID NO: 30757 - DNA, 25 bp, Rattus norvegicus
aactggtcttgaacctgccttatag

SEQ ID NO: 30758 - DNA, 25 bp, Rattus norvegicus
aactggtcttgatcctgccttatag

SEQ ID NO: 30759 - DNA, 25 bp, Rattus norvegicus
aactggtcttggaggcagatttgat

SEQ ID NO: 30760 - DNA, 25 bp, Rattus norvegicus
aactggtcttggtggcagatttgat

SEQ ID NO: 30761 - DNA, 25 bp, Rattus norvegicus
aactggtgactacctttttgacaac

SEQ ID NO: 30762 - DNA, 25 bp, Rattus norvegicus
aactggtgactagctttttgacaac

SEQ ID NO: 30763 - DNA, 25 bp, Rattus norvegicus
aactggtgatccagggctgtgttaa

SEQ ID NO: 30764 - DNA, 25 bp, Rattus norvegicus
aactggtgatcctgggctgtgttaa

SEQ ID NO: 30765 - DNA, 25 bp, Rattus norvegicus
aactggtgatctcttcaccctgaag

SEQ ID NO: 30766 - DNA, 25 bp, Rattus norvegicus
aactggtgatctgttcaccctgaag

SEQ ID NO: 30767 - DNA, 25 bp, Rattus norvegicus
aactggtgcagtcgctacaggacct

SEQ ID NO: 30768 - DNA, 25 bp, Rattus norvegicus
aactggtgcagtggctacaggacct

SEQ ID NO: 30769 - DNA, 25 bp, Rattus norvegicus
aactggtgcatcaagcgacggtcac

SEQ ID NO: 30770 - DNA, 25 bp, Rattus norvegicus
aactggtgcatctagcgacggtcac

SEQ ID NO: 30771 - DNA, 25 bp, Rattus norvegicus
aactggtgccaaagtggtggtatct

SEQ ID NO: 30772 - DNA, 25 bp, Rattus norvegicus
aactggtgccaatgtggtggtatct

SEQ ID NO: 30773 - DNA, 25 bp, Rattus norvegicus
aactggtgctggactcagtgtcagt

SEQ ID NO: 30774 - DNA, 25 bp, Rattus norvegicus
aactggtgctggtctcagtgtcagt

SEQ ID NO: 30775 - DNA, 25 bp, Rattus norvegicus
aactggtggcgcagtttgtattgtg

SEQ ID NO: 30776 - DNA, 25 bp, Rattus norvegicus
aactggtggcgctgtttgtattgtg

SEQ ID NO: 30777 - DNA, 25 bp, Rattus norvegicus
aactggtggctgatagtcacttcat

SEQ ID NO: 30778 - DNA, 25 bp, Rattus norvegicus
aactggtggctgttagtcacttcat

SEQ ID NO: 30779 - DNA, 25 bp, Rattus norvegicus
aactggtgggtaatctgggcctagc

SEQ ID NO: 30780 - DNA, 25 bp, Rattus norvegicus
aactggtgggtattctgggcctagc

SEQ ID NO: 30781 - DNA, 25 bp, Rattus norvegicus
aactggttaagcatggtcttcgcgc

SEQ ID NO: 30782 - DNA, 25 bp, Rattus norvegicus
aactggttaagcttggtcttcgcgc

SEQ ID NO: 30783 - DNA, 25 bp, Rattus norvegicus
aactggttacatcaagactcggcac

SEQ ID NO: 30784 - DNA, 25 bp, Rattus norvegicus
aactggttacatgaagactcggcac

SEQ ID NO: 30785 - DNA, 25 bp, Rattus norvegicus
aactggttagctcgcgtcactaaca

SEQ ID NO: 30786 - DNA, 25 bp, Rattus norvegicus
aactggttagctggcgtcactaaca

SEQ ID NO: 30787 - DNA, 25 bp, Rattus norvegicus
aactggttcataaccctagtcacat

SEQ ID NO: 30788 - DNA, 25 bp, Rattus norvegicus
aactggttcatatccctagtcacat

SEQ ID NO: 30789 - DNA, 25 bp, Rattus norvegicus
aactggttcatcatctagtactcga

SEQ ID NO: 30790 - DNA, 25 bp, Rattus norvegicus
aactggttcatcttctagtactcga

SEQ ID NO: 30791 - DNA, 25 bp, Rattus norvegicus
aactggttccaaagcctgttccagg

SEQ ID NO: 30792 - DNA, 25 bp, Rattus norvegicus
aactggttccaatgcctgttccagg

SEQ ID NO: 30793 - DNA, 25 bp, Rattus norvegicus
aactggttccacatactcagagctt

SEQ ID NO: 30794 - DNA, 25 bp, Rattus norvegicus
aactggttccacttactcagagctt

SEQ ID NO: 30795 - DNA, 25 bp, Rattus norvegicus
aactggttccatcaagactgtgcac

SEQ ID NO: 30796 - DNA, 25 bp, Rattus norvegicus
aactggttccatgaagactgtgcac

SEQ ID NO: 30797 - DNA, 25 bp, Rattus norvegicus
aactggttctcaaaggtttgaactg

SEQ ID NO: 30798 - DNA, 25 bp, Rattus norvegicus
aactggttctcataggtttgaactg

SEQ ID NO: 30799 - DNA, 25 bp, Rattus norvegicus
aactggttctttcgatttcatcact

SEQ ID NO: 30800 - DNA, 25 bp, Rattus norvegicus
aactggttctttggatttcatcact

SEQ ID NO: 30801 - DNA, 25 bp, Rattus norvegicus
aactggttgaacatgaggccctcta

SEQ ID NO: 30802 - DNA, 25 bp, Rattus norvegicus
aactggttgaacttgaggccctcta

SEQ ID NO: 30803 - DNA, 25 bp, Rattus norvegicus
aactggtttgtgaattgctgctgca

SEQ ID NO: 30804 - DNA, 25 bp, Rattus norvegicus
aactggtttgtgtattgctgctgca

SEQ ID NO: 30805 - DNA, 25 bp, Rattus norvegicus
aactggttttaaagtctcttacatg

SEQ ID NO: 30806 - DNA, 25 bp, Rattus norvegicus
aactggttttaatgtctcttacatg

SEQ ID NO: 30807 - DNA, 25 bp, Rattus norvegicus
aactgtaacactagttccaagggat

SEQ ID NO: 30808 - DNA, 25 bp, Rattus norvegicus
aactgtaacacttgttccaagggat

SEQ ID NO: 30809 - DNA, 25 bp, Rattus norvegicus
aactgtaactcaagtcagcaactta

SEQ ID NO: 30810 - DNA, 25 bp, Rattus norvegicus
aactgtaactcatgtcagcaactta

SEQ ID NO: 30811 - DNA, 25 bp, Rattus norvegicus
aactgtaagaagagctccctgtcct

SEQ ID NO: 30812 - DNA, 25 bp, Rattus norvegicus
aactgtaagaagtgctccctgtcct

SEQ ID NO: 30813 - DNA, 25 bp, Rattus norvegicus
aactgtaagactcttgagctggaac

SEQ ID NO: 30814 - DNA, 25 bp, Rattus norvegicus
aactgtaagactgttgagctggaac

SEQ ID NO: 30815 - DNA, 25 bp, Rattus norvegicus
aactgtaagcctcttgtcctctttt

SEQ ID NO: 30816 - DNA, 25 bp, Rattus norvegicus
aactgtaagcctgttgtcctctttt

SEQ ID NO: 30817 - DNA, 25 bp, Rattus norvegicus
aactgtaatagcactcgatcatatg

SEQ ID NO: 30818 - DNA, 25 bp, Rattus norvegicus
aactgtaatagctctcgatcatatg

SEQ ID NO: 30819 - DNA, 25 bp, Rattus norvegicus
aactgtaattccatcgagctctggt

SEQ ID NO: 30820 - DNA, 25 bp, Rattus norvegicus
aactgtaattccttcgagctctggt

SEQ ID NO: 30821 - DNA, 25 bp, Rattus norvegicus
aactgtacatggaatatttcgggtg

SEQ ID NO: 30822 - DNA, 25 bp, Rattus norvegicus
aactgtacatggaccgctactggaa

SEQ ID NO: 30823 - DNA, 25 bp, Rattus norvegicus
aactgtacatggtatatttcgggtg

SEQ ID NO: 30824 - DNA, 25 bp, Rattus norvegicus
aactgtacatggtccgctactggaa

SEQ ID NO: 30825 - DNA, 25 bp, Rattus norvegicus
aactgtacatttcccaatgggtttt

SEQ ID NO: 30826 - DNA, 25 bp, Rattus norvegicus
aactgtacatttgccaatgggtttt

SEQ ID NO: 30827 - DNA, 25 bp, Rattus norvegicus
aactgtaccaaacagcgcaagcgct

SEQ ID NO: 30828 - DNA, 25 bp, Rattus norvegicus
aactgtaccaaagagcgcaagcgct

SEQ ID NO: 30829 - DNA, 25 bp, Rattus norvegicus
aactgtaccacaaccgccttgggag

SEQ ID NO: 30830 - DNA, 25 bp, Rattus norvegicus
aactgtaccacatccgccttgggag

SEQ ID NO: 30831 - DNA, 25 bp, Rattus norvegicus
aactgtaccgaaatgtcactcctct

SEQ ID NO: 30832 - DNA, 25 bp, Rattus norvegicus
aactgtaccgaattgtcactcctct

SEQ ID NO: 30833 - DNA, 25 bp, Rattus norvegicus
aactgtacctccagaagttcagaga

SEQ ID NO: 30834 - DNA, 25 bp, Rattus norvegicus
aactgtacctcctgaagttcagaga

SEQ ID NO: 30835 - DNA, 25 bp, Rattus norvegicus
aactgtacctgcactattgtcttca

SEQ ID NO: 30836 - DNA, 25 bp, Rattus norvegicus
aactgtacctgctctattgtcttca

SEQ ID NO: 30837 - DNA, 25 bp, Rattus norvegicus
aactgtacggcgagtgctgtagcta

SEQ ID NO: 30838 - DNA, 25 bp, Rattus norvegicus
aactgtacggcgtgtgctgtagcta

SEQ ID NO: 30839 - DNA, 25 bp, Rattus norvegicus
aactgtacggtactttgcctcaaag

SEQ ID NO: 30840 - DNA, 25 bp, Rattus norvegicus
aactgtacggtagtttgcctcaaag

SEQ ID NO: 30841 - DNA, 25 bp, Rattus norvegicus
aactgtactctcagattggaacgac

SEQ ID NO: 30842 - DNA, 25 bp, Rattus norvegicus
aactgtactctctgattggaacgac

SEQ ID NO: 30843 - DNA, 25 bp, Rattus norvegicus
aactgtactgctaaaattcttgaat

SEQ ID NO: 30844 - DNA, 25 bp, Rattus norvegicus
aactgtactgctcttggagacctgg

SEQ ID NO: 30845 - DNA, 25 bp, Rattus norvegicus
aactgtactgctgttggagacctgg

SEQ ID NO: 30846 - DNA, 25 bp, Rattus norvegicus
aactgtactgcttaaattcttgaat

SEQ ID NO: 30847 - DNA, 25 bp, Rattus norvegicus
aactgtactgtaaaggcctgcctgg

SEQ ID NO: 30848 - DNA, 25 bp, Rattus norvegicus
aactgtactgtataggcctgcctgg

SEQ ID NO: 30849 - DNA, 25 bp, Rattus norvegicus
aactgtactttgctattaactgctg

SEQ ID NO: 30850 - DNA, 25 bp, Rattus norvegicus
aactgtactttggtattaactgctg

SEQ ID NO: 30851 - DNA, 25 bp, Rattus norvegicus
aactgtagaatcagcattcccagag

SEQ ID NO: 30852 - DNA, 25 bp, Rattus norvegicus
aactgtagaatctgcattcccagag

SEQ ID NO: 30853 - DNA, 25 bp, Rattus norvegicus
aactgtagatgactcccctgtggat

SEQ ID NO: 30854 - DNA, 25 bp, Rattus norvegicus
aactgtagatgagtcccctgtggat

SEQ ID NO: 30855 - DNA, 25 bp, Rattus norvegicus
aactgtagcactagttcgccactgt

SEQ ID NO: 30856 - DNA, 25 bp, Rattus norvegicus
aactgtagcacttgttcgccactgt

SEQ ID NO: 30857 - DNA, 25 bp, Rattus norvegicus
aactgtagcagcaaggacctcgacc

SEQ ID NO: 30858 - DNA, 25 bp, Rattus norvegicus
aactgtagcagctaggacctcgacc

SEQ ID NO: 30859 - DNA, 25 bp, Rattus norvegicus
aactgtagcccacgaggttccagca

SEQ ID NO: 30860 - DNA, 25 bp, Rattus norvegicus
aactgtagcccaggaggttccagca

SEQ ID NO: 30861 - DNA, 25 bp, Rattus norvegicus
aactgtagggccagagtctatcctg

SEQ ID NO: 30862 - DNA, 25 bp, Rattus norvegicus
aactgtagggcctgagtctatcctg

SEQ ID NO: 30863 - DNA, 25 bp, Rattus norvegicus
aactgtaggtgcagttgccttggac

SEQ ID NO: 30864 - DNA, 25 bp, Rattus norvegicus
aactgtaggtgctgttgccttggac

SEQ ID NO: 30865 - DNA, 25 bp, Rattus norvegicus
aactgtagtctcatagaatgtcgta

SEQ ID NO: 30866 - DNA, 25 bp, Rattus norvegicus
aactgtagtctcttagaatgtcgta

SEQ ID NO: 30867 - DNA, 25 bp, Rattus norvegicus
aactgtagtcttcaaccccattatc

SEQ ID NO: 30868 - DNA, 25 bp, Rattus norvegicus
aactgtagtcttgaaccccattatc

SEQ ID NO: 30869 - DNA, 25 bp, Rattus norvegicus
aactgtataccaaatcccatcatag

SEQ ID NO: 30870 - DNA, 25 bp, Rattus norvegicus
aactgtataccatatcccatcatag

SEQ ID NO: 30871 - DNA, 25 bp, Rattus norvegicus
aactgtatacccagatgactcctta

SEQ ID NO: 30872 - DNA, 25 bp, Rattus norvegicus
aactgtataccctgatgactcctta

SEQ ID NO: 30873 - DNA, 25 bp, Rattus norvegicus
aactgtatagctctgacactgtata

SEQ ID NO: 30874 - DNA, 25 bp, Rattus norvegicus
aactgtatagctgtgacactgtata

SEQ ID NO: 30875 - DNA, 25 bp, Rattus norvegicus
aactgtataggactggcagaattca

SEQ ID NO: 30876 - DNA, 25 bp, Rattus norvegicus
aactgtataggagtggcagaattca

SEQ ID NO: 30877 - DNA, 25 bp, Rattus norvegicus
aactgtatatagctgactgtgtgaa

SEQ ID NO: 30878 - DNA, 25 bp, Rattus norvegicus
aactgtatataggtgactgtgtgaa

SEQ ID NO: 30879 - DNA, 25 bp, Rattus norvegicus
aactgtatcaccatgatgcctgcat

SEQ ID NO: 30880 - DNA, 25 bp, Rattus norvegicus
aactgtatcaccttgatgcctgcat

SEQ ID NO: 30881 - DNA, 25 bp, Rattus norvegicus
aactgtatcacgattatacctgcag

SEQ ID NO: 30882 - DNA, 25 bp, Rattus norvegicus
aactgtatcacgtttatacctgcag

SEQ ID NO: 30883 - DNA, 25 bp, Rattus norvegicus
aactgtatgactacgctcaggaaca

SEQ ID NO: 30884 - DNA, 25 bp, Rattus norvegicus
aactgtatgacttcgctcaggaaca

SEQ ID NO: 30885 - DNA, 25 bp, Rattus norvegicus
aactgtatggttactttatatgggt

SEQ ID NO: 30886 - DNA, 25 bp, Rattus norvegicus
aactgtatggtttctttatatgggt

SEQ ID NO: 30887 - DNA, 25 bp, Rattus norvegicus
aactgtattacgatgcttccaccgg

SEQ ID NO: 30888 - DNA, 25 bp, Rattus norvegicus
aactgtattacgttgcttccaccgg

SEQ ID NO: 30889 - DNA, 25 bp, Rattus norvegicus
aactgtattcctcgctgcttgggaa

SEQ ID NO: 30890 - DNA, 25 bp, Rattus norvegicus
aactgtattcctggctgcttgggaa

SEQ ID NO: 30891 - DNA, 25 bp, Rattus norvegicus
aactgtattctgaaccatttagggt

SEQ ID NO: 30892 - DNA, 25 bp, Rattus norvegicus
aactgtattctgtaccatttagggt

SEQ ID NO: 30893 - DNA, 25 bp, Rattus norvegicus
aactgtatttgtattacttgcttgt

SEQ ID NO: 30894 - DNA, 25 bp, Rattus norvegicus
aactgtatttgttttacttgcttgt

SEQ ID NO: 30895 - DNA, 25 bp, Rattus norvegicus
aactgtattttcacgtcattgcgga

SEQ ID NO: 30896 - DNA, 25 bp, Rattus norvegicus
aactgtattttctcgtcattgcgga

SEQ ID NO: 30897 - DNA, 25 bp, Rattus norvegicus
aactgtcaaaagacatctcctccac

SEQ ID NO: 30898 - DNA, 25 bp, Rattus norvegicus
aactgtcaaaagtcatctcctccac

SEQ ID NO: 30899 - DNA, 25 bp, Rattus norvegicus
aactgtcaagaaccctgtttacctt

SEQ ID NO: 30900 - DNA, 25 bp, Rattus norvegicus
aactgtcaagaagcctgtttacctt

SEQ ID NO: 30901 - DNA, 25 bp, Rattus norvegicus
aactgtcacatgctcatcctggaga

SEQ ID NO: 30902 - DNA, 25 bp, Rattus norvegicus
aactgtcacatggtcatcctggaga

SEQ ID NO: 30903 - DNA, 25 bp, Rattus norvegicus
aactgtcacgttctccacggtggag

SEQ ID NO: 30904 - DNA, 25 bp, Rattus norvegicus
aactgtcacgttgtccacggtggag

SEQ ID NO: 30905 - DNA, 25 bp, Rattus norvegicus
aactgtcactaacctgacgcagctg

SEQ ID NO: 30906 - DNA, 25 bp, Rattus norvegicus
aactgtcactaagctgacgcagctg

SEQ ID NO: 30907 - DNA, 25 bp, Rattus norvegicus
aactgtcacttcatttcttttaaat

SEQ ID NO: 30908 - DNA, 25 bp, Rattus norvegicus
aactgtcacttcttttcttttaaat

SEQ ID NO: 30909 - DNA, 25 bp, Rattus norvegicus
aactgtcagatgctctgggtttcta

SEQ ID NO: 30910 - DNA, 25 bp, Rattus norvegicus
aactgtcagatggtctgggtttcta

SEQ ID NO: 30911 - DNA, 25 bp, Rattus norvegicus
aactgtcagggtcttggcttaaatc

SEQ ID NO: 30912 - DNA, 25 bp, Rattus norvegicus
aactgtcagggtgttggcttaaatc

SEQ ID NO: 30913 - DNA, 25 bp, Rattus norvegicus
aactgtcaggtgctagtggcccaca

SEQ ID NO: 30914 - DNA, 25 bp, Rattus norvegicus
aactgtcaggtggtagtggcccaca

SEQ ID NO: 30915 - DNA, 25 bp, Rattus norvegicus
aactgtcagtcacgaggcagctcct

SEQ ID NO: 30916 - DNA, 25 bp, Rattus norvegicus
aactgtcagtcaggaggcagctcct

SEQ ID NO: 30917 - DNA, 25 bp, Rattus norvegicus
aactgtcatacgaatgggacctaca

SEQ ID NO: 30918 - DNA, 25 bp, Rattus norvegicus
aactgtcatacgtatgggacctaca

SEQ ID NO: 30919 - DNA, 25 bp, Rattus norvegicus
aactgtcatagtatatattactagt

SEQ ID NO: 30920 - DNA, 25 bp, Rattus norvegicus
aactgtcatagtttatattactagt

SEQ ID NO: 30921 - DNA, 25 bp, Rattus norvegicus
aactgtcatcagagaagagccacca

SEQ ID NO: 30922 - DNA, 25 bp, Rattus norvegicus
aactgtcatcagctaagtctaggag

SEQ ID NO: 30923 - DNA, 25 bp, Rattus norvegicus
aactgtcatcaggtaagtctaggag

SEQ ID NO: 30924 - DNA, 25 bp, Rattus norvegicus
aactgtcatcagtgaagagccacca

SEQ ID NO: 30925 - DNA, 25 bp, Rattus norvegicus
aactgtcatcctctttgctaggtta

SEQ ID NO: 30926 - DNA, 25 bp, Rattus norvegicus
aactgtcatcctgtttgctaggtta

SEQ ID NO: 30927 - DNA, 25 bp, Rattus norvegicus
aactgtcatgtcagaggtgtaaaca

SEQ ID NO: 30928 - DNA, 25 bp, Rattus norvegicus
aactgtcatgtctgaggtgtaaaca

SEQ ID NO: 30929 - DNA, 25 bp, Rattus norvegicus
aactgtcatgtgctgtctgttaggc

SEQ ID NO: 30930 - DNA, 25 bp, Rattus norvegicus
aactgtcatgtggtgtctgttaggc

SEQ ID NO: 30931 - DNA, 25 bp, Rattus norvegicus
aactgtcattggctgtactggcaag

SEQ ID NO: 30932 - DNA, 25 bp, Rattus norvegicus
aactgtcattgggtgtactggcaag

SEQ ID NO: 30933 - DNA, 25 bp, Rattus norvegicus
aactgtccaagcaggaggtaccaca

SEQ ID NO: 30934 - DNA, 25 bp, Rattus norvegicus
aactgtccaagctggaggtaccaca

SEQ ID NO: 30935 - DNA, 25 bp, Rattus norvegicus
aactgtccaatgatacatatacctg

SEQ ID NO: 30936 - DNA, 25 bp, Rattus norvegicus
aactgtccaatgttacatatacctg

SEQ ID NO: 30937 - DNA, 25 bp, Rattus norvegicus
aactgtccacacacttttattttgt

SEQ ID NO: 30938 - DNA, 25 bp, Rattus norvegicus
aactgtccacactcttttattttgt

SEQ ID NO: 30939 - DNA, 25 bp, Rattus norvegicus
aactgtccagctaagcctttatggg

SEQ ID NO: 30940 - DNA, 25 bp, Rattus norvegicus
aactgtccagcttagcctttatggg

SEQ ID NO: 30941 - DNA, 25 bp, Rattus norvegicus
aactgtccattcatcacctggaata

SEQ ID NO: 30942 - DNA, 25 bp, Rattus norvegicus
aactgtccattcttcacctggaata

SEQ ID NO: 30943 - DNA, 25 bp, Rattus norvegicus
aactgtccccaactcagggttaatg

SEQ ID NO: 30944 - DNA, 25 bp, Rattus norvegicus
aactgtccccaagtcagggttaatg

SEQ ID NO: 30945 - DNA, 25 bp, Rattus norvegicus
aactgtccctgaagactcttaacct

SEQ ID NO: 30946 - DNA, 25 bp, Rattus norvegicus
aactgtccctgatgactcttaacct

SEQ ID NO: 30947 - DNA, 25 bp, Rattus norvegicus
aactgtccgagtctgctttatagca

SEQ ID NO: 30948 - DNA, 25 bp, Rattus norvegicus
aactgtccgagtgtgctttatagca

SEQ ID NO: 30949 - DNA, 25 bp, Rattus norvegicus
aactgtccgtcaagtgtagccgcgt

SEQ ID NO: 30950 - DNA, 25 bp, Rattus norvegicus
aactgtccgtcatgtgtagccgcgt

SEQ ID NO: 30951 - DNA, 25 bp, Rattus norvegicus
aactgtcctcatctggagcctactt

SEQ ID NO: 30952 - DNA, 25 bp, Rattus norvegicus
aactgtcctcatgtggagcctactt

SEQ ID NO: 30953 - DNA, 25 bp, Rattus norvegicus
aactgtccttacatctccagaggga

SEQ ID NO: 30954 - DNA, 25 bp, Rattus norvegicus
aactgtccttacttctccagaggga

SEQ ID NO: 30955 - DNA, 25 bp, Rattus norvegicus
aactgtccttgtcttcatggataac

SEQ ID NO: 30956 - DNA, 25 bp, Rattus norvegicus
aactgtccttgtgttcatggataac

SEQ ID NO: 30957 - DNA, 25 bp, Rattus norvegicus
aactgtcgagatccaggcagactca

SEQ ID NO: 30958 - DNA, 25 bp, Rattus norvegicus
aactgtcgagatgcaggcagactca

SEQ ID NO: 30959 - DNA, 25 bp, Rattus norvegicus
aactgtcgtagtcatggctttggga

SEQ ID NO: 30960 - DNA, 25 bp, Rattus norvegicus
aactgtcgtagtgatggctttggga

SEQ ID NO: 30961 - DNA, 25 bp, Rattus norvegicus
aactgtctaagtacttccaagccaa

SEQ ID NO: 30962 - DNA, 25 bp, Rattus norvegicus
aactgtctaagttcttccaagccaa

SEQ ID NO: 30963 - DNA, 25 bp, Rattus norvegicus
aactgtctacagaatgtcttttgca

SEQ ID NO: 30964 - DNA, 25 bp, Rattus norvegicus
aactgtctacagtatgtcttttgca

SEQ ID NO: 30965 - DNA, 25 bp, Rattus norvegicus
aactgtctactaccccacattatgt

SEQ ID NO: 30966 - DNA, 25 bp, Rattus norvegicus
aactgtctactagcccacattatgt

SEQ ID NO: 30967 - DNA, 25 bp, Rattus norvegicus
aactgtctataactcaaagatctga

SEQ ID NO: 30968 - DNA, 25 bp, Rattus norvegicus
aactgtctataagtcaaagatctga

SEQ ID NO: 30969 - DNA, 25 bp, Rattus norvegicus
aactgtctatagctccaattccagg

SEQ ID NO: 30970 - DNA, 25 bp, Rattus norvegicus
aactgtctataggtccaattccagg

SEQ ID NO: 30971 - DNA, 25 bp, Rattus norvegicus
aactgtctcaatattttcctctggg

SEQ ID NO: 30972 - DNA, 25 bp, Rattus norvegicus
aactgtctcaattttttcctctggg

SEQ ID NO: 30973 - DNA, 25 bp, Rattus norvegicus
aactgtctccctcctgtaagatgat

SEQ ID NO: 30974 - DNA, 25 bp, Rattus norvegicus
aactgtctccctgctgtaagatgat

SEQ ID NO: 30975 - DNA, 25 bp, Rattus norvegicus
aactgtctcttcagtgaagacttca

SEQ ID NO: 30976 - DNA, 25 bp, Rattus norvegicus
aactgtctcttctgtgaagacttca

SEQ ID NO: 30977 - DNA, 25 bp, Rattus norvegicus
aactgtctgaaaagcacctttgtgg

SEQ ID NO: 30978 - DNA, 25 bp, Rattus norvegicus
aactgtctgaaatgcacctttgtgg

SEQ ID NO: 30979 - DNA, 25 bp, Rattus norvegicus
aactgtctgacgaggattctgggaa

SEQ ID NO: 30980 - DNA, 25 bp, Rattus norvegicus
aactgtctgacgtggattctgggaa

SEQ ID NO: 30981 - DNA, 25 bp, Rattus norvegicus
aactgtctgagtcagtgttcctgaa

SEQ ID NO: 30982 - DNA, 25 bp, Rattus norvegicus
aactgtctgagtgagtgttcctgaa

SEQ ID NO: 30983 - DNA, 25 bp, Rattus norvegicus
aactgtctggctatacactttaaca

SEQ ID NO: 30984 - DNA, 25 bp, Rattus norvegicus
aactgtctggctttacactttaaca

SEQ ID NO: 30985 - DNA, 25 bp, Rattus norvegicus
aactgtctggtcatggtagctgtcc

SEQ ID NO: 30986 - DNA, 25 bp, Rattus norvegicus
aactgtctggtcttggtagctgtcc

SEQ ID NO: 30987 - DNA, 25 bp, Rattus norvegicus
aactgtctggttagtactttttatg

SEQ ID NO: 30988 - DNA, 25 bp, Rattus norvegicus
aactgtctggtttgtactttttatg

SEQ ID NO: 30989 - DNA, 25 bp, Rattus norvegicus
aactgtctgtaacgctttttaagag

SEQ ID NO: 30990 - DNA, 25 bp, Rattus norvegicus
aactgtctgtaaggctttttaagag

SEQ ID NO: 30991 - DNA, 25 bp, Rattus norvegicus
aactgtcttattactagagtctcaa

SEQ ID NO: 30992 - DNA, 25 bp, Rattus norvegicus
aactgtcttatttctagagtctcaa

SEQ ID NO: 30993 - DNA, 25 bp, Rattus norvegicus
aactgtcttctcaaatccagagcaa

SEQ ID NO: 30994 - DNA, 25 bp, Rattus norvegicus
aactgtcttctctaatccagagcaa

SEQ ID NO: 30995 - DNA, 25 bp, Rattus norvegicus
aactgtcttgacatcactaatctgg

SEQ ID NO: 30996 - DNA, 25 bp, Rattus norvegicus
aactgtcttgacttcactaatctgg

SEQ ID NO: 30997 - DNA, 25 bp, Rattus norvegicus
aactgtctttaaactcgtgttaact

SEQ ID NO: 30998 - DNA, 25 bp, Rattus norvegicus
aactgtctttaatctcgtgttaact

SEQ ID NO: 30999 - DNA, 25 bp, Rattus norvegicus
aactgtctttgactgatggagaatc

SEQ ID NO: 31000 - DNA, 25 bp, Rattus norvegicus
aactgtctttgagtgatggagaatc

SEQ ID NO: 31001 - DNA, 25 bp, Rattus norvegicus
aactgtgaaaacagtgctctgggaa

SEQ ID NO: 31002 - DNA, 25 bp, Rattus norvegicus
aactgtgaaaactgtgctctgggaa

SEQ ID NO: 31003 - DNA, 25 bp, Rattus norvegicus
aactgtgaaataactcaagcccgag

SEQ ID NO: 31004 - DNA, 25 bp, Rattus norvegicus
aactgtgaaatatctcaagcccgag

SEQ ID NO: 31005 - DNA, 25 bp, Rattus norvegicus
aactgtgaacgtattcttcagccct

SEQ ID NO: 31006 - DNA, 25 bp, Rattus norvegicus
aactgtgaacgttttcttcagccct

SEQ ID NO: 31007 - DNA, 25 bp, Rattus norvegicus
aactgtgaactcacctgtgtggctg

SEQ ID NO: 31008 - DNA, 25 bp, Rattus norvegicus
aactgtgaactcagtggttgcaacc

SEQ ID NO: 31009 - DNA, 25 bp, Rattus norvegicus
aactgtgaactctcctgtgtggctg

SEQ ID NO: 31010 - DNA, 25 bp, Rattus norvegicus
aactgtgaactctgtggttgcaacc

SEQ ID NO: 31011 - DNA, 25 bp, Rattus norvegicus
aactgtgaaggccatcatcatcgct

SEQ ID NO: 31012 - DNA, 25 bp, Rattus norvegicus
aactgtgaaggcgatcatcatcgct

SEQ ID NO: 31013 - DNA, 25 bp, Rattus norvegicus
aactgtgaagtaataaatgagtccc

SEQ ID NO: 31014 - DNA, 25 bp, Rattus norvegicus
aactgtgaagtattaaatgagtccc

SEQ ID NO: 31015 - DNA, 25 bp, Rattus norvegicus
aactgtgaatacacacttttggcac

SEQ ID NO: 31016 - DNA, 25 bp, Rattus norvegicus
aactgtgaatactcacttttggcac

SEQ ID NO: 31017 - DNA, 25 bp, Rattus norvegicus
aactgtgaatctcaggccttctgtc

SEQ ID NO: 31018 - DNA, 25 bp, Rattus norvegicus
aactgtgaatctgaggccttctgtc

SEQ ID NO: 31019 - DNA, 25 bp, Rattus norvegicus
aactgtgaatgaatttccgtttact

SEQ ID NO: 31020 - DNA, 25 bp, Rattus norvegicus
aactgtgaatgattttccgtttact

SEQ ID NO: 31021 - DNA, 25 bp, Rattus norvegicus
aactgtgacattaaagtggttacat

SEQ ID NO: 31022 - DNA, 25 bp, Rattus norvegicus
aactgtgacatttaagtggttacat

SEQ ID NO: 31023 - DNA, 25 bp, Rattus norvegicus
aactgtgactctctggtattctcct

SEQ ID NO: 31024 - DNA, 25 bp, Rattus norvegicus
aactgtgactctgtggtattctcct

SEQ ID NO: 31025 - DNA, 25 bp, Rattus norvegicus
aactgtgactgtctcttgggtctga

SEQ ID NO: 31026 - DNA, 25 bp, Rattus norvegicus
aactgtgactgtgtcttgggtctga

SEQ ID NO: 31027 - DNA, 25 bp, Rattus norvegicus
aactgtgactttaccccaaatgtca

SEQ ID NO: 31028 - DNA, 25 bp, Rattus norvegicus
aactgtgacttttccccaaatgtca

SEQ ID NO: 31029 - DNA, 25 bp, Rattus norvegicus
aactgtgagaacatccgcctgtctg

SEQ ID NO: 31030 - DNA, 25 bp, Rattus norvegicus
aactgtgagaacttccgcctgtctg

SEQ ID NO: 31031 - DNA, 25 bp, Rattus norvegicus
aactgtgagagtcgcccttagggct

SEQ ID NO: 31032 - DNA, 25 bp, Rattus norvegicus
aactgtgagagtggcccttagggct

SEQ ID NO: 31033 - DNA, 25 bp, Rattus norvegicus
aactgtgagctgatgagagcccttg

SEQ ID NO: 31034 - DNA, 25 bp, Rattus norvegicus
aactgtgagctgttgagagcccttg

SEQ ID NO: 31035 - DNA, 25 bp, Rattus norvegicus
aactgtgaggacaactctgaagaca

SEQ ID NO: 31036 - DNA, 25 bp, Rattus norvegicus
aactgtgaggactactctgaagaca

SEQ ID NO: 31037 - DNA, 25 bp, Rattus norvegicus
aactgtgagttccttttgttcagac

SEQ ID NO: 31038 - DNA, 25 bp, Rattus norvegicus
aactgtgagttcgttttgttcagac

SEQ ID NO: 31039 - DNA, 25 bp, Rattus norvegicus
aactgtgatcgcatggctgtttttg

SEQ ID NO: 31040 - DNA, 25 bp, Rattus norvegicus
aactgtgatcgcttggctgtttttg

SEQ ID NO: 31041 - DNA, 25 bp, Rattus norvegicus
aactgtgatgaaagcacttctcaaa

SEQ ID NO: 31042 - DNA, 25 bp, Rattus norvegicus
aactgtgatgaatgcacttctcaaa

SEQ ID NO: 31043 - DNA, 25 bp, Rattus norvegicus
aactgtgatgacaccatgcgtgtgt

SEQ ID NO: 31044 - DNA, 25 bp, Rattus norvegicus
aactgtgatgacatcgttccttcct

SEQ ID NO: 31045 - DNA, 25 bp, Rattus norvegicus
aactgtgatgactccatgcgtgtgt

SEQ ID NO: 31046 - DNA, 25 bp, Rattus norvegicus
aactgtgatgacttcgttccttcct

SEQ ID NO: 31047 - DNA, 25 bp, Rattus norvegicus
aactgtgatgttaccaggttgctgt

SEQ ID NO: 31048 - DNA, 25 bp, Rattus norvegicus
aactgtgatgtttccaggttgctgt

SEQ ID NO: 31049 - DNA, 25 bp, Rattus norvegicus
aactgtgattctattataacttgca

SEQ ID NO: 31050 - DNA, 25 bp, Rattus norvegicus
aactgtgattcttttataacttgca

SEQ ID NO: 31051 - DNA, 25 bp, Rattus norvegicus
aactgtgattgcaccttgggtggat

SEQ ID NO: 31052 - DNA, 25 bp, Rattus norvegicus
aactgtgattgctccttgggtggat

SEQ ID NO: 31053 - DNA, 25 bp, Rattus norvegicus
aactgtgcaatactgttccttcatg

SEQ ID NO: 31054 - DNA, 25 bp, Rattus norvegicus
aactgtgcaatagtgttccttcatg

SEQ ID NO: 31055 - DNA, 25 bp, Rattus norvegicus
aactgtgcaatcctgctgtttaaag

SEQ ID NO: 31056 - DNA, 25 bp, Rattus norvegicus
aactgtgcaatcgtgctgtttaaag

SEQ ID NO: 31057 - DNA, 25 bp, Rattus norvegicus
aactgtgcacagctctgcccagcat

SEQ ID NO: 31058 - DNA, 25 bp, Rattus norvegicus
aactgtgcacaggtctgcccagcat

SEQ ID NO: 31059 - DNA, 25 bp, Rattus norvegicus
aactgtgcacccattgtattagcca

SEQ ID NO: 31060 - DNA, 25 bp, Rattus norvegicus
aactgtgcaccctttgtattagcca

SEQ ID NO: 31061 - DNA, 25 bp, Rattus norvegicus
aactgtgcagtcacaacatctgaat

SEQ ID NO: 31062 - DNA, 25 bp, Rattus norvegicus
aactgtgcagtctcaacatctgaat

SEQ ID NO: 31063 - DNA, 25 bp, Rattus norvegicus
aactgtgcagttccgttgtgataca

SEQ ID NO: 31064 - DNA, 25 bp, Rattus norvegicus
aactgtgcagttgcgttgtgataca

SEQ ID NO: 31065 - DNA, 25 bp, Rattus norvegicus
aactgtgccaagaattattctgcta

SEQ ID NO: 31066 - DNA, 25 bp, Rattus norvegicus
aactgtgccaagtattattctgcta

SEQ ID NO: 31067 - DNA, 25 bp, Rattus norvegicus
aactgtgcccatcacaggtagggct

SEQ ID NO: 31068 - DNA, 25 bp, Rattus norvegicus
aactgtgcccatgacaggtagggct

SEQ ID NO: 31069 - DNA, 25 bp, Rattus norvegicus
aactgtgccctactgttgtctgtgg

SEQ ID NO: 31070 - DNA, 25 bp, Rattus norvegicus
aactgtgccctagtgttgtctgtgg

SEQ ID NO: 31071 - DNA, 25 bp, Rattus norvegicus
aactgtgccctcagttgttggatcc

SEQ ID NO: 31072 - DNA, 25 bp, Rattus norvegicus
aactgtgccctctgttgttggatcc

SEQ ID NO: 31073 - DNA, 25 bp, Rattus norvegicus
aactgtgcctagcacgtggactggt

SEQ ID NO: 31074 - DNA, 25 bp, Rattus norvegicus
aactgtgcctaggacgtggactggt

SEQ ID NO: 31075 - DNA, 25 bp, Rattus norvegicus
aactgtgcgcaactgtagccccggg

SEQ ID NO: 31076 - DNA, 25 bp, Rattus norvegicus
aactgtgcgcaagtgtagccccggg

SEQ ID NO: 31077 - DNA, 25 bp, Rattus norvegicus
aactgtgcggagataacacctcgaa

SEQ ID NO: 31078 - DNA, 25 bp, Rattus norvegicus
aactgtgcggagttaacacctcgaa

SEQ ID NO: 31079 - DNA, 25 bp, Rattus norvegicus
aactgtgcggcactgtttgctaact

SEQ ID NO: 31080 - DNA, 25 bp, Rattus norvegicus
aactgtgcggcagtgtttgctaact

SEQ ID NO: 31081 - DNA, 25 bp, Rattus norvegicus
aactgtgctagcagttgcggtaatt

SEQ ID NO: 31082 - DNA, 25 bp, Rattus norvegicus
aactgtgctagctgttgcggtaatt

SEQ ID NO: 31083 - DNA, 25 bp, Rattus norvegicus
aactgtgctaggaggtttccaggaa

SEQ ID NO: 31084 - DNA, 25 bp, Rattus norvegicus
aactgtgctaggtggtttccaggaa

SEQ ID NO: 31085 - DNA, 25 bp, Rattus norvegicus
aactgtgctccgacttctaggttaa

SEQ ID NO: 31086 - DNA, 25 bp, Rattus norvegicus
aactgtgctccgtcttctaggttaa

SEQ ID NO: 31087 - DNA, 25 bp, Rattus norvegicus
aactgtgctcctcagagcattgcca

SEQ ID NO: 31088 - DNA, 25 bp, Rattus norvegicus
aactgtgctcctgagagcattgcca

SEQ ID NO: 31089 - DNA, 25 bp, Rattus norvegicus
aactgtgctctgaaggatgacctca

SEQ ID NO: 31090 - DNA, 25 bp, Rattus norvegicus
aactgtgctctgctgtggtaaggcc

SEQ ID NO: 31091 - DNA, 25 bp, Rattus norvegicus
aactgtgctctggtgtggtaaggcc

SEQ ID NO: 31092 - DNA, 25 bp, Rattus norvegicus
aactgtgctctgtaggatgacctca

SEQ ID NO: 31093 - DNA, 25 bp, Rattus norvegicus
aactgtgctgaaatgggtggactac

SEQ ID NO: 31094 - DNA, 25 bp, Rattus norvegicus
aactgtgctgaacacatgcggcgct

SEQ ID NO: 31095 - DNA, 25 bp, Rattus norvegicus
aactgtgctgaagacatgcggcgct

SEQ ID NO: 31096 - DNA, 25 bp, Rattus norvegicus
aactgtgctgaattgggtggactac

SEQ ID NO: 31097 - DNA, 25 bp, Rattus norvegicus
aactgtgctgcaaaacatgtacatt

SEQ ID NO: 31098 - DNA, 25 bp, Rattus norvegicus
aactgtgctgcaaaggtaggatgtt

SEQ ID NO: 31099 - DNA, 25 bp, Rattus norvegicus
aactgtgctgcataacatgtacatt

SEQ ID NO: 31100 - DNA, 25 bp, Rattus norvegicus
aactgtgctgcataggtaggatgtt

SEQ ID NO: 31101 - DNA, 25 bp, Rattus norvegicus
aactgtgctggcctcggtaaggatc

SEQ ID NO: 31102 - DNA, 25 bp, Rattus norvegicus
aactgtgctggcgtcggtaaggatc

SEQ ID NO: 31103 - DNA, 25 bp, Rattus norvegicus
aactgtgctgtcaaccatgtattaa

SEQ ID NO: 31104 - DNA, 25 bp, Rattus norvegicus
aactgtgctgtctaccatgtattaa

SEQ ID NO: 31105 - DNA, 25 bp, Rattus norvegicus
aactgtgcttgcatgtaatcctcaa

SEQ ID NO: 31106 - DNA, 25 bp, Rattus norvegicus
aactgtgcttgcattctgattggaa

SEQ ID NO: 31107 - DNA, 25 bp, Rattus norvegicus
aactgtgcttgcttgtaatcctcaa

SEQ ID NO: 31108 - DNA, 25 bp, Rattus norvegicus
aactgtgcttgctttctgattggaa

SEQ ID NO: 31109 - DNA, 25 bp, Rattus norvegicus
aactgtgctttcagaagtgcccttc

SEQ ID NO: 31110 - DNA, 25 bp, Rattus norvegicus
aactgtgctttctgaagtgcccttc

SEQ ID NO: 31111 - DNA, 25 bp, Rattus norvegicus
aactgtggagcgctcttcacctaaa

SEQ ID NO: 31112 - DNA, 25 bp, Rattus norvegicus
aactgtggagcggtcttcacctaaa

SEQ ID NO: 31113 - DNA, 25 bp, Rattus norvegicus
aactgtggatcaatcggacccagaa

SEQ ID NO: 31114 - DNA, 25 bp, Rattus norvegicus
aactgtggatcattcggacccagaa

SEQ ID NO: 31115 - DNA, 25 bp, Rattus norvegicus
aactgtggcagcagacatgtcttgt

SEQ ID NO: 31116 - DNA, 25 bp, Rattus norvegicus
aactgtggcagcaggctcagggacc

SEQ ID NO: 31117 - DNA, 25 bp, Rattus norvegicus
aactgtggcagctgacatgtcttgt

SEQ ID NO: 31118 - DNA, 25 bp, Rattus norvegicus
aactgtggcagctggctcagggacc

SEQ ID NO: 31119 - DNA, 25 bp, Rattus norvegicus
aactgtggcattatctataccatag

SEQ ID NO: 31120 - DNA, 25 bp, Rattus norvegicus
aactgtggcattttctataccatag

SEQ ID NO: 31121 - DNA, 25 bp, Rattus norvegicus
aactgtggccacaactgagctttaa

SEQ ID NO: 31122 - DNA, 25 bp, Rattus norvegicus
aactgtggccactactgagctttaa

SEQ ID NO: 31123 - DNA, 25 bp, Rattus norvegicus
aactgtggcgtcagcagcagttgca

SEQ ID NO: 31124 - DNA, 25 bp, Rattus norvegicus
aactgtggcgtctgcagcagttgca

SEQ ID NO: 31125 - DNA, 25 bp, Rattus norvegicus
aactgtgggaacaggaaactggtgc

SEQ ID NO: 31126 - DNA, 25 bp, Rattus norvegicus
aactgtgggaacatacatgccatgg

SEQ ID NO: 31127 - DNA, 25 bp, Rattus norvegicus
aactgtgggaactggaaactggtgc

SEQ ID NO: 31128 - DNA, 25 bp, Rattus norvegicus
aactgtgggaacttacatgccatgg

SEQ ID NO: 31129 - DNA, 25 bp, Rattus norvegicus
aactgtgggaagcagctcttcactt

SEQ ID NO: 31130 - DNA, 25 bp, Rattus norvegicus
aactgtgggaaggagctcttcactt

SEQ ID NO: 31131 - DNA, 25 bp, Rattus norvegicus
aactgtgggcagcatcgccctgtgt

SEQ ID NO: 31132 - DNA, 25 bp, Rattus norvegicus
aactgtgggcaggatcgccctgtgt

SEQ ID NO: 31133 - DNA, 25 bp, Rattus norvegicus
aactgtgggtcactggagcagacac

SEQ ID NO: 31134 - DNA, 25 bp, Rattus norvegicus
aactgtgggtcagtggagcagacac

SEQ ID NO: 31135 - DNA, 25 bp, Rattus norvegicus
aactgtggtcttcttgggccgagca

SEQ ID NO: 31136 - DNA, 25 bp, Rattus norvegicus
aactgtggtcttgttgggccgagca

SEQ ID NO: 31137 - DNA, 25 bp, Rattus norvegicus
aactgtggtgaaagacctctggccc

SEQ ID NO: 31138 - DNA, 25 bp, Rattus norvegicus
aactgtggtgaatgacctctggccc

SEQ ID NO: 31139 - DNA, 25 bp, Rattus norvegicus
aactgtggtgatatacatttggtat

SEQ ID NO: 31140 - DNA, 25 bp, Rattus norvegicus
aactgtggtgatttacatttggtat

SEQ ID NO: 31141 - DNA, 25 bp, Rattus norvegicus
aactgtggtgggatctcctgccgag

SEQ ID NO: 31142 - DNA, 25 bp, Rattus norvegicus
aactgtggtgggttctcctgccgag

SEQ ID NO: 31143 - DNA, 25 bp, Rattus norvegicus
aactgtggttagagatgatacctcc

SEQ ID NO: 31144 - DNA, 25 bp, Rattus norvegicus
aactgtggttagtgatgatacctcc

SEQ ID NO: 31145 - DNA, 25 bp, Rattus norvegicus
aactgtgtaacccttttatgcttca

SEQ ID NO: 31146 - DNA, 25 bp, Rattus norvegicus
aactgtgtaaccgttttatgcttca

SEQ ID NO: 31147 - DNA, 25 bp, Rattus norvegicus
aactgtgtaaggctggttatgacca

SEQ ID NO: 31148 - DNA, 25 bp, Rattus norvegicus
aactgtgtaagggtggttatgacca

SEQ ID NO: 31149 - DNA, 25 bp, Rattus norvegicus
aactgtgtaccacagatctccggct

SEQ ID NO: 31150 - DNA, 25 bp, Rattus norvegicus
aactgtgtaccagagatctccggct

SEQ ID NO: 31151 - DNA, 25 bp, Rattus norvegicus
aactgtgtacttagtgctttttgac

SEQ ID NO: 31152 - DNA, 25 bp, Rattus norvegicus
aactgtgtactttgtgctttttgac

SEQ ID NO: 31153 - DNA, 25 bp, Rattus norvegicus
aactgtgtagagatctgggcctaga

SEQ ID NO: 31154 - DNA, 25 bp, Rattus norvegicus
aactgtgtagagttctgggcctaga

SEQ ID NO: 31155 - DNA, 25 bp, Rattus norvegicus
aactgtgtagcactgcgagggcttc

SEQ ID NO: 31156 - DNA, 25 bp, Rattus norvegicus
aactgtgtagcagtgcgagggcttc

SEQ ID NO: 31157 - DNA, 25 bp, Rattus norvegicus
aactgtgtcagactttcctgagtga

SEQ ID NO: 31158 - DNA, 25 bp, Rattus norvegicus
aactgtgtcagagtttcctgagtga

SEQ ID NO: 31159 - DNA, 25 bp, Rattus norvegicus
aactgtgtcccacaatttcttcgta

SEQ ID NO: 31160 - DNA, 25 bp, Rattus norvegicus
aactgtgtcccagaatttcttcgta

SEQ ID NO: 31161 - DNA, 25 bp, Rattus norvegicus
aactgtgtgactacaaaatactggg

SEQ ID NO: 31162 - DNA, 25 bp, Rattus norvegicus
aactgtgtgacttcaaaatactggg

SEQ ID NO: 31163 - DNA, 25 bp, Rattus norvegicus
aactgtgtgaggctgccccgcagtt

SEQ ID NO: 31164 - DNA, 25 bp, Rattus norvegicus
aactgtgtgagggtgccccgcagtt

SEQ ID NO: 31165 - DNA, 25 bp, Rattus norvegicus
aactgtgtgatcatggccaaaccct

SEQ ID NO: 31166 - DNA, 25 bp, Rattus norvegicus
aactgtgtgatcttggccaaaccct

SEQ ID NO: 31167 - DNA, 25 bp, Rattus norvegicus
aactgtgtgggaaggcctactccca

SEQ ID NO: 31168 - DNA, 25 bp, Rattus norvegicus
aactgtgtgggatggcctactccca

SEQ ID NO: 31169 - DNA, 25 bp, Rattus norvegicus
aactgtgtggtgaccaggcatggcc

SEQ ID NO: 31170 - DNA, 25 bp, Rattus norvegicus
aactgtgtggtgtccaggcatggcc

SEQ ID NO: 31171 - DNA, 25 bp, Rattus norvegicus
aactgtgtgtggaaaccttgcatca

SEQ ID NO: 31172 - DNA, 25 bp, Rattus norvegicus
aactgtgtgtggtaaccttgcatca

SEQ ID NO: 31173 - DNA, 25 bp, Rattus norvegicus
aactgtgttcaaaactgactttaaa

SEQ ID NO: 31174 - DNA, 25 bp, Rattus norvegicus
aactgtgttcaaccataattccggt

SEQ ID NO: 31175 - DNA, 25 bp, Rattus norvegicus
aactgtgttcaagcataattccggt

SEQ ID NO: 31176 - DNA, 25 bp, Rattus norvegicus
aactgtgttcaatactgactttaaa

SEQ ID NO: 31177 - DNA, 25 bp, Rattus norvegicus
aactgtgtttatctcgtatgtggcg

SEQ ID NO: 31178 - DNA, 25 bp, Rattus norvegicus
aactgtgtttatgtcgtatgtggcg

SEQ ID NO: 31179 - DNA, 25 bp, Rattus norvegicus
aactgtgtttctcaggcataggcca

SEQ ID NO: 31180 - DNA, 25 bp, Rattus norvegicus
aactgtgtttctgaggcataggcca

SEQ ID NO: 31181 - DNA, 25 bp, Rattus norvegicus
aactgtgtttgacgtcctttattga

SEQ ID NO: 31182 - DNA, 25 bp, Rattus norvegicus
aactgtgtttgaggtcctttattga

SEQ ID NO: 31183 - DNA, 25 bp, Rattus norvegicus
aactgtgtttgcagacttgaggcaa

SEQ ID NO: 31184 - DNA, 25 bp, Rattus norvegicus
aactgtgtttgcctttgatttctac

SEQ ID NO: 31185 - DNA, 25 bp, Rattus norvegicus
aactgtgtttgcgtttgatttctac

SEQ ID NO: 31186 - DNA, 25 bp, Rattus norvegicus
aactgtgtttgctgacttgaggcaa

SEQ ID NO: 31187 - DNA, 25 bp, Rattus norvegicus
aactgtgttttcaagcttcctgcta

SEQ ID NO: 31188 - DNA, 25 bp, Rattus norvegicus
aactgtgttttcacaattgtctcta

SEQ ID NO: 31189 - DNA, 25 bp, Rattus norvegicus
aactgtgttttcacttaaaatgtca

SEQ ID NO: 31190 - DNA, 25 bp, Rattus norvegicus
aactgtgttttctagcttcctgcta

SEQ ID NO: 31191 - DNA, 25 bp, Rattus norvegicus
aactgtgttttctcaattgtctcta

SEQ ID NO: 31192 - DNA, 25 bp, Rattus norvegicus
aactgtgttttctcttaaaatgtca

SEQ ID NO: 31193 - DNA, 25 bp, Rattus norvegicus
aactgttaaggccagctgtgtcatg

SEQ ID NO: 31194 - DNA, 25 bp, Rattus norvegicus
aactgttaaggcgagctgtgtcatg

SEQ ID NO: 31195 - DNA, 25 bp, Rattus norvegicus
aactgttacactatctatgcatcgt

SEQ ID NO: 31196 - DNA, 25 bp, Rattus norvegicus
aactgttacactttctatgcatcgt

SEQ ID NO: 31197 - DNA, 25 bp, Rattus norvegicus
aactgttacgagagctgtgggtgcc

SEQ ID NO: 31198 - DNA, 25 bp, Rattus norvegicus
aactgttacgagtgctgtgggtgcc

SEQ ID NO: 31199 - DNA, 25 bp, Rattus norvegicus
aactgttaggttacactgtcattat

SEQ ID NO: 31200 - DNA, 25 bp, Rattus norvegicus
aactgttaggtttcactgtcattat

SEQ ID NO: 31201 - DNA, 25 bp, Rattus norvegicus
aactgttagtagagtggccagcaca

SEQ ID NO: 31202 - DNA, 25 bp, Rattus norvegicus
aactgttagtagtgtggccagcaca

SEQ ID NO: 31203 - DNA, 25 bp, Rattus norvegicus
aactgttagtccaagttatctaagc

SEQ ID NO: 31204 - DNA, 25 bp, Rattus norvegicus
aactgttagtcctagttatctaagc

SEQ ID NO: 31205 - DNA, 25 bp, Rattus norvegicus
aactgttatggacgcctcatctctg

SEQ ID NO: 31206 - DNA, 25 bp, Rattus norvegicus
aactgttatggaggcctcatctctg

SEQ ID NO: 31207 - DNA, 25 bp, Rattus norvegicus
aactgttatgtccatgggtgattca

SEQ ID NO: 31208 - DNA, 25 bp, Rattus norvegicus
aactgttatgtcgatgggtgattca

SEQ ID NO: 31209 - DNA, 25 bp, Rattus norvegicus
aactgttcagtccttaaaattgcca

SEQ ID NO: 31210 - DNA, 25 bp, Rattus norvegicus
aactgttcagtcgttaaaattgcca

SEQ ID NO: 31211 - DNA, 25 bp, Rattus norvegicus
aactgttcagttaacctcacttgct

SEQ ID NO: 31212 - DNA, 25 bp, Rattus norvegicus
aactgttcagtttacctcacttgct

SEQ ID NO: 31213 - DNA, 25 bp, Rattus norvegicus
aactgttcattgctggaatgttcca

SEQ ID NO: 31214 - DNA, 25 bp, Rattus norvegicus
aactgttcattggtggaatgttcca

SEQ ID NO: 31215 - DNA, 25 bp, Rattus norvegicus
aactgttcctgtagttcatggctga

SEQ ID NO: 31216 - DNA, 25 bp, Rattus norvegicus
aactgttcctgttgttcatggctga

SEQ ID NO: 31217 - DNA, 25 bp, Rattus norvegicus
aactgttccttgctcaacagctgga

SEQ ID NO: 31218 - DNA, 25 bp, Rattus norvegicus
aactgttccttggtcaacagctgga

SEQ ID NO: 31219 - DNA, 25 bp, Rattus norvegicus
aactgttcgatgcatgctacttctt

SEQ ID NO: 31220 - DNA, 25 bp, Rattus norvegicus
aactgttcgatggatgctacttctt

SEQ ID NO: 31221 - DNA, 25 bp, Rattus norvegicus
aactgttcgattacttggcccagaa

SEQ ID NO: 31222 - DNA, 25 bp, Rattus norvegicus
aactgttcgatttcttggcccagaa

SEQ ID NO: 31223 - DNA, 25 bp, Rattus norvegicus
aactgttcgttgattacctgttgct

SEQ ID NO: 31224 - DNA, 25 bp, Rattus norvegicus
aactgttcgttgtttacctgttgct

SEQ ID NO: 31225 - DNA, 25 bp, Rattus norvegicus
aactgttctagaaccagcaggtggc

SEQ ID NO: 31226 - DNA, 25 bp, Rattus norvegicus
aactgttctagatccagcaggtggc

SEQ ID NO: 31227 - DNA, 25 bp, Rattus norvegicus
aactgttctagcagcagcaagcacc

SEQ ID NO: 31228 - DNA, 25 bp, Rattus norvegicus
aactgttctagctgcagcaagcacc

SEQ ID NO: 31229 - DNA, 25 bp, Rattus norvegicus
aactgttctcagacatttaagctaa

SEQ ID NO: 31230 - DNA, 25 bp, Rattus norvegicus
aactgttctcagtcatttaagctaa

SEQ ID NO: 31231 - DNA, 25 bp, Rattus norvegicus
aactgttctccaaacggtgtattct

SEQ ID NO: 31232 - DNA, 25 bp, Rattus norvegicus
aactgttctccatacggtgtattct

SEQ ID NO: 31233 - DNA, 25 bp, Rattus norvegicus
aactgttctgaaatgatagcattta

SEQ ID NO: 31234 - DNA, 25 bp, Rattus norvegicus
aactgttctgaattgatagcattta

SEQ ID NO: 31235 - DNA, 25 bp, Rattus norvegicus
aactgttctgttcgttcactcttat

SEQ ID NO: 31236 - DNA, 25 bp, Rattus norvegicus
aactgttctgttggttcactcttat

SEQ ID NO: 31237 - DNA, 25 bp, Rattus norvegicus
aactgttcttgccaacagggccaaa

SEQ ID NO: 31238 - DNA, 25 bp, Rattus norvegicus
aactgttcttgcgaacagggccaaa

SEQ ID NO: 31239 - DNA, 25 bp, Rattus norvegicus
aactgttgactgcatcctgtttgct

SEQ ID NO: 31240 - DNA, 25 bp, Rattus norvegicus
aactgttgactggatcctgtttgct

SEQ ID NO: 31241 - DNA, 25 bp, Rattus norvegicus
aactgttgaggacccggctgagttc

SEQ ID NO: 31242 - DNA, 25 bp, Rattus norvegicus
aactgttgaggagccggctgagttc

SEQ ID NO: 31243 - DNA, 25 bp, Rattus norvegicus
aactgttgagtaatctgaaccggaa

SEQ ID NO: 31244 - DNA, 25 bp, Rattus norvegicus
aactgttgagtattctgaaccggaa

SEQ ID NO: 31245 - DNA, 25 bp, Rattus norvegicus
aactgttgatataccattgatttgc

SEQ ID NO: 31246 - DNA, 25 bp, Rattus norvegicus
aactgttgatattccattgatttgc

SEQ ID NO: 31247 - DNA, 25 bp, Rattus norvegicus
aactgttgccacattagaactgtca

SEQ ID NO: 31248 - DNA, 25 bp, Rattus norvegicus
aactgttgccactttagaactgtca

SEQ ID NO: 31249 - DNA, 25 bp, Rattus norvegicus
aactgttgccagaaacattccttat

SEQ ID NO: 31250 - DNA, 25 bp, Rattus norvegicus
aactgttgccagtaacattccttat

SEQ ID NO: 31251 - DNA, 25 bp, Rattus norvegicus
aactgttgccttaatgacatcctct

SEQ ID NO: 31252 - DNA, 25 bp, Rattus norvegicus
aactgttgcctttatgacatcctct

SEQ ID NO: 31253 - DNA, 25 bp, Rattus norvegicus
aactgttgctagatcttcctagagc

SEQ ID NO: 31254 - DNA, 25 bp, Rattus norvegicus
aactgttgctagttcttcctagagc

SEQ ID NO: 31255 - DNA, 25 bp, Rattus norvegicus
aactgttggattacatctccgcagg

SEQ ID NO: 31256 - DNA, 25 bp, Rattus norvegicus
aactgttggatttcatctccgcagg

SEQ ID NO: 31257 - DNA, 25 bp, Rattus norvegicus
aactgttggcccattactctccgct

SEQ ID NO: 31258 - DNA, 25 bp, Rattus norvegicus
aactgttggccctttactctccgct

SEQ ID NO: 31259 - DNA, 25 bp, Rattus norvegicus
aactgttgggcaccaagcttctgaa

SEQ ID NO: 31260 - DNA, 25 bp, Rattus norvegicus
aactgttgggcagcaagcttctgaa

SEQ ID NO: 31261 - DNA, 25 bp, Rattus norvegicus
aactgttggtcactgggtgcccagc

SEQ ID NO: 31262 - DNA, 25 bp, Rattus norvegicus
aactgttggtcagtgggtgcccagc

SEQ ID NO: 31263 - DNA, 25 bp, Rattus norvegicus
aactgttggtggactgtagcagaca

SEQ ID NO: 31264 - DNA, 25 bp, Rattus norvegicus
aactgttggtggtctgtagcagaca

SEQ ID NO: 31265 - DNA, 25 bp, Rattus norvegicus
aactgttgtaccataaagccgagat

SEQ ID NO: 31266 - DNA, 25 bp, Rattus norvegicus
aactgttgtaccttaaagccgagat

SEQ ID NO: 31267 - DNA, 25 bp, Rattus norvegicus
aactgttgtattccttttgtgtgtg

SEQ ID NO: 31268 - DNA, 25 bp, Rattus norvegicus
aactgttgtattgcttttgtgtgtg

SEQ ID NO: 31269 - DNA, 25 bp, Rattus norvegicus
aactgttgtcctctttcttgactcc

SEQ ID NO: 31270 - DNA, 25 bp, Rattus norvegicus
aactgttgtcctgtttcttgactcc

SEQ ID NO: 31271 - DNA, 25 bp, Rattus norvegicus
aactgttgtctgcagctcatccatg

SEQ ID NO: 31272 - DNA, 25 bp, Rattus norvegicus
aactgttgtctggagctcatccatg

SEQ ID NO: 31273 - DNA, 25 bp, Rattus norvegicus
aactgttgtcttcctcttgatatag

SEQ ID NO: 31274 - DNA, 25 bp, Rattus norvegicus
aactgttgtcttgctcttgatatag

SEQ ID NO: 31275 - DNA, 25 bp, Rattus norvegicus
aactgttgtgttagccaagactgat

SEQ ID NO: 31276 - DNA, 25 bp, Rattus norvegicus
aactgttgtgtttgccaagactgat

SEQ ID NO: 31277 - DNA, 25 bp, Rattus norvegicus
aactgtttaagtctatgccaaaaag

SEQ ID NO: 31278 - DNA, 25 bp, Rattus norvegicus
aactgtttaagtgtatgccaaaaag

SEQ ID NO: 31279 - DNA, 25 bp, Rattus norvegicus
aactgtttcaaacaacgatgaagat

SEQ ID NO: 31280 - DNA, 25 bp, Rattus norvegicus
aactgtttcaaagaacgatgaagat

SEQ ID NO: 31281 - DNA, 25 bp, Rattus norvegicus
aactgtttcaagctacgtttggaag

SEQ ID NO: 31282 - DNA, 25 bp, Rattus norvegicus
aactgtttcaaggtacgtttggaag

SEQ ID NO: 31283 - DNA, 25 bp, Rattus norvegicus
aactgtttcaccaatggtaagactg

SEQ ID NO: 31284 - DNA, 25 bp, Rattus norvegicus
aactgtttcacctatggtaagactg

SEQ ID NO: 31285 - DNA, 25 bp, Rattus norvegicus
aactgtttccttactcttctagaga

SEQ ID NO: 31286 - DNA, 25 bp, Rattus norvegicus
aactgtttcctttctcttctagaga

SEQ ID NO: 31287 - DNA, 25 bp, Rattus norvegicus
aactgtttctccaatgtggttccat

SEQ ID NO: 31288 - DNA, 25 bp, Rattus norvegicus
aactgtttctcctatgtggttccat

SEQ ID NO: 31289 - DNA, 25 bp, Rattus norvegicus
aactgtttctcgagagctttcagcg

SEQ ID NO: 31290 - DNA, 25 bp, Rattus norvegicus
aactgtttctcgtgagctttcagcg

SEQ ID NO: 31291 - DNA, 25 bp, Rattus norvegicus
aactgtttctgaattagctgaagct

SEQ ID NO: 31292 - DNA, 25 bp, Rattus norvegicus
aactgtttctgatttagctgaagct

SEQ ID NO: 31293 - DNA, 25 bp, Rattus norvegicus
aactgtttctgtcgcagcttttaca

SEQ ID NO: 31294 - DNA, 25 bp, Rattus norvegicus
aactgtttctgtggcagcttttaca

SEQ ID NO: 31295 - DNA, 25 bp, Rattus norvegicus
aactgtttcttacctgcactgtttg

SEQ ID NO: 31296 - DNA, 25 bp, Rattus norvegicus
aactgtttcttagctgcactgtttg

SEQ ID NO: 31297 - DNA, 25 bp, Rattus norvegicus
aactgtttgagcaggcggtccatca

SEQ ID NO: 31298 - DNA, 25 bp, Rattus norvegicus
aactgtttgagctggcggtccatca

SEQ ID NO: 31299 - DNA, 25 bp, Rattus norvegicus
aactgtttgcctcgatgtgcctttt

SEQ ID NO: 31300 - DNA, 25 bp, Rattus norvegicus
aactgtttgcctggatgtgcctttt

SEQ ID NO: 31301 - DNA, 25 bp, Rattus norvegicus
aactgtttgtccatccgtcctttag

SEQ ID NO: 31302 - DNA, 25 bp, Rattus norvegicus
aactgtttgtccttccgtcctttag

SEQ ID NO: 31303 - DNA, 25 bp, Rattus norvegicus
aactgtttgttcatggtgccttgca

SEQ ID NO: 31304 - DNA, 25 bp, Rattus norvegicus
aactgtttgttcttggtgccttgca

SEQ ID NO: 31305 - DNA, 25 bp, Rattus norvegicus
aactgtttgtttcaacttgcagcca

SEQ ID NO: 31306 - DNA, 25 bp, Rattus norvegicus
aactgtttgtttccactctgttctc

SEQ ID NO: 31307 - DNA, 25 bp, Rattus norvegicus
aactgtttgtttgaacttgcagcca

SEQ ID NO: 31308 - DNA, 25 bp, Rattus norvegicus
aactgtttgtttgcactctgttctc

SEQ ID NO: 31309 - DNA, 25 bp, Rattus norvegicus
aactgttttcatcggtttcaactcg

SEQ ID NO: 31310 - DNA, 25 bp, Rattus norvegicus
aactgttttcatgggtttcaactcg

SEQ ID NO: 31311 - DNA, 25 bp, Rattus norvegicus
aactgttttgctattctttcatgta

SEQ ID NO: 31312 - DNA, 25 bp, Rattus norvegicus
aactgttttgcttttctttcatgta

SEQ ID NO: 31313 - DNA, 25 bp, Rattus norvegicus
aactgttttgtaagtgcctcttcta

SEQ ID NO: 31314 - DNA, 25 bp, Rattus norvegicus
aactgttttgtatgtgcctcttcta

SEQ ID NO: 31315 - DNA, 25 bp, Rattus norvegicus
aacttaaacatcagacaccctcact

SEQ ID NO: 31316 - DNA, 25 bp, Rattus norvegicus
aacttaaacatctgacaccctcact

SEQ ID NO: 31317 - DNA, 25 bp, Rattus norvegicus
aacttaaactggcatgatactttcc

SEQ ID NO: 31318 - DNA, 25 bp, Rattus norvegicus
aacttaaactgggatgatactttcc

SEQ ID NO: 31319 - DNA, 25 bp, Rattus norvegicus
aacttaaaggcaatatgatgtttag

SEQ ID NO: 31320 - DNA, 25 bp, Rattus norvegicus
aacttaaaggcattatgatgtttag

SEQ ID NO: 31321 - DNA, 25 bp, Rattus norvegicus
aacttaaatgtgaccagctctctgc

SEQ ID NO: 31322 - DNA, 25 bp, Rattus norvegicus
aacttaaatgtgtccagctctctgc

SEQ ID NO: 31323 - DNA, 25 bp, Rattus norvegicus
aacttaacttcaatgtactttacag

SEQ ID NO: 31324 - DNA, 25 bp, Rattus norvegicus
aacttaacttcattgtactttacag

SEQ ID NO: 31325 - DNA, 25 bp, Rattus norvegicus
aacttaagacttatcattcgcagga

SEQ ID NO: 31326 - DNA, 25 bp, Rattus norvegicus
aacttaagacttttcattcgcagga

SEQ ID NO: 31327 - DNA, 25 bp, Rattus norvegicus
aacttaagccctcaaatgtagccgg

SEQ ID NO: 31328 - DNA, 25 bp, Rattus norvegicus
aacttaagccctgaaatgtagccgg

SEQ ID NO: 31329 - DNA, 25 bp, Rattus norvegicus
aacttaaggaccaatgggcttccat

SEQ ID NO: 31330 - DNA, 25 bp, Rattus norvegicus
aacttaaggacctatgggcttccat

SEQ ID NO: 31331 - DNA, 25 bp, Rattus norvegicus
aacttaagggcaattgactattcag

SEQ ID NO: 31332 - DNA, 25 bp, Rattus norvegicus
aacttaagggcatttgactattcag

SEQ ID NO: 31333 - DNA, 25 bp, Rattus norvegicus
aacttaaggtggcacacaacccctg

SEQ ID NO: 31334 - DNA, 25 bp, Rattus norvegicus
aacttaaggtgggacacaacccctg

SEQ ID NO: 31335 - DNA, 25 bp, Rattus norvegicus
aacttaagtatcattgagtctgcaa

SEQ ID NO: 31336 - DNA, 25 bp, Rattus norvegicus
aacttaagtatctttgagtctgcaa

SEQ ID NO: 31337 - DNA, 25 bp, Rattus norvegicus
aacttaagtcttatgctctgggcat

SEQ ID NO: 31338 - DNA, 25 bp, Rattus norvegicus
aacttaagtcttttgctctgggcat

SEQ ID NO: 31339 - DNA, 25 bp, Rattus norvegicus
aacttaatccccactcagattggtt

SEQ ID NO: 31340 - DNA, 25 bp, Rattus norvegicus
aacttaatcccctctcagattggtt

SEQ ID NO: 31341 - DNA, 25 bp, Rattus norvegicus
aacttaatggctaggctatcatcaa

SEQ ID NO: 31342 - DNA, 25 bp, Rattus norvegicus
aacttaatggcttggctatcatcaa

SEQ ID NO: 31343 - DNA, 25 bp, Rattus norvegicus
aacttaattgcccagatatttttgc

SEQ ID NO: 31344 - DNA, 25 bp, Rattus norvegicus
aacttaattgccgagatatttttgc

SEQ ID NO: 31345 - DNA, 25 bp, Rattus norvegicus
aacttaatttgcattcatccgcaag

SEQ ID NO: 31346 - DNA, 25 bp, Rattus norvegicus
aacttaatttgctttcatccgcaag

SEQ ID NO: 31347 - DNA, 25 bp, Rattus norvegicus
aacttacaaatgacactgccgtttt

SEQ ID NO: 31348 - DNA, 25 bp, Rattus norvegicus
aacttacaaatgtcactgccgtttt

SEQ ID NO: 31349 - DNA, 25 bp, Rattus norvegicus
aacttacacgtaattgcttcctata

SEQ ID NO: 31350 - DNA, 25 bp, Rattus norvegicus
aacttacacgtatttgcttcctata

SEQ ID NO: 31351 - DNA, 25 bp, Rattus norvegicus
aacttacacttgacttctgcccttg

SEQ ID NO: 31352 - DNA, 25 bp, Rattus norvegicus
aacttacacttgtcttctgcccttg

SEQ ID NO: 31353 - DNA, 25 bp, Rattus norvegicus
aacttacagcacaaaccaggtcgga

SEQ ID NO: 31354 - DNA, 25 bp, Rattus norvegicus
aacttacagcactaaccaggtcgga

SEQ ID NO: 31355 - DNA, 25 bp, Rattus norvegicus
aacttacaggcgagaggtgattccc

SEQ ID NO: 31356 - DNA, 25 bp, Rattus norvegicus
aacttacaggcgtgaggtgattccc

SEQ ID NO: 31357 - DNA, 25 bp, Rattus norvegicus
aacttacatgttatccagggatatt

SEQ ID NO: 31358 - DNA, 25 bp, Rattus norvegicus
aacttacatgttttccagggatatt

SEQ ID NO: 31359 - DNA, 25 bp, Rattus norvegicus
aacttaccagatctgtccgtagcta

SEQ ID NO: 31360 - DNA, 25 bp, Rattus norvegicus
aacttaccagatgtgtccgtagcta

SEQ ID NO: 31361 - DNA, 25 bp, Rattus norvegicus
aacttaccagcaagtagtcatccat

SEQ ID NO: 31362 - DNA, 25 bp, Rattus norvegicus
aacttaccagcatgtagtcatccat

SEQ ID NO: 31363 - DNA, 25 bp, Rattus norvegicus
aacttaccaggaacttgggaccgag

SEQ ID NO: 31364 - DNA, 25 bp, Rattus norvegicus
aacttaccaggatcttgggaccgag

SEQ ID NO: 31365 - DNA, 25 bp, Rattus norvegicus
aacttaccaggtatctcaggtggag

SEQ ID NO: 31366 - DNA, 25 bp, Rattus norvegicus
aacttaccaggtttctcaggtggag

SEQ ID NO: 31367 - DNA, 25 bp, Rattus norvegicus
aacttacctcctaattgggttgcat

SEQ ID NO: 31368 - DNA, 25 bp, Rattus norvegicus
aacttacctccttattgggttgcat

SEQ ID NO: 31369 - DNA, 25 bp, Rattus norvegicus
aacttacctcttccttatgtcttct

SEQ ID NO: 31370 - DNA, 25 bp, Rattus norvegicus
aacttacctcttgcttatgtcttct

SEQ ID NO: 31371 - DNA, 25 bp, Rattus norvegicus
aacttacctgatcactttacacctc

SEQ ID NO: 31372 - DNA, 25 bp, Rattus norvegicus
aacttacctgatgactttacacctc

SEQ ID NO: 31373 - DNA, 25 bp, Rattus norvegicus
aacttacgcaagatgggagcccctg

SEQ ID NO: 31374 - DNA, 25 bp, Rattus norvegicus
aacttacgcaagttgggagcccctg

SEQ ID NO: 31375 - DNA, 25 bp, Rattus norvegicus
aacttacgctgacgctgataacatt

SEQ ID NO: 31376 - DNA, 25 bp, Rattus norvegicus
aacttacgctgaggctgataacatt

SEQ ID NO: 31377 - DNA, 25 bp, Rattus norvegicus
aacttactatgcatgaatgagacgg

SEQ ID NO: 31378 - DNA, 25 bp, Rattus norvegicus
aacttactatgcttgaatgagacgg

SEQ ID NO: 31379 - DNA, 25 bp, Rattus norvegicus
aacttactccagaagtattcctcta

SEQ ID NO: 31380 - DNA, 25 bp, Rattus norvegicus
aacttactccagtagtattcctcta

SEQ ID NO: 31381 - DNA, 25 bp, Rattus norvegicus
aacttactctgcagaccagcatgac

SEQ ID NO: 31382 - DNA, 25 bp, Rattus norvegicus
aacttactctgctgaccagcatgac

SEQ ID NO: 31383 - DNA, 25 bp, Rattus norvegicus
aacttactggttccactggtggttg

SEQ ID NO: 31384 - DNA, 25 bp, Rattus norvegicus
aacttactggttgcactggtggttg

SEQ ID NO: 31385 - DNA, 25 bp, Rattus norvegicus
aacttactgtggacagtgtctggcc

SEQ ID NO: 31386 - DNA, 25 bp, Rattus norvegicus
aacttactgtggtcagtgtctggcc

SEQ ID NO: 31387 - DNA, 25 bp, Rattus norvegicus
aacttacttcaacggctgcaggatg

SEQ ID NO: 31388 - DNA, 25 bp, Rattus norvegicus
aacttacttcaagggctgcaggatg

SEQ ID NO: 31389 - DNA, 25 bp, Rattus norvegicus
aacttagaatttatagccatggaac

SEQ ID NO: 31390 - DNA, 25 bp, Rattus norvegicus
aacttagaatttttagccatggaac

SEQ ID NO: 31391 - DNA, 25 bp, Rattus norvegicus
aacttagaggtgatggtccaggcca

SEQ ID NO: 31392 - DNA, 25 bp, Rattus norvegicus
aacttagaggtgttggtccaggcca

SEQ ID NO: 31393 - DNA, 25 bp, Rattus norvegicus
aacttagcacctcagactcagatac

SEQ ID NO: 31394 - DNA, 25 bp, Rattus norvegicus
aacttagcacctgagactcagatac

SEQ ID NO: 31395 - DNA, 25 bp, Rattus norvegicus
aacttagcccagaagaattccataa

SEQ ID NO: 31396 - DNA, 25 bp, Rattus norvegicus
aacttagcccagtagaattccataa

SEQ ID NO: 31397 - DNA, 25 bp, Rattus norvegicus
aacttaggaatgcttcgctcatcat

SEQ ID NO: 31398 - DNA, 25 bp, Rattus norvegicus
aacttaggaatggttcgctcatcat

SEQ ID NO: 31399 - DNA, 25 bp, Rattus norvegicus
aacttaggtcaccaccattgtgcat

SEQ ID NO: 31400 - DNA, 25 bp, Rattus norvegicus
aacttaggtcacgaccattgtgcat

SEQ ID NO: 31401 - DNA, 25 bp, Rattus norvegicus
aacttaggtgagaggctgttggtca

SEQ ID NO: 31402 - DNA, 25 bp, Rattus norvegicus
aacttaggtgagtggctgttggtca

SEQ ID NO: 31403 - DNA, 25 bp, Rattus norvegicus
aacttaggttgacttgaactcaggc

SEQ ID NO: 31404 - DNA, 25 bp, Rattus norvegicus
aacttaggttgagttgaactcaggc

SEQ ID NO: 31405 - DNA, 25 bp, Rattus norvegicus
aacttaggtttacttagctcagcat

SEQ ID NO: 31406 - DNA, 25 bp, Rattus norvegicus
aacttaggtttagttagctcagcat

SEQ ID NO: 31407 - DNA, 25 bp, Rattus norvegicus
aacttagtccatctcagttctggtg

SEQ ID NO: 31408 - DNA, 25 bp, Rattus norvegicus
aacttagtccatgtcagttctggtg

SEQ ID NO: 31409 - DNA, 25 bp, Rattus norvegicus
aacttagtgacaagtgcttcagaac

SEQ ID NO: 31410 - DNA, 25 bp, Rattus norvegicus
aacttagtgacatgtgcttcagaac

SEQ ID NO: 31411 - DNA, 25 bp, Rattus norvegicus
aacttagtgagacctttgatgagac

SEQ ID NO: 31412 - DNA, 25 bp, Rattus norvegicus
aacttagtgagagctttgatgagac

SEQ ID NO: 31413 - DNA, 25 bp, Rattus norvegicus
aacttagtgtgaaccttgtaattac

SEQ ID NO: 31414 - DNA, 25 bp, Rattus norvegicus
aacttagtgtgatccttgtaattac

SEQ ID NO: 31415 - DNA, 25 bp, Rattus norvegicus
aacttataaaagatggcgtccagct

SEQ ID NO: 31416 - DNA, 25 bp, Rattus norvegicus
aacttataaaagttggcgtccagct

SEQ ID NO: 31417 - DNA, 25 bp, Rattus norvegicus
aacttataaatgctctctctcaaga

SEQ ID NO: 31418 - DNA, 25 bp, Rattus norvegicus
aacttataaatggtctctctcaaga

SEQ ID NO: 31419 - DNA, 25 bp, Rattus norvegicus
aacttataagccaacttgccctgaa

SEQ ID NO: 31420 - DNA, 25 bp, Rattus norvegicus
aacttataagcctacttgccctgaa

SEQ ID NO: 31421 - DNA, 25 bp, Rattus norvegicus
aacttatacactaaagtcatgtgag

SEQ ID NO: 31422 - DNA, 25 bp, Rattus norvegicus
aacttatacacttaagtcatgtgag

SEQ ID NO: 31423 - DNA, 25 bp, Rattus norvegicus
aacttatcagatacccatttggaag

SEQ ID NO: 31424 - DNA, 25 bp, Rattus norvegicus
aacttatcagattcccatttggaag

SEQ ID NO: 31425 - DNA, 25 bp, Rattus norvegicus
aacttatctcttcaaatatgcacat

SEQ ID NO: 31426 - DNA, 25 bp, Rattus norvegicus
aacttatctcttgaaatatgcacat

SEQ ID NO: 31427 - DNA, 25 bp, Rattus norvegicus
aacttatctgtacccttgaaacctg

SEQ ID NO: 31428 - DNA, 25 bp, Rattus norvegicus
aacttatctgtagccttgaaacctg

SEQ ID NO: 31429 - DNA, 25 bp, Rattus norvegicus
aacttatcttggatcccaggctttg

SEQ ID NO: 31430 - DNA, 25 bp, Rattus norvegicus
aacttatcttggttcccaggctttg

SEQ ID NO: 31431 - DNA, 25 bp, Rattus norvegicus
aacttatgcagcagcagttgcccag

SEQ ID NO: 31432 - DNA, 25 bp, Rattus norvegicus
aacttatgcagctgcagttgcccag

SEQ ID NO: 31433 - DNA, 25 bp, Rattus norvegicus
aacttatgctaaagaacttatactc

SEQ ID NO: 31434 - DNA, 25 bp, Rattus norvegicus
aacttatgctaatgaacttatactc

SEQ ID NO: 31435 - DNA, 25 bp, Rattus norvegicus
aacttatggtcgatcattcctgtgg

SEQ ID NO: 31436 - DNA, 25 bp, Rattus norvegicus
aacttatggtcgttcattcctgtgg

SEQ ID NO: 31437 - DNA, 25 bp, Rattus norvegicus
aacttattaattatcagctcttggg

SEQ ID NO: 31438 - DNA, 25 bp, Rattus norvegicus
aacttattaattttcagctcttggg

SEQ ID NO: 31439 - DNA, 25 bp, Rattus norvegicus
aacttattcatgaggtggctcgtcc

SEQ ID NO: 31440 - DNA, 25 bp, Rattus norvegicus
aacttattcatgtggtggctcgtcc

SEQ ID NO: 31441 - DNA, 25 bp, Rattus norvegicus
aacttattctctcactacatcttcc

SEQ ID NO: 31442 - DNA, 25 bp, Rattus norvegicus
aacttattctctgactacatcttcc

SEQ ID NO: 31443 - DNA, 25 bp, Rattus norvegicus
aacttattctgcagtgtactttgag

SEQ ID NO: 31444 - DNA, 25 bp, Rattus norvegicus
aacttattctgctgtgtactttgag

SEQ ID NO: 31445 - DNA, 25 bp, Rattus norvegicus
aacttcaaattaagagtcttctctg

SEQ ID NO: 31446 - DNA, 25 bp, Rattus norvegicus
aacttcaaattatgagtcttctctg

SEQ ID NO: 31447 - DNA, 25 bp, Rattus norvegicus
aacttcaacaacaccattcaggctg

SEQ ID NO: 31448 - DNA, 25 bp, Rattus norvegicus
aacttcaacaactccattcaggctg

SEQ ID NO: 31449 - DNA, 25 bp, Rattus norvegicus
aacttcaaccggcagtatgctcagg

SEQ ID NO: 31450 - DNA, 25 bp, Rattus norvegicus
aacttcaaccgggagtatgctcagg

SEQ ID NO: 31451 - DNA, 25 bp, Rattus norvegicus
aacttcaactgaactctgagggagt

SEQ ID NO: 31452 - DNA, 25 bp, Rattus norvegicus
aacttcaactgatctctgagggagt

SEQ ID NO: 31453 - DNA, 25 bp, Rattus norvegicus
aacttcaagcgtatggattttgtga

SEQ ID NO: 31454 - DNA, 25 bp, Rattus norvegicus
aacttcaagcgtttggattttgtga

SEQ ID NO: 31455 - DNA, 25 bp, Rattus norvegicus
aacttcaagtggatcttccctgtct

SEQ ID NO: 31456 - DNA, 25 bp, Rattus norvegicus
aacttcaagtggttcttccctgtct

SEQ ID NO: 31457 - DNA, 25 bp, Rattus norvegicus
aacttcaagttcaagcactccgtcg

SEQ ID NO: 31458 - DNA, 25 bp, Rattus norvegicus
aacttcaagttctagcactccgtcg

SEQ ID NO: 31459 - DNA, 25 bp, Rattus norvegicus
aacttcacaaccacatgtacttctg

SEQ ID NO: 31460 - DNA, 25 bp, Rattus norvegicus
aacttcacaacctcatgtacttctg

SEQ ID NO: 31461 - DNA, 25 bp, Rattus norvegicus
aacttcacagttctcctgatcactg

SEQ ID NO: 31462 - DNA, 25 bp, Rattus norvegicus
aacttcacagttgtcctgatcactg

SEQ ID NO: 31463 - DNA, 25 bp, Rattus norvegicus
aacttcacattcctcagtgtcatcg

SEQ ID NO: 31464 - DNA, 25 bp, Rattus norvegicus
aacttcacattcgtcagtgtcatcg

SEQ ID NO: 31465 - DNA, 25 bp, Rattus norvegicus
aacttcaccgcacacttactgagtg

SEQ ID NO: 31466 - DNA, 25 bp, Rattus norvegicus
aacttcaccgcagacttactgagtg

SEQ ID NO: 31467 - DNA, 25 bp, Rattus norvegicus
aacttcacgtgtcccacttagattt

SEQ ID NO: 31468 - DNA, 25 bp, Rattus norvegicus
aacttcacgtgtgccacttagattt

SEQ ID NO: 31469 - DNA, 25 bp, Rattus norvegicus
aacttcactcacatcactgaataat

SEQ ID NO: 31470 - DNA, 25 bp, Rattus norvegicus
aacttcactcacttcactgaataat

SEQ ID NO: 31471 - DNA, 25 bp, Rattus norvegicus
aacttcactgttctatccgtgttgg

SEQ ID NO: 31472 - DNA, 25 bp, Rattus norvegicus
aacttcactgttgtatccgtgttgg

SEQ ID NO: 31473 - DNA, 25 bp, Rattus norvegicus
aacttcagagaaatgcaccatcgca

SEQ ID NO: 31474 - DNA, 25 bp, Rattus norvegicus
aacttcagagaattgcaccatcgca

SEQ ID NO: 31475 - DNA, 25 bp, Rattus norvegicus
aacttcagagtaattttatcttcca

SEQ ID NO: 31476 - DNA, 25 bp, Rattus norvegicus
aacttcagagtatttttatcttcca

SEQ ID NO: 31477 - DNA, 25 bp, Rattus norvegicus
aacttcagcagtaaggcaccgtgta

SEQ ID NO: 31478 - DNA, 25 bp, Rattus norvegicus
aacttcagcagttaggcaccgtgta

SEQ ID NO: 31479 - DNA, 25 bp, Rattus norvegicus
aacttcagcgtcaagaggctgcctt

SEQ ID NO: 31480 - DNA, 25 bp, Rattus norvegicus
aacttcagcgtctagaggctgcctt

SEQ ID NO: 31481 - DNA, 25 bp, Rattus norvegicus
aacttcagctgtcaatttcattccc

SEQ ID NO: 31482 - DNA, 25 bp, Rattus norvegicus
aacttcagctgtgaatttcattccc

SEQ ID NO: 31483 - DNA, 25 bp, Rattus norvegicus
aacttcagggacagtcacccaggga

SEQ ID NO: 31484 - DNA, 25 bp, Rattus norvegicus
aacttcagggactgtcacccaggga

SEQ ID NO: 31485 - DNA, 25 bp, Rattus norvegicus
aacttcagtatgacccatgttatag

SEQ ID NO: 31486 - DNA, 25 bp, Rattus norvegicus
aacttcagtatgtcccatgttatag

SEQ ID NO: 31487 - DNA, 25 bp, Rattus norvegicus
aacttcagtctccaggttccaatgc

SEQ ID NO: 31488 - DNA, 25 bp, Rattus norvegicus
aacttcagtctcgaggttccaatgc

SEQ ID NO: 31489 - DNA, 25 bp, Rattus norvegicus
aacttcagtgttagtgtaaatggca

SEQ ID NO: 31490 - DNA, 25 bp, Rattus norvegicus
aacttcagtgtttgtgtaaatggca

SEQ ID NO: 31491 - DNA, 25 bp, Rattus norvegicus
aacttcatacctcaggactaccagg

SEQ ID NO: 31492 - DNA, 25 bp, Rattus norvegicus
aacttcatacctgaggactaccagg

SEQ ID NO: 31493 - DNA, 25 bp, Rattus norvegicus
aacttcatagctatgttctccttaa

SEQ ID NO: 31494 - DNA, 25 bp, Rattus norvegicus
aacttcatagctttgttctccttaa

SEQ ID NO: 31495 - DNA, 25 bp, Rattus norvegicus
aacttcatatcaattccactttgcc

SEQ ID NO: 31496 - DNA, 25 bp, Rattus norvegicus
aacttcatatcatttccactttgcc

SEQ ID NO: 31497 - DNA, 25 bp, Rattus norvegicus
aacttcatcaggcacaaggcctaga

SEQ ID NO: 31498 - DNA, 25 bp, Rattus norvegicus
aacttcatcagggacaaggcctaga

SEQ ID NO: 31499 - DNA, 25 bp, Rattus norvegicus
aacttcatcctgatctgcctctaca

SEQ ID NO: 31500 - DNA, 25 bp, Rattus norvegicus
aacttcatcctgttctgcctctaca

SEQ ID NO: 31501 - DNA, 25 bp, Rattus norvegicus
aacttcatcgctccctgcacagaaa

SEQ ID NO: 31502 - DNA, 25 bp, Rattus norvegicus
aacttcatcgctgcctgcacagaaa

SEQ ID NO: 31503 - DNA, 25 bp, Rattus norvegicus
aacttcatgcaaatggctatcgtca

SEQ ID NO: 31504 - DNA, 25 bp, Rattus norvegicus
aacttcatgcaattggctatcgtca

SEQ ID NO: 31505 - DNA, 25 bp, Rattus norvegicus
aacttcatggctcgatctcttctaa

SEQ ID NO: 31506 - DNA, 25 bp, Rattus norvegicus
aacttcatggctggatctcttctaa

SEQ ID NO: 31507 - DNA, 25 bp, Rattus norvegicus
aacttcattagtcgcatatccgtgg

SEQ ID NO: 31508 - DNA, 25 bp, Rattus norvegicus
aacttcattagtggcatatccgtgg

SEQ ID NO: 31509 - DNA, 25 bp, Rattus norvegicus
aacttcattggaacactgaatgacc

SEQ ID NO: 31510 - DNA, 25 bp, Rattus norvegicus
aacttcattggatcactgaatgacc

SEQ ID NO: 31511 - DNA, 25 bp, Rattus norvegicus
aacttcattgttcacgggacactct

SEQ ID NO: 31512 - DNA, 25 bp, Rattus norvegicus
aacttcattgttgacgggacactct

SEQ ID NO: 31513 - DNA, 25 bp, Rattus norvegicus
aacttcatttctattcctgggatcc

SEQ ID NO: 31514 - DNA, 25 bp, Rattus norvegicus
aacttcatttcttttcctgggatcc

SEQ ID NO: 31515 - DNA, 25 bp, Rattus norvegicus
aacttccaaaacctgtttgtctgtg

SEQ ID NO: 31516 - DNA, 25 bp, Rattus norvegicus
aacttccaaaacgtgtttgtctgtg

SEQ ID NO: 31517 - DNA, 25 bp, Rattus norvegicus
aacttccaaaccaaggcatcttcaa

SEQ ID NO: 31518 - DNA, 25 bp, Rattus norvegicus
aacttccaaacctaggcatcttcaa

SEQ ID NO: 31519 - DNA, 25 bp, Rattus norvegicus
aacttccaagggactcggtctcaga

SEQ ID NO: 31520 - DNA, 25 bp, Rattus norvegicus
aacttccaagggtctcggtctcaga

SEQ ID NO: 31521 - DNA, 25 bp, Rattus norvegicus
aacttccaatgcactcctaatggag

SEQ ID NO: 31522 - DNA, 25 bp, Rattus norvegicus
aacttccaatgctctcctaatggag

SEQ ID NO: 31523 - DNA, 25 bp, Rattus norvegicus
aacttccagaaaccggtgcctgtgc

SEQ ID NO: 31524 - DNA, 25 bp, Rattus norvegicus
aacttccagaaagcggtgcctgtgc

SEQ ID NO: 31525 - DNA, 25 bp, Rattus norvegicus
aacttccagaataccttacctatct

SEQ ID NO: 31526 - DNA, 25 bp, Rattus norvegicus
aacttccagaattccttacctatct

SEQ ID NO: 31527 - DNA, 25 bp, Rattus norvegicus
aacttccagagacccaaggatccaa

SEQ ID NO: 31528 - DNA, 25 bp, Rattus norvegicus
aacttccagagagccaaggatccaa

SEQ ID NO: 31529 - DNA, 25 bp, Rattus norvegicus
aacttccagattcggcacatgcctg

SEQ ID NO: 31530 - DNA, 25 bp, Rattus norvegicus
aacttccagattgggcacatgcctg

SEQ ID NO: 31531 - DNA, 25 bp, Rattus norvegicus
aacttccaggccattgttatctctc

SEQ ID NO: 31532 - DNA, 25 bp, Rattus norvegicus
aacttccaggcctttgttatctctc

SEQ ID NO: 31533 - DNA, 25 bp, Rattus norvegicus
aacttccaggtgattgactttgaat

SEQ ID NO: 31534 - DNA, 25 bp, Rattus norvegicus
aacttccaggtgtttgactttgaat

SEQ ID NO: 31535 - DNA, 25 bp, Rattus norvegicus
aacttccatcttcatcttcagcatg

SEQ ID NO: 31536 - DNA, 25 bp, Rattus norvegicus
aacttccatcttgatcttcagcatg

SEQ ID NO: 31537 - DNA, 25 bp, Rattus norvegicus
aacttccatgttatcgccgttgaga

SEQ ID NO: 31538 - DNA, 25 bp, Rattus norvegicus
aacttccatgttttcgccgttgaga

SEQ ID NO: 31539 - DNA, 25 bp, Rattus norvegicus
aacttccattgaacacagtgtctgt

SEQ ID NO: 31540 - DNA, 25 bp, Rattus norvegicus
aacttccattgatcacagtgtctgt

SEQ ID NO: 31541 - DNA, 25 bp, Rattus norvegicus
aacttcccaggacccgatggtactg

SEQ ID NO: 31542 - DNA, 25 bp, Rattus norvegicus
aacttcccaggagccgatggtactg

SEQ ID NO: 31543 - DNA, 25 bp, Rattus norvegicus
aacttcccattcactacataggcct

SEQ ID NO: 31544 - DNA, 25 bp, Rattus norvegicus
aacttcccattctctacataggcct

SEQ ID NO: 31545 - DNA, 25 bp, Rattus norvegicus
aacttccccttgacctggatgactt

SEQ ID NO: 31546 - DNA, 25 bp, Rattus norvegicus
aacttccccttgtcctggatgactt

SEQ ID NO: 31547 - DNA, 25 bp, Rattus norvegicus
aacttcccgaatctgtttctcaagg

SEQ ID NO: 31548 - DNA, 25 bp, Rattus norvegicus
aacttcccgaatgtgtttctcaagg

SEQ ID NO: 31549 - DNA, 25 bp, Rattus norvegicus
aacttcccgagtatctgagaccatt

SEQ ID NO: 31550 - DNA, 25 bp, Rattus norvegicus
aacttcccgagtttctgagaccatt

SEQ ID NO: 31551 - DNA, 25 bp, Rattus norvegicus
aacttcccgggaagcatgggctagg

SEQ ID NO: 31552 - DNA, 25 bp, Rattus norvegicus
aacttcccgggatgcatgggctagg

SEQ ID NO: 31553 - DNA, 25 bp, Rattus norvegicus
aacttccctgggagagtgtgacttc

SEQ ID NO: 31554 - DNA, 25 bp, Rattus norvegicus
aacttccctgggtgagtgtgacttc

SEQ ID NO: 31555 - DNA, 25 bp, Rattus norvegicus
aacttccctgtaatcacagcaagta

SEQ ID NO: 31556 - DNA, 25 bp, Rattus norvegicus
aacttccctgtattcacagcaagta

SEQ ID NO: 31557 - DNA, 25 bp, Rattus norvegicus
aacttccctgtcattttcaacacaa

SEQ ID NO: 31558 - DNA, 25 bp, Rattus norvegicus
aacttccctgtctttttcaacacaa

SEQ ID NO: 31559 - DNA, 25 bp, Rattus norvegicus
aacttccgaaaacgcctggcatgat

SEQ ID NO: 31560 - DNA, 25 bp, Rattus norvegicus
aacttccgaaaaggcctggcatgat

SEQ ID NO: 31561 - DNA, 25 bp, Rattus norvegicus
aacttccgcaggagcgagagtatct

SEQ ID NO: 31562 - DNA, 25 bp, Rattus norvegicus
aacttccgcaggtgcgagagtatct

SEQ ID NO: 31563 - DNA, 25 bp, Rattus norvegicus
aacttccgggatcccattcacctta

SEQ ID NO: 31564 - DNA, 25 bp, Rattus norvegicus
aacttccgggatgccattcacctta

SEQ ID NO: 31565 - DNA, 25 bp, Rattus norvegicus
aacttcctcagtccgtattacttgg

SEQ ID NO: 31566 - DNA, 25 bp, Rattus norvegicus
aacttcctcagtgcgtattacttgg

SEQ ID NO: 31567 - DNA, 25 bp, Rattus norvegicus
aacttcctcatgcaccgagaaatgt

SEQ ID NO: 31568 - DNA, 25 bp, Rattus norvegicus
aacttcctcatggaccgagaaatgt

SEQ ID NO: 31569 - DNA, 25 bp, Rattus norvegicus
aacttcctccagagattgtgactct

SEQ ID NO: 31570 - DNA, 25 bp, Rattus norvegicus
aacttcctccagtgattgtgactct

SEQ ID NO: 31571 - DNA, 25 bp, Rattus norvegicus
aacttcctcctgattgacatgacga

SEQ ID NO: 31572 - DNA, 25 bp, Rattus norvegicus
aacttcctcctgtttgacatgacga

SEQ ID NO: 31573 - DNA, 25 bp, Rattus norvegicus
aacttcctcttcatgtatgacccta

SEQ ID NO: 31574 - DNA, 25 bp, Rattus norvegicus
aacttcctcttcttgtatgacccta

SEQ ID NO: 31575 - DNA, 25 bp, Rattus norvegicus
aacttcctgagtctgtgtgattctg

SEQ ID NO: 31576 - DNA, 25 bp, Rattus norvegicus
aacttcctgagtgtgtgtgattctg

SEQ ID NO: 31577 - DNA, 25 bp, Rattus norvegicus
aacttcctgcctcctggatgaagga

SEQ ID NO: 31578 - DNA, 25 bp, Rattus norvegicus
aacttcctgcctgctggatgaagga

SEQ ID NO: 31579 - DNA, 25 bp, Rattus norvegicus
aacttcctgggcctgactctagagg

SEQ ID NO: 31580 - DNA, 25 bp, Rattus norvegicus
aacttcctgggcgtgactctagagg

SEQ ID NO: 31581 - DNA, 25 bp, Rattus norvegicus
aacttcctggtgaggacagcaagag

SEQ ID NO: 31582 - DNA, 25 bp, Rattus norvegicus
aacttcctggtgtggacagcaagag

SEQ ID NO: 31583 - DNA, 25 bp, Rattus norvegicus
aacttcctgtaactcaagcttccgg

SEQ ID NO: 31584 - DNA, 25 bp, Rattus norvegicus
aacttcctgtaagtcaagcttccgg

SEQ ID NO: 31585 - DNA, 25 bp, Rattus norvegicus
aacttcctgtgcacaatgtaccttt

SEQ ID NO: 31586 - DNA, 25 bp, Rattus norvegicus
aacttcctgtgccttcataacttgt

SEQ ID NO: 31587 - DNA, 25 bp, Rattus norvegicus
aacttcctgtgcgttcataacttgt

SEQ ID NO: 31588 - DNA, 25 bp, Rattus norvegicus
aacttcctgtgctcaatgtaccttt

SEQ ID NO: 31589 - DNA, 25 bp, Rattus norvegicus
aacttccttataaaactgtgcctat

SEQ ID NO: 31590 - DNA, 25 bp, Rattus norvegicus
aacttccttatataactgtgcctat

SEQ ID NO: 31591 - DNA, 25 bp, Rattus norvegicus
aacttccttctgctacaaactcaat

SEQ ID NO: 31592 - DNA, 25 bp, Rattus norvegicus
aacttccttctggtacaaactcaat

SEQ ID NO: 31593 - DNA, 25 bp, Rattus norvegicus
aacttcgacactatccccagagaag

SEQ ID NO: 31594 - DNA, 25 bp, Rattus norvegicus
aacttcgacactttccccagagaag

SEQ ID NO: 31595 - DNA, 25 bp, Rattus norvegicus
aacttcgagtagcagggatctcgta

SEQ ID NO: 31596 - DNA, 25 bp, Rattus norvegicus
aacttcgagtaggagggatctcgta

SEQ ID NO: 31597 - DNA, 25 bp, Rattus norvegicus
aacttcgatggcagcgttgcctctg

SEQ ID NO: 31598 - DNA, 25 bp, Rattus norvegicus
aacttcgatggctgcgttgcctctg

SEQ ID NO: 31599 - DNA, 25 bp, Rattus norvegicus
aacttcgcctccattgtggtggcca

SEQ ID NO: 31600 - DNA, 25 bp, Rattus norvegicus
aacttcgcctcctttgtggtggcca

SEQ ID NO: 31601 - DNA, 25 bp, Rattus norvegicus
aacttcggactaagattgaacccaa

SEQ ID NO: 31602 - DNA, 25 bp, Rattus norvegicus
aacttcggactatgattgaacccaa

SEQ ID NO: 31603 - DNA, 25 bp, Rattus norvegicus
aacttcggcatgaactattcactgg

SEQ ID NO: 31604 - DNA, 25 bp, Rattus norvegicus
aacttcggcatgtactattcactgg

SEQ ID NO: 31605 - DNA, 25 bp, Rattus norvegicus
aacttcgggagtatcagaccacaga

SEQ ID NO: 31606 - DNA, 25 bp, Rattus norvegicus
aacttcgggagtttcagaccacaga

SEQ ID NO: 31607 - DNA, 25 bp, Rattus norvegicus
aacttcggttccatgtgcttagcaa

SEQ ID NO: 31608 - DNA, 25 bp, Rattus norvegicus
aacttcggttccttgtgcttagcaa

SEQ ID NO: 31609 - DNA, 25 bp, Rattus norvegicus
aacttcgtgcatcaggtggtgacca

SEQ ID NO: 31610 - DNA, 25 bp, Rattus norvegicus
aacttcgtgcatgaggtggtgacca

SEQ ID NO: 31611 - DNA, 25 bp, Rattus norvegicus
aacttcgtggccagcaagcatgagc

SEQ ID NO: 31612 - DNA, 25 bp, Rattus norvegicus
aacttcgtggcctgcaagcatgagc

SEQ ID NO: 31613 - DNA, 25 bp, Rattus norvegicus
aacttctaacccaggtgtggtggct

SEQ ID NO: 31614 - DNA, 25 bp, Rattus norvegicus
aacttctaaccctggtgtggtggct

SEQ ID NO: 31615 - DNA, 25 bp, Rattus norvegicus
aacttctactggaccaacatctcca

SEQ ID NO: 31616 - DNA, 25 bp, Rattus norvegicus
aacttctactggtccaacatctcca

SEQ ID NO: 31617 - DNA, 25 bp, Rattus norvegicus
aacttctacttgctatcagcattaa

SEQ ID NO: 31618 - DNA, 25 bp, Rattus norvegicus
aacttctacttggtatcagcattaa

SEQ ID NO: 31619 - DNA, 25 bp, Rattus norvegicus
aacttctagtagaggacgagtccga

SEQ ID NO: 31620 - DNA, 25 bp, Rattus norvegicus
aacttctagtagtggacgagtccga

SEQ ID NO: 31621 - DNA, 25 bp, Rattus norvegicus
aacttctcacaacgctaactcggct

SEQ ID NO: 31622 - DNA, 25 bp, Rattus norvegicus
aacttctcacaaggctaactcggct

SEQ ID NO: 31623 - DNA, 25 bp, Rattus norvegicus
aacttctcacagaggcattgttgac

SEQ ID NO: 31624 - DNA, 25 bp, Rattus norvegicus
aacttctcacagtggcattgttgac

SEQ ID NO: 31625 - DNA, 25 bp, Rattus norvegicus
aacttctcagggactacacctcgta

SEQ ID NO: 31626 - DNA, 25 bp, Rattus norvegicus
aacttctcagggtctacacctcgta

SEQ ID NO: 31627 - DNA, 25 bp, Rattus norvegicus
aacttctccagacatggctgggcct

SEQ ID NO: 31628 - DNA, 25 bp, Rattus norvegicus
aacttctccagagatggctgggcct

SEQ ID NO: 31629 - DNA, 25 bp, Rattus norvegicus
aacttctccaggaggcggcgccggt

SEQ ID NO: 31630 - DNA, 25 bp, Rattus norvegicus
aacttctccaggtggcggcgccggt

SEQ ID NO: 31631 - DNA, 25 bp, Rattus norvegicus
aacttctccctaagtttcactaaca

SEQ ID NO: 31632 - DNA, 25 bp, Rattus norvegicus
aacttctccctatgtttcactaaca

SEQ ID NO: 31633 - DNA, 25 bp, Rattus norvegicus
aacttctccctgcttacagtctgac

SEQ ID NO: 31634 - DNA, 25 bp, Rattus norvegicus
aacttctccctggttacagtctgac

SEQ ID NO: 31635 - DNA, 25 bp, Rattus norvegicus
aacttctcctaaaaaggccacacct

SEQ ID NO: 31636 - DNA, 25 bp, Rattus norvegicus
aacttctcctaataaggccacacct

SEQ ID NO: 31637 - DNA, 25 bp, Rattus norvegicus
aacttctcctgtctgtttgtggatc

SEQ ID NO: 31638 - DNA, 25 bp, Rattus norvegicus
aacttctcctgtgtgtttgtggatc

SEQ ID NO: 31639 - DNA, 25 bp, Rattus norvegicus
aacttctccttcagtgctgtttgat

SEQ ID NO: 31640 - DNA, 25 bp, Rattus norvegicus
aacttctccttctgtgctgtttgat

SEQ ID NO: 31641 - DNA, 25 bp, Rattus norvegicus
aacttctctgtgacaagccatttgg

SEQ ID NO: 31642 - DNA, 25 bp, Rattus norvegicus
aacttctctgtgtcaagccatttgg

SEQ ID NO: 31643 - DNA, 25 bp, Rattus norvegicus
aacttctcttacctccagagggagg

SEQ ID NO: 31644 - DNA, 25 bp, Rattus norvegicus
aacttctcttacgtccagagggagg

SEQ ID NO: 31645 - DNA, 25 bp, Rattus norvegicus
aacttctcttttaagctgtatcctc

SEQ ID NO: 31646 - DNA, 25 bp, Rattus norvegicus
aacttctctttttagctgtatcctc

SEQ ID NO: 31647 - DNA, 25 bp, Rattus norvegicus
aacttctgaccgatgtggtatacac

SEQ ID NO: 31648 - DNA, 25 bp, Rattus norvegicus
aacttctgaccgttgtggtatacac

SEQ ID NO: 31649 - DNA, 25 bp, Rattus norvegicus
aacttctgagttaaactgccaacag

SEQ ID NO: 31650 - DNA, 25 bp, Rattus norvegicus
aacttctgagtttaactgccaacag

SEQ ID NO: 31651 - DNA, 25 bp, Rattus norvegicus
aacttctgatccatcaagtgctagg

SEQ ID NO: 31652 - DNA, 25 bp, Rattus norvegicus
aacttctgatccttcaagtgctagg

SEQ ID NO: 31653 - DNA, 25 bp, Rattus norvegicus
aacttctgattacctctcatccagt

SEQ ID NO: 31654 - DNA, 25 bp, Rattus norvegicus
aacttctgattagctctcatccagt

SEQ ID NO: 31655 - DNA, 25 bp, Rattus norvegicus
aacttctgccacattcctaaatggg

SEQ ID NO: 31656 - DNA, 25 bp, Rattus norvegicus
aacttctgccactttcctaaatggg

SEQ ID NO: 31657 - DNA, 25 bp, Rattus norvegicus
aacttctgccagctcggcggacctg

SEQ ID NO: 31658 - DNA, 25 bp, Rattus norvegicus
aacttctgccaggtcggcggacctg

SEQ ID NO: 31659 - DNA, 25 bp, Rattus norvegicus
aacttctgcctccaacttagcgagt

SEQ ID NO: 31660 - DNA, 25 bp, Rattus norvegicus
aacttctgcctcgaacttagcgagt

SEQ ID NO: 31661 - DNA, 25 bp, Rattus norvegicus
aacttctggagactaggcatactgt

SEQ ID NO: 31662 - DNA, 25 bp, Rattus norvegicus
aacttctggagagtaggcatactgt

SEQ ID NO: 31663 - DNA, 25 bp, Rattus norvegicus
aacttctggatgaccagacaagagt

SEQ ID NO: 31664 - DNA, 25 bp, Rattus norvegicus
aacttctggatgtccagacaagagt

SEQ ID NO: 31665 - DNA, 25 bp, Rattus norvegicus
aacttctggcacaagggttcggtgt

SEQ ID NO: 31666 - DNA, 25 bp, Rattus norvegicus
aacttctggcactagggttcggtgt

SEQ ID NO: 31667 - DNA, 25 bp, Rattus norvegicus
aacttctggctaaactcctgcagtt

SEQ ID NO: 31668 - DNA, 25 bp, Rattus norvegicus
aacttctggctatactcctgcagtt

SEQ ID NO: 31669 - DNA, 25 bp, Rattus norvegicus
aacttctggtggagttccagctggt

SEQ ID NO: 31670 - DNA, 25 bp, Rattus norvegicus
aacttctggtggtgttccagctggt

SEQ ID NO: 31671 - DNA, 25 bp, Rattus norvegicus
aacttctgtaagacgcttgatacta

SEQ ID NO: 31672 - DNA, 25 bp, Rattus norvegicus
aacttctgtaagtcgcttgatacta

SEQ ID NO: 31673 - DNA, 25 bp, Rattus norvegicus
aacttctgtcaccatgttgtttctg

SEQ ID NO: 31674 - DNA, 25 bp, Rattus norvegicus
aacttctgtcacgatgttgtttctg

SEQ ID NO: 31675 - DNA, 25 bp, Rattus norvegicus
aacttctgtcataaatttactacta

SEQ ID NO: 31676 - DNA, 25 bp, Rattus norvegicus
aacttctgtcattaatttactacta

SEQ ID NO: 31677 - DNA, 25 bp, Rattus norvegicus
aacttctgtctaatgtgtgggcttt

SEQ ID NO: 31678 - DNA, 25 bp, Rattus norvegicus
aacttctgtctattgtgtgggcttt

SEQ ID NO: 31679 - DNA, 25 bp, Rattus norvegicus
aacttctgtggtattgtcctatata

SEQ ID NO: 31680 - DNA, 25 bp, Rattus norvegicus
aacttctgtggttttgtcctatata

SEQ ID NO: 31681 - DNA, 25 bp, Rattus norvegicus
aacttctgttagcagttcatctggg

SEQ ID NO: 31682 - DNA, 25 bp, Rattus norvegicus
aacttctgttaggagttcatctggg

SEQ ID NO: 31683 - DNA, 25 bp, Rattus norvegicus
aacttctgttgtcctccagcatggt

SEQ ID NO: 31684 - DNA, 25 bp, Rattus norvegicus
aacttctgttgtgctccagcatggt

SEQ ID NO: 31685 - DNA, 25 bp, Rattus norvegicus
aacttcttactgcacttgagtactc

SEQ ID NO: 31686 - DNA, 25 bp, Rattus norvegicus
aacttcttactggacttgagtactc

SEQ ID NO: 31687 - DNA, 25 bp, Rattus norvegicus
aacttcttatgtagagacggttaca

SEQ ID NO: 31688 - DNA, 25 bp, Rattus norvegicus
aacttcttatgttgagacggttaca

SEQ ID NO: 31689 - DNA, 25 bp, Rattus norvegicus
aacttcttattcattatccaaaagg

SEQ ID NO: 31690 - DNA, 25 bp, Rattus norvegicus
aacttcttattctttatccaaaagg

SEQ ID NO: 31691 - DNA, 25 bp, Rattus norvegicus
aacttcttcaatcacttcagcgacc

SEQ ID NO: 31692 - DNA, 25 bp, Rattus norvegicus
aacttcttcaatgacttcagcgacc

SEQ ID NO: 31693 - DNA, 25 bp, Rattus norvegicus
aacttcttcattaagtactctcggg

SEQ ID NO: 31694 - DNA, 25 bp, Rattus norvegicus
aacttcttcatttagtactctcggg

SEQ ID NO: 31695 - DNA, 25 bp, Rattus norvegicus
aacttcttccacactgtgggagctg

SEQ ID NO: 31696 - DNA, 25 bp, Rattus norvegicus
aacttcttccactctgtgggagctg

SEQ ID NO: 31697 - DNA, 25 bp, Rattus norvegicus
aacttcttccttcttgctggctcat

SEQ ID NO: 31698 - DNA, 25 bp, Rattus norvegicus
aacttcttccttgttgctggctcat

SEQ ID NO: 31699 - DNA, 25 bp, Rattus norvegicus
aacttcttgaatatgtggcccgtaa

SEQ ID NO: 31700 - DNA, 25 bp, Rattus norvegicus
aacttcttgaatttgtggcccgtaa

SEQ ID NO: 31701 - DNA, 25 bp, Rattus norvegicus
aacttcttgcaaaatgcagtccact

SEQ ID NO: 31702 - DNA, 25 bp, Rattus norvegicus
aacttcttgcaatatgcagtccact

SEQ ID NO: 31703 - DNA, 25 bp, Rattus norvegicus
aacttcttttctataatgtgaggcg

SEQ ID NO: 31704 - DNA, 25 bp, Rattus norvegicus
aacttcttttctttaatgtgaggcg

SEQ ID NO: 31705 - DNA, 25 bp, Rattus norvegicus
aacttcttttgcatttgccattcca

SEQ ID NO: 31706 - DNA, 25 bp, Rattus norvegicus
aacttcttttgcttttgccattcca

SEQ ID NO: 31707 - DNA, 25 bp, Rattus norvegicus
aacttgaacattaatctgtggctta

SEQ ID NO: 31708 - DNA, 25 bp, Rattus norvegicus
aacttgaacattagcctgtgcttcc

SEQ ID NO: 31709 - DNA, 25 bp, Rattus norvegicus
aacttgaacatttatctgtggctta

SEQ ID NO: 31710 - DNA, 25 bp, Rattus norvegicus
aacttgaacatttgcctgtgcttcc

SEQ ID NO: 31711 - DNA, 25 bp, Rattus norvegicus
aacttgaagcagaggcagagcccac

SEQ ID NO: 31712 - DNA, 25 bp, Rattus norvegicus
aacttgaagcagtggcagagcccac

SEQ ID NO: 31713 - DNA, 25 bp, Rattus norvegicus
aacttgaagtatatggtgcctaaca

SEQ ID NO: 31714 - DNA, 25 bp, Rattus norvegicus
aacttgaagtatttggtgcctaaca

SEQ ID NO: 31715 - DNA, 25 bp, Rattus norvegicus
aacttgaatcttatcttgcattgta

SEQ ID NO: 31716 - DNA, 25 bp, Rattus norvegicus
aacttgaatcttttcttgcattgta

SEQ ID NO: 31717 - DNA, 25 bp, Rattus norvegicus
aacttgacagtgcacctcagacagg

SEQ ID NO: 31718 - DNA, 25 bp, Rattus norvegicus
aacttgacagtggacctcagacagg

SEQ ID NO: 31719 - DNA, 25 bp, Rattus norvegicus
aacttgaccttgaaagcagagccca

SEQ ID NO: 31720 - DNA, 25 bp, Rattus norvegicus
aacttgaccttgtaagcagagccca

SEQ ID NO: 31721 - DNA, 25 bp, Rattus norvegicus
aacttgacgtgcacattccctagaa

SEQ ID NO: 31722 - DNA, 25 bp, Rattus norvegicus
aacttgacgtgctcattccctagaa

SEQ ID NO: 31723 - DNA, 25 bp, Rattus norvegicus
aacttgactgtaactctaaggagcc

SEQ ID NO: 31724 - DNA, 25 bp, Rattus norvegicus
aacttgactgtatctctaaggagcc

SEQ ID NO: 31725 - DNA, 25 bp, Rattus norvegicus
aacttgagaactagactggttgcga

SEQ ID NO: 31726 - DNA, 25 bp, Rattus norvegicus
aacttgagaacttgactggttgcga

SEQ ID NO: 31727 - DNA, 25 bp, Rattus norvegicus
aacttgagagctccggttggcccag

SEQ ID NO: 31728 - DNA, 25 bp, Rattus norvegicus
aacttgagagctgcggttggcccag

SEQ ID NO: 31729 - DNA, 25 bp, Rattus norvegicus
aacttgagcacactctgcgactcat

SEQ ID NO: 31730 - DNA, 25 bp, Rattus norvegicus
aacttgagcacagtctgcgactcat

SEQ ID NO: 31731 - DNA, 25 bp, Rattus norvegicus
aacttgagcattcaggtctgggaga

SEQ ID NO: 31732 - DNA, 25 bp, Rattus norvegicus
aacttgagcattgaggtctgggaga

SEQ ID NO: 31733 - DNA, 25 bp, Rattus norvegicus
aacttgagcctgcagcttggtgtcc

SEQ ID NO: 31734 - DNA, 25 bp, Rattus norvegicus
aacttgagcctggagcttggtgtcc

SEQ ID NO: 31735 - DNA, 25 bp, Rattus norvegicus
aacttgaggagactgtggcattgac

SEQ ID NO: 31736 - DNA, 25 bp, Rattus norvegicus
aacttgaggagagtgtggcattgac

SEQ ID NO: 31737 - DNA, 25 bp, Rattus norvegicus
aacttgagttacatctgttcctctc

SEQ ID NO: 31738 - DNA, 25 bp, Rattus norvegicus
aacttgagttacttctgttcctctc

SEQ ID NO: 31739 - DNA, 25 bp, Rattus norvegicus
aacttgagtttgacattcatgggca

SEQ ID NO: 31740 - DNA, 25 bp, Rattus norvegicus
aacttgagtttgtcattcatgggca

SEQ ID NO: 31741 - DNA, 25 bp, Rattus norvegicus
aacttgatacacatactgcttgctc

SEQ ID NO: 31742 - DNA, 25 bp, Rattus norvegicus
aacttgatacacttactgcttgctc

SEQ ID NO: 31743 - DNA, 25 bp, Rattus norvegicus
aacttgatatcaaacccactctgtc

SEQ ID NO: 31744 - DNA, 25 bp, Rattus norvegicus
aacttgatatcatacccactctgtc

SEQ ID NO: 31745 - DNA, 25 bp, Rattus norvegicus
aacttgatcacccatattcaatccc

SEQ ID NO: 31746 - DNA, 25 bp, Rattus norvegicus
aacttgatcaccgatattcaatccc

SEQ ID NO: 31747 - DNA, 25 bp, Rattus norvegicus
aacttgatgattaagctttgctgga

SEQ ID NO: 31748 - DNA, 25 bp, Rattus norvegicus
aacttgatgatttagctttgctgga

SEQ ID NO: 31749 - DNA, 25 bp, Rattus norvegicus
aacttgattctcctttttgctaatt

SEQ ID NO: 31750 - DNA, 25 bp, Rattus norvegicus
aacttgattctcgtttttgctaatt

SEQ ID NO: 31751 - DNA, 25 bp, Rattus norvegicus
aacttgattgttccactatgtgaca

SEQ ID NO: 31752 - DNA, 25 bp, Rattus norvegicus
aacttgattgttgcactatgtgaca

SEQ ID NO: 31753 - DNA, 25 bp, Rattus norvegicus
aacttgcaatgccagcagtcaggag

SEQ ID NO: 31754 - DNA, 25 bp, Rattus norvegicus
aacttgcaatgcgagcagtcaggag

SEQ ID NO: 31755 - DNA, 25 bp, Rattus norvegicus
aacttgcacgacaatggcatgctgc

SEQ ID NO: 31756 - DNA, 25 bp, Rattus norvegicus
aacttgcacgactatggcatgctgc

SEQ ID NO: 31757 - DNA, 25 bp, Rattus norvegicus
aacttgcactgcatgacctggagca

SEQ ID NO: 31758 - DNA, 25 bp, Rattus norvegicus
aacttgcactgcttgacctggagca

SEQ ID NO: 31759 - DNA, 25 bp, Rattus norvegicus
aacttgcagacccacggtgttatgg

SEQ ID NO: 31760 - DNA, 25 bp, Rattus norvegicus
aacttgcagaccgacggtgttatgg

SEQ ID NO: 31761 - DNA, 25 bp, Rattus norvegicus
aacttgcagtcccttagttcacggg

SEQ ID NO: 31762 - DNA, 25 bp, Rattus norvegicus
aacttgcagtccgttagttcacggg

SEQ ID NO: 31763 - DNA, 25 bp, Rattus norvegicus
aacttgcattgtactccatggcaga

SEQ ID NO: 31764 - DNA, 25 bp, Rattus norvegicus
aacttgcattgttctccatggcaga

SEQ ID NO: 31765 - DNA, 25 bp, Rattus norvegicus
aacttgccaggccatgtcacttggg

SEQ ID NO: 31766 - DNA, 25 bp, Rattus norvegicus
aacttgccaggcgatgtcacttggg

SEQ ID NO: 31767 - DNA, 25 bp, Rattus norvegicus
aacttgccagttatctgagtcccaa

SEQ ID NO: 31768 - DNA, 25 bp, Rattus norvegicus
aacttgccagttttctgagtcccaa

SEQ ID NO: 31769 - DNA, 25 bp, Rattus norvegicus
aacttgcccatccagcatgagttca

SEQ ID NO: 31770 - DNA, 25 bp, Rattus norvegicus
aacttgcccatcgagcatgagttca

SEQ ID NO: 31771 - DNA, 25 bp, Rattus norvegicus
aacttgccctgtaaactaggctatc

SEQ ID NO: 31772 - DNA, 25 bp, Rattus norvegicus
aacttgccctgttaactaggctatc

SEQ ID NO: 31773 - DNA, 25 bp, Rattus norvegicus
aacttgcctggtagtggaaaatgac

SEQ ID NO: 31774 - DNA, 25 bp, Rattus norvegicus
aacttgcctggttgtggaaaatgac

SEQ ID NO: 31775 - DNA, 25 bp, Rattus norvegicus
aacttgccttcgattttcttaccag

SEQ ID NO: 31776 - DNA, 25 bp, Rattus norvegicus
aacttgccttcgtttttcttaccag

SEQ ID NO: 31777 - DNA, 25 bp, Rattus norvegicus
aacttgccttgtcctgggcgtaagc

SEQ ID NO: 31778 - DNA, 25 bp, Rattus norvegicus
aacttgccttgtgctgggcgtaagc

SEQ ID NO: 31779 - DNA, 25 bp, Rattus norvegicus
aacttgcctttgcactgagcgtttc

SEQ ID NO: 31780 - DNA, 25 bp, Rattus norvegicus
aacttgcctttggactgagcgtttc

SEQ ID NO: 31781 - DNA, 25 bp, Rattus norvegicus
aacttgcgcagacacaggatgctct

SEQ ID NO: 31782 - DNA, 25 bp, Rattus norvegicus
aacttgcgcagagacaggatgctct

SEQ ID NO: 31783 - DNA, 25 bp, Rattus norvegicus
aacttgctaatgactgtctaaccac

SEQ ID NO: 31784 - DNA, 25 bp, Rattus norvegicus
aacttgctaatgctttatcttccca

SEQ ID NO: 31785 - DNA, 25 bp, Rattus norvegicus
aacttgctaatggtttatcttccca

SEQ ID NO: 31786 - DNA, 25 bp, Rattus norvegicus
aacttgctaatgtctgtctaaccac

SEQ ID NO: 31787 - DNA, 25 bp, Rattus norvegicus
aacttgctacagaaacaccctgatg

SEQ ID NO: 31788 - DNA, 25 bp, Rattus norvegicus
aacttgctacagtaacaccctgatg

SEQ ID NO: 31789 - DNA, 25 bp, Rattus norvegicus
aacttgctcggtctgaattctttga

SEQ ID NO: 31790 - DNA, 25 bp, Rattus norvegicus
aacttgctcggtgtgaattctttga

SEQ ID NO: 31791 - DNA, 25 bp, Rattus norvegicus
aacttgctctaacggctgtgcacac

SEQ ID NO: 31792 - DNA, 25 bp, Rattus norvegicus
aacttgctctaagggctgtgcacac

SEQ ID NO: 31793 - DNA, 25 bp, Rattus norvegicus
aacttgctctgaagtgggtccctaa

SEQ ID NO: 31794 - DNA, 25 bp, Rattus norvegicus
aacttgctctgatgtgggtccctaa

SEQ ID NO: 31795 - DNA, 25 bp, Rattus norvegicus
aacttgctctgcaggatgcagccaa

SEQ ID NO: 31796 - DNA, 25 bp, Rattus norvegicus
aacttgctctgctggatgcagccaa

SEQ ID NO: 31797 - DNA, 25 bp, Rattus norvegicus
aacttgctgaggcagacttcctacg

SEQ ID NO: 31798 - DNA, 25 bp, Rattus norvegicus
aacttgctgagggagacttcctacg

SEQ ID NO: 31799 - DNA, 25 bp, Rattus norvegicus
aacttgctgcttctgctggatgtac

SEQ ID NO: 31800 - DNA, 25 bp, Rattus norvegicus
aacttgctgcttgtgctggatgtac

SEQ ID NO: 31801 - DNA, 25 bp, Rattus norvegicus
aacttgctgggccacgagaagaaga

SEQ ID NO: 31802 - DNA, 25 bp, Rattus norvegicus
aacttgctgggcgacgagaagaaga

SEQ ID NO: 31803 - DNA, 25 bp, Rattus norvegicus
aacttgctgtcaatttcttaattca

SEQ ID NO: 31804 - DNA, 25 bp, Rattus norvegicus
aacttgctgtcattttcttaattca

SEQ ID NO: 31805 - DNA, 25 bp, Rattus norvegicus
aacttgcttagtcatcctggagaaa

SEQ ID NO: 31806 - DNA, 25 bp, Rattus norvegicus
aacttgcttagtgatcctggagaaa

SEQ ID NO: 31807 - DNA, 25 bp, Rattus norvegicus
aacttgcttgctacttgctggagcc

SEQ ID NO: 31808 - DNA, 25 bp, Rattus norvegicus
aacttgcttgcttcttgctggagcc

SEQ ID NO: 31809 - DNA, 25 bp, Rattus norvegicus
aacttgctttccctagtggctgtca

SEQ ID NO: 31810 - DNA, 25 bp, Rattus norvegicus
aacttgctttccgtagtggctgtca

SEQ ID NO: 31811 - DNA, 25 bp, Rattus norvegicus
aacttgctttgtacctcagagatag

SEQ ID NO: 31812 - DNA, 25 bp, Rattus norvegicus
aacttgctttgttcctcagagatag

SEQ ID NO: 31813 - DNA, 25 bp, Rattus norvegicus
aacttgcttttgagactgggtccca

SEQ ID NO: 31814 - DNA, 25 bp, Rattus norvegicus
aacttgcttttgtgactgggtccca

SEQ ID NO: 31815 - DNA, 25 bp, Rattus norvegicus
aacttggaagacctgctgaagatta

SEQ ID NO: 31816 - DNA, 25 bp, Rattus norvegicus
aacttggaagacgtgctgaagatta

SEQ ID NO: 31817 - DNA, 25 bp, Rattus norvegicus
aacttggaagccaacaccgatgacc

SEQ ID NO: 31818 - DNA, 25 bp, Rattus norvegicus
aacttggaagcctacaccgatgacc

SEQ ID NO: 31819 - DNA, 25 bp, Rattus norvegicus
aacttggaagctaggctctgcgcgt

SEQ ID NO: 31820 - DNA, 25 bp, Rattus norvegicus
aacttggaagcttggctctgcgcgt

SEQ ID NO: 31821 - DNA, 25 bp, Rattus norvegicus
aacttggaatcacaatccctcggcc

SEQ ID NO: 31822 - DNA, 25 bp, Rattus norvegicus
aacttggaatcagaatccctcggcc

SEQ ID NO: 31823 - DNA, 25 bp, Rattus norvegicus
aacttggaccacatagatttgattg

SEQ ID NO: 31824 - DNA, 25 bp, Rattus norvegicus
aacttggaccacttagatttgattg

SEQ ID NO: 31825 - DNA, 25 bp, Rattus norvegicus
aacttggactcccaactcaggtggg

SEQ ID NO: 31826 - DNA, 25 bp, Rattus norvegicus
aacttggactccgaactcaggtggg

SEQ ID NO: 31827 - DNA, 25 bp, Rattus norvegicus
aacttggacttacctttagtgcagg

SEQ ID NO: 31828 - DNA, 25 bp, Rattus norvegicus
aacttggacttagctttagtgcagg

SEQ ID NO: 31829 - DNA, 25 bp, Rattus norvegicus
aacttggagcgaccattttgggcct

SEQ ID NO: 31830 - DNA, 25 bp, Rattus norvegicus
aacttggagcgagcattttgggcct

SEQ ID NO: 31831 - DNA, 25 bp, Rattus norvegicus
aacttggagctgacattggatggaa

SEQ ID NO: 31832 - DNA, 25 bp, Rattus norvegicus
aacttggagctgtcattggatggaa

SEQ ID NO: 31833 - DNA, 25 bp, Rattus norvegicus
aacttggaggttcctgattcagctc

SEQ ID NO: 31834 - DNA, 25 bp, Rattus norvegicus
aacttggaggttgctgattcagctc

SEQ ID NO: 31835 - DNA, 25 bp, Rattus norvegicus
aacttggagtctactaatcaattga

SEQ ID NO: 31836 - DNA, 25 bp, Rattus norvegicus
aacttggagtcttctaatcaattga

SEQ ID NO: 31837 - DNA, 25 bp, Rattus norvegicus
aacttggattctcacgactcctaga

SEQ ID NO: 31838 - DNA, 25 bp, Rattus norvegicus
aacttggattctgacgactcctaga

SEQ ID NO: 31839 - DNA, 25 bp, Rattus norvegicus
aacttggcaaacactcgacggtcgt

SEQ ID NO: 31840 - DNA, 25 bp, Rattus norvegicus
aacttggcaaactctcgacggtcgt

SEQ ID NO: 31841 - DNA, 25 bp, Rattus norvegicus
aacttggcatcgccctcgccttatg

SEQ ID NO: 31842 - DNA, 25 bp, Rattus norvegicus
aacttggcatcggcctcgccttatg

SEQ ID NO: 31843 - DNA, 25 bp, Rattus norvegicus
aacttggcccacaccttgtagggca

SEQ ID NO: 31844 - DNA, 25 bp, Rattus norvegicus
aacttggcccactccttgtagggca

SEQ ID NO: 31845 - DNA, 25 bp, Rattus norvegicus
aacttggccttgcaatccctgtgtt

SEQ ID NO: 31846 - DNA, 25 bp, Rattus norvegicus
aacttggccttggaatccctgtgtt

SEQ ID NO: 31847 - DNA, 25 bp, Rattus norvegicus
aacttggcgcttcttagcccgtgtg

SEQ ID NO: 31848 - DNA, 25 bp, Rattus norvegicus
aacttggcgcttgttagcccgtgtg

SEQ ID NO: 31849 - DNA, 25 bp, Rattus norvegicus
aacttggcggccactgaggaaggtc

SEQ ID NO: 31850 - DNA, 25 bp, Rattus norvegicus
aacttggcggcctctgaggaaggtc

SEQ ID NO: 31851 - DNA, 25 bp, Rattus norvegicus
aacttggctcatattgtgcctccaa

SEQ ID NO: 31852 - DNA, 25 bp, Rattus norvegicus
aacttggctcattttgtgcctccaa

SEQ ID NO: 31853 - DNA, 25 bp, Rattus norvegicus
aacttggctctcagattcacagtct

SEQ ID NO: 31854 - DNA, 25 bp, Rattus norvegicus
aacttggctctctgattcacagtct

SEQ ID NO: 31855 - DNA, 25 bp, Rattus norvegicus
aacttggctgaaaacccgtgcggtt

SEQ ID NO: 31856 - DNA, 25 bp, Rattus norvegicus
aacttggctgaatacccgtgcggtt

SEQ ID NO: 31857 - DNA, 25 bp, Rattus norvegicus
aacttggctgctaaagacacactgg

SEQ ID NO: 31858 - DNA, 25 bp, Rattus norvegicus
aacttggctgctacttggaatatga

SEQ ID NO: 31859 - DNA, 25 bp, Rattus norvegicus
aacttggctgcttaagacacactgg

SEQ ID NO: 31860 - DNA, 25 bp, Rattus norvegicus
aacttggctgcttcttggaatatga

SEQ ID NO: 31861 - DNA, 25 bp, Rattus norvegicus
aacttggctgtgagtttttggattt

SEQ ID NO: 31862 - DNA, 25 bp, Rattus norvegicus
aacttggctgtgctcgtgactggac

SEQ ID NO: 31863 - DNA, 25 bp, Rattus norvegicus
aacttggctgtggtcgtgactggac

SEQ ID NO: 31864 - DNA, 25 bp, Rattus norvegicus
aacttggctgtgtgtttttggattt

SEQ ID NO: 31865 - DNA, 25 bp, Rattus norvegicus
aacttggctttccttacttatactg

SEQ ID NO: 31866 - DNA, 25 bp, Rattus norvegicus
aacttggctttcgttacttatactg

SEQ ID NO: 31867 - DNA, 25 bp, Rattus norvegicus
aacttgggaaggcacactggtatga

SEQ ID NO: 31868 - DNA, 25 bp, Rattus norvegicus
aacttgggaagggacactggtatga

SEQ ID NO: 31869 - DNA, 25 bp, Rattus norvegicus
aacttgggcacaacagggcacccct

SEQ ID NO: 31870 - DNA, 25 bp, Rattus norvegicus
aacttgggcacatcagggcacccct

SEQ ID NO: 31871 - DNA, 25 bp, Rattus norvegicus
aacttgggcatacctgtgttcttga

SEQ ID NO: 31872 - DNA, 25 bp, Rattus norvegicus
aacttgggcatagctgtgttcttga

SEQ ID NO: 31873 - DNA, 25 bp, Rattus norvegicus
aacttgggctaacggtcctaccatg

SEQ ID NO: 31874 - DNA, 25 bp, Rattus norvegicus
aacttgggctaagggtcctaccatg

SEQ ID NO: 31875 - DNA, 25 bp, Rattus norvegicus
aacttgggctcaaaatttctggtac

SEQ ID NO: 31876 - DNA, 25 bp, Rattus norvegicus
aacttgggctcataatttctggtac

SEQ ID NO: 31877 - DNA, 25 bp, Rattus norvegicus
aacttgggtgtgctccagcatccga

SEQ ID NO: 31878 - DNA, 25 bp, Rattus norvegicus
aacttgggtgtggtccagcatccga

SEQ ID NO: 31879 - DNA, 25 bp, Rattus norvegicus
aacttggtacctaatgttccatgtc

SEQ ID NO: 31880 - DNA, 25 bp, Rattus norvegicus
aacttggtaccttatgttccatgtc

SEQ ID NO: 31881 - DNA, 25 bp, Rattus norvegicus
aacttggtcctaataatgtatacat

SEQ ID NO: 31882 - DNA, 25 bp, Rattus norvegicus
aacttggtcctattaatgtatacat

SEQ ID NO: 31883 - DNA, 25 bp, Rattus norvegicus
aacttggtccttatcagaactgctg

SEQ ID NO: 31884 - DNA, 25 bp, Rattus norvegicus
aacttggtccttttcagaactgctg

SEQ ID NO: 31885 - DNA, 25 bp, Rattus norvegicus
aacttggtcttcatcttcaaaacag

SEQ ID NO: 31886 - DNA, 25 bp, Rattus norvegicus
aacttggtcttcttcttcaaaacag

SEQ ID NO: 31887 - DNA, 25 bp, Rattus norvegicus
aacttggtctttcactccttgcata

SEQ ID NO: 31888 - DNA, 25 bp, Rattus norvegicus
aacttggtctttgactccttgcata

SEQ ID NO: 31889 - DNA, 25 bp, Rattus norvegicus
aacttggtgccaatttgaaacttga

SEQ ID NO: 31890 - DNA, 25 bp, Rattus norvegicus
aacttggtgccacagacttctgaga

SEQ ID NO: 31891 - DNA, 25 bp, Rattus norvegicus
aacttggtgccactcagttgggatc

SEQ ID NO: 31892 - DNA, 25 bp, Rattus norvegicus
aacttggtgccagagacttctgaga

SEQ ID NO: 31893 - DNA, 25 bp, Rattus norvegicus
aacttggtgccagtcagttgggatc

SEQ ID NO: 31894 - DNA, 25 bp, Rattus norvegicus
aacttggtgccattttgaaacttga

SEQ ID NO: 31895 - DNA, 25 bp, Rattus norvegicus
aacttggtgcggctgcaggacctgg

SEQ ID NO: 31896 - DNA, 25 bp, Rattus norvegicus
aacttggtgcgggtgcaggacctgg

SEQ ID NO: 31897 - DNA, 25 bp, Rattus norvegicus
aacttggtgtggagctgagccctac

SEQ ID NO: 31898 - DNA, 25 bp, Rattus norvegicus
aacttggtgtggtgctgagccctac

SEQ ID NO: 31899 - DNA, 25 bp, Rattus norvegicus
aacttggttcaacactgagctcctt

SEQ ID NO: 31900 - DNA, 25 bp, Rattus norvegicus
aacttggttcaagactgagctcctt

SEQ ID NO: 31901 - DNA, 25 bp, Rattus norvegicus
aacttggttcttatctaatacacat

SEQ ID NO: 31902 - DNA, 25 bp, Rattus norvegicus
aacttggttcttttctaatacacat

SEQ ID NO: 31903 - DNA, 25 bp, Rattus norvegicus
aacttggtttgcagctttctgcaca

SEQ ID NO: 31904 - DNA, 25 bp, Rattus norvegicus
aacttggtttgctgctttctgcaca

SEQ ID NO: 31905 - DNA, 25 bp, Rattus norvegicus
aacttggttttgctttgttcagact

SEQ ID NO: 31906 - DNA, 25 bp, Rattus norvegicus
aacttggttttggtttgttcagact

SEQ ID NO: 31907 - DNA, 25 bp, Rattus norvegicus
aacttgtaacaactgaagtgatcat

SEQ ID NO: 31908 - DNA, 25 bp, Rattus norvegicus
aacttgtaacaagtgaagtgatcat

SEQ ID NO: 31909 - DNA, 25 bp, Rattus norvegicus
aacttgtaacgtagcttcattctca

SEQ ID NO: 31910 - DNA, 25 bp, Rattus norvegicus
aacttgtaacgttgcttcattctca

SEQ ID NO: 31911 - DNA, 25 bp, Rattus norvegicus
aacttgtaagtgacctcccagagtg

SEQ ID NO: 31912 - DNA, 25 bp, Rattus norvegicus
aacttgtaagtgtcctcccagagtg

SEQ ID NO: 31913 - DNA, 25 bp, Rattus norvegicus
aacttgtacaacacagaggctcttc

SEQ ID NO: 31914 - DNA, 25 bp, Rattus norvegicus
aacttgtacaactcagaggctcttc

SEQ ID NO: 31915 - DNA, 25 bp, Rattus norvegicus
aacttgtacattctttcccatgagt

SEQ ID NO: 31916 - DNA, 25 bp, Rattus norvegicus
aacttgtacattgtttcccatgagt

SEQ ID NO: 31917 - DNA, 25 bp, Rattus norvegicus
aacttgtactgcagccgagaatcca

SEQ ID NO: 31918 - DNA, 25 bp, Rattus norvegicus
aacttgtactgctgccgagaatcca

SEQ ID NO: 31919 - DNA, 25 bp, Rattus norvegicus
aacttgtagggcctgtacctatgtt

SEQ ID NO: 31920 - DNA, 25 bp, Rattus norvegicus
aacttgtagggcgtgtacctatgtt

SEQ ID NO: 31921 - DNA, 25 bp, Rattus norvegicus
aacttgtatagcctgatgcctcctt

SEQ ID NO: 31922 - DNA, 25 bp, Rattus norvegicus
aacttgtatagcgtgatgcctcctt

SEQ ID NO: 31923 - DNA, 25 bp, Rattus norvegicus
aacttgtatcagcttgttttgtcaa

SEQ ID NO: 31924 - DNA, 25 bp, Rattus norvegicus
aacttgtatcaggttgttttgtcaa

SEQ ID NO: 31925 - DNA, 25 bp, Rattus norvegicus
aacttgtatcctattctagctcttg

SEQ ID NO: 31926 - DNA, 25 bp, Rattus norvegicus
aacttgtatccttttctagctcttg

SEQ ID NO: 31927 - DNA, 25 bp, Rattus norvegicus
aacttgtatgcaagactccacagac

SEQ ID NO: 31928 - DNA, 25 bp, Rattus norvegicus
aacttgtatgcatgactccacagac

SEQ ID NO: 31929 - DNA, 25 bp, Rattus norvegicus
aacttgtattgaagaccctttggag

SEQ ID NO: 31930 - DNA, 25 bp, Rattus norvegicus
aacttgtattgatgaccctttggag

SEQ ID NO: 31931 - DNA, 25 bp, Rattus norvegicus
aacttgtcaaacacagctgccatag

SEQ ID NO: 31932 - DNA, 25 bp, Rattus norvegicus
aacttgtcaaactcagctgccatag

SEQ ID NO: 31933 - DNA, 25 bp, Rattus norvegicus
aacttgtccctgattcaagggcgag

SEQ ID NO: 31934 - DNA, 25 bp, Rattus norvegicus
aacttgtccctgtttcaagggcgag

SEQ ID NO: 31935 - DNA, 25 bp, Rattus norvegicus
aacttgtcctgtcctggaaagtggt

SEQ ID NO: 31936 - DNA, 25 bp, Rattus norvegicus
aacttgtcctgtgctggaaagtggt

SEQ ID NO: 31937 - DNA, 25 bp, Rattus norvegicus
aacttgtctaaaattgtctggctga

SEQ ID NO: 31938 - DNA, 25 bp, Rattus norvegicus
aacttgtctaaatttgtctggctga

SEQ ID NO: 31939 - DNA, 25 bp, Rattus norvegicus
aacttgtctctgaggtggcgatgct

SEQ ID NO: 31940 - DNA, 25 bp, Rattus norvegicus
aacttgtctctgtggtggcgatgct

SEQ ID NO: 31941 - DNA, 25 bp, Rattus norvegicus
aacttgtctgacaggatggcattcg

SEQ ID NO: 31942 - DNA, 25 bp, Rattus norvegicus
aacttgtctgactggatggcattcg

SEQ ID NO: 31943 - DNA, 25 bp, Rattus norvegicus
aacttgtgactaacggtttcttcag

SEQ ID NO: 31944 - DNA, 25 bp, Rattus norvegicus
aacttgtgactatcggtttcttcag

SEQ ID NO: 31945 - DNA, 25 bp, Rattus norvegicus
aacttgtgatccagatgcctccacc

SEQ ID NO: 31946 - DNA, 25 bp, Rattus norvegicus
aacttgtgatcctgatgcctccacc

SEQ ID NO: 31947 - DNA, 25 bp, Rattus norvegicus
aacttgtgattcattgtgtccctca

SEQ ID NO: 31948 - DNA, 25 bp, Rattus norvegicus
aacttgtgattctttgtgtccctca

SEQ ID NO: 31949 - DNA, 25 bp, Rattus norvegicus
aacttgtgcagtatccatttcttcc

SEQ ID NO: 31950 - DNA, 25 bp, Rattus norvegicus
aacttgtgcagtttccatttcttcc

SEQ ID NO: 31951 - DNA, 25 bp, Rattus norvegicus
aacttgtgccggcaactgctggaca

SEQ ID NO: 31952 - DNA, 25 bp, Rattus norvegicus
aacttgtgccgggaactgctggaca

SEQ ID NO: 31953 - DNA, 25 bp, Rattus norvegicus
aacttgtggcagatttctgcctttc

SEQ ID NO: 31954 - DNA, 25 bp, Rattus norvegicus
aacttgtggcagttttctgcctttc

SEQ ID NO: 31955 - DNA, 25 bp, Rattus norvegicus
aacttgtgtatcaactggcgcagaa

SEQ ID NO: 31956 - DNA, 25 bp, Rattus norvegicus
aacttgtgtatctactggcgcagaa

SEQ ID NO: 31957 - DNA, 25 bp, Rattus norvegicus
aacttgtgttggagtatgccatgac

SEQ ID NO: 31958 - DNA, 25 bp, Rattus norvegicus
aacttgtgttggtgtatgccatgac

SEQ ID NO: 31959 - DNA, 25 bp, Rattus norvegicus
aacttgtgtttcacgtaagcctgtg

SEQ ID NO: 31960 - DNA, 25 bp, Rattus norvegicus
aacttgtgtttctcgtaagcctgtg

SEQ ID NO: 31961 - DNA, 25 bp, Rattus norvegicus
aacttgttaacaacttggcccagat

SEQ ID NO: 31962 - DNA, 25 bp, Rattus norvegicus
aacttgttaacatcttggcccagat

SEQ ID NO: 31963 - DNA, 25 bp, Rattus norvegicus
aacttgttaggccagccaactcttt

SEQ ID NO: 31964 - DNA, 25 bp, Rattus norvegicus
aacttgttaggcgagccaactcttt

SEQ ID NO: 31965 - DNA, 25 bp, Rattus norvegicus
aacttgttcaacctgtagtggctag

SEQ ID NO: 31966 - DNA, 25 bp, Rattus norvegicus
aacttgttcaacgtgtagtggctag

SEQ ID NO: 31967 - DNA, 25 bp, Rattus norvegicus
aacttgttcagaagccatgtcaccc

SEQ ID NO: 31968 - DNA, 25 bp, Rattus norvegicus
aacttgttcagatgccatgtcaccc

SEQ ID NO: 31969 - DNA, 25 bp, Rattus norvegicus
aacttgttcattaccatctgtataa

SEQ ID NO: 31970 - DNA, 25 bp, Rattus norvegicus
aacttgttcatttccatctgtataa

SEQ ID NO: 31971 - DNA, 25 bp, Rattus norvegicus
aacttgttctatatgttcctggcct

SEQ ID NO: 31972 - DNA, 25 bp, Rattus norvegicus
aacttgttctatttgttcctggcct

SEQ ID NO: 31973 - DNA, 25 bp, Rattus norvegicus
aacttgttctgaagccctctgtttc

SEQ ID NO: 31974 - DNA, 25 bp, Rattus norvegicus
aacttgttctgatgccctctgtttc

SEQ ID NO: 31975 - DNA, 25 bp, Rattus norvegicus
aacttgttctggatcctattcatcg

SEQ ID NO: 31976 - DNA, 25 bp, Rattus norvegicus
aacttgttctggttcctattcatcg

SEQ ID NO: 31977 - DNA, 25 bp, Rattus norvegicus
aacttgttgaagatgtccgtcctcc

SEQ ID NO: 31978 - DNA, 25 bp, Rattus norvegicus
aacttgttgaagttgtccgtcctcc

SEQ ID NO: 31979 - DNA, 25 bp, Rattus norvegicus
aacttgttgacaccacatgtgaacc

SEQ ID NO: 31980 - DNA, 25 bp, Rattus norvegicus
aacttgttgacagcacatgtgaacc

SEQ ID NO: 31981 - DNA, 25 bp, Rattus norvegicus
aacttgttgattacctctctctatc

SEQ ID NO: 31982 - DNA, 25 bp, Rattus norvegicus
aacttgttgatttcctctctctatc

SEQ ID NO: 31983 - DNA, 25 bp, Rattus norvegicus
aacttgttgtatatctcacttctga

SEQ ID NO: 31984 - DNA, 25 bp, Rattus norvegicus
aacttgttgtatttctcacttctga

SEQ ID NO: 31985 - DNA, 25 bp, Rattus norvegicus
aacttgtttcttctggttctctgaa

SEQ ID NO: 31986 - DNA, 25 bp, Rattus norvegicus
aacttgtttcttgtggttctctgaa

SEQ ID NO: 31987 - DNA, 25 bp, Rattus norvegicus
aacttgtttgtgattggttgcctgc

SEQ ID NO: 31988 - DNA, 25 bp, Rattus norvegicus
aacttgtttgtgtttggttgcctgc

SEQ ID NO: 31989 - DNA, 25 bp, Rattus norvegicus
aacttgtttgttccctctcagagaa

SEQ ID NO: 31990 - DNA, 25 bp, Rattus norvegicus
aacttgtttgttgcctctcagagaa

SEQ ID NO: 31991 - DNA, 25 bp, Rattus norvegicus
aactttaaacgtctcgctacagtgg

SEQ ID NO: 31992 - DNA, 25 bp, Rattus norvegicus
aactttaaacgtgtcgctacagtgg

SEQ ID NO: 31993 - DNA, 25 bp, Rattus norvegicus
aactttaactgcaacgagtcagtga

SEQ ID NO: 31994 - DNA, 25 bp, Rattus norvegicus
aactttaactgcatactataccaca

SEQ ID NO: 31995 - DNA, 25 bp, Rattus norvegicus
aactttaactgctacgagtcagtga

SEQ ID NO: 31996 - DNA, 25 bp, Rattus norvegicus
aactttaactgcttactataccaca

SEQ ID NO: 31997 - DNA, 25 bp, Rattus norvegicus
aactttaactgtcagcctggatcca

SEQ ID NO: 31998 - DNA, 25 bp, Rattus norvegicus
aactttaactgtgagcctggatcca

SEQ ID NO: 31999 - DNA, 25 bp, Rattus norvegicus
aactttaatgacagtgcttcctctc

SEQ ID NO: 32000 - DNA, 25 bp, Rattus norvegicus
aactttaatgactgtgcttcctctc

SEQ ID NO: 32001 - DNA, 25 bp, Rattus norvegicus
aactttacagtactgatccccgcta

SEQ ID NO: 32002 - DNA, 25 bp, Rattus norvegicus
aactttacagtagtgatccccgcta

SEQ ID NO: 32003 - DNA, 25 bp, Rattus norvegicus
aactttaccacgactaagtgtgcca

SEQ ID NO: 32004 - DNA, 25 bp, Rattus norvegicus
aactttaccacgtctaagtgtgcca

SEQ ID NO: 32005 - DNA, 25 bp, Rattus norvegicus
aactttaccatcaagagtgctcatg

SEQ ID NO: 32006 - DNA, 25 bp, Rattus norvegicus
aactttaccatctagagtgctcatg

SEQ ID NO: 32007 - DNA, 25 bp, Rattus norvegicus
aactttactctgatgtttgcagcag

SEQ ID NO: 32008 - DNA, 25 bp, Rattus norvegicus
aactttactctgttgtttgcagcag

SEQ ID NO: 32009 - DNA, 25 bp, Rattus norvegicus
aactttacttggctgcttattgctt

SEQ ID NO: 32010 - DNA, 25 bp, Rattus norvegicus
aactttacttgggtgcttattgctt

SEQ ID NO: 32011 - DNA, 25 bp, Rattus norvegicus
aactttactttgctgctttgctgag

SEQ ID NO: 32012 - DNA, 25 bp, Rattus norvegicus
aactttactttggtgctttgctgag

SEQ ID NO: 32013 - DNA, 25 bp, Rattus norvegicus
aactttagacagagcttgtcctcag

SEQ ID NO: 32014 - DNA, 25 bp, Rattus norvegicus
aactttagacagtgcttgtcctcag

SEQ ID NO: 32015 - DNA, 25 bp, Rattus norvegicus
aactttagccagaattcccgccttg

SEQ ID NO: 32016 - DNA, 25 bp, Rattus norvegicus
aactttagccagtattcccgccttg

SEQ ID NO: 32017 - DNA, 25 bp, Rattus norvegicus
aactttagccatagggtccatctct

SEQ ID NO: 32018 - DNA, 25 bp, Rattus norvegicus
aactttagccattgggtccatctct

SEQ ID NO: 32019 - DNA, 25 bp, Rattus norvegicus
aactttagtgccctgtggatctctc

SEQ ID NO: 32020 - DNA, 25 bp, Rattus norvegicus
aactttagtgccgtgtggatctctc

SEQ ID NO: 32021 - DNA, 25 bp, Rattus norvegicus
aactttatcccaatgccattttcat

SEQ ID NO: 32022 - DNA, 25 bp, Rattus norvegicus
aactttatcccattgccattttcat

SEQ ID NO: 32023 - DNA, 25 bp, Rattus norvegicus
aactttattattacccagagagcca

SEQ ID NO: 32024 - DNA, 25 bp, Rattus norvegicus
aactttattatttcccagagagcca

SEQ ID NO: 32025 - DNA, 25 bp, Rattus norvegicus
aactttattcccataatcactgaag

SEQ ID NO: 32026 - DNA, 25 bp, Rattus norvegicus
aactttattcccttaatcactgaag

SEQ ID NO: 32027 - DNA, 25 bp, Rattus norvegicus
aactttattcctagctcagcgcgag

SEQ ID NO: 32028 - DNA, 25 bp, Rattus norvegicus
aactttattccttgctcagcgcgag

SEQ ID NO: 32029 - DNA, 25 bp, Rattus norvegicus
aactttcaaaagacatgctgcccaa

SEQ ID NO: 32030 - DNA, 25 bp, Rattus norvegicus
aactttcaaaagtcatgctgcccaa

SEQ ID NO: 32031 - DNA, 25 bp, Rattus norvegicus
aactttcaaagtagagtcttccaga

SEQ ID NO: 32032 - DNA, 25 bp, Rattus norvegicus
aactttcaaagttgagtcttccaga

SEQ ID NO: 32033 - DNA, 25 bp, Rattus norvegicus
aactttcaccccagttacaatgtca

SEQ ID NO: 32034 - DNA, 25 bp, Rattus norvegicus
aactttcacccctgttacaatgtca

SEQ ID NO: 32035 - DNA, 25 bp, Rattus norvegicus
aactttcagcttatggagagctctg

SEQ ID NO: 32036 - DNA, 25 bp, Rattus norvegicus
aactttcagcttttggagagctctg

SEQ ID NO: 32037 - DNA, 25 bp, Rattus norvegicus
aactttcagttaatgtctgtgatga

SEQ ID NO: 32038 - DNA, 25 bp, Rattus norvegicus
aactttcagttattgtctgtgatga

SEQ ID NO: 32039 - DNA, 25 bp, Rattus norvegicus
aactttcattctatgtcactggtaa

SEQ ID NO: 32040 - DNA, 25 bp, Rattus norvegicus
aactttcattctttgtcactggtaa

SEQ ID NO: 32041 - DNA, 25 bp, Rattus norvegicus
aactttccaaaaccattaccagtga

SEQ ID NO: 32042 - DNA, 25 bp, Rattus norvegicus
aactttccaaaagcattaccagtga

SEQ ID NO: 32043 - DNA, 25 bp, Rattus norvegicus
aactttccaaatcccatggtcgtgc

SEQ ID NO: 32044 - DNA, 25 bp, Rattus norvegicus
aactttccaaatgccatggtcgtgc

SEQ ID NO: 32045 - DNA, 25 bp, Rattus norvegicus
aactttccagtcatagagttttctg

SEQ ID NO: 32046 - DNA, 25 bp, Rattus norvegicus
aactttccagtcttagagttttctg

SEQ ID NO: 32047 - DNA, 25 bp, Rattus norvegicus
aactttcccattccaagtctggctg

SEQ ID NO: 32048 - DNA, 25 bp, Rattus norvegicus
aactttcccattgcaagtctggctg

SEQ ID NO: 32049 - DNA, 25 bp, Rattus norvegicus
aactttccctgactgcttacgagga

SEQ ID NO: 32050 - DNA, 25 bp, Rattus norvegicus
aactttccctgagtgcttacgagga

SEQ ID NO: 32051 - DNA, 25 bp, Rattus norvegicus
aactttcctatgaatccgagcatcc

SEQ ID NO: 32052 - DNA, 25 bp, Rattus norvegicus
aactttcctatgtatccgagcatcc

SEQ ID NO: 32053 - DNA, 25 bp, Rattus norvegicus
aactttcctcctcagactggacaga

SEQ ID NO: 32054 - DNA, 25 bp, Rattus norvegicus
aactttcctcctgagactggacaga

SEQ ID NO: 32055 - DNA, 25 bp, Rattus norvegicus
aactttcctcttcctctgggagtcc

SEQ ID NO: 32056 - DNA, 25 bp, Rattus norvegicus
aactttcctcttgctctgggagtcc

SEQ ID NO: 32057 - DNA, 25 bp, Rattus norvegicus
aactttccttcaagtgttctgtctg

SEQ ID NO: 32058 - DNA, 25 bp, Rattus norvegicus
aactttccttcatgtgttctgtctg

SEQ ID NO: 32059 - DNA, 25 bp, Rattus norvegicus
aactttccttgtccagtccctagga

SEQ ID NO: 32060 - DNA, 25 bp, Rattus norvegicus
aactttccttgtgcagtccctagga

SEQ ID NO: 32061 - DNA, 25 bp, Rattus norvegicus
aactttccttttaacatgatctctt

SEQ ID NO: 32062 - DNA, 25 bp, Rattus norvegicus
aactttcctttttacatgatctctt

SEQ ID NO: 32063 - DNA, 25 bp, Rattus norvegicus
aactttctaactataggcacagagg

SEQ ID NO: 32064 - DNA, 25 bp, Rattus norvegicus
aactttctaactttaggcacagagg

SEQ ID NO: 32065 - DNA, 25 bp, Rattus norvegicus
aactttctacagagggtgtgacctg

SEQ ID NO: 32066 - DNA, 25 bp, Rattus norvegicus
aactttctacagtgggtgtgacctg

SEQ ID NO: 32067 - DNA, 25 bp, Rattus norvegicus
aactttctagcaagtggtataacct

SEQ ID NO: 32068 - DNA, 25 bp, Rattus norvegicus
aactttctagcatgtggtataacct

SEQ ID NO: 32069 - DNA, 25 bp, Rattus norvegicus
aactttctagtaatgccgttagcga

SEQ ID NO: 32070 - DNA, 25 bp, Rattus norvegicus
aactttctagtattgccgttagcga

SEQ ID NO: 32071 - DNA, 25 bp, Rattus norvegicus
aactttctcctcactgttaactaga

SEQ ID NO: 32072 - DNA, 25 bp, Rattus norvegicus
aactttctcctctctgttaactaga

SEQ ID NO: 32073 - DNA, 25 bp, Rattus norvegicus
aactttctctcaccttccagggagt

SEQ ID NO: 32074 - DNA, 25 bp, Rattus norvegicus
aactttctctcagcttccagggagt

SEQ ID NO: 32075 - DNA, 25 bp, Rattus norvegicus
aactttctgaaaacccaacattctg

SEQ ID NO: 32076 - DNA, 25 bp, Rattus norvegicus
aactttctgaaatcccaacattctg

SEQ ID NO: 32077 - DNA, 25 bp, Rattus norvegicus
aactttctgaacatcccacagcagt

SEQ ID NO: 32078 - DNA, 25 bp, Rattus norvegicus
aactttctgaacttcccacagcagt

SEQ ID NO: 32079 - DNA, 25 bp, Rattus norvegicus
aactttctgaatctgccaactttga

SEQ ID NO: 32080 - DNA, 25 bp, Rattus norvegicus
aactttctgaatgtgccaactttga

SEQ ID NO: 32081 - DNA, 25 bp, Rattus norvegicus
aactttctgcacagggcgatctttg

SEQ ID NO: 32082 - DNA, 25 bp, Rattus norvegicus
aactttctgcactgggcgatctttg

SEQ ID NO: 32083 - DNA, 25 bp, Rattus norvegicus
aactttctgcggctatcagtggttt

SEQ ID NO: 32084 - DNA, 25 bp, Rattus norvegicus
aactttctgcgggtatcagtggttt

SEQ ID NO: 32085 - DNA, 25 bp, Rattus norvegicus
aactttctggccactctgattaagg

SEQ ID NO: 32086 - DNA, 25 bp, Rattus norvegicus
aactttctggcctctctgattaagg

SEQ ID NO: 32087 - DNA, 25 bp, Rattus norvegicus
aactttctgttgaccctatccaggc

SEQ ID NO: 32088 - DNA, 25 bp, Rattus norvegicus
aactttctgttgtccctatccaggc

SEQ ID NO: 32089 - DNA, 25 bp, Rattus norvegicus
aactttctgtttctcatcttcagtg

SEQ ID NO: 32090 - DNA, 25 bp, Rattus norvegicus
aactttctgtttgtcatcttcagtg

SEQ ID NO: 32091 - DNA, 25 bp, Rattus norvegicus
aactttcttgtaatctttggtgaca

SEQ ID NO: 32092 - DNA, 25 bp, Rattus norvegicus
aactttcttgtattctttggtgaca

SEQ ID NO: 32093 - DNA, 25 bp, Rattus norvegicus
aactttctttgacactgaggagacc

SEQ ID NO: 32094 - DNA, 25 bp, Rattus norvegicus
aactttctttgagactgaggagacc

SEQ ID NO: 32095 - DNA, 25 bp, Rattus norvegicus
aactttgaaagtcaatctacctgaa

SEQ ID NO: 32096 - DNA, 25 bp, Rattus norvegicus
aactttgaaagtgaatctacctgaa

SEQ ID NO: 32097 - DNA, 25 bp, Rattus norvegicus
aactttgaaataatgtcttgttcac

SEQ ID NO: 32098 - DNA, 25 bp, Rattus norvegicus
aactttgaaatattgtcttgttcac

SEQ ID NO: 32099 - DNA, 25 bp, Rattus norvegicus
aactttgaagccagcaagagtgaca

SEQ ID NO: 32100 - DNA, 25 bp, Rattus norvegicus
aactttgaagcctgcaagagtgaca

SEQ ID NO: 32101 - DNA, 25 bp, Rattus norvegicus
aactttgaatataacaggcatgcct

SEQ ID NO: 32102 - DNA, 25 bp, Rattus norvegicus
aactttgaatattacaggcatgcct

SEQ ID NO: 32103 - DNA, 25 bp, Rattus norvegicus
aactttgaatttatgaccctcctgc

SEQ ID NO: 32104 - DNA, 25 bp, Rattus norvegicus
aactttgaatttttgaccctcctgc

SEQ ID NO: 32105 - DNA, 25 bp, Rattus norvegicus
aactttgagagcatgtccctgggca

SEQ ID NO: 32106 - DNA, 25 bp, Rattus norvegicus
aactttgagagcttgtccctgggca

SEQ ID NO: 32107 - DNA, 25 bp, Rattus norvegicus
aactttgagcataggtctatcttag

SEQ ID NO: 32108 - DNA, 25 bp, Rattus norvegicus
aactttgagcatatcccttggaact

SEQ ID NO: 32109 - DNA, 25 bp, Rattus norvegicus
aactttgagcattggtctatcttag

SEQ ID NO: 32110 - DNA, 25 bp, Rattus norvegicus
aactttgagcatttcccttggaact

SEQ ID NO: 32111 - DNA, 25 bp, Rattus norvegicus
aactttgagctaatggttcggccca

SEQ ID NO: 32112 - DNA, 25 bp, Rattus norvegicus
aactttgagctattggttcggccca

SEQ ID NO: 32113 - DNA, 25 bp, Rattus norvegicus
aactttgaggccacacactgcactc

SEQ ID NO: 32114 - DNA, 25 bp, Rattus norvegicus
aactttgaggccatgtcatgtgtga

SEQ ID NO: 32115 - DNA, 25 bp, Rattus norvegicus
aactttgaggcctcacactgcactc

SEQ ID NO: 32116 - DNA, 25 bp, Rattus norvegicus
aactttgaggccttgtcatgtgtga

SEQ ID NO: 32117 - DNA, 25 bp, Rattus norvegicus
aactttgagttcattaggccactgg

SEQ ID NO: 32118 - DNA, 25 bp, Rattus norvegicus
aactttgagttctttaggccactgg

SEQ ID NO: 32119 - DNA, 25 bp, Rattus norvegicus
aactttgatcttacccagaggcctg

SEQ ID NO: 32120 - DNA, 25 bp, Rattus norvegicus
aactttgatctttcccagaggcctg

SEQ ID NO: 32121 - DNA, 25 bp, Rattus norvegicus
aactttgattgacacacgtgcccgt

SEQ ID NO: 32122 - DNA, 25 bp, Rattus norvegicus
aactttgattgagacacgtgcccgt

SEQ ID NO: 32123 - DNA, 25 bp, Rattus norvegicus
aactttgatttgctttcctgggatt

SEQ ID NO: 32124 - DNA, 25 bp, Rattus norvegicus
aactttgatttggtttcctgggatt

SEQ ID NO: 32125 - DNA, 25 bp, Rattus norvegicus
aactttgcaaagcaggttgccacct

SEQ ID NO: 32126 - DNA, 25 bp, Rattus norvegicus
aactttgcaaaggaggttgccacct

SEQ ID NO: 32127 - DNA, 25 bp, Rattus norvegicus
aactttgcactcatgtatgtacttc

SEQ ID NO: 32128 - DNA, 25 bp, Rattus norvegicus
aactttgcactcttgtatgtacttc

SEQ ID NO: 32129 - DNA, 25 bp, Rattus norvegicus
aactttgcagaacgcatctggcagg

SEQ ID NO: 32130 - DNA, 25 bp, Rattus norvegicus
aactttgcagaaggcatctggcagg

SEQ ID NO: 32131 - DNA, 25 bp, Rattus norvegicus
aactttgcaggcagcgccgtgtgca

SEQ ID NO: 32132 - DNA, 25 bp, Rattus norvegicus
aactttgcaggctgcgccgtgtgca

SEQ ID NO: 32133 - DNA, 25 bp, Rattus norvegicus
aactttgcagttatactctttcttt

SEQ ID NO: 32134 - DNA, 25 bp, Rattus norvegicus
aactttgcagttttactctttcttt

SEQ ID NO: 32135 - DNA, 25 bp, Rattus norvegicus
aactttgcatctcatgatgtactgt

SEQ ID NO: 32136 - DNA, 25 bp, Rattus norvegicus
aactttgcatctgatgatgtactgt

SEQ ID NO: 32137 - DNA, 25 bp, Rattus norvegicus
aactttgccaaaaactttctccatc

SEQ ID NO: 32138 - DNA, 25 bp, Rattus norvegicus
aactttgccaaaaggtcaaagctga

SEQ ID NO: 32139 - DNA, 25 bp, Rattus norvegicus
aactttgccaaatactttctccatc

SEQ ID NO: 32140 - DNA, 25 bp, Rattus norvegicus
aactttgccaaatggtcaaagctga

SEQ ID NO: 32141 - DNA, 25 bp, Rattus norvegicus
aactttgccagtacgtctatctaga

SEQ ID NO: 32142 - DNA, 25 bp, Rattus norvegicus
aactttgccagttcgtctatctaga

SEQ ID NO: 32143 - DNA, 25 bp, Rattus norvegicus
aactttgcctcgacagccatatggt

SEQ ID NO: 32144 - DNA, 25 bp, Rattus norvegicus
aactttgcctcgtcagccatatggt

SEQ ID NO: 32145 - DNA, 25 bp, Rattus norvegicus
aactttgctgctcggactcagtgac

SEQ ID NO: 32146 - DNA, 25 bp, Rattus norvegicus
aactttgctgctgggactcagtgac

SEQ ID NO: 32147 - DNA, 25 bp, Rattus norvegicus
aactttgctggactcagctgaccct

SEQ ID NO: 32148 - DNA, 25 bp, Rattus norvegicus
aactttgctggagtcagctgaccct

SEQ ID NO: 32149 - DNA, 25 bp, Rattus norvegicus
aactttgctttgaagtgtgcccttc

SEQ ID NO: 32150 - DNA, 25 bp, Rattus norvegicus
aactttgctttgtagtgtgcccttc

SEQ ID NO: 32151 - DNA, 25 bp, Rattus norvegicus
aactttggactcaatacctgtaata

SEQ ID NO: 32152 - DNA, 25 bp, Rattus norvegicus
aactttggactctatacctgtaata

SEQ ID NO: 32153 - DNA, 25 bp, Rattus norvegicus
aactttggactgagctgtgccagac

SEQ ID NO: 32154 - DNA, 25 bp, Rattus norvegicus
aactttggactgtgctgtgccagac

SEQ ID NO: 32155 - DNA, 25 bp, Rattus norvegicus
aactttggattcaggccttcttgct

SEQ ID NO: 32156 - DNA, 25 bp, Rattus norvegicus
aactttggattctggccttcttgct

SEQ ID NO: 32157 - DNA, 25 bp, Rattus norvegicus
aactttggcattcgcggtgacagca

SEQ ID NO: 32158 - DNA, 25 bp, Rattus norvegicus
aactttggcattggcggtgacagca

SEQ ID NO: 32159 - DNA, 25 bp, Rattus norvegicus
aactttggcgtgaacctgatgcact

SEQ ID NO: 32160 - DNA, 25 bp, Rattus norvegicus
aactttggcgtgtacctgatgcact

SEQ ID NO: 32161 - DNA, 25 bp, Rattus norvegicus
aactttggtagtactgactcatcaa

SEQ ID NO: 32162 - DNA, 25 bp, Rattus norvegicus
aactttggtagttctgactcatcaa

SEQ ID NO: 32163 - DNA, 25 bp, Rattus norvegicus
aactttggttctacagcataccctt

SEQ ID NO: 32164 - DNA, 25 bp, Rattus norvegicus
aactttggttcttcagcataccctt

SEQ ID NO: 32165 - DNA, 25 bp, Rattus norvegicus
aactttgtaaacactgaagcacaca

SEQ ID NO: 32166 - DNA, 25 bp, Rattus norvegicus
aactttgtaaactctgaagcacaca

SEQ ID NO: 32167 - DNA, 25 bp, Rattus norvegicus
aactttgtacaaattatccacggca

SEQ ID NO: 32168 - DNA, 25 bp, Rattus norvegicus
aactttgtacaatttatccacggca

SEQ ID NO: 32169 - DNA, 25 bp, Rattus norvegicus
aactttgtaccacacctagagccct

SEQ ID NO: 32170 - DNA, 25 bp, Rattus norvegicus
aactttgtaccagacctagagccct

SEQ ID NO: 32171 - DNA, 25 bp, Rattus norvegicus
aactttgtagcaatgattctcttct

SEQ ID NO: 32172 - DNA, 25 bp, Rattus norvegicus
aactttgtagcattgattctcttct

SEQ ID NO: 32173 - DNA, 25 bp, Rattus norvegicus
aactttgtagtcctgctggtcttca

SEQ ID NO: 32174 - DNA, 25 bp, Rattus norvegicus
aactttgtagtcgtgctggtcttca

SEQ ID NO: 32175 - DNA, 25 bp, Rattus norvegicus
aactttgtagttccgatctagtcgg

SEQ ID NO: 32176 - DNA, 25 bp, Rattus norvegicus
aactttgtagttgcgatctagtcgg

SEQ ID NO: 32177 - DNA, 25 bp, Rattus norvegicus
aactttgtatccatgagcacagcaa

SEQ ID NO: 32178 - DNA, 25 bp, Rattus norvegicus
aactttgtatccttgagcacagcaa

SEQ ID NO: 32179 - DNA, 25 bp, Rattus norvegicus
aactttgtatgactttgctatcttc

SEQ ID NO: 32180 - DNA, 25 bp, Rattus norvegicus
aactttgtatgagtttgctatcttc

SEQ ID NO: 32181 - DNA, 25 bp, Rattus norvegicus
aactttgtatgtcttgcctgtcggg

SEQ ID NO: 32182 - DNA, 25 bp, Rattus norvegicus
aactttgtatgtgttgcctgtcggg

SEQ ID NO: 32183 - DNA, 25 bp, Rattus norvegicus
aactttgtcaaacagcctactgatg

SEQ ID NO: 32184 - DNA, 25 bp, Rattus norvegicus
aactttgtcaaagagcctactgatg

SEQ ID NO: 32185 - DNA, 25 bp, Rattus norvegicus
aactttgtcagccacgtgtcattag

SEQ ID NO: 32186 - DNA, 25 bp, Rattus norvegicus
aactttgtcagcgacgtgtcattag

SEQ ID NO: 32187 - DNA, 25 bp, Rattus norvegicus
aactttgtcatgctgatgtgaacac

SEQ ID NO: 32188 - DNA, 25 bp, Rattus norvegicus
aactttgtcatggtgatgtgaacac

SEQ ID NO: 32189 - DNA, 25 bp, Rattus norvegicus
aactttgtccgacagtttcagccgc

SEQ ID NO: 32190 - DNA, 25 bp, Rattus norvegicus
aactttgtccgagagtttcagccgc

SEQ ID NO: 32191 - DNA, 25 bp, Rattus norvegicus
aactttgtctggctttgaatcggat

SEQ ID NO: 32192 - DNA, 25 bp, Rattus norvegicus
aactttgtctgggtttgaatcggat

SEQ ID NO: 32193 - DNA, 25 bp, Rattus norvegicus
aactttgtgagtactgtctttagaa

SEQ ID NO: 32194 - DNA, 25 bp, Rattus norvegicus
aactttgtgagttctgtctttagaa

SEQ ID NO: 32195 - DNA, 25 bp, Rattus norvegicus
aactttgtgcacactggccatggcg

SEQ ID NO: 32196 - DNA, 25 bp, Rattus norvegicus
aactttgtgcactctggccatggcg

SEQ ID NO: 32197 - DNA, 25 bp, Rattus norvegicus
aactttgtgctcctgaacaggtaca

SEQ ID NO: 32198 - DNA, 25 bp, Rattus norvegicus
aactttgtgctcgtgaacaggtaca

SEQ ID NO: 32199 - DNA, 25 bp, Rattus norvegicus
aactttgtgcttatcatcggcatca

SEQ ID NO: 32200 - DNA, 25 bp, Rattus norvegicus
aactttgtgcttttcatcggcatca

SEQ ID NO: 32201 - DNA, 25 bp, Rattus norvegicus
aactttgtggcaacctatggcagag

SEQ ID NO: 32202 - DNA, 25 bp, Rattus norvegicus
aactttgtggcacctcacggcgttt

SEQ ID NO: 32203 - DNA, 25 bp, Rattus norvegicus
aactttgtggcagctcacggcgttt

SEQ ID NO: 32204 - DNA, 25 bp, Rattus norvegicus
aactttgtggcatcctatggcagag

SEQ ID NO: 32205 - DNA, 25 bp, Rattus norvegicus
aactttgtggcgagcgctgcaaact

SEQ ID NO: 32206 - DNA, 25 bp, Rattus norvegicus
aactttgtggcgtgcgctgcaaact

SEQ ID NO: 32207 - DNA, 25 bp, Rattus norvegicus
aactttgtggtccatctctgagcgt

SEQ ID NO: 32208 - DNA, 25 bp, Rattus norvegicus
aactttgtggtcgatctctgagcgt

SEQ ID NO: 32209 - DNA, 25 bp, Rattus norvegicus
aactttgtttgacacaccacactgg

SEQ ID NO: 32210 - DNA, 25 bp, Rattus norvegicus
aactttgtttgagacaccacactgg

SEQ ID NO: 32211 - DNA, 25 bp, Rattus norvegicus
aacttttactctcgagttctgtgga

SEQ ID NO: 32212 - DNA, 25 bp, Rattus norvegicus
aacttttactctggagttctgtgga

SEQ ID NO: 32213 - DNA, 25 bp, Rattus norvegicus
aacttttatgcgatttgttctgaaa

SEQ ID NO: 32214 - DNA, 25 bp, Rattus norvegicus
aacttttatgcgttttgttctgaaa

SEQ ID NO: 32215 - DNA, 25 bp, Rattus norvegicus
aacttttcaataaactacagccctg

SEQ ID NO: 32216 - DNA, 25 bp, Rattus norvegicus
aacttttcaatatactacagccctg

SEQ ID NO: 32217 - DNA, 25 bp, Rattus norvegicus
aacttttcaggcaagttactgtgat

SEQ ID NO: 32218 - DNA, 25 bp, Rattus norvegicus
aacttttcaggctagttactgtgat

SEQ ID NO: 32219 - DNA, 25 bp, Rattus norvegicus
aacttttcagttcactgtcccagat

SEQ ID NO: 32220 - DNA, 25 bp, Rattus norvegicus
aacttttcagttgactgtcccagat

SEQ ID NO: 32221 - DNA, 25 bp, Rattus norvegicus
aacttttccccgaaatgagcacata

SEQ ID NO: 32222 - DNA, 25 bp, Rattus norvegicus
aacttttccccgtaatgagcacata

SEQ ID NO: 32223 - DNA, 25 bp, Rattus norvegicus
aacttttccgctatggccactgagg

SEQ ID NO: 32224 - DNA, 25 bp, Rattus norvegicus
aacttttccgctttggccactgagg

SEQ ID NO: 32225 - DNA, 25 bp, Rattus norvegicus
aacttttcgcagacagggtggtgct

SEQ ID NO: 32226 - DNA, 25 bp, Rattus norvegicus
aacttttcgcagtcagggtggtgct

SEQ ID NO: 32227 - DNA, 25 bp, Rattus norvegicus
aacttttcgcttagtctctatagcc

SEQ ID NO: 32228 - DNA, 25 bp, Rattus norvegicus
aacttttcgctttgtctctatagcc

SEQ ID NO: 32229 - DNA, 25 bp, Rattus norvegicus
aacttttctacacacttcctttatg

SEQ ID NO: 32230 - DNA, 25 bp, Rattus norvegicus
aacttttctacagacttcctttatg

SEQ ID NO: 32231 - DNA, 25 bp, Rattus norvegicus
aacttttctagcacacacttaactc

SEQ ID NO: 32232 - DNA, 25 bp, Rattus norvegicus
aacttttctagctcacacttaactc

SEQ ID NO: 32233 - DNA, 25 bp, Rattus norvegicus
aacttttctccgagcaagcgagctc

SEQ ID NO: 32234 - DNA, 25 bp, Rattus norvegicus
aacttttctccgtgcaagcgagctc

SEQ ID NO: 32235 - DNA, 25 bp, Rattus norvegicus
aacttttctgccaccagactgttaa

SEQ ID NO: 32236 - DNA, 25 bp, Rattus norvegicus
aacttttctgcctccagactgttaa

SEQ ID NO: 32237 - DNA, 25 bp, Rattus norvegicus
aacttttctgttctacgtattcttg

SEQ ID NO: 32238 - DNA, 25 bp, Rattus norvegicus
aacttttctgttgtacgtattcttg

SEQ ID NO: 32239 - DNA, 25 bp, Rattus norvegicus
aacttttcttccctgaacctgagag

SEQ ID NO: 32240 - DNA, 25 bp, Rattus norvegicus
aacttttcttccgtgaacctgagag

SEQ ID NO: 32241 - DNA, 25 bp, Rattus norvegicus
aacttttcttgcacacaggcctggg

SEQ ID NO: 32242 - DNA, 25 bp, Rattus norvegicus
aacttttcttgctcacaggcctggg

SEQ ID NO: 32243 - DNA, 25 bp, Rattus norvegicus
aacttttgaatgatctctggtgaat

SEQ ID NO: 32244 - DNA, 25 bp, Rattus norvegicus
aacttttgaatgttctctggtgaat

SEQ ID NO: 32245 - DNA, 25 bp, Rattus norvegicus
aacttttgaccaccagttcggtgcc

SEQ ID NO: 32246 - DNA, 25 bp, Rattus norvegicus
aacttttgaccagcagttcggtgcc

SEQ ID NO: 32247 - DNA, 25 bp, Rattus norvegicus
aacttttgagtgacacctcctttgg

SEQ ID NO: 32248 - DNA, 25 bp, Rattus norvegicus
aacttttgagtgtcacctcctttgg

SEQ ID NO: 32249 - DNA, 25 bp, Rattus norvegicus
aacttttgctctcaggtacctgaac

SEQ ID NO: 32250 - DNA, 25 bp, Rattus norvegicus
aacttttgctctgaggtacctgaac

SEQ ID NO: 32251 - DNA, 25 bp, Rattus norvegicus
aacttttggagacatgggcatctgc

SEQ ID NO: 32252 - DNA, 25 bp, Rattus norvegicus
aacttttggagagatgggcatctgc

SEQ ID NO: 32253 - DNA, 25 bp, Rattus norvegicus
aacttttggatcatcctgttctgtc

SEQ ID NO: 32254 - DNA, 25 bp, Rattus norvegicus
aacttttggatcttcctgttctgtc

SEQ ID NO: 32255 - DNA, 25 bp, Rattus norvegicus
aacttttgtctccacattgttacca

SEQ ID NO: 32256 - DNA, 25 bp, Rattus norvegicus
aacttttgtctcgacattgttacca

SEQ ID NO: 32257 - DNA, 25 bp, Rattus norvegicus
aacttttgtggccttgggactgtgt

SEQ ID NO: 32258 - DNA, 25 bp, Rattus norvegicus
aacttttgtggcgttgggactgtgt

SEQ ID NO: 32259 - DNA, 25 bp, Rattus norvegicus
aacttttgttaaagctactgatcct

SEQ ID NO: 32260 - DNA, 25 bp, Rattus norvegicus
aacttttgttaatgctactgatcct

SEQ ID NO: 32261 - DNA, 25 bp, Rattus norvegicus
aacttttgttgtcatacttctggaa

SEQ ID NO: 32262 - DNA, 25 bp, Rattus norvegicus
aacttttgttgtgatacttctggaa

SEQ ID NO: 32263 - DNA, 25 bp, Rattus norvegicus
aactttttaatgacgtgtcagcctc

SEQ ID NO: 32264 - DNA, 25 bp, Rattus norvegicus
aactttttaatgtcgtgtcagcctc

SEQ ID NO: 32265 - DNA, 25 bp, Rattus norvegicus
aactttttaccaaattctcagctat

SEQ ID NO: 32266 - DNA, 25 bp, Rattus norvegicus
aactttttaccatattctcagctat

SEQ ID NO: 32267 - DNA, 25 bp, Rattus norvegicus
aactttttacccatactgcaagctg

SEQ ID NO: 32268 - DNA, 25 bp, Rattus norvegicus
aactttttacccttactgcaagctg

SEQ ID NO: 32269 - DNA, 25 bp, Rattus norvegicus
aactttttagtcctgcgtgtgtaca

SEQ ID NO: 32270 - DNA, 25 bp, Rattus norvegicus
aactttttagtcgtgcgtgtgtaca

SEQ ID NO: 32271 - DNA, 25 bp, Rattus norvegicus
aactttttcattctctggtgtgaaa

SEQ ID NO: 32272 - DNA, 25 bp, Rattus norvegicus
aactttttcattgtctggtgtgaaa

SEQ ID NO: 32273 - DNA, 25 bp, Rattus norvegicus
aactttttctcaagaacaccttcct

SEQ ID NO: 32274 - DNA, 25 bp, Rattus norvegicus
aactttttctcatgaacaccttcct

SEQ ID NO: 32275 - DNA, 25 bp, Rattus norvegicus
aactttttgattcctgttcatgcca

SEQ ID NO: 32276 - DNA, 25 bp, Rattus norvegicus
aactttttgattgctgttcatgcca

SEQ ID NO: 32277 - DNA, 25 bp, Rattus norvegicus
aactttttgtggctcgttggtcatt

SEQ ID NO: 32278 - DNA, 25 bp, Rattus norvegicus
aactttttgtgggtcgttggtcatt

SEQ ID NO: 32279 - DNA, 25 bp, Rattus norvegicus
aacttttttagcacaccttatgctt

SEQ ID NO: 32280 - DNA, 25 bp, Rattus norvegicus
aacttttttagctcaccttatgctt

SEQ ID NO: 32281 - DNA, 25 bp, Rattus norvegicus
aagaaaaacagcactcctcttcaac

SEQ ID NO: 32282 - DNA, 25 bp, Rattus norvegicus
aagaaaaacagctctcctcttcaac

SEQ ID NO: 32283 - DNA, 25 bp, Rattus norvegicus
aagaaaaatattcctcctggtgctg

SEQ ID NO: 32284 - DNA, 25 bp, Rattus norvegicus
aagaaaaatattgctcctggtgctg

SEQ ID NO: 32285 - DNA, 25 bp, Rattus norvegicus
aagaaaaatgacacccctctgggat

SEQ ID NO: 32286 - DNA, 25 bp, Rattus norvegicus
aagaaaaatgactcccctctgggat

SEQ ID NO: 32287 - DNA, 25 bp, Rattus norvegicus
aagaaaaatgttcccactgaatttg

SEQ ID NO: 32288 - DNA, 25 bp, Rattus norvegicus
aagaaaaatgttgccactgaatttg

SEQ ID NO: 32289 - DNA, 25 bp, Rattus norvegicus
aagaaaaccaccaatggccggctgc

SEQ ID NO: 32290 - DNA, 25 bp, Rattus norvegicus
aagaaaaccacctatggccggctgc

SEQ ID NO: 32291 - DNA, 25 bp, Rattus norvegicus
aagaaaacccatcggcctatgtcct

SEQ ID NO: 32292 - DNA, 25 bp, Rattus norvegicus
aagaaaacccatgggcctatgtcct

SEQ ID NO: 32293 - DNA, 25 bp, Rattus norvegicus
aagaaaacccttagtcacagcagac

SEQ ID NO: 32294 - DNA, 25 bp, Rattus norvegicus
aagaaaaccctttgtcacagcagac

SEQ ID NO: 32295 - DNA, 25 bp, Rattus norvegicus
aagaaaacgcagactcactggccac

SEQ ID NO: 32296 - DNA, 25 bp, Rattus norvegicus
aagaaaacgcagtctcactggccac

SEQ ID NO: 32297 - DNA, 25 bp, Rattus norvegicus
aagaaaacggtgacagccggccgtg

SEQ ID NO: 32298 - DNA, 25 bp, Rattus norvegicus
aagaaaacggtgtcagccggccgtg

SEQ ID NO: 32299 - DNA, 25 bp, Rattus norvegicus
aagaaaactgatactcccttcactg

SEQ ID NO: 32300 - DNA, 25 bp, Rattus norvegicus
aagaaaactgattctcccttcactg

SEQ ID NO: 32301 - DNA, 25 bp, Rattus norvegicus
aagaaaagactcactttgccaaata

SEQ ID NO: 32302 - DNA, 25 bp, Rattus norvegicus
aagaaaagactctctttgccaaata

SEQ ID NO: 32303 - DNA, 25 bp, Rattus norvegicus
aagaaaagagctctgaccccaagtc

SEQ ID NO: 32304 - DNA, 25 bp, Rattus norvegicus
aagaaaagagctgtgaccccaagtc

SEQ ID NO: 32305 - DNA, 25 bp, Rattus norvegicus
aagaaaagatctccccttcgttggg

SEQ ID NO: 32306 - DNA, 25 bp, Rattus norvegicus
aagaaaagatctgcccttcgttggg

SEQ ID NO: 32307 - DNA, 25 bp, Rattus norvegicus
aagaaaagcaccatcagagcccagt

SEQ ID NO: 32308 - DNA, 25 bp, Rattus norvegicus
aagaaaagcaccttcagagcccagt

SEQ ID NO: 32309 - DNA, 25 bp, Rattus norvegicus
aagaaaagcataacgaaggtccaag

SEQ ID NO: 32310 - DNA, 25 bp, Rattus norvegicus
aagaaaagcatatcgaaggtccaag

SEQ ID NO: 32311 - DNA, 25 bp, Rattus norvegicus
aagaaaagccagagtacgcctcttt

SEQ ID NO: 32312 - DNA, 25 bp, Rattus norvegicus
aagaaaagccagtgtacgcctcttt

SEQ ID NO: 32313 - DNA, 25 bp, Rattus norvegicus
aagaaaagccatcctgtatcacctt

SEQ ID NO: 32314 - DNA, 25 bp, Rattus norvegicus
aagaaaagccatgctgtatcacctt

SEQ ID NO: 32315 - DNA, 25 bp, Rattus norvegicus
aagaaaagcggaagtccaagcacaa

SEQ ID NO: 32316 - DNA, 25 bp, Rattus norvegicus
aagaaaagcggatgtccaagcacaa

SEQ ID NO: 32317 - DNA, 25 bp, Rattus norvegicus
aagaaaagctttcccactttgtgga

SEQ ID NO: 32318 - DNA, 25 bp, Rattus norvegicus
aagaaaagctttgccactttgtgga

SEQ ID NO: 32319 - DNA, 25 bp, Rattus norvegicus
aagaaaaggcatacgcaacagtgac

SEQ ID NO: 32320 - DNA, 25 bp, Rattus norvegicus
aagaaaaggcattcgcaacagtgac

SEQ ID NO: 32321 - DNA, 25 bp, Rattus norvegicus
aagaaaagttctctcgcgtttgtga

SEQ ID NO: 32322 - DNA, 25 bp, Rattus norvegicus
aagaaaagttctgtcgcgtttgtga

SEQ ID NO: 32323 - DNA, 25 bp, Rattus norvegicus
aagaaaatctcaccagctgcatcca

SEQ ID NO: 32324 - DNA, 25 bp, Rattus norvegicus
aagaaaatctcagcagctgcatcca

SEQ ID NO: 32325 - DNA, 25 bp, Rattus norvegicus
aagaaaatctccactacccacttct

SEQ ID NO: 32326 - DNA, 25 bp, Rattus norvegicus
aagaaaatctcctctacccacttct

SEQ ID NO: 32327 - DNA, 25 bp, Rattus norvegicus
aagaaaatcttaccttcatcccatc

SEQ ID NO: 32328 - DNA, 25 bp, Rattus norvegicus
aagaaaatcttagcttcatcccatc

SEQ ID NO: 32329 - DNA, 25 bp, Rattus norvegicus
aagaaaatgcccaggcctggtttgg

SEQ ID NO: 32330 - DNA, 25 bp, Rattus norvegicus
aagaaaatgccctggcctggtttgg

SEQ ID NO: 32331 - DNA, 25 bp, Rattus norvegicus
aagaaaatgctgattggccctcaat

SEQ ID NO: 32332 - DNA, 25 bp, Rattus norvegicus
aagaaaatgctgtttggccctcaat

SEQ ID NO: 32333 - DNA, 25 bp, Rattus norvegicus
aagaaaatgggtctcccctcagtgt

SEQ ID NO: 32334 - DNA, 25 bp, Rattus norvegicus
aagaaaatgggtgtcccctcagtgt

SEQ ID NO: 32335 - DNA, 25 bp, Rattus norvegicus
aagaaacaaagcaggcacctaccaa

SEQ ID NO: 32336 - DNA, 25 bp, Rattus norvegicus
aagaaacaaagctggcacctaccaa

SEQ ID NO: 32337 - DNA, 25 bp, Rattus norvegicus
aagaaacaatgccaacttcctcagc

SEQ ID NO: 32338 - DNA, 25 bp, Rattus norvegicus
aagaaacaatgcgaacttcctcagc

SEQ ID NO: 32339 - DNA, 25 bp, Rattus norvegicus
aagaaacaccagcaagccatgactc

SEQ ID NO: 32340 - DNA, 25 bp, Rattus norvegicus
aagaaacaccaggaagccatgactc

SEQ ID NO: 32341 - DNA, 25 bp, Rattus norvegicus
aagaaacagaccacactagtgtatt

SEQ ID NO: 32342 - DNA, 25 bp, Rattus norvegicus
aagaaacagacctcactagtgtatt

SEQ ID NO: 32343 - DNA, 25 bp, Rattus norvegicus
aagaaacagcatcctactcttgggc

SEQ ID NO: 32344 - DNA, 25 bp, Rattus norvegicus
aagaaacagcatgctactcttgggc

SEQ ID NO: 32345 - DNA, 25 bp, Rattus norvegicus
aagaaacagcccaacgtgtgtacag

SEQ ID NO: 32346 - DNA, 25 bp, Rattus norvegicus
aagaaacagccctacgtgtgtacag

SEQ ID NO: 32347 - DNA, 25 bp, Rattus norvegicus
aagaaacagctgaggctctgctgtc

SEQ ID NO: 32348 - DNA, 25 bp, Rattus norvegicus
aagaaacagctgcagctagagagat

SEQ ID NO: 32349 - DNA, 25 bp, Rattus norvegicus
aagaaacagctggagctagagagat

SEQ ID NO: 32350 - DNA, 25 bp, Rattus norvegicus
aagaaacagctgtggctctgctgtc

SEQ ID NO: 32351 - DNA, 25 bp, Rattus norvegicus
aagaaacagtggcatgacctcccct

SEQ ID NO: 32352 - DNA, 25 bp, Rattus norvegicus
aagaaacagtgggatgacctcccct

SEQ ID NO: 32353 - DNA, 25 bp, Rattus norvegicus
aagaaacatcccagcttgatccctc

SEQ ID NO: 32354 - DNA, 25 bp, Rattus norvegicus
aagaaacatccctgcttgatccctc

SEQ ID NO: 32355 - DNA, 25 bp, Rattus norvegicus
aagaaacatgcacgctggtctctcc

SEQ ID NO: 32356 - DNA, 25 bp, Rattus norvegicus
aagaaacatgcaggctggtctctcc

SEQ ID NO: 32357 - DNA, 25 bp, Rattus norvegicus
aagaaaccatttccaggtgggatca

SEQ ID NO: 32358 - DNA, 25 bp, Rattus norvegicus
aagaaaccatttgcaggtgggatca

SEQ ID NO: 32359 - DNA, 25 bp, Rattus norvegicus
aagaaaccctaaacatctggcctcg

SEQ ID NO: 32360 - DNA, 25 bp, Rattus norvegicus
aagaaaccctaatcatctggcctcg

SEQ ID NO: 32361 - DNA, 25 bp, Rattus norvegicus
aagaaaccctggaggcagctgtgtc

SEQ ID NO: 32362 - DNA, 25 bp, Rattus norvegicus
aagaaaccctggtggcagctgtgtc

SEQ ID NO: 32363 - DNA, 25 bp, Rattus norvegicus
aagaaaccctgtcagtcctcaggtt

SEQ ID NO: 32364 - DNA, 25 bp, Rattus norvegicus
aagaaaccctgtgagtcctcaggtt

SEQ ID NO: 32365 - DNA, 25 bp, Rattus norvegicus
aagaaacccttcagatcacaatccg

SEQ ID NO: 32366 - DNA, 25 bp, Rattus norvegicus
aagaaacccttctgatcacaatccg

SEQ ID NO: 32367 - DNA, 25 bp, Rattus norvegicus
aagaaacctccaaatggacaacggg

SEQ ID NO: 32368 - DNA, 25 bp, Rattus norvegicus
aagaaacctccaagtgccactcgta

SEQ ID NO: 32369 - DNA, 25 bp, Rattus norvegicus
aagaaacctccatatggacaacggg

SEQ ID NO: 32370 - DNA, 25 bp, Rattus norvegicus
aagaaacctccatgtgccactcgta

SEQ ID NO: 32371 - DNA, 25 bp, Rattus norvegicus
aagaaacctccgctgtgtgtgtctt

SEQ ID NO: 32372 - DNA, 25 bp, Rattus norvegicus
aagaaacctccggtgtgtgtgtctt

SEQ ID NO: 32373 - DNA, 25 bp, Rattus norvegicus
aagaaacctgtgactcagctgaacc

SEQ ID NO: 32374 - DNA, 25 bp, Rattus norvegicus
aagaaacctgtgtctcagctgaacc

SEQ ID NO: 32375 - DNA, 25 bp, Rattus norvegicus
aagaaacgagccatcctgactctgt

SEQ ID NO: 32376 - DNA, 25 bp, Rattus norvegicus
aagaaacgagccttcctgactctgt

SEQ ID NO: 32377 - DNA, 25 bp, Rattus norvegicus
aagaaacggacgagcgctgtgccac

SEQ ID NO: 32378 - DNA, 25 bp, Rattus norvegicus
aagaaacggacgtgcgctgtgccac

SEQ ID NO: 32379 - DNA, 25 bp, Rattus norvegicus
aagaaactacaaatttgcacatatt

SEQ ID NO: 32380 - DNA, 25 bp, Rattus norvegicus
aagaaactacaattttgcacatatt

SEQ ID NO: 32381 - DNA, 25 bp, Rattus norvegicus
aagaaactcatgaagccaggctgat

SEQ ID NO: 32382 - DNA, 25 bp, Rattus norvegicus
aagaaactcatgtagccaggctgat

SEQ ID NO: 32383 - DNA, 25 bp, Rattus norvegicus
aagaaactcattcccaacgtgcaaa

SEQ ID NO: 32384 - DNA, 25 bp, Rattus norvegicus
aagaaactcattgccaacgtgcaaa

SEQ ID NO: 32385 - DNA, 25 bp, Rattus norvegicus
aagaaactccagctttgctttctgc

SEQ ID NO: 32386 - DNA, 25 bp, Rattus norvegicus
aagaaactccaggtttgctttctgc

SEQ ID NO: 32387 - DNA, 25 bp, Rattus norvegicus
aagaaactccgcagctgtggaccag

SEQ ID NO: 32388 - DNA, 25 bp, Rattus norvegicus
aagaaactccgctgctgtggaccag

SEQ ID NO: 32389 - DNA, 25 bp, Rattus norvegicus
aagaaactctcaagcctccttatat

SEQ ID NO: 32390 - DNA, 25 bp, Rattus norvegicus
aagaaactctcatgcctccttatat

SEQ ID NO: 32391 - DNA, 25 bp, Rattus norvegicus
aagaaactctttcagcacatctcgg

SEQ ID NO: 32392 - DNA, 25 bp, Rattus norvegicus
aagaaactctttgagcacatctcgg

SEQ ID NO: 32393 - DNA, 25 bp, Rattus norvegicus
aagaaactgcacagagtctgccttc

SEQ ID NO: 32394 - DNA, 25 bp, Rattus norvegicus
aagaaactgcactgagtctgccttc

SEQ ID NO: 32395 - DNA, 25 bp, Rattus norvegicus
aagaaactgcctagctgccttaaac

SEQ ID NO: 32396 - DNA, 25 bp, Rattus norvegicus
aagaaactgccttgctgccttaaac

SEQ ID NO: 32397 - DNA, 25 bp, Rattus norvegicus
aagaaactgcgacgcatttcccatg

SEQ ID NO: 32398 - DNA, 25 bp, Rattus norvegicus
aagaaactgcgaggcatttcccatg

SEQ ID NO: 32399 - DNA, 25 bp, Rattus norvegicus
aagaaactgcgcatcctgtgtacta

SEQ ID NO: 32400 - DNA, 25 bp, Rattus norvegicus
aagaaactgcgccagctgacacatc

SEQ ID NO: 32401 - DNA, 25 bp, Rattus norvegicus
aagaaactgcgcgagctgacacatc

SEQ ID NO: 32402 - DNA, 25 bp, Rattus norvegicus
aagaaactgcgcttcctgtgtacta

SEQ ID NO: 32403 - DNA, 25 bp, Rattus norvegicus
aagaaactgggcatgtccagggcct

SEQ ID NO: 32404 - DNA, 25 bp, Rattus norvegicus
aagaaactgggcttgtccagggcct

SEQ ID NO: 32405 - DNA, 25 bp, Rattus norvegicus
aagaaactgtccctccaaagtcaat

SEQ ID NO: 32406 - DNA, 25 bp, Rattus norvegicus
aagaaactgtccgtccaaagtcaat

SEQ ID NO: 32407 - DNA, 25 bp, Rattus norvegicus
aagaaactgtgtctttccctgccag

SEQ ID NO: 32408 - DNA, 25 bp, Rattus norvegicus
aagaaactgtgtgtttccctgccag

SEQ ID NO: 32409 - DNA, 25 bp, Rattus norvegicus
aagaaacttcatccctaacacccag

SEQ ID NO: 32410 - DNA, 25 bp, Rattus norvegicus
aagaaacttcatgcctaacacccag

SEQ ID NO: 32411 - DNA, 25 bp, Rattus norvegicus
aagaaacttgttctctacacgtata

SEQ ID NO: 32412 - DNA, 25 bp, Rattus norvegicus
aagaaacttgttgtctacacgtata

SEQ ID NO: 32413 - DNA, 25 bp, Rattus norvegicus
aagaaactttgtatgccagcaggat

SEQ ID NO: 32414 - DNA, 25 bp, Rattus norvegicus
aagaaactttgtttgccagcaggat

SEQ ID NO: 32415 - DNA, 25 bp, Rattus norvegicus
aagaaagaagcacattcctcctgcc

SEQ ID NO: 32416 - DNA, 25 bp, Rattus norvegicus
aagaaagaagcagattcctcctgcc

SEQ ID NO: 32417 - DNA, 25 bp, Rattus norvegicus
aagaaagatcctctgctgcatgcca

SEQ ID NO: 32418 - DNA, 25 bp, Rattus norvegicus
aagaaagatcctgtgctgcatgcca

SEQ ID NO: 32419 - DNA, 25 bp, Rattus norvegicus
aagaaagatgcaacaccctcgaggc

SEQ ID NO: 32420 - DNA, 25 bp, Rattus norvegicus
aagaaagatgcatcaccctcgaggc

SEQ ID NO: 32421 - DNA, 25 bp, Rattus norvegicus
aagaaagcacagatgacccgtcaga

SEQ ID NO: 32422 - DNA, 25 bp, Rattus norvegicus
aagaaagcacagttgacccgtcaga

SEQ ID NO: 32423 - DNA, 25 bp, Rattus norvegicus
aagaaagcacatcgtgcctgcgcgc

SEQ ID NO: 32424 - DNA, 25 bp, Rattus norvegicus
aagaaagcacatggtgcctgcgcgc

SEQ ID NO: 32425 - DNA, 25 bp, Rattus norvegicus
aagaaagcactcatcgtgggccacc

SEQ ID NO: 32426 - DNA, 25 bp, Rattus norvegicus
aagaaagcactcttcgtgggccacc

SEQ ID NO: 32427 - DNA, 25 bp, Rattus norvegicus
aagaaagcatttcactgggcccatg

SEQ ID NO: 32428 - DNA, 25 bp, Rattus norvegicus
aagaaagcatttccagtccacagca

SEQ ID NO: 32429 - DNA, 25 bp, Rattus norvegicus
aagaaagcatttgactgggcccatg

SEQ ID NO: 32430 - DNA, 25 bp, Rattus norvegicus
aagaaagcatttgcagtccacagca

SEQ ID NO: 32431 - DNA, 25 bp, Rattus norvegicus
aagaaagcccagctaaccctgttag

SEQ ID NO: 32432 - DNA, 25 bp, Rattus norvegicus
aagaaagcccaggtaaccctgttag

SEQ ID NO: 32433 - DNA, 25 bp, Rattus norvegicus
aagaaagccctgcacctttagcaca

SEQ ID NO: 32434 - DNA, 25 bp, Rattus norvegicus
aagaaagccctggacctttagcaca

SEQ ID NO: 32435 - DNA, 25 bp, Rattus norvegicus
aagaaagcccttctgagttggcctt

SEQ ID NO: 32436 - DNA, 25 bp, Rattus norvegicus
aagaaagcccttgtgagttggcctt

SEQ ID NO: 32437 - DNA, 25 bp, Rattus norvegicus
aagaaagccgtgctgtctgacatcg

SEQ ID NO: 32438 - DNA, 25 bp, Rattus norvegicus
aagaaagccgtggtgtctgacatcg

SEQ ID NO: 32439 - DNA, 25 bp, Rattus norvegicus
aagaaagcctaacctatctcaaaaa

SEQ ID NO: 32440 - DNA, 25 bp, Rattus norvegicus
aagaaagcctaagctatctcaaaaa

SEQ ID NO: 32441 - DNA, 25 bp, Rattus norvegicus
aagaaagcctttcaacactgccctt

SEQ ID NO: 32442 - DNA, 25 bp, Rattus norvegicus
aagaaagcctttgaacactgccctt

SEQ ID NO: 32443 - DNA, 25 bp, Rattus norvegicus
aagaaagcgaccagttctccgagac

SEQ ID NO: 32444 - DNA, 25 bp, Rattus norvegicus
aagaaagcgacctgttctccgagac

SEQ ID NO: 32445 - DNA, 25 bp, Rattus norvegicus
aagaaaggacagaaccactgcccta

SEQ ID NO: 32446 - DNA, 25 bp, Rattus norvegicus
aagaaaggacagtaccactgcccta

SEQ ID NO: 32447 - DNA, 25 bp, Rattus norvegicus
aagaaaggacatctggcttctatgt

SEQ ID NO: 32448 - DNA, 25 bp, Rattus norvegicus
aagaaaggacatgtggcttctatgt

SEQ ID NO: 32449 - DNA, 25 bp, Rattus norvegicus
aagaaaggcagtcacggcagctcac

SEQ ID NO: 32450 - DNA, 25 bp, Rattus norvegicus
aagaaaggcagtgacggcagctcac

SEQ ID NO: 32451 - DNA, 25 bp, Rattus norvegicus
aagaaaggcatgactccacactgta

SEQ ID NO: 32452 - DNA, 25 bp, Rattus norvegicus
aagaaaggcatgtctccacactgta

SEQ ID NO: 32453 - DNA, 25 bp, Rattus norvegicus
aagaaaggcctcatgtcctcttctg

SEQ ID NO: 32454 - DNA, 25 bp, Rattus norvegicus
aagaaaggcctcttgtcctcttctg

SEQ ID NO: 32455 - DNA, 25 bp, Rattus norvegicus
aagaaaggcgtcacaactgtctccc

SEQ ID NO: 32456 - DNA, 25 bp, Rattus norvegicus
aagaaaggcgtctcaactgtctccc

SEQ ID NO: 32457 - DNA, 25 bp, Rattus norvegicus
aagaaaggctggacaaggctccctc

SEQ ID NO: 32458 - DNA, 25 bp, Rattus norvegicus
aagaaaggctggtcaaggctccctc

SEQ ID NO: 32459 - DNA, 25 bp, Rattus norvegicus
aagaaagggcctctgcagcctgtca

SEQ ID NO: 32460 - DNA, 25 bp, Rattus norvegicus
aagaaagggcctgtgcagcctgtca

SEQ ID NO: 32461 - DNA, 25 bp, Rattus norvegicus
aagaaagggcggctatccaccagac

SEQ ID NO: 32462 - DNA, 25 bp, Rattus norvegicus
aagaaagggcgggtatccaccagac

SEQ ID NO: 32463 - DNA, 25 bp, Rattus norvegicus
aagaaaggtattactgtccgacaga

SEQ ID NO: 32464 - DNA, 25 bp, Rattus norvegicus
aagaaaggtatttctgtccgacaga

SEQ ID NO: 32465 - DNA, 25 bp, Rattus norvegicus
aagaaaggtctacaagcatctttgc

SEQ ID NO: 32466 - DNA, 25 bp, Rattus norvegicus
aagaaaggtctagaagcatctttgc

SEQ ID NO: 32467 - DNA, 25 bp, Rattus norvegicus
aagaaaggtgtgagaaggcccagct

SEQ ID NO: 32468 - DNA, 25 bp, Rattus norvegicus
aagaaaggtgtgtgaaggcccagct

SEQ ID NO: 32469 - DNA, 25 bp, Rattus norvegicus
aagaaagtatccagtgtctccagcc

SEQ ID NO: 32470 - DNA, 25 bp, Rattus norvegicus
aagaaagtatcctgtgtctccagcc

SEQ ID NO: 32471 - DNA, 25 bp, Rattus norvegicus
aagaaagtccacacaggccccaatg

SEQ ID NO: 32472 - DNA, 25 bp, Rattus norvegicus
aagaaagtccactcaggccccaatg

SEQ ID NO: 32473 - DNA, 25 bp, Rattus norvegicus
aagaaagtccagacgcctcacagga

SEQ ID NO: 32474 - DNA, 25 bp, Rattus norvegicus
aagaaagtccagtcgcctcacagga

SEQ ID NO: 32475 - DNA, 25 bp, Rattus norvegicus
aagaaagtccttactcatcagagaa

SEQ ID NO: 32476 - DNA, 25 bp, Rattus norvegicus
aagaaagtcctttctcatcagagaa

SEQ ID NO: 32477 - DNA, 25 bp, Rattus norvegicus
aagaaagtgctgctgtccctaggct

SEQ ID NO: 32478 - DNA, 25 bp, Rattus norvegicus
aagaaagtgctggtgtccctaggct

SEQ ID NO: 32479 - DNA, 25 bp, Rattus norvegicus
aagaaagtgtctacgcatcagccct

SEQ ID NO: 32480 - DNA, 25 bp, Rattus norvegicus
aagaaagtgtcttcgcatcagccct

SEQ ID NO: 32481 - DNA, 25 bp, Rattus norvegicus
aagaaagttcacctgtttccctctg

SEQ ID NO: 32482 - DNA, 25 bp, Rattus norvegicus
aagaaagttcacgtgtttccctctg

SEQ ID NO: 32483 - DNA, 25 bp, Rattus norvegicus
aagaaatacagtccatctttgggaa

SEQ ID NO: 32484 - DNA, 25 bp, Rattus norvegicus
aagaaatacagtgcatctttgggaa

SEQ ID NO: 32485 - DNA, 25 bp, Rattus norvegicus
aagaaatactccacaaagtagtcct

SEQ ID NO: 32486 - DNA, 25 bp, Rattus norvegicus
aagaaatactcctcaaagtagtcct

SEQ ID NO: 32487 - DNA, 25 bp, Rattus norvegicus
aagaaatacttgacacggctttgaa

SEQ ID NO: 32488 - DNA, 25 bp, Rattus norvegicus
aagaaatacttgtcacggctttgaa

SEQ ID NO: 32489 - DNA, 25 bp, Rattus norvegicus
aagaaatagtggacgctctcccacc

SEQ ID NO: 32490 - DNA, 25 bp, Rattus norvegicus
aagaaatagtggtcgctctcccacc

SEQ ID NO: 32491 - DNA, 25 bp, Rattus norvegicus
aagaaatatctccagggcctcggat

SEQ ID NO: 32492 - DNA, 25 bp, Rattus norvegicus
aagaaatatctcgagggcctcggat

SEQ ID NO: 32493 - DNA, 25 bp, Rattus norvegicus
aagaaatattcaacgtcaccctcca

SEQ ID NO: 32494 - DNA, 25 bp, Rattus norvegicus
aagaaatattcatcgtcaccctcca

SEQ ID NO: 32495 - DNA, 25 bp, Rattus norvegicus
aagaaatcacatagagccctgctgt

SEQ ID NO: 32496 - DNA, 25 bp, Rattus norvegicus
aagaaatcacattgagccctgctgt

SEQ ID NO: 32497 - DNA, 25 bp, Rattus norvegicus
aagaaatccaagctttctgccctgt

SEQ ID NO: 32498 - DNA, 25 bp, Rattus norvegicus
aagaaatccaaggtttctgccctgt

SEQ ID NO: 32499 - DNA, 25 bp, Rattus norvegicus
aagaaatccacaagcatttgcctcc

SEQ ID NO: 32500 - DNA, 25 bp, Rattus norvegicus
aagaaatccacatgcatttgcctcc

SEQ ID NO: 32501 - DNA, 25 bp, Rattus norvegicus
aagaaatccagaactcagtcccggt

SEQ ID NO: 32502 - DNA, 25 bp, Rattus norvegicus
aagaaatccagatctcagtcccggt

SEQ ID NO: 32503 - DNA, 25 bp, Rattus norvegicus
aagaaatcccataatccaggctatt

SEQ ID NO: 32504 - DNA, 25 bp, Rattus norvegicus
aagaaatcccattatccaggctatt

SEQ ID NO: 32505 - DNA, 25 bp, Rattus norvegicus
aagaaatccgtgaggcattccgagt

SEQ ID NO: 32506 - DNA, 25 bp, Rattus norvegicus
aagaaatccgtgtggcattccgagt

SEQ ID NO: 32507 - DNA, 25 bp, Rattus norvegicus
aagaaatccttaccggagtccagct

SEQ ID NO: 32508 - DNA, 25 bp, Rattus norvegicus
aagaaatccttagcggagtccagct

SEQ ID NO: 32509 - DNA, 25 bp, Rattus norvegicus
aagaaatcggatccatagaagacat

SEQ ID NO: 32510 - DNA, 25 bp, Rattus norvegicus
aagaaatcggatgcatagaagacat

SEQ ID NO: 32511 - DNA, 25 bp, Rattus norvegicus
aagaaatctcttaaggtccactgcc

SEQ ID NO: 32512 - DNA, 25 bp, Rattus norvegicus
aagaaatctctttaggtccactgcc

SEQ ID NO: 32513 - DNA, 25 bp, Rattus norvegicus
aagaaatctgtaacagtcccctccg

SEQ ID NO: 32514 - DNA, 25 bp, Rattus norvegicus
aagaaatctgtatcagtcccctccg

SEQ ID NO: 32515 - DNA, 25 bp, Rattus norvegicus
aagaaatgatagcagctccagaaat

SEQ ID NO: 32516 - DNA, 25 bp, Rattus norvegicus
aagaaatgataggagctccagaaat

SEQ ID NO: 32517 - DNA, 25 bp, Rattus norvegicus
aagaaatgcagaacccgcgtttagt

SEQ ID NO: 32518 - DNA, 25 bp, Rattus norvegicus
aagaaatgcagatcccgcgtttagt

SEQ ID NO: 32519 - DNA, 25 bp, Rattus norvegicus
aagaaatgccatctccgaacggtgg

SEQ ID NO: 32520 - DNA, 25 bp, Rattus norvegicus
aagaaatgccatgtccgaacggtgg

SEQ ID NO: 32521 - DNA, 25 bp, Rattus norvegicus
aagaaatgccttctctcttaggcct

SEQ ID NO: 32522 - DNA, 25 bp, Rattus norvegicus
aagaaatgccttgtctcttaggcct

SEQ ID NO: 32523 - DNA, 25 bp, Rattus norvegicus
aagaaatgcgccctcagtggttcca

SEQ ID NO: 32524 - DNA, 25 bp, Rattus norvegicus
aagaaatgcgccgtcagtggttcca

SEQ ID NO: 32525 - DNA, 25 bp, Rattus norvegicus
aagaaatggtgtctgctctagctca

SEQ ID NO: 32526 - DNA, 25 bp, Rattus norvegicus
aagaaatggtgtgtgctctagctca

SEQ ID NO: 32527 - DNA, 25 bp, Rattus norvegicus
aagaaatgtcccctgccatgtactc

SEQ ID NO: 32528 - DNA, 25 bp, Rattus norvegicus
aagaaatgtcccgtgccatgtactc

SEQ ID NO: 32529 - DNA, 25 bp, Rattus norvegicus
aagaaatgtgtcaagtccccttcgc

SEQ ID NO: 32530 - DNA, 25 bp, Rattus norvegicus
aagaaatgtgtctagtccccttcgc

SEQ ID NO: 32531 - DNA, 25 bp, Rattus norvegicus
aagaaattagcgctgtttggtgaat

SEQ ID NO: 32532 - DNA, 25 bp, Rattus norvegicus
aagaaattagcggtgtttggtgaat

SEQ ID NO: 32533 - DNA, 25 bp, Rattus norvegicus
aagaaattcactcaggctacccctc

SEQ ID NO: 32534 - DNA, 25 bp, Rattus norvegicus
aagaaattcactgaggctacccctc

SEQ ID NO: 32535 - DNA, 25 bp, Rattus norvegicus
aagaaattggagatgcttggagcag

SEQ ID NO: 32536 - DNA, 25 bp, Rattus norvegicus
aagaaattggagttgcttggagcag

SEQ ID NO: 32537 - DNA, 25 bp, Rattus norvegicus
aagaaattgtacaagagcccaggaa

SEQ ID NO: 32538 - DNA, 25 bp, Rattus norvegicus
aagaaattgtactagagcccaggaa

SEQ ID NO: 32539 - DNA, 25 bp, Rattus norvegicus
aagaaattgttccttattgctcaga

SEQ ID NO: 32540 - DNA, 25 bp, Rattus norvegicus
aagaaattgttcgttattgctcaga

SEQ ID NO: 32541 - DNA, 25 bp, Rattus norvegicus
aagaaatttccacacaatcagtatg

SEQ ID NO: 32542 - DNA, 25 bp, Rattus norvegicus
aagaaatttccagacaatcagtatg

SEQ ID NO: 32543 - DNA, 25 bp, Rattus norvegicus
aagaaatttgccagccctgagtgcc

SEQ ID NO: 32544 - DNA, 25 bp, Rattus norvegicus
aagaaatttgcctgccctgagtgcc

SEQ ID NO: 32545 - DNA, 25 bp, Rattus norvegicus
aagaacaacgttatcagggatggct

SEQ ID NO: 32546 - DNA, 25 bp, Rattus norvegicus
aagaacaacgttttcagggatggct

SEQ ID NO: 32547 - DNA, 25 bp, Rattus norvegicus
aagaacaactccctgtaaccacctg

SEQ ID NO: 32548 - DNA, 25 bp, Rattus norvegicus
aagaacaactccgtgtaaccacctg

SEQ ID NO: 32549 - DNA, 25 bp, Rattus norvegicus
aagaacaagcgtcgctatgctccca

SEQ ID NO: 32550 - DNA, 25 bp, Rattus norvegicus
aagaacaagcgtggctatgctccca

SEQ ID NO: 32551 - DNA, 25 bp, Rattus norvegicus
aagaacaagcttcgacatctgtcag

SEQ ID NO: 32552 - DNA, 25 bp, Rattus norvegicus
aagaacaagcttggacatctgtcag

SEQ ID NO: 32553 - DNA, 25 bp, Rattus norvegicus
aagaacaaggcccacaacatcttcc

SEQ ID NO: 32554 - DNA, 25 bp, Rattus norvegicus
aagaacaaggccgacaacatcttcc

SEQ ID NO: 32555 - DNA, 25 bp, Rattus norvegicus
aagaacaaggttcactgcgtggctt

SEQ ID NO: 32556 - DNA, 25 bp, Rattus norvegicus
aagaacaaggttgactgcgtggctt

SEQ ID NO: 32557 - DNA, 25 bp, Rattus norvegicus
aagaacaagtccatggccagccatt

SEQ ID NO: 32558 - DNA, 25 bp, Rattus norvegicus
aagaacaagtccttggccagccatt

SEQ ID NO: 32559 - DNA, 25 bp, Rattus norvegicus
aagaacaagttacggccacaccagt

SEQ ID NO: 32560 - DNA, 25 bp, Rattus norvegicus
aagaacaagttagggccacaccagt

SEQ ID NO: 32561 - DNA, 25 bp, Rattus norvegicus
aagaacaatacccagctagcctcag

SEQ ID NO: 32562 - DNA, 25 bp, Rattus norvegicus
aagaacaataccgagctagcctcag

SEQ ID NO: 32563 - DNA, 25 bp, Rattus norvegicus
aagaacaatcttataataatcacgt

SEQ ID NO: 32564 - DNA, 25 bp, Rattus norvegicus
aagaacaatcttttaataatcacgt

SEQ ID NO: 32565 - DNA, 25 bp, Rattus norvegicus
aagaacacaccgatttctcatgcct

SEQ ID NO: 32566 - DNA, 25 bp, Rattus norvegicus
aagaacacaccgttttctcatgcct

SEQ ID NO: 32567 - DNA, 25 bp, Rattus norvegicus
aagaacacagctcggatcctcaaga

SEQ ID NO: 32568 - DNA, 25 bp, Rattus norvegicus
aagaacacagctgggatcctcaaga

SEQ ID NO: 32569 - DNA, 25 bp, Rattus norvegicus
aagaacacagtcctcaactgtcctc

SEQ ID NO: 32570 - DNA, 25 bp, Rattus norvegicus
aagaacacagtcgtcaactgtcctc

SEQ ID NO: 32571 - DNA, 25 bp, Rattus norvegicus
aagaacacatccatcacttgggtcc

SEQ ID NO: 32572 - DNA, 25 bp, Rattus norvegicus
aagaacacatccttcacttgggtcc

SEQ ID NO: 32573 - DNA, 25 bp, Rattus norvegicus
aagaacaccaaaccaccatttcagt

SEQ ID NO: 32574 - DNA, 25 bp, Rattus norvegicus
aagaacaccaaagcaccatttcagt

SEQ ID NO: 32575 - DNA, 25 bp, Rattus norvegicus
aagaacacctacagtgtgccgtgca

SEQ ID NO: 32576 - DNA, 25 bp, Rattus norvegicus
aagaacacctactgtgtgccgtgca

SEQ ID NO: 32577 - DNA, 25 bp, Rattus norvegicus
aagaacacgggcagctgcttgcact

SEQ ID NO: 32578 - DNA, 25 bp, Rattus norvegicus
aagaacacgggctgctgcttgcact

SEQ ID NO: 32579 - DNA, 25 bp, Rattus norvegicus
aagaacactgctatcgtggtcccgt

SEQ ID NO: 32580 - DNA, 25 bp, Rattus norvegicus
aagaacactgctttcgtggtcccgt

SEQ ID NO: 32581 - DNA, 25 bp, Rattus norvegicus
aagaacacttaacactggccagcaa

SEQ ID NO: 32582 - DNA, 25 bp, Rattus norvegicus
aagaacacttaagactggccagcaa

SEQ ID NO: 32583 - DNA, 25 bp, Rattus norvegicus
aagaacacttgacgcctgttcgggc

SEQ ID NO: 32584 - DNA, 25 bp, Rattus norvegicus
aagaacacttgaggcctgttcgggc

SEQ ID NO: 32585 - DNA, 25 bp, Rattus norvegicus
aagaacagaggaacccgatcgggat

SEQ ID NO: 32586 - DNA, 25 bp, Rattus norvegicus
aagaacagaggatcccgatcgggat

SEQ ID NO: 32587 - DNA, 25 bp, Rattus norvegicus
aagaacagatatcgcctcttgcttc

SEQ ID NO: 32588 - DNA, 25 bp, Rattus norvegicus
aagaacagatatggcctcttgcttc

SEQ ID NO: 32589 - DNA, 25 bp, Rattus norvegicus
aagaacagcagccaaccgccaggaa

SEQ ID NO: 32590 - DNA, 25 bp, Rattus norvegicus
aagaacagcagcgaaccgccaggaa

SEQ ID NO: 32591 - DNA, 25 bp, Rattus norvegicus
aagaacagctctctgacacctgaga

SEQ ID NO: 32592 - DNA, 25 bp, Rattus norvegicus
aagaacagctctgtgacacctgaga

SEQ ID NO: 32593 - DNA, 25 bp, Rattus norvegicus
aagaacagcttcctggatcacgaat

SEQ ID NO: 32594 - DNA, 25 bp, Rattus norvegicus
aagaacagcttcgtggatcacgaat

SEQ ID NO: 32595 - DNA, 25 bp, Rattus norvegicus
aagaacaggaccagaggacgggctc

SEQ ID NO: 32596 - DNA, 25 bp, Rattus norvegicus
aagaacaggacctgaggacgggctc

SEQ ID NO: 32597 - DNA, 25 bp, Rattus norvegicus
aagaacaggcacaaaccctcttatc

SEQ ID NO: 32598 - DNA, 25 bp, Rattus norvegicus
aagaacaggcactaaccctcttatc

SEQ ID NO: 32599 - DNA, 25 bp, Rattus norvegicus
aagaacaggccactgcagggttgtc

SEQ ID NO: 32600 - DNA, 25 bp, Rattus norvegicus
aagaacaggccagtgcagggttgtc

SEQ ID NO: 32601 - DNA, 25 bp, Rattus norvegicus
aagaacaggttccttcacaggctga

SEQ ID NO: 32602 - DNA, 25 bp, Rattus norvegicus
aagaacaggttcgttcacaggctga

SEQ ID NO: 32603 - DNA, 25 bp, Rattus norvegicus
aagaacagttcaattgggccaaagg

SEQ ID NO: 32604 - DNA, 25 bp, Rattus norvegicus
aagaacagttcatttgggccaaagg

SEQ ID NO: 32605 - DNA, 25 bp, Rattus norvegicus
aagaacagttccacgggtcttcata

SEQ ID NO: 32606 - DNA, 25 bp, Rattus norvegicus
aagaacagttcctcgggtcttcata

SEQ ID NO: 32607 - DNA, 25 bp, Rattus norvegicus
aagaacagtttcctccatctttgag

SEQ ID NO: 32608 - DNA, 25 bp, Rattus norvegicus
aagaacagtttcgtccatctttgag

SEQ ID NO: 32609 - DNA, 25 bp, Rattus norvegicus
aagaacataagcacctacgcgcgac

SEQ ID NO: 32610 - DNA, 25 bp, Rattus norvegicus
aagaacataagctcctacgcgcgac

SEQ ID NO: 32611 - DNA, 25 bp, Rattus norvegicus
aagaacatcacgcactcctgtgtgt

SEQ ID NO: 32612 - DNA, 25 bp, Rattus norvegicus
aagaacatcacggactcctgtgtgt

SEQ ID NO: 32613 - DNA, 25 bp, Rattus norvegicus
aagaacatcagccaggaggccattg

SEQ ID NO: 32614 - DNA, 25 bp, Rattus norvegicus
aagaacatcagcgaggaggccattg

SEQ ID NO: 32615 - DNA, 25 bp, Rattus norvegicus
aagaacatcatcctaacagctttga

SEQ ID NO: 32616 - DNA, 25 bp, Rattus norvegicus
aagaacatcatcgtaacagctttga

SEQ ID NO: 32617 - DNA, 25 bp, Rattus norvegicus
aagaacatcggtcttccccagttag

SEQ ID NO: 32618 - DNA, 25 bp, Rattus norvegicus
aagaacatcggtgttccccagttag

SEQ ID NO: 32619 - DNA, 25 bp, Rattus norvegicus
aagaacatctgtcaacctggtctct

SEQ ID NO: 32620 - DNA, 25 bp, Rattus norvegicus
aagaacatctgtctgaccccagata

SEQ ID NO: 32621 - DNA, 25 bp, Rattus norvegicus
aagaacatctgtgaacctggtctct

SEQ ID NO: 32622 - DNA, 25 bp, Rattus norvegicus
aagaacatctgtgtgaccccagata

SEQ ID NO: 32623 - DNA, 25 bp, Rattus norvegicus
aagaacatgaaaccctgtacagtgg

SEQ ID NO: 32624 - DNA, 25 bp, Rattus norvegicus
aagaacatgaaagcctgtacagtgg

SEQ ID NO: 32625 - DNA, 25 bp, Rattus norvegicus
aagaacatgaccccataccgatcac

SEQ ID NO: 32626 - DNA, 25 bp, Rattus norvegicus
aagaacatgaccgcataccgatcac

SEQ ID NO: 32627 - DNA, 25 bp, Rattus norvegicus
aagaacatgagaaacgcccaccggc

SEQ ID NO: 32628 - DNA, 25 bp, Rattus norvegicus
aagaacatgagatacgcccaccggc

SEQ ID NO: 32629 - DNA, 25 bp, Rattus norvegicus
aagaacatgcggctcagctccttgg

SEQ ID NO: 32630 - DNA, 25 bp, Rattus norvegicus
aagaacatgcgggtcagctccttgg

SEQ ID NO: 32631 - DNA, 25 bp, Rattus norvegicus
aagaacatgctgctgaagctaggta

SEQ ID NO: 32632 - DNA, 25 bp, Rattus norvegicus
aagaacatgctggtgaagctaggta

SEQ ID NO: 32633 - DNA, 25 bp, Rattus norvegicus
aagaacatgtgaagctggaccagct

SEQ ID NO: 32634 - DNA, 25 bp, Rattus norvegicus
aagaacatgtgatgctggaccagct

SEQ ID NO: 32635 - DNA, 25 bp, Rattus norvegicus
aagaacattcatatcaacccgagat

SEQ ID NO: 32636 - DNA, 25 bp, Rattus norvegicus
aagaacattcatttcaacccgagat

SEQ ID NO: 32637 - DNA, 25 bp, Rattus norvegicus
aagaacattccgagtgtgacatggg

SEQ ID NO: 32638 - DNA, 25 bp, Rattus norvegicus
aagaacattccgtgtgtgacatggg

SEQ ID NO: 32639 - DNA, 25 bp, Rattus norvegicus
aagaacattgctaaccctactgcca

SEQ ID NO: 32640 - DNA, 25 bp, Rattus norvegicus
aagaacattgctcctccttatttat

SEQ ID NO: 32641 - DNA, 25 bp, Rattus norvegicus
aagaacattgctgctccttatttat

SEQ ID NO: 32642 - DNA, 25 bp, Rattus norvegicus
aagaacattgcttaccctactgcca

SEQ ID NO: 32643 - DNA, 25 bp, Rattus norvegicus
aagaaccaaccacggatgtgtcacc

SEQ ID NO: 32644 - DNA, 25 bp, Rattus norvegicus
aagaaccaaccagggatgtgtcacc

SEQ ID NO: 32645 - DNA, 25 bp, Rattus norvegicus
aagaaccaagatcgagggcagagaa

SEQ ID NO: 32646 - DNA, 25 bp, Rattus norvegicus
aagaaccaagatggagggcagagaa

SEQ ID NO: 32647 - DNA, 25 bp, Rattus norvegicus
aagaaccaatgtatcagctgcctct

SEQ ID NO: 32648 - DNA, 25 bp, Rattus norvegicus
aagaaccaatgtttcagctgcctct

SEQ ID NO: 32649 - DNA, 25 bp, Rattus norvegicus
aagaaccaccagacggttgcggaat

SEQ ID NO: 32650 - DNA, 25 bp, Rattus norvegicus
aagaaccaccagtcggttgcggaat

SEQ ID NO: 32651 - DNA, 25 bp, Rattus norvegicus
aagaaccacccaccagaccagagat

SEQ ID NO: 32652 - DNA, 25 bp, Rattus norvegicus
aagaaccacccagcagaccagagat

SEQ ID NO: 32653 - DNA, 25 bp, Rattus norvegicus
aagaaccacgtaagcaatgcctagg

SEQ ID NO: 32654 - DNA, 25 bp, Rattus norvegicus
aagaaccacgtatgcaatgcctagg

SEQ ID NO: 32655 - DNA, 25 bp, Rattus norvegicus
aagaaccactcacgtcctctggtgt

SEQ ID NO: 32656 - DNA, 25 bp, Rattus norvegicus
aagaaccactcaggtcctctggtgt

SEQ ID NO: 32657 - DNA, 25 bp, Rattus norvegicus
aagaaccacttcactgtggcgcaga

SEQ ID NO: 32658 - DNA, 25 bp, Rattus norvegicus
aagaaccacttctctgtggcgcaga

SEQ ID NO: 32659 - DNA, 25 bp, Rattus norvegicus
aagaaccagacactttgcagactct

SEQ ID NO: 32660 - DNA, 25 bp, Rattus norvegicus
aagaaccagacagtttgcagactct

SEQ ID NO: 32661 - DNA, 25 bp, Rattus norvegicus
aagaaccagcctcagcaggttgtga

SEQ ID NO: 32662 - DNA, 25 bp, Rattus norvegicus
aagaaccagcctgagcaggttgtga

SEQ ID NO: 32663 - DNA, 25 bp, Rattus norvegicus
aagaaccagctgacggccaggaggt

SEQ ID NO: 32664 - DNA, 25 bp, Rattus norvegicus
aagaaccagctgtcggccaggaggt

SEQ ID NO: 32665 - DNA, 25 bp, Rattus norvegicus
aagaaccagtatcgctctcctgcag

SEQ ID NO: 32666 - DNA, 25 bp, Rattus norvegicus
aagaaccagtatggctctcctgcag

SEQ ID NO: 32667 - DNA, 25 bp, Rattus norvegicus
aagaaccatgctatgcagagtgctt

SEQ ID NO: 32668 - DNA, 25 bp, Rattus norvegicus
aagaaccatgctttgcagagtgctt

SEQ ID NO: 32669 - DNA, 25 bp, Rattus norvegicus
aagaaccatggccacgagagaataa

SEQ ID NO: 32670 - DNA, 25 bp, Rattus norvegicus
aagaaccatggcgacgagagaataa

SEQ ID NO: 32671 - DNA, 25 bp, Rattus norvegicus
aagaaccatgggacttttcatttga

SEQ ID NO: 32672 - DNA, 25 bp, Rattus norvegicus
aagaaccatgggtcttttcatttga

SEQ ID NO: 32673 - DNA, 25 bp, Rattus norvegicus
aagaaccatgttccctgtattaatc

SEQ ID NO: 32674 - DNA, 25 bp, Rattus norvegicus
aagaaccatgttgcctgtattaatc

SEQ ID NO: 32675 - DNA, 25 bp, Rattus norvegicus
aagaaccatttcctgttgtgaagta

SEQ ID NO: 32676 - DNA, 25 bp, Rattus norvegicus
aagaaccatttcgtgttgtgaagta

SEQ ID NO: 32677 - DNA, 25 bp, Rattus norvegicus
aagaaccatttgcaagatcaactaa

SEQ ID NO: 32678 - DNA, 25 bp, Rattus norvegicus
aagaaccatttggaagatcaactaa

SEQ ID NO: 32679 - DNA, 25 bp, Rattus norvegicus
aagaacccactgagtccgtctgtta

SEQ ID NO: 32680 - DNA, 25 bp, Rattus norvegicus
aagaacccactgtgtccgtctgtta

SEQ ID NO: 32681 - DNA, 25 bp, Rattus norvegicus
aagaacccagacaatgaggcctcgc

SEQ ID NO: 32682 - DNA, 25 bp, Rattus norvegicus
aagaacccagactatgaggcctcgc

SEQ ID NO: 32683 - DNA, 25 bp, Rattus norvegicus
aagaacccagagatcctgcatctga

SEQ ID NO: 32684 - DNA, 25 bp, Rattus norvegicus
aagaacccagagttcctgcatctga

SEQ ID NO: 32685 - DNA, 25 bp, Rattus norvegicus
aagaacccagtgaccagcaagaatt

SEQ ID NO: 32686 - DNA, 25 bp, Rattus norvegicus
aagaacccagtgtccagcaagaatt

SEQ ID NO: 32687 - DNA, 25 bp, Rattus norvegicus
aagaacccagttctgctatatgcta

SEQ ID NO: 32688 - DNA, 25 bp, Rattus norvegicus
aagaacccagttgtgctatatgcta

SEQ ID NO: 32689 - DNA, 25 bp, Rattus norvegicus
aagaacccataaactggagctcaga

SEQ ID NO: 32690 - DNA, 25 bp, Rattus norvegicus
aagaacccataatctggagctcaga

SEQ ID NO: 32691 - DNA, 25 bp, Rattus norvegicus
aagaacccatggcttgtgatccatc

SEQ ID NO: 32692 - DNA, 25 bp, Rattus norvegicus
aagaacccatgggttgtgatccatc

SEQ ID NO: 32693 - DNA, 25 bp, Rattus norvegicus
aagaaccccaacactggtcacattt

SEQ ID NO: 32694 - DNA, 25 bp, Rattus norvegicus
aagaaccccaactctggtcacattt

SEQ ID NO: 32695 - DNA, 25 bp, Rattus norvegicus
aagaaccccaccaccagagaagttg

SEQ ID NO: 32696 - DNA, 25 bp, Rattus norvegicus
aagaaccccacctccagagaagttg

SEQ ID NO: 32697 - DNA, 25 bp, Rattus norvegicus
aagaacccctcaaagcctttgctcg

SEQ ID NO: 32698 - DNA, 25 bp, Rattus norvegicus
aagaacccctcatagcctttgctcg

SEQ ID NO: 32699 - DNA, 25 bp, Rattus norvegicus
aagaaccccttcatttcagtcctga

SEQ ID NO: 32700 - DNA, 25 bp, Rattus norvegicus
aagaaccccttcttttcagtcctga

SEQ ID NO: 32701 - DNA, 25 bp, Rattus norvegicus
aagaaccctaacaacagtgctgctg

SEQ ID NO: 32702 - DNA, 25 bp, Rattus norvegicus
aagaaccctaactacagtgctgctg

SEQ ID NO: 32703 - DNA, 25 bp, Rattus norvegicus
aagaaccctacgacagtatctcaac

SEQ ID NO: 32704 - DNA, 25 bp, Rattus norvegicus
aagaaccctacgtcagtatctcaac

SEQ ID NO: 32705 - DNA, 25 bp, Rattus norvegicus
aagaaccctcgccattcacagtggg

SEQ ID NO: 32706 - DNA, 25 bp, Rattus norvegicus
aagaaccctcgcgattcacagtggg

SEQ ID NO: 32707 - DNA, 25 bp, Rattus norvegicus
aagaaccctgagcttgtaggagcaa

SEQ ID NO: 32708 - DNA, 25 bp, Rattus norvegicus
aagaaccctgaggttgtaggagcaa

SEQ ID NO: 32709 - DNA, 25 bp, Rattus norvegicus
aagaaccctgccctgaaagctcaga

SEQ ID NO: 32710 - DNA, 25 bp, Rattus norvegicus
aagaaccctgccgtgaaagctcaga

SEQ ID NO: 32711 - DNA, 25 bp, Rattus norvegicus
aagaacccttttatgcgcaactgtg

SEQ ID NO: 32712 - DNA, 25 bp, Rattus norvegicus
aagaacccttttttgcgcaactgtg

SEQ ID NO: 32713 - DNA, 25 bp, Rattus norvegicus
aagaaccgaccaccgaggcaggtgt

SEQ ID NO: 32714 - DNA, 25 bp, Rattus norvegicus
aagaaccgaccagcgaggcaggtgt

SEQ ID NO: 32715 - DNA, 25 bp, Rattus norvegicus
aagaaccgatcaatattgtccctcc

SEQ ID NO: 32716 - DNA, 25 bp, Rattus norvegicus
aagaaccgatcattattgtccctcc

SEQ ID NO: 32717 - DNA, 25 bp, Rattus norvegicus
aagaaccggcacaggcccttctgag

SEQ ID NO: 32718 - DNA, 25 bp, Rattus norvegicus
aagaaccggcactggcccttctgag

SEQ ID NO: 32719 - DNA, 25 bp, Rattus norvegicus
aagaaccgtcttaggaatcaccacg

SEQ ID NO: 32720 - DNA, 25 bp, Rattus norvegicus
aagaaccgtctttggaatcaccacg

SEQ ID NO: 32721 - DNA, 25 bp, Rattus norvegicus
aagaaccgttaactgcacagctgcc

SEQ ID NO: 32722 - DNA, 25 bp, Rattus norvegicus
aagaaccgttaagtgcacagctgcc

SEQ ID NO: 32723 - DNA, 25 bp, Rattus norvegicus
aagaacctatataaatgctaagcat

SEQ ID NO: 32724 - DNA, 25 bp, Rattus norvegicus
aagaacctatattaatgctaagcat

SEQ ID NO: 32725 - DNA, 25 bp, Rattus norvegicus
aagaacctcagtcaattctcagaga

SEQ ID NO: 32726 - DNA, 25 bp, Rattus norvegicus
aagaacctcagtgaattctcagaga

SEQ ID NO: 32727 - DNA, 25 bp, Rattus norvegicus
aagaacctccataacagtgtccttc

SEQ ID NO: 32728 - DNA, 25 bp, Rattus norvegicus
aagaacctccattacagtgtccttc

SEQ ID NO: 32729 - DNA, 25 bp, Rattus norvegicus
aagaacctctcactatgtgtttcat

SEQ ID NO: 32730 - DNA, 25 bp, Rattus norvegicus
aagaacctctcagtatgtgtttcat

SEQ ID NO: 32731 - DNA, 25 bp, Rattus norvegicus
aagaacctgataatcctgctgaagt

SEQ ID NO: 32732 - DNA, 25 bp, Rattus norvegicus
aagaacctgatattcctgctgaagt

SEQ ID NO: 32733 - DNA, 25 bp, Rattus norvegicus
aagaacctgcaaattcatcacagaa

SEQ ID NO: 32734 - DNA, 25 bp, Rattus norvegicus
aagaacctgcaatttcatcacagaa

SEQ ID NO: 32735 - DNA, 25 bp, Rattus norvegicus
aagaacctgctgatgcagtacaaca

SEQ ID NO: 32736 - DNA, 25 bp, Rattus norvegicus
aagaacctgctgttgcagtacaaca

SEQ ID NO: 32737 - DNA, 25 bp, Rattus norvegicus
aagaacctgtaacgcataggcctcc

SEQ ID NO: 32738 - DNA, 25 bp, Rattus norvegicus
aagaacctgtaaggcataggcctcc

SEQ ID NO: 32739 - DNA, 25 bp, Rattus norvegicus
aagaaccttgatctgggagctggac

SEQ ID NO: 32740 - DNA, 25 bp, Rattus norvegicus
aagaaccttgatgtgggagctggac

SEQ ID NO: 32741 - DNA, 25 bp, Rattus norvegicus
aagaacgacttaatcacagaacgga

SEQ ID NO: 32742 - DNA, 25 bp, Rattus norvegicus
aagaacgacttattcacagaacgga

SEQ ID NO: 32743 - DNA, 25 bp, Rattus norvegicus
aagaacgcagccatcactgggacag

SEQ ID NO: 32744 - DNA, 25 bp, Rattus norvegicus
aagaacgcagccttcactgggacag

SEQ ID NO: 32745 - DNA, 25 bp, Rattus norvegicus
aagaacgccctcaagaacatgatgg

SEQ ID NO: 32746 - DNA, 25 bp, Rattus norvegicus
aagaacgccctctagaacatgatgg

SEQ ID NO: 32747 - DNA, 25 bp, Rattus norvegicus
aagaacgcctctcatatgattgata

SEQ ID NO: 32748 - DNA, 25 bp, Rattus norvegicus
aagaacgcctctgatatgattgata

SEQ ID NO: 32749 - DNA, 25 bp, Rattus norvegicus
aagaacgctcccaatcctataaagg

SEQ ID NO: 32750 - DNA, 25 bp, Rattus norvegicus
aagaacgctccctatcctataaagg

SEQ ID NO: 32751 - DNA, 25 bp, Rattus norvegicus
aagaacgctgccatagcacccctat

SEQ ID NO: 32752 - DNA, 25 bp, Rattus norvegicus
aagaacgctgccttagcacccctat

SEQ ID NO: 32753 - DNA, 25 bp, Rattus norvegicus
aagaacggaagtcccatcctcaaca

SEQ ID NO: 32754 - DNA, 25 bp, Rattus norvegicus
aagaacggaagtgccatcctcaaca

SEQ ID NO: 32755 - DNA, 25 bp, Rattus norvegicus
aagaacggcctcatatgtgccttcg

SEQ ID NO: 32756 - DNA, 25 bp, Rattus norvegicus
aagaacggcctcttatgtgccttcg

SEQ ID NO: 32757 - DNA, 25 bp, Rattus norvegicus
aagaacggctccactttggtggaat

SEQ ID NO: 32758 - DNA, 25 bp, Rattus norvegicus
aagaacggctcctctttggtggaat

SEQ ID NO: 32759 - DNA, 25 bp, Rattus norvegicus
aagaacgggccaagcttgcaaaaga

SEQ ID NO: 32760 - DNA, 25 bp, Rattus norvegicus
aagaacgggccatgcttgcaaaaga

SEQ ID NO: 32761 - DNA, 25 bp, Rattus norvegicus
aagaacgggcccatggaagtagctg

SEQ ID NO: 32762 - DNA, 25 bp, Rattus norvegicus
aagaacgggcccttggaagtagctg

SEQ ID NO: 32763 - DNA, 25 bp, Rattus norvegicus
aagaacgggtgtccttgtttctgtc

SEQ ID NO: 32764 - DNA, 25 bp, Rattus norvegicus
aagaacgggtgtgcttgtttctgtc

SEQ ID NO: 32765 - DNA, 25 bp, Rattus norvegicus
aagaacggtcacatgtggtgcgaag

SEQ ID NO: 32766 - DNA, 25 bp, Rattus norvegicus
aagaacggtcacttgtggtgcgaag

SEQ ID NO: 32767 - DNA, 25 bp, Rattus norvegicus
aagaacggtcgcaaacgtactgcct

SEQ ID NO: 32768 - DNA, 25 bp, Rattus norvegicus
aagaacggtcgctaacgtactgcct

SEQ ID NO: 32769 - DNA, 25 bp, Rattus norvegicus
aagaacggtgctcatccactggacc

SEQ ID NO: 32770 - DNA, 25 bp, Rattus norvegicus
aagaacggtgctgatccactggacc

SEQ ID NO: 32771 - DNA, 25 bp, Rattus norvegicus
aagaacgtcaatccgggtggccaca

SEQ ID NO: 32772 - DNA, 25 bp, Rattus norvegicus
aagaacgtcaatgcgggtggccaca

SEQ ID NO: 32773 - DNA, 25 bp, Rattus norvegicus
aagaacgtcataactgcctaggcag

SEQ ID NO: 32774 - DNA, 25 bp, Rattus norvegicus
aagaacgtcatatctgcctaggcag

SEQ ID NO: 32775 - DNA, 25 bp, Rattus norvegicus
aagaacgtccagagccagggtggcc

SEQ ID NO: 32776 - DNA, 25 bp, Rattus norvegicus
aagaacgtccagtgccagggtggcc

SEQ ID NO: 32777 - DNA, 25 bp, Rattus norvegicus
aagaacgtccatacctttgattatg

SEQ ID NO: 32778 - DNA, 25 bp, Rattus norvegicus
aagaacgtccattcctttgattatg

SEQ ID NO: 32779 - DNA, 25 bp, Rattus norvegicus
aagaacgtgattcgcggctaggact

SEQ ID NO: 32780 - DNA, 25 bp, Rattus norvegicus
aagaacgtgattggcggctaggact

SEQ ID NO: 32781 - DNA, 25 bp, Rattus norvegicus
aagaacgtgctgacacatgtaggta

SEQ ID NO: 32782 - DNA, 25 bp, Rattus norvegicus
aagaacgtgctgtcacatgtaggta

SEQ ID NO: 32783 - DNA, 25 bp, Rattus norvegicus
aagaacgtggatcgactcacattcc

SEQ ID NO: 32784 - DNA, 25 bp, Rattus norvegicus
aagaacgtggatggactcacattcc

SEQ ID NO: 32785 - DNA, 25 bp, Rattus norvegicus
aagaactaagatcgagacgggcaga

SEQ ID NO: 32786 - DNA, 25 bp, Rattus norvegicus
aagaactaagatggagacgggcaga

SEQ ID NO: 32787 - DNA, 25 bp, Rattus norvegicus
aagaactaataaatggtgcaggcca

SEQ ID NO: 32788 - DNA, 25 bp, Rattus norvegicus
aagaactaataattggtgcaggcca

SEQ ID NO: 32789 - DNA, 25 bp, Rattus norvegicus
aagaactaatggagctacctccctt

SEQ ID NO: 32790 - DNA, 25 bp, Rattus norvegicus
aagaactaatggtgctacctccctt

SEQ ID NO: 32791 - DNA, 25 bp, Rattus norvegicus
aagaactacagcatcaaactcccag

SEQ ID NO: 32792 - DNA, 25 bp, Rattus norvegicus
aagaactacagcttcaaactcccag

SEQ ID NO: 32793 - DNA, 25 bp, Rattus norvegicus
aagaactagaccctgcatgtgcacg

SEQ ID NO: 32794 - DNA, 25 bp, Rattus norvegicus
aagaactagaccgtgcatgtgcacg

SEQ ID NO: 32795 - DNA, 25 bp, Rattus norvegicus
aagaactagatcatccacagctccc

SEQ ID NO: 32796 - DNA, 25 bp, Rattus norvegicus
aagaactagatcttccacagctccc

SEQ ID NO: 32797 - DNA, 25 bp, Rattus norvegicus
aagaactagcgcctgagctcttccc

SEQ ID NO: 32798 - DNA, 25 bp, Rattus norvegicus
aagaactagcgcgtgagctcttccc

SEQ ID NO: 32799 - DNA, 25 bp, Rattus norvegicus
aagaactagctgatggcctgttgcc

SEQ ID NO: 32800 - DNA, 25 bp, Rattus norvegicus
aagaactagctgttggcctgttgcc

SEQ ID NO: 32801 - DNA, 25 bp, Rattus norvegicus
aagaactatgctatgatgtgctagc

SEQ ID NO: 32802 - DNA, 25 bp, Rattus norvegicus
aagaactatgctttgatgtgctagc

SEQ ID NO: 32803 - DNA, 25 bp, Rattus norvegicus
aagaactcaaccagacgtcggcaag

SEQ ID NO: 32804 - DNA, 25 bp, Rattus norvegicus
aagaactcaacctgacgtcggcaag

SEQ ID NO: 32805 - DNA, 25 bp, Rattus norvegicus
aagaactcagttacatctgggcaat

SEQ ID NO: 32806 - DNA, 25 bp, Rattus norvegicus
aagaactcagtttcatctgggcaat

SEQ ID NO: 32807 - DNA, 25 bp, Rattus norvegicus
aagaactcatcccaaaggcttcccg

SEQ ID NO: 32808 - DNA, 25 bp, Rattus norvegicus
aagaactcatccgaaaggcttcccg

SEQ ID NO: 32809 - DNA, 25 bp, Rattus norvegicus
aagaactccagcatcgcggatctca

SEQ ID NO: 32810 - DNA, 25 bp, Rattus norvegicus
aagaactccagcctgcacagaaaga

SEQ ID NO: 32811 - DNA, 25 bp, Rattus norvegicus
aagaactccagcgtgcacagaaaga

SEQ ID NO: 32812 - DNA, 25 bp, Rattus norvegicus
aagaactccagcttcgcggatctca

SEQ ID NO: 32813 - DNA, 25 bp, Rattus norvegicus
aagaactcgtaacgccaaaatcaca

SEQ ID NO: 32814 - DNA, 25 bp, Rattus norvegicus
aagaactcgtaaggccaaaatcaca

SEQ ID NO: 32815 - DNA, 25 bp, Rattus norvegicus
aagaactctaatctctgtacttagt

SEQ ID NO: 32816 - DNA, 25 bp, Rattus norvegicus
aagaactctaatgtctgtacttagt

SEQ ID NO: 32817 - DNA, 25 bp, Rattus norvegicus
aagaactctattcagctgggaacct

SEQ ID NO: 32818 - DNA, 25 bp, Rattus norvegicus
aagaactctattgagctgggaacct

SEQ ID NO: 32819 - DNA, 25 bp, Rattus norvegicus
aagaactctctcatactggcgcgat

SEQ ID NO: 32820 - DNA, 25 bp, Rattus norvegicus
aagaactctctcttactggcgcgat

SEQ ID NO: 32821 - DNA, 25 bp, Rattus norvegicus
aagaactctgatcccctgagtgcgg

SEQ ID NO: 32822 - DNA, 25 bp, Rattus norvegicus
aagaactctgatgccctgagtgcgg

SEQ ID NO: 32823 - DNA, 25 bp, Rattus norvegicus
aagaactctgtgatcgtagggcgac

SEQ ID NO: 32824 - DNA, 25 bp, Rattus norvegicus
aagaactctgtgttcgtagggcgac

SEQ ID NO: 32825 - DNA, 25 bp, Rattus norvegicus
aagaactcttttcactgttccattg

SEQ ID NO: 32826 - DNA, 25 bp, Rattus norvegicus
aagaactcttttgactgttccattg

SEQ ID NO: 32827 - DNA, 25 bp, Rattus norvegicus
aagaactgacttatgattttaccta

SEQ ID NO: 32828 - DNA, 25 bp, Rattus norvegicus
aagaactgacttatggtattgtata

SEQ ID NO: 32829 - DNA, 25 bp, Rattus norvegicus
aagaactgacttttgattttaccta

SEQ ID NO: 32830 - DNA, 25 bp, Rattus norvegicus
aagaactgacttttggtattgtata

SEQ ID NO: 32831 - DNA, 25 bp, Rattus norvegicus
aagaactgagacctgggcctggcac

SEQ ID NO: 32832 - DNA, 25 bp, Rattus norvegicus
aagaactgagacgtgggcctggcac

SEQ ID NO: 32833 - DNA, 25 bp, Rattus norvegicus
aagaactgagcccagtcctccgggt

SEQ ID NO: 32834 - DNA, 25 bp, Rattus norvegicus
aagaactgagccgagtcctccgggt

SEQ ID NO: 32835 - DNA, 25 bp, Rattus norvegicus
aagaactgaggccttttctcactct

SEQ ID NO: 32836 - DNA, 25 bp, Rattus norvegicus
aagaactgaggcgttttctcactct

SEQ ID NO: 32837 - DNA, 25 bp, Rattus norvegicus
aagaactgattgcacggacggccta

SEQ ID NO: 32838 - DNA, 25 bp, Rattus norvegicus
aagaactgattggacggacggccta

SEQ ID NO: 32839 - DNA, 25 bp, Rattus norvegicus
aagaactgccacaagggagacctct

SEQ ID NO: 32840 - DNA, 25 bp, Rattus norvegicus
aagaactgccactagggagacctct

SEQ ID NO: 32841 - DNA, 25 bp, Rattus norvegicus
aagaactgccctaattgccatggag

SEQ ID NO: 32842 - DNA, 25 bp, Rattus norvegicus
aagaactgcccttattgccatggag

SEQ ID NO: 32843 - DNA, 25 bp, Rattus norvegicus
aagaactgcgtgagcaagccgggta

SEQ ID NO: 32844 - DNA, 25 bp, Rattus norvegicus
aagaactgcgtgtgcaagccgggta

SEQ ID NO: 32845 - DNA, 25 bp, Rattus norvegicus
aagaactgctccagctgccccagtg

SEQ ID NO: 32846 - DNA, 25 bp, Rattus norvegicus
aagaactgctcctgctgccccagtg

SEQ ID NO: 32847 - DNA, 25 bp, Rattus norvegicus
aagaactgggacaccgagagcctca

SEQ ID NO: 32848 - DNA, 25 bp, Rattus norvegicus
aagaactgggactccgagagcctca

SEQ ID NO: 32849 - DNA, 25 bp, Rattus norvegicus
aagaactgggttcaatcctactggg

SEQ ID NO: 32850 - DNA, 25 bp, Rattus norvegicus
aagaactgggttgaatcctactggg

SEQ ID NO: 32851 - DNA, 25 bp, Rattus norvegicus
aagaactggtttctgggcctcaaga

SEQ ID NO: 32852 - DNA, 25 bp, Rattus norvegicus
aagaactggtttgtgggcctcaaga

SEQ ID NO: 32853 - DNA, 25 bp, Rattus norvegicus
aagaactgtagccaacatacttcag

SEQ ID NO: 32854 - DNA, 25 bp, Rattus norvegicus
aagaactgtagccttgtggccaaga

SEQ ID NO: 32855 - DNA, 25 bp, Rattus norvegicus
aagaactgtagcgaacatacttcag

SEQ ID NO: 32856 - DNA, 25 bp, Rattus norvegicus
aagaactgtagcgttgtggccaaga

SEQ ID NO: 32857 - DNA, 25 bp, Rattus norvegicus
aagaactgtataccccagacctcag

SEQ ID NO: 32858 - DNA, 25 bp, Rattus norvegicus
aagaactgtatagcccagacctcag

SEQ ID NO: 32859 - DNA, 25 bp, Rattus norvegicus
aagaactgtcagacctttgggccaa

SEQ ID NO: 32860 - DNA, 25 bp, Rattus norvegicus
aagaactgtcagtcctttgggccaa

SEQ ID NO: 32861 - DNA, 25 bp, Rattus norvegicus
aagaactgttgtactggccgaggct

SEQ ID NO: 32862 - DNA, 25 bp, Rattus norvegicus
aagaactgttgttctggccgaggct

SEQ ID NO: 32863 - DNA, 25 bp, Rattus norvegicus
aagaacttaaagcagccatccaggg

SEQ ID NO: 32864 - DNA, 25 bp, Rattus norvegicus
aagaacttaaaggagccatccaggg

SEQ ID NO: 32865 - DNA, 25 bp, Rattus norvegicus
aagaacttaagtcttgggctggaga

SEQ ID NO: 32866 - DNA, 25 bp, Rattus norvegicus
aagaacttaagtgttgggctggaga

SEQ ID NO: 32867 - DNA, 25 bp, Rattus norvegicus
aagaacttacctctaacccagcctg

SEQ ID NO: 32868 - DNA, 25 bp, Rattus norvegicus
aagaacttacctgtaacccagcctg

SEQ ID NO: 32869 - DNA, 25 bp, Rattus norvegicus
aagaacttacgactctggctctgaa

SEQ ID NO: 32870 - DNA, 25 bp, Rattus norvegicus
aagaacttacgagtctggctctgaa

SEQ ID NO: 32871 - DNA, 25 bp, Rattus norvegicus
aagaacttattgattcctctcctct

SEQ ID NO: 32872 - DNA, 25 bp, Rattus norvegicus
aagaacttattgcatctgtgccaga

SEQ ID NO: 32873 - DNA, 25 bp, Rattus norvegicus
aagaacttattggatctgtgccaga

SEQ ID NO: 32874 - DNA, 25 bp, Rattus norvegicus
aagaacttattgtttcctctcctct

SEQ ID NO: 32875 - DNA, 25 bp, Rattus norvegicus
aagaacttcagtaaatggcctgggc

SEQ ID NO: 32876 - DNA, 25 bp, Rattus norvegicus
aagaacttcagttaatggcctgggc

SEQ ID NO: 32877 - DNA, 25 bp, Rattus norvegicus
aagaacttccggctttccatctgcg

SEQ ID NO: 32878 - DNA, 25 bp, Rattus norvegicus
aagaacttccgggtttccatctgcg

SEQ ID NO: 32879 - DNA, 25 bp, Rattus norvegicus
aagaacttcctaaacttgggtgcca

SEQ ID NO: 32880 - DNA, 25 bp, Rattus norvegicus
aagaacttcctatacttgggtgcca

SEQ ID NO: 32881 - DNA, 25 bp, Rattus norvegicus
aagaacttctggacaagctgctaga

SEQ ID NO: 32882 - DNA, 25 bp, Rattus norvegicus
aagaacttctggtcaagctgctaga

SEQ ID NO: 32883 - DNA, 25 bp, Rattus norvegicus
aagaacttcttcactgacgtctacg

SEQ ID NO: 32884 - DNA, 25 bp, Rattus norvegicus
aagaacttcttctctgacgtctacg

SEQ ID NO: 32885 - DNA, 25 bp, Rattus norvegicus
aagaacttgacaaccgcgactggct

SEQ ID NO: 32886 - DNA, 25 bp, Rattus norvegicus
aagaacttgacatccgcgactggct

SEQ ID NO: 32887 - DNA, 25 bp, Rattus norvegicus
aagaacttgccccttatgactgtgt

SEQ ID NO: 32888 - DNA, 25 bp, Rattus norvegicus
aagaacttgcccgttatgactgtgt

SEQ ID NO: 32889 - DNA, 25 bp, Rattus norvegicus
aagaacttgctcaactggcgagaat

SEQ ID NO: 32890 - DNA, 25 bp, Rattus norvegicus
aagaacttgctctactggcgagaat

SEQ ID NO: 32891 - DNA, 25 bp, Rattus norvegicus
aagaacttggcactcatgatctggg

SEQ ID NO: 32892 - DNA, 25 bp, Rattus norvegicus
aagaacttggcagtcatgatctggg

SEQ ID NO: 32893 - DNA, 25 bp, Rattus norvegicus
aagaacttgggccatcggacacctc

SEQ ID NO: 32894 - DNA, 25 bp, Rattus norvegicus
aagaacttgggcgatcggacacctc

SEQ ID NO: 32895 - DNA, 25 bp, Rattus norvegicus
aagaacttggtaccatgacttcagt

SEQ ID NO: 32896 - DNA, 25 bp, Rattus norvegicus
aagaacttggtagcatgacttcagt

SEQ ID NO: 32897 - DNA, 25 bp, Rattus norvegicus
aagaacttgtccaggatgcctccat

SEQ ID NO: 32898 - DNA, 25 bp, Rattus norvegicus
aagaacttgtcctggatgcctccat

SEQ ID NO: 32899 - DNA, 25 bp, Rattus norvegicus
aagaactttaacactgcccaggaga

SEQ ID NO: 32900 - DNA, 25 bp, Rattus norvegicus
aagaactttaactctgcccaggaga

SEQ ID NO: 32901 - DNA, 25 bp, Rattus norvegicus
aagaactttctcctttgattgcagt

SEQ ID NO: 32902 - DNA, 25 bp, Rattus norvegicus
aagaactttctcgtttgattgcagt

SEQ ID NO: 32903 - DNA, 25 bp, Rattus norvegicus
aagaagaaagatccaatcgattcct

SEQ ID NO: 32904 - DNA, 25 bp, Rattus norvegicus
aagaagaaagatgcaatcgattcct

SEQ ID NO: 32905 - DNA, 25 bp, Rattus norvegicus
aagaagaaatggaggcctcggcctt

SEQ ID NO: 32906 - DNA, 25 bp, Rattus norvegicus
aagaagaaatggctgcacccctgca

SEQ ID NO: 32907 - DNA, 25 bp, Rattus norvegicus
aagaagaaatgggtgcacccctgca

SEQ ID NO: 32908 - DNA, 25 bp, Rattus norvegicus
aagaagaaatggtggcctcggcctt

SEQ ID NO: 32909 - DNA, 25 bp, Rattus norvegicus
aagaagaacacgctgaaccccacat

SEQ ID NO: 32910 - DNA, 25 bp, Rattus norvegicus
aagaagaacacggtgaaccccacat

SEQ ID NO: 32911 - DNA, 25 bp, Rattus norvegicus
aagaagaacagcagatgaagctcaa

SEQ ID NO: 32912 - DNA, 25 bp, Rattus norvegicus
aagaagaacagctgatgaagctcaa

SEQ ID NO: 32913 - DNA, 25 bp, Rattus norvegicus
aagaagaaccctactcctcagagga

SEQ ID NO: 32914 - DNA, 25 bp, Rattus norvegicus
aagaagaacccttctcctcagagga

SEQ ID NO: 32915 - DNA, 25 bp, Rattus norvegicus
aagaagaactcgacgcggctcacgt

SEQ ID NO: 32916 - DNA, 25 bp, Rattus norvegicus
aagaagaactcgtcgcggctcacgt

SEQ ID NO: 32917 - DNA, 25 bp, Rattus norvegicus
aagaagaactctattcctcctgtcg

SEQ ID NO: 32918 - DNA, 25 bp, Rattus norvegicus
aagaagaactcttttcctcctgtcg

SEQ ID NO: 32919 - DNA, 25 bp, Rattus norvegicus
aagaagaagatcctccgcttccggt

SEQ ID NO: 32920 - DNA, 25 bp, Rattus norvegicus
aagaagaagatcgtccgcttccggt

SEQ ID NO: 32921 - DNA, 25 bp, Rattus norvegicus
aagaagaagccaccatgtacacggg

SEQ ID NO: 32922 - DNA, 25 bp, Rattus norvegicus
aagaagaagccagcatgtacacggg

SEQ ID NO: 32923 - DNA, 25 bp, Rattus norvegicus
aagaagaagcgcacgagccccatga

SEQ ID NO: 32924 - DNA, 25 bp, Rattus norvegicus
aagaagaagcgctcgagccccatga

SEQ ID NO: 32925 - DNA, 25 bp, Rattus norvegicus
aagaagaatttgactcctcccagat

SEQ ID NO: 32926 - DNA, 25 bp, Rattus norvegicus
aagaagaatttgtctcctcccagat

SEQ ID NO: 32927 - DNA, 25 bp, Rattus norvegicus
aagaagacagcgatgggacctcatt

SEQ ID NO: 32928 - DNA, 25 bp, Rattus norvegicus
aagaagacagcgttgggacctcatt

SEQ ID NO: 32929 - DNA, 25 bp, Rattus norvegicus
aagaagaccacacacaagctgcagt

SEQ ID NO: 32930 - DNA, 25 bp, Rattus norvegicus
aagaagaccacagacaagctgcagt

SEQ ID NO: 32931 - DNA, 25 bp, Rattus norvegicus
aagaagaccagcagacagcctcagt

SEQ ID NO: 32932 - DNA, 25 bp, Rattus norvegicus
aagaagaccagctgacagcctcagt

SEQ ID NO: 32933 - DNA, 25 bp, Rattus norvegicus
aagaagacgaccaccaacgatcgct

SEQ ID NO: 32934 - DNA, 25 bp, Rattus norvegicus
aagaagacgacctccaacgatcgct

SEQ ID NO: 32935 - DNA, 25 bp, Rattus norvegicus
aagaagacggtcagcatccctgagc

SEQ ID NO: 32936 - DNA, 25 bp, Rattus norvegicus
aagaagacggtctgcatccctgagc

SEQ ID NO: 32937 - DNA, 25 bp, Rattus norvegicus
aagaagactactcgcctggtgggat

SEQ ID NO: 32938 - DNA, 25 bp, Rattus norvegicus
aagaagactactggcctggtgggat

SEQ ID NO: 32939 - DNA, 25 bp, Rattus norvegicus
aagaagactccaccctttctttgga

SEQ ID NO: 32940 - DNA, 25 bp, Rattus norvegicus
aagaagactccagcctttctttgga

SEQ ID NO: 32941 - DNA, 25 bp, Rattus norvegicus
aagaagactgccaacgagctgctgg

SEQ ID NO: 32942 - DNA, 25 bp, Rattus norvegicus
aagaagactgcctacgagctgctgg

SEQ ID NO: 32943 - DNA, 25 bp, Rattus norvegicus
aagaagacttaaatcccagcgtggt

SEQ ID NO: 32944 - DNA, 25 bp, Rattus norvegicus
aagaagacttaattcccagcgtggt

SEQ ID NO: 32945 - DNA, 25 bp, Rattus norvegicus
aagaagagacccattccctagagca

SEQ ID NO: 32946 - DNA, 25 bp, Rattus norvegicus
aagaagagaccctttccctagagca

SEQ ID NO: 32947 - DNA, 25 bp, Rattus norvegicus
aagaagagagtcacattgtcctggg

SEQ ID NO: 32948 - DNA, 25 bp, Rattus norvegicus
aagaagagagtctcattgtcctggg

SEQ ID NO: 32949 - DNA, 25 bp, Rattus norvegicus
aagaagagcgacacgtgacctgcta

SEQ ID NO: 32950 - DNA, 25 bp, Rattus norvegicus
aagaagagcgactcgtgacctgcta

SEQ ID NO: 32951 - DNA, 25 bp, Rattus norvegicus
aagaagagcgctaaggcagccctgc

SEQ ID NO: 32952 - DNA, 25 bp, Rattus norvegicus
aagaagagcgcttaggcagccctgc

SEQ ID NO: 32953 - DNA, 25 bp, Rattus norvegicus
aagaagagctctcagcgagtcccgt

SEQ ID NO: 32954 - DNA, 25 bp, Rattus norvegicus
aagaagagctctgagcgagtcccgt

SEQ ID NO: 32955 - DNA, 25 bp, Rattus norvegicus
aagaagagcttgaagccccggccta

SEQ ID NO: 32956 - DNA, 25 bp, Rattus norvegicus
aagaagagcttgtagccccggccta

SEQ ID NO: 32957 - DNA, 25 bp, Rattus norvegicus
aagaagagctttcgctgtcccttac

SEQ ID NO: 32958 - DNA, 25 bp, Rattus norvegicus
aagaagagctttggctgtcccttac

SEQ ID NO: 32959 - DNA, 25 bp, Rattus norvegicus
aagaagaggaggagccacacccagc

SEQ ID NO: 32960 - DNA, 25 bp, Rattus norvegicus
aagaagaggaggtgccacacccagc

SEQ ID NO: 32961 - DNA, 25 bp, Rattus norvegicus
aagaagaggctcaacccatctggtt

SEQ ID NO: 32962 - DNA, 25 bp, Rattus norvegicus
aagaagaggctctacccatctggtt

SEQ ID NO: 32963 - DNA, 25 bp, Rattus norvegicus
aagaagaggctgacttgcctgcagc

SEQ ID NO: 32964 - DNA, 25 bp, Rattus norvegicus
aagaagaggctgtcttgcctgcagc

SEQ ID NO: 32965 - DNA, 25 bp, Rattus norvegicus
aagaagaggcttcccatttctccta

SEQ ID NO: 32966 - DNA, 25 bp, Rattus norvegicus
aagaagaggcttgccatttctccta

SEQ ID NO: 32967 - DNA, 25 bp, Rattus norvegicus
aagaagaggtatcccattcagcccc

SEQ ID NO: 32968 - DNA, 25 bp, Rattus norvegicus
aagaagaggtatgccattcagcccc

SEQ ID NO: 32969 - DNA, 25 bp, Rattus norvegicus
aagaagagtaacctcatcccatggg

SEQ ID NO: 32970 - DNA, 25 bp, Rattus norvegicus
aagaagagtaacgtcatcccatggg

SEQ ID NO: 32971 - DNA, 25 bp, Rattus norvegicus
aagaagagtctccagagcaagagga

SEQ ID NO: 32972 - DNA, 25 bp, Rattus norvegicus
aagaagagtctcgagagcaagagga

SEQ ID NO: 32973 - DNA, 25 bp, Rattus norvegicus
aagaagataagcctctgcctccaat

SEQ ID NO: 32974 - DNA, 25 bp, Rattus norvegicus
aagaagataagcgtctgcctccaat

SEQ ID NO: 32975 - DNA, 25 bp, Rattus norvegicus
aagaagatacatctgcagcagctaa

SEQ ID NO: 32976 - DNA, 25 bp, Rattus norvegicus
aagaagatacatgtgcagcagctaa

SEQ ID NO: 32977 - DNA, 25 bp, Rattus norvegicus
aagaagatcaacaccagctaccgtg

SEQ ID NO: 32978 - DNA, 25 bp, Rattus norvegicus
aagaagatcaactccagctaccgtg

SEQ ID NO: 32979 - DNA, 25 bp, Rattus norvegicus
aagaagatcacaccgttcgtgccca

SEQ ID NO: 32980 - DNA, 25 bp, Rattus norvegicus
aagaagatcacagcgttcgtgccca

SEQ ID NO: 32981 - DNA, 25 bp, Rattus norvegicus
aagaagatccacagcactcagcggg

SEQ ID NO: 32982 - DNA, 25 bp, Rattus norvegicus
aagaagatccactgcactcagcggg

SEQ ID NO: 32983 - DNA, 25 bp, Rattus norvegicus
aagaagatctgtcttccacctgatc

SEQ ID NO: 32984 - DNA, 25 bp, Rattus norvegicus
aagaagatctgtcttccttggtcaa

SEQ ID NO: 32985 - DNA, 25 bp, Rattus norvegicus
aagaagatctgtgttccacctgatc

SEQ ID NO: 32986 - DNA, 25 bp, Rattus norvegicus
aagaagatctgtgttccttggtcaa

SEQ ID NO: 32987 - DNA, 25 bp, Rattus norvegicus
aagaagatcttcattggcctcatcc

SEQ ID NO: 32988 - DNA, 25 bp, Rattus norvegicus
aagaagatcttctttggcctcatcc

SEQ ID NO: 32989 - DNA, 25 bp, Rattus norvegicus
aagaagatgaggctcagcaccacag

SEQ ID NO: 32990 - DNA, 25 bp, Rattus norvegicus
aagaagatgagggtcagcaccacag

SEQ ID NO: 32991 - DNA, 25 bp, Rattus norvegicus
aagaagatgattctgtcctccctca

SEQ ID NO: 32992 - DNA, 25 bp, Rattus norvegicus
aagaagatgattgtgtcctccctca

SEQ ID NO: 32993 - DNA, 25 bp, Rattus norvegicus
aagaagatgcctcagtctgtgcccc

SEQ ID NO: 32994 - DNA, 25 bp, Rattus norvegicus
aagaagatgcctgagtctgtgcccc

SEQ ID NO: 32995 - DNA, 25 bp, Rattus norvegicus
aagaagatgcggactaatcctgaag

SEQ ID NO: 32996 - DNA, 25 bp, Rattus norvegicus
aagaagatgcggtctaatcctgaag

SEQ ID NO: 32997 - DNA, 25 bp, Rattus norvegicus
aagaagattctgcagctggagcgcc

SEQ ID NO: 32998 - DNA, 25 bp, Rattus norvegicus
aagaagattctggagctggagcgcc

SEQ ID NO: 32999 - DNA, 25 bp, Rattus norvegicus
aagaagatttcaatggagacgtgga

SEQ ID NO: 33000 - DNA, 25 bp, Rattus norvegicus
aagaagatttcattggagacgtgga

SEQ ID NO: 33001 - DNA, 25 bp, Rattus norvegicus
aagaagcaaaatacctcacccttgt

SEQ ID NO: 33002 - DNA, 25 bp, Rattus norvegicus
aagaagcaaaattcctcacccttgt

SEQ ID NO: 33003 - DNA, 25 bp, Rattus norvegicus
aagaagcaaatgctcctgggagtca

SEQ ID NO: 33004 - DNA, 25 bp, Rattus norvegicus
aagaagcaaatggtcctgggagtca

SEQ ID NO: 33005 - DNA, 25 bp, Rattus norvegicus
aagaagcaactaagcctcctttcgc

SEQ ID NO: 33006 - DNA, 25 bp, Rattus norvegicus
aagaagcaactatgcctcctttcgc

SEQ ID NO: 33007 - DNA, 25 bp, Rattus norvegicus
aagaagcaaggactctgataccaga

SEQ ID NO: 33008 - DNA, 25 bp, Rattus norvegicus
aagaagcaaggagtctgataccaga

SEQ ID NO: 33009 - DNA, 25 bp, Rattus norvegicus
aagaagcaagtcagggtgtggtccc

SEQ ID NO: 33010 - DNA, 25 bp, Rattus norvegicus
aagaagcaagtctgggtgtggtccc

SEQ ID NO: 33011 - DNA, 25 bp, Rattus norvegicus
aagaagcaatggcaaccccagccgt

SEQ ID NO: 33012 - DNA, 25 bp, Rattus norvegicus
aagaagcaatgggaaccccagccgt

SEQ ID NO: 33013 - DNA, 25 bp, Rattus norvegicus
aagaagcacctgcagttcatgaacc

SEQ ID NO: 33014 - DNA, 25 bp, Rattus norvegicus
aagaagcacctggagttcatgaacc

SEQ ID NO: 33015 - DNA, 25 bp, Rattus norvegicus
aagaagcactagacctccggagcac

SEQ ID NO: 33016 - DNA, 25 bp, Rattus norvegicus
aagaagcactagtcctccggagcac

SEQ ID NO: 33017 - DNA, 25 bp, Rattus norvegicus
aagaagcacttcctcccgtggctgg

SEQ ID NO: 33018 - DNA, 25 bp, Rattus norvegicus
aagaagcacttcgtcccgtggctgg

SEQ ID NO: 33019 - DNA, 25 bp, Rattus norvegicus
aagaagcagaggacgcagccgcatc

SEQ ID NO: 33020 - DNA, 25 bp, Rattus norvegicus
aagaagcagaggtcgcagccgcatc

SEQ ID NO: 33021 - DNA, 25 bp, Rattus norvegicus
aagaagcagatgacaccctcatagt

SEQ ID NO: 33022 - DNA, 25 bp, Rattus norvegicus
aagaagcagatgtcaccctcatagt

SEQ ID NO: 33023 - DNA, 25 bp, Rattus norvegicus
aagaagcagcagcacagccatgaag

SEQ ID NO: 33024 - DNA, 25 bp, Rattus norvegicus
aagaagcagcaggacagccatgaag

SEQ ID NO: 33025 - DNA, 25 bp, Rattus norvegicus
aagaagcagctacccgtgtactcac

SEQ ID NO: 33026 - DNA, 25 bp, Rattus norvegicus
aagaagcagctagccgtgtactcac

SEQ ID NO: 33027 - DNA, 25 bp, Rattus norvegicus
aagaagcagctcatgaggctaagga

SEQ ID NO: 33028 - DNA, 25 bp, Rattus norvegicus
aagaagcagctcattaactccttcc

SEQ ID NO: 33029 - DNA, 25 bp, Rattus norvegicus
aagaagcagctcttgaggctaagga

SEQ ID NO: 33030 - DNA, 25 bp, Rattus norvegicus
aagaagcagctctttaactccttcc

SEQ ID NO: 33031 - DNA, 25 bp, Rattus norvegicus
aagaagcaggcacagtcactccccg

SEQ ID NO: 33032 - DNA, 25 bp, Rattus norvegicus
aagaagcaggcagagtcactccccg

SEQ ID NO: 33033 - DNA, 25 bp, Rattus norvegicus
aagaagcatagtcggctcctcagaa

SEQ ID NO: 33034 - DNA, 25 bp, Rattus norvegicus
aagaagcatagtgggctcctcagaa

SEQ ID NO: 33035 - DNA, 25 bp, Rattus norvegicus
aagaagcatcagacaggagcctgtc

SEQ ID NO: 33036 - DNA, 25 bp, Rattus norvegicus
aagaagcatcagcaagtggtccaca

SEQ ID NO: 33037 - DNA, 25 bp, Rattus norvegicus
aagaagcatcaggaagtggtccaca

SEQ ID NO: 33038 - DNA, 25 bp, Rattus norvegicus
aagaagcatcagtcaggagcctgtc

SEQ ID NO: 33039 - DNA, 25 bp, Rattus norvegicus
aagaagcattgccactgtgagccca

SEQ ID NO: 33040 - DNA, 25 bp, Rattus norvegicus
aagaagcattgcgactgtgagccca

SEQ ID NO: 33041 - DNA, 25 bp, Rattus norvegicus
aagaagccacacacaagatgaagat

SEQ ID NO: 33042 - DNA, 25 bp, Rattus norvegicus
aagaagccacactcaagatgaagat

SEQ ID NO: 33043 - DNA, 25 bp, Rattus norvegicus
aagaagccagcactgtcggagcctc

SEQ ID NO: 33044 - DNA, 25 bp, Rattus norvegicus
aagaagccagcagtgtcggagcctc

SEQ ID NO: 33045 - DNA, 25 bp, Rattus norvegicus
aagaagccagccctccaaaactctg

SEQ ID NO: 33046 - DNA, 25 bp, Rattus norvegicus
aagaagccagccgtccaaaactctg

SEQ ID NO: 33047 - DNA, 25 bp, Rattus norvegicus
aagaagccagcgattagttcagcac

SEQ ID NO: 33048 - DNA, 25 bp, Rattus norvegicus
aagaagccagcgtttagttcagcac

SEQ ID NO: 33049 - DNA, 25 bp, Rattus norvegicus
aagaagccaggacagattctcccct

SEQ ID NO: 33050 - DNA, 25 bp, Rattus norvegicus
aagaagccaggagagattctcccct

SEQ ID NO: 33051 - DNA, 25 bp, Rattus norvegicus
aagaagccaggcaaaggtagctact

SEQ ID NO: 33052 - DNA, 25 bp, Rattus norvegicus
aagaagccaggctaaggtagctact

SEQ ID NO: 33053 - DNA, 25 bp, Rattus norvegicus
aagaagccagggagcactgattagt

SEQ ID NO: 33054 - DNA, 25 bp, Rattus norvegicus
aagaagccagggtgcactgattagt

SEQ ID NO: 33055 - DNA, 25 bp, Rattus norvegicus
aagaagccaggtacgtgaagcagct

SEQ ID NO: 33056 - DNA, 25 bp, Rattus norvegicus
aagaagccaggttcgtgaagcagct

SEQ ID NO: 33057 - DNA, 25 bp, Rattus norvegicus
aagaagccatccactattggatccc

SEQ ID NO: 33058 - DNA, 25 bp, Rattus norvegicus
aagaagccatcctctattggatccc

SEQ ID NO: 33059 - DNA, 25 bp, Rattus norvegicus
aagaagccatctctatcgtgtgctg

SEQ ID NO: 33060 - DNA, 25 bp, Rattus norvegicus
aagaagccatctgtatcgtgtgctg

SEQ ID NO: 33061 - DNA, 25 bp, Rattus norvegicus
aagaagcccacactggtggccaaat

SEQ ID NO: 33062 - DNA, 25 bp, Rattus norvegicus
aagaagcccacagtggtggccaaat

SEQ ID NO: 33063 - DNA, 25 bp, Rattus norvegicus
aagaagccccagatgagtaccccat

SEQ ID NO: 33064 - DNA, 25 bp, Rattus norvegicus
aagaagccccagttgagtaccccat

SEQ ID NO: 33065 - DNA, 25 bp, Rattus norvegicus
aagaagcccctgacagcgggtgagc

SEQ ID NO: 33066 - DNA, 25 bp, Rattus norvegicus
aagaagcccctgtcagcgggtgagc

SEQ ID NO: 33067 - DNA, 25 bp, Rattus norvegicus
aagaagcccgatattcactatctca

SEQ ID NO: 33068 - DNA, 25 bp, Rattus norvegicus
aagaagcccgattttcactatctca

SEQ ID NO: 33069 - DNA, 25 bp, Rattus norvegicus
aagaagccctaaagcatcctttctt

SEQ ID NO: 33070 - DNA, 25 bp, Rattus norvegicus
aagaagccctaatgcatcctttctt

SEQ ID NO: 33071 - DNA, 25 bp, Rattus norvegicus
aagaagccgcagagcaagacgttga

SEQ ID NO: 33072 - DNA, 25 bp, Rattus norvegicus
aagaagccgcagtgcaagacgttga

SEQ ID NO: 33073 - DNA, 25 bp, Rattus norvegicus
aagaagccgtacatacatggtccct

SEQ ID NO: 33074 - DNA, 25 bp, Rattus norvegicus
aagaagccgtacttacatggtccct

SEQ ID NO: 33075 - DNA, 25 bp, Rattus norvegicus
aagaagccgtgcagcagaggacgcc

SEQ ID NO: 33076 - DNA, 25 bp, Rattus norvegicus
aagaagccgtgcattgccgccctgt

SEQ ID NO: 33077 - DNA, 25 bp, Rattus norvegicus
aagaagccgtgctgcagaggacgcc

SEQ ID NO: 33078 - DNA, 25 bp, Rattus norvegicus
aagaagccgtgctttgccgccctgt

SEQ ID NO: 33079 - DNA, 25 bp, Rattus norvegicus
aagaagcctagtcaccggccgcagg

SEQ ID NO: 33080 - DNA, 25 bp, Rattus norvegicus
aagaagcctagtgaccggccgcagg

SEQ ID NO: 33081 - DNA, 25 bp, Rattus norvegicus
aagaagcctgcgctgtctagaagaa

SEQ ID NO: 33082 - DNA, 25 bp, Rattus norvegicus
aagaagcctgcggtgtctagaagaa

SEQ ID NO: 33083 - DNA, 25 bp, Rattus norvegicus
aagaagcctggtaggaatcccctca

SEQ ID NO: 33084 - DNA, 25 bp, Rattus norvegicus
aagaagcctggttggaatcccctca

SEQ ID NO: 33085 - DNA, 25 bp, Rattus norvegicus
aagaagcctgtaaccgagttcgcca

SEQ ID NO: 33086 - DNA, 25 bp, Rattus norvegicus
aagaagcctgtatccgagttcgcca

SEQ ID NO: 33087 - DNA, 25 bp, Rattus norvegicus
aagaagcgacgcacccgcctgtgaa

SEQ ID NO: 33088 - DNA, 25 bp, Rattus norvegicus
aagaagcgacgctcccgcctgtgaa

SEQ ID NO: 33089 - DNA, 25 bp, Rattus norvegicus
aagaagcgattaagtgtaactccac

SEQ ID NO: 33090 - DNA, 25 bp, Rattus norvegicus
aagaagcgattatgtgtaactccac

SEQ ID NO: 33091 - DNA, 25 bp, Rattus norvegicus
aagaagcgcatcatccagatccaca

SEQ ID NO: 33092 - DNA, 25 bp, Rattus norvegicus
aagaagcgcatcttccagatccaca

SEQ ID NO: 33093 - DNA, 25 bp, Rattus norvegicus
aagaagcgcgtgatccgcatgctca

SEQ ID NO: 33094 - DNA, 25 bp, Rattus norvegicus
aagaagcgcgtgttccgcatgctca

SEQ ID NO: 33095 - DNA, 25 bp, Rattus norvegicus
aagaagcgctctagcccagggaatg

SEQ ID NO: 33096 - DNA, 25 bp, Rattus norvegicus
aagaagcgctcttgcccagggaatg

SEQ ID NO: 33097 - DNA, 25 bp, Rattus norvegicus
aagaagcgcttcaaccctgtgatta

SEQ ID NO: 33098 - DNA, 25 bp, Rattus norvegicus
aagaagcgcttcatgcggaagccga

SEQ ID NO: 33099 - DNA, 25 bp, Rattus norvegicus
aagaagcgcttctaccctgtgatta

SEQ ID NO: 33100 - DNA, 25 bp, Rattus norvegicus
aagaagcgcttcttgcggaagccga

SEQ ID NO: 33101 - DNA, 25 bp, Rattus norvegicus
aagaagcggctgaggagcccctgat

SEQ ID NO: 33102 - DNA, 25 bp, Rattus norvegicus
aagaagcggctgtggagcccctgat

SEQ ID NO: 33103 - DNA, 25 bp, Rattus norvegicus
aagaagcggtgcagcatgatctcct

SEQ ID NO: 33104 - DNA, 25 bp, Rattus norvegicus
aagaagcggtgcagtgttagcgcct

SEQ ID NO: 33105 - DNA, 25 bp, Rattus norvegicus
aagaagcggtgctgcatgatctcct

SEQ ID NO: 33106 - DNA, 25 bp, Rattus norvegicus
aagaagcggtgctgtgttagcgcct

SEQ ID NO: 33107 - DNA, 25 bp, Rattus norvegicus
aagaagcgtgctccacagcggagca

SEQ ID NO: 33108 - DNA, 25 bp, Rattus norvegicus
aagaagcgtgctgcacagcggagca

SEQ ID NO: 33109 - DNA, 25 bp, Rattus norvegicus
aagaagctaactctcttccaacctc

SEQ ID NO: 33110 - DNA, 25 bp, Rattus norvegicus
aagaagctaactgtcttccaacctc

SEQ ID NO: 33111 - DNA, 25 bp, Rattus norvegicus
aagaagctatacactgggagcccct

SEQ ID NO: 33112 - DNA, 25 bp, Rattus norvegicus
aagaagctatactctgggagcccct

SEQ ID NO: 33113 - DNA, 25 bp, Rattus norvegicus
aagaagctcaaactgtccatcctcc

SEQ ID NO: 33114 - DNA, 25 bp, Rattus norvegicus
aagaagctcaaagtgtccatcctcc

SEQ ID NO: 33115 - DNA, 25 bp, Rattus norvegicus
aagaagctcaggcagtccctatggt

SEQ ID NO: 33116 - DNA, 25 bp, Rattus norvegicus
aagaagctcagggagtccctatggt

SEQ ID NO: 33117 - DNA, 25 bp, Rattus norvegicus
aagaagctctaacgcggacgtctgc

SEQ ID NO: 33118 - DNA, 25 bp, Rattus norvegicus
aagaagctctaaggcggacgtctgc

SEQ ID NO: 33119 - DNA, 25 bp, Rattus norvegicus
aagaagctgagccatcttactagct

SEQ ID NO: 33120 - DNA, 25 bp, Rattus norvegicus
aagaagctgagcgatcttactagct

SEQ ID NO: 33121 - DNA, 25 bp, Rattus norvegicus
aagaagctgcagaggatgtcatccc

SEQ ID NO: 33122 - DNA, 25 bp, Rattus norvegicus
aagaagctgcagtggatgtcatccc

SEQ ID NO: 33123 - DNA, 25 bp, Rattus norvegicus
aagaagctgcatatgaagatctcca

SEQ ID NO: 33124 - DNA, 25 bp, Rattus norvegicus
aagaagctgcatttgaagatctcca

SEQ ID NO: 33125 - DNA, 25 bp, Rattus norvegicus
aagaagctgctgagtcgggacatcc

SEQ ID NO: 33126 - DNA, 25 bp, Rattus norvegicus
aagaagctgctgtgtcgggacatcc

SEQ ID NO: 33127 - DNA, 25 bp, Rattus norvegicus
aagaagctggaacactcgcacgacc

SEQ ID NO: 33128 - DNA, 25 bp, Rattus norvegicus
aagaagctggaagactcgcacgacc

SEQ ID NO: 33129 - DNA, 25 bp, Rattus norvegicus
aagaagctggcgactgagctcagtt

SEQ ID NO: 33130 - DNA, 25 bp, Rattus norvegicus
aagaagctggcgtctgagctcagtt

SEQ ID NO: 33131 - DNA, 25 bp, Rattus norvegicus
aagaagctggctatctatggcctct

SEQ ID NO: 33132 - DNA, 25 bp, Rattus norvegicus
aagaagctggctctgttctacaacg

SEQ ID NO: 33133 - DNA, 25 bp, Rattus norvegicus
aagaagctggctgtgttctacaacg

SEQ ID NO: 33134 - DNA, 25 bp, Rattus norvegicus
aagaagctggctttctatggcctct

SEQ ID NO: 33135 - DNA, 25 bp, Rattus norvegicus
aagaagctgggcattctcatgctcc

SEQ ID NO: 33136 - DNA, 25 bp, Rattus norvegicus
aagaagctgggctttctcatgctcc

SEQ ID NO: 33137 - DNA, 25 bp, Rattus norvegicus
aagaagctggtaagagtgccctcct

SEQ ID NO: 33138 - DNA, 25 bp, Rattus norvegicus
aagaagctggtatgagtgccctcct

SEQ ID NO: 33139 - DNA, 25 bp, Rattus norvegicus
aagaagctggtcagtgtccctttgc

SEQ ID NO: 33140 - DNA, 25 bp, Rattus norvegicus
aagaagctggtctgtgtccctttgc

SEQ ID NO: 33141 - DNA, 25 bp, Rattus norvegicus
aagaagctggtgattgagtcaagtt

SEQ ID NO: 33142 - DNA, 25 bp, Rattus norvegicus
aagaagctggtgtttgagtcaagtt

SEQ ID NO: 33143 - DNA, 25 bp, Rattus norvegicus
aagaagctgtacacggtttgatcat

SEQ ID NO: 33144 - DNA, 25 bp, Rattus norvegicus
aagaagctgtactcggtttgatcat

SEQ ID NO: 33145 - DNA, 25 bp, Rattus norvegicus
aagaagcttcttagagcctcagtca

SEQ ID NO: 33146 - DNA, 25 bp, Rattus norvegicus
aagaagcttctttgagcctcagtca

SEQ ID NO: 33147 - DNA, 25 bp, Rattus norvegicus
aagaagcttgagaagctctccacac

SEQ ID NO: 33148 - DNA, 25 bp, Rattus norvegicus
aagaagcttgagtagctctccacac

SEQ ID NO: 33149 - DNA, 25 bp, Rattus norvegicus
aagaagcttgctccacgagggctga

SEQ ID NO: 33150 - DNA, 25 bp, Rattus norvegicus
aagaagcttgctgcacgagggctga

SEQ ID NO: 33151 - DNA, 25 bp, Rattus norvegicus
aagaagcttgttacttctgcccagt

SEQ ID NO: 33152 - DNA, 25 bp, Rattus norvegicus
aagaagcttgtttcttctgcccagt

SEQ ID NO: 33153 - DNA, 25 bp, Rattus norvegicus
aagaagctttggcactaaggactga

SEQ ID NO: 33154 - DNA, 25 bp, Rattus norvegicus
aagaagctttgggactaaggactga

SEQ ID NO: 33155 - DNA, 25 bp, Rattus norvegicus
aagaaggaaatgcacgctgccccgg

SEQ ID NO: 33156 - DNA, 25 bp, Rattus norvegicus
aagaaggaaatggacgctgccccgg

SEQ ID NO: 33157 - DNA, 25 bp, Rattus norvegicus
aagaaggaacataccaccgctggaa

SEQ ID NO: 33158 - DNA, 25 bp, Rattus norvegicus
aagaaggaacattccaccgctggaa

SEQ ID NO: 33159 - DNA, 25 bp, Rattus norvegicus
aagaaggaactccaggtggctttca

SEQ ID NO: 33160 - DNA, 25 bp, Rattus norvegicus
aagaaggaactcgaggtggctttca

SEQ ID NO: 33161 - DNA, 25 bp, Rattus norvegicus
aagaaggaagcccttgacctgctac

SEQ ID NO: 33162 - DNA, 25 bp, Rattus norvegicus
aagaaggaagccgttgacctgctac

SEQ ID NO: 33163 - DNA, 25 bp, Rattus norvegicus
aagaaggactttacctggcctagct

SEQ ID NO: 33164 - DNA, 25 bp, Rattus norvegicus
aagaaggacttttcctggcctagct

SEQ ID NO: 33165 - DNA, 25 bp, Rattus norvegicus
aagaaggagagccaacttgccccat

SEQ ID NO: 33166 - DNA, 25 bp, Rattus norvegicus
aagaaggagagcgaacttgccccat

SEQ ID NO: 33167 - DNA, 25 bp, Rattus norvegicus
aagaaggagcctccaactaccccgg

SEQ ID NO: 33168 - DNA, 25 bp, Rattus norvegicus
aagaaggagcctgcaactaccccgg

SEQ ID NO: 33169 - DNA, 25 bp, Rattus norvegicus
aagaaggatgaccattgctcggaaa

SEQ ID NO: 33170 - DNA, 25 bp, Rattus norvegicus
aagaaggatgacgattgctcggaaa

SEQ ID NO: 33171 - DNA, 25 bp, Rattus norvegicus
aagaaggatgccacgctgcagaacc

SEQ ID NO: 33172 - DNA, 25 bp, Rattus norvegicus
aagaaggatgcctcgctgcagaacc

SEQ ID NO: 33173 - DNA, 25 bp, Rattus norvegicus
aagaaggcacctactggctttgtcc

SEQ ID NO: 33174 - DNA, 25 bp, Rattus norvegicus
aagaaggcaccttctggctttgtcc

SEQ ID NO: 33175 - DNA, 25 bp, Rattus norvegicus
aagaaggcacttagtctgagacaga

SEQ ID NO: 33176 - DNA, 25 bp, Rattus norvegicus
aagaaggcactttgtctgagacaga

SEQ ID NO: 33177 - DNA, 25 bp, Rattus norvegicus
aagaaggcagcccaatttcccgact

SEQ ID NO: 33178 - DNA, 25 bp, Rattus norvegicus
aagaaggcagccgaatttcccgact

SEQ ID NO: 33179 - DNA, 25 bp, Rattus norvegicus
aagaaggcatctatccttctggttt

SEQ ID NO: 33180 - DNA, 25 bp, Rattus norvegicus
aagaaggcatctttccttctggttt

SEQ ID NO: 33181 - DNA, 25 bp, Rattus norvegicus
aagaaggccaatagcccctctgagg

SEQ ID NO: 33182 - DNA, 25 bp, Rattus norvegicus
aagaaggccaattgcccctctgagg

SEQ ID NO: 33183 - DNA, 25 bp, Rattus norvegicus
aagaaggccaccaccctgtggtgga

SEQ ID NO: 33184 - DNA, 25 bp, Rattus norvegicus
aagaaggccacctccctgtggtgga

SEQ ID NO: 33185 - DNA, 25 bp, Rattus norvegicus
aagaaggcctccaagactgcagaga

SEQ ID NO: 33186 - DNA, 25 bp, Rattus norvegicus
aagaaggcctcctagactgcagaga

SEQ ID NO: 33187 - DNA, 25 bp, Rattus norvegicus
aagaaggcgcgtcatgcgtgcatca

SEQ ID NO: 33188 - DNA, 25 bp, Rattus norvegicus
aagaaggcgcgtgatgcgtgcatca

SEQ ID NO: 33189 - DNA, 25 bp, Rattus norvegicus
aagaaggcggccaaacccagcgtgc

SEQ ID NO: 33190 - DNA, 25 bp, Rattus norvegicus
aagaaggcggcctaacccagcgtgc

SEQ ID NO: 33191 - DNA, 25 bp, Rattus norvegicus
aagaaggctacacggcactgaccaa

SEQ ID NO: 33192 - DNA, 25 bp, Rattus norvegicus
aagaaggctacagggcactgaccaa

SEQ ID NO: 33193 - DNA, 25 bp, Rattus norvegicus
aagaaggctacgagtcctggagcag

SEQ ID NO: 33194 - DNA, 25 bp, Rattus norvegicus
aagaaggctacgctgaacttgctgg

SEQ ID NO: 33195 - DNA, 25 bp, Rattus norvegicus
aagaaggctacggtgaacttgctgg

SEQ ID NO: 33196 - DNA, 25 bp, Rattus norvegicus
aagaaggctacgtgtcctggagcag

SEQ ID NO: 33197 - DNA, 25 bp, Rattus norvegicus
aagaaggctccaccatcgtttgaag

SEQ ID NO: 33198 - DNA, 25 bp, Rattus norvegicus
aagaaggctccagcatcgtttgaag

SEQ ID NO: 33199 - DNA, 25 bp, Rattus norvegicus
aagaaggctgacactaagtgctccc

SEQ ID NO: 33200 - DNA, 25 bp, Rattus norvegicus
aagaaggctgactctaagtgctccc

SEQ ID NO: 33201 - DNA, 25 bp, Rattus norvegicus
aagaaggctgcacacacggctgtcg

SEQ ID NO: 33202 - DNA, 25 bp, Rattus norvegicus
aagaaggctgcaccatcgcactggg

SEQ ID NO: 33203 - DNA, 25 bp, Rattus norvegicus
aagaaggctgcagacacggctgtcg

SEQ ID NO: 33204 - DNA, 25 bp, Rattus norvegicus
aagaaggctgcagcatcgcactggg

SEQ ID NO: 33205 - DNA, 25 bp, Rattus norvegicus
aagaaggctgctactcacagggcac

SEQ ID NO: 33206 - DNA, 25 bp, Rattus norvegicus
aagaaggctgctatgctgacccggc

SEQ ID NO: 33207 - DNA, 25 bp, Rattus norvegicus
aagaaggctgcttctcacagggcac

SEQ ID NO: 33208 - DNA, 25 bp, Rattus norvegicus
aagaaggctgctttgctgacccggc

SEQ ID NO: 33209 - DNA, 25 bp, Rattus norvegicus
aagaaggctggaatccctccgtgtg

SEQ ID NO: 33210 - DNA, 25 bp, Rattus norvegicus
aagaaggctggattccctccgtgtg

SEQ ID NO: 33211 - DNA, 25 bp, Rattus norvegicus
aagaaggctgttctccacagttggg

SEQ ID NO: 33212 - DNA, 25 bp, Rattus norvegicus
aagaaggctgttgtccacagttggg

SEQ ID NO: 33213 - DNA, 25 bp, Rattus norvegicus
aagaaggcttccacgaagggctgga

SEQ ID NO: 33214 - DNA, 25 bp, Rattus norvegicus
aagaaggcttcctcgaagggctgga

SEQ ID NO: 33215 - DNA, 25 bp, Rattus norvegicus
aagaagggaccccaggctgtaccag

SEQ ID NO: 33216 - DNA, 25 bp, Rattus norvegicus
aagaagggacccgaggctgtaccag

SEQ ID NO: 33217 - DNA, 25 bp, Rattus norvegicus
aagaagggcagtagaagcgaccaaa

SEQ ID NO: 33218 - DNA, 25 bp, Rattus norvegicus
aagaagggcagttgaagcgaccaaa

SEQ ID NO: 33219 - DNA, 25 bp, Rattus norvegicus
aagaagggcctcactgtgtgtccca

SEQ ID NO: 33220 - DNA, 25 bp, Rattus norvegicus
aagaagggcctctctgtgtgtccca

SEQ ID NO: 33221 - DNA, 25 bp, Rattus norvegicus
aagaagggcctgatcttcatactca

SEQ ID NO: 33222 - DNA, 25 bp, Rattus norvegicus
aagaagggcctgttcttcatactca

SEQ ID NO: 33223 - DNA, 25 bp, Rattus norvegicus
aagaagggctgcagaatcacagtga

SEQ ID NO: 33224 - DNA, 25 bp, Rattus norvegicus
aagaagggctgctgaatcacagtga

SEQ ID NO: 33225 - DNA, 25 bp, Rattus norvegicus
aagaagggtcctaggcctgcccatg

SEQ ID NO: 33226 - DNA, 25 bp, Rattus norvegicus
aagaagggtcctcgtaggccaacag

SEQ ID NO: 33227 - DNA, 25 bp, Rattus norvegicus
aagaagggtcctggtaggccaacag

SEQ ID NO: 33228 - DNA, 25 bp, Rattus norvegicus
aagaagggtccttggcctgcccatg

SEQ ID NO: 33229 - DNA, 25 bp, Rattus norvegicus
aagaagggtcgcatcttccagcgag

SEQ ID NO: 33230 - DNA, 25 bp, Rattus norvegicus
aagaagggtcgcttcttccagcgag

SEQ ID NO: 33231 - DNA, 25 bp, Rattus norvegicus
aagaagggtgatcgtagctccgtac

SEQ ID NO: 33232 - DNA, 25 bp, Rattus norvegicus
aagaagggtgatggtagctccgtac

SEQ ID NO: 33233 - DNA, 25 bp, Rattus norvegicus
aagaaggtctgcatcgagtctgagc

SEQ ID NO: 33234 - DNA, 25 bp, Rattus norvegicus
aagaaggtctgcttcgagtctgagc

SEQ ID NO: 33235 - DNA, 25 bp, Rattus norvegicus
aagaaggtctggatgttcctgccca

SEQ ID NO: 33236 - DNA, 25 bp, Rattus norvegicus
aagaaggtctggttgttcctgccca

SEQ ID NO: 33237 - DNA, 25 bp, Rattus norvegicus
aagaaggtgattcccctaccattgt

SEQ ID NO: 33238 - DNA, 25 bp, Rattus norvegicus
aagaaggtgattgccctaccattgt

SEQ ID NO: 33239 - DNA, 25 bp, Rattus norvegicus
aagaaggtgcccaacagacttgcct

SEQ ID NO: 33240 - DNA, 25 bp, Rattus norvegicus
aagaaggtgccctacagacttgcct

SEQ ID NO: 33241 - DNA, 25 bp, Rattus norvegicus
aagaaggttatcagcatgggtgcga

SEQ ID NO: 33242 - DNA, 25 bp, Rattus norvegicus
aagaaggttatctgcatgggtgcga

SEQ ID NO: 33243 - DNA, 25 bp, Rattus norvegicus
aagaaggttcttcgacaacttgtct

SEQ ID NO: 33244 - DNA, 25 bp, Rattus norvegicus
aagaaggttcttggacaacttgtct

SEQ ID NO: 33245 - DNA, 25 bp, Rattus norvegicus
aagaaggttgtcaccctgacggaag

SEQ ID NO: 33246 - DNA, 25 bp, Rattus norvegicus
aagaaggttgtctccctgacggaag

SEQ ID NO: 33247 - DNA, 25 bp, Rattus norvegicus
aagaaggttttcagggccatgtcta

SEQ ID NO: 33248 - DNA, 25 bp, Rattus norvegicus
aagaaggttttctgggccatgtcta

SEQ ID NO: 33249 - DNA, 25 bp, Rattus norvegicus
aagaagtaaggtaccagcactgatt

SEQ ID NO: 33250 - DNA, 25 bp, Rattus norvegicus
aagaagtaaggttccagcactgatt

SEQ ID NO: 33251 - DNA, 25 bp, Rattus norvegicus
aagaagtacacacggcatgtgccac

SEQ ID NO: 33252 - DNA, 25 bp, Rattus norvegicus
aagaagtacacagggcatgtgccac

SEQ ID NO: 33253 - DNA, 25 bp, Rattus norvegicus
aagaagtacactcacaccaactggc

SEQ ID NO: 33254 - DNA, 25 bp, Rattus norvegicus
aagaagtacactgacaccaactggc

SEQ ID NO: 33255 - DNA, 25 bp, Rattus norvegicus
aagaagtacatcactgcccacggac

SEQ ID NO: 33256 - DNA, 25 bp, Rattus norvegicus
aagaagtacatctctgcccacggac

SEQ ID NO: 33257 - DNA, 25 bp, Rattus norvegicus
aagaagtaccagctgaacctgccag

SEQ ID NO: 33258 - DNA, 25 bp, Rattus norvegicus
aagaagtaccaggtgaacctgccag

SEQ ID NO: 33259 - DNA, 25 bp, Rattus norvegicus
aagaagtacggccaagtccccatgt

SEQ ID NO: 33260 - DNA, 25 bp, Rattus norvegicus
aagaagtacggcgaagtccccatgt

SEQ ID NO: 33261 - DNA, 25 bp, Rattus norvegicus
aagaagtactaacccgcagtgcacc

SEQ ID NO: 33262 - DNA, 25 bp, Rattus norvegicus
aagaagtactaagccgcagtgcacc

SEQ ID NO: 33263 - DNA, 25 bp, Rattus norvegicus
aagaagtactggctgtcggtctcct

SEQ ID NO: 33264 - DNA, 25 bp, Rattus norvegicus
aagaagtactgggtgtcggtctcct

SEQ ID NO: 33265 - DNA, 25 bp, Rattus norvegicus
aagaagtatgaactactgaggccac

SEQ ID NO: 33266 - DNA, 25 bp, Rattus norvegicus
aagaagtatgaagtactgaggccac

SEQ ID NO: 33267 - DNA, 25 bp, Rattus norvegicus
aagaagtcaggcaggatcccaacca

SEQ ID NO: 33268 - DNA, 25 bp, Rattus norvegicus
aagaagtcaggctggatcccaacca

SEQ ID NO: 33269 - DNA, 25 bp, Rattus norvegicus
aagaagtcagtgctcctgtgttgtc

SEQ ID NO: 33270 - DNA, 25 bp, Rattus norvegicus
aagaagtcagtggtcctgtgttgtc

SEQ ID NO: 33271 - DNA, 25 bp, Rattus norvegicus
aagaagtcattcagcctgggtctgg

SEQ ID NO: 33272 - DNA, 25 bp, Rattus norvegicus
aagaagtcattctgcctgggtctgg

SEQ ID NO: 33273 - DNA, 25 bp, Rattus norvegicus
aagaagtccaagctctgctcagtga

SEQ ID NO: 33274 - DNA, 25 bp, Rattus norvegicus
aagaagtccaaggtctgctcagtga

SEQ ID NO: 33275 - DNA, 25 bp, Rattus norvegicus
aagaagtccggcagctctggttttc

SEQ ID NO: 33276 - DNA, 25 bp, Rattus norvegicus
aagaagtccggctgctctggttttc

SEQ ID NO: 33277 - DNA, 25 bp, Rattus norvegicus
aagaagtcctggatgtgctcagcag

SEQ ID NO: 33278 - DNA, 25 bp, Rattus norvegicus
aagaagtcctggttgtgctcagcag

SEQ ID NO: 33279 - DNA, 25 bp, Rattus norvegicus
aagaagtcgcagctcctgcaagtgt

SEQ ID NO: 33280 - DNA, 25 bp, Rattus norvegicus
aagaagtcgcaggtcctgcaagtgt

SEQ ID NO: 33281 - DNA, 25 bp, Rattus norvegicus
aagaagtcgcctaagccttatgaag

SEQ ID NO: 33282 - DNA, 25 bp, Rattus norvegicus
aagaagtcgccttagccttatgaag

SEQ ID NO: 33283 - DNA, 25 bp, Rattus norvegicus
aagaagtcgggaacgcacacacaca

SEQ ID NO: 33284 - DNA, 25 bp, Rattus norvegicus
aagaagtcgggatcgcacacacaca

SEQ ID NO: 33285 - DNA, 25 bp, Rattus norvegicus
aagaagtctctgagcagcacctgtc

SEQ ID NO: 33286 - DNA, 25 bp, Rattus norvegicus
aagaagtctctgtgcagcacctgtc

SEQ ID NO: 33287 - DNA, 25 bp, Rattus norvegicus
aagaagtctgacatctgtggcagaa

SEQ ID NO: 33288 - DNA, 25 bp, Rattus norvegicus
aagaagtctgaccaagtgtgacagt

SEQ ID NO: 33289 - DNA, 25 bp, Rattus norvegicus
aagaagtctgacgaagtgtgacagt

SEQ ID NO: 33290 - DNA, 25 bp, Rattus norvegicus
aagaagtctgacttctgtggcagaa

SEQ ID NO: 33291 - DNA, 25 bp, Rattus norvegicus
aagaagtctgccaatgtcttcctga

SEQ ID NO: 33292 - DNA, 25 bp, Rattus norvegicus
aagaagtctgccaggtccgggagcc

SEQ ID NO: 33293 - DNA, 25 bp, Rattus norvegicus
aagaagtctgcctatgtcttcctga

SEQ ID NO: 33294 - DNA, 25 bp, Rattus norvegicus
aagaagtctgcctggtccgggagcc

SEQ ID NO: 33295 - DNA, 25 bp, Rattus norvegicus
aagaagtcttctccactctaactgt

SEQ ID NO: 33296 - DNA, 25 bp, Rattus norvegicus
aagaagtcttctctgctgggtagga

SEQ ID NO: 33297 - DNA, 25 bp, Rattus norvegicus
aagaagtcttctgcactctaactgt

SEQ ID NO: 33298 - DNA, 25 bp, Rattus norvegicus
aagaagtcttctgtgctgggtagga

SEQ ID NO: 33299 - DNA, 25 bp, Rattus norvegicus
aagaagtctttcaatagctaggcat

SEQ ID NO: 33300 - DNA, 25 bp, Rattus norvegicus
aagaagtctttctatagctaggcat

SEQ ID NO: 33301 - DNA, 25 bp, Rattus norvegicus
aagaagtgaaatccctctgctcctc

SEQ ID NO: 33302 - DNA, 25 bp, Rattus norvegicus
aagaagtgaaatgcctctgctcctc

SEQ ID NO: 33303 - DNA, 25 bp, Rattus norvegicus
aagaagtgaggacctaggccgccct

SEQ ID NO: 33304 - DNA, 25 bp, Rattus norvegicus
aagaagtgaggagctaggccgccct

SEQ ID NO: 33305 - DNA, 25 bp, Rattus norvegicus
aagaagtgcagtcggctgctcccca

SEQ ID NO: 33306 - DNA, 25 bp, Rattus norvegicus
aagaagtgcagtgggctgctcccca

SEQ ID NO: 33307 - DNA, 25 bp, Rattus norvegicus
aagaagtgcattattctcagatgtg

SEQ ID NO: 33308 - DNA, 25 bp, Rattus norvegicus
aagaagtgcatttttctcagatgtg

SEQ ID NO: 33309 - DNA, 25 bp, Rattus norvegicus
aagaagtgccagatcctgctggctt

SEQ ID NO: 33310 - DNA, 25 bp, Rattus norvegicus
aagaagtgccagttcctgctggctt

SEQ ID NO: 33311 - DNA, 25 bp, Rattus norvegicus
aagaagtgccccatgagaccaggac

SEQ ID NO: 33312 - DNA, 25 bp, Rattus norvegicus
aagaagtgccccttgagaccaggac

SEQ ID NO: 33313 - DNA, 25 bp, Rattus norvegicus
aagaagtgccttcccctgactacag

SEQ ID NO: 33314 - DNA, 25 bp, Rattus norvegicus
aagaagtgccttgccctgactacag

SEQ ID NO: 33315 - DNA, 25 bp, Rattus norvegicus
aagaagtgcttgatgcccttgaact

SEQ ID NO: 33316 - DNA, 25 bp, Rattus norvegicus
aagaagtgcttgttgcccttgaact

SEQ ID NO: 33317 - DNA, 25 bp, Rattus norvegicus
aagaagtggcagaatgcacccagag

SEQ ID NO: 33318 - DNA, 25 bp, Rattus norvegicus
aagaagtggcagtatgcacccagag

SEQ ID NO: 33319 - DNA, 25 bp, Rattus norvegicus
aagaagtggccaagcgcaagctggt

SEQ ID NO: 33320 - DNA, 25 bp, Rattus norvegicus
aagaagtggccatgcgcaagctggt

SEQ ID NO: 33321 - DNA, 25 bp, Rattus norvegicus
aagaagtggcctcgacttcggacta

SEQ ID NO: 33322 - DNA, 25 bp, Rattus norvegicus
aagaagtggcctggacttcggacta

SEQ ID NO: 33323 - DNA, 25 bp, Rattus norvegicus
aagaagtggctgacgagccctgtgc

SEQ ID NO: 33324 - DNA, 25 bp, Rattus norvegicus
aagaagtggctgtcgagccctgtgc

SEQ ID NO: 33325 - DNA, 25 bp, Rattus norvegicus
aagaagtgggacctacgctgtctgc

SEQ ID NO: 33326 - DNA, 25 bp, Rattus norvegicus
aagaagtgggacgtacgctgtctgc

SEQ ID NO: 33327 - DNA, 25 bp, Rattus norvegicus
aagaagtggtacatcagctcgccca

SEQ ID NO: 33328 - DNA, 25 bp, Rattus norvegicus
aagaagtggtacttcagctcgccca

SEQ ID NO: 33329 - DNA, 25 bp, Rattus norvegicus
aagaagtgtccacgcccgtggattg

SEQ ID NO: 33330 - DNA, 25 bp, Rattus norvegicus
aagaagtgtccaggcccgtggattg

SEQ ID NO: 33331 - DNA, 25 bp, Rattus norvegicus
aagaagtgtcccagctgagggtcct

SEQ ID NO: 33332 - DNA, 25 bp, Rattus norvegicus
aagaagtgtccctgctgagggtcct

SEQ ID NO: 33333 - DNA, 25 bp, Rattus norvegicus
aagaagtgtgccatgggctgccaac

SEQ ID NO: 33334 - DNA, 25 bp, Rattus norvegicus
aagaagtgtgccttgggctgccaac

SEQ ID NO: 33335 - DNA, 25 bp, Rattus norvegicus
aagaagttagatcaggtgcgcctga

SEQ ID NO: 33336 - DNA, 25 bp, Rattus norvegicus
aagaagttagatgaggtgcgcctga

SEQ ID NO: 33337 - DNA, 25 bp, Rattus norvegicus
aagaagttagtgagctctctgtaat

SEQ ID NO: 33338 - DNA, 25 bp, Rattus norvegicus
aagaagttagtgtgctctctgtaat

SEQ ID NO: 33339 - DNA, 25 bp, Rattus norvegicus
aagaagttcaacctggagagatgga

SEQ ID NO: 33340 - DNA, 25 bp, Rattus norvegicus
aagaagttcaacgtggagagatgga

SEQ ID NO: 33341 - DNA, 25 bp, Rattus norvegicus
aagaagttcatgcagcgcgaccctg

SEQ ID NO: 33342 - DNA, 25 bp, Rattus norvegicus
aagaagttcatggagcgcgaccctg

SEQ ID NO: 33343 - DNA, 25 bp, Rattus norvegicus
aagaagttccgcatactaccatgtc

SEQ ID NO: 33344 - DNA, 25 bp, Rattus norvegicus
aagaagttccgcttactaccatgtc

SEQ ID NO: 33345 - DNA, 25 bp, Rattus norvegicus
aagaagttccggaagcacctcagcg

SEQ ID NO: 33346 - DNA, 25 bp, Rattus norvegicus
aagaagttccggtagcacctcagcg

SEQ ID NO: 33347 - DNA, 25 bp, Rattus norvegicus
aagaagttcgcccagccacatatgt

SEQ ID NO: 33348 - DNA, 25 bp, Rattus norvegicus
aagaagttcgccgagccacatatgt

SEQ ID NO: 33349 - DNA, 25 bp, Rattus norvegicus
aagaagttcgctacactgcctcgaa

SEQ ID NO: 33350 - DNA, 25 bp, Rattus norvegicus
aagaagttcgcttcactgcctcgaa

SEQ ID NO: 33351 - DNA, 25 bp, Rattus norvegicus
aagaagttcttcactagtccactca

SEQ ID NO: 33352 - DNA, 25 bp, Rattus norvegicus
aagaagttcttcagcgccatccttt

SEQ ID NO: 33353 - DNA, 25 bp, Rattus norvegicus
aagaagttcttctctagtccactca

SEQ ID NO: 33354 - DNA, 25 bp, Rattus norvegicus
aagaagttcttctgcgccatccttt

SEQ ID NO: 33355 - DNA, 25 bp, Rattus norvegicus
aagaagttgcgaactgcctggtgat

SEQ ID NO: 33356 - DNA, 25 bp, Rattus norvegicus
aagaagttgcgatctgcctggtgat

SEQ ID NO: 33357 - DNA, 25 bp, Rattus norvegicus
aagaagttgggcagccagctcctgg

SEQ ID NO: 33358 - DNA, 25 bp, Rattus norvegicus
aagaagttgggctgccagctcctgg

SEQ ID NO: 33359 - DNA, 25 bp, Rattus norvegicus
aagaagtttactccaatgtgaataa

SEQ ID NO: 33360 - DNA, 25 bp, Rattus norvegicus
aagaagtttactgcaatgtgaataa

SEQ ID NO: 33361 - DNA, 25 bp, Rattus norvegicus
aagaagtttccgatggagccgctga

SEQ ID NO: 33362 - DNA, 25 bp, Rattus norvegicus
aagaagtttccgttggagccgctga

SEQ ID NO: 33363 - DNA, 25 bp, Rattus norvegicus
aagaagtttcttccacgttctcctg

SEQ ID NO: 33364 - DNA, 25 bp, Rattus norvegicus
aagaagtttcttccagcatcgccgg

SEQ ID NO: 33365 - DNA, 25 bp, Rattus norvegicus
aagaagtttcttgcacgttctcctg

SEQ ID NO: 33366 - DNA, 25 bp, Rattus norvegicus
aagaagtttcttgcagcatcgccgg

SEQ ID NO: 33367 - DNA, 25 bp, Rattus norvegicus
aagaagtttgacacccaagtgtggg

SEQ ID NO: 33368 - DNA, 25 bp, Rattus norvegicus
aagaagtttgactcccaagtgtggg

SEQ ID NO: 33369 - DNA, 25 bp, Rattus norvegicus
aagaataaaacccttctgctcctca

SEQ ID NO: 33370 - DNA, 25 bp, Rattus norvegicus
aagaataaaaccgttctgctcctca

SEQ ID NO: 33371 - DNA, 25 bp, Rattus norvegicus
aagaataacctcattgctcacgcag

SEQ ID NO: 33372 - DNA, 25 bp, Rattus norvegicus
aagaataacctctttgctcacgcag

SEQ ID NO: 33373 - DNA, 25 bp, Rattus norvegicus
aagaataagaacagccgtcgccatt

SEQ ID NO: 33374 - DNA, 25 bp, Rattus norvegicus
aagaataagaactgccgtcgccatt

SEQ ID NO: 33375 - DNA, 25 bp, Rattus norvegicus
aagaataatagcctatgttgttttg

SEQ ID NO: 33376 - DNA, 25 bp, Rattus norvegicus
aagaataatagcgtatgttgttttg

SEQ ID NO: 33377 - DNA, 25 bp, Rattus norvegicus
aagaataccaggaggcccgaggcct

SEQ ID NO: 33378 - DNA, 25 bp, Rattus norvegicus
aagaataccaggtggcccgaggcct

SEQ ID NO: 33379 - DNA, 25 bp, Rattus norvegicus
aagaatacttcgaggctgtgctgtt

SEQ ID NO: 33380 - DNA, 25 bp, Rattus norvegicus
aagaatacttcgtggctgtgctgtt

SEQ ID NO: 33381 - DNA, 25 bp, Rattus norvegicus
aagaatactttaacatacctgctaa

SEQ ID NO: 33382 - DNA, 25 bp, Rattus norvegicus
aagaatactttatcatacctgctaa

SEQ ID NO: 33383 - DNA, 25 bp, Rattus norvegicus
aagaatagaaccaactcaccgtgct

SEQ ID NO: 33384 - DNA, 25 bp, Rattus norvegicus
aagaatagaacctactcaccgtgct

SEQ ID NO: 33385 - DNA, 25 bp, Rattus norvegicus
aagaatagactccatgggttcatat

SEQ ID NO: 33386 - DNA, 25 bp, Rattus norvegicus
aagaatagactcgatgggttcatat

SEQ ID NO: 33387 - DNA, 25 bp, Rattus norvegicus
aagaatataaagactcgaggattag

SEQ ID NO: 33388 - DNA, 25 bp, Rattus norvegicus
aagaatataaagtctcgaggattag

SEQ ID NO: 33389 - DNA, 25 bp, Rattus norvegicus
aagaatatatcgcttcccatcggct

SEQ ID NO: 33390 - DNA, 25 bp, Rattus norvegicus
aagaatatatcggttcccatcggct

SEQ ID NO: 33391 - DNA, 25 bp, Rattus norvegicus
aagaatatcacaagctcatctcctt

SEQ ID NO: 33392 - DNA, 25 bp, Rattus norvegicus
aagaatatcacatgctcatctcctt

SEQ ID NO: 33393 - DNA, 25 bp, Rattus norvegicus
aagaatatcacccttcagcacttct

SEQ ID NO: 33394 - DNA, 25 bp, Rattus norvegicus
aagaatatcaccgttcagcacttct

SEQ ID NO: 33395 - DNA, 25 bp, Rattus norvegicus
aagaatatgatcacaggcaccgccc

SEQ ID NO: 33396 - DNA, 25 bp, Rattus norvegicus
aagaatatgatctcaggcaccgccc

SEQ ID NO: 33397 - DNA, 25 bp, Rattus norvegicus
aagaatatgtcacccttgggatagg

SEQ ID NO: 33398 - DNA, 25 bp, Rattus norvegicus
aagaatatgtcagccttgggatagg

SEQ ID NO: 33399 - DNA, 25 bp, Rattus norvegicus
aagaatatttccagctcacgtcggt

SEQ ID NO: 33400 - DNA, 25 bp, Rattus norvegicus
aagaatatttcctgctcacgtcggt

SEQ ID NO: 33401 - DNA, 25 bp, Rattus norvegicus
aagaatattttcatctctgaataat

SEQ ID NO: 33402 - DNA, 25 bp, Rattus norvegicus
aagaatattttcttctctgaataat

SEQ ID NO: 33403 - DNA, 25 bp, Rattus norvegicus
aagaatcacacgcagctgctgctat

SEQ ID NO: 33404 - DNA, 25 bp, Rattus norvegicus
aagaatcacacggagctgctgctat

SEQ ID NO: 33405 - DNA, 25 bp, Rattus norvegicus
aagaatcacataccactgtcctata

SEQ ID NO: 33406 - DNA, 25 bp, Rattus norvegicus
aagaatcacatagcactgtcctata

SEQ ID NO: 33407 - DNA, 25 bp, Rattus norvegicus
aagaatcactcaaccttgatcctca

SEQ ID NO: 33408 - DNA, 25 bp, Rattus norvegicus
aagaatcactcatccttgatcctca

SEQ ID NO: 33409 - DNA, 25 bp, Rattus norvegicus
aagaatcagatcaccctcatgggct

SEQ ID NO: 33410 - DNA, 25 bp, Rattus norvegicus
aagaatcagatctccctcatgggct

SEQ ID NO: 33411 - DNA, 25 bp, Rattus norvegicus
aagaatcagattctcctcatgctgt

SEQ ID NO: 33412 - DNA, 25 bp, Rattus norvegicus
aagaatcagattgtcctcatgctgt

SEQ ID NO: 33413 - DNA, 25 bp, Rattus norvegicus
aagaatcaggcactgctcacagaaa

SEQ ID NO: 33414 - DNA, 25 bp, Rattus norvegicus
aagaatcaggcagtgctcacagaaa

SEQ ID NO: 33415 - DNA, 25 bp, Rattus norvegicus
aagaatcagttaaaggtcatcctca

SEQ ID NO: 33416 - DNA, 25 bp, Rattus norvegicus
aagaatcagttataggtcatcctca

SEQ ID NO: 33417 - DNA, 25 bp, Rattus norvegicus
aagaatcattgtaactctggctgca

SEQ ID NO: 33418 - DNA, 25 bp, Rattus norvegicus
aagaatcattgttactctggctgca

SEQ ID NO: 33419 - DNA, 25 bp, Rattus norvegicus
aagaatccaacacacacaactctct

SEQ ID NO: 33420 - DNA, 25 bp, Rattus norvegicus
aagaatccaacagacacaactctct

SEQ ID NO: 33421 - DNA, 25 bp, Rattus norvegicus
aagaatccagtgcaacacttcctct

SEQ ID NO: 33422 - DNA, 25 bp, Rattus norvegicus
aagaatccagtggaacacttcctct

SEQ ID NO: 33423 - DNA, 25 bp, Rattus norvegicus
aagaatccatctaaatgcctcctgc

SEQ ID NO: 33424 - DNA, 25 bp, Rattus norvegicus
aagaatccatcttaatgcctcctgc

SEQ ID NO: 33425 - DNA, 25 bp, Rattus norvegicus
aagaatcccaagagtctagacccac

SEQ ID NO: 33426 - DNA, 25 bp, Rattus norvegicus
aagaatcccaagtgtctagacccac

SEQ ID NO: 33427 - DNA, 25 bp, Rattus norvegicus
aagaatccgatgacctgtccatatc

SEQ ID NO: 33428 - DNA, 25 bp, Rattus norvegicus
aagaatccgatgtcctgtccatatc

SEQ ID NO: 33429 - DNA, 25 bp, Rattus norvegicus
aagaatccgtcgacaggagcttctc

SEQ ID NO: 33430 - DNA, 25 bp, Rattus norvegicus
aagaatccgtcgtcaggagcttctc

SEQ ID NO: 33431 - DNA, 25 bp, Rattus norvegicus
aagaatcctaccattaactgctgaa

SEQ ID NO: 33432 - DNA, 25 bp, Rattus norvegicus
aagaatcctacccaatcctaggtcg

SEQ ID NO: 33433 - DNA, 25 bp, Rattus norvegicus
aagaatcctaccgaatcctaggtcg

SEQ ID NO: 33434 - DNA, 25 bp, Rattus norvegicus
aagaatcctacctttaactgctgaa

SEQ ID NO: 33435 - DNA, 25 bp, Rattus norvegicus
aagaatcctccgattagttcacagc

SEQ ID NO: 33436 - DNA, 25 bp, Rattus norvegicus
aagaatcctccgtttagttcacagc

SEQ ID NO: 33437 - DNA, 25 bp, Rattus norvegicus
aagaatcctgccaacctgtcggagt

SEQ ID NO: 33438 - DNA, 25 bp, Rattus norvegicus
aagaatcctgcctacctgtcggagt

SEQ ID NO: 33439 - DNA, 25 bp, Rattus norvegicus
aagaatcctggcatgacctttagca

SEQ ID NO: 33440 - DNA, 25 bp, Rattus norvegicus
aagaatcctggcttgacctttagca

SEQ ID NO: 33441 - DNA, 25 bp, Rattus norvegicus
aagaatcctgtcagatccctatgct

SEQ ID NO: 33442 - DNA, 25 bp, Rattus norvegicus
aagaatcctgtctgatccctatgct

SEQ ID NO: 33443 - DNA, 25 bp, Rattus norvegicus
aagaatcctgttccctggttgtgaa

SEQ ID NO: 33444 - DNA, 25 bp, Rattus norvegicus
aagaatcctgttgcctggttgtgaa

SEQ ID NO: 33445 - DNA, 25 bp, Rattus norvegicus
aagaatccttctcgcctgaggagca

SEQ ID NO: 33446 - DNA, 25 bp, Rattus norvegicus
aagaatccttctggcctgaggagca

SEQ ID NO: 33447 - DNA, 25 bp, Rattus norvegicus
aagaatcgacgcagcaaactgctgc

SEQ ID NO: 33448 - DNA, 25 bp, Rattus norvegicus
aagaatcgacgctgcaaactgctgc

SEQ ID NO: 33449 - DNA, 25 bp, Rattus norvegicus
aagaatcggcgaacacatgcccagt

SEQ ID NO: 33450 - DNA, 25 bp, Rattus norvegicus
aagaatcggcgatcacatgcccagt

SEQ ID NO: 33451 - DNA, 25 bp, Rattus norvegicus
aagaatcggtggcagttctctctct

SEQ ID NO: 33452 - DNA, 25 bp, Rattus norvegicus
aagaatcggtgggagttctctctct

SEQ ID NO: 33453 - DNA, 25 bp, Rattus norvegicus
aagaatcgtgtactgacgtcatcaa

SEQ ID NO: 33454 - DNA, 25 bp, Rattus norvegicus
aagaatcgtgtagtgacgtcatcaa

SEQ ID NO: 33455 - DNA, 25 bp, Rattus norvegicus
aagaatctataaatgcttactgaag

SEQ ID NO: 33456 - DNA, 25 bp, Rattus norvegicus
aagaatctataattgcttactgaag

SEQ ID NO: 33457 - DNA, 25 bp, Rattus norvegicus
aagaatctcaaactccttgcttcac

SEQ ID NO: 33458 - DNA, 25 bp, Rattus norvegicus
aagaatctcaaagtccttgcttcac

SEQ ID NO: 33459 - DNA, 25 bp, Rattus norvegicus
aagaatctcaccagtactgacggct

SEQ ID NO: 33460 - DNA, 25 bp, Rattus norvegicus
aagaatctcacctgtactgacggct

SEQ ID NO: 33461 - DNA, 25 bp, Rattus norvegicus
aagaatctccgtcactatgtggaaa

SEQ ID NO: 33462 - DNA, 25 bp, Rattus norvegicus
aagaatctccgtgactatgtggaaa

SEQ ID NO: 33463 - DNA, 25 bp, Rattus norvegicus
aagaatctccttatgtcatcacgtg

SEQ ID NO: 33464 - DNA, 25 bp, Rattus norvegicus
aagaatctccttttgtcatcacgtg

SEQ ID NO: 33465 - DNA, 25 bp, Rattus norvegicus
aagaatctctctcttgcctaagatg

SEQ ID NO: 33466 - DNA, 25 bp, Rattus norvegicus
aagaatctctctgttgcctaagatg

SEQ ID NO: 33467 - DNA, 25 bp, Rattus norvegicus
aagaatctctttaccgagtcttcca

SEQ ID NO: 33468 - DNA, 25 bp, Rattus norvegicus
aagaatctcttttccgagtcttcca

SEQ ID NO: 33469 - DNA, 25 bp, Rattus norvegicus
aagaatctgcggctggcctttgaca

SEQ ID NO: 33470 - DNA, 25 bp, Rattus norvegicus
aagaatctgcgggtggcctttgaca

SEQ ID NO: 33471 - DNA, 25 bp, Rattus norvegicus
aagaatctgctgagtactcctggag

SEQ ID NO: 33472 - DNA, 25 bp, Rattus norvegicus
aagaatctgctgctcacaggccata

SEQ ID NO: 33473 - DNA, 25 bp, Rattus norvegicus
aagaatctgctggtcacaggccata

SEQ ID NO: 33474 - DNA, 25 bp, Rattus norvegicus
aagaatctgctgtgtactcctggag

SEQ ID NO: 33475 - DNA, 25 bp, Rattus norvegicus
aagaatctggtgcttcgggttccga

SEQ ID NO: 33476 - DNA, 25 bp, Rattus norvegicus
aagaatctggtggttcgggttccga

SEQ ID NO: 33477 - DNA, 25 bp, Rattus norvegicus
aagaatctgtcaacatccataccga

SEQ ID NO: 33478 - DNA, 25 bp, Rattus norvegicus
aagaatctgtcatcatccataccga

SEQ ID NO: 33479 - DNA, 25 bp, Rattus norvegicus
aagaatctgtgtacctaaactgtca

SEQ ID NO: 33480 - DNA, 25 bp, Rattus norvegicus
aagaatctgtgttcctaaactgtca

SEQ ID NO: 33481 - DNA, 25 bp, Rattus norvegicus
aagaatcttaggaaccgtgtctggg

SEQ ID NO: 33482 - DNA, 25 bp, Rattus norvegicus
aagaatcttaggtaccgtgtctggg

SEQ ID NO: 33483 - DNA, 25 bp, Rattus norvegicus
aagaatcttgcaccccagatgtttc

SEQ ID NO: 33484 - DNA, 25 bp, Rattus norvegicus
aagaatcttgcagcccagatgtttc

SEQ ID NO: 33485 - DNA, 25 bp, Rattus norvegicus
aagaatctttcaagacctctccata

SEQ ID NO: 33486 - DNA, 25 bp, Rattus norvegicus
aagaatctttcatgacctctccata

SEQ ID NO: 33487 - DNA, 25 bp, Rattus norvegicus
aagaatcttttcacggctcagtggt

SEQ ID NO: 33488 - DNA, 25 bp, Rattus norvegicus
aagaatcttttctcggctcagtggt

SEQ ID NO: 33489 - DNA, 25 bp, Rattus norvegicus
aagaatgaaccgcaggcagcacgga

SEQ ID NO: 33490 - DNA, 25 bp, Rattus norvegicus
aagaatgaaccggaggcagcacgga

SEQ ID NO: 33491 - DNA, 25 bp, Rattus norvegicus
aagaatgaacgactccgtgctgcct

SEQ ID NO: 33492 - DNA, 25 bp, Rattus norvegicus
aagaatgaacgagtccgtgctgcct

SEQ ID NO: 33493 - DNA, 25 bp, Rattus norvegicus
aagaatgacataaatgctgctgtga

SEQ ID NO: 33494 - DNA, 25 bp, Rattus norvegicus
aagaatgacatacggccgctttcta

SEQ ID NO: 33495 - DNA, 25 bp, Rattus norvegicus
aagaatgacatagggccgctttcta

SEQ ID NO: 33496 - DNA, 25 bp, Rattus norvegicus
aagaatgacatatatgctgctgtga

SEQ ID NO: 33497 - DNA, 25 bp, Rattus norvegicus
aagaatgacattatgccctgataat

SEQ ID NO: 33498 - DNA, 25 bp, Rattus norvegicus
aagaatgacattttgccctgataat

SEQ ID NO: 33499 - DNA, 25 bp, Rattus norvegicus
aagaatgaccaccaccttgctttcc

SEQ ID NO: 33500 - DNA, 25 bp, Rattus norvegicus
aagaatgaccacgaccttgctttcc

SEQ ID NO: 33501 - DNA, 25 bp, Rattus norvegicus
aagaatgactgacggcaggcacagg

SEQ ID NO: 33502 - DNA, 25 bp, Rattus norvegicus
aagaatgactgagggcaggcacagg

SEQ ID NO: 33503 - DNA, 25 bp, Rattus norvegicus
aagaatgactgcacttgctgtcgca

SEQ ID NO: 33504 - DNA, 25 bp, Rattus norvegicus
aagaatgactgctcttgctgtcgca

SEQ ID NO: 33505 - DNA, 25 bp, Rattus norvegicus
aagaatgagcacaactccatcctgc

SEQ ID NO: 33506 - DNA, 25 bp, Rattus norvegicus
aagaatgagcactactccatcctgc

SEQ ID NO: 33507 - DNA, 25 bp, Rattus norvegicus
aagaatgatctgcacttcccggtca

SEQ ID NO: 33508 - DNA, 25 bp, Rattus norvegicus
aagaatgatctggacttcccggtca

SEQ ID NO: 33509 - DNA, 25 bp, Rattus norvegicus
aagaatgatgtgaactggaatgtga

SEQ ID NO: 33510 - DNA, 25 bp, Rattus norvegicus
aagaatgatgtgtactggaatgtga

SEQ ID NO: 33511 - DNA, 25 bp, Rattus norvegicus
aagaatgcactgacctgtccaaaca

SEQ ID NO: 33512 - DNA, 25 bp, Rattus norvegicus
aagaatgcactgtcctgtccaaaca

SEQ ID NO: 33513 - DNA, 25 bp, Rattus norvegicus
aagaatgcaggtcctttctcatgct

SEQ ID NO: 33514 - DNA, 25 bp, Rattus norvegicus
aagaatgcaggtgctttctcatgct

SEQ ID NO: 33515 - DNA, 25 bp, Rattus norvegicus
aagaatgcagtcatcgcgttgcgta

SEQ ID NO: 33516 - DNA, 25 bp, Rattus norvegicus
aagaatgcagtcttcgcgttgcgta

SEQ ID NO: 33517 - DNA, 25 bp, Rattus norvegicus
aagaatgcatacagccgtgcccagg

SEQ ID NO: 33518 - DNA, 25 bp, Rattus norvegicus
aagaatgcatactgccgtgcccagg

SEQ ID NO: 33519 - DNA, 25 bp, Rattus norvegicus
aagaatgcatcgctggctacaccaa

SEQ ID NO: 33520 - DNA, 25 bp, Rattus norvegicus
aagaatgcatcggtggctacaccaa

SEQ ID NO: 33521 - DNA, 25 bp, Rattus norvegicus
aagaatgccaccaatgttgaacagg

SEQ ID NO: 33522 - DNA, 25 bp, Rattus norvegicus
aagaatgccacctatgttgaacagg

SEQ ID NO: 33523 - DNA, 25 bp, Rattus norvegicus
aagaatgccagcctcagctactgct

SEQ ID NO: 33524 - DNA, 25 bp, Rattus norvegicus
aagaatgccagcgtcagctactgct

SEQ ID NO: 33525 - DNA, 25 bp, Rattus norvegicus
aagaatgcccaactggcacagtccc

SEQ ID NO: 33526 - DNA, 25 bp, Rattus norvegicus
aagaatgcccaagtggcacagtccc

SEQ ID NO: 33527 - DNA, 25 bp, Rattus norvegicus
aagaatgcccgacaggaaacctaag

SEQ ID NO: 33528 - DNA, 25 bp, Rattus norvegicus
aagaatgcccgagaggaaacctaag

SEQ ID NO: 33529 - DNA, 25 bp, Rattus norvegicus
aagaatgctacgatttactgccaag

SEQ ID NO: 33530 - DNA, 25 bp, Rattus norvegicus
aagaatgctacgttttactgccaag

SEQ ID NO: 33531 - DNA, 25 bp, Rattus norvegicus
aagaatgctcttcagtctcaagtct

SEQ ID NO: 33532 - DNA, 25 bp, Rattus norvegicus
aagaatgctcttgagtctcaagtct

SEQ ID NO: 33533 - DNA, 25 bp, Rattus norvegicus
aagaatgctgaaatttgccaactaa

SEQ ID NO: 33534 - DNA, 25 bp, Rattus norvegicus
aagaatgctgaattttgccaactaa

SEQ ID NO: 33535 - DNA, 25 bp, Rattus norvegicus
aagaatgcttgcagcaggccccaaa

SEQ ID NO: 33536 - DNA, 25 bp, Rattus norvegicus
aagaatgcttgctgcaggccccaaa

SEQ ID NO: 33537 - DNA, 25 bp, Rattus norvegicus
aagaatggaagtctgccacacaggg

SEQ ID NO: 33538 - DNA, 25 bp, Rattus norvegicus
aagaatggaagtgtgccacacaggg

SEQ ID NO: 33539 - DNA, 25 bp, Rattus norvegicus
aagaatggacgcaccagtggccttg

SEQ ID NO: 33540 - DNA, 25 bp, Rattus norvegicus
aagaatggacgctccagtggccttg

SEQ ID NO: 33541 - DNA, 25 bp, Rattus norvegicus
aagaatggactgaagttctcaagtt

SEQ ID NO: 33542 - DNA, 25 bp, Rattus norvegicus
aagaatggactgtagttctcaagtt

SEQ ID NO: 33543 - DNA, 25 bp, Rattus norvegicus
aagaatggagttcgccgtgtgctac

SEQ ID NO: 33544 - DNA, 25 bp, Rattus norvegicus
aagaatggagttggccgtgtgctac

SEQ ID NO: 33545 - DNA, 25 bp, Rattus norvegicus
aagaatggattgatgcagggctaca

SEQ ID NO: 33546 - DNA, 25 bp, Rattus norvegicus
aagaatggattgttgcagggctaca

SEQ ID NO: 33547 - DNA, 25 bp, Rattus norvegicus
aagaatggcctcctagactatagca

SEQ ID NO: 33548 - DNA, 25 bp, Rattus norvegicus
aagaatggcctcgtagactatagca

SEQ ID NO: 33549 - DNA, 25 bp, Rattus norvegicus
aagaatgggctcacaatacttgatg

SEQ ID NO: 33550 - DNA, 25 bp, Rattus norvegicus
aagaatgggctctcaatacttgatg

SEQ ID NO: 33551 - DNA, 25 bp, Rattus norvegicus
aagaatggtaagaccggcctccttg

SEQ ID NO: 33552 - DNA, 25 bp, Rattus norvegicus
aagaatggtaagtccggcctccttg

SEQ ID NO: 33553 - DNA, 25 bp, Rattus norvegicus
aagaatggtggactctgaccctccc

SEQ ID NO: 33554 - DNA, 25 bp, Rattus norvegicus
aagaatggtggagtctgaccctccc

SEQ ID NO: 33555 - DNA, 25 bp, Rattus norvegicus
aagaatggtggcatgttttcatggt

SEQ ID NO: 33556 - DNA, 25 bp, Rattus norvegicus
aagaatggtggcttgttttcatggt

SEQ ID NO: 33557 - DNA, 25 bp, Rattus norvegicus
aagaatgtatttcaaagcttcatga

SEQ ID NO: 33558 - DNA, 25 bp, Rattus norvegicus
aagaatgtatttgaaagcttcatga

SEQ ID NO: 33559 - DNA, 25 bp, Rattus norvegicus
aagaatgtctctcggacttcagcct

SEQ ID NO: 33560 - DNA, 25 bp, Rattus norvegicus
aagaatgtctctgggacttcagcct

SEQ ID NO: 33561 - DNA, 25 bp, Rattus norvegicus
aagaatgtcttgctgtctagtgcat

SEQ ID NO: 33562 - DNA, 25 bp, Rattus norvegicus
aagaatgtcttggtgtctagtgcat

SEQ ID NO: 33563 - DNA, 25 bp, Rattus norvegicus
aagaatgtctttccctgaggttaca

SEQ ID NO: 33564 - DNA, 25 bp, Rattus norvegicus
aagaatgtctttgcctgaggttaca

SEQ ID NO: 33565 - DNA, 25 bp, Rattus norvegicus
aagaatgtgacccatgatccctcac

SEQ ID NO: 33566 - DNA, 25 bp, Rattus norvegicus
aagaatgtgaccgatgatccctcac

SEQ ID NO: 33567 - DNA, 25 bp, Rattus norvegicus
aagaatgtggccaaacgctgcaggt

SEQ ID NO: 33568 - DNA, 25 bp, Rattus norvegicus
aagaatgtggcctaacgctgcaggt

SEQ ID NO: 33569 - DNA, 25 bp, Rattus norvegicus
aagaatgtgtcacggcatcttgccc

SEQ ID NO: 33570 - DNA, 25 bp, Rattus norvegicus
aagaatgtgtcagggcatcttgccc

SEQ ID NO: 33571 - DNA, 25 bp, Rattus norvegicus
aagaatgtgtccatttttgccaaag

SEQ ID NO: 33572 - DNA, 25 bp, Rattus norvegicus
aagaatgtgtccttttttgccaaag

SEQ ID NO: 33573 - DNA, 25 bp, Rattus norvegicus
aagaatgtgtggcaccccacatctc

SEQ ID NO: 33574 - DNA, 25 bp, Rattus norvegicus
aagaatgtgtgggaccccacatctc

SEQ ID NO: 33575 - DNA, 25 bp, Rattus norvegicus
aagaattactaccagtcccaccttg

SEQ ID NO: 33576 - DNA, 25 bp, Rattus norvegicus
aagaattactacgagtcccaccttg

SEQ ID NO: 33577 - DNA, 25 bp, Rattus norvegicus
aagaattactctagctctcctagca

SEQ ID NO: 33578 - DNA, 25 bp, Rattus norvegicus
aagaattactcttgctctcctagca

SEQ ID NO: 33579 - DNA, 25 bp, Rattus norvegicus
aagaattagctccaggtctctatcc

SEQ ID NO: 33580 - DNA, 25 bp, Rattus norvegicus
aagaattagctcgaggtctctatcc

SEQ ID NO: 33581 - DNA, 25 bp, Rattus norvegicus
aagaattcaaagaggttacatggac

SEQ ID NO: 33582 - DNA, 25 bp, Rattus norvegicus
aagaattcaaagtggttacatggac

SEQ ID NO: 33583 - DNA, 25 bp, Rattus norvegicus
aagaattcacacagacgggcactcc

SEQ ID NO: 33584 - DNA, 25 bp, Rattus norvegicus
aagaattcacactgacgggcactcc

SEQ ID NO: 33585 - DNA, 25 bp, Rattus norvegicus
aagaattcagctaacgcttccagac

SEQ ID NO: 33586 - DNA, 25 bp, Rattus norvegicus
aagaattcagctatgtggtgagtct

SEQ ID NO: 33587 - DNA, 25 bp, Rattus norvegicus
aagaattcagcttacgcttccagac

SEQ ID NO: 33588 - DNA, 25 bp, Rattus norvegicus
aagaattcagctttgtggtgagtct

SEQ ID NO: 33589 - DNA, 25 bp, Rattus norvegicus
aagaattcagttccggctgcctgat

SEQ ID NO: 33590 - DNA, 25 bp, Rattus norvegicus
aagaattcagttgcggctgcctgat

SEQ ID NO: 33591 - DNA, 25 bp, Rattus norvegicus
aagaattcccacaaggcagacctct

SEQ ID NO: 33592 - DNA, 25 bp, Rattus norvegicus
aagaattcccactaggcagacctct

SEQ ID NO: 33593 - DNA, 25 bp, Rattus norvegicus
aagaattccctcattcgttatctca

SEQ ID NO: 33594 - DNA, 25 bp, Rattus norvegicus
aagaattccctctttcgttatctca

SEQ ID NO: 33595 - DNA, 25 bp, Rattus norvegicus
aagaattccttaacttcgcagatga

SEQ ID NO: 33596 - DNA, 25 bp, Rattus norvegicus
aagaattccttatcttcgcagatga

SEQ ID NO: 33597 - DNA, 25 bp, Rattus norvegicus
aagaattccttgctttttcaaaatg

SEQ ID NO: 33598 - DNA, 25 bp, Rattus norvegicus
aagaattccttggtttttcaaaatg

SEQ ID NO: 33599 - DNA, 25 bp, Rattus norvegicus
aagaattcgctgactgcctttgcta

SEQ ID NO: 33600 - DNA, 25 bp, Rattus norvegicus
aagaattcgctgtctgcctttgcta

SEQ ID NO: 33601 - DNA, 25 bp, Rattus norvegicus
aagaattcgtcaacacgctgcacag

SEQ ID NO: 33602 - DNA, 25 bp, Rattus norvegicus
aagaattcgtcatcacgctgcacag

SEQ ID NO: 33603 - DNA, 25 bp, Rattus norvegicus
aagaattctccccacgttcgaagat

SEQ ID NO: 33604 - DNA, 25 bp, Rattus norvegicus
aagaattctcccgacgttcgaagat

SEQ ID NO: 33605 - DNA, 25 bp, Rattus norvegicus
aagaattctgttagcttggcagcat

SEQ ID NO: 33606 - DNA, 25 bp, Rattus norvegicus
aagaattctgttccaaatcatatat

SEQ ID NO: 33607 - DNA, 25 bp, Rattus norvegicus
aagaattctgttgcaaatcatatat

SEQ ID NO: 33608 - DNA, 25 bp, Rattus norvegicus
aagaattctgtttgcttggcagcat

SEQ ID NO: 33609 - DNA, 25 bp, Rattus norvegicus
aagaattgagttcctctgagggagc

SEQ ID NO: 33610 - DNA, 25 bp, Rattus norvegicus
aagaattgagttgctctgagggagc

SEQ ID NO: 33611 - DNA, 25 bp, Rattus norvegicus
aagaattgcaatctgctcaccagca

SEQ ID NO: 33612 - DNA, 25 bp, Rattus norvegicus
aagaattgcaatgtgctcaccagca

SEQ ID NO: 33613 - DNA, 25 bp, Rattus norvegicus
aagaattgccctccaaccagtgttt

SEQ ID NO: 33614 - DNA, 25 bp, Rattus norvegicus
aagaattgccctgcaaccagtgttt

SEQ ID NO: 33615 - DNA, 25 bp, Rattus norvegicus
aagaattgccttagggagtcagatc

SEQ ID NO: 33616 - DNA, 25 bp, Rattus norvegicus
aagaattgccttccccaaacctacg

SEQ ID NO: 33617 - DNA, 25 bp, Rattus norvegicus
aagaattgccttgcccaaacctacg

SEQ ID NO: 33618 - DNA, 25 bp, Rattus norvegicus
aagaattgcctttgggagtcagatc

SEQ ID NO: 33619 - DNA, 25 bp, Rattus norvegicus
aagaattgcttcctaaatagaaaag

SEQ ID NO: 33620 - DNA, 25 bp, Rattus norvegicus
aagaattgcttcgtaaatagaaaag

SEQ ID NO: 33621 - DNA, 25 bp, Rattus norvegicus
aagaattggcagctgcctactcaag

SEQ ID NO: 33622 - DNA, 25 bp, Rattus norvegicus
aagaattggcaggtgcctactcaag

SEQ ID NO: 33623 - DNA, 25 bp, Rattus norvegicus
aagaattgtgcgacgggctaacgca

SEQ ID NO: 33624 - DNA, 25 bp, Rattus norvegicus
aagaattgtgcgtcgggctaacgca

SEQ ID NO: 33625 - DNA, 25 bp, Rattus norvegicus
aagaattgtttcatggctgaatttg

SEQ ID NO: 33626 - DNA, 25 bp, Rattus norvegicus
aagaattgtttcttggctgaatttg

SEQ ID NO: 33627 - DNA, 25 bp, Rattus norvegicus
aagaatttcccacgctagaagaccg

SEQ ID NO: 33628 - DNA, 25 bp, Rattus norvegicus
aagaatttcccacttcctgctgtga

SEQ ID NO: 33629 - DNA, 25 bp, Rattus norvegicus
aagaatttcccaggctagaagaccg

SEQ ID NO: 33630 - DNA, 25 bp, Rattus norvegicus
aagaatttcccagttcctgctgtga

SEQ ID NO: 33631 - DNA, 25 bp, Rattus norvegicus
aagaatttctaccaagctgctgtga

SEQ ID NO: 33632 - DNA, 25 bp, Rattus norvegicus
aagaatttctacgaagctgctgtga

SEQ ID NO: 33633 - DNA, 25 bp, Rattus norvegicus
aagaatttctccagcacacgatgat

SEQ ID NO: 33634 - DNA, 25 bp, Rattus norvegicus
aagaatttctcctgcacacgatgat

SEQ ID NO: 33635 - DNA, 25 bp, Rattus norvegicus
aagaatttgctgctggtgtcttctc

SEQ ID NO: 33636 - DNA, 25 bp, Rattus norvegicus
aagaatttgctggtggtgtcttctc

SEQ ID NO: 33637 - DNA, 25 bp, Rattus norvegicus
aagaatttgtccctatgcacatatt

SEQ ID NO: 33638 - DNA, 25 bp, Rattus norvegicus
aagaatttgtccgtatgcacatatt

SEQ ID NO: 33639 - DNA, 25 bp, Rattus norvegicus
aagaattttcatatgctgctgtgtg

SEQ ID NO: 33640 - DNA, 25 bp, Rattus norvegicus
aagaattttcatcctgttcctgcaa

SEQ ID NO: 33641 - DNA, 25 bp, Rattus norvegicus
aagaattttcatgctgttcctgcaa

SEQ ID NO: 33642 - DNA, 25 bp, Rattus norvegicus
aagaattttcatttgctgctgtgtg

SEQ ID NO: 33643 - DNA, 25 bp, Rattus norvegicus
aagaattttctcatcctgattggag

SEQ ID NO: 33644 - DNA, 25 bp, Rattus norvegicus
aagaattttctcttcctgattggag

SEQ ID NO: 33645 - DNA, 25 bp, Rattus norvegicus
aagaattttgagcttctggtagaag

SEQ ID NO: 33646 - DNA, 25 bp, Rattus norvegicus
aagaattttgaggttctggtagaag

SEQ ID NO: 33647 - DNA, 25 bp, Rattus norvegicus
aagacaaaatgtcggctctgaccat

SEQ ID NO: 33648 - DNA, 25 bp, Rattus norvegicus
aagacaaaatgtgggctctgaccat

SEQ ID NO: 33649 - DNA, 25 bp, Rattus norvegicus
aagacaaacagaacccgtgagcccg

SEQ ID NO: 33650 - DNA, 25 bp, Rattus norvegicus
aagacaaacagatcccgtgagcccg

SEQ ID NO: 33651 - DNA, 25 bp, Rattus norvegicus
aagacaaacaggaccacacaaagaa

SEQ ID NO: 33652 - DNA, 25 bp, Rattus norvegicus
aagacaaacaggtccacacaaagaa

SEQ ID NO: 33653 - DNA, 25 bp, Rattus norvegicus
aagacaaaccctatcagcaggtcag

SEQ ID NO: 33654 - DNA, 25 bp, Rattus norvegicus
aagacaaaccctttcagcaggtcag

SEQ ID NO: 33655 - DNA, 25 bp, Rattus norvegicus
aagacaaacctcatctagccgcggg

SEQ ID NO: 33656 - DNA, 25 bp, Rattus norvegicus
aagacaaacctcttctagccgcggg

SEQ ID NO: 33657 - DNA, 25 bp, Rattus norvegicus
aagacaaacgacagctcttccaagg

SEQ ID NO: 33658 - DNA, 25 bp, Rattus norvegicus
aagacaaacgactgctcttccaagg

SEQ ID NO: 33659 - DNA, 25 bp, Rattus norvegicus
aagacaaactgcatgccttgaccac

SEQ ID NO: 33660 - DNA, 25 bp, Rattus norvegicus
aagacaaactgcttgccttgaccac

SEQ ID NO: 33661 - DNA, 25 bp, Rattus norvegicus
aagacaaagtccaccgccagcgctt

SEQ ID NO: 33662 - DNA, 25 bp, Rattus norvegicus
aagacaaagtcctccgccagcgctt

SEQ ID NO: 33663 - DNA, 25 bp, Rattus norvegicus
aagacaacactcagactttggctcc

SEQ ID NO: 33664 - DNA, 25 bp, Rattus norvegicus
aagacaacactctgactttggctcc

SEQ ID NO: 33665 - DNA, 25 bp, Rattus norvegicus
aagacaaccaacaggctctggtaga

SEQ ID NO: 33666 - DNA, 25 bp, Rattus norvegicus
aagacaaccaactggctctggtaga

SEQ ID NO: 33667 - DNA, 25 bp, Rattus norvegicus
aagacaaccaatacattgttggtaa

SEQ ID NO: 33668 - DNA, 25 bp, Rattus norvegicus
aagacaaccaattcattgttggtaa

SEQ ID NO: 33669 - DNA, 25 bp, Rattus norvegicus
aagacaacccaaaatctgccacaga

SEQ ID NO: 33670 - DNA, 25 bp, Rattus norvegicus
aagacaacccaatatctgccacaga

SEQ ID NO: 33671 - DNA, 25 bp, Rattus norvegicus
aagacaacggctcggactgacctag

SEQ ID NO: 33672 - DNA, 25 bp, Rattus norvegicus
aagacaacggctgggactgacctag

SEQ ID NO: 33673 - DNA, 25 bp, Rattus norvegicus
aagacaacgggaaggactgacgcac

SEQ ID NO: 33674 - DNA, 25 bp, Rattus norvegicus
aagacaacgggatggactgacgcac

SEQ ID NO: 33675 - DNA, 25 bp, Rattus norvegicus
aagacaacgtacagtggcatgagtt

SEQ ID NO: 33676 - DNA, 25 bp, Rattus norvegicus
aagacaacgtactgtggcatgagtt

SEQ ID NO: 33677 - DNA, 25 bp, Rattus norvegicus
aagacaactcttccgaagaagccag

SEQ ID NO: 33678 - DNA, 25 bp, Rattus norvegicus
aagacaactcttgcgaagaagccag

SEQ ID NO: 33679 - DNA, 25 bp, Rattus norvegicus
aagacaactgagactgtctgccatt

SEQ ID NO: 33680 - DNA, 25 bp, Rattus norvegicus
aagacaactgagtctgtctgccatt

SEQ ID NO: 33681 - DNA, 25 bp, Rattus norvegicus
aagacaactgtgctggtcttcctca

SEQ ID NO: 33682 - DNA, 25 bp, Rattus norvegicus
aagacaactgtggtggtcttcctca

SEQ ID NO: 33683 - DNA, 25 bp, Rattus norvegicus
aagacaacttatatagccctatgag

SEQ ID NO: 33684 - DNA, 25 bp, Rattus norvegicus
aagacaacttatttagccctatgag

SEQ ID NO: 33685 - DNA, 25 bp, Rattus norvegicus
aagacaagacgtccttagcactgag

SEQ ID NO: 33686 - DNA, 25 bp, Rattus norvegicus
aagacaagacgtgcttagcactgag

SEQ ID NO: 33687 - DNA, 25 bp, Rattus norvegicus
aagacaagatgtcagccctggctgc

SEQ ID NO: 33688 - DNA, 25 bp, Rattus norvegicus
aagacaagatgtgagccctggctgc

SEQ ID NO: 33689 - DNA, 25 bp, Rattus norvegicus
aagacaagcaacattacggccaccc

SEQ ID NO: 33690 - DNA, 25 bp, Rattus norvegicus
aagacaagcaactttacggccaccc

SEQ ID NO: 33691 - DNA, 25 bp, Rattus norvegicus
aagacaagcacgaagaaatcaaatt

SEQ ID NO: 33692 - DNA, 25 bp, Rattus norvegicus
aagacaagcacgtagaaatcaaatt

SEQ ID NO: 33693 - DNA, 25 bp, Rattus norvegicus
aagacaagcagtccagccgatccat

SEQ ID NO: 33694 - DNA, 25 bp, Rattus norvegicus
aagacaagcagtgcagccgatccat

SEQ ID NO: 33695 - DNA, 25 bp, Rattus norvegicus
aagacaagcatcaagccaggcccaa

SEQ ID NO: 33696 - DNA, 25 bp, Rattus norvegicus
aagacaagcatctagccaggcccaa

SEQ ID NO: 33697 - DNA, 25 bp, Rattus norvegicus
aagacaagcgctataccttcatccg

SEQ ID NO: 33698 - DNA, 25 bp, Rattus norvegicus
aagacaagcgctttaccttcatccg

SEQ ID NO: 33699 - DNA, 25 bp, Rattus norvegicus
aagacaagcggtaagaggagcccac

SEQ ID NO: 33700 - DNA, 25 bp, Rattus norvegicus
aagacaagcggttagaggagcccac

SEQ ID NO: 33701 - DNA, 25 bp, Rattus norvegicus
aagacaaggccaaccgatacttctc

SEQ ID NO: 33702 - DNA, 25 bp, Rattus norvegicus
aagacaaggccatccgatacttctc

SEQ ID NO: 33703 - DNA, 25 bp, Rattus norvegicus
aagacaagtcaaccctcaccctgaa

SEQ ID NO: 33704 - DNA, 25 bp, Rattus norvegicus
aagacaagtcaagcctcaccctgaa

SEQ ID NO: 33705 - DNA, 25 bp, Rattus norvegicus
aagacaagtccacccaccgtcgttg

SEQ ID NO: 33706 - DNA, 25 bp, Rattus norvegicus
aagacaagtccagccaccgtcgttg

SEQ ID NO: 33707 - DNA, 25 bp, Rattus norvegicus
aagacaagtgcacgccttcctatag

SEQ ID NO: 33708 - DNA, 25 bp, Rattus norvegicus
aagacaagtgcaggccttcctatag

SEQ ID NO: 33709 - DNA, 25 bp, Rattus norvegicus
aagacaagtggtatgtgaggctcac

SEQ ID NO: 33710 - DNA, 25 bp, Rattus norvegicus
aagacaagtggtttgtgaggctcac

SEQ ID NO: 33711 - DNA, 25 bp, Rattus norvegicus
aagacaatattcaggtctctgggaa

SEQ ID NO: 33712 - DNA, 25 bp, Rattus norvegicus
aagacaatattctggtctctgggaa

SEQ ID NO: 33713 - DNA, 25 bp, Rattus norvegicus
aagacaatcaatacctctctttttt

SEQ ID NO: 33714 - DNA, 25 bp, Rattus norvegicus
aagacaatcaattcctctctttttt

SEQ ID NO: 33715 - DNA, 25 bp, Rattus norvegicus
aagacaatctcccagtgaccttaga

SEQ ID NO: 33716 - DNA, 25 bp, Rattus norvegicus
aagacaatctccgagtgaccttaga

SEQ ID NO: 33717 - DNA, 25 bp, Rattus norvegicus
aagacaatcttgaagcagggcagtg

SEQ ID NO: 33718 - DNA, 25 bp, Rattus norvegicus
aagacaatcttgtagcagggcagtg

SEQ ID NO: 33719 - DNA, 25 bp, Rattus norvegicus
aagacaatgaagaccgttcgcctcc

SEQ ID NO: 33720 - DNA, 25 bp, Rattus norvegicus
aagacaatgaagtccgttcgcctcc

SEQ ID NO: 33721 - DNA, 25 bp, Rattus norvegicus
aagacaatgcgtccttgtacctagc

SEQ ID NO: 33722 - DNA, 25 bp, Rattus norvegicus
aagacaatgcgtgcttgtacctagc

SEQ ID NO: 33723 - DNA, 25 bp, Rattus norvegicus
aagacaatggtgacccgcttcaatg

SEQ ID NO: 33724 - DNA, 25 bp, Rattus norvegicus
aagacaatggtgtcccgcttcaatg

SEQ ID NO: 33725 - DNA, 25 bp, Rattus norvegicus
aagacaatgtacaagagactcagat

SEQ ID NO: 33726 - DNA, 25 bp, Rattus norvegicus
aagacaatgtacatctggcccatcc

SEQ ID NO: 33727 - DNA, 25 bp, Rattus norvegicus
aagacaatgtactagagactcagat

SEQ ID NO: 33728 - DNA, 25 bp, Rattus norvegicus
aagacaatgtacttctggcccatcc

SEQ ID NO: 33729 - DNA, 25 bp, Rattus norvegicus
aagacaatgtgtaaaactcccaggg

SEQ ID NO: 33730 - DNA, 25 bp, Rattus norvegicus
aagacaatgtgttaaactcccaggg

SEQ ID NO: 33731 - DNA, 25 bp, Rattus norvegicus
aagacaattgacactctgccctttg

SEQ ID NO: 33732 - DNA, 25 bp, Rattus norvegicus
aagacaattgactctctgccctttg

SEQ ID NO: 33733 - DNA, 25 bp, Rattus norvegicus
aagacaattgtccaggctgtgggct

SEQ ID NO: 33734 - DNA, 25 bp, Rattus norvegicus
aagacaattgtcgaggctgtgggct

SEQ ID NO: 33735 - DNA, 25 bp, Rattus norvegicus
aagacacaagggatcactctggagt

SEQ ID NO: 33736 - DNA, 25 bp, Rattus norvegicus
aagacacaagggttcactctggagt

SEQ ID NO: 33737 - DNA, 25 bp, Rattus norvegicus
aagacacaagtcctctcgcagtaat

SEQ ID NO: 33738 - DNA, 25 bp, Rattus norvegicus
aagacacaagtcgtctcgcagtaat

SEQ ID NO: 33739 - DNA, 25 bp, Rattus norvegicus
aagacacacacaccaaagacaggaa

SEQ ID NO: 33740 - DNA, 25 bp, Rattus norvegicus
aagacacacacagcaaagacaggaa

SEQ ID NO: 33741 - DNA, 25 bp, Rattus norvegicus
aagacacacattctctgcaaggctc

SEQ ID NO: 33742 - DNA, 25 bp, Rattus norvegicus
aagacacacattgtctgcaaggctc

SEQ ID NO: 33743 - DNA, 25 bp, Rattus norvegicus
aagacacacttgctctaaagcccat

SEQ ID NO: 33744 - DNA, 25 bp, Rattus norvegicus
aagacacacttggtctaaagcccat

SEQ ID NO: 33745 - DNA, 25 bp, Rattus norvegicus
aagacacagcttctgaggcaggcac

SEQ ID NO: 33746 - DNA, 25 bp, Rattus norvegicus
aagacacagcttgtgaggcaggcac

SEQ ID NO: 33747 - DNA, 25 bp, Rattus norvegicus
aagacacaggctcatcttgctagtc

SEQ ID NO: 33748 - DNA, 25 bp, Rattus norvegicus
aagacacaggctgatcttgctagtc

SEQ ID NO: 33749 - DNA, 25 bp, Rattus norvegicus
aagacacagtctcttcagcacatgt

SEQ ID NO: 33750 - DNA, 25 bp, Rattus norvegicus
aagacacagtctgttcagcacatgt

SEQ ID NO: 33751 - DNA, 25 bp, Rattus norvegicus
aagacacagtgtagtacgcatacat

SEQ ID NO: 33752 - DNA, 25 bp, Rattus norvegicus
aagacacagtgttgtacgcatacat

SEQ ID NO: 33753 - DNA, 25 bp, Rattus norvegicus
aagacacatggcagacccctgactt

SEQ ID NO: 33754 - DNA, 25 bp, Rattus norvegicus
aagacacatggcatgcaagccctca

SEQ ID NO: 33755 - DNA, 25 bp, Rattus norvegicus
aagacacatggctgacccctgactt

SEQ ID NO: 33756 - DNA, 25 bp, Rattus norvegicus
aagacacatggcttgcaagccctca

SEQ ID NO: 33757 - DNA, 25 bp, Rattus norvegicus
aagacacatgttccacttagacgaa

SEQ ID NO: 33758 - DNA, 25 bp, Rattus norvegicus
aagacacatgttgcacttagacgaa

SEQ ID NO: 33759 - DNA, 25 bp, Rattus norvegicus
aagacaccacttaattgggcctgcc

SEQ ID NO: 33760 - DNA, 25 bp, Rattus norvegicus
aagacaccactttattgggcctgcc

SEQ ID NO: 33761 - DNA, 25 bp, Rattus norvegicus
aagacaccagcgaagacattgagga

SEQ ID NO: 33762 - DNA, 25 bp, Rattus norvegicus
aagacaccagcgtagacattgagga

SEQ ID NO: 33763 - DNA, 25 bp, Rattus norvegicus
aagacaccagttcaacagctgtgaa

SEQ ID NO: 33764 - DNA, 25 bp, Rattus norvegicus
aagacaccagttgaacagctgtgaa

SEQ ID NO: 33765 - DNA, 25 bp, Rattus norvegicus
aagacaccatcacgagggctgtacc

SEQ ID NO: 33766 - DNA, 25 bp, Rattus norvegicus
aagacaccatcaggagggctgtacc

SEQ ID NO: 33767 - DNA, 25 bp, Rattus norvegicus
aagacaccccaacttcagatactgg

SEQ ID NO: 33768 - DNA, 25 bp, Rattus norvegicus
aagacaccccaagttcagatactgg

SEQ ID NO: 33769 - DNA, 25 bp, Rattus norvegicus
aagacaccctgaagaactttctctc

SEQ ID NO: 33770 - DNA, 25 bp, Rattus norvegicus
aagacaccctgatgaactttctctc

SEQ ID NO: 33771 - DNA, 25 bp, Rattus norvegicus
aagacaccgatgacttcatctgcac

SEQ ID NO: 33772 - DNA, 25 bp, Rattus norvegicus
aagacaccgatgtcttcatctgcac

SEQ ID NO: 33773 - DNA, 25 bp, Rattus norvegicus
aagacaccgctgcaagtcgccaaag

SEQ ID NO: 33774 - DNA, 25 bp, Rattus norvegicus
aagacaccgctggaagtcgccaaag

SEQ ID NO: 33775 - DNA, 25 bp, Rattus norvegicus
aagacacctgccactatgagtgttc

SEQ ID NO: 33776 - DNA, 25 bp, Rattus norvegicus
aagacacctgcctctatgagtgttc

SEQ ID NO: 33777 - DNA, 25 bp, Rattus norvegicus
aagacacctggcattgggcacatca

SEQ ID NO: 33778 - DNA, 25 bp, Rattus norvegicus
aagacacctggctttgggcacatca

SEQ ID NO: 33779 - DNA, 25 bp, Rattus norvegicus
aagacacctgttagatctggcttcc

SEQ ID NO: 33780 - DNA, 25 bp, Rattus norvegicus
aagacacctgtttgatctggcttcc

SEQ ID NO: 33781 - DNA, 25 bp, Rattus norvegicus
aagacacgcagcaatggatccagca

SEQ ID NO: 33782 - DNA, 25 bp, Rattus norvegicus
aagacacgcagctatggatccagca

SEQ ID NO: 33783 - DNA, 25 bp, Rattus norvegicus
aagacacgcccacaggtgaatgcag

SEQ ID NO: 33784 - DNA, 25 bp, Rattus norvegicus
aagacacgcccagaggtgaatgcag

SEQ ID NO: 33785 - DNA, 25 bp, Rattus norvegicus
aagacacggactagcttggtcatct

SEQ ID NO: 33786 - DNA, 25 bp, Rattus norvegicus
aagacacggacttgcttggtcatct

SEQ ID NO: 33787 - DNA, 25 bp, Rattus norvegicus
aagacacggagtcctaagacatcat

SEQ ID NO: 33788 - DNA, 25 bp, Rattus norvegicus
aagacacggagtgctaagacatcat

SEQ ID NO: 33789 - DNA, 25 bp, Rattus norvegicus
aagacacggtctaccacaaggagat

SEQ ID NO: 33790 - DNA, 25 bp, Rattus norvegicus
aagacacggtcttccacaaggagat

SEQ ID NO: 33791 - DNA, 25 bp, Rattus norvegicus
aagacacgtttaaatgacctcgatg

SEQ ID NO: 33792 - DNA, 25 bp, Rattus norvegicus
aagacacgtttatatgacctcgatg

SEQ ID NO: 33793 - DNA, 25 bp, Rattus norvegicus
aagacactaagacctgtgtttccag

SEQ ID NO: 33794 - DNA, 25 bp, Rattus norvegicus
aagacactaagagctgtgtttccag

SEQ ID NO: 33795 - DNA, 25 bp, Rattus norvegicus
aagacactacacagagcccattggc

SEQ ID NO: 33796 - DNA, 25 bp, Rattus norvegicus
aagacactacactgagcccattggc

SEQ ID NO: 33797 - DNA, 25 bp, Rattus norvegicus
aagacactatttatgcagctatttg

SEQ ID NO: 33798 - DNA, 25 bp, Rattus norvegicus
aagacactatttttgcagctatttg

SEQ ID NO: 33799 - DNA, 25 bp, Rattus norvegicus
aagacactcagtcgacatgcccttc

SEQ ID NO: 33800 - DNA, 25 bp, Rattus norvegicus
aagacactcagtggacatgcccttc

SEQ ID NO: 33801 - DNA, 25 bp, Rattus norvegicus
aagacactcatccttgctgttctgc

SEQ ID NO: 33802 - DNA, 25 bp, Rattus norvegicus
aagacactcatcgttgctgttctgc

SEQ ID NO: 33803 - DNA, 25 bp, Rattus norvegicus
aagacactcctccaacatcaggttg

SEQ ID NO: 33804 - DNA, 25 bp, Rattus norvegicus
aagacactcctcgaacatcaggttg

SEQ ID NO: 33805 - DNA, 25 bp, Rattus norvegicus
aagacactctctactttggtttgct

SEQ ID NO: 33806 - DNA, 25 bp, Rattus norvegicus
aagacactctcttctttggtttgct

SEQ ID NO: 33807 - DNA, 25 bp, Rattus norvegicus
aagacactgaccacactgtttatta

SEQ ID NO: 33808 - DNA, 25 bp, Rattus norvegicus
aagacactgacctcactgtttatta

SEQ ID NO: 33809 - DNA, 25 bp, Rattus norvegicus
aagacactgagactggctatccttc

SEQ ID NO: 33810 - DNA, 25 bp, Rattus norvegicus
aagacactgagagtggctatccttc

SEQ ID NO: 33811 - DNA, 25 bp, Rattus norvegicus
aagacactgagcctgttcaacttaa

SEQ ID NO: 33812 - DNA, 25 bp, Rattus norvegicus
aagacactgagcgtgttcaacttaa

SEQ ID NO: 33813 - DNA, 25 bp, Rattus norvegicus
aagacactgcctagagacacccaag

SEQ ID NO: 33814 - DNA, 25 bp, Rattus norvegicus
aagacactgccttgagacacccaag

SEQ ID NO: 33815 - DNA, 25 bp, Rattus norvegicus
aagacactgctaaggccttggttct

SEQ ID NO: 33816 - DNA, 25 bp, Rattus norvegicus
aagacactgctatggccttggttct

SEQ ID NO: 33817 - DNA, 25 bp, Rattus norvegicus
aagacactggcaccctggcctggag

SEQ ID NO: 33818 - DNA, 25 bp, Rattus norvegicus
aagacactggcagcctggcctggag

SEQ ID NO: 33819 - DNA, 25 bp, Rattus norvegicus
aagacactggctcgagagagacgca

SEQ ID NO: 33820 - DNA, 25 bp, Rattus norvegicus
aagacactggctggagagagacgca

SEQ ID NO: 33821 - DNA, 25 bp, Rattus norvegicus
aagacactgggacagtctcctctgt

SEQ ID NO: 33822 - DNA, 25 bp, Rattus norvegicus
aagacactgggagagtctcctctgt

SEQ ID NO: 33823 - DNA, 25 bp, Rattus norvegicus
aagacactggtaagaaaggtacaat

SEQ ID NO: 33824 - DNA, 25 bp, Rattus norvegicus
aagacactggtatgaaaggtacaat

SEQ ID NO: 33825 - DNA, 25 bp, Rattus norvegicus
aagacactggtcagtggaagccacc

SEQ ID NO: 33826 - DNA, 25 bp, Rattus norvegicus
aagacactggtctgtggaagccacc

SEQ ID NO: 33827 - DNA, 25 bp, Rattus norvegicus
aagacactggtgaatctcagaatgg

SEQ ID NO: 33828 - DNA, 25 bp, Rattus norvegicus
aagacactggtgtatctcagaatgg

SEQ ID NO: 33829 - DNA, 25 bp, Rattus norvegicus
aagacactgttaactgtcacgctta

SEQ ID NO: 33830 - DNA, 25 bp, Rattus norvegicus
aagacactgttatctgtcacgctta

SEQ ID NO: 33831 - DNA, 25 bp, Rattus norvegicus
aagacacttagcatggcactcaggt

SEQ ID NO: 33832 - DNA, 25 bp, Rattus norvegicus
aagacacttagcttggcactcaggt

SEQ ID NO: 33833 - DNA, 25 bp, Rattus norvegicus
aagacacttcgtattcccaaagctg

SEQ ID NO: 33834 - DNA, 25 bp, Rattus norvegicus
aagacacttcgttttcccaaagctg

SEQ ID NO: 33835 - DNA, 25 bp, Rattus norvegicus
aagacacttgcgctttcatgccttt

SEQ ID NO: 33836 - DNA, 25 bp, Rattus norvegicus
aagacacttgcggtttcatgccttt

SEQ ID NO: 33837 - DNA, 25 bp, Rattus norvegicus
aagacacttgggaacctctgaggag

SEQ ID NO: 33838 - DNA, 25 bp, Rattus norvegicus
aagacacttgggtacctctgaggag

SEQ ID NO: 33839 - DNA, 25 bp, Rattus norvegicus
aagacacttggtatatgtgaaagca

SEQ ID NO: 33840 - DNA, 25 bp, Rattus norvegicus
aagacacttggtttatgtgaaagca

SEQ ID NO: 33841 - DNA, 25 bp, Rattus norvegicus
aagacacttgttacttgcctacttg

SEQ ID NO: 33842 - DNA, 25 bp, Rattus norvegicus
aagacacttgtttcttgcctacttg

SEQ ID NO: 33843 - DNA, 25 bp, Rattus norvegicus
aagacacttttgcagctgacagaac

SEQ ID NO: 33844 - DNA, 25 bp, Rattus norvegicus
aagacacttttggagctgacagaac

SEQ ID NO: 33845 - DNA, 25 bp, Rattus norvegicus
aagacagaagcaaagcctgcctctc

SEQ ID NO: 33846 - DNA, 25 bp, Rattus norvegicus
aagacagaagcaccggtggccgcca

SEQ ID NO: 33847 - DNA, 25 bp, Rattus norvegicus
aagacagaagcagcggtggccgcca

SEQ ID NO: 33848 - DNA, 25 bp, Rattus norvegicus
aagacagaagcatagcctgcctctc

SEQ ID NO: 33849 - DNA, 25 bp, Rattus norvegicus
aagacagaagctcctccttcatcaa

SEQ ID NO: 33850 - DNA, 25 bp, Rattus norvegicus
aagacagaagctgctccttcatcaa

SEQ ID NO: 33851 - DNA, 25 bp, Rattus norvegicus
aagacagaaggtcctcgttgccatc

SEQ ID NO: 33852 - DNA, 25 bp, Rattus norvegicus
aagacagaaggtgctcgttgccatc

SEQ ID NO: 33853 - DNA, 25 bp, Rattus norvegicus
aagacagacagaacccatgacagat

SEQ ID NO: 33854 - DNA, 25 bp, Rattus norvegicus
aagacagacagacatctgccgacca

SEQ ID NO: 33855 - DNA, 25 bp, Rattus norvegicus
aagacagacagagatctgccgacca

SEQ ID NO: 33856 - DNA, 25 bp, Rattus norvegicus
aagacagacagatcccatgacagat

SEQ ID NO: 33857 - DNA, 25 bp, Rattus norvegicus
aagacagaccagactcttctgaggg

SEQ ID NO: 33858 - DNA, 25 bp, Rattus norvegicus
aagacagaccagtctcttctgaggg

SEQ ID NO: 33859 - DNA, 25 bp, Rattus norvegicus
aagacagaccctaggtaacaggata

SEQ ID NO: 33860 - DNA, 25 bp, Rattus norvegicus
aagacagacccttggtaacaggata

SEQ ID NO: 33861 - DNA, 25 bp, Rattus norvegicus
aagacagacctcatggcctttagcc

SEQ ID NO: 33862 - DNA, 25 bp, Rattus norvegicus
aagacagacctcttggcctttagcc

SEQ ID NO: 33863 - DNA, 25 bp, Rattus norvegicus
aagacagactgtagagactccacca

SEQ ID NO: 33864 - DNA, 25 bp, Rattus norvegicus
aagacagactgttgagactccacca

SEQ ID NO: 33865 - DNA, 25 bp, Rattus norvegicus
aagacagacttcaacttcatctcct

SEQ ID NO: 33866 - DNA, 25 bp, Rattus norvegicus
aagacagacttctacttcatctcct

SEQ ID NO: 33867 - DNA, 25 bp, Rattus norvegicus
aagacagaggccagatcatctctct

SEQ ID NO: 33868 - DNA, 25 bp, Rattus norvegicus
aagacagaggcctgatcatctctct

SEQ ID NO: 33869 - DNA, 25 bp, Rattus norvegicus
aagacagaggttccttctccatgtg

SEQ ID NO: 33870 - DNA, 25 bp, Rattus norvegicus
aagacagaggttgcttctccatgtg

SEQ ID NO: 33871 - DNA, 25 bp, Rattus norvegicus
aagacagagtgaactggctcccagc

SEQ ID NO: 33872 - DNA, 25 bp, Rattus norvegicus
aagacagagtgatctggctcccagc

SEQ ID NO: 33873 - DNA, 25 bp, Rattus norvegicus
aagacagatgccctgccagacggag

SEQ ID NO: 33874 - DNA, 25 bp, Rattus norvegicus
aagacagatgccgtgccagacggag

SEQ ID NO: 33875 - DNA, 25 bp, Rattus norvegicus
aagacagatttacgagctatcaggg

SEQ ID NO: 33876 - DNA, 25 bp, Rattus norvegicus
aagacagatttaggagctatcaggg

SEQ ID NO: 33877 - DNA, 25 bp, Rattus norvegicus
aagacagcaacaacctgtgcctaca

SEQ ID NO: 33878 - DNA, 25 bp, Rattus norvegicus
aagacagcaacatcctgtgcctaca

SEQ ID NO: 33879 - DNA, 25 bp, Rattus norvegicus
aagacagcaccaagggactccaaga

SEQ ID NO: 33880 - DNA, 25 bp, Rattus norvegicus
aagacagcaccatgggactccaaga

SEQ ID NO: 33881 - DNA, 25 bp, Rattus norvegicus
aagacagcaggccatgcgagcaagc

SEQ ID NO: 33882 - DNA, 25 bp, Rattus norvegicus
aagacagcaggcgatgcgagcaagc

SEQ ID NO: 33883 - DNA, 25 bp, Rattus norvegicus
aagacagcatccacactggtgactg

SEQ ID NO: 33884 - DNA, 25 bp, Rattus norvegicus
aagacagcatcctcactggtgactg

SEQ ID NO: 33885 - DNA, 25 bp, Rattus norvegicus
aagacagcatctagaactcagtcct

SEQ ID NO: 33886 - DNA, 25 bp, Rattus norvegicus
aagacagcatcttgaactcagtcct

SEQ ID NO: 33887 - DNA, 25 bp, Rattus norvegicus
aagacagccagaaggttcccggacc

SEQ ID NO: 33888 - DNA, 25 bp, Rattus norvegicus
aagacagccagatggttcccggacc

SEQ ID NO: 33889 - DNA, 25 bp, Rattus norvegicus
aagacagcccacaaaatcgcctcgg

SEQ ID NO: 33890 - DNA, 25 bp, Rattus norvegicus
aagacagcccactaaatcgcctcgg

SEQ ID NO: 33891 - DNA, 25 bp, Rattus norvegicus
aagacagcccggagcaagcagtgag

SEQ ID NO: 33892 - DNA, 25 bp, Rattus norvegicus
aagacagcccggtgcaagcagtgag

SEQ ID NO: 33893 - DNA, 25 bp, Rattus norvegicus
aagacagcctgtcttctgcagatgt

SEQ ID NO: 33894 - DNA, 25 bp, Rattus norvegicus
aagacagcctgtgttctgcagatgt

SEQ ID NO: 33895 - DNA, 25 bp, Rattus norvegicus
aagacagccttgaacagtttcatgc

SEQ ID NO: 33896 - DNA, 25 bp, Rattus norvegicus
aagacagccttgagctgacgcaaca

SEQ ID NO: 33897 - DNA, 25 bp, Rattus norvegicus
aagacagccttgtacagtttcatgc

SEQ ID NO: 33898 - DNA, 25 bp, Rattus norvegicus
aagacagccttgtgctgacgcaaca

SEQ ID NO: 33899 - DNA, 25 bp, Rattus norvegicus
aagacagcgtgtagtgccctggcct

SEQ ID NO: 33900 - DNA, 25 bp, Rattus norvegicus
aagacagcgtgttgtgccctggcct

SEQ ID NO: 33901 - DNA, 25 bp, Rattus norvegicus
aagacagcgtttccagacactgcat

SEQ ID NO: 33902 - DNA, 25 bp, Rattus norvegicus
aagacagcgtttgcagacactgcat

SEQ ID NO: 33903 - DNA, 25 bp, Rattus norvegicus
aagacagctccccagtcggtacaag

SEQ ID NO: 33904 - DNA, 25 bp, Rattus norvegicus
aagacagctcccgagtcggtacaag

SEQ ID NO: 33905 - DNA, 25 bp, Rattus norvegicus
aagacagctgcgctgtactcccata

SEQ ID NO: 33906 - DNA, 25 bp, Rattus norvegicus
aagacagctgcggtgtactcccata

SEQ ID NO: 33907 - DNA, 25 bp, Rattus norvegicus
aagacagctggtcaggtccctgctc

SEQ ID NO: 33908 - DNA, 25 bp, Rattus norvegicus
aagacagctggtgaggtccctgctc

SEQ ID NO: 33909 - DNA, 25 bp, Rattus norvegicus
aagacagcttctcggacgaggccaa

SEQ ID NO: 33910 - DNA, 25 bp, Rattus norvegicus
aagacagcttctgggacgaggccaa

SEQ ID NO: 33911 - DNA, 25 bp, Rattus norvegicus
aagacagctttcatcggttgtgcag

SEQ ID NO: 33912 - DNA, 25 bp, Rattus norvegicus
aagacagctttcttcggttgtgcag

SEQ ID NO: 33913 - DNA, 25 bp, Rattus norvegicus
aagacaggaagaacctactgcgact

SEQ ID NO: 33914 - DNA, 25 bp, Rattus norvegicus
aagacaggaagatcctactgcgact

SEQ ID NO: 33915 - DNA, 25 bp, Rattus norvegicus
aagacaggacctatgcaacgcacag

SEQ ID NO: 33916 - DNA, 25 bp, Rattus norvegicus
aagacaggacctttgcaacgcacag

SEQ ID NO: 33917 - DNA, 25 bp, Rattus norvegicus
aagacaggacttcagcagccaattg

SEQ ID NO: 33918 - DNA, 25 bp, Rattus norvegicus
aagacaggacttgagcagccaattg

SEQ ID NO: 33919 - DNA, 25 bp, Rattus norvegicus
aagacaggcactaccccaaaaggat

SEQ ID NO: 33920 - DNA, 25 bp, Rattus norvegicus
aagacaggcacttccccaaaaggat

SEQ ID NO: 33921 - DNA, 25 bp, Rattus norvegicus
aagacaggccaaaacttcccgagta

SEQ ID NO: 33922 - DNA, 25 bp, Rattus norvegicus
aagacaggccaatacttcccgagta

SEQ ID NO: 33923 - DNA, 25 bp, Rattus norvegicus
aagacaggccgtcttcaacaggctc

SEQ ID NO: 33924 - DNA, 25 bp, Rattus norvegicus
aagacaggccgtgttcaacaggctc

SEQ ID NO: 33925 - DNA, 25 bp, Rattus norvegicus
aagacaggcctcatccagagtcaaa

SEQ ID NO: 33926 - DNA, 25 bp, Rattus norvegicus
aagacaggcctcttccagagtcaaa

SEQ ID NO: 33927 - DNA, 25 bp, Rattus norvegicus
aagacaggcctgatcttggaaggtt

SEQ ID NO: 33928 - DNA, 25 bp, Rattus norvegicus
aagacaggcctgttcttggaaggtt

SEQ ID NO: 33929 - DNA, 25 bp, Rattus norvegicus
aagacagggcctacaggtgcccagg

SEQ ID NO: 33930 - DNA, 25 bp, Rattus norvegicus
aagacagggccttcaggtgcccagg

SEQ ID NO: 33931 - DNA, 25 bp, Rattus norvegicus
aagacagggcgtcgctcctgttctc

SEQ ID NO: 33932 - DNA, 25 bp, Rattus norvegicus
aagacagggcgtggctcctgttctc

SEQ ID NO: 33933 - DNA, 25 bp, Rattus norvegicus
aagacagggctcaggttcaagccag

SEQ ID NO: 33934 - DNA, 25 bp, Rattus norvegicus
aagacagggctctggttcaagccag

SEQ ID NO: 33935 - DNA, 25 bp, Rattus norvegicus
aagacagggctgagttccctgacga

SEQ ID NO: 33936 - DNA, 25 bp, Rattus norvegicus
aagacagggctgtgttccctgacga

SEQ ID NO: 33937 - DNA, 25 bp, Rattus norvegicus
aagacagggcttctcttaggctcac

SEQ ID NO: 33938 - DNA, 25 bp, Rattus norvegicus
aagacagggcttgtcttaggctcac

SEQ ID NO: 33939 - DNA, 25 bp, Rattus norvegicus
aagacagggtccacagaaatcgctg

SEQ ID NO: 33940 - DNA, 25 bp, Rattus norvegicus
aagacagggtcctcagaaatcgctg

SEQ ID NO: 33941 - DNA, 25 bp, Rattus norvegicus
aagacaggttccctggctgccagga

SEQ ID NO: 33942 - DNA, 25 bp, Rattus norvegicus
aagacaggttccgtggctgccagga

SEQ ID NO: 33943 - DNA, 25 bp, Rattus norvegicus
aagacagtactgctgcatgtcctgt

SEQ ID NO: 33944 - DNA, 25 bp, Rattus norvegicus
aagacagtactggtgcatgtcctgt

SEQ ID NO: 33945 - DNA, 25 bp, Rattus norvegicus
aagacagtagatatctggtcccaga

SEQ ID NO: 33946 - DNA, 25 bp, Rattus norvegicus
aagacagtagatttctggtcccaga

SEQ ID NO: 33947 - DNA, 25 bp, Rattus norvegicus
aagacagtagtcctcacatgcagaa

SEQ ID NO: 33948 - DNA, 25 bp, Rattus norvegicus
aagacagtagtcgtcacatgcagaa

SEQ ID NO: 33949 - DNA, 25 bp, Rattus norvegicus
aagacagtccacattttagcatgtg

SEQ ID NO: 33950 - DNA, 25 bp, Rattus norvegicus
aagacagtccactttttagcatgtg

SEQ ID NO: 33951 - DNA, 25 bp, Rattus norvegicus
aagacagtcccaatgtgtgcttctc

SEQ ID NO: 33952 - DNA, 25 bp, Rattus norvegicus
aagacagtcccattgtgtgcttctc

SEQ ID NO: 33953 - DNA, 25 bp, Rattus norvegicus
aagacagtccggagcagctacgagt

SEQ ID NO: 33954 - DNA, 25 bp, Rattus norvegicus
aagacagtccggtgcagctacgagt

SEQ ID NO: 33955 - DNA, 25 bp, Rattus norvegicus
aagacagtcctcctgaagtggctgg

SEQ ID NO: 33956 - DNA, 25 bp, Rattus norvegicus
aagacagtcctcgtgaagtggctgg

SEQ ID NO: 33957 - DNA, 25 bp, Rattus norvegicus
aagacagtctcactttaatgccctc

SEQ ID NO: 33958 - DNA, 25 bp, Rattus norvegicus
aagacagtctcagtttaatgccctc

SEQ ID NO: 33959 - DNA, 25 bp, Rattus norvegicus
aagacagtctcgagagagggctcat

SEQ ID NO: 33960 - DNA, 25 bp, Rattus norvegicus
aagacagtctcgtgagagggctcat

SEQ ID NO: 33961 - DNA, 25 bp, Rattus norvegicus
aagacagtctctatgcaggaccctg

SEQ ID NO: 33962 - DNA, 25 bp, Rattus norvegicus
aagacagtctctttgcaggaccctg

SEQ ID NO: 33963 - DNA, 25 bp, Rattus norvegicus
aagacagtgaccagctacccggagc

SEQ ID NO: 33964 - DNA, 25 bp, Rattus norvegicus
aagacagtgacccagtatcatttgg

SEQ ID NO: 33965 - DNA, 25 bp, Rattus norvegicus
aagacagtgaccgagtatcatttgg

SEQ ID NO: 33966 - DNA, 25 bp, Rattus norvegicus
aagacagtgacctgctacccggagc

SEQ ID NO: 33967 - DNA, 25 bp, Rattus norvegicus
aagacagtgactacctcattgtccc

SEQ ID NO: 33968 - DNA, 25 bp, Rattus norvegicus
aagacagtgacttcctcattgtccc

SEQ ID NO: 33969 - DNA, 25 bp, Rattus norvegicus
aagacagtgcacaagaccagtcatt

SEQ ID NO: 33970 - DNA, 25 bp, Rattus norvegicus
aagacagtgcactagaccagtcatt

SEQ ID NO: 33971 - DNA, 25 bp, Rattus norvegicus
aagacagtgccccagagactcccat

SEQ ID NO: 33972 - DNA, 25 bp, Rattus norvegicus
aagacagtgcccgagagactcccat

SEQ ID NO: 33973 - DNA, 25 bp, Rattus norvegicus
aagacagtgctcatttctcatccag

SEQ ID NO: 33974 - DNA, 25 bp, Rattus norvegicus
aagacagtgctcttttctcatccag

SEQ ID NO: 33975 - DNA, 25 bp, Rattus norvegicus
aagacagtgcttcagactctgagct

SEQ ID NO: 33976 - DNA, 25 bp, Rattus norvegicus
aagacagtgcttgagactctgagct

SEQ ID NO: 33977 - DNA, 25 bp, Rattus norvegicus
aagacagtttctctaccggctgcaa

SEQ ID NO: 33978 - DNA, 25 bp, Rattus norvegicus
aagacagtttctgtaccggctgcaa

SEQ ID NO: 33979 - DNA, 25 bp, Rattus norvegicus
aagacagttttccatgctggcacgt

SEQ ID NO: 33980 - DNA, 25 bp, Rattus norvegicus
aagacagttttcgatgctggcacgt

SEQ ID NO: 33981 - DNA, 25 bp, Rattus norvegicus
aagacatacaacatgggccatccaa

SEQ ID NO: 33982 - DNA, 25 bp, Rattus norvegicus
aagacatacaacttgggccatccaa

SEQ ID NO: 33983 - DNA, 25 bp, Rattus norvegicus
aagacatagcttactgtacccctaa

SEQ ID NO: 33984 - DNA, 25 bp, Rattus norvegicus
aagacatagctttctgtacccctaa

SEQ ID NO: 33985 - DNA, 25 bp, Rattus norvegicus
aagacatatattatggttcccacga

SEQ ID NO: 33986 - DNA, 25 bp, Rattus norvegicus
aagacatatattttggttcccacga

SEQ ID NO: 33987 - DNA, 25 bp, Rattus norvegicus
aagacatcaagcatggttctcccgg

SEQ ID NO: 33988 - DNA, 25 bp, Rattus norvegicus
aagacatcaagcttggttctcccgg

SEQ ID NO: 33989 - DNA, 25 bp, Rattus norvegicus
aagacatccaaaccctcctgttgga

SEQ ID NO: 33990 - DNA, 25 bp, Rattus norvegicus
aagacatccaaagcctcctgttgga

SEQ ID NO: 33991 - DNA, 25 bp, Rattus norvegicus
aagacatccagtaggctcgccggat

SEQ ID NO: 33992 - DNA, 25 bp, Rattus norvegicus
aagacatccagttggctcgccggat

SEQ ID NO: 33993 - DNA, 25 bp, Rattus norvegicus
aagacatcccaaaagctgcactatc

SEQ ID NO: 33994 - DNA, 25 bp, Rattus norvegicus
aagacatcccaatagctgcactatc

SEQ ID NO: 33995 - DNA, 25 bp, Rattus norvegicus
aagacatccccactgaagggcatta

SEQ ID NO: 33996 - DNA, 25 bp, Rattus norvegicus
aagacatccccagtgaagggcatta

SEQ ID NO: 33997 - DNA, 25 bp, Rattus norvegicus
aagacatccgagacttggctgccag

SEQ ID NO: 33998 - DNA, 25 bp, Rattus norvegicus
aagacatccgagtcttggctgccag

SEQ ID NO: 33999 - DNA, 25 bp, Rattus norvegicus
aagacatcctgcacagaagcctgta

SEQ ID NO: 34000 - DNA, 25 bp, Rattus norvegicus
aagacatcctgctcagaagcctgta

SEQ ID NO: 34001 - DNA, 25 bp, Rattus norvegicus
aagacatcgccaagcatctcaagat

SEQ ID NO: 34002 - DNA, 25 bp, Rattus norvegicus
aagacatcgccatgcatctcaagat

SEQ ID NO: 34003 - DNA, 25 bp, Rattus norvegicus
aagacatcggacaccctggaactgg

SEQ ID NO: 34004 - DNA, 25 bp, Rattus norvegicus
aagacatcggactccctggaactgg

SEQ ID NO: 34005 - DNA, 25 bp, Rattus norvegicus
aagacatctccaatgcattatcaca

SEQ ID NO: 34006 - DNA, 25 bp, Rattus norvegicus
aagacatctccattgcattatcaca

SEQ ID NO: 34007 - DNA, 25 bp, Rattus norvegicus
aagacatctgagagcgagccgtcct

SEQ ID NO: 34008 - DNA, 25 bp, Rattus norvegicus
aagacatctgagtgcgagccgtcct

SEQ ID NO: 34009 - DNA, 25 bp, Rattus norvegicus
aagacatcttagaagaccaccatgt

SEQ ID NO: 34010 - DNA, 25 bp, Rattus norvegicus
aagacatcttagtagaccaccatgt

SEQ ID NO: 34011 - DNA, 25 bp, Rattus norvegicus
aagacatcttgcagtcaatgctggg

SEQ ID NO: 34012 - DNA, 25 bp, Rattus norvegicus
aagacatcttgctgtcaatgctggg

SEQ ID NO: 34013 - DNA, 25 bp, Rattus norvegicus
aagacatgacgtctcccgggaacat

SEQ ID NO: 34014 - DNA, 25 bp, Rattus norvegicus
aagacatgacgtgtcccgggaacat

SEQ ID NO: 34015 - DNA, 25 bp, Rattus norvegicus
aagacatgcaagagccctgggcgta

SEQ ID NO: 34016 - DNA, 25 bp, Rattus norvegicus
aagacatgcaagtgccctgggcgta

SEQ ID NO: 34017 - DNA, 25 bp, Rattus norvegicus
aagacatgcagtaccttacccctga

SEQ ID NO: 34018 - DNA, 25 bp, Rattus norvegicus
aagacatgcagttccttacccctga

SEQ ID NO: 34019 - DNA, 25 bp, Rattus norvegicus
aagacatggacaccgtcagacctcc

SEQ ID NO: 34020 - DNA, 25 bp, Rattus norvegicus
aagacatggacagcgtcagacctcc

SEQ ID NO: 34021 - DNA, 25 bp, Rattus norvegicus
aagacatggagacctctgcttggct

SEQ ID NO: 34022 - DNA, 25 bp, Rattus norvegicus
aagacatggagagctctgcttggct

SEQ ID NO: 34023 - DNA, 25 bp, Rattus norvegicus
aagacatggagtccgcagacacaca

SEQ ID NO: 34024 - DNA, 25 bp, Rattus norvegicus
aagacatggagtgcgcagacacaca

SEQ ID NO: 34025 - DNA, 25 bp, Rattus norvegicus
aagacatggcgacagcacagcacgg

SEQ ID NO: 34026 - DNA, 25 bp, Rattus norvegicus
aagacatggcgagagcacagcacgg

SEQ ID NO: 34027 - DNA, 25 bp, Rattus norvegicus
aagacatgggccaggacacgtctca

SEQ ID NO: 34028 - DNA, 25 bp, Rattus norvegicus
aagacatgggcctggacacgtctca

SEQ ID NO: 34029 - DNA, 25 bp, Rattus norvegicus
aagacatgtcacaggctgcagacca

SEQ ID NO: 34030 - DNA, 25 bp, Rattus norvegicus
aagacatgtcactggctgcagacca

SEQ ID NO: 34031 - DNA, 25 bp, Rattus norvegicus
aagacatgtccgaagactacaacga

SEQ ID NO: 34032 - DNA, 25 bp, Rattus norvegicus
aagacatgtccgtagactacaacga

SEQ ID NO: 34033 - DNA, 25 bp, Rattus norvegicus
aagacatgttctcggcttcactcaa

SEQ ID NO: 34034 - DNA, 25 bp, Rattus norvegicus
aagacatgttctgggcttcactcaa

SEQ ID NO: 34035 - DNA, 25 bp, Rattus norvegicus
aagacatgttttctagtgccccttt

SEQ ID NO: 34036 - DNA, 25 bp, Rattus norvegicus
aagacatgttttgtagtgccccttt

SEQ ID NO: 34037 - DNA, 25 bp, Rattus norvegicus
aagacattaaacagcttctagcaaa

SEQ ID NO: 34038 - DNA, 25 bp, Rattus norvegicus
aagacattaaactgcttctagcaaa

SEQ ID NO: 34039 - DNA, 25 bp, Rattus norvegicus
aagacattacctcgcttcaatcaag

SEQ ID NO: 34040 - DNA, 25 bp, Rattus norvegicus
aagacattacctggcttcaatcaag

SEQ ID NO: 34041 - DNA, 25 bp, Rattus norvegicus
aagacattccagaccttggaggtaa

SEQ ID NO: 34042 - DNA, 25 bp, Rattus norvegicus
aagacattccagtccttggaggtaa

SEQ ID NO: 34043 - DNA, 25 bp, Rattus norvegicus
aagacattccgcatgcagatttgag

SEQ ID NO: 34044 - DNA, 25 bp, Rattus norvegicus
aagacattccgcttgcagatttgag

SEQ ID NO: 34045 - DNA, 25 bp, Rattus norvegicus
aagacattctccctctgtgtttgtg

SEQ ID NO: 34046 - DNA, 25 bp, Rattus norvegicus
aagacattctccgtctgtgtttgtg

SEQ ID NO: 34047 - DNA, 25 bp, Rattus norvegicus
aagacattctcgagcgacctctttc

SEQ ID NO: 34048 - DNA, 25 bp, Rattus norvegicus
aagacattctcgtgcgacctctttc

SEQ ID NO: 34049 - DNA, 25 bp, Rattus norvegicus
aagacattctggctgactccattta

SEQ ID NO: 34050 - DNA, 25 bp, Rattus norvegicus
aagacattctgggtgactccattta

SEQ ID NO: 34051 - DNA, 25 bp, Rattus norvegicus
aagacattgattctacttctggaac

SEQ ID NO: 34052 - DNA, 25 bp, Rattus norvegicus
aagacattgattgtacttctggaac

SEQ ID NO: 34053 - DNA, 25 bp, Rattus norvegicus
aagacattgcagacccaactgaggt

SEQ ID NO: 34054 - DNA, 25 bp, Rattus norvegicus
aagacattgcagtcccaactgaggt

SEQ ID NO: 34055 - DNA, 25 bp, Rattus norvegicus
aagacattttctcggcaaactcatg

SEQ ID NO: 34056 - DNA, 25 bp, Rattus norvegicus
aagacattttctgggcaaactcatg

SEQ ID NO: 34057 - DNA, 25 bp, Rattus norvegicus
aagacattttgaccatactgtaaac

SEQ ID NO: 34058 - DNA, 25 bp, Rattus norvegicus
aagacattttgagcatactgtaaac

SEQ ID NO: 34059 - DNA, 25 bp, Rattus norvegicus
aagacattttgtattcagaacgttg

SEQ ID NO: 34060 - DNA, 25 bp, Rattus norvegicus
aagacattttgttttcagaacgttg

SEQ ID NO: 34061 - DNA, 25 bp, Rattus norvegicus
aagaccaaactcaggcttcacagtt

SEQ ID NO: 34062 - DNA, 25 bp, Rattus norvegicus
aagaccaaactctggcttcacagtt

SEQ ID NO: 34063 - DNA, 25 bp, Rattus norvegicus
aagaccaaaggcatgctgctaccta

SEQ ID NO: 34064 - DNA, 25 bp, Rattus norvegicus
aagaccaaaggcttgctgctaccta

SEQ ID NO: 34065 - DNA, 25 bp, Rattus norvegicus
aagaccaagatgatggtcccctgct

SEQ ID NO: 34066 - DNA, 25 bp, Rattus norvegicus
aagaccaagatgttggtcccctgct

SEQ ID NO: 34067 - DNA, 25 bp, Rattus norvegicus
aagaccaagccacacacagcactaa

SEQ ID NO: 34068 - DNA, 25 bp, Rattus norvegicus
aagaccaagccacgctcatgccaga

SEQ ID NO: 34069 - DNA, 25 bp, Rattus norvegicus
aagaccaagccagacacagcactaa

SEQ ID NO: 34070 - DNA, 25 bp, Rattus norvegicus
aagaccaagccaggctcatgccaga

SEQ ID NO: 34071 - DNA, 25 bp, Rattus norvegicus
aagaccaagctgaaatctcttgtag

SEQ ID NO: 34072 - DNA, 25 bp, Rattus norvegicus
aagaccaagctgtaatctcttgtag

SEQ ID NO: 34073 - DNA, 25 bp, Rattus norvegicus
aagaccaatcagatggctgccacca

SEQ ID NO: 34074 - DNA, 25 bp, Rattus norvegicus
aagaccaatcagttggctgccacca

SEQ ID NO: 34075 - DNA, 25 bp, Rattus norvegicus
aagaccacaaagatctcccagcagt

SEQ ID NO: 34076 - DNA, 25 bp, Rattus norvegicus
aagaccacaaagttctcccagcagt

SEQ ID NO: 34077 - DNA, 25 bp, Rattus norvegicus
aagaccacaatgcatcacacggcta

SEQ ID NO: 34078 - DNA, 25 bp, Rattus norvegicus
aagaccacaatggatcacacggcta

SEQ ID NO: 34079 - DNA, 25 bp, Rattus norvegicus
aagaccacacatagccaccgtattt

SEQ ID NO: 34080 - DNA, 25 bp, Rattus norvegicus
aagaccacacattgccaccgtattt

SEQ ID NO: 34081 - DNA, 25 bp, Rattus norvegicus
aagaccacagatagatccctaagga

SEQ ID NO: 34082 - DNA, 25 bp, Rattus norvegicus
aagaccacagattgatccctaagga

SEQ ID NO: 34083 - DNA, 25 bp, Rattus norvegicus
aagaccacaggacacaggacactga

SEQ ID NO: 34084 - DNA, 25 bp, Rattus norvegicus
aagaccacaggagacaggacactga

SEQ ID NO: 34085 - DNA, 25 bp, Rattus norvegicus
aagaccacagtgacgacatatccag

SEQ ID NO: 34086 - DNA, 25 bp, Rattus norvegicus
aagaccacagtgtcgacatatccag

SEQ ID NO: 34087 - DNA, 25 bp, Rattus norvegicus
aagaccaccactccatgtgtactga

SEQ ID NO: 34088 - DNA, 25 bp, Rattus norvegicus
aagaccaccactgcatgtgtactga

SEQ ID NO: 34089 - DNA, 25 bp, Rattus norvegicus
aagaccactcatacagcggaacctg

SEQ ID NO: 34090 - DNA, 25 bp, Rattus norvegicus
aagaccactcattcagcggaacctg

SEQ ID NO: 34091 - DNA, 25 bp, Rattus norvegicus
aagaccactgatagcttttctccat

SEQ ID NO: 34092 - DNA, 25 bp, Rattus norvegicus
aagaccactgatctctcagtgccct

SEQ ID NO: 34093 - DNA, 25 bp, Rattus norvegicus
aagaccactgatgtctcagtgccct

SEQ ID NO: 34094 - DNA, 25 bp, Rattus norvegicus
aagaccactgattgcttttctccat

SEQ ID NO: 34095 - DNA, 25 bp, Rattus norvegicus
aagaccactggcaaatctacgaaga

SEQ ID NO: 34096 - DNA, 25 bp, Rattus norvegicus
aagaccactggctaatctacgaaga

SEQ ID NO: 34097 - DNA, 25 bp, Rattus norvegicus
aagaccactgttctgcaatgcttgg

SEQ ID NO: 34098 - DNA, 25 bp, Rattus norvegicus
aagaccactgttgtgcaatgcttgg

SEQ ID NO: 34099 - DNA, 25 bp, Rattus norvegicus
aagaccagagagatgtgtgaccact

SEQ ID NO: 34100 - DNA, 25 bp, Rattus norvegicus
aagaccagagagttgtgtgaccact

SEQ ID NO: 34101 - DNA, 25 bp, Rattus norvegicus
aagaccagaggacgttctcctgcag

SEQ ID NO: 34102 - DNA, 25 bp, Rattus norvegicus
aagaccagaggaggttctcctgcag

SEQ ID NO: 34103 - DNA, 25 bp, Rattus norvegicus
aagaccagagtcacccaagagctac

SEQ ID NO: 34104 - DNA, 25 bp, Rattus norvegicus
aagaccagagtctcccaagagctac

SEQ ID NO: 34105 - DNA, 25 bp, Rattus norvegicus
aagaccagcccaaatgcaggagcct

SEQ ID NO: 34106 - DNA, 25 bp, Rattus norvegicus
aagaccagcccatatgcaggagcct

SEQ ID NO: 34107 - DNA, 25 bp, Rattus norvegicus
aagaccagcctaagcaagacctgtc

SEQ ID NO: 34108 - DNA, 25 bp, Rattus norvegicus
aagaccagcctatgcaagacctgtc

SEQ ID NO: 34109 - DNA, 25 bp, Rattus norvegicus
aagaccagctgaagttaatccacca

SEQ ID NO: 34110 - DNA, 25 bp, Rattus norvegicus
aagaccagctgatgttaatccacca

SEQ ID NO: 34111 - DNA, 25 bp, Rattus norvegicus
aagaccagctgcagggctacgagag

SEQ ID NO: 34112 - DNA, 25 bp, Rattus norvegicus
aagaccagctgctgggctacgagag

SEQ ID NO: 34113 - DNA, 25 bp, Rattus norvegicus
aagaccagctgtcggtggcatcatt

SEQ ID NO: 34114 - DNA, 25 bp, Rattus norvegicus
aagaccagctgtgggtggcatcatt

SEQ ID NO: 34115 - DNA, 25 bp, Rattus norvegicus
aagaccagcttcaacatgggcctaa

SEQ ID NO: 34116 - DNA, 25 bp, Rattus norvegicus
aagaccagcttctacatgggcctaa

SEQ ID NO: 34117 - DNA, 25 bp, Rattus norvegicus
aagaccaggattaactgcactaggt

SEQ ID NO: 34118 - DNA, 25 bp, Rattus norvegicus
aagaccaggatttactgcactaggt

SEQ ID NO: 34119 - DNA, 25 bp, Rattus norvegicus
aagaccaggcagactgttcttgcta

SEQ ID NO: 34120 - DNA, 25 bp, Rattus norvegicus
aagaccaggcagtctgttcttgcta

SEQ ID NO: 34121 - DNA, 25 bp, Rattus norvegicus
aagaccaggcctacagagcatctga

SEQ ID NO: 34122 - DNA, 25 bp, Rattus norvegicus
aagaccaggccttcagagcatctga

SEQ ID NO: 34123 - DNA, 25 bp, Rattus norvegicus
aagaccagggccagaaatcctcgac

SEQ ID NO: 34124 - DNA, 25 bp, Rattus norvegicus
aagaccagggcctgaaatcctcgac

SEQ ID NO: 34125 - DNA, 25 bp, Rattus norvegicus
aagaccagggtcctgagcatccagt

SEQ ID NO: 34126 - DNA, 25 bp, Rattus norvegicus
aagaccagggtcgtgagcatccagt

SEQ ID NO: 34127 - DNA, 25 bp, Rattus norvegicus
aagaccaggtggagatacacagcac

SEQ ID NO: 34128 - DNA, 25 bp, Rattus norvegicus
aagaccaggtggtgatacacagcac

SEQ ID NO: 34129 - DNA, 25 bp, Rattus norvegicus
aagaccaggttacagcgggtgccat

SEQ ID NO: 34130 - DNA, 25 bp, Rattus norvegicus
aagaccaggttagagcgggtgccat

SEQ ID NO: 34131 - DNA, 25 bp, Rattus norvegicus
aagaccaggtttaacaccatctcct

SEQ ID NO: 34132 - DNA, 25 bp, Rattus norvegicus
aagaccaggttttacaccatctcct

SEQ ID NO: 34133 - DNA, 25 bp, Rattus norvegicus
aagaccagtaataccagcagtcaag

SEQ ID NO: 34134 - DNA, 25 bp, Rattus norvegicus
aagaccagtaattccagcagtcaag

SEQ ID NO: 34135 - DNA, 25 bp, Rattus norvegicus
aagaccagtctgaaaccctgacgtg

SEQ ID NO: 34136 - DNA, 25 bp, Rattus norvegicus
aagaccagtctgtaaccctgacgtg

SEQ ID NO: 34137 - DNA, 25 bp, Rattus norvegicus
aagaccagtggccattctacacttg

SEQ ID NO: 34138 - DNA, 25 bp, Rattus norvegicus
aagaccagtggcgattctacacttg

SEQ ID NO: 34139 - DNA, 25 bp, Rattus norvegicus
aagaccagttctacctgttggctgc

SEQ ID NO: 34140 - DNA, 25 bp, Rattus norvegicus
aagaccagttcttcctgttggctgc

SEQ ID NO: 34141 - DNA, 25 bp, Rattus norvegicus
aagaccataagtacatcctcagcgg

SEQ ID NO: 34142 - DNA, 25 bp, Rattus norvegicus
aagaccataagttcatcctcagcgg

SEQ ID NO: 34143 - DNA, 25 bp, Rattus norvegicus
aagaccatacagatttgtgctggag

SEQ ID NO: 34144 - DNA, 25 bp, Rattus norvegicus
aagaccatacagttttgtgctggag

SEQ ID NO: 34145 - DNA, 25 bp, Rattus norvegicus
aagaccatcaacctttggagagccc

SEQ ID NO: 34146 - DNA, 25 bp, Rattus norvegicus
aagaccatcaacgtttggagagccc

SEQ ID NO: 34147 - DNA, 25 bp, Rattus norvegicus
aagaccatcagcatgtatgtggcca

SEQ ID NO: 34148 - DNA, 25 bp, Rattus norvegicus
aagaccatcagcttgtatgtggcca

SEQ ID NO: 34149 - DNA, 25 bp, Rattus norvegicus
aagaccatcattctgactggatcca

SEQ ID NO: 34150 - DNA, 25 bp, Rattus norvegicus
aagaccatcattgtgactggatcca

SEQ ID NO: 34151 - DNA, 25 bp, Rattus norvegicus
aagaccatccatctgtgttcctggc

SEQ ID NO: 34152 - DNA, 25 bp, Rattus norvegicus
aagaccatccatgtgtgttcctggc

SEQ ID NO: 34153 - DNA, 25 bp, Rattus norvegicus
aagaccatcggtccaggcaaccagg

SEQ ID NO: 34154 - DNA, 25 bp, Rattus norvegicus
aagaccatcggtgcaggcaaccagg

SEQ ID NO: 34155 - DNA, 25 bp, Rattus norvegicus
aagaccatcttgaaaatcgcaaaca

SEQ ID NO: 34156 - DNA, 25 bp, Rattus norvegicus
aagaccatcttgtaaatcgcaaaca

SEQ ID NO: 34157 - DNA, 25 bp, Rattus norvegicus
aagaccatgcggaacaagctcctgt

SEQ ID NO: 34158 - DNA, 25 bp, Rattus norvegicus
aagaccatgcggtacaagctcctgt

SEQ ID NO: 34159 - DNA, 25 bp, Rattus norvegicus
aagaccatgctgaagtttgagtttc

SEQ ID NO: 34160 - DNA, 25 bp, Rattus norvegicus
aagaccatgctgtagtttgagtttc

SEQ ID NO: 34161 - DNA, 25 bp, Rattus norvegicus
aagaccatggttcccagacaagctc

SEQ ID NO: 34162 - DNA, 25 bp, Rattus norvegicus
aagaccatggttgccagacaagctc

SEQ ID NO: 34163 - DNA, 25 bp, Rattus norvegicus
aagaccattgaaaagccaaaggact

SEQ ID NO: 34164 - DNA, 25 bp, Rattus norvegicus
aagaccattgaatagccaaaggact

SEQ ID NO: 34165 - DNA, 25 bp, Rattus norvegicus
aagaccattgagattgatcatagtg

SEQ ID NO: 34166 - DNA, 25 bp, Rattus norvegicus
aagaccattgagtttgatcatagtg

SEQ ID NO: 34167 - DNA, 25 bp, Rattus norvegicus
aagaccattgttagacttggctcaa

SEQ ID NO: 34168 - DNA, 25 bp, Rattus norvegicus
aagaccattgtttgacttggctcaa

SEQ ID NO: 34169 - DNA, 25 bp, Rattus norvegicus
aagacccaagagctttgacatccta

SEQ ID NO: 34170 - DNA, 25 bp, Rattus norvegicus
aagacccaagaggtttgacatccta

SEQ ID NO: 34171 - DNA, 25 bp, Rattus norvegicus
aagacccaagttatcaggcgctatc

SEQ ID NO: 34172 - DNA, 25 bp, Rattus norvegicus
aagacccaagttttcaggcgctatc

SEQ ID NO: 34173 - DNA, 25 bp, Rattus norvegicus
aagacccaatcactacccagtgtgt

SEQ ID NO: 34174 - DNA, 25 bp, Rattus norvegicus
aagacccaatcagtacccagtgtgt

SEQ ID NO: 34175 - DNA, 25 bp, Rattus norvegicus
aagacccagaagagagagccgatga

SEQ ID NO: 34176 - DNA, 25 bp, Rattus norvegicus
aagacccagaagtgagagccgatga

SEQ ID NO: 34177 - DNA, 25 bp, Rattus norvegicus
aagacccagacaccctatgtctaaa

SEQ ID NO: 34178 - DNA, 25 bp, Rattus norvegicus
aagacccagacagcctatgtctaaa

SEQ ID NO: 34179 - DNA, 25 bp, Rattus norvegicus
aagacccagcccagatctggagagt

SEQ ID NO: 34180 - DNA, 25 bp, Rattus norvegicus
aagacccagccctgatctggagagt

SEQ ID NO: 34181 - DNA, 25 bp, Rattus norvegicus
aagacccagcctccagtcctagaga

SEQ ID NO: 34182 - DNA, 25 bp, Rattus norvegicus
aagacccagcctgcagtcctagaga

SEQ ID NO: 34183 - DNA, 25 bp, Rattus norvegicus
aagacccaggctaagttcctttctg

SEQ ID NO: 34184 - DNA, 25 bp, Rattus norvegicus
aagacccaggcttagttcctttctg

SEQ ID NO: 34185 - DNA, 25 bp, Rattus norvegicus
aagacccagggcaccttcaagaagc

SEQ ID NO: 34186 - DNA, 25 bp, Rattus norvegicus
aagacccagggctccttcaagaagc

SEQ ID NO: 34187 - DNA, 25 bp, Rattus norvegicus
aagacccaggtaccggtgatctgta

SEQ ID NO: 34188 - DNA, 25 bp, Rattus norvegicus
aagacccaggtagcggtgatctgta

SEQ ID NO: 34189 - DNA, 25 bp, Rattus norvegicus
aagacccagtctcctggacttagaa

SEQ ID NO: 34190 - DNA, 25 bp, Rattus norvegicus
aagacccagtctgctggacttagaa

SEQ ID NO: 34191 - DNA, 25 bp, Rattus norvegicus
aagacccatcctaagatgctggctg

SEQ ID NO: 34192 - DNA, 25 bp, Rattus norvegicus
aagacccatccttagatgctggctg

SEQ ID NO: 34193 - DNA, 25 bp, Rattus norvegicus
aagaccccagctctgtggagaccgt

SEQ ID NO: 34194 - DNA, 25 bp, Rattus norvegicus
aagaccccagctgtgtggagaccgt

SEQ ID NO: 34195 - DNA, 25 bp, Rattus norvegicus
aagaccccagggattctcaggctac

SEQ ID NO: 34196 - DNA, 25 bp, Rattus norvegicus
aagaccccagggtttctcaggctac

SEQ ID NO: 34197 - DNA, 25 bp, Rattus norvegicus
aagaccccagtgactatgtgcgtgc

SEQ ID NO: 34198 - DNA, 25 bp, Rattus norvegicus
aagaccccagtgtctatgtgcgtgc

SEQ ID NO: 34199 - DNA, 25 bp, Rattus norvegicus
aagaccccatgcatttaattccaac

SEQ ID NO: 34200 - DNA, 25 bp, Rattus norvegicus
aagaccccatgcttttaattccaac

SEQ ID NO: 34201 - DNA, 25 bp, Rattus norvegicus
aagaccccgacaccggctagtttag

SEQ ID NO: 34202 - DNA, 25 bp, Rattus norvegicus
aagaccccgacagcggctagtttag

SEQ ID NO: 34203 - DNA, 25 bp, Rattus norvegicus
aagacccctatgcttgggcatcttg

SEQ ID NO: 34204 - DNA, 25 bp, Rattus norvegicus
aagacccctatggttgggcatcttg

SEQ ID NO: 34205 - DNA, 25 bp, Rattus norvegicus
aagacccctgagaacctgcacattg

SEQ ID NO: 34206 - DNA, 25 bp, Rattus norvegicus
aagacccctgagagatgctgtgctg

SEQ ID NO: 34207 - DNA, 25 bp, Rattus norvegicus
aagacccctgagtacctgcacattg

SEQ ID NO: 34208 - DNA, 25 bp, Rattus norvegicus
aagacccctgagtgatgctgtgctg

SEQ ID NO: 34209 - DNA, 25 bp, Rattus norvegicus
aagaccccttgcagaatgagaacgt

SEQ ID NO: 34210 - DNA, 25 bp, Rattus norvegicus
aagaccccttgctgaatgagaacgt

SEQ ID NO: 34211 - DNA, 25 bp, Rattus norvegicus
aagacccgacttcccaaaacattgg

SEQ ID NO: 34212 - DNA, 25 bp, Rattus norvegicus
aagacccgacttgccaaaacattgg

SEQ ID NO: 34213 - DNA, 25 bp, Rattus norvegicus
aagacccgagctactgaaaactttg

SEQ ID NO: 34214 - DNA, 25 bp, Rattus norvegicus
aagacccgagcttctgaaaactttg

SEQ ID NO: 34215 - DNA, 25 bp, Rattus norvegicus
aagacccgaggcacagtcaatgcaa

SEQ ID NO: 34216 - DNA, 25 bp, Rattus norvegicus
aagacccgaggctcagtcaatgcaa

SEQ ID NO: 34217 - DNA, 25 bp, Rattus norvegicus
aagacccgccctagttgctcttcgg

SEQ ID NO: 34218 - DNA, 25 bp, Rattus norvegicus
aagacccgcccttgttgctcttcgg

SEQ ID NO: 34219 - DNA, 25 bp, Rattus norvegicus
aagacccggaagagacgcagtgctt

SEQ ID NO: 34220 - DNA, 25 bp, Rattus norvegicus
aagacccggaagtgacgcagtgctt

SEQ ID NO: 34221 - DNA, 25 bp, Rattus norvegicus
aagacccggacactacggctggtgt

SEQ ID NO: 34222 - DNA, 25 bp, Rattus norvegicus
aagacccggacagtacggctggtgt

SEQ ID NO: 34223 - DNA, 25 bp, Rattus norvegicus
aagacccgggagaagcgagatttca

SEQ ID NO: 34224 - DNA, 25 bp, Rattus norvegicus
aagacccgggagacagagcggctcc

SEQ ID NO: 34225 - DNA, 25 bp, Rattus norvegicus
aagacccgggagtagcgagatttca

SEQ ID NO: 34226 - DNA, 25 bp, Rattus norvegicus
aagacccgggagtcagagcggctcc

SEQ ID NO: 34227 - DNA, 25 bp, Rattus norvegicus
aagacccgtatcatttgctctgtgg

SEQ ID NO: 34228 - DNA, 25 bp, Rattus norvegicus
aagacccgtatcttttgctctgtgg

SEQ ID NO: 34229 - DNA, 25 bp, Rattus norvegicus
aagacccgtcgtactgagaaaccat

SEQ ID NO: 34230 - DNA, 25 bp, Rattus norvegicus
aagacccgtcgttctgagaaaccat

SEQ ID NO: 34231 - DNA, 25 bp, Rattus norvegicus
aagacccgtgagctcctaattatga

SEQ ID NO: 34232 - DNA, 25 bp, Rattus norvegicus
aagacccgtgaggtcctaattatga

SEQ ID NO: 34233 - DNA, 25 bp, Rattus norvegicus
aagaccctaaatcagagccctctga

SEQ ID NO: 34234 - DNA, 25 bp, Rattus norvegicus
aagaccctaaatgagagccctctga

SEQ ID NO: 34235 - DNA, 25 bp, Rattus norvegicus
aagaccctacggagggacacacagt

SEQ ID NO: 34236 - DNA, 25 bp, Rattus norvegicus
aagaccctacggtgggacacacagt

SEQ ID NO: 34237 - DNA, 25 bp, Rattus norvegicus
aagaccctccgtctatgggattaca

SEQ ID NO: 34238 - DNA, 25 bp, Rattus norvegicus
aagaccctccgtgtatgggattaca

SEQ ID NO: 34239 - DNA, 25 bp, Rattus norvegicus
aagaccctcctgacgtgcttttgag

SEQ ID NO: 34240 - DNA, 25 bp, Rattus norvegicus
aagaccctcctgtcgtgcttttgag

SEQ ID NO: 34241 - DNA, 25 bp, Rattus norvegicus
aagaccctgaccacttctgggatga

SEQ ID NO: 34242 - DNA, 25 bp, Rattus norvegicus
aagaccctgacctcttctgggatga

SEQ ID NO: 34243 - DNA, 25 bp, Rattus norvegicus
aagaccctgaggaacagcaagccaa

SEQ ID NO: 34244 - DNA, 25 bp, Rattus norvegicus
aagaccctgaggtacagcaagccaa

SEQ ID NO: 34245 - DNA, 25 bp, Rattus norvegicus
aagaccctgatgaccaccattagat

SEQ ID NO: 34246 - DNA, 25 bp, Rattus norvegicus
aagaccctgatgtccaccattagat

SEQ ID NO: 34247 - DNA, 25 bp, Rattus norvegicus
aagaccctgcctctaagaagccact

SEQ ID NO: 34248 - DNA, 25 bp, Rattus norvegicus
aagaccctgcctgtaagaagccact

SEQ ID NO: 34249 - DNA, 25 bp, Rattus norvegicus
aagaccctggacctgcgagatagat

SEQ ID NO: 34250 - DNA, 25 bp, Rattus norvegicus
aagaccctggacgtgcgagatagat

SEQ ID NO: 34251 - DNA, 25 bp, Rattus norvegicus
aagaccctggagctgattggtgtaa

SEQ ID NO: 34252 - DNA, 25 bp, Rattus norvegicus
aagaccctggaggtgattggtgtaa

SEQ ID NO: 34253 - DNA, 25 bp, Rattus norvegicus
aagaccctggctacacaggacagtt

SEQ ID NO: 34254 - DNA, 25 bp, Rattus norvegicus
aagaccctggcttcacaggacagtt

SEQ ID NO: 34255 - DNA, 25 bp, Rattus norvegicus
aagaccctgggcacaaatatcagca

SEQ ID NO: 34256 - DNA, 25 bp, Rattus norvegicus
aagaccctgggcatgtgatccacga

SEQ ID NO: 34257 - DNA, 25 bp, Rattus norvegicus
aagaccctgggctcaaatatcagca

SEQ ID NO: 34258 - DNA, 25 bp, Rattus norvegicus
aagaccctgggcttgtgatccacga

SEQ ID NO: 34259 - DNA, 25 bp, Rattus norvegicus
aagaccctgttccaactgtaggcct

SEQ ID NO: 34260 - DNA, 25 bp, Rattus norvegicus
aagaccctgttcgaactgtaggcct

SEQ ID NO: 34261 - DNA, 25 bp, Rattus norvegicus
aagacccttaaactcatagcattta

SEQ ID NO: 34262 - DNA, 25 bp, Rattus norvegicus
aagacccttaaagtcatagcattta

SEQ ID NO: 34263 - DNA, 25 bp, Rattus norvegicus
aagacccttactctgggtgctccaa

SEQ ID NO: 34264 - DNA, 25 bp, Rattus norvegicus
aagacccttactgtgggtgctccaa

SEQ ID NO: 34265 - DNA, 25 bp, Rattus norvegicus
aagacccttatgagtattcgtgttt

SEQ ID NO: 34266 - DNA, 25 bp, Rattus norvegicus
aagacccttatgtgtattcgtgttt

SEQ ID NO: 34267 - DNA, 25 bp, Rattus norvegicus
aagacccttcaaaggacagtggaga

SEQ ID NO: 34268 - DNA, 25 bp, Rattus norvegicus
aagacccttcaatggacagtggaga

SEQ ID NO: 34269 - DNA, 25 bp, Rattus norvegicus
aagacccttcgcaagaaaggtccat

SEQ ID NO: 34270 - DNA, 25 bp, Rattus norvegicus
aagacccttcgctagaaaggtccat

SEQ ID NO: 34271 - DNA, 25 bp, Rattus norvegicus
aagacccttgatcaccggctgctca

SEQ ID NO: 34272 - DNA, 25 bp, Rattus norvegicus
aagacccttgatgaccggctgctca

SEQ ID NO: 34273 - DNA, 25 bp, Rattus norvegicus
aagacccttgctacgtgggcaacaa

SEQ ID NO: 34274 - DNA, 25 bp, Rattus norvegicus
aagacccttgcttcgtgggcaacaa

SEQ ID NO: 34275 - DNA, 25 bp, Rattus norvegicus
aagacccttgggactgacagctaag

SEQ ID NO: 34276 - DNA, 25 bp, Rattus norvegicus
aagacccttgggtctgacagctaag

SEQ ID NO: 34277 - DNA, 25 bp, Rattus norvegicus
aagaccctttatctacttctgtctc

SEQ ID NO: 34278 - DNA, 25 bp, Rattus norvegicus
aagaccctttatgtacttctgtctc

SEQ ID NO: 34279 - DNA, 25 bp, Rattus norvegicus
aagaccgaaggtcctgctgtgccct

SEQ ID NO: 34280 - DNA, 25 bp, Rattus norvegicus
aagaccgaaggtgctgctgtgccct

SEQ ID NO: 34281 - DNA, 25 bp, Rattus norvegicus
aagaccgaatacaggatttgattga

SEQ ID NO: 34282 - DNA, 25 bp, Rattus norvegicus
aagaccgaatactggatttgattga

SEQ ID NO: 34283 - DNA, 25 bp, Rattus norvegicus
aagaccgacaggcaggcagcacaag

SEQ ID NO: 34284 - DNA, 25 bp, Rattus norvegicus
aagaccgacagggaggcagcacaag

SEQ ID NO: 34285 - DNA, 25 bp, Rattus norvegicus
aagaccgagcagactccagtgctgt

SEQ ID NO: 34286 - DNA, 25 bp, Rattus norvegicus
aagaccgagcagtctccagtgctgt

SEQ ID NO: 34287 - DNA, 25 bp, Rattus norvegicus
aagaccgagctgcagttggacactg

SEQ ID NO: 34288 - DNA, 25 bp, Rattus norvegicus
aagaccgagctggagttggacactg

SEQ ID NO: 34289 - DNA, 25 bp, Rattus norvegicus
aagaccgagcttcacacatgcagaa

SEQ ID NO: 34290 - DNA, 25 bp, Rattus norvegicus
aagaccgagcttgacacatgcagaa

SEQ ID NO: 34291 - DNA, 25 bp, Rattus norvegicus
aagaccgattccacaggctttagat

SEQ ID NO: 34292 - DNA, 25 bp, Rattus norvegicus
aagaccgattcctcaggctttagat

SEQ ID NO: 34293 - DNA, 25 bp, Rattus norvegicus
aagaccgcagtgaggagaatctcag

SEQ ID NO: 34294 - DNA, 25 bp, Rattus norvegicus
aagaccgcagtgcagccagcagtgt

SEQ ID NO: 34295 - DNA, 25 bp, Rattus norvegicus
aagaccgcagtggagccagcagtgt

SEQ ID NO: 34296 - DNA, 25 bp, Rattus norvegicus
aagaccgcagtgtggagaatctcag

SEQ ID NO: 34297 - DNA, 25 bp, Rattus norvegicus
aagaccgcagttcatgaagccctgt

SEQ ID NO: 34298 - DNA, 25 bp, Rattus norvegicus
aagaccgcagttgatgaagccctgt

SEQ ID NO: 34299 - DNA, 25 bp, Rattus norvegicus
aagaccgccaagcaccttcgagaaa

SEQ ID NO: 34300 - DNA, 25 bp, Rattus norvegicus
aagaccgccaaggaccttcgagaaa

SEQ ID NO: 34301 - DNA, 25 bp, Rattus norvegicus
aagaccgccgatcagtttgttaaag

SEQ ID NO: 34302 - DNA, 25 bp, Rattus norvegicus
aagaccgccgatgagtttgttaaag

SEQ ID NO: 34303 - DNA, 25 bp, Rattus norvegicus
aagaccgccggacgaaagacgcagc

SEQ ID NO: 34304 - DNA, 25 bp, Rattus norvegicus
aagaccgccggaggaaagacgcagc

SEQ ID NO: 34305 - DNA, 25 bp, Rattus norvegicus
aagaccgcctatcatgtactaataa

SEQ ID NO: 34306 - DNA, 25 bp, Rattus norvegicus
aagaccgcctatgatgtactaataa

SEQ ID NO: 34307 - DNA, 25 bp, Rattus norvegicus
aagaccggaacaaccactgcggact

SEQ ID NO: 34308 - DNA, 25 bp, Rattus norvegicus
aagaccggaacatccactgcggact

SEQ ID NO: 34309 - DNA, 25 bp, Rattus norvegicus
aagaccggaaccaagcgaggcctgt

SEQ ID NO: 34310 - DNA, 25 bp, Rattus norvegicus
aagaccggaacctagcgaggcctgt

SEQ ID NO: 34311 - DNA, 25 bp, Rattus norvegicus
aagaccggcatgctgatgtcctcaa

SEQ ID NO: 34312 - DNA, 25 bp, Rattus norvegicus
aagaccggcatggtgatgtcctcaa

SEQ ID NO: 34313 - DNA, 25 bp, Rattus norvegicus
aagaccggccagctgaccctgtgta

SEQ ID NO: 34314 - DNA, 25 bp, Rattus norvegicus
aagaccggccaggtgaccctgtgta

SEQ ID NO: 34315 - DNA, 25 bp, Rattus norvegicus
aagaccggctgcaaaacgcacagat

SEQ ID NO: 34316 - DNA, 25 bp, Rattus norvegicus
aagaccggctgctaaacgcacagat

SEQ ID NO: 34317 - DNA, 25 bp, Rattus norvegicus
aagaccgggaacaactgtactgtgt

SEQ ID NO: 34318 - DNA, 25 bp, Rattus norvegicus
aagaccgggaactactgtactgtgt

SEQ ID NO: 34319 - DNA, 25 bp, Rattus norvegicus
aagaccgggatgattctttcatcac

SEQ ID NO: 34320 - DNA, 25 bp, Rattus norvegicus
aagaccgggatgtttctttcatcac

SEQ ID NO: 34321 - DNA, 25 bp, Rattus norvegicus
aagaccgggcgcacagcactgattt

SEQ ID NO: 34322 - DNA, 25 bp, Rattus norvegicus
aagaccgggcgctcagcactgattt

SEQ ID NO: 34323 - DNA, 25 bp, Rattus norvegicus
aagaccggttggagctatggccatt

SEQ ID NO: 34324 - DNA, 25 bp, Rattus norvegicus
aagaccggttggtgctatggccatt

SEQ ID NO: 34325 - DNA, 25 bp, Rattus norvegicus
aagaccgtacccagcggtgtgcggc

SEQ ID NO: 34326 - DNA, 25 bp, Rattus norvegicus
aagaccgtaccctgcggtgtgcggc

SEQ ID NO: 34327 - DNA, 25 bp, Rattus norvegicus
aagaccgtcagtccaagcatggctc

SEQ ID NO: 34328 - DNA, 25 bp, Rattus norvegicus
aagaccgtcagtgcaagcatggctc

SEQ ID NO: 34329 - DNA, 25 bp, Rattus norvegicus
aagaccgtcggcaacagatatcgtg

SEQ ID NO: 34330 - DNA, 25 bp, Rattus norvegicus
aagaccgtcggctacagatatcgtg

SEQ ID NO: 34331 - DNA, 25 bp, Rattus norvegicus
aagaccgtcttcagcttggttgtca

SEQ ID NO: 34332 - DNA, 25 bp, Rattus norvegicus
aagaccgtcttctgcttggttgtca

SEQ ID NO: 34333 - DNA, 25 bp, Rattus norvegicus
aagaccgtgggtatgcttccagcat

SEQ ID NO: 34334 - DNA, 25 bp, Rattus norvegicus
aagaccgtgggtttgcttccagcat

SEQ ID NO: 34335 - DNA, 25 bp, Rattus norvegicus
aagaccgttcccacaagagagatca

SEQ ID NO: 34336 - DNA, 25 bp, Rattus norvegicus
aagaccgttccctcaagagagatca

SEQ ID NO: 34337 - DNA, 25 bp, Rattus norvegicus
aagacctaagcccttagcgggcagt

SEQ ID NO: 34338 - DNA, 25 bp, Rattus norvegicus
aagacctaagccgttagcgggcagt

SEQ ID NO: 34339 - DNA, 25 bp, Rattus norvegicus
aagacctaattacacacctggccat

SEQ ID NO: 34340 - DNA, 25 bp, Rattus norvegicus
aagacctaattagacacctggccat

SEQ ID NO: 34341 - DNA, 25 bp, Rattus norvegicus
aagacctacttcactcacattgatg

SEQ ID NO: 34342 - DNA, 25 bp, Rattus norvegicus
aagacctacttctctcacattgatg

SEQ ID NO: 34343 - DNA, 25 bp, Rattus norvegicus
aagacctagagaaccagcaaagcat

SEQ ID NO: 34344 - DNA, 25 bp, Rattus norvegicus
aagacctagagatccagcaaagcat

SEQ ID NO: 34345 - DNA, 25 bp, Rattus norvegicus
aagacctagatcattcccttgttct

SEQ ID NO: 34346 - DNA, 25 bp, Rattus norvegicus
aagacctagatctttcccttgttct

SEQ ID NO: 34347 - DNA, 25 bp, Rattus norvegicus
aagacctagcaaatcctggtttaga

SEQ ID NO: 34348 - DNA, 25 bp, Rattus norvegicus
aagacctagcaattcctggtttaga

SEQ ID NO: 34349 - DNA, 25 bp, Rattus norvegicus
aagacctagcccctgacagcagtga

SEQ ID NO: 34350 - DNA, 25 bp, Rattus norvegicus
aagacctagcccgtgacagcagtga

SEQ ID NO: 34351 - DNA, 25 bp, Rattus norvegicus
aagacctagtatcttcatgcctcgg

SEQ ID NO: 34352 - DNA, 25 bp, Rattus norvegicus
aagacctagtatgttcatgcctcgg

SEQ ID NO: 34353 - DNA, 25 bp, Rattus norvegicus
aagacctatcttactgacctgagaa

SEQ ID NO: 34354 - DNA, 25 bp, Rattus norvegicus
aagacctatctttctgacctgagaa

SEQ ID NO: 34355 - DNA, 25 bp, Rattus norvegicus
aagacctatgcgcagtgctcagctc

SEQ ID NO: 34356 - DNA, 25 bp, Rattus norvegicus
aagacctatgcggagtgctcagctc

SEQ ID NO: 34357 - DNA, 25 bp, Rattus norvegicus
aagacctatgtgagctgtctcagca

SEQ ID NO: 34358 - DNA, 25 bp, Rattus norvegicus
aagacctatgtgtgctgtctcagca

SEQ ID NO: 34359 - DNA, 25 bp, Rattus norvegicus
aagacctattctatgagcctttctg

SEQ ID NO: 34360 - DNA, 25 bp, Rattus norvegicus
aagacctattctttgagcctttctg

SEQ ID NO: 34361 - DNA, 25 bp, Rattus norvegicus
aagacctcaaggacctgtgactgcc

SEQ ID NO: 34362 - DNA, 25 bp, Rattus norvegicus
aagacctcaaggtcctgtgactgcc

SEQ ID NO: 34363 - DNA, 25 bp, Rattus norvegicus
aagacctcactgactggtgcttggt

SEQ ID NO: 34364 - DNA, 25 bp, Rattus norvegicus
aagacctcactgtctggtgcttggt

SEQ ID NO: 34365 - DNA, 25 bp, Rattus norvegicus
aagacctcagagcagctggaccagc

SEQ ID NO: 34366 - DNA, 25 bp, Rattus norvegicus
aagacctcagaggagctggaccagc

SEQ ID NO: 34367 - DNA, 25 bp, Rattus norvegicus
aagacctcagctaagggactgtgga

SEQ ID NO: 34368 - DNA, 25 bp, Rattus norvegicus
aagacctcagcttagggactgtgga

SEQ ID NO: 34369 - DNA, 25 bp, Rattus norvegicus
aagacctcagtgaattcccaatcag

SEQ ID NO: 34370 - DNA, 25 bp, Rattus norvegicus
aagacctcagtgtattcccaatcag

SEQ ID NO: 34371 - DNA, 25 bp, Rattus norvegicus
aagacctcatacaacttcagcttac

SEQ ID NO: 34372 - DNA, 25 bp, Rattus norvegicus
aagacctcatactacttcagcttac

SEQ ID NO: 34373 - DNA, 25 bp, Rattus norvegicus
aagacctccttgagcttcatctgag

SEQ ID NO: 34374 - DNA, 25 bp, Rattus norvegicus
aagacctccttgtgcttcatctgag

SEQ ID NO: 34375 - DNA, 25 bp, Rattus norvegicus
aagacctcgaagacagcggaccagt

SEQ ID NO: 34376 - DNA, 25 bp, Rattus norvegicus
aagacctcgaagtcagcggaccagt

SEQ ID NO: 34377 - DNA, 25 bp, Rattus norvegicus
aagacctcgtggagaatttttactg

SEQ ID NO: 34378 - DNA, 25 bp, Rattus norvegicus
aagacctcgtggtgaatttttactg

SEQ ID NO: 34379 - DNA, 25 bp, Rattus norvegicus
aagacctctctgacactcaaagcag

SEQ ID NO: 34380 - DNA, 25 bp, Rattus norvegicus
aagacctctctgtcactcaaagcag

SEQ ID NO: 34381 - DNA, 25 bp, Rattus norvegicus
aagacctctgacagagctcgttgga

SEQ ID NO: 34382 - DNA, 25 bp, Rattus norvegicus
aagacctctgactgagctcgttgga

SEQ ID NO: 34383 - DNA, 25 bp, Rattus norvegicus
aagacctctgcacatgaccacattg

SEQ ID NO: 34384 - DNA, 25 bp, Rattus norvegicus
aagacctctgcagatgaccacattg

SEQ ID NO: 34385 - DNA, 25 bp, Rattus norvegicus
aagacctctgccagcacacatggga

SEQ ID NO: 34386 - DNA, 25 bp, Rattus norvegicus
aagacctctgcctgcacacatggga

SEQ ID NO: 34387 - DNA, 25 bp, Rattus norvegicus
aagacctctggccatgtagacaaat

SEQ ID NO: 34388 - DNA, 25 bp, Rattus norvegicus
aagacctctggcgatgtagacaaat

SEQ ID NO: 34389 - DNA, 25 bp, Rattus norvegicus
aagacctctgttactaaagcaccac

SEQ ID NO: 34390 - DNA, 25 bp, Rattus norvegicus
aagacctctgtttctaaagcaccac

SEQ ID NO: 34391 - DNA, 25 bp, Rattus norvegicus
aagacctcttccaagggacagccag

SEQ ID NO: 34392 - DNA, 25 bp, Rattus norvegicus
aagacctcttcctagggacagccag

SEQ ID NO: 34393 - DNA, 25 bp, Rattus norvegicus
aagacctctttccagaatggctaaa

SEQ ID NO: 34394 - DNA, 25 bp, Rattus norvegicus
aagacctctttcgagaatggctaaa

SEQ ID NO: 34395 - DNA, 25 bp, Rattus norvegicus
aagacctgaggaactcactctctct

SEQ ID NO: 34396 - DNA, 25 bp, Rattus norvegicus
aagacctgaggactctgctgagctt

SEQ ID NO: 34397 - DNA, 25 bp, Rattus norvegicus
aagacctgaggagtctgctgagctt

SEQ ID NO: 34398 - DNA, 25 bp, Rattus norvegicus
aagacctgaggatctcactctctct

SEQ ID NO: 34399 - DNA, 25 bp, Rattus norvegicus
aagacctgccagaagtcacagtgat

SEQ ID NO: 34400 - DNA, 25 bp, Rattus norvegicus
aagacctgccagtagtcacagtgat

SEQ ID NO: 34401 - DNA, 25 bp, Rattus norvegicus
aagacctgcgccaggatacatacgt

SEQ ID NO: 34402 - DNA, 25 bp, Rattus norvegicus
aagacctgcgcctggatacatacgt

SEQ ID NO: 34403 - DNA, 25 bp, Rattus norvegicus
aagacctgctttatatccgacttcg

SEQ ID NO: 34404 - DNA, 25 bp, Rattus norvegicus
aagacctgctttttatccgacttcg

SEQ ID NO: 34405 - DNA, 25 bp, Rattus norvegicus
aagacctggaggaggttcctgccat

SEQ ID NO: 34406 - DNA, 25 bp, Rattus norvegicus
aagacctggaggtggttcctgccat

SEQ ID NO: 34407 - DNA, 25 bp, Rattus norvegicus
aagacctggataagctgccttgggt

SEQ ID NO: 34408 - DNA, 25 bp, Rattus norvegicus
aagacctggatatgctgccttgggt

SEQ ID NO: 34409 - DNA, 25 bp, Rattus norvegicus
aagacctggcagagctcatcaacaa

SEQ ID NO: 34410 - DNA, 25 bp, Rattus norvegicus
aagacctggcagtgctcatcaacaa

SEQ ID NO: 34411 - DNA, 25 bp, Rattus norvegicus
aagacctggcgtaagcacaggcgct

SEQ ID NO: 34412 - DNA, 25 bp, Rattus norvegicus
aagacctggcgtccacgagttcaga

SEQ ID NO: 34413 - DNA, 25 bp, Rattus norvegicus
aagacctggcgtgcacgagttcaga

SEQ ID NO: 34414 - DNA, 25 bp, Rattus norvegicus
aagacctggcgttagcacaggcgct

SEQ ID NO: 34415 - DNA, 25 bp, Rattus norvegicus
aagacctgggctcacagcttaggct

SEQ ID NO: 34416 - DNA, 25 bp, Rattus norvegicus
aagacctgggctgacagcttaggct

SEQ ID NO: 34417 - DNA, 25 bp, Rattus norvegicus
aagacctgggtcacctggtaggact

SEQ ID NO: 34418 - DNA, 25 bp, Rattus norvegicus
aagacctgggtcaggctttaatctc

SEQ ID NO: 34419 - DNA, 25 bp, Rattus norvegicus
aagacctgggtctcctggtaggact

SEQ ID NO: 34420 - DNA, 25 bp, Rattus norvegicus
aagacctgggtctggctttaatctc

SEQ ID NO: 34421 - DNA, 25 bp, Rattus norvegicus
aagacctggtgcacagatgctgctc

SEQ ID NO: 34422 - DNA, 25 bp, Rattus norvegicus
aagacctggtgctcagatgctgctc

SEQ ID NO: 34423 - DNA, 25 bp, Rattus norvegicus
aagacctggtgtccagtggtcccga

SEQ ID NO: 34424 - DNA, 25 bp, Rattus norvegicus
aagacctggtgtgcagtggtcccga

SEQ ID NO: 34425 - DNA, 25 bp, Rattus norvegicus
aagacctgtactagggccacgcaga

SEQ ID NO: 34426 - DNA, 25 bp, Rattus norvegicus
aagacctgtacttgggccacgcaga

SEQ ID NO: 34427 - DNA, 25 bp, Rattus norvegicus
aagacctgtcggacgggatccacgt

SEQ ID NO: 34428 - DNA, 25 bp, Rattus norvegicus
aagacctgtcggtcgggatccacgt

SEQ ID NO: 34429 - DNA, 25 bp, Rattus norvegicus
aagacctgtctcaggaggagatcca

SEQ ID NO: 34430 - DNA, 25 bp, Rattus norvegicus
aagacctgtctctggaggagatcca

SEQ ID NO: 34431 - DNA, 25 bp, Rattus norvegicus
aagacctgtgtacaccttggactca

SEQ ID NO: 34432 - DNA, 25 bp, Rattus norvegicus
aagacctgtgtagaccttggactca

SEQ ID NO: 34433 - DNA, 25 bp, Rattus norvegicus
aagacctgtgtgagctctagtcgtc

SEQ ID NO: 34434 - DNA, 25 bp, Rattus norvegicus
aagacctgtgtgtgctctagtcgtc

SEQ ID NO: 34435 - DNA, 25 bp, Rattus norvegicus
aagacctgtttaacactgtgtgacc

SEQ ID NO: 34436 - DNA, 25 bp, Rattus norvegicus
aagacctgtttatcactgtgtgacc

SEQ ID NO: 34437 - DNA, 25 bp, Rattus norvegicus
aagaccttaatcagcccacgtcaat

SEQ ID NO: 34438 - DNA, 25 bp, Rattus norvegicus
aagaccttaatctgcccacgtcaat

SEQ ID NO: 34439 - DNA, 25 bp, Rattus norvegicus
aagaccttagcaaacttgtacaaca

SEQ ID NO: 34440 - DNA, 25 bp, Rattus norvegicus
aagaccttagcatacttgtacaaca

SEQ ID NO: 34441 - DNA, 25 bp, Rattus norvegicus
aagaccttcaaccagtattcctcct

SEQ ID NO: 34442 - DNA, 25 bp, Rattus norvegicus
aagaccttcaacgagtattcctcct

SEQ ID NO: 34443 - DNA, 25 bp, Rattus norvegicus
aagaccttcaagcagcactttgaga

SEQ ID NO: 34444 - DNA, 25 bp, Rattus norvegicus
aagaccttcaaggagcactttgaga

SEQ ID NO: 34445 - DNA, 25 bp, Rattus norvegicus
aagaccttcaccaatgacttctctt

SEQ ID NO: 34446 - DNA, 25 bp, Rattus norvegicus
aagaccttcacctatgacttctctt

SEQ ID NO: 34447 - DNA, 25 bp, Rattus norvegicus
aagaccttcagtaattctgtcaccc

SEQ ID NO: 34448 - DNA, 25 bp, Rattus norvegicus
aagaccttcagttattctgtcaccc

SEQ ID NO: 34449 - DNA, 25 bp, Rattus norvegicus
aagaccttccttcgacttgctgctc

SEQ ID NO: 34450 - DNA, 25 bp, Rattus norvegicus
aagaccttccttggacttgctgctc

SEQ ID NO: 34451 - DNA, 25 bp, Rattus norvegicus
aagaccttcgagcagtccatgcaga

SEQ ID NO: 34452 - DNA, 25 bp, Rattus norvegicus
aagaccttcgaggagtccatgcaga

SEQ ID NO: 34453 - DNA, 25 bp, Rattus norvegicus
aagaccttctctccctcgatgatgc

SEQ ID NO: 34454 - DNA, 25 bp, Rattus norvegicus
aagaccttctctgcctcgatgatgc

SEQ ID NO: 34455 - DNA, 25 bp, Rattus norvegicus
aagaccttctgcatgactgtgtgag

SEQ ID NO: 34456 - DNA, 25 bp, Rattus norvegicus
aagaccttctgcttgactgtgtgag

SEQ ID NO: 34457 - DNA, 25 bp, Rattus norvegicus
aagaccttcttgagtttgccttgtg

SEQ ID NO: 34458 - DNA, 25 bp, Rattus norvegicus
aagaccttcttgtgtttgccttgtg

SEQ ID NO: 34459 - DNA, 25 bp, Rattus norvegicus
aagaccttgcaacccagcctatggc

SEQ ID NO: 34460 - DNA, 25 bp, Rattus norvegicus
aagaccttgcaagccagcctatggc

SEQ ID NO: 34461 - DNA, 25 bp, Rattus norvegicus
aagaccttgcatcgctcagagtcaa

SEQ ID NO: 34462 - DNA, 25 bp, Rattus norvegicus
aagaccttgcatggctcagagtcaa

SEQ ID NO: 34463 - DNA, 25 bp, Rattus norvegicus
aagaccttggatatgagcttgtcaa

SEQ ID NO: 34464 - DNA, 25 bp, Rattus norvegicus
aagaccttggatttgagcttgtcaa

SEQ ID NO: 34465 - DNA, 25 bp, Rattus norvegicus
aagaccttggctattccaagctgga

SEQ ID NO: 34466 - DNA, 25 bp, Rattus norvegicus
aagaccttggcttttccaagctgga

SEQ ID NO: 34467 - DNA, 25 bp, Rattus norvegicus
aagaccttgggcaagctcttctgtc

SEQ ID NO: 34468 - DNA, 25 bp, Rattus norvegicus
aagaccttgggctagctcttctgtc

SEQ ID NO: 34469 - DNA, 25 bp, Rattus norvegicus
aagaccttgtgtacctcttctcatg

SEQ ID NO: 34470 - DNA, 25 bp, Rattus norvegicus
aagaccttgtgttcctcttctcatg

SEQ ID NO: 34471 - DNA, 25 bp, Rattus norvegicus
aagacctttaacatctctggaggat

SEQ ID NO: 34472 - DNA, 25 bp, Rattus norvegicus
aagacctttaacttctctggaggat

SEQ ID NO: 34473 - DNA, 25 bp, Rattus norvegicus
aagacctttatgcttgcttcaagaa

SEQ ID NO: 34474 - DNA, 25 bp, Rattus norvegicus
aagacctttatggttgcttcaagaa

SEQ ID NO: 34475 - DNA, 25 bp, Rattus norvegicus
aagacctttccactgctgagatgtg

SEQ ID NO: 34476 - DNA, 25 bp, Rattus norvegicus
aagacctttccagtgctgagatgtg

SEQ ID NO: 34477 - DNA, 25 bp, Rattus norvegicus
aagacctttctcatgaactcagttg

SEQ ID NO: 34478 - DNA, 25 bp, Rattus norvegicus
aagacctttctcttgaactcagttg

SEQ ID NO: 34479 - DNA, 25 bp, Rattus norvegicus
aagacctttgctctctggaggttca

SEQ ID NO: 34480 - DNA, 25 bp, Rattus norvegicus
aagacctttgctgtctggaggttca

SEQ ID NO: 34481 - DNA, 25 bp, Rattus norvegicus
aagaccttttagcaccatgggacag

SEQ ID NO: 34482 - DNA, 25 bp, Rattus norvegicus
aagaccttttaggaccatgggacag

SEQ ID NO: 34483 - DNA, 25 bp, Rattus norvegicus
aagacgaagctgaacaggacctaat

SEQ ID NO: 34484 - DNA, 25 bp, Rattus norvegicus
aagacgaagctgtacaggacctaat

SEQ ID NO: 34485 - DNA, 25 bp, Rattus norvegicus
aagacgacacccaattcttgaaagt

SEQ ID NO: 34486 - DNA, 25 bp, Rattus norvegicus
aagacgacaccctattcttgaaagt

SEQ ID NO: 34487 - DNA, 25 bp, Rattus norvegicus
aagacgacatttacccactgagcct

SEQ ID NO: 34488 - DNA, 25 bp, Rattus norvegicus
aagacgacattttcccactgagcct

SEQ ID NO: 34489 - DNA, 25 bp, Rattus norvegicus
aagacgacctacagggctagctaca

SEQ ID NO: 34490 - DNA, 25 bp, Rattus norvegicus
aagacgacctactgggctagctaca

SEQ ID NO: 34491 - DNA, 25 bp, Rattus norvegicus
aagacgagaaagaggcggagtcact

SEQ ID NO: 34492 - DNA, 25 bp, Rattus norvegicus
aagacgagaaagtggcggagtcact

SEQ ID NO: 34493 - DNA, 25 bp, Rattus norvegicus
aagacgagaccaacggccttcagag

SEQ ID NO: 34494 - DNA, 25 bp, Rattus norvegicus
aagacgagaccatcggccttcagag

SEQ ID NO: 34495 - DNA, 25 bp, Rattus norvegicus
aagacgagcagaccggccctttgta

SEQ ID NO: 34496 - DNA, 25 bp, Rattus norvegicus
aagacgagcagagcggccctttgta

SEQ ID NO: 34497 - DNA, 25 bp, Rattus norvegicus
aagacgagcagcagccccaggctgg

SEQ ID NO: 34498 - DNA, 25 bp, Rattus norvegicus
aagacgagcagctgccccaggctgg

SEQ ID NO: 34499 - DNA, 25 bp, Rattus norvegicus
aagacgaggcagaccctgaactcaa

SEQ ID NO: 34500 - DNA, 25 bp, Rattus norvegicus
aagacgaggcagtccctgaactcaa

SEQ ID NO: 34501 - DNA, 25 bp, Rattus norvegicus
aagacgagtcacacgcgggaaaggt

SEQ ID NO: 34502 - DNA, 25 bp, Rattus norvegicus
aagacgagtcactcgcgggaaaggt

SEQ ID NO: 34503 - DNA, 25 bp, Rattus norvegicus
aagacgatcagcaccagtttggcag

SEQ ID NO: 34504 - DNA, 25 bp, Rattus norvegicus
aagacgatcagctccagtttggcag

SEQ ID NO: 34505 - DNA, 25 bp, Rattus norvegicus
aagacgatccatccggagctctcaa

SEQ ID NO: 34506 - DNA, 25 bp, Rattus norvegicus
aagacgatccatgcggagctctcaa

SEQ ID NO: 34507 - DNA, 25 bp, Rattus norvegicus
aagacgatgggaccggcttgttcaa

SEQ ID NO: 34508 - DNA, 25 bp, Rattus norvegicus
aagacgatgggagcggcttgttcaa

SEQ ID NO: 34509 - DNA, 25 bp, Rattus norvegicus
aagacgatgttccaggccatacttg

SEQ ID NO: 34510 - DNA, 25 bp, Rattus norvegicus
aagacgatgttcgaggccatacttg

SEQ ID NO: 34511 - DNA, 25 bp, Rattus norvegicus
aagacgatttccatagtaacccgat

SEQ ID NO: 34512 - DNA, 25 bp, Rattus norvegicus
aagacgatttccttagtaacccgat

SEQ ID NO: 34513 - DNA, 25 bp, Rattus norvegicus
aagacgcagcaccaggaaccctaag

SEQ ID NO: 34514 - DNA, 25 bp, Rattus norvegicus
aagacgcagcacgaggaaccctaag

SEQ ID NO: 34515 - DNA, 25 bp, Rattus norvegicus
aagacgcagcccatcctgtttggca

SEQ ID NO: 34516 - DNA, 25 bp, Rattus norvegicus
aagacgcagcccttcctgtttggca

SEQ ID NO: 34517 - DNA, 25 bp, Rattus norvegicus
aagacgcagccgagtacactgtgat

SEQ ID NO: 34518 - DNA, 25 bp, Rattus norvegicus
aagacgcagccgtgtacactgtgat

SEQ ID NO: 34519 - DNA, 25 bp, Rattus norvegicus
aagacgcagcttccacattagtgac

SEQ ID NO: 34520 - DNA, 25 bp, Rattus norvegicus
aagacgcagcttgcacattagtgac

SEQ ID NO: 34521 - DNA, 25 bp, Rattus norvegicus
aagacgcaggtcagacacaggatta

SEQ ID NO: 34522 - DNA, 25 bp, Rattus norvegicus
aagacgcaggtctgacacaggatta

SEQ ID NO: 34523 - DNA, 25 bp, Rattus norvegicus
aagacgcagtagctactgagcctcg

SEQ ID NO: 34524 - DNA, 25 bp, Rattus norvegicus
aagacgcagtaggtactgagcctcg

SEQ ID NO: 34525 - DNA, 25 bp, Rattus norvegicus
aagacgcagtgtctgagaccagcat

SEQ ID NO: 34526 - DNA, 25 bp, Rattus norvegicus
aagacgcagtgtgtgagaccagcat

SEQ ID NO: 34527 - DNA, 25 bp, Rattus norvegicus
aagacgcattttccgggtgaatcat

SEQ ID NO: 34528 - DNA, 25 bp, Rattus norvegicus
aagacgcattttgcgggtgaatcat

SEQ ID NO: 34529 - DNA, 25 bp, Rattus norvegicus
aagacgccaaggaccagaacgagct

SEQ ID NO: 34530 - DNA, 25 bp, Rattus norvegicus
aagacgccaaggtccagaacgagct

SEQ ID NO: 34531 - DNA, 25 bp, Rattus norvegicus
aagacgccaagtacgccgtgtcaga

SEQ ID NO: 34532 - DNA, 25 bp, Rattus norvegicus
aagacgccaagttcgccgtgtcaga

SEQ ID NO: 34533 - DNA, 25 bp, Rattus norvegicus
aagacgccattgagcaagctgtgaa

SEQ ID NO: 34534 - DNA, 25 bp, Rattus norvegicus
aagacgccattgtgcaagctgtgaa

SEQ ID NO: 34535 - DNA, 25 bp, Rattus norvegicus
aagacgccctctcctgtcaaggcag

SEQ ID NO: 34536 - DNA, 25 bp, Rattus norvegicus
aagacgccctctgctgtcaaggcag

SEQ ID NO: 34537 - DNA, 25 bp, Rattus norvegicus
aagacgcctgaaatcctttgaccaa

SEQ ID NO: 34538 - DNA, 25 bp, Rattus norvegicus
aagacgcctgaattcctttgaccaa

SEQ ID NO: 34539 - DNA, 25 bp, Rattus norvegicus
aagacgccttccacctgagcaaggg

SEQ ID NO: 34540 - DNA, 25 bp, Rattus norvegicus
aagacgccttcctcctgagcaaggg

SEQ ID NO: 34541 - DNA, 25 bp, Rattus norvegicus
aagacgcggaagaggctaccactgc

SEQ ID NO: 34542 - DNA, 25 bp, Rattus norvegicus
aagacgcggaagtggctaccactgc

SEQ ID NO: 34543 - DNA, 25 bp, Rattus norvegicus
aagacgcggactcgtgataacccac

SEQ ID NO: 34544 - DNA, 25 bp, Rattus norvegicus
aagacgcggactggtgataacccac

SEQ ID NO: 34545 - DNA, 25 bp, Rattus norvegicus
aagacgcgtacactctgcactgatt

SEQ ID NO: 34546 - DNA, 25 bp, Rattus norvegicus
aagacgcgtacagtctgcactgatt

SEQ ID NO: 34547 - DNA, 25 bp, Rattus norvegicus
aagacgctaagcagcggctcgtgcc

SEQ ID NO: 34548 - DNA, 25 bp, Rattus norvegicus
aagacgctaagctgcggctcgtgcc

SEQ ID NO: 34549 - DNA, 25 bp, Rattus norvegicus
aagacgctatgtaatctaaaccaca

SEQ ID NO: 34550 - DNA, 25 bp, Rattus norvegicus
aagacgctatgttatctaaaccaca

SEQ ID NO: 34551 - DNA, 25 bp, Rattus norvegicus
aagacgctcccgagcgctcccgaag

SEQ ID NO: 34552 - DNA, 25 bp, Rattus norvegicus
aagacgctcccgtgcgctcccgaag

SEQ ID NO: 34553 - DNA, 25 bp, Rattus norvegicus
aagacgctgatgaacaattgttccg

SEQ ID NO: 34554 - DNA, 25 bp, Rattus norvegicus
aagacgctgatgtacaattgttccg

SEQ ID NO: 34555 - DNA, 25 bp, Rattus norvegicus
aagacgctgtctcttcaaggaggac

SEQ ID NO: 34556 - DNA, 25 bp, Rattus norvegicus
aagacgctgtctgttcaaggaggac

SEQ ID NO: 34557 - DNA, 25 bp, Rattus norvegicus
aagacgcttccgcatgacttcgtcg

SEQ ID NO: 34558 - DNA, 25 bp, Rattus norvegicus
aagacgcttccggatgacttcgtcg

SEQ ID NO: 34559 - DNA, 25 bp, Rattus norvegicus
aagacgcttcgaaacttctcagaat

SEQ ID NO: 34560 - DNA, 25 bp, Rattus norvegicus
aagacgcttcgatacttctcagaat

SEQ ID NO: 34561 - DNA, 25 bp, Rattus norvegicus
aagacgcttggacccaagtgctaca

SEQ ID NO: 34562 - DNA, 25 bp, Rattus norvegicus
aagacgcttggagccaagtgctaca

SEQ ID NO: 34563 - DNA, 25 bp, Rattus norvegicus
aagacggaacgtacaccatctgtca

SEQ ID NO: 34564 - DNA, 25 bp, Rattus norvegicus
aagacggaacgttcaccatctgtca

SEQ ID NO: 34565 - DNA, 25 bp, Rattus norvegicus
aagacggaagctactgccagtggct

SEQ ID NO: 34566 - DNA, 25 bp, Rattus norvegicus
aagacggaagcttctgccagtggct

SEQ ID NO: 34567 - DNA, 25 bp, Rattus norvegicus
aagacggaagtgaagctgcagcatc

SEQ ID NO: 34568 - DNA, 25 bp, Rattus norvegicus
aagacggaagtgtagctgcagcatc

SEQ ID NO: 34569 - DNA, 25 bp, Rattus norvegicus
aagacggacacaacatgcagcagga

SEQ ID NO: 34570 - DNA, 25 bp, Rattus norvegicus
aagacggacacatcatgcagcagga

SEQ ID NO: 34571 - DNA, 25 bp, Rattus norvegicus
aagacggatgacctgggccggtggc

SEQ ID NO: 34572 - DNA, 25 bp, Rattus norvegicus
aagacggatgacgtgggccggtggc

SEQ ID NO: 34573 - DNA, 25 bp, Rattus norvegicus
aagacggatggacagacggctccac

SEQ ID NO: 34574 - DNA, 25 bp, Rattus norvegicus
aagacggatggagagacggctccac

SEQ ID NO: 34575 - DNA, 25 bp, Rattus norvegicus
aagacggattccatgaggctgctcc

SEQ ID NO: 34576 - DNA, 25 bp, Rattus norvegicus
aagacggattccttgaggctgctcc

SEQ ID NO: 34577 - DNA, 25 bp, Rattus norvegicus
aagacggcagccatacaacgcagtc

SEQ ID NO: 34578 - DNA, 25 bp, Rattus norvegicus
aagacggcagccttacaacgcagtc

SEQ ID NO: 34579 - DNA, 25 bp, Rattus norvegicus
aagacggcagctatgctttcttatg

SEQ ID NO: 34580 - DNA, 25 bp, Rattus norvegicus
aagacggcagctttgctttcttatg

SEQ ID NO: 34581 - DNA, 25 bp, Rattus norvegicus
aagacggcccgcatgaggacattga

SEQ ID NO: 34582 - DNA, 25 bp, Rattus norvegicus
aagacggcccgcttgaggacattga

SEQ ID NO: 34583 - DNA, 25 bp, Rattus norvegicus
aagacggcgctgaagtccgacagag

SEQ ID NO: 34584 - DNA, 25 bp, Rattus norvegicus
aagacggcgctgtagtccgacagag

SEQ ID NO: 34585 - DNA, 25 bp, Rattus norvegicus
aagacggctataattccaatggaga

SEQ ID NO: 34586 - DNA, 25 bp, Rattus norvegicus
aagacggctatatttccaatggaga

SEQ ID NO: 34587 - DNA, 25 bp, Rattus norvegicus
aagacggctcgaaaaggactggcat

SEQ ID NO: 34588 - DNA, 25 bp, Rattus norvegicus
aagacggctcgataaggactggcat

SEQ ID NO: 34589 - DNA, 25 bp, Rattus norvegicus
aagacggctgacacaggcaatcctg

SEQ ID NO: 34590 - DNA, 25 bp, Rattus norvegicus
aagacggctgactcaggcaatcctg

SEQ ID NO: 34591 - DNA, 25 bp, Rattus norvegicus
aagacgggcttcacttcagacagat

SEQ ID NO: 34592 - DNA, 25 bp, Rattus norvegicus
aagacgggcttctcttcagacagat

SEQ ID NO: 34593 - DNA, 25 bp, Rattus norvegicus
aagacggtgaaaaactgcctggctc

SEQ ID NO: 34594 - DNA, 25 bp, Rattus norvegicus
aagacggtgaaatactgcctggctc

SEQ ID NO: 34595 - DNA, 25 bp, Rattus norvegicus
aagacggtggagagtattcatcttc

SEQ ID NO: 34596 - DNA, 25 bp, Rattus norvegicus
aagacggtggagtgtattcatcttc

SEQ ID NO: 34597 - DNA, 25 bp, Rattus norvegicus
aagacggtggctacaggtggtcctc

SEQ ID NO: 34598 - DNA, 25 bp, Rattus norvegicus
aagacggtggcttcaggtggtcctc

SEQ ID NO: 34599 - DNA, 25 bp, Rattus norvegicus
aagacggtggttagctgccactcga

SEQ ID NO: 34600 - DNA, 25 bp, Rattus norvegicus
aagacggtggtttgctgccactcga

SEQ ID NO: 34601 - DNA, 25 bp, Rattus norvegicus
aagacggtgtcactctggtggccca

SEQ ID NO: 34602 - DNA, 25 bp, Rattus norvegicus
aagacggtgtcagtctggtggccca

SEQ ID NO: 34603 - DNA, 25 bp, Rattus norvegicus
aagacgtagtctctgtttccctgaa

SEQ ID NO: 34604 - DNA, 25 bp, Rattus norvegicus
aagacgtagtctgtgtttccctgaa

SEQ ID NO: 34605 - DNA, 25 bp, Rattus norvegicus
aagacgtagtggcatcagttttata

SEQ ID NO: 34606 - DNA, 25 bp, Rattus norvegicus
aagacgtagtgggatcagttttata

SEQ ID NO: 34607 - DNA, 25 bp, Rattus norvegicus
aagacgtatcaactggccttctgct

SEQ ID NO: 34608 - DNA, 25 bp, Rattus norvegicus
aagacgtatcaagtggccttctgct

SEQ ID NO: 34609 - DNA, 25 bp, Rattus norvegicus
aagacgtcagagaacggcgtgtcct

SEQ ID NO: 34610 - DNA, 25 bp, Rattus norvegicus
aagacgtcagagtacggcgtgtcct

SEQ ID NO: 34611 - DNA, 25 bp, Rattus norvegicus
aagacgtcagctcactgtgctgaga

SEQ ID NO: 34612 - DNA, 25 bp, Rattus norvegicus
aagacgtcagctgactgtgctgaga

SEQ ID NO: 34613 - DNA, 25 bp, Rattus norvegicus
aagacgtcccttcctgccttaaaat

SEQ ID NO: 34614 - DNA, 25 bp, Rattus norvegicus
aagacgtcccttgctgccttaaaat

SEQ ID NO: 34615 - DNA, 25 bp, Rattus norvegicus
aagacgtcgtgaacttggacctcaa

SEQ ID NO: 34616 - DNA, 25 bp, Rattus norvegicus
aagacgtcgtgatcttggacctcaa

SEQ ID NO: 34617 - DNA, 25 bp, Rattus norvegicus
aagacgtctcccatcagtatttcat

SEQ ID NO: 34618 - DNA, 25 bp, Rattus norvegicus
aagacgtctcccttcagtatttcat

SEQ ID NO: 34619 - DNA, 25 bp, Rattus norvegicus
aagacgtctcttcccttttgttaat

SEQ ID NO: 34620 - DNA, 25 bp, Rattus norvegicus
aagacgtctcttgccttttgttaat

SEQ ID NO: 34621 - DNA, 25 bp, Rattus norvegicus
aagacgtcttaccatgctacaacag

SEQ ID NO: 34622 - DNA, 25 bp, Rattus norvegicus
aagacgtcttacgatgctacaacag

SEQ ID NO: 34623 - DNA, 25 bp, Rattus norvegicus
aagacgtgcagcagggtctgttcat

SEQ ID NO: 34624 - DNA, 25 bp, Rattus norvegicus
aagacgtgcagctgggtctgttcat

SEQ ID NO: 34625 - DNA, 25 bp, Rattus norvegicus
aagacgtgccacattatctttggaa

SEQ ID NO: 34626 - DNA, 25 bp, Rattus norvegicus
aagacgtgccactttatctttggaa

SEQ ID NO: 34627 - DNA, 25 bp, Rattus norvegicus
aagacgtggcttatggaacattttg

SEQ ID NO: 34628 - DNA, 25 bp, Rattus norvegicus
aagacgtggcttttggaacattttg

SEQ ID NO: 34629 - DNA, 25 bp, Rattus norvegicus
aagacgtggtcgctactacagttgc

SEQ ID NO: 34630 - DNA, 25 bp, Rattus norvegicus
aagacgtggtcggtactacagttgc

SEQ ID NO: 34631 - DNA, 25 bp, Rattus norvegicus
aagacgtggttcagctcaagctagt

SEQ ID NO: 34632 - DNA, 25 bp, Rattus norvegicus
aagacgtggttctgctcaagctagt

SEQ ID NO: 34633 - DNA, 25 bp, Rattus norvegicus
aagacgtgtatacctttgctttggg

SEQ ID NO: 34634 - DNA, 25 bp, Rattus norvegicus
aagacgtgtatagctttgctttggg

SEQ ID NO: 34635 - DNA, 25 bp, Rattus norvegicus
aagacgttagctattcctgaacaga

SEQ ID NO: 34636 - DNA, 25 bp, Rattus norvegicus
aagacgttagcttttcctgaacaga

SEQ ID NO: 34637 - DNA, 25 bp, Rattus norvegicus
aagacgttaggcacagggtgtccat

SEQ ID NO: 34638 - DNA, 25 bp, Rattus norvegicus
aagacgttaggctcagggtgtccat

SEQ ID NO: 34639 - DNA, 25 bp, Rattus norvegicus
aagacgttctgacacacatggcgca

SEQ ID NO: 34640 - DNA, 25 bp, Rattus norvegicus
aagacgttctgagacacatggcgca

SEQ ID NO: 34641 - DNA, 25 bp, Rattus norvegicus
aagacgttgcctcgtattgtacatt

SEQ ID NO: 34642 - DNA, 25 bp, Rattus norvegicus
aagacgttgcctggtattgtacatt

SEQ ID NO: 34643 - DNA, 25 bp, Rattus norvegicus
aagacgtttggactctgacggcctc

SEQ ID NO: 34644 - DNA, 25 bp, Rattus norvegicus
aagacgtttggagtctgacggcctc

SEQ ID NO: 34645 - DNA, 25 bp, Rattus norvegicus
aagacgttttcactgttggcctgga

SEQ ID NO: 34646 - DNA, 25 bp, Rattus norvegicus
aagacgttttcagtgttggcctgga

SEQ ID NO: 34647 - DNA, 25 bp, Rattus norvegicus
aagactaacttccagctgtagctat

SEQ ID NO: 34648 - DNA, 25 bp, Rattus norvegicus
aagactaacttcgagctgtagctat

SEQ ID NO: 34649 - DNA, 25 bp, Rattus norvegicus
aagactaagccccattcggtgtcgg

SEQ ID NO: 34650 - DNA, 25 bp, Rattus norvegicus
aagactaagcccgattcggtgtcgg

SEQ ID NO: 34651 - DNA, 25 bp, Rattus norvegicus
aagactaatggtatctctcccattc

SEQ ID NO: 34652 - DNA, 25 bp, Rattus norvegicus
aagactaatggtttctctcccattc

SEQ ID NO: 34653 - DNA, 25 bp, Rattus norvegicus
aagactacagccctggccacaaaca

SEQ ID NO: 34654 - DNA, 25 bp, Rattus norvegicus
aagactacagccgtggccacaaaca

SEQ ID NO: 34655 - DNA, 25 bp, Rattus norvegicus
aagactacaggtatgtcggcaagct

SEQ ID NO: 34656 - DNA, 25 bp, Rattus norvegicus
aagactacaggtcttagcgtccgct

SEQ ID NO: 34657 - DNA, 25 bp, Rattus norvegicus
aagactacaggtgttagcgtccgct

SEQ ID NO: 34658 - DNA, 25 bp, Rattus norvegicus
aagactacaggtttgtcggcaagct

SEQ ID NO: 34659 - DNA, 25 bp, Rattus norvegicus
aagactacatctaccgcccgcaggg

SEQ ID NO: 34660 - DNA, 25 bp, Rattus norvegicus
aagactacatcttccgcccgcaggg

SEQ ID NO: 34661 - DNA, 25 bp, Rattus norvegicus
aagactaccaagctccacttcgagg

SEQ ID NO: 34662 - DNA, 25 bp, Rattus norvegicus
aagactaccaaggtccacttcgagg

SEQ ID NO: 34663 - DNA, 25 bp, Rattus norvegicus
aagactactgatctgctcactatca

SEQ ID NO: 34664 - DNA, 25 bp, Rattus norvegicus
aagactactgatgtgctcactatca

SEQ ID NO: 34665 - DNA, 25 bp, Rattus norvegicus
aagactacttagaagagcccgagaa

SEQ ID NO: 34666 - DNA, 25 bp, Rattus norvegicus
aagactacttagtagagcccgagaa

SEQ ID NO: 34667 - DNA, 25 bp, Rattus norvegicus
aagactagaaaaccctccccatctg

SEQ ID NO: 34668 - DNA, 25 bp, Rattus norvegicus
aagactagaaaagcctccccatctg

SEQ ID NO: 34669 - DNA, 25 bp, Rattus norvegicus
aagactagaggacccgggcctagct

SEQ ID NO: 34670 - DNA, 25 bp, Rattus norvegicus
aagactagaggagccgggcctagct

SEQ ID NO: 34671 - DNA, 25 bp, Rattus norvegicus
aagactagagtcagtgctcagagca

SEQ ID NO: 34672 - DNA, 25 bp, Rattus norvegicus
aagactagagtctgtgctcagagca

SEQ ID NO: 34673 - DNA, 25 bp, Rattus norvegicus
aagactagcctgcacaacatagaga

SEQ ID NO: 34674 - DNA, 25 bp, Rattus norvegicus
aagactagcctggacaacatagaga

SEQ ID NO: 34675 - DNA, 25 bp, Rattus norvegicus
aagactagcgaaagctcttaaccac

SEQ ID NO: 34676 - DNA, 25 bp, Rattus norvegicus
aagactagcgaatgctcttaaccac

SEQ ID NO: 34677 - DNA, 25 bp, Rattus norvegicus
aagactagcgcaaagactcggcagt

SEQ ID NO: 34678 - DNA, 25 bp, Rattus norvegicus
aagactagcgcatagactcggcagt

SEQ ID NO: 34679 - DNA, 25 bp, Rattus norvegicus
aagactaggctgctgtgcccagtgt

SEQ ID NO: 34680 - DNA, 25 bp, Rattus norvegicus
aagactaggctggtgtgcccagtgt

SEQ ID NO: 34681 - DNA, 25 bp, Rattus norvegicus
aagactagggccaccgtcaggctta

SEQ ID NO: 34682 - DNA, 25 bp, Rattus norvegicus
aagactagggcctccgtcaggctta

SEQ ID NO: 34683 - DNA, 25 bp, Rattus norvegicus
aagactagggtgctgccctgctaga

SEQ ID NO: 34684 - DNA, 25 bp, Rattus norvegicus
aagactagggtggtgccctgctaga

SEQ ID NO: 34685 - DNA, 25 bp, Rattus norvegicus
aagactaggtacagcggtctctaca

SEQ ID NO: 34686 - DNA, 25 bp, Rattus norvegicus
aagactaggtactgcggtctctaca

SEQ ID NO: 34687 - DNA, 25 bp, Rattus norvegicus
aagactagtgtccactgcatttttt

SEQ ID NO: 34688 - DNA, 25 bp, Rattus norvegicus
aagactagtgtcgactgcatttttt

SEQ ID NO: 34689 - DNA, 25 bp, Rattus norvegicus
aagactatactcagccaggttcatc

SEQ ID NO: 34690 - DNA, 25 bp, Rattus norvegicus
aagactatactctgccaggttcatc

SEQ ID NO: 34691 - DNA, 25 bp, Rattus norvegicus
aagactatcagtacattctcgctgg

SEQ ID NO: 34692 - DNA, 25 bp, Rattus norvegicus
aagactatcagttcattctcgctgg

SEQ ID NO: 34693 - DNA, 25 bp, Rattus norvegicus
aagactatctttaatgaccatgcca

SEQ ID NO: 34694 - DNA, 25 bp, Rattus norvegicus
aagactatcttttatgaccatgcca

SEQ ID NO: 34695 - DNA, 25 bp, Rattus norvegicus
aagactatgggaaggatgtgctgac

SEQ ID NO: 34696 - DNA, 25 bp, Rattus norvegicus
aagactatgggatggatgtgctgac

SEQ ID NO: 34697 - DNA, 25 bp, Rattus norvegicus
aagactatgggcaggtgtccctgga

SEQ ID NO: 34698 - DNA, 25 bp, Rattus norvegicus
aagactatgggctggtgtccctgga

SEQ ID NO: 34699 - DNA, 25 bp, Rattus norvegicus
aagactatggtcaggcctgctcaag

SEQ ID NO: 34700 - DNA, 25 bp, Rattus norvegicus
aagactatggtctggcctgctcaag

SEQ ID NO: 34701 - DNA, 25 bp, Rattus norvegicus
aagactatgtccacaaagttcgccc

SEQ ID NO: 34702 - DNA, 25 bp, Rattus norvegicus
aagactatgtcctcaaagttcgccc

SEQ ID NO: 34703 - DNA, 25 bp, Rattus norvegicus
aagactattccaactggccaaccat

SEQ ID NO: 34704 - DNA, 25 bp, Rattus norvegicus
aagactattccatctggccaaccat

SEQ ID NO: 34705 - DNA, 25 bp, Rattus norvegicus
aagactattgtgagtcagggcagca

SEQ ID NO: 34706 - DNA, 25 bp, Rattus norvegicus
aagactattgtgtgtcagggcagca

SEQ ID NO: 34707 - DNA, 25 bp, Rattus norvegicus
aagactcaagacatcaccatgcttc

SEQ ID NO: 34708 - DNA, 25 bp, Rattus norvegicus
aagactcaagacttcaccatgcttc

SEQ ID NO: 34709 - DNA, 25 bp, Rattus norvegicus
aagactcaagttaaatgttcatgcc

SEQ ID NO: 34710 - DNA, 25 bp, Rattus norvegicus
aagactcaagtttaatgttcatgcc

SEQ ID NO: 34711 - DNA, 25 bp, Rattus norvegicus
aagactcaataccatctttccggat

SEQ ID NO: 34712 - DNA, 25 bp, Rattus norvegicus
aagactcaatacgatctttccggat

SEQ ID NO: 34713 - DNA, 25 bp, Rattus norvegicus
aagactcaatgaccctcgctatgcc

SEQ ID NO: 34714 - DNA, 25 bp, Rattus norvegicus
aagactcaatgagcctcgctatgcc

SEQ ID NO: 34715 - DNA, 25 bp, Rattus norvegicus
aagactcacgttagggcggtggcgc

SEQ ID NO: 34716 - DNA, 25 bp, Rattus norvegicus
aagactcacgtttgggcggtggcgc

SEQ ID NO: 34717 - DNA, 25 bp, Rattus norvegicus
aagactcagaaccactaattttagc

SEQ ID NO: 34718 - DNA, 25 bp, Rattus norvegicus
aagactcagaacgactaattttagc

SEQ ID NO: 34719 - DNA, 25 bp, Rattus norvegicus
aagactcagcaaaatctgctccacc

SEQ ID NO: 34720 - DNA, 25 bp, Rattus norvegicus
aagactcagcaatatctgctccacc

SEQ ID NO: 34721 - DNA, 25 bp, Rattus norvegicus
aagactcagcagacgtactctgcca

SEQ ID NO: 34722 - DNA, 25 bp, Rattus norvegicus
aagactcagcagtcgtactctgcca

SEQ ID NO: 34723 - DNA, 25 bp, Rattus norvegicus
aagactcagcccatacttcaaacag

SEQ ID NO: 34724 - DNA, 25 bp, Rattus norvegicus
aagactcagcccttacttcaaacag

SEQ ID NO: 34725 - DNA, 25 bp, Rattus norvegicus
aagactcaggatactacacgctaaa

SEQ ID NO: 34726 - DNA, 25 bp, Rattus norvegicus
aagactcaggatcaaccacagcacg

SEQ ID NO: 34727 - DNA, 25 bp, Rattus norvegicus
aagactcaggatgaaccacagcacg

SEQ ID NO: 34728 - DNA, 25 bp, Rattus norvegicus
aagactcaggattctacacgctaaa

SEQ ID NO: 34729 - DNA, 25 bp, Rattus norvegicus
aagactcaggtcattcctacgacag

SEQ ID NO: 34730 - DNA, 25 bp, Rattus norvegicus
aagactcaggtctttcctacgacag

SEQ ID NO: 34731 - DNA, 25 bp, Rattus norvegicus
aagactcagtgactggagccctgtc

SEQ ID NO: 34732 - DNA, 25 bp, Rattus norvegicus
aagactcagtgacttgccagtgcct

SEQ ID NO: 34733 - DNA, 25 bp, Rattus norvegicus
aagactcagtgagtggagccctgtc

SEQ ID NO: 34734 - DNA, 25 bp, Rattus norvegicus
aagactcagtgagttgccagtgcct

SEQ ID NO: 34735 - DNA, 25 bp, Rattus norvegicus
aagactcattttcttcatgcttact

SEQ ID NO: 34736 - DNA, 25 bp, Rattus norvegicus
aagactcattttgttcatgcttact

SEQ ID NO: 34737 - DNA, 25 bp, Rattus norvegicus
aagactccaagtctgatcccttgag

SEQ ID NO: 34738 - DNA, 25 bp, Rattus norvegicus
aagactccaagtgtgatcccttgag

SEQ ID NO: 34739 - DNA, 25 bp, Rattus norvegicus
aagactccactgacactactagttg

SEQ ID NO: 34740 - DNA, 25 bp, Rattus norvegicus
aagactccactgtcactactagttg

SEQ ID NO: 34741 - DNA, 25 bp, Rattus norvegicus
aagactccatatcgcttcacaaagg

SEQ ID NO: 34742 - DNA, 25 bp, Rattus norvegicus
aagactccatatggcttcacaaagg

SEQ ID NO: 34743 - DNA, 25 bp, Rattus norvegicus
aagactcccaaacagaggcttctag

SEQ ID NO: 34744 - DNA, 25 bp, Rattus norvegicus
aagactcccaaactctaccgaatga

SEQ ID NO: 34745 - DNA, 25 bp, Rattus norvegicus
aagactcccaaagagaggcttctag

SEQ ID NO: 34746 - DNA, 25 bp, Rattus norvegicus
aagactcccaaagtctaccgaatga

SEQ ID NO: 34747 - DNA, 25 bp, Rattus norvegicus
aagactcccatcatagctgagccct

SEQ ID NO: 34748 - DNA, 25 bp, Rattus norvegicus
aagactcccatcttagctgagccct

SEQ ID NO: 34749 - DNA, 25 bp, Rattus norvegicus
aagactcccgggacctgtcagaaat

SEQ ID NO: 34750 - DNA, 25 bp, Rattus norvegicus
aagactcccgggtcctgtcagaaat

SEQ ID NO: 34751 - DNA, 25 bp, Rattus norvegicus
aagactcccgttagctcactctcaa

SEQ ID NO: 34752 - DNA, 25 bp, Rattus norvegicus
aagactcccgtttgctcactctcaa

SEQ ID NO: 34753 - DNA, 25 bp, Rattus norvegicus
aagactccctttcacatgtgggtta

SEQ ID NO: 34754 - DNA, 25 bp, Rattus norvegicus
aagactccctttgacatgtgggtta

SEQ ID NO: 34755 - DNA, 25 bp, Rattus norvegicus
aagactccgcttctaatccctgaag

SEQ ID NO: 34756 - DNA, 25 bp, Rattus norvegicus
aagactccgcttgtaatccctgaag

SEQ ID NO: 34757 - DNA, 25 bp, Rattus norvegicus
aagactccggagacattcctaggcc

SEQ ID NO: 34758 - DNA, 25 bp, Rattus norvegicus
aagactccggagtcattcctaggcc

SEQ ID NO: 34759 - DNA, 25 bp, Rattus norvegicus
aagactccgggaccagcacagggat

SEQ ID NO: 34760 - DNA, 25 bp, Rattus norvegicus
aagactccgggagcagcacagggat

SEQ ID NO: 34761 - DNA, 25 bp, Rattus norvegicus
aagactcctactcctcactgttggc

SEQ ID NO: 34762 - DNA, 25 bp, Rattus norvegicus
aagactcctactgctcactgttggc

SEQ ID NO: 34763 - DNA, 25 bp, Rattus norvegicus
aagactcctcaaacaactctgtaaa

SEQ ID NO: 34764 - DNA, 25 bp, Rattus norvegicus
aagactcctcaatcaactctgtaaa

SEQ ID NO: 34765 - DNA, 25 bp, Rattus norvegicus
aagactcctcatctttgttccagga

SEQ ID NO: 34766 - DNA, 25 bp, Rattus norvegicus
aagactcctcatgtttgttccagga

SEQ ID NO: 34767 - DNA, 25 bp, Rattus norvegicus
aagactcctctcaagtttcagcaaa

SEQ ID NO: 34768 - DNA, 25 bp, Rattus norvegicus
aagactcctctctagtttcagcaaa

SEQ ID NO: 34769 - DNA, 25 bp, Rattus norvegicus
aagactcctgtcacattccaagaaa

SEQ ID NO: 34770 - DNA, 25 bp, Rattus norvegicus
aagactcctgtctcattccaagaaa

SEQ ID NO: 34771 - DNA, 25 bp, Rattus norvegicus
aagactcctttactgcatctcgtgg

SEQ ID NO: 34772 - DNA, 25 bp, Rattus norvegicus
aagactcctttagtgcatctcgtgg

SEQ ID NO: 34773 - DNA, 25 bp, Rattus norvegicus
aagactcgagtgaagctgccttcgg

SEQ ID NO: 34774 - DNA, 25 bp, Rattus norvegicus
aagactcgagtgtagctgccttcgg

SEQ ID NO: 34775 - DNA, 25 bp, Rattus norvegicus
aagactcgcctgaaaaaagcaaagt

SEQ ID NO: 34776 - DNA, 25 bp, Rattus norvegicus
aagactcgcctgtaaaaagcaaagt

SEQ ID NO: 34777 - DNA, 25 bp, Rattus norvegicus
aagactcgctgacgcaggctctgaa

SEQ ID NO: 34778 - DNA, 25 bp, Rattus norvegicus
aagactcgctgaggcaggctctgaa

SEQ ID NO: 34779 - DNA, 25 bp, Rattus norvegicus
aagactcggaaccagccaaggcaca

SEQ ID NO: 34780 - DNA, 25 bp, Rattus norvegicus
aagactcggaacgagccaaggcaca

SEQ ID NO: 34781 - DNA, 25 bp, Rattus norvegicus
aagactcggctgattatgccacttt

SEQ ID NO: 34782 - DNA, 25 bp, Rattus norvegicus
aagactcggctgtttatgccacttt

SEQ ID NO: 34783 - DNA, 25 bp, Rattus norvegicus
aagactcgttctacacaatttggtg

SEQ ID NO: 34784 - DNA, 25 bp, Rattus norvegicus
aagactcgttcttcacaatttggtg

SEQ ID NO: 34785 - DNA, 25 bp, Rattus norvegicus
aagactctaacaacctgaggtgaag

SEQ ID NO: 34786 - DNA, 25 bp, Rattus norvegicus
aagactctaacatcctgaggtgaag

SEQ ID NO: 34787 - DNA, 25 bp, Rattus norvegicus
aagactctagaaaagcggtgccgaa

SEQ ID NO: 34788 - DNA, 25 bp, Rattus norvegicus
aagactctagaatagcggtgccgaa

SEQ ID NO: 34789 - DNA, 25 bp, Rattus norvegicus
aagactctagatatatttggaaggt

SEQ ID NO: 34790 - DNA, 25 bp, Rattus norvegicus
aagactctagatttatttggaaggt

SEQ ID NO: 34791 - DNA, 25 bp, Rattus norvegicus
aagactctatgtcagtccaggccag

SEQ ID NO: 34792 - DNA, 25 bp, Rattus norvegicus
aagactctatgtgagtccaggccag

SEQ ID NO: 34793 - DNA, 25 bp, Rattus norvegicus
aagactctcactcaacctgaagttc

SEQ ID NO: 34794 - DNA, 25 bp, Rattus norvegicus
aagactctcactgaacctgaagttc

SEQ ID NO: 34795 - DNA, 25 bp, Rattus norvegicus
aagactctcagtccttcctggacag

SEQ ID NO: 34796 - DNA, 25 bp, Rattus norvegicus
aagactctcagtgcttcctggacag

SEQ ID NO: 34797 - DNA, 25 bp, Rattus norvegicus
aagactctcgcaagctgcctccttt

SEQ ID NO: 34798 - DNA, 25 bp, Rattus norvegicus
aagactctcgcatgctgcctccttt

SEQ ID NO: 34799 - DNA, 25 bp, Rattus norvegicus
aagactctcgggagaagccgcatca

SEQ ID NO: 34800 - DNA, 25 bp, Rattus norvegicus
aagactctcgggtgaagccgcatca

SEQ ID NO: 34801 - DNA, 25 bp, Rattus norvegicus
aagactctctcaattgatacaccat

SEQ ID NO: 34802 - DNA, 25 bp, Rattus norvegicus
aagactctctcatttgatacaccat

SEQ ID NO: 34803 - DNA, 25 bp, Rattus norvegicus
aagactctctggctgaagatccgca

SEQ ID NO: 34804 - DNA, 25 bp, Rattus norvegicus
aagactctctgggtgaagatccgca

SEQ ID NO: 34805 - DNA, 25 bp, Rattus norvegicus
aagactctgagaaaggcctgcctgt

SEQ ID NO: 34806 - DNA, 25 bp, Rattus norvegicus
aagactctgagataggcctgcctgt

SEQ ID NO: 34807 - DNA, 25 bp, Rattus norvegicus
aagactctggaacatcgccgagtga

SEQ ID NO: 34808 - DNA, 25 bp, Rattus norvegicus
aagactctggaagatcgccgagtga

SEQ ID NO: 34809 - DNA, 25 bp, Rattus norvegicus
aagactctggagagcctgcctacta

SEQ ID NO: 34810 - DNA, 25 bp, Rattus norvegicus
aagactctggagcttcaacatctga

SEQ ID NO: 34811 - DNA, 25 bp, Rattus norvegicus
aagactctggaggttcaacatctga

SEQ ID NO: 34812 - DNA, 25 bp, Rattus norvegicus
aagactctggagtgcctgcctacta

SEQ ID NO: 34813 - DNA, 25 bp, Rattus norvegicus
aagactctgggtcttatcttcgcta

SEQ ID NO: 34814 - DNA, 25 bp, Rattus norvegicus
aagactctgggtgttatcttcgcta

SEQ ID NO: 34815 - DNA, 25 bp, Rattus norvegicus
aagactctggtacaaggtgtgccat

SEQ ID NO: 34816 - DNA, 25 bp, Rattus norvegicus
aagactctggtagaaggtgtgccat

SEQ ID NO: 34817 - DNA, 25 bp, Rattus norvegicus
aagactctggtgcaactgcaaggat

SEQ ID NO: 34818 - DNA, 25 bp, Rattus norvegicus
aagactctggtggaactgcaaggat

SEQ ID NO: 34819 - DNA, 25 bp, Rattus norvegicus
aagactctgtcaacacttagccatc

SEQ ID NO: 34820 - DNA, 25 bp, Rattus norvegicus
aagactctgtcatcacttagccatc

SEQ ID NO: 34821 - DNA, 25 bp, Rattus norvegicus
aagactctgtccctattcacttgtc

SEQ ID NO: 34822 - DNA, 25 bp, Rattus norvegicus
aagactctgtccgtattcacttgtc

SEQ ID NO: 34823 - DNA, 25 bp, Rattus norvegicus
aagactctgtggatacctcactggc

SEQ ID NO: 34824 - DNA, 25 bp, Rattus norvegicus
aagactctgtggcaccatggtaaca

SEQ ID NO: 34825 - DNA, 25 bp, Rattus norvegicus
aagactctgtggctatgaacatcaa

SEQ ID NO: 34826 - DNA, 25 bp, Rattus norvegicus
aagactctgtgggaccatggtaaca

SEQ ID NO: 34827 - DNA, 25 bp, Rattus norvegicus
aagactctgtgggtatgaacatcaa

SEQ ID NO: 34828 - DNA, 25 bp, Rattus norvegicus
aagactctgtggttacctcactggc

SEQ ID NO: 34829 - DNA, 25 bp, Rattus norvegicus
aagactctgttacggcatggtgcaa

SEQ ID NO: 34830 - DNA, 25 bp, Rattus norvegicus
aagactctgttagggcatggtgcaa

SEQ ID NO: 34831 - DNA, 25 bp, Rattus norvegicus
aagactcttcccagtagggagccat

SEQ ID NO: 34832 - DNA, 25 bp, Rattus norvegicus
aagactcttccccatatgcagagat

SEQ ID NO: 34833 - DNA, 25 bp, Rattus norvegicus
aagactcttcccgatatgcagagat

SEQ ID NO: 34834 - DNA, 25 bp, Rattus norvegicus
aagactcttccctgtagggagccat

SEQ ID NO: 34835 - DNA, 25 bp, Rattus norvegicus
aagactcttcttctgaagctggatg

SEQ ID NO: 34836 - DNA, 25 bp, Rattus norvegicus
aagactcttcttgtgaagctggatg

SEQ ID NO: 34837 - DNA, 25 bp, Rattus norvegicus
aagactcttgaaacctgttacccct

SEQ ID NO: 34838 - DNA, 25 bp, Rattus norvegicus
aagactcttgaatcctgttacccct

SEQ ID NO: 34839 - DNA, 25 bp, Rattus norvegicus
aagactcttgagaggcctggcaact

SEQ ID NO: 34840 - DNA, 25 bp, Rattus norvegicus
aagactcttgagagttttcctgtcc

SEQ ID NO: 34841 - DNA, 25 bp, Rattus norvegicus
aagactcttgagtggcctggcaact

SEQ ID NO: 34842 - DNA, 25 bp, Rattus norvegicus
aagactcttgagtgttttcctgtcc

SEQ ID NO: 34843 - DNA, 25 bp, Rattus norvegicus
aagactcttgggagcttcagcttgg

SEQ ID NO: 34844 - DNA, 25 bp, Rattus norvegicus
aagactcttgggtgcttcagcttgg

SEQ ID NO: 34845 - DNA, 25 bp, Rattus norvegicus
aagactcttgtcagtgtttcagaag

SEQ ID NO: 34846 - DNA, 25 bp, Rattus norvegicus
aagactcttgtctgtgtttcagaag

SEQ ID NO: 34847 - DNA, 25 bp, Rattus norvegicus
aagactgaaaccagagcgccgtctg

SEQ ID NO: 34848 - DNA, 25 bp, Rattus norvegicus
aagactgaaacctgagcgccgtctg

SEQ ID NO: 34849 - DNA, 25 bp, Rattus norvegicus
aagactgaacgtaaggcctcctgcc

SEQ ID NO: 34850 - DNA, 25 bp, Rattus norvegicus
aagactgaacgttaggcctcctgcc

SEQ ID NO: 34851 - DNA, 25 bp, Rattus norvegicus
aagactgaagacaacacggtgacaa

SEQ ID NO: 34852 - DNA, 25 bp, Rattus norvegicus
aagactgaagactacacggtgacaa

SEQ ID NO: 34853 - DNA, 25 bp, Rattus norvegicus
aagactgaatcactgtcctttctca

SEQ ID NO: 34854 - DNA, 25 bp, Rattus norvegicus
aagactgaatcagtgtcctttctca

SEQ ID NO: 34855 - DNA, 25 bp, Rattus norvegicus
aagactgaatctcttagcttccaac

SEQ ID NO: 34856 - DNA, 25 bp, Rattus norvegicus
aagactgaatctgttagcttccaac

SEQ ID NO: 34857 - DNA, 25 bp, Rattus norvegicus
aagactgaccggagtctcattgtct

SEQ ID NO: 34858 - DNA, 25 bp, Rattus norvegicus
aagactgaccggtgtctcattgtct

SEQ ID NO: 34859 - DNA, 25 bp, Rattus norvegicus
aagactgactgcaggctgcggcctg

SEQ ID NO: 34860 - DNA, 25 bp, Rattus norvegicus
aagactgactgctggctgcggcctg

SEQ ID NO: 34861 - DNA, 25 bp, Rattus norvegicus
aagactgagcagcttgttcttgcct

SEQ ID NO: 34862 - DNA, 25 bp, Rattus norvegicus
aagactgagcaggttgttcttgcct

SEQ ID NO: 34863 - DNA, 25 bp, Rattus norvegicus
aagactgaggaaacgcgggtttgct

SEQ ID NO: 34864 - DNA, 25 bp, Rattus norvegicus
aagactgaggaatcgcgggtttgct

SEQ ID NO: 34865 - DNA, 25 bp, Rattus norvegicus
aagactgaggatagtccctgagctc

SEQ ID NO: 34866 - DNA, 25 bp, Rattus norvegicus
aagactgaggattgtccctgagctc

SEQ ID NO: 34867 - DNA, 25 bp, Rattus norvegicus
aagactgaggtcacggaactccgac

SEQ ID NO: 34868 - DNA, 25 bp, Rattus norvegicus
aagactgaggtctcggaactccgac

SEQ ID NO: 34869 - DNA, 25 bp, Rattus norvegicus
aagactgagttcctgcagtaccaag

SEQ ID NO: 34870 - DNA, 25 bp, Rattus norvegicus
aagactgagttcgtgcagtaccaag

SEQ ID NO: 34871 - DNA, 25 bp, Rattus norvegicus
aagactgatgtgatgattttactga

SEQ ID NO: 34872 - DNA, 25 bp, Rattus norvegicus
aagactgatgtgctggctccttaac

SEQ ID NO: 34873 - DNA, 25 bp, Rattus norvegicus
aagactgatgtggtggctccttaac

SEQ ID NO: 34874 - DNA, 25 bp, Rattus norvegicus
aagactgatgtgttgattttactga

SEQ ID NO: 34875 - DNA, 25 bp, Rattus norvegicus
aagactgattgacctgtccattcaa

SEQ ID NO: 34876 - DNA, 25 bp, Rattus norvegicus
aagactgattgagctgtccattcaa

SEQ ID NO: 34877 - DNA, 25 bp, Rattus norvegicus
aagactgattggcaatccgtccggc

SEQ ID NO: 34878 - DNA, 25 bp, Rattus norvegicus
aagactgattgggaatccgtccggc

SEQ ID NO: 34879 - DNA, 25 bp, Rattus norvegicus
aagactgatttccacagcctggagt

SEQ ID NO: 34880 - DNA, 25 bp, Rattus norvegicus
aagactgatttcgacagcctggagt

SEQ ID NO: 34881 - DNA, 25 bp, Rattus norvegicus
aagactgcaacgaccagggccgctg

SEQ ID NO: 34882 - DNA, 25 bp, Rattus norvegicus
aagactgcaacgtccagggccgctg

SEQ ID NO: 34883 - DNA, 25 bp, Rattus norvegicus
aagactgcacggcaccagttataaa

SEQ ID NO: 34884 - DNA, 25 bp, Rattus norvegicus
aagactgcacgggaccagttataaa

SEQ ID NO: 34885 - DNA, 25 bp, Rattus norvegicus
aagactgcagcaccctggtgacctg

SEQ ID NO: 34886 - DNA, 25 bp, Rattus norvegicus
aagactgcagcagcctggtgacctg

SEQ ID NO: 34887 - DNA, 25 bp, Rattus norvegicus
aagactgcaggaaactcatgctcaa

SEQ ID NO: 34888 - DNA, 25 bp, Rattus norvegicus
aagactgcaggatactcatgctcaa

SEQ ID NO: 34889 - DNA, 25 bp, Rattus norvegicus
aagactgcagtgcaacagctccagt

SEQ ID NO: 34890 - DNA, 25 bp, Rattus norvegicus
aagactgcagtggaacagctccagt

SEQ ID NO: 34891 - DNA, 25 bp, Rattus norvegicus
aagactgcatctacctaactcaagc

SEQ ID NO: 34892 - DNA, 25 bp, Rattus norvegicus
aagactgcatcttcctaactcaagc

SEQ ID NO: 34893 - DNA, 25 bp, Rattus norvegicus
aagactgcatgtattgtaccaccat

SEQ ID NO: 34894 - DNA, 25 bp, Rattus norvegicus
aagactgcatgttttgtaccaccat

SEQ ID NO: 34895 - DNA, 25 bp, Rattus norvegicus
aagactgccacgagccttaggaata

SEQ ID NO: 34896 - DNA, 25 bp, Rattus norvegicus
aagactgccacgtgccttaggaata

SEQ ID NO: 34897 - DNA, 25 bp, Rattus norvegicus
aagactgcccatagttgtctccggg

SEQ ID NO: 34898 - DNA, 25 bp, Rattus norvegicus
aagactgcccatcactgatcaagac

SEQ ID NO: 34899 - DNA, 25 bp, Rattus norvegicus
aagactgcccatgactgatcaagac

SEQ ID NO: 34900 - DNA, 25 bp, Rattus norvegicus
aagactgcccattgttgtctccggg

SEQ ID NO: 34901 - DNA, 25 bp, Rattus norvegicus
aagactgccctacgccagatgttta

SEQ ID NO: 34902 - DNA, 25 bp, Rattus norvegicus
aagactgccctaggccagatgttta

SEQ ID NO: 34903 - DNA, 25 bp, Rattus norvegicus
aagactgcctctctcatggtcacta

SEQ ID NO: 34904 - DNA, 25 bp, Rattus norvegicus
aagactgcctctgtcatggtcacta

SEQ ID NO: 34905 - DNA, 25 bp, Rattus norvegicus
aagactgcgcacagcgggtcaagga

SEQ ID NO: 34906 - DNA, 25 bp, Rattus norvegicus
aagactgcgcactgcgggtcaagga

SEQ ID NO: 34907 - DNA, 25 bp, Rattus norvegicus
aagactgcgcgtagctcaaggacac

SEQ ID NO: 34908 - DNA, 25 bp, Rattus norvegicus
aagactgcgcgttgctcaaggacac

SEQ ID NO: 34909 - DNA, 25 bp, Rattus norvegicus
aagactgcgtccaaagtttcccatg

SEQ ID NO: 34910 - DNA, 25 bp, Rattus norvegicus
aagactgcgtcctaagtttcccatg

SEQ ID NO: 34911 - DNA, 25 bp, Rattus norvegicus
aagactgcgtgactagagccttctc

SEQ ID NO: 34912 - DNA, 25 bp, Rattus norvegicus
aagactgcgtgagtagagccttctc

SEQ ID NO: 34913 - DNA, 25 bp, Rattus norvegicus
aagactgctcatatttaatgttgta

SEQ ID NO: 34914 - DNA, 25 bp, Rattus norvegicus
aagactgctcatttttaatgttgta

SEQ ID NO: 34915 - DNA, 25 bp, Rattus norvegicus
aagactgctctaatttccactgaaa

SEQ ID NO: 34916 - DNA, 25 bp, Rattus norvegicus
aagactgctctattttccactgaaa

SEQ ID NO: 34917 - DNA, 25 bp, Rattus norvegicus
aagactgctgaccttgtgggaccag

SEQ ID NO: 34918 - DNA, 25 bp, Rattus norvegicus
aagactgctgacgttgtgggaccag

SEQ ID NO: 34919 - DNA, 25 bp, Rattus norvegicus
aagactgctgatctggaaatactaa

SEQ ID NO: 34920 - DNA, 25 bp, Rattus norvegicus
aagactgctgatgtggaaatactaa

SEQ ID NO: 34921 - DNA, 25 bp, Rattus norvegicus
aagactgctgtactatttgttgacc

SEQ ID NO: 34922 - DNA, 25 bp, Rattus norvegicus
aagactgctgtagtatttgttgacc

SEQ ID NO: 34923 - DNA, 25 bp, Rattus norvegicus
aagactgctgtcatgcagaacggga

SEQ ID NO: 34924 - DNA, 25 bp, Rattus norvegicus
aagactgctgtcttgcagaacggga

SEQ ID NO: 34925 - DNA, 25 bp, Rattus norvegicus
aagactgctgtgactggtggaaatc

SEQ ID NO: 34926 - DNA, 25 bp, Rattus norvegicus
aagactgctgtgtctggtggaaatc

SEQ ID NO: 34927 - DNA, 25 bp, Rattus norvegicus
aagactgctttacttcatggctgtt

SEQ ID NO: 34928 - DNA, 25 bp, Rattus norvegicus
aagactgctttagttcatggctgtt

SEQ ID NO: 34929 - DNA, 25 bp, Rattus norvegicus
aagactggaatcaggtggagctcgt

SEQ ID NO: 34930 - DNA, 25 bp, Rattus norvegicus
aagactggaatctggtggagctcgt

SEQ ID NO: 34931 - DNA, 25 bp, Rattus norvegicus
aagactggacagactctggcctcag

SEQ ID NO: 34932 - DNA, 25 bp, Rattus norvegicus
aagactggacagtctctggcctcag

SEQ ID NO: 34933 - DNA, 25 bp, Rattus norvegicus
aagactggactccattgtctagccc

SEQ ID NO: 34934 - DNA, 25 bp, Rattus norvegicus
aagactggactcgattgtctagccc

SEQ ID NO: 34935 - DNA, 25 bp, Rattus norvegicus
aagactggagagaccggtgacagcc

SEQ ID NO: 34936 - DNA, 25 bp, Rattus norvegicus
aagactggagagtccggtgacagcc

SEQ ID NO: 34937 - DNA, 25 bp, Rattus norvegicus
aagactggagcaaccactgcgggat

SEQ ID NO: 34938 - DNA, 25 bp, Rattus norvegicus
aagactggagcatccactgcgggat

SEQ ID NO: 34939 - DNA, 25 bp, Rattus norvegicus
aagactggagtcaacatccttcgtc

SEQ ID NO: 34940 - DNA, 25 bp, Rattus norvegicus
aagactggagtctacatccttcgtc

SEQ ID NO: 34941 - DNA, 25 bp, Rattus norvegicus
aagactggagttccaccactgggac

SEQ ID NO: 34942 - DNA, 25 bp, Rattus norvegicus
aagactggagttgcaccactgggac

SEQ ID NO: 34943 - DNA, 25 bp, Rattus norvegicus
aagactggatcaaggactgggacga

SEQ ID NO: 34944 - DNA, 25 bp, Rattus norvegicus
aagactggatcatggactgggacga

SEQ ID NO: 34945 - DNA, 25 bp, Rattus norvegicus
aagactggatgaccctttattcctc

SEQ ID NO: 34946 - DNA, 25 bp, Rattus norvegicus
aagactggatgagcctttattcctc

SEQ ID NO: 34947 - DNA, 25 bp, Rattus norvegicus
aagactggattcctgcttgactcga

SEQ ID NO: 34948 - DNA, 25 bp, Rattus norvegicus
aagactggattcgtgcttgactcga

SEQ ID NO: 34949 - DNA, 25 bp, Rattus norvegicus
aagactggcagaaggagctctacaa

SEQ ID NO: 34950 - DNA, 25 bp, Rattus norvegicus
aagactggcagatggagctctacaa

SEQ ID NO: 34951 - DNA, 25 bp, Rattus norvegicus
aagactggcagcattgttctcaagt

SEQ ID NO: 34952 - DNA, 25 bp, Rattus norvegicus
aagactggcagctttgttctcaagt

SEQ ID NO: 34953 - DNA, 25 bp, Rattus norvegicus
aagactgggaagactctgttaacat

SEQ ID NO: 34954 - DNA, 25 bp, Rattus norvegicus
aagactgggaagtctctgttaacat

SEQ ID NO: 34955 - DNA, 25 bp, Rattus norvegicus
aagactgggactcaacctggacctt

SEQ ID NO: 34956 - DNA, 25 bp, Rattus norvegicus
aagactgggactgaacctggacctt

SEQ ID NO: 34957 - DNA, 25 bp, Rattus norvegicus
aagactgggcaaactgcatcatgag

SEQ ID NO: 34958 - DNA, 25 bp, Rattus norvegicus
aagactgggcaatctgcatcatgag

SEQ ID NO: 34959 - DNA, 25 bp, Rattus norvegicus
aagactgggcatctccctgagggtt

SEQ ID NO: 34960 - DNA, 25 bp, Rattus norvegicus
aagactgggcatgtccctgagggtt

SEQ ID NO: 34961 - DNA, 25 bp, Rattus norvegicus
aagactgggccaaccctagggagaa

SEQ ID NO: 34962 - DNA, 25 bp, Rattus norvegicus
aagactgggccacctgttgtcagaa

SEQ ID NO: 34963 - DNA, 25 bp, Rattus norvegicus
aagactgggccagctgttgtcagaa

SEQ ID NO: 34964 - DNA, 25 bp, Rattus norvegicus
aagactgggccatccctagggagaa

SEQ ID NO: 34965 - DNA, 25 bp, Rattus norvegicus
aagactgggcccattcagactgatg

SEQ ID NO: 34966 - DNA, 25 bp, Rattus norvegicus
aagactgggccctttcagactgatg

SEQ ID NO: 34967 - DNA, 25 bp, Rattus norvegicus
aagactgggcgcagttcgagtccga

SEQ ID NO: 34968 - DNA, 25 bp, Rattus norvegicus
aagactgggcgctgttcgagtccga

SEQ ID NO: 34969 - DNA, 25 bp, Rattus norvegicus
aagactgggctgagtttgtgaagct

SEQ ID NO: 34970 - DNA, 25 bp, Rattus norvegicus
aagactgggctgtgtttgtgaagct

SEQ ID NO: 34971 - DNA, 25 bp, Rattus norvegicus
aagactgggtctcattttgtaggcg

SEQ ID NO: 34972 - DNA, 25 bp, Rattus norvegicus
aagactgggtctgattttgtaggcg

SEQ ID NO: 34973 - DNA, 25 bp, Rattus norvegicus
aagactgggtggacacttcccttgg

SEQ ID NO: 34974 - DNA, 25 bp, Rattus norvegicus
aagactgggtggtcacttcccttgg

SEQ ID NO: 34975 - DNA, 25 bp, Rattus norvegicus
aagactgggtgtagccacatatcct

SEQ ID NO: 34976 - DNA, 25 bp, Rattus norvegicus
aagactgggtgttgccacatatcct

SEQ ID NO: 34977 - DNA, 25 bp, Rattus norvegicus
aagactggtcggaagccttacactg

SEQ ID NO: 34978 - DNA, 25 bp, Rattus norvegicus
aagactggtcggtagccttacactg

SEQ ID NO: 34979 - DNA, 25 bp, Rattus norvegicus
aagactggtgctactgcttttaaag

SEQ ID NO: 34980 - DNA, 25 bp, Rattus norvegicus
aagactggtgctctaactgctgtgg

SEQ ID NO: 34981 - DNA, 25 bp, Rattus norvegicus
aagactggtgctgtaactgctgtgg

SEQ ID NO: 34982 - DNA, 25 bp, Rattus norvegicus
aagactggtgcttctgcttttaaag

SEQ ID NO: 34983 - DNA, 25 bp, Rattus norvegicus
aagactggtggtcaaccagacaccc

SEQ ID NO: 34984 - DNA, 25 bp, Rattus norvegicus
aagactggtggtgaaccagacaccc

SEQ ID NO: 34985 - DNA, 25 bp, Rattus norvegicus
aagactggttggcagccatggccac

SEQ ID NO: 34986 - DNA, 25 bp, Rattus norvegicus
aagactggttgggagccatggccac

SEQ ID NO: 34987 - DNA, 25 bp, Rattus norvegicus
aagactgtaccaccagctcacactt

SEQ ID NO: 34988 - DNA, 25 bp, Rattus norvegicus
aagactgtaccagcagctcacactt

SEQ ID NO: 34989 - DNA, 25 bp, Rattus norvegicus
aagactgtagacacgagctgaccct

SEQ ID NO: 34990 - DNA, 25 bp, Rattus norvegicus
aagactgtagactcgagctgaccct

SEQ ID NO: 34991 - DNA, 25 bp, Rattus norvegicus
aagactgtatttacaccacacctct

SEQ ID NO: 34992 - DNA, 25 bp, Rattus norvegicus
aagactgtattttcaccacacctct

SEQ ID NO: 34993 - DNA, 25 bp, Rattus norvegicus
aagactgtcaatatggtgctgtgtg

SEQ ID NO: 34994 - DNA, 25 bp, Rattus norvegicus
aagactgtcaatttggtgctgtgtg

SEQ ID NO: 34995 - DNA, 25 bp, Rattus norvegicus
aagactgtcactctgtcgtgcgagt

SEQ ID NO: 34996 - DNA, 25 bp, Rattus norvegicus
aagactgtcactgtgtcgtgcgagt

SEQ ID NO: 34997 - DNA, 25 bp, Rattus norvegicus
aagactgtccaaaaagcacctgaga

SEQ ID NO: 34998 - DNA, 25 bp, Rattus norvegicus
aagactgtccaataagcacctgaga

SEQ ID NO: 34999 - DNA, 25 bp, Rattus norvegicus
aagactgtcctgacttgttttgaat

SEQ ID NO: 35000 - DNA, 25 bp, Rattus norvegicus
aagactgtcctgtcttgttttgaat

SEQ ID NO: 35001 - DNA, 25 bp, Rattus norvegicus
aagactgtcgtgaacgggttcttct

SEQ ID NO: 35002 - DNA, 25 bp, Rattus norvegicus
aagactgtcgtgtacgggttcttct

SEQ ID NO: 35003 - DNA, 25 bp, Rattus norvegicus
aagactgtctaacacctgtttcatt

SEQ ID NO: 35004 - DNA, 25 bp, Rattus norvegicus
aagactgtctaagacctgtttcatt

SEQ ID NO: 35005 - DNA, 25 bp, Rattus norvegicus
aagactgtcttaagccctggtgatg

SEQ ID NO: 35006 - DNA, 25 bp, Rattus norvegicus
aagactgtcttatgccctggtgatg

SEQ ID NO: 35007 - DNA, 25 bp, Rattus norvegicus
aagactgtcttcagaacttggtgaa

SEQ ID NO: 35008 - DNA, 25 bp, Rattus norvegicus
aagactgtcttctgaacttggtgaa

SEQ ID NO: 35009 - DNA, 25 bp, Rattus norvegicus
aagactgtgagcagtggtttcactg

SEQ ID NO: 35010 - DNA, 25 bp, Rattus norvegicus
aagactgtgagctgtggtttcactg

SEQ ID NO: 35011 - DNA, 25 bp, Rattus norvegicus
aagactgtgaggagtgtgtcccaat

SEQ ID NO: 35012 - DNA, 25 bp, Rattus norvegicus
aagactgtgaggtgtgtgtcccaat

SEQ ID NO: 35013 - DNA, 25 bp, Rattus norvegicus
aagactgtgcccactgaaaaactaa

SEQ ID NO: 35014 - DNA, 25 bp, Rattus norvegicus
aagactgtgccctctgaaaaactaa

SEQ ID NO: 35015 - DNA, 25 bp, Rattus norvegicus
aagactgtgctacctttttctgttg

SEQ ID NO: 35016 - DNA, 25 bp, Rattus norvegicus
aagactgtgctagctttttctgttg

SEQ ID NO: 35017 - DNA, 25 bp, Rattus norvegicus
aagactgtgggcatcgatgacctaa

SEQ ID NO: 35018 - DNA, 25 bp, Rattus norvegicus
aagactgtgggcttcgatgacctaa

SEQ ID NO: 35019 - DNA, 25 bp, Rattus norvegicus
aagactgtggtcaccccaattctag

SEQ ID NO: 35020 - DNA, 25 bp, Rattus norvegicus
aagactgtggtctccccaattctag

SEQ ID NO: 35021 - DNA, 25 bp, Rattus norvegicus
aagactgtgtaaagtggtccttttt

SEQ ID NO: 35022 - DNA, 25 bp, Rattus norvegicus
aagactgtgtaatgtggtccttttt

SEQ ID NO: 35023 - DNA, 25 bp, Rattus norvegicus
aagactgtgtatatccctactagag

SEQ ID NO: 35024 - DNA, 25 bp, Rattus norvegicus
aagactgtgtatcgtggccctacgg

SEQ ID NO: 35025 - DNA, 25 bp, Rattus norvegicus
aagactgtgtatggtggccctacgg

SEQ ID NO: 35026 - DNA, 25 bp, Rattus norvegicus
aagactgtgtatttccctactagag

SEQ ID NO: 35027 - DNA, 25 bp, Rattus norvegicus
aagactgtgtgaatgcgtgttctgc

SEQ ID NO: 35028 - DNA, 25 bp, Rattus norvegicus
aagactgtgtgattgcgtgttctgc

SEQ ID NO: 35029 - DNA, 25 bp, Rattus norvegicus
aagactgtgtggcattacgttggca

SEQ ID NO: 35030 - DNA, 25 bp, Rattus norvegicus
aagactgtgtgggattacgttggca

SEQ ID NO: 35031 - DNA, 25 bp, Rattus norvegicus
aagactgtgttcatctgcagcggat

SEQ ID NO: 35032 - DNA, 25 bp, Rattus norvegicus
aagactgtgttcttctgcagcggat

SEQ ID NO: 35033 - DNA, 25 bp, Rattus norvegicus
aagactgttcttatcgggctactgt

SEQ ID NO: 35034 - DNA, 25 bp, Rattus norvegicus
aagactgttcttttcgggctactgt

SEQ ID NO: 35035 - DNA, 25 bp, Rattus norvegicus
aagactgttgccagctgtccttttc

SEQ ID NO: 35036 - DNA, 25 bp, Rattus norvegicus
aagactgttgcctgctgtccttttc

SEQ ID NO: 35037 - DNA, 25 bp, Rattus norvegicus
aagactgttgtgatctttgttcaat

SEQ ID NO: 35038 - DNA, 25 bp, Rattus norvegicus
aagactgttgtgcatctagactgta

SEQ ID NO: 35039 - DNA, 25 bp, Rattus norvegicus
aagactgttgtggatctagactgta

SEQ ID NO: 35040 - DNA, 25 bp, Rattus norvegicus
aagactgttgtgttctttgttcaat

SEQ ID NO: 35041 - DNA, 25 bp, Rattus norvegicus
aagactgtttccctgagttatcgca

SEQ ID NO: 35042 - DNA, 25 bp, Rattus norvegicus
aagactgtttccgtgagttatcgca

SEQ ID NO: 35043 - DNA, 25 bp, Rattus norvegicus
aagacttaaatgctgccccaagtga

SEQ ID NO: 35044 - DNA, 25 bp, Rattus norvegicus
aagacttaaatggtgccccaagtga

SEQ ID NO: 35045 - DNA, 25 bp, Rattus norvegicus
aagacttaaccaaggctgtcctctc

SEQ ID NO: 35046 - DNA, 25 bp, Rattus norvegicus
aagacttaaccatggctgtcctctc

SEQ ID NO: 35047 - DNA, 25 bp, Rattus norvegicus
aagacttaagttctcttgagcgcaa

SEQ ID NO: 35048 - DNA, 25 bp, Rattus norvegicus
aagacttaagttgtcttgagcgcaa

SEQ ID NO: 35049 - DNA, 25 bp, Rattus norvegicus
aagacttacaaacttccctgcagaa

SEQ ID NO: 35050 - DNA, 25 bp, Rattus norvegicus
aagacttacaaagttccctgcagaa

SEQ ID NO: 35051 - DNA, 25 bp, Rattus norvegicus
aagacttactttccagcttcctatc

SEQ ID NO: 35052 - DNA, 25 bp, Rattus norvegicus
aagacttactttgcagcttcctatc

SEQ ID NO: 35053 - DNA, 25 bp, Rattus norvegicus
aagacttagaacaacccagcaaggt

SEQ ID NO: 35054 - DNA, 25 bp, Rattus norvegicus
aagacttagaactacccagcaaggt

SEQ ID NO: 35055 - DNA, 25 bp, Rattus norvegicus
aagacttagcaaactgctggtgtaa

SEQ ID NO: 35056 - DNA, 25 bp, Rattus norvegicus
aagacttagcaatctgctggtgtaa

SEQ ID NO: 35057 - DNA, 25 bp, Rattus norvegicus
aagacttagggcagccagcttccac

SEQ ID NO: 35058 - DNA, 25 bp, Rattus norvegicus
aagacttagggctgccagcttccac

SEQ ID NO: 35059 - DNA, 25 bp, Rattus norvegicus
aagacttatacgacggcttgtcacc

SEQ ID NO: 35060 - DNA, 25 bp, Rattus norvegicus
aagacttatacgtcggcttgtcacc

SEQ ID NO: 35061 - DNA, 25 bp, Rattus norvegicus
aagacttatcttctgcctgacaagt

SEQ ID NO: 35062 - DNA, 25 bp, Rattus norvegicus
aagacttatcttgtgcctgacaagt

SEQ ID NO: 35063 - DNA, 25 bp, Rattus norvegicus
aagacttattttaatgccaggcata

SEQ ID NO: 35064 - DNA, 25 bp, Rattus norvegicus
aagacttatttttatgccaggcata

SEQ ID NO: 35065 - DNA, 25 bp, Rattus norvegicus
aagacttcaaacagatactgcctga

SEQ ID NO: 35066 - DNA, 25 bp, Rattus norvegicus
aagacttcaaactgatactgcctga

SEQ ID NO: 35067 - DNA, 25 bp, Rattus norvegicus
aagacttcaaagatttctgctgtaa

SEQ ID NO: 35068 - DNA, 25 bp, Rattus norvegicus
aagacttcaaagttttctgctgtaa

SEQ ID NO: 35069 - DNA, 25 bp, Rattus norvegicus
aagacttcagggaccatgttcaaga

SEQ ID NO: 35070 - DNA, 25 bp, Rattus norvegicus
aagacttcagggtccatgttcaaga

SEQ ID NO: 35071 - DNA, 25 bp, Rattus norvegicus
aagacttcagtcactggatggccgc

SEQ ID NO: 35072 - DNA, 25 bp, Rattus norvegicus
aagacttcagtctctggatggccgc

SEQ ID NO: 35073 - DNA, 25 bp, Rattus norvegicus
aagacttcatagctaccactgagga

SEQ ID NO: 35074 - DNA, 25 bp, Rattus norvegicus
aagacttcatagctttggcgcaacg

SEQ ID NO: 35075 - DNA, 25 bp, Rattus norvegicus
aagacttcataggtaccactgagga

SEQ ID NO: 35076 - DNA, 25 bp, Rattus norvegicus
aagacttcataggtttggcgcaacg

SEQ ID NO: 35077 - DNA, 25 bp, Rattus norvegicus
aagacttcatcaacagccagacact

SEQ ID NO: 35078 - DNA, 25 bp, Rattus norvegicus
aagacttcatcatcagccagacact

SEQ ID NO: 35079 - DNA, 25 bp, Rattus norvegicus
aagacttccaaacgctttgctcacc

SEQ ID NO: 35080 - DNA, 25 bp, Rattus norvegicus
aagacttccaaaggctttgctcacc

SEQ ID NO: 35081 - DNA, 25 bp, Rattus norvegicus
aagacttccatgaatacccagtaat

SEQ ID NO: 35082 - DNA, 25 bp, Rattus norvegicus
aagacttccatgtatacccagtaat

SEQ ID NO: 35083 - DNA, 25 bp, Rattus norvegicus
aagacttcccagctaatgagttatt

SEQ ID NO: 35084 - DNA, 25 bp, Rattus norvegicus
aagacttcccaggtaatgagttatt

SEQ ID NO: 35085 - DNA, 25 bp, Rattus norvegicus
aagacttcctagattgtctgtggac

SEQ ID NO: 35086 - DNA, 25 bp, Rattus norvegicus
aagacttcctagtttgtctgtggac

SEQ ID NO: 35087 - DNA, 25 bp, Rattus norvegicus
aagacttcctgcaaagagcactgac

SEQ ID NO: 35088 - DNA, 25 bp, Rattus norvegicus
aagacttcctgctaagagcactgac

SEQ ID NO: 35089 - DNA, 25 bp, Rattus norvegicus
aagacttccttgagatcagatgaga

SEQ ID NO: 35090 - DNA, 25 bp, Rattus norvegicus
aagacttccttgtgatcagatgaga

SEQ ID NO: 35091 - DNA, 25 bp, Rattus norvegicus
aagacttcgcttacttgcataagtg

SEQ ID NO: 35092 - DNA, 25 bp, Rattus norvegicus
aagacttcgctttcttgcataagtg

SEQ ID NO: 35093 - DNA, 25 bp, Rattus norvegicus
aagacttcgggcaccagcataaaaa

SEQ ID NO: 35094 - DNA, 25 bp, Rattus norvegicus
aagacttcgggctccagcataaaaa

SEQ ID NO: 35095 - DNA, 25 bp, Rattus norvegicus
aagacttctagaccagccaacgtat

SEQ ID NO: 35096 - DNA, 25 bp, Rattus norvegicus
aagacttctagagcagccaacgtat

SEQ ID NO: 35097 - DNA, 25 bp, Rattus norvegicus
aagacttctcagatctcttcttatc

SEQ ID NO: 35098 - DNA, 25 bp, Rattus norvegicus
aagacttctcagttctcttcttatc

SEQ ID NO: 35099 - DNA, 25 bp, Rattus norvegicus
aagacttctcgtagtgtacccatgg

SEQ ID NO: 35100 - DNA, 25 bp, Rattus norvegicus
aagacttctcgttgtgtacccatgg

SEQ ID NO: 35101 - DNA, 25 bp, Rattus norvegicus
aagacttcttatactctggccctgt

SEQ ID NO: 35102 - DNA, 25 bp, Rattus norvegicus
aagacttcttattctctggccctgt

SEQ ID NO: 35103 - DNA, 25 bp, Rattus norvegicus
aagacttgagatatcccattcccag

SEQ ID NO: 35104 - DNA, 25 bp, Rattus norvegicus
aagacttgagatttcccattcccag

SEQ ID NO: 35105 - DNA, 25 bp, Rattus norvegicus
aagacttgagctatgtgcaattaga

SEQ ID NO: 35106 - DNA, 25 bp, Rattus norvegicus
aagacttgagctttgtgcaattaga

SEQ ID NO: 35107 - DNA, 25 bp, Rattus norvegicus
aagacttgagtccactgtgggcagc

SEQ ID NO: 35108 - DNA, 25 bp, Rattus norvegicus
aagacttgagtcgactgtgggcagc

SEQ ID NO: 35109 - DNA, 25 bp, Rattus norvegicus
aagacttgagtgagatagctgctgg

SEQ ID NO: 35110 - DNA, 25 bp, Rattus norvegicus
aagacttgagtgtgatagctgctgg

SEQ ID NO: 35111 - DNA, 25 bp, Rattus norvegicus
aagacttgataaaccccttcataga

SEQ ID NO: 35112 - DNA, 25 bp, Rattus norvegicus
aagacttgataatccccttcataga

SEQ ID NO: 35113 - DNA, 25 bp, Rattus norvegicus
aagacttgccatatttctattgtaa

SEQ ID NO: 35114 - DNA, 25 bp, Rattus norvegicus
aagacttgccatttttctattgtaa

SEQ ID NO: 35115 - DNA, 25 bp, Rattus norvegicus
aagacttgctgccaaattctgcctt

SEQ ID NO: 35116 - DNA, 25 bp, Rattus norvegicus
aagacttgctgcgaaattctgcctt

SEQ ID NO: 35117 - DNA, 25 bp, Rattus norvegicus
aagacttgctggcagtcctctcaag

SEQ ID NO: 35118 - DNA, 25 bp, Rattus norvegicus
aagacttgctggctaggtccgttct

SEQ ID NO: 35119 - DNA, 25 bp, Rattus norvegicus
aagacttgctgggagtcctctcaag

SEQ ID NO: 35120 - DNA, 25 bp, Rattus norvegicus
aagacttgctgggtaggtccgttct

SEQ ID NO: 35121 - DNA, 25 bp, Rattus norvegicus
aagacttggactcctccggcaagaa

SEQ ID NO: 35122 - DNA, 25 bp, Rattus norvegicus
aagacttggactgctccggcaagaa

SEQ ID NO: 35123 - DNA, 25 bp, Rattus norvegicus
aagacttggatgagcagcaagcaac

SEQ ID NO: 35124 - DNA, 25 bp, Rattus norvegicus
aagacttggatgtgcagcaagcaac

SEQ ID NO: 35125 - DNA, 25 bp, Rattus norvegicus
aagacttggccaacatgttccgttt

SEQ ID NO: 35126 - DNA, 25 bp, Rattus norvegicus
aagacttggccatcatgttccgttt

SEQ ID NO: 35127 - DNA, 25 bp, Rattus norvegicus
aagacttggctaagtgcatttcagt

SEQ ID NO: 35128 - DNA, 25 bp, Rattus norvegicus
aagacttggctatgtgcatttcagt

SEQ ID NO: 35129 - DNA, 25 bp, Rattus norvegicus
aagacttggcttcctatacctgtac

SEQ ID NO: 35130 - DNA, 25 bp, Rattus norvegicus
aagacttggcttgctatacctgtac

SEQ ID NO: 35131 - DNA, 25 bp, Rattus norvegicus
aagacttgggtgagttctgacagat

SEQ ID NO: 35132 - DNA, 25 bp, Rattus norvegicus
aagacttgggtgtgttctgacagat

SEQ ID NO: 35133 - DNA, 25 bp, Rattus norvegicus
aagacttggttcagatctcgactct

SEQ ID NO: 35134 - DNA, 25 bp, Rattus norvegicus
aagacttggttctgatctcgactct

SEQ ID NO: 35135 - DNA, 25 bp, Rattus norvegicus
aagacttgtaccatgtgtggccacg

SEQ ID NO: 35136 - DNA, 25 bp, Rattus norvegicus
aagacttgtaccttgtgtggccacg

SEQ ID NO: 35137 - DNA, 25 bp, Rattus norvegicus
aagacttgtcagcagggaggcccaa

SEQ ID NO: 35138 - DNA, 25 bp, Rattus norvegicus
aagacttgtcaggagggaggcccaa

SEQ ID NO: 35139 - DNA, 25 bp, Rattus norvegicus
aagacttgtgttagagcttgggctg

SEQ ID NO: 35140 - DNA, 25 bp, Rattus norvegicus
aagacttgtgttctcattcttcttc

SEQ ID NO: 35141 - DNA, 25 bp, Rattus norvegicus
aagacttgtgttgtcattcttcttc

SEQ ID NO: 35142 - DNA, 25 bp, Rattus norvegicus
aagacttgtgtttgagcttgggctg

SEQ ID NO: 35143 - DNA, 25 bp, Rattus norvegicus
aagacttgtttaccacggcccacag

SEQ ID NO: 35144 - DNA, 25 bp, Rattus norvegicus
aagacttgtttagcacggcccacag

SEQ ID NO: 35145 - DNA, 25 bp, Rattus norvegicus
aagactttaaagcttctctccacgc

SEQ ID NO: 35146 - DNA, 25 bp, Rattus norvegicus
aagactttaaaggttctctccacgc

SEQ ID NO: 35147 - DNA, 25 bp, Rattus norvegicus
aagactttaactcgagactcctatt

SEQ ID NO: 35148 - DNA, 25 bp, Rattus norvegicus
aagactttaactggagactcctatt

SEQ ID NO: 35149 - DNA, 25 bp, Rattus norvegicus
aagactttaccaaccataggctggg

SEQ ID NO: 35150 - DNA, 25 bp, Rattus norvegicus
aagactttaccatccataggctggg

SEQ ID NO: 35151 - DNA, 25 bp, Rattus norvegicus
aagactttcaagattatgccttcaa

SEQ ID NO: 35152 - DNA, 25 bp, Rattus norvegicus
aagactttcaagtttatgccttcaa

SEQ ID NO: 35153 - DNA, 25 bp, Rattus norvegicus
aagactttcagaacgacaccagaga

SEQ ID NO: 35154 - DNA, 25 bp, Rattus norvegicus
aagactttcagatcgacaccagaga

SEQ ID NO: 35155 - DNA, 25 bp, Rattus norvegicus
aagactttcctgacatgtttaagaa

SEQ ID NO: 35156 - DNA, 25 bp, Rattus norvegicus
aagactttcctgtcatgtttaagaa

SEQ ID NO: 35157 - DNA, 25 bp, Rattus norvegicus
aagactttcgcccacagctgcagcg

SEQ ID NO: 35158 - DNA, 25 bp, Rattus norvegicus
aagactttcgccgacagctgcagcg

SEQ ID NO: 35159 - DNA, 25 bp, Rattus norvegicus
aagactttctgactagtgctcacag

SEQ ID NO: 35160 - DNA, 25 bp, Rattus norvegicus
aagactttctgagtagtgctcacag

SEQ ID NO: 35161 - DNA, 25 bp, Rattus norvegicus
aagactttgcaccttagccgattct

SEQ ID NO: 35162 - DNA, 25 bp, Rattus norvegicus
aagactttgcacgttagccgattct

SEQ ID NO: 35163 - DNA, 25 bp, Rattus norvegicus
aagactttgcctatcacatggctca

SEQ ID NO: 35164 - DNA, 25 bp, Rattus norvegicus
aagactttgcctttcacatggctca

SEQ ID NO: 35165 - DNA, 25 bp, Rattus norvegicus
aagactttgggcactttgcctggta

SEQ ID NO: 35166 - DNA, 25 bp, Rattus norvegicus
aagactttgggctctttgcctggta

SEQ ID NO: 35167 - DNA, 25 bp, Rattus norvegicus
aagactttgtgaacttgggttgcac

SEQ ID NO: 35168 - DNA, 25 bp, Rattus norvegicus
aagactttgtgatcttgggttgcac

SEQ ID NO: 35169 - DNA, 25 bp, Rattus norvegicus
aagactttgttcatccttcagatca

SEQ ID NO: 35170 - DNA, 25 bp, Rattus norvegicus
aagactttgttcttccttcagatca

SEQ ID NO: 35171 - DNA, 25 bp, Rattus norvegicus
aagacttttcccacttgtcgagtct

SEQ ID NO: 35172 - DNA, 25 bp, Rattus norvegicus
aagacttttccctcttgtcgagtct

SEQ ID NO: 35173 - DNA, 25 bp, Rattus norvegicus
aagacttttctaatgacaggtgcat

SEQ ID NO: 35174 - DNA, 25 bp, Rattus norvegicus
aagacttttctattgacaggtgcat

SEQ ID NO: 35175 - DNA, 25 bp, Rattus norvegicus
aagactttttataatctcatgtgaa

SEQ ID NO: 35176 - DNA, 25 bp, Rattus norvegicus
aagactttttattatctcatgtgaa

SEQ ID NO: 35177 - DNA, 25 bp, Rattus norvegicus
aagactttttgacgcccatctcctg

SEQ ID NO: 35178 - DNA, 25 bp, Rattus norvegicus
aagactttttgaggcccatctcctg

SEQ ID NO: 35179 - DNA, 25 bp, Rattus norvegicus
aagagaaaacccactctcaagaagg

SEQ ID NO: 35180 - DNA, 25 bp, Rattus norvegicus
aagagaaaaccctctctcaagaagg

SEQ ID NO: 35181 - DNA, 25 bp, Rattus norvegicus
aagagaaaactcagtttctctcctc

SEQ ID NO: 35182 - DNA, 25 bp, Rattus norvegicus
aagagaaaactctgtttctctcctc

SEQ ID NO: 35183 - DNA, 25 bp, Rattus norvegicus
aagagaaaactgcaacccacgcggg

SEQ ID NO: 35184 - DNA, 25 bp, Rattus norvegicus
aagagaaaactggaacccacgcggg

SEQ ID NO: 35185 - DNA, 25 bp, Rattus norvegicus
aagagaaaattcctcgcagggcgct

SEQ ID NO: 35186 - DNA, 25 bp, Rattus norvegicus
aagagaaaattcgtcgcagggcgct

SEQ ID NO: 35187 - DNA, 25 bp, Rattus norvegicus
aagagaaacactccctgcagaacag

SEQ ID NO: 35188 - DNA, 25 bp, Rattus norvegicus
aagagaaacactgcctgcagaacag

SEQ ID NO: 35189 - DNA, 25 bp, Rattus norvegicus
aagagaaacaggagccagtgtatat

SEQ ID NO: 35190 - DNA, 25 bp, Rattus norvegicus
aagagaaacaggtgccagtgtatat

SEQ ID NO: 35191 - DNA, 25 bp, Rattus norvegicus
aagagaaacggccatgtctacatgt

SEQ ID NO: 35192 - DNA, 25 bp, Rattus norvegicus
aagagaaacggcgatgtctacatgt

SEQ ID NO: 35193 - DNA, 25 bp, Rattus norvegicus
aagagaaagcacaccagaacttcgg

SEQ ID NO: 35194 - DNA, 25 bp, Rattus norvegicus
aagagaaagcactccagaacttcgg

SEQ ID NO: 35195 - DNA, 25 bp, Rattus norvegicus
aagagaaagccactgagctccctgt

SEQ ID NO: 35196 - DNA, 25 bp, Rattus norvegicus
aagagaaagccagtgagctccctgt

SEQ ID NO: 35197 - DNA, 25 bp, Rattus norvegicus
aagagaaagtccatcgctccgtatg

SEQ ID NO: 35198 - DNA, 25 bp, Rattus norvegicus
aagagaaagtccttcgctccgtatg

SEQ ID NO: 35199 - DNA, 25 bp, Rattus norvegicus
aagagaaatatgaccagctttactg

SEQ ID NO: 35200 - DNA, 25 bp, Rattus norvegicus
aagagaaatatgtccagctttactg

SEQ ID NO: 35201 - DNA, 25 bp, Rattus norvegicus
aagagaaatccactcactccctcag

SEQ ID NO: 35202 - DNA, 25 bp, Rattus norvegicus
aagagaaatccagtcactccctcag

SEQ ID NO: 35203 - DNA, 25 bp, Rattus norvegicus
aagagaacagttccggccttcagta

SEQ ID NO: 35204 - DNA, 25 bp, Rattus norvegicus
aagagaacagttgcggccttcagta

SEQ ID NO: 35205 - DNA, 25 bp, Rattus norvegicus
aagagaaccctgctttgccagagac

SEQ ID NO: 35206 - DNA, 25 bp, Rattus norvegicus
aagagaaccctggtttgccagagac

SEQ ID NO: 35207 - DNA, 25 bp, Rattus norvegicus
aagagaactcacagcgggtcacgga

SEQ ID NO: 35208 - DNA, 25 bp, Rattus norvegicus
aagagaactcactgcgggtcacgga

SEQ ID NO: 35209 - DNA, 25 bp, Rattus norvegicus
aagagaacttccaattggcacaagc

SEQ ID NO: 35210 - DNA, 25 bp, Rattus norvegicus
aagagaacttcctattggcacaagc

SEQ ID NO: 35211 - DNA, 25 bp, Rattus norvegicus
aagagaactttaatggacgccagtg

SEQ ID NO: 35212 - DNA, 25 bp, Rattus norvegicus
aagagaactttattggacgccagtg

SEQ ID NO: 35213 - DNA, 25 bp, Rattus norvegicus
aagagaactttgagcccttcatgaa

SEQ ID NO: 35214 - DNA, 25 bp, Rattus norvegicus
aagagaactttgtgcccttcatgaa

SEQ ID NO: 35215 - DNA, 25 bp, Rattus norvegicus
aagagaagacgacgccttccgagcg

SEQ ID NO: 35216 - DNA, 25 bp, Rattus norvegicus
aagagaagacgaggccttccgagcg

SEQ ID NO: 35217 - DNA, 25 bp, Rattus norvegicus
aagagaagacttcccgaagcccgat

SEQ ID NO: 35218 - DNA, 25 bp, Rattus norvegicus
aagagaagacttgccgaagcccgat

SEQ ID NO: 35219 - DNA, 25 bp, Rattus norvegicus
aagagaagataaccctgagccctgc

SEQ ID NO: 35220 - DNA, 25 bp, Rattus norvegicus
aagagaagataagcctgagccctgc

SEQ ID NO: 35221 - DNA, 25 bp, Rattus norvegicus
aagagaagattgccagcctcagtac

SEQ ID NO: 35222 - DNA, 25 bp, Rattus norvegicus
aagagaagattggcagcctcagtac

SEQ ID NO: 35223 - DNA, 25 bp, Rattus norvegicus
aagagaagcagtctcctcccttgtg

SEQ ID NO: 35224 - DNA, 25 bp, Rattus norvegicus
aagagaagcagtgtcctcccttgtg

SEQ ID NO: 35225 - DNA, 25 bp, Rattus norvegicus
aagagaagctgtcacctccttatag

SEQ ID NO: 35226 - DNA, 25 bp, Rattus norvegicus
aagagaagctgtcctggagcacaca

SEQ ID NO: 35227 - DNA, 25 bp, Rattus norvegicus
aagagaagctgtgacctccttatag

SEQ ID NO: 35228 - DNA, 25 bp, Rattus norvegicus
aagagaagctgtgctggagcacaca

SEQ ID NO: 35229 - DNA, 25 bp, Rattus norvegicus
aagagaagcttcaaccgacagtcgt

SEQ ID NO: 35230 - DNA, 25 bp, Rattus norvegicus
aagagaagcttctaccgacagtcgt

SEQ ID NO: 35231 - DNA, 25 bp, Rattus norvegicus
aagagaaggaccacatccaccgagt

SEQ ID NO: 35232 - DNA, 25 bp, Rattus norvegicus
aagagaaggaccctaggcgctgcct

SEQ ID NO: 35233 - DNA, 25 bp, Rattus norvegicus
aagagaaggaccgtaggcgctgcct

SEQ ID NO: 35234 - DNA, 25 bp, Rattus norvegicus
aagagaaggacctcatccaccgagt

SEQ ID NO: 35235 - DNA, 25 bp, Rattus norvegicus
aagagaaggctaaagccctccctgt

SEQ ID NO: 35236 - DNA, 25 bp, Rattus norvegicus
aagagaaggctatagccctccctgt

SEQ ID NO: 35237 - DNA, 25 bp, Rattus norvegicus
aagagaaggtacagtgtagcccctg

SEQ ID NO: 35238 - DNA, 25 bp, Rattus norvegicus
aagagaaggtactgtgtagcccctg

SEQ ID NO: 35239 - DNA, 25 bp, Rattus norvegicus
aagagaaggtgtcctcagagcctcc

SEQ ID NO: 35240 - DNA, 25 bp, Rattus norvegicus
aagagaaggtgtgctcagagcctcc

SEQ ID NO: 35241 - DNA, 25 bp, Rattus norvegicus
aagagaagtggcctttgccgcctcc

SEQ ID NO: 35242 - DNA, 25 bp, Rattus norvegicus
aagagaagtggcgtttgccgcctcc

SEQ ID NO: 35243 - DNA, 25 bp, Rattus norvegicus
aagagaagttccaccaagacctgga

SEQ ID NO: 35244 - DNA, 25 bp, Rattus norvegicus
aagagaagttcctccaagacctgga

SEQ ID NO: 35245 - DNA, 25 bp, Rattus norvegicus
aagagaatacagaccccagtctctc

SEQ ID NO: 35246 - DNA, 25 bp, Rattus norvegicus
aagagaatacagtccccagtctctc

SEQ ID NO: 35247 - DNA, 25 bp, Rattus norvegicus
aagagaatcactctccatgggtcaa

SEQ ID NO: 35248 - DNA, 25 bp, Rattus norvegicus
aagagaatcactgtccatgggtcaa

SEQ ID NO: 35249 - DNA, 25 bp, Rattus norvegicus
aagagaatcatgacccacaaccaca

SEQ ID NO: 35250 - DNA, 25 bp, Rattus norvegicus
aagagaatcatgtcccacaaccaca

SEQ ID NO: 35251 - DNA, 25 bp, Rattus norvegicus
aagagaatccaaactgcctgctgca

SEQ ID NO: 35252 - DNA, 25 bp, Rattus norvegicus
aagagaatccaatctgcctgctgca

SEQ ID NO: 35253 - DNA, 25 bp, Rattus norvegicus
aagagaatccaccattcccaggaat

SEQ ID NO: 35254 - DNA, 25 bp, Rattus norvegicus
aagagaatccacgattcccaggaat

SEQ ID NO: 35255 - DNA, 25 bp, Rattus norvegicus
aagagaatccagctacctggcctgt

SEQ ID NO: 35256 - DNA, 25 bp, Rattus norvegicus
aagagaatccaggtacctggcctgt

SEQ ID NO: 35257 - DNA, 25 bp, Rattus norvegicus
aagagaatcggtcctaagaggcttg

SEQ ID NO: 35258 - DNA, 25 bp, Rattus norvegicus
aagagaatcggtgctaagaggcttg

SEQ ID NO: 35259 - DNA, 25 bp, Rattus norvegicus
aagagaatctggctcatccttggct

SEQ ID NO: 35260 - DNA, 25 bp, Rattus norvegicus
aagagaatctgggtcatccttggct

SEQ ID NO: 35261 - DNA, 25 bp, Rattus norvegicus
aagagaatcttcctcccaagttcgc

SEQ ID NO: 35262 - DNA, 25 bp, Rattus norvegicus
aagagaatcttcgtcccaagttcgc

SEQ ID NO: 35263 - DNA, 25 bp, Rattus norvegicus
aagagaatggcaacacccaggccct

SEQ ID NO: 35264 - DNA, 25 bp, Rattus norvegicus
aagagaatggcatcacccaggccct

SEQ ID NO: 35265 - DNA, 25 bp, Rattus norvegicus
aagagaatgggccacccagtgaccc

SEQ ID NO: 35266 - DNA, 25 bp, Rattus norvegicus
aagagaatgggcgacccagtgaccc

SEQ ID NO: 35267 - DNA, 25 bp, Rattus norvegicus
aagagaattattccccagcaggaaa

SEQ ID NO: 35268 - DNA, 25 bp, Rattus norvegicus
aagagaattattgcccagcaggaaa

SEQ ID NO: 35269 - DNA, 25 bp, Rattus norvegicus
aagagaattgctacagtctagccgt

SEQ ID NO: 35270 - DNA, 25 bp, Rattus norvegicus
aagagaattgcttcagtctagccgt

SEQ ID NO: 35271 - DNA, 25 bp, Rattus norvegicus
aagagacaaaagacccacagcctcc

SEQ ID NO: 35272 - DNA, 25 bp, Rattus norvegicus
aagagacaaaagtcccacagcctcc

SEQ ID NO: 35273 - DNA, 25 bp, Rattus norvegicus
aagagacaacgacgactcctgccac

SEQ ID NO: 35274 - DNA, 25 bp, Rattus norvegicus
aagagacaacgaggactcctgccac

SEQ ID NO: 35275 - DNA, 25 bp, Rattus norvegicus
aagagacacacacttccctgaagga

SEQ ID NO: 35276 - DNA, 25 bp, Rattus norvegicus
aagagacacacagttccctgaagga

SEQ ID NO: 35277 - DNA, 25 bp, Rattus norvegicus
aagagacaccaaaggtaccgcagcc

SEQ ID NO: 35278 - DNA, 25 bp, Rattus norvegicus
aagagacaccaatggtaccgcagcc

SEQ ID NO: 35279 - DNA, 25 bp, Rattus norvegicus
aagagacaccacaccgctaggaaag

SEQ ID NO: 35280 - DNA, 25 bp, Rattus norvegicus
aagagacaccactccgctaggaaag

SEQ ID NO: 35281 - DNA, 25 bp, Rattus norvegicus
aagagacactcgatcctgggtggga

SEQ ID NO: 35282 - DNA, 25 bp, Rattus norvegicus
aagagacactcgttcctgggtggga

SEQ ID NO: 35283 - DNA, 25 bp, Rattus norvegicus
aagagacactgcactcataactcct

SEQ ID NO: 35284 - DNA, 25 bp, Rattus norvegicus
aagagacactgcagaagagaccaag

SEQ ID NO: 35285 - DNA, 25 bp, Rattus norvegicus
aagagacactgctctcataactcct

SEQ ID NO: 35286 - DNA, 25 bp, Rattus norvegicus
aagagacactgctgaagagaccaag

SEQ ID NO: 35287 - DNA, 25 bp, Rattus norvegicus
aagagacagctgatgcgctccttgt

SEQ ID NO: 35288 - DNA, 25 bp, Rattus norvegicus
aagagacagctgttgcgctccttgt

SEQ ID NO: 35289 - DNA, 25 bp, Rattus norvegicus
aagagacagcttcccatcttggtca

SEQ ID NO: 35290 - DNA, 25 bp, Rattus norvegicus
aagagacagcttgccatcttggtca

SEQ ID NO: 35291 - DNA, 25 bp, Rattus norvegicus
aagagacaggtcatcatccatcctg

SEQ ID NO: 35292 - DNA, 25 bp, Rattus norvegicus
aagagacaggtcttcatccatcctg

SEQ ID NO: 35293 - DNA, 25 bp, Rattus norvegicus
aagagacagtctccacactggtgtt

SEQ ID NO: 35294 - DNA, 25 bp, Rattus norvegicus
aagagacagtctgcacactggtgtt

SEQ ID NO: 35295 - DNA, 25 bp, Rattus norvegicus
aagagacagtttccatcacatggag

SEQ ID NO: 35296 - DNA, 25 bp, Rattus norvegicus
aagagacagtttgcatcacatggag

SEQ ID NO: 35297 - DNA, 25 bp, Rattus norvegicus
aagagacatcctcgcaagagtccgc

SEQ ID NO: 35298 - DNA, 25 bp, Rattus norvegicus
aagagacatcctggcaagagtccgc

SEQ ID NO: 35299 - DNA, 25 bp, Rattus norvegicus
aagagacatctcagttactgcccct

SEQ ID NO: 35300 - DNA, 25 bp, Rattus norvegicus
aagagacatctctgttactgcccct

SEQ ID NO: 35301 - DNA, 25 bp, Rattus norvegicus
aagagacatggtacctgagcaggcg

SEQ ID NO: 35302 - DNA, 25 bp, Rattus norvegicus
aagagacatggttcctgagcaggcg

SEQ ID NO: 35303 - DNA, 25 bp, Rattus norvegicus
aagagacatgttcgtgttctgacac

SEQ ID NO: 35304 - DNA, 25 bp, Rattus norvegicus
aagagacatgttggtgttctgacac

SEQ ID NO: 35305 - DNA, 25 bp, Rattus norvegicus
aagagacattctaggccctggaggg

SEQ ID NO: 35306 - DNA, 25 bp, Rattus norvegicus
aagagacattcttggccctggaggg

SEQ ID NO: 35307 - DNA, 25 bp, Rattus norvegicus
aagagacattgaactcaggccctgg

SEQ ID NO: 35308 - DNA, 25 bp, Rattus norvegicus
aagagacattgatctcaggccctgg

SEQ ID NO: 35309 - DNA, 25 bp, Rattus norvegicus
aagagaccactcagtgccaagtcaa

SEQ ID NO: 35310 - DNA, 25 bp, Rattus norvegicus
aagagaccactctgtgccaagtcaa

SEQ ID NO: 35311 - DNA, 25 bp, Rattus norvegicus
aagagaccagatagggtcccgggca

SEQ ID NO: 35312 - DNA, 25 bp, Rattus norvegicus
aagagaccagattgggtcccgggca

SEQ ID NO: 35313 - DNA, 25 bp, Rattus norvegicus
aagagaccatgtccttttgtatgac

SEQ ID NO: 35314 - DNA, 25 bp, Rattus norvegicus
aagagaccatgtgcttttgtatgac

SEQ ID NO: 35315 - DNA, 25 bp, Rattus norvegicus
aagagacccataagcctgtgtactg

SEQ ID NO: 35316 - DNA, 25 bp, Rattus norvegicus
aagagacccatatgcctgtgtactg

SEQ ID NO: 35317 - DNA, 25 bp, Rattus norvegicus
aagagacccggaacctgtgatcttc

SEQ ID NO: 35318 - DNA, 25 bp, Rattus norvegicus
aagagacccggatcctgtgatcttc

SEQ ID NO: 35319 - DNA, 25 bp, Rattus norvegicus
aagagaccctgaccaaattgaccat

SEQ ID NO: 35320 - DNA, 25 bp, Rattus norvegicus
aagagaccctgagcaaattgaccat

SEQ ID NO: 35321 - DNA, 25 bp, Rattus norvegicus
aagagaccctgcattaaacaccaag

SEQ ID NO: 35322 - DNA, 25 bp, Rattus norvegicus
aagagaccctgctttaaacaccaag

SEQ ID NO: 35323 - DNA, 25 bp, Rattus norvegicus
aagagaccctggaggacagtccgca

SEQ ID NO: 35324 - DNA, 25 bp, Rattus norvegicus
aagagaccctggtggacagtccgca

SEQ ID NO: 35325 - DNA, 25 bp, Rattus norvegicus
aagagacccttcatgtgacggaagt

SEQ ID NO: 35326 - DNA, 25 bp, Rattus norvegicus
aagagacccttcttgtgacggaagt

SEQ ID NO: 35327 - DNA, 25 bp, Rattus norvegicus
aagagacctacacagtggcccacga

SEQ ID NO: 35328 - DNA, 25 bp, Rattus norvegicus
aagagacctacagagtggcccacga

SEQ ID NO: 35329 - DNA, 25 bp, Rattus norvegicus
aagagacctactattgacctcagcc

SEQ ID NO: 35330 - DNA, 25 bp, Rattus norvegicus
aagagacctacttttgacctcagcc

SEQ ID NO: 35331 - DNA, 25 bp, Rattus norvegicus
aagagacctggtatctgagaccaaa

SEQ ID NO: 35332 - DNA, 25 bp, Rattus norvegicus
aagagacctggtttctgagaccaaa

SEQ ID NO: 35333 - DNA, 25 bp, Rattus norvegicus
aagagaccttcaagtacttcctccg

SEQ ID NO: 35334 - DNA, 25 bp, Rattus norvegicus
aagagaccttcatgtacttcctccg

SEQ ID NO: 35335 - DNA, 25 bp, Rattus norvegicus
aagagaccttctatcctctgtactt

SEQ ID NO: 35336 - DNA, 25 bp, Rattus norvegicus
aagagaccttctttcctctgtactt

SEQ ID NO: 35337 - DNA, 25 bp, Rattus norvegicus
aagagaccttgtacagcctgtcaga

SEQ ID NO: 35338 - DNA, 25 bp, Rattus norvegicus
aagagaccttgttcagcctgtcaga

SEQ ID NO: 35339 - DNA, 25 bp, Rattus norvegicus
aagagacggctcaggagctgcagcc

SEQ ID NO: 35340 - DNA, 25 bp, Rattus norvegicus
aagagacggctctggagctgcagcc

SEQ ID NO: 35341 - DNA, 25 bp, Rattus norvegicus
aagagacggtcaccctcaagaggga

SEQ ID NO: 35342 - DNA, 25 bp, Rattus norvegicus
aagagacggtcagcctcaagaggga

SEQ ID NO: 35343 - DNA, 25 bp, Rattus norvegicus
aagagacgtatcagccggatgccgc

SEQ ID NO: 35344 - DNA, 25 bp, Rattus norvegicus
aagagacgtatctgccggatgccgc

SEQ ID NO: 35345 - DNA, 25 bp, Rattus norvegicus
aagagacgtttccactcagttttgt

SEQ ID NO: 35346 - DNA, 25 bp, Rattus norvegicus
aagagacgtttcgactcagttttgt

SEQ ID NO: 35347 - DNA, 25 bp, Rattus norvegicus
aagagactacagcaacgtgggaact

SEQ ID NO: 35348 - DNA, 25 bp, Rattus norvegicus
aagagactacaggaacgtgggaact

SEQ ID NO: 35349 - DNA, 25 bp, Rattus norvegicus
aagagactacgaatctcacgccttc

SEQ ID NO: 35350 - DNA, 25 bp, Rattus norvegicus
aagagactacgattctcacgccttc

SEQ ID NO: 35351 - DNA, 25 bp, Rattus norvegicus
aagagactagttcactcgtcctgga

SEQ ID NO: 35352 - DNA, 25 bp, Rattus norvegicus
aagagactagttgactcgtcctgga

SEQ ID NO: 35353 - DNA, 25 bp, Rattus norvegicus
aagagactatctaagctgctgattg

SEQ ID NO: 35354 - DNA, 25 bp, Rattus norvegicus
aagagactatcttagctgctgattg

SEQ ID NO: 35355 - DNA, 25 bp, Rattus norvegicus
aagagactcagtcgcaatgtggatg

SEQ ID NO: 35356 - DNA, 25 bp, Rattus norvegicus
aagagactcagtggcaatgtggatg

SEQ ID NO: 35357 - DNA, 25 bp, Rattus norvegicus
aagagactcctcactataggaaggg

SEQ ID NO: 35358 - DNA, 25 bp, Rattus norvegicus
aagagactcctctctataggaaggg

SEQ ID NO: 35359 - DNA, 25 bp, Rattus norvegicus
aagagactccttctgcaatctccct

SEQ ID NO: 35360 - DNA, 25 bp, Rattus norvegicus
aagagactccttgtgcaatctccct

SEQ ID NO: 35361 - DNA, 25 bp, Rattus norvegicus
aagagactctgccaagtgagctcaa

SEQ ID NO: 35362 - DNA, 25 bp, Rattus norvegicus
aagagactctgcgaagtgagctcaa

SEQ ID NO: 35363 - DNA, 25 bp, Rattus norvegicus
aagagactctgtagccttcctgaag

SEQ ID NO: 35364 - DNA, 25 bp, Rattus norvegicus
aagagactctgttgccttcctgaag

SEQ ID NO: 35365 - DNA, 25 bp, Rattus norvegicus
aagagactcttgcatttccattctg

SEQ ID NO: 35366 - DNA, 25 bp, Rattus norvegicus
aagagactcttggatttccattctg

SEQ ID NO: 35367 - DNA, 25 bp, Rattus norvegicus
aagagactgactcagaactctctgt

SEQ ID NO: 35368 - DNA, 25 bp, Rattus norvegicus
aagagactgactgagaactctctgt

SEQ ID NO: 35369 - DNA, 25 bp, Rattus norvegicus
aagagactgatgacgccgcgaaacc

SEQ ID NO: 35370 - DNA, 25 bp, Rattus norvegicus
aagagactgatgtcgccgcgaaacc

SEQ ID NO: 35371 - DNA, 25 bp, Rattus norvegicus
aagagactgcctattcaagcaccgt

SEQ ID NO: 35372 - DNA, 25 bp, Rattus norvegicus
aagagactgccttttcaagcaccgt

SEQ ID NO: 35373 - DNA, 25 bp, Rattus norvegicus
aagagactgtgtcttcctcttccga

SEQ ID NO: 35374 - DNA, 25 bp, Rattus norvegicus
aagagactgtgtgttcctcttccga

SEQ ID NO: 35375 - DNA, 25 bp, Rattus norvegicus
aagagactgttcaagctgctggaat

SEQ ID NO: 35376 - DNA, 25 bp, Rattus norvegicus
aagagactgttctagctgctggaat

SEQ ID NO: 35377 - DNA, 25 bp, Rattus norvegicus
aagagacttccacagcaccagcgct

SEQ ID NO: 35378 - DNA, 25 bp, Rattus norvegicus
aagagacttccagagcaccagcgct

SEQ ID NO: 35379 - DNA, 25 bp, Rattus norvegicus
aagagacttctgacacgggtccggc

SEQ ID NO: 35380 - DNA, 25 bp, Rattus norvegicus
aagagacttctgacatgactactgg

SEQ ID NO: 35381 - DNA, 25 bp, Rattus norvegicus
aagagacttctgtcacgggtccggc

SEQ ID NO: 35382 - DNA, 25 bp, Rattus norvegicus
aagagacttctgtcatgactactgg

SEQ ID NO: 35383 - DNA, 25 bp, Rattus norvegicus
aagagacttcttcgcctgagttcag

SEQ ID NO: 35384 - DNA, 25 bp, Rattus norvegicus
aagagacttcttggcctgagttcag

SEQ ID NO: 35385 - DNA, 25 bp, Rattus norvegicus
aagagagaaaacacccgggatgctg

SEQ ID NO: 35386 - DNA, 25 bp, Rattus norvegicus
aagagagaaaactcccgggatgctg

SEQ ID NO: 35387 - DNA, 25 bp, Rattus norvegicus
aagagagaaaatcacccaaggacaa

SEQ ID NO: 35388 - DNA, 25 bp, Rattus norvegicus
aagagagaaaatgacccaaggacaa

SEQ ID NO: 35389 - DNA, 25 bp, Rattus norvegicus
aagagagaacatatgtttccctggg

SEQ ID NO: 35390 - DNA, 25 bp, Rattus norvegicus
aagagagaacatttgtttccctggg

SEQ ID NO: 35391 - DNA, 25 bp, Rattus norvegicus
aagagagaacttcactgaactatca

SEQ ID NO: 35392 - DNA, 25 bp, Rattus norvegicus
aagagagaacttgactgaactatca

SEQ ID NO: 35393 - DNA, 25 bp, Rattus norvegicus
aagagagacactcctataccctggg

SEQ ID NO: 35394 - DNA, 25 bp, Rattus norvegicus
aagagagacactgctataccctggg

SEQ ID NO: 35395 - DNA, 25 bp, Rattus norvegicus
aagagagaccccatccaggaaagtg

SEQ ID NO: 35396 - DNA, 25 bp, Rattus norvegicus
aagagagaccccttccaggaaagtg

SEQ ID NO: 35397 - DNA, 25 bp, Rattus norvegicus
aagagagacgtcacctcagaaccat

SEQ ID NO: 35398 - DNA, 25 bp, Rattus norvegicus
aagagagacgtctcctcagaaccat

SEQ ID NO: 35399 - DNA, 25 bp, Rattus norvegicus
aagagagactccattcatggtgtct

SEQ ID NO: 35400 - DNA, 25 bp, Rattus norvegicus
aagagagactcctttcatggtgtct

SEQ ID NO: 35401 - DNA, 25 bp, Rattus norvegicus
aagagagagacacccaggctcctgg

SEQ ID NO: 35402 - DNA, 25 bp, Rattus norvegicus
aagagagagacagccaggctcctgg

SEQ ID NO: 35403 - DNA, 25 bp, Rattus norvegicus
aagagagagaggacagatgcactgt

SEQ ID NO: 35404 - DNA, 25 bp, Rattus norvegicus
aagagagagaggtcagatgcactgt

SEQ ID NO: 35405 - DNA, 25 bp, Rattus norvegicus
aagagagagcacaccagaaccattt

SEQ ID NO: 35406 - DNA, 25 bp, Rattus norvegicus
aagagagagcactccagaaccattt

SEQ ID NO: 35407 - DNA, 25 bp, Rattus norvegicus
aagagagagcagaccccaggctagc

SEQ ID NO: 35408 - DNA, 25 bp, Rattus norvegicus
aagagagagcagtccccaggctagc

SEQ ID NO: 35409 - DNA, 25 bp, Rattus norvegicus
aagagagagctgcttcagcgtccca

SEQ ID NO: 35410 - DNA, 25 bp, Rattus norvegicus
aagagagagctggttcagcgtccca

SEQ ID NO: 35411 - DNA, 25 bp, Rattus norvegicus
aagagagagcttctctgctggcctc

SEQ ID NO: 35412 - DNA, 25 bp, Rattus norvegicus
aagagagagcttgtctgctggcctc

SEQ ID NO: 35413 - DNA, 25 bp, Rattus norvegicus
aagagagatcctctgcgatccccat

SEQ ID NO: 35414 - DNA, 25 bp, Rattus norvegicus
aagagagatcctgtgcgatccccat

SEQ ID NO: 35415 - DNA, 25 bp, Rattus norvegicus
aagagagatcttccatatgtaagga

SEQ ID NO: 35416 - DNA, 25 bp, Rattus norvegicus
aagagagatcttgcatatgtaagga

SEQ ID NO: 35417 - DNA, 25 bp, Rattus norvegicus
aagagagcactgagcgtccagaacc

SEQ ID NO: 35418 - DNA, 25 bp, Rattus norvegicus
aagagagcactgtgcgtccagaacc

SEQ ID NO: 35419 - DNA, 25 bp, Rattus norvegicus
aagagagcagacatcctcagagaca

SEQ ID NO: 35420 - DNA, 25 bp, Rattus norvegicus
aagagagcagacttcctcagagaca

SEQ ID NO: 35421 - DNA, 25 bp, Rattus norvegicus
aagagagcagcaagcctttgccatc

SEQ ID NO: 35422 - DNA, 25 bp, Rattus norvegicus
aagagagcagcatgcctttgccatc

SEQ ID NO: 35423 - DNA, 25 bp, Rattus norvegicus
aagagagcaggcactgtgcgctgcc

SEQ ID NO: 35424 - DNA, 25 bp, Rattus norvegicus
aagagagcaggctctgtgcgctgcc

SEQ ID NO: 35425 - DNA, 25 bp, Rattus norvegicus
aagagagccaacacccattacttgt

SEQ ID NO: 35426 - DNA, 25 bp, Rattus norvegicus
aagagagccaactcccattacttgt

SEQ ID NO: 35427 - DNA, 25 bp, Rattus norvegicus
aagagagccatccaccagaggacaa

SEQ ID NO: 35428 - DNA, 25 bp, Rattus norvegicus
aagagagccatcgaccagaggacaa

SEQ ID NO: 35429 - DNA, 25 bp, Rattus norvegicus
aagagagccatgcttctacacgcca

SEQ ID NO: 35430 - DNA, 25 bp, Rattus norvegicus
aagagagccatggttctacacgcca

SEQ ID NO: 35431 - DNA, 25 bp, Rattus norvegicus
aagagagccggaactcagtgcccgt

SEQ ID NO: 35432 - DNA, 25 bp, Rattus norvegicus
aagagagccggatctcagtgcccgt

SEQ ID NO: 35433 - DNA, 25 bp, Rattus norvegicus
aagagagccgtcagtacacaggcgt

SEQ ID NO: 35434 - DNA, 25 bp, Rattus norvegicus
aagagagccgtctgtacacaggcgt

SEQ ID NO: 35435 - DNA, 25 bp, Rattus norvegicus
aagagagcgcctatctcattcagaa

SEQ ID NO: 35436 - DNA, 25 bp, Rattus norvegicus
aagagagcgcctttctcattcagaa

SEQ ID NO: 35437 - DNA, 25 bp, Rattus norvegicus
aagagagcgcgcaccggctccaaag

SEQ ID NO: 35438 - DNA, 25 bp, Rattus norvegicus
aagagagcgcgctccggctccaaag

SEQ ID NO: 35439 - DNA, 25 bp, Rattus norvegicus
aagagagctactcggccatcctgat

SEQ ID NO: 35440 - DNA, 25 bp, Rattus norvegicus
aagagagctactgggccatcctgat

SEQ ID NO: 35441 - DNA, 25 bp, Rattus norvegicus
aagagagctattcacccagagttct

SEQ ID NO: 35442 - DNA, 25 bp, Rattus norvegicus
aagagagctattgacccagagttct

SEQ ID NO: 35443 - DNA, 25 bp, Rattus norvegicus
aagagagctctcaacttcctagtca

SEQ ID NO: 35444 - DNA, 25 bp, Rattus norvegicus
aagagagctctcatagctgtcacag

SEQ ID NO: 35445 - DNA, 25 bp, Rattus norvegicus
aagagagctctctacttcctagtca

SEQ ID NO: 35446 - DNA, 25 bp, Rattus norvegicus
aagagagctctcttagctgtcacag

SEQ ID NO: 35447 - DNA, 25 bp, Rattus norvegicus
aagagagctgcaccctttgagatct

SEQ ID NO: 35448 - DNA, 25 bp, Rattus norvegicus
aagagagctgcagcctttgagatct

SEQ ID NO: 35449 - DNA, 25 bp, Rattus norvegicus
aagagagctggcatccactgaacgg

SEQ ID NO: 35450 - DNA, 25 bp, Rattus norvegicus
aagagagctggcttccactgaacgg

SEQ ID NO: 35451 - DNA, 25 bp, Rattus norvegicus
aagagagctgtcacaaggaccgcag

SEQ ID NO: 35452 - DNA, 25 bp, Rattus norvegicus
aagagagctgtctcaaggaccgcag

SEQ ID NO: 35453 - DNA, 25 bp, Rattus norvegicus
aagagagctttcctcttcctggaga

SEQ ID NO: 35454 - DNA, 25 bp, Rattus norvegicus
aagagagctttcgtcttcctggaga

SEQ ID NO: 35455 - DNA, 25 bp, Rattus norvegicus
aagagaggacaccattgaactgccc

SEQ ID NO: 35456 - DNA, 25 bp, Rattus norvegicus
aagagaggacacgattgaactgccc

SEQ ID NO: 35457 - DNA, 25 bp, Rattus norvegicus
aagagaggattcaatggaagacaga

SEQ ID NO: 35458 - DNA, 25 bp, Rattus norvegicus
aagagaggattctatggaagacaga

SEQ ID NO: 35459 - DNA, 25 bp, Rattus norvegicus
aagagaggcacgagtccgaggcccc

SEQ ID NO: 35460 - DNA, 25 bp, Rattus norvegicus
aagagaggcacgtgtccgaggcccc

SEQ ID NO: 35461 - DNA, 25 bp, Rattus norvegicus
aagagaggcagcatctacctcagac

SEQ ID NO: 35462 - DNA, 25 bp, Rattus norvegicus
aagagaggcagcttctacctcagac

SEQ ID NO: 35463 - DNA, 25 bp, Rattus norvegicus
aagagaggcctcagctgcttgtgac

SEQ ID NO: 35464 - DNA, 25 bp, Rattus norvegicus
aagagaggcctctgctgcttgtgac

SEQ ID NO: 35465 - DNA, 25 bp, Rattus norvegicus
aagagaggccttcggtgataccatt

SEQ ID NO: 35466 - DNA, 25 bp, Rattus norvegicus
aagagaggccttgggtgataccatt

SEQ ID NO: 35467 - DNA, 25 bp, Rattus norvegicus
aagagaggctctatatttaataatt

SEQ ID NO: 35468 - DNA, 25 bp, Rattus norvegicus
aagagaggctctttatttaataatt

SEQ ID NO: 35469 - DNA, 25 bp, Rattus norvegicus
aagagagggcctcctccgaggaatt

SEQ ID NO: 35470 - DNA, 25 bp, Rattus norvegicus
aagagagggcctgctccgaggaatt

SEQ ID NO: 35471 - DNA, 25 bp, Rattus norvegicus
aagagagggctgatccacatgggcc

SEQ ID NO: 35472 - DNA, 25 bp, Rattus norvegicus
aagagagggctgttccacatgggcc

SEQ ID NO: 35473 - DNA, 25 bp, Rattus norvegicus
aagagagggtggagccctttctgct

SEQ ID NO: 35474 - DNA, 25 bp, Rattus norvegicus
aagagagggtggtgccctttctgct

SEQ ID NO: 35475 - DNA, 25 bp, Rattus norvegicus
aagagaggtaggcttccctccacag

SEQ ID NO: 35476 - DNA, 25 bp, Rattus norvegicus
aagagaggtagggttccctccacag

SEQ ID NO: 35477 - DNA, 25 bp, Rattus norvegicus
aagagaggtctgctcaatgaaactg

SEQ ID NO: 35478 - DNA, 25 bp, Rattus norvegicus
aagagaggtctggtcaatgaaactg

SEQ ID NO: 35479 - DNA, 25 bp, Rattus norvegicus
aagagaggttccacatgagcatgac

SEQ ID NO: 35480 - DNA, 25 bp, Rattus norvegicus
aagagaggttcctcatgagcatgac

SEQ ID NO: 35481 - DNA, 25 bp, Rattus norvegicus
aagagagtactcctacttccacaga

SEQ ID NO: 35482 - DNA, 25 bp, Rattus norvegicus
aagagagtactcgtacttccacaga

SEQ ID NO: 35483 - DNA, 25 bp, Rattus norvegicus
aagagagtagctacacgggaggcat

SEQ ID NO: 35484 - DNA, 25 bp, Rattus norvegicus
aagagagtagcttcacgggaggcat

SEQ ID NO: 35485 - DNA, 25 bp, Rattus norvegicus
aagagagtagttactgcaccctccc

SEQ ID NO: 35486 - DNA, 25 bp, Rattus norvegicus
aagagagtagtttctgcaccctccc

SEQ ID NO: 35487 - DNA, 25 bp, Rattus norvegicus
aagagagtcaccatgatttccaaag

SEQ ID NO: 35488 - DNA, 25 bp, Rattus norvegicus
aagagagtcaccttgatttccaaag

SEQ ID NO: 35489 - DNA, 25 bp, Rattus norvegicus
aagagagtccttattgcagcccatg

SEQ ID NO: 35490 - DNA, 25 bp, Rattus norvegicus
aagagagtcctttttgcagcccatg

SEQ ID NO: 35491 - DNA, 25 bp, Rattus norvegicus
aagagagtggctcttaatgcccaga

SEQ ID NO: 35492 - DNA, 25 bp, Rattus norvegicus
aagagagtggctgttaatgcccaga

SEQ ID NO: 35493 - DNA, 25 bp, Rattus norvegicus
aagagagtttgccattgtgcccact

SEQ ID NO: 35494 - DNA, 25 bp, Rattus norvegicus
aagagagtttgcgattgtgcccact

SEQ ID NO: 35495 - DNA, 25 bp, Rattus norvegicus
aagagataacatcacccttcctttt

SEQ ID NO: 35496 - DNA, 25 bp, Rattus norvegicus
aagagataacatgacccttcctttt

SEQ ID NO: 35497 - DNA, 25 bp, Rattus norvegicus
aagagataaggcaggcctcctgtgc

SEQ ID NO: 35498 - DNA, 25 bp, Rattus norvegicus
aagagataaggctggcctcctgtgc

SEQ ID NO: 35499 - DNA, 25 bp, Rattus norvegicus
aagagatactccacctgtgctgcct

SEQ ID NO: 35500 - DNA, 25 bp, Rattus norvegicus
aagagatactcctcctgtgctgcct

SEQ ID NO: 35501 - DNA, 25 bp, Rattus norvegicus
aagagatactggactgcactggtgg

SEQ ID NO: 35502 - DNA, 25 bp, Rattus norvegicus
aagagatactggtctgcactggtgg

SEQ ID NO: 35503 - DNA, 25 bp, Rattus norvegicus
aagagatcagttcatcatccccaaa

SEQ ID NO: 35504 - DNA, 25 bp, Rattus norvegicus
aagagatcagttgatcatccccaaa

SEQ ID NO: 35505 - DNA, 25 bp, Rattus norvegicus
aagagatccatgactttgcccaact

SEQ ID NO: 35506 - DNA, 25 bp, Rattus norvegicus
aagagatccatgtctttgcccaact

SEQ ID NO: 35507 - DNA, 25 bp, Rattus norvegicus
aagagatcccagaaattgtcattag

SEQ ID NO: 35508 - DNA, 25 bp, Rattus norvegicus
aagagatcccagtaattgtcattag

SEQ ID NO: 35509 - DNA, 25 bp, Rattus norvegicus
aagagatccccgcaagggtgcaaga

SEQ ID NO: 35510 - DNA, 25 bp, Rattus norvegicus
aagagatccccggaagggtgcaaga

SEQ ID NO: 35511 - DNA, 25 bp, Rattus norvegicus
aagagatccgagagctgtctgccac

SEQ ID NO: 35512 - DNA, 25 bp, Rattus norvegicus
aagagatccgagtgctgtctgccac

SEQ ID NO: 35513 - DNA, 25 bp, Rattus norvegicus
aagagatcgcccaagtgcgaagcaa

SEQ ID NO: 35514 - DNA, 25 bp, Rattus norvegicus
aagagatcgccctagtgcgaagcaa

SEQ ID NO: 35515 - DNA, 25 bp, Rattus norvegicus
aagagatcgtcactaacccgccaga

SEQ ID NO: 35516 - DNA, 25 bp, Rattus norvegicus
aagagatcgtcagtaacccgccaga

SEQ ID NO: 35517 - DNA, 25 bp, Rattus norvegicus
aagagatcgtctacacacacgcacg

SEQ ID NO: 35518 - DNA, 25 bp, Rattus norvegicus
aagagatcgtcttcacacacgcacg

SEQ ID NO: 35519 - DNA, 25 bp, Rattus norvegicus
aagagatctctgacgacagtgcccg

SEQ ID NO: 35520 - DNA, 25 bp, Rattus norvegicus
aagagatctctgtcgacagtgcccg

SEQ ID NO: 35521 - DNA, 25 bp, Rattus norvegicus
aagagatctcttctggcttacggtt

SEQ ID NO: 35522 - DNA, 25 bp, Rattus norvegicus
aagagatctcttgtggcttacggtt

SEQ ID NO: 35523 - DNA, 25 bp, Rattus norvegicus
aagagatctgacactctcccgagac

SEQ ID NO: 35524 - DNA, 25 bp, Rattus norvegicus
aagagatctgactctctcccgagac

SEQ ID NO: 35525 - DNA, 25 bp, Rattus norvegicus
aagagatctgccaccccaagtgttg

SEQ ID NO: 35526 - DNA, 25 bp, Rattus norvegicus
aagagatctgccaccgccgggccgt

SEQ ID NO: 35527 - DNA, 25 bp, Rattus norvegicus
aagagatctgcctccccaagtgttg

SEQ ID NO: 35528 - DNA, 25 bp, Rattus norvegicus
aagagatctgcctccgccgggccgt

SEQ ID NO: 35529 - DNA, 25 bp, Rattus norvegicus
aagagatgactgcacagcctgtcgc

SEQ ID NO: 35530 - DNA, 25 bp, Rattus norvegicus
aagagatgactggacagcctgtcgc

SEQ ID NO: 35531 - DNA, 25 bp, Rattus norvegicus
aagagatgacttaccaggccgagga

SEQ ID NO: 35532 - DNA, 25 bp, Rattus norvegicus
aagagatgactttccaggccgagga

SEQ ID NO: 35533 - DNA, 25 bp, Rattus norvegicus
aagagatgatccatcaggctgagat

SEQ ID NO: 35534 - DNA, 25 bp, Rattus norvegicus
aagagatgatccttcaggctgagat

SEQ ID NO: 35535 - DNA, 25 bp, Rattus norvegicus
aagagatgattgcaccctgagttgg

SEQ ID NO: 35536 - DNA, 25 bp, Rattus norvegicus
aagagatgattggaccctgagttgg

SEQ ID NO: 35537 - DNA, 25 bp, Rattus norvegicus
aagagatgccctcctgcctcataca

SEQ ID NO: 35538 - DNA, 25 bp, Rattus norvegicus
aagagatgccctgctgcctcataca

SEQ ID NO: 35539 - DNA, 25 bp, Rattus norvegicus
aagagatgcctccatttctgtcctt

SEQ ID NO: 35540 - DNA, 25 bp, Rattus norvegicus
aagagatgcctcgatttctgtcctt

SEQ ID NO: 35541 - DNA, 25 bp, Rattus norvegicus
aagagatgccttccagggtgaacaa

SEQ ID NO: 35542 - DNA, 25 bp, Rattus norvegicus
aagagatgccttgcagggtgaacaa

SEQ ID NO: 35543 - DNA, 25 bp, Rattus norvegicus
aagagatgctataccaagggcccag

SEQ ID NO: 35544 - DNA, 25 bp, Rattus norvegicus
aagagatgctattccaagggcccag

SEQ ID NO: 35545 - DNA, 25 bp, Rattus norvegicus
aagagatgctgcaatggtcacgagg

SEQ ID NO: 35546 - DNA, 25 bp, Rattus norvegicus
aagagatgctgctatggtcacgagg

SEQ ID NO: 35547 - DNA, 25 bp, Rattus norvegicus
aagagatgctggacccttttcagga

SEQ ID NO: 35548 - DNA, 25 bp, Rattus norvegicus
aagagatgctggtcccttttcagga

SEQ ID NO: 35549 - DNA, 25 bp, Rattus norvegicus
aagagatgctttacacaccacgttc

SEQ ID NO: 35550 - DNA, 25 bp, Rattus norvegicus
aagagatgcttttcacaccacgttc

SEQ ID NO: 35551 - DNA, 25 bp, Rattus norvegicus
aagagatggagacaagctcctccct

SEQ ID NO: 35552 - DNA, 25 bp, Rattus norvegicus
aagagatggagagaagctcctccct

SEQ ID NO: 35553 - DNA, 25 bp, Rattus norvegicus
aagagatggcctctcaggacagcga

SEQ ID NO: 35554 - DNA, 25 bp, Rattus norvegicus
aagagatggcctgtcaggacagcga

SEQ ID NO: 35555 - DNA, 25 bp, Rattus norvegicus
aagagatggtctcagttccaggaaa

SEQ ID NO: 35556 - DNA, 25 bp, Rattus norvegicus
aagagatggtctgagttccaggaaa

SEQ ID NO: 35557 - DNA, 25 bp, Rattus norvegicus
aagagatgttctactggagcaggag

SEQ ID NO: 35558 - DNA, 25 bp, Rattus norvegicus
aagagatgttcttctggagcaggag

SEQ ID NO: 35559 - DNA, 25 bp, Rattus norvegicus
aagagattaactccaacctccactt

SEQ ID NO: 35560 - DNA, 25 bp, Rattus norvegicus
aagagattaactgcaacctccactt

SEQ ID NO: 35561 - DNA, 25 bp, Rattus norvegicus
aagagattccggagcccatttgact

SEQ ID NO: 35562 - DNA, 25 bp, Rattus norvegicus
aagagattccggtgcccatttgact

SEQ ID NO: 35563 - DNA, 25 bp, Rattus norvegicus
aagagattcgccctgtctatggagc

SEQ ID NO: 35564 - DNA, 25 bp, Rattus norvegicus
aagagattcgccgtgtctatggagc

SEQ ID NO: 35565 - DNA, 25 bp, Rattus norvegicus
aagagattctaaaccccgtctctga

SEQ ID NO: 35566 - DNA, 25 bp, Rattus norvegicus
aagagattctaatccccgtctctga

SEQ ID NO: 35567 - DNA, 25 bp, Rattus norvegicus
aagagattgcccatccaagtctagc

SEQ ID NO: 35568 - DNA, 25 bp, Rattus norvegicus
aagagattgcccttccaagtctagc

SEQ ID NO: 35569 - DNA, 25 bp, Rattus norvegicus
aagagattggcaccaccatgtctgg

SEQ ID NO: 35570 - DNA, 25 bp, Rattus norvegicus
aagagattggcagcaccatgtctgg

SEQ ID NO: 35571 - DNA, 25 bp, Rattus norvegicus
aagagattggtccactggtgcagca

SEQ ID NO: 35572 - DNA, 25 bp, Rattus norvegicus
aagagattggtcgactggtgcagca

SEQ ID NO: 35573 - DNA, 25 bp, Rattus norvegicus
aagagattgtccatcacgatccact

SEQ ID NO: 35574 - DNA, 25 bp, Rattus norvegicus
aagagattgtccttcacgatccact

SEQ ID NO: 35575 - DNA, 25 bp, Rattus norvegicus
aagagatttcaacctgccggcagaa

SEQ ID NO: 35576 - DNA, 25 bp, Rattus norvegicus
aagagatttcaagctgccggcagaa

SEQ ID NO: 35577 - DNA, 25 bp, Rattus norvegicus
aagagatttcccagccatcgtggaa

SEQ ID NO: 35578 - DNA, 25 bp, Rattus norvegicus
aagagatttccctgccatcgtggaa

SEQ ID NO: 35579 - DNA, 25 bp, Rattus norvegicus
aagagatttcgtcttgtgtgtgtgt

SEQ ID NO: 35580 - DNA, 25 bp, Rattus norvegicus
aagagatttcgtgttgtgtgtgtgt

SEQ ID NO: 35581 - DNA, 25 bp, Rattus norvegicus
aagagattttcaccggtttcatcgt

SEQ ID NO: 35582 - DNA, 25 bp, Rattus norvegicus
aagagattttcagcggtttcatcgt

SEQ ID NO: 35583 - DNA, 25 bp, Rattus norvegicus
aagagcaaaggccacccagctgtct

SEQ ID NO: 35584 - DNA, 25 bp, Rattus norvegicus
aagagcaaaggcgacccagctgtct

SEQ ID NO: 35585 - DNA, 25 bp, Rattus norvegicus
aagagcaaagttatccccacattca

SEQ ID NO: 35586 - DNA, 25 bp, Rattus norvegicus
aagagcaaagttttccccacattca

SEQ ID NO: 35587 - DNA, 25 bp, Rattus norvegicus
aagagcaaccccatacagggcctgt

SEQ ID NO: 35588 - DNA, 25 bp, Rattus norvegicus
aagagcaaccccttacagggcctgt

SEQ ID NO: 35589 - DNA, 25 bp, Rattus norvegicus
aagagcaagacactcttcctcatca

SEQ ID NO: 35590 - DNA, 25 bp, Rattus norvegicus
aagagcaagacagtcttcctcatca

SEQ ID NO: 35591 - DNA, 25 bp, Rattus norvegicus
aagagcaagccaacaagcagcatcc

SEQ ID NO: 35592 - DNA, 25 bp, Rattus norvegicus
aagagcaagccacatcctcttcagt

SEQ ID NO: 35593 - DNA, 25 bp, Rattus norvegicus
aagagcaagccacctcagtgcacag

SEQ ID NO: 35594 - DNA, 25 bp, Rattus norvegicus
aagagcaagccagatcctcttcagt

SEQ ID NO: 35595 - DNA, 25 bp, Rattus norvegicus
aagagcaagccagctcagtgcacag

SEQ ID NO: 35596 - DNA, 25 bp, Rattus norvegicus
aagagcaagccatcaagcagcatcc

SEQ ID NO: 35597 - DNA, 25 bp, Rattus norvegicus
aagagcaagctcaggactgtctcac

SEQ ID NO: 35598 - DNA, 25 bp, Rattus norvegicus
aagagcaagctctggactgtctcac

SEQ ID NO: 35599 - DNA, 25 bp, Rattus norvegicus
aagagcaagctgcactttctccgtc

SEQ ID NO: 35600 - DNA, 25 bp, Rattus norvegicus
aagagcaagctggactttctccgtc

SEQ ID NO: 35601 - DNA, 25 bp, Rattus norvegicus
aagagcaagggaccgcaagccctca

SEQ ID NO: 35602 - DNA, 25 bp, Rattus norvegicus
aagagcaagggagcgcaagccctca

SEQ ID NO: 35603 - DNA, 25 bp, Rattus norvegicus
aagagcaaggtcacagcgcccctgg

SEQ ID NO: 35604 - DNA, 25 bp, Rattus norvegicus
aagagcaaggtctcagcgcccctgg

SEQ ID NO: 35605 - DNA, 25 bp, Rattus norvegicus
aagagcaagttacggccacagcatg

SEQ ID NO: 35606 - DNA, 25 bp, Rattus norvegicus
aagagcaagttagggccacagcatg

SEQ ID NO: 35607 - DNA, 25 bp, Rattus norvegicus
aagagcacaacccaggatggcccat

SEQ ID NO: 35608 - DNA, 25 bp, Rattus norvegicus
aagagcacaaccgaggatggcccat

SEQ ID NO: 35609 - DNA, 25 bp, Rattus norvegicus
aagagcacaccgatatctatgtaaa

SEQ ID NO: 35610 - DNA, 25 bp, Rattus norvegicus
aagagcacaccgttatctatgtaaa

SEQ ID NO: 35611 - DNA, 25 bp, Rattus norvegicus
aagagcacacggcattccagctgta

SEQ ID NO: 35612 - DNA, 25 bp, Rattus norvegicus
aagagcacacgggattccagctgta

SEQ ID NO: 35613 - DNA, 25 bp, Rattus norvegicus
aagagcacacttctcacctgggttc

SEQ ID NO: 35614 - DNA, 25 bp, Rattus norvegicus
aagagcacacttgtcacctgggttc

SEQ ID NO: 35615 - DNA, 25 bp, Rattus norvegicus
aagagcacagatactctcgacctct

SEQ ID NO: 35616 - DNA, 25 bp, Rattus norvegicus
aagagcacagatcagttgccgcccc

SEQ ID NO: 35617 - DNA, 25 bp, Rattus norvegicus
aagagcacagatgagttgccgcccc

SEQ ID NO: 35618 - DNA, 25 bp, Rattus norvegicus
aagagcacagattctctcgacctct

SEQ ID NO: 35619 - DNA, 25 bp, Rattus norvegicus
aagagcacagcacagtgtctgcctg

SEQ ID NO: 35620 - DNA, 25 bp, Rattus norvegicus
aagagcacagcactcctacaagtcc

SEQ ID NO: 35621 - DNA, 25 bp, Rattus norvegicus
aagagcacagcagagtgtctgcctg

SEQ ID NO: 35622 - DNA, 25 bp, Rattus norvegicus
aagagcacagcagtcctacaagtcc

SEQ ID NO: 35623 - DNA, 25 bp, Rattus norvegicus
aagagcacagcccaggttaagcaag

SEQ ID NO: 35624 - DNA, 25 bp, Rattus norvegicus
aagagcacagccgaggttaagcaag

SEQ ID NO: 35625 - DNA, 25 bp, Rattus norvegicus
aagagcacatggctgtccacagaca

SEQ ID NO: 35626 - DNA, 25 bp, Rattus norvegicus
aagagcacatgggtgtccacagaca

SEQ ID NO: 35627 - DNA, 25 bp, Rattus norvegicus
aagagcacatttcttacctgtccat

SEQ ID NO: 35628 - DNA, 25 bp, Rattus norvegicus
aagagcacatttgttacctgtccat

SEQ ID NO: 35629 - DNA, 25 bp, Rattus norvegicus
aagagcaccatgactgcacacgtgt

SEQ ID NO: 35630 - DNA, 25 bp, Rattus norvegicus
aagagcaccatgtctgcacacgtgt

SEQ ID NO: 35631 - DNA, 25 bp, Rattus norvegicus
aagagcaccttgattagctgccaat

SEQ ID NO: 35632 - DNA, 25 bp, Rattus norvegicus
aagagcaccttgtttagctgccaat

SEQ ID NO: 35633 - DNA, 25 bp, Rattus norvegicus
aagagcacgaggactttctctgcca

SEQ ID NO: 35634 - DNA, 25 bp, Rattus norvegicus
aagagcacgaggtctttctctgcca

SEQ ID NO: 35635 - DNA, 25 bp, Rattus norvegicus
aagagcactctaagatacaccctgt

SEQ ID NO: 35636 - DNA, 25 bp, Rattus norvegicus
aagagcactctatgatacaccctgt

SEQ ID NO: 35637 - DNA, 25 bp, Rattus norvegicus
aagagcactgcaacacgctaatctt

SEQ ID NO: 35638 - DNA, 25 bp, Rattus norvegicus
aagagcactgcatcacgctaatctt

SEQ ID NO: 35639 - DNA, 25 bp, Rattus norvegicus
aagagcactggaaacttacccatga

SEQ ID NO: 35640 - DNA, 25 bp, Rattus norvegicus
aagagcactggatacttacccatga

SEQ ID NO: 35641 - DNA, 25 bp, Rattus norvegicus
aagagcactggcatgtttttacaga

SEQ ID NO: 35642 - DNA, 25 bp, Rattus norvegicus
aagagcactggcttgtttttacaga

SEQ ID NO: 35643 - DNA, 25 bp, Rattus norvegicus
aagagcacttctcatggttccatcc

SEQ ID NO: 35644 - DNA, 25 bp, Rattus norvegicus
aagagcacttctgatggttccatcc

SEQ ID NO: 35645 - DNA, 25 bp, Rattus norvegicus
aagagcacttgcacagttctcctct

SEQ ID NO: 35646 - DNA, 25 bp, Rattus norvegicus
aagagcacttgctcagttctcctct

SEQ ID NO: 35647 - DNA, 25 bp, Rattus norvegicus
aagagcagaactcgcccatctatat

SEQ ID NO: 35648 - DNA, 25 bp, Rattus norvegicus
aagagcagaactggcccatctatat

SEQ ID NO: 35649 - DNA, 25 bp, Rattus norvegicus
aagagcagactgcatccttactggc

SEQ ID NO: 35650 - DNA, 25 bp, Rattus norvegicus
aagagcagactggatccttactggc

SEQ ID NO: 35651 - DNA, 25 bp, Rattus norvegicus
aagagcagaggaaaggtgttaacat

SEQ ID NO: 35652 - DNA, 25 bp, Rattus norvegicus
aagagcagaggataggtgttaacat

SEQ ID NO: 35653 - DNA, 25 bp, Rattus norvegicus
aagagcagaggcacggccgtagact

SEQ ID NO: 35654 - DNA, 25 bp, Rattus norvegicus
aagagcagaggctcggccgtagact

SEQ ID NO: 35655 - DNA, 25 bp, Rattus norvegicus
aagagcagcaggctggcatctccag

SEQ ID NO: 35656 - DNA, 25 bp, Rattus norvegicus
aagagcagcagggtggcatctccag

SEQ ID NO: 35657 - DNA, 25 bp, Rattus norvegicus
aagagcagcagtcaggccctgtgct

SEQ ID NO: 35658 - DNA, 25 bp, Rattus norvegicus
aagagcagcagtgaggccctgtgct

SEQ ID NO: 35659 - DNA, 25 bp, Rattus norvegicus
aagagcagcataaaccaggtccagc

SEQ ID NO: 35660 - DNA, 25 bp, Rattus norvegicus
aagagcagcatataccaggtccagc

SEQ ID NO: 35661 - DNA, 25 bp, Rattus norvegicus
aagagcagcatcaactctctgggct

SEQ ID NO: 35662 - DNA, 25 bp, Rattus norvegicus
aagagcagcatctactctctgggct

SEQ ID NO: 35663 - DNA, 25 bp, Rattus norvegicus
aagagcagcattagcctgcctggaa

SEQ ID NO: 35664 - DNA, 25 bp, Rattus norvegicus
aagagcagcatttgcctgcctggaa

SEQ ID NO: 35665 - DNA, 25 bp, Rattus norvegicus
aagagcagccatcctggtttttatc

SEQ ID NO: 35666 - DNA, 25 bp, Rattus norvegicus
aagagcagccatgctggtttttatc

SEQ ID NO: 35667 - DNA, 25 bp, Rattus norvegicus
aagagcagccctcaggtaaccagaa

SEQ ID NO: 35668 - DNA, 25 bp, Rattus norvegicus
aagagcagccctgaggtaaccagaa

SEQ ID NO: 35669 - DNA, 25 bp, Rattus norvegicus
aagagcagcctgagcctggagaaca

SEQ ID NO: 35670 - DNA, 25 bp, Rattus norvegicus
aagagcagcctgtgcctggagaaca

SEQ ID NO: 35671 - DNA, 25 bp, Rattus norvegicus
aagagcagcgagagacctacttcca

SEQ ID NO: 35672 - DNA, 25 bp, Rattus norvegicus
aagagcagcgagtgacctacttcca

SEQ ID NO: 35673 - DNA, 25 bp, Rattus norvegicus
aagagcagcggcatccggctgaagc

SEQ ID NO: 35674 - DNA, 25 bp, Rattus norvegicus
aagagcagcggcttccggctgaagc

SEQ ID NO: 35675 - DNA, 25 bp, Rattus norvegicus
aagagcagcgttacaacagtttcct

SEQ ID NO: 35676 - DNA, 25 bp, Rattus norvegicus
aagagcagcgtttcaacagtttcct

SEQ ID NO: 35677 - DNA, 25 bp, Rattus norvegicus
aagagcagctacaacctggacgcaa

SEQ ID NO: 35678 - DNA, 25 bp, Rattus norvegicus
aagagcagctactacctggacgcaa

SEQ ID NO: 35679 - DNA, 25 bp, Rattus norvegicus
aagagcagctcgcagaagccgaccc

SEQ ID NO: 35680 - DNA, 25 bp, Rattus norvegicus
aagagcagctcggagaagccgaccc

SEQ ID NO: 35681 - DNA, 25 bp, Rattus norvegicus
aagagcagctgaaaacaccagagat

SEQ ID NO: 35682 - DNA, 25 bp, Rattus norvegicus
aagagcagctgataacaccagagat

SEQ ID NO: 35683 - DNA, 25 bp, Rattus norvegicus
aagagcagctggctttactggcctg

SEQ ID NO: 35684 - DNA, 25 bp, Rattus norvegicus
aagagcagctgggtttactggcctg

SEQ ID NO: 35685 - DNA, 25 bp, Rattus norvegicus
aagagcagctttcttttcctggcct

SEQ ID NO: 35686 - DNA, 25 bp, Rattus norvegicus
aagagcagctttgttttcctggcct

SEQ ID NO: 35687 - DNA, 25 bp, Rattus norvegicus
aagagcaggaccctaggccactcac

SEQ ID NO: 35688 - DNA, 25 bp, Rattus norvegicus
aagagcaggaccgtaggccactcac

SEQ ID NO: 35689 - DNA, 25 bp, Rattus norvegicus
aagagcaggatcacagaggcgcaat

SEQ ID NO: 35690 - DNA, 25 bp, Rattus norvegicus
aagagcaggatctcagaggcgcaat

SEQ ID NO: 35691 - DNA, 25 bp, Rattus norvegicus
aagagcaggccacgcaggtgccatc

SEQ ID NO: 35692 - DNA, 25 bp, Rattus norvegicus
aagagcaggccaggcaggtgccatc

SEQ ID NO: 35693 - DNA, 25 bp, Rattus norvegicus
aagagcaggcttctgcgttcacagt

SEQ ID NO: 35694 - DNA, 25 bp, Rattus norvegicus
aagagcaggcttgtgcgttcacagt

SEQ ID NO: 35695 - DNA, 25 bp, Rattus norvegicus
aagagcagggcgatcctgccacggt

SEQ ID NO: 35696 - DNA, 25 bp, Rattus norvegicus
aagagcagggcgttcctgccacggt

SEQ ID NO: 35697 - DNA, 25 bp, Rattus norvegicus
aagagcagtagcctgctggccaaga

SEQ ID NO: 35698 - DNA, 25 bp, Rattus norvegicus
aagagcagtagcgtgctggccaaga

SEQ ID NO: 35699 - DNA, 25 bp, Rattus norvegicus
aagagcagtcataccttctcacttg

SEQ ID NO: 35700 - DNA, 25 bp, Rattus norvegicus
aagagcagtcattccttctcacttg

SEQ ID NO: 35701 - DNA, 25 bp, Rattus norvegicus
aagagcatataaagcgcaccatttc

SEQ ID NO: 35702 - DNA, 25 bp, Rattus norvegicus
aagagcatataatgcgcaccatttc

SEQ ID NO: 35703 - DNA, 25 bp, Rattus norvegicus
aagagcatcagtcgcctcgtcaaga

SEQ ID NO: 35704 - DNA, 25 bp, Rattus norvegicus
aagagcatcagtggcctcgtcaaga

SEQ ID NO: 35705 - DNA, 25 bp, Rattus norvegicus
aagagcatcctaagcagctctgcag

SEQ ID NO: 35706 - DNA, 25 bp, Rattus norvegicus
aagagcatcctatgcagctctgcag

SEQ ID NO: 35707 - DNA, 25 bp, Rattus norvegicus
aagagcatccttcgctccaaaaata

SEQ ID NO: 35708 - DNA, 25 bp, Rattus norvegicus
aagagcatccttggctccaaaaata

SEQ ID NO: 35709 - DNA, 25 bp, Rattus norvegicus
aagagcatcgggagtgctttcctgc

SEQ ID NO: 35710 - DNA, 25 bp, Rattus norvegicus
aagagcatcgggtgtgctttcctgc

SEQ ID NO: 35711 - DNA, 25 bp, Rattus norvegicus
aagagcatctctagatctctctatc

SEQ ID NO: 35712 - DNA, 25 bp, Rattus norvegicus
aagagcatctcttgatctctctatc

SEQ ID NO: 35713 - DNA, 25 bp, Rattus norvegicus
aagagcatctttcgacatctgccct

SEQ ID NO: 35714 - DNA, 25 bp, Rattus norvegicus
aagagcatctttctgcatccggagc

SEQ ID NO: 35715 - DNA, 25 bp, Rattus norvegicus
aagagcatctttggacatctgccct

SEQ ID NO: 35716 - DNA, 25 bp, Rattus norvegicus
aagagcatctttgtgcatccggagc

SEQ ID NO: 35717 - DNA, 25 bp, Rattus norvegicus
aagagcatgtgacttccctgaagat

SEQ ID NO: 35718 - DNA, 25 bp, Rattus norvegicus
aagagcatgtgagttccctgaagat

SEQ ID NO: 35719 - DNA, 25 bp, Rattus norvegicus
aagagcatgtgtccaatcccagggt

SEQ ID NO: 35720 - DNA, 25 bp, Rattus norvegicus
aagagcatgtgtgcaatcccagggt

SEQ ID NO: 35721 - DNA, 25 bp, Rattus norvegicus
aagagcattaacaaagccctacaaa

SEQ ID NO: 35722 - DNA, 25 bp, Rattus norvegicus
aagagcattaactaagccctacaaa

SEQ ID NO: 35723 - DNA, 25 bp, Rattus norvegicus
aagagcattgcaatgaatattattc

SEQ ID NO: 35724 - DNA, 25 bp, Rattus norvegicus
aagagcattgcattgaatattattc

SEQ ID NO: 35725 - DNA, 25 bp, Rattus norvegicus
aagagcatttatagtgttttggaac

SEQ ID NO: 35726 - DNA, 25 bp, Rattus norvegicus
aagagcatttatatgcctttggcag

SEQ ID NO: 35727 - DNA, 25 bp, Rattus norvegicus
aagagcatttattgtgttttggaac

SEQ ID NO: 35728 - DNA, 25 bp, Rattus norvegicus
aagagcatttatttgcctttggcag

SEQ ID NO: 35729 - DNA, 25 bp, Rattus norvegicus
aagagcatttgccttgaggtgatgt

SEQ ID NO: 35730 - DNA, 25 bp, Rattus norvegicus
aagagcatttgcgttgaggtgatgt

SEQ ID NO: 35731 - DNA, 25 bp, Rattus norvegicus
aagagcatttgtcttggttcccttg

SEQ ID NO: 35732 - DNA, 25 bp, Rattus norvegicus
aagagcatttgtgttggttcccttg

SEQ ID NO: 35733 - DNA, 25 bp, Rattus norvegicus
aagagcattttaacatctgctaatg

SEQ ID NO: 35734 - DNA, 25 bp, Rattus norvegicus
aagagcattttatcatctgctaatg

SEQ ID NO: 35735 - DNA, 25 bp, Rattus norvegicus
aagagccaatgtcccctgctccaga

SEQ ID NO: 35736 - DNA, 25 bp, Rattus norvegicus
aagagccaatgtgccctgctccaga

SEQ ID NO: 35737 - DNA, 25 bp, Rattus norvegicus
aagagccacaccaacagttactggg

SEQ ID NO: 35738 - DNA, 25 bp, Rattus norvegicus
aagagccacacctacagttactggg

SEQ ID NO: 35739 - DNA, 25 bp, Rattus norvegicus
aagagccaccagagcctgttttgtt

SEQ ID NO: 35740 - DNA, 25 bp, Rattus norvegicus
aagagccaccagtgcctgttttgtt

SEQ ID NO: 35741 - DNA, 25 bp, Rattus norvegicus
aagagccactcacgttcttcacagt

SEQ ID NO: 35742 - DNA, 25 bp, Rattus norvegicus
aagagccactcaggttcttcacagt

SEQ ID NO: 35743 - DNA, 25 bp, Rattus norvegicus
aagagccactccaggaacttttcta

SEQ ID NO: 35744 - DNA, 25 bp, Rattus norvegicus
aagagccactcctggaacttttcta

SEQ ID NO: 35745 - DNA, 25 bp, Rattus norvegicus
aagagccacttcaggacatcctgtg

SEQ ID NO: 35746 - DNA, 25 bp, Rattus norvegicus
aagagccacttctggacatcctgtg

SEQ ID NO: 35747 - DNA, 25 bp, Rattus norvegicus
aagagccagactatgagacctacct

SEQ ID NO: 35748 - DNA, 25 bp, Rattus norvegicus
aagagccagactttgagacctacct

SEQ ID NO: 35749 - DNA, 25 bp, Rattus norvegicus
aagagccagattaaggccgggcaaa

SEQ ID NO: 35750 - DNA, 25 bp, Rattus norvegicus
aagagccagatttaggccgggcaaa

SEQ ID NO: 35751 - DNA, 25 bp, Rattus norvegicus
aagagccagcggaaggactttcctt

SEQ ID NO: 35752 - DNA, 25 bp, Rattus norvegicus
aagagccagcggtaggactttcctt

SEQ ID NO: 35753 - DNA, 25 bp, Rattus norvegicus
aagagccagcttagtctttctttcc

SEQ ID NO: 35754 - DNA, 25 bp, Rattus norvegicus
aagagccagcttcttgttagcctga

SEQ ID NO: 35755 - DNA, 25 bp, Rattus norvegicus
aagagccagcttgttgttagcctga

SEQ ID NO: 35756 - DNA, 25 bp, Rattus norvegicus
aagagccagctttgtctttctttcc

SEQ ID NO: 35757 - DNA, 25 bp, Rattus norvegicus
aagagccaggtcaggaacccagtct

SEQ ID NO: 35758 - DNA, 25 bp, Rattus norvegicus
aagagccaggtccagtttatagcac

SEQ ID NO: 35759 - DNA, 25 bp, Rattus norvegicus
aagagccaggtcgagtttatagcac

SEQ ID NO: 35760 - DNA, 25 bp, Rattus norvegicus
aagagccaggtctggaacccagtct

SEQ ID NO: 35761 - DNA, 25 bp, Rattus norvegicus
aagagccagttgattttgagcaatg

SEQ ID NO: 35762 - DNA, 25 bp, Rattus norvegicus
aagagccagttgtttttgagcaatg

SEQ ID NO: 35763 - DNA, 25 bp, Rattus norvegicus
aagagccatctcataagatccagct

SEQ ID NO: 35764 - DNA, 25 bp, Rattus norvegicus
aagagccatctcttaagatccagct

SEQ ID NO: 35765 - DNA, 25 bp, Rattus norvegicus
aagagccatggacctgtcctgtgga

SEQ ID NO: 35766 - DNA, 25 bp, Rattus norvegicus
aagagccatggagctgtcctgtgga

SEQ ID NO: 35767 - DNA, 25 bp, Rattus norvegicus
aagagccatggccaagactaccttg

SEQ ID NO: 35768 - DNA, 25 bp, Rattus norvegicus
aagagccatggcgaagactaccttg

SEQ ID NO: 35769 - DNA, 25 bp, Rattus norvegicus
aagagccatttaataaatgccaagc

SEQ ID NO: 35770 - DNA, 25 bp, Rattus norvegicus
aagagccatttattaaatgccaagc

SEQ ID NO: 35771 - DNA, 25 bp, Rattus norvegicus
aagagcccacacctaggacattttg

SEQ ID NO: 35772 - DNA, 25 bp, Rattus norvegicus
aagagcccacacgtaggacattttg

SEQ ID NO: 35773 - DNA, 25 bp, Rattus norvegicus
aagagcccagcacccgtaggcaaag

SEQ ID NO: 35774 - DNA, 25 bp, Rattus norvegicus
aagagcccagcagccgtaggcaaag

SEQ ID NO: 35775 - DNA, 25 bp, Rattus norvegicus
aagagcccagcgatctggttggcca

SEQ ID NO: 35776 - DNA, 25 bp, Rattus norvegicus
aagagcccagcgttctggttggcca

SEQ ID NO: 35777 - DNA, 25 bp, Rattus norvegicus
aagagcccagggagacagtttattt

SEQ ID NO: 35778 - DNA, 25 bp, Rattus norvegicus
aagagcccagggtgacagtttattt

SEQ ID NO: 35779 - DNA, 25 bp, Rattus norvegicus
aagagcccagtcagcgtctggattt

SEQ ID NO: 35780 - DNA, 25 bp, Rattus norvegicus
aagagcccagtctgcgtctggattt

SEQ ID NO: 35781 - DNA, 25 bp, Rattus norvegicus
aagagcccatgactctcaacaaaat

SEQ ID NO: 35782 - DNA, 25 bp, Rattus norvegicus
aagagcccatgagtctcaacaaaat

SEQ ID NO: 35783 - DNA, 25 bp, Rattus norvegicus
aagagccccgatcgtgctatcaaac

SEQ ID NO: 35784 - DNA, 25 bp, Rattus norvegicus
aagagccccgatggtgctatcaaac

SEQ ID NO: 35785 - DNA, 25 bp, Rattus norvegicus
aagagcccctcgaaagcagctcaaa

SEQ ID NO: 35786 - DNA, 25 bp, Rattus norvegicus
aagagcccctcgtaagcagctcaaa

SEQ ID NO: 35787 - DNA, 25 bp, Rattus norvegicus
aagagcccctggacctttgaagcca

SEQ ID NO: 35788 - DNA, 25 bp, Rattus norvegicus
aagagcccctggtcctttgaagcca

SEQ ID NO: 35789 - DNA, 25 bp, Rattus norvegicus
aagagccccttcaggcttgaattaa

SEQ ID NO: 35790 - DNA, 25 bp, Rattus norvegicus
aagagccccttctggcttgaattaa

SEQ ID NO: 35791 - DNA, 25 bp, Rattus norvegicus
aagagcccctttctcttgcaatgtc

SEQ ID NO: 35792 - DNA, 25 bp, Rattus norvegicus
aagagcccctttgtcttgcaatgtc

SEQ ID NO: 35793 - DNA, 25 bp, Rattus norvegicus
aagagcccgaagctgtagcatccct

SEQ ID NO: 35794 - DNA, 25 bp, Rattus norvegicus
aagagcccgaaggtgtagcatccct

SEQ ID NO: 35795 - DNA, 25 bp, Rattus norvegicus
aagagccctcacagagtgggcagcc

SEQ ID NO: 35796 - DNA, 25 bp, Rattus norvegicus
aagagccctcactgagtgggcagcc

SEQ ID NO: 35797 - DNA, 25 bp, Rattus norvegicus
aagagccctcctatactccatggga

SEQ ID NO: 35798 - DNA, 25 bp, Rattus norvegicus
aagagccctcctttactccatggga

SEQ ID NO: 35799 - DNA, 25 bp, Rattus norvegicus
aagagccctctgatttattgcctag

SEQ ID NO: 35800 - DNA, 25 bp, Rattus norvegicus
aagagccctctgttttattgcctag

SEQ ID NO: 35801 - DNA, 25 bp, Rattus norvegicus
aagagccctgacaaccttgacatag

SEQ ID NO: 35802 - DNA, 25 bp, Rattus norvegicus
aagagccctgactaccttgacatag

SEQ ID NO: 35803 - DNA, 25 bp, Rattus norvegicus
aagagccctgggatgttcatatgcc

SEQ ID NO: 35804 - DNA, 25 bp, Rattus norvegicus
aagagccctgggttgttcatatgcc

SEQ ID NO: 35805 - DNA, 25 bp, Rattus norvegicus
aagagccctggtcaggttccagcat

SEQ ID NO: 35806 - DNA, 25 bp, Rattus norvegicus
aagagccctggtgaggttccagcat

SEQ ID NO: 35807 - DNA, 25 bp, Rattus norvegicus
aagagccctgtgacgtgttctggaa

SEQ ID NO: 35808 - DNA, 25 bp, Rattus norvegicus
aagagccctgtgtcgtgttctggaa

SEQ ID NO: 35809 - DNA, 25 bp, Rattus norvegicus
aagagccctgttctcaaccggatta

SEQ ID NO: 35810 - DNA, 25 bp, Rattus norvegicus
aagagccctgttctgtgtatttgcc

SEQ ID NO: 35811 - DNA, 25 bp, Rattus norvegicus
aagagccctgttgtcaaccggatta

SEQ ID NO: 35812 - DNA, 25 bp, Rattus norvegicus
aagagccctgttgtgtgtatttgcc

SEQ ID NO: 35813 - DNA, 25 bp, Rattus norvegicus
aagagcccttcgaaggctttgtctt

SEQ ID NO: 35814 - DNA, 25 bp, Rattus norvegicus
aagagcccttcgtaggctttgtctt

SEQ ID NO: 35815 - DNA, 25 bp, Rattus norvegicus
aagagccgaaagagacatccagtct

SEQ ID NO: 35816 - DNA, 25 bp, Rattus norvegicus
aagagccgaaagtgacatccagtct

SEQ ID NO: 35817 - DNA, 25 bp, Rattus norvegicus
aagagccgatgcaggcttctttttt

SEQ ID NO: 35818 - DNA, 25 bp, Rattus norvegicus
aagagccgatgctggcttctttttt

SEQ ID NO: 35819 - DNA, 25 bp, Rattus norvegicus
aagagccgcagccatttgtcacgag

SEQ ID NO: 35820 - DNA, 25 bp, Rattus norvegicus
aagagccgcagcgatttgtcacgag

SEQ ID NO: 35821 - DNA, 25 bp, Rattus norvegicus
aagagccgcctcacgctctcgatgg

SEQ ID NO: 35822 - DNA, 25 bp, Rattus norvegicus
aagagccgcctctcgctctcgatgg

SEQ ID NO: 35823 - DNA, 25 bp, Rattus norvegicus
aagagccgtgtgaacataccagtgc

SEQ ID NO: 35824 - DNA, 25 bp, Rattus norvegicus
aagagccgtgtgtacataccagtgc

SEQ ID NO: 35825 - DNA, 25 bp, Rattus norvegicus
aagagcctaaggacaccgcactgtg

SEQ ID NO: 35826 - DNA, 25 bp, Rattus norvegicus
aagagcctaaggtcaccgcactgtg

SEQ ID NO: 35827 - DNA, 25 bp, Rattus norvegicus
aagagcctagacctgtttaactgtg

SEQ ID NO: 35828 - DNA, 25 bp, Rattus norvegicus
aagagcctagacgtgtttaactgtg

SEQ ID NO: 35829 - DNA, 25 bp, Rattus norvegicus
aagagcctagcaaacagcctgtgtg

SEQ ID NO: 35830 - DNA, 25 bp, Rattus norvegicus
aagagcctagcatacagcctgtgtg

SEQ ID NO: 35831 - DNA, 25 bp, Rattus norvegicus
aagagcctatctacacttctgatta

SEQ ID NO: 35832 - DNA, 25 bp, Rattus norvegicus
aagagcctatcttcacttctgatta

SEQ ID NO: 35833 - DNA, 25 bp, Rattus norvegicus
aagagcctattcctacttctgattt

SEQ ID NO: 35834 - DNA, 25 bp, Rattus norvegicus
aagagcctattcgtacttctgattt

SEQ ID NO: 35835 - DNA, 25 bp, Rattus norvegicus
aagagcctcctcatggatatctgga

SEQ ID NO: 35836 - DNA, 25 bp, Rattus norvegicus
aagagcctcctcttggatatctgga

SEQ ID NO: 35837 - DNA, 25 bp, Rattus norvegicus
aagagcctccttcagcagctactga

SEQ ID NO: 35838 - DNA, 25 bp, Rattus norvegicus
aagagcctccttgagcagctactga

SEQ ID NO: 35839 - DNA, 25 bp, Rattus norvegicus
aagagcctcggtatttctatgtaga

SEQ ID NO: 35840 - DNA, 25 bp, Rattus norvegicus
aagagcctcggtttttctatgtaga

SEQ ID NO: 35841 - DNA, 25 bp, Rattus norvegicus
aagagcctctctacatgacattacc

SEQ ID NO: 35842 - DNA, 25 bp, Rattus norvegicus
aagagcctctcttcatgacattacc

SEQ ID NO: 35843 - DNA, 25 bp, Rattus norvegicus
aagagcctgaacattcccatttgtt

SEQ ID NO: 35844 - DNA, 25 bp, Rattus norvegicus
aagagcctgaactttcccatttgtt

SEQ ID NO: 35845 - DNA, 25 bp, Rattus norvegicus
aagagcctgatgaccggatgccgac

SEQ ID NO: 35846 - DNA, 25 bp, Rattus norvegicus
aagagcctgatgtccggatgccgac

SEQ ID NO: 35847 - DNA, 25 bp, Rattus norvegicus
aagagcctgcaactgttctgtgatt

SEQ ID NO: 35848 - DNA, 25 bp, Rattus norvegicus
aagagcctgcaagtgttctgtgatt

SEQ ID NO: 35849 - DNA, 25 bp, Rattus norvegicus
aagagcctgccaaggctgcctcgga

SEQ ID NO: 35850 - DNA, 25 bp, Rattus norvegicus
aagagcctgccatggctgcctcgga

SEQ ID NO: 35851 - DNA, 25 bp, Rattus norvegicus
aagagcctgctgactaatgcgaatt

SEQ ID NO: 35852 - DNA, 25 bp, Rattus norvegicus
aagagcctgctgtctaatgcgaatt

SEQ ID NO: 35853 - DNA, 25 bp, Rattus norvegicus
aagagcctggagattggccgcagct

SEQ ID NO: 35854 - DNA, 25 bp, Rattus norvegicus
aagagcctggagctgaaacctgcca

SEQ ID NO: 35855 - DNA, 25 bp, Rattus norvegicus
aagagcctggaggtgaaacctgcca

SEQ ID NO: 35856 - DNA, 25 bp, Rattus norvegicus
aagagcctggagtttggccgcagct

SEQ ID NO: 35857 - DNA, 25 bp, Rattus norvegicus
aagagcctgggactcctaagcagaa

SEQ ID NO: 35858 - DNA, 25 bp, Rattus norvegicus
aagagcctgggagtcctaagcagaa

SEQ ID NO: 35859 - DNA, 25 bp, Rattus norvegicus
aagagcctgggcctggcacacagca

SEQ ID NO: 35860 - DNA, 25 bp, Rattus norvegicus
aagagcctgggcgtggcacacagca

SEQ ID NO: 35861 - DNA, 25 bp, Rattus norvegicus
aagagcctgtcccaggttttatcct

SEQ ID NO: 35862 - DNA, 25 bp, Rattus norvegicus
aagagcctgtccgaggttttatcct

SEQ ID NO: 35863 - DNA, 25 bp, Rattus norvegicus
aagagcctgtctctcctagaaactg

SEQ ID NO: 35864 - DNA, 25 bp, Rattus norvegicus
aagagcctgtctgtcctagaaactg

SEQ ID NO: 35865 - DNA, 25 bp, Rattus norvegicus
aagagccttaccaggtttgtgccgg

SEQ ID NO: 35866 - DNA, 25 bp, Rattus norvegicus
aagagccttacctggtttgtgccgg

SEQ ID NO: 35867 - DNA, 25 bp, Rattus norvegicus
aagagccttactcacctgttgctgt

SEQ ID NO: 35868 - DNA, 25 bp, Rattus norvegicus
aagagccttactgacctgttgctgt

SEQ ID NO: 35869 - DNA, 25 bp, Rattus norvegicus
aagagccttatcctggagggcaaga

SEQ ID NO: 35870 - DNA, 25 bp, Rattus norvegicus
aagagccttatcgtggagggcaaga

SEQ ID NO: 35871 - DNA, 25 bp, Rattus norvegicus
aagagccttccacaatgacactgct

SEQ ID NO: 35872 - DNA, 25 bp, Rattus norvegicus
aagagccttccagaatgacactgct

SEQ ID NO: 35873 - DNA, 25 bp, Rattus norvegicus
aagagccttctcatccattgatctg

SEQ ID NO: 35874 - DNA, 25 bp, Rattus norvegicus
aagagccttctcttccattgatctg

SEQ ID NO: 35875 - DNA, 25 bp, Rattus norvegicus
aagagccttctgagagtcctgggaa

SEQ ID NO: 35876 - DNA, 25 bp, Rattus norvegicus
aagagccttctgtgagtcctgggaa

SEQ ID NO: 35877 - DNA, 25 bp, Rattus norvegicus
aagagccttgccagacagatggaga

SEQ ID NO: 35878 - DNA, 25 bp, Rattus norvegicus
aagagccttgcctgacagatggaga

SEQ ID NO: 35879 - DNA, 25 bp, Rattus norvegicus
aagagccttgcgactgctgaggaag

SEQ ID NO: 35880 - DNA, 25 bp, Rattus norvegicus
aagagccttgcgtctgctgaggaag

SEQ ID NO: 35881 - DNA, 25 bp, Rattus norvegicus
aagagccttgtcacttcacattgtg

SEQ ID NO: 35882 - DNA, 25 bp, Rattus norvegicus
aagagccttgtctcttcacattgtg

SEQ ID NO: 35883 - DNA, 25 bp, Rattus norvegicus
aagagcctttgtaatgagctgcaag

SEQ ID NO: 35884 - DNA, 25 bp, Rattus norvegicus
aagagcctttgttatgagctgcaag

SEQ ID NO: 35885 - DNA, 25 bp, Rattus norvegicus
aagagccttttaaagttggaatcaa

SEQ ID NO: 35886 - DNA, 25 bp, Rattus norvegicus
aagagccttttatagttggaatcaa

SEQ ID NO: 35887 - DNA, 25 bp, Rattus norvegicus
aagagccttttgcactgataaactg

SEQ ID NO: 35888 - DNA, 25 bp, Rattus norvegicus
aagagccttttggactgataaactg

SEQ ID NO: 35889 - DNA, 25 bp, Rattus norvegicus
aagagcgaggtactgaaggccatcc

SEQ ID NO: 35890 - DNA, 25 bp, Rattus norvegicus
aagagcgaggtagtgaaggccatcc

SEQ ID NO: 35891 - DNA, 25 bp, Rattus norvegicus
aagagcgagtgccaggcttcctgca

SEQ ID NO: 35892 - DNA, 25 bp, Rattus norvegicus
aagagcgagtgcgaggcttcctgca

SEQ ID NO: 35893 - DNA, 25 bp, Rattus norvegicus
aagagcgatagtatttgccaggata

SEQ ID NO: 35894 - DNA, 25 bp, Rattus norvegicus
aagagcgatagtttttgccaggata

SEQ ID NO: 35895 - DNA, 25 bp, Rattus norvegicus
aagagcgatcagattgcccatggcc

SEQ ID NO: 35896 - DNA, 25 bp, Rattus norvegicus
aagagcgatcagtttgcccatggcc

SEQ ID NO: 35897 - DNA, 25 bp, Rattus norvegicus
aagagcgccttccagaggagcatct

SEQ ID NO: 35898 - DNA, 25 bp, Rattus norvegicus
aagagcgccttcgagaggagcatct

SEQ ID NO: 35899 - DNA, 25 bp, Rattus norvegicus
aagagcgcgtggcatgtcagcatca

SEQ ID NO: 35900 - DNA, 25 bp, Rattus norvegicus
aagagcgcgtgggatgtcagcatca

SEQ ID NO: 35901 - DNA, 25 bp, Rattus norvegicus
aagagcgctccaaattccttttgat

SEQ ID NO: 35902 - DNA, 25 bp, Rattus norvegicus
aagagcgctccatattccttttgat

SEQ ID NO: 35903 - DNA, 25 bp, Rattus norvegicus
aagagcgctctaccgttcctaagtg

SEQ ID NO: 35904 - DNA, 25 bp, Rattus norvegicus
aagagcgctctagcgttcctaagtg

SEQ ID NO: 35905 - DNA, 25 bp, Rattus norvegicus
aagagcgctgctactaatgatggca

SEQ ID NO: 35906 - DNA, 25 bp, Rattus norvegicus
aagagcgctgcttctaatgatggca

SEQ ID NO: 35907 - DNA, 25 bp, Rattus norvegicus
aagagcgcttagcagcccatgcatt

SEQ ID NO: 35908 - DNA, 25 bp, Rattus norvegicus
aagagcgcttaggagcccatgcatt

SEQ ID NO: 35909 - DNA, 25 bp, Rattus norvegicus
aagagcggactgagaaactgcccat

SEQ ID NO: 35910 - DNA, 25 bp, Rattus norvegicus
aagagcggactgtgaaactgcccat

SEQ ID NO: 35911 - DNA, 25 bp, Rattus norvegicus
aagagcggaggaaccacaatccctt

SEQ ID NO: 35912 - DNA, 25 bp, Rattus norvegicus
aagagcggaggatccacaatccctt

SEQ ID NO: 35913 - DNA, 25 bp, Rattus norvegicus
aagagcgggagcacttcctaataga

SEQ ID NO: 35914 - DNA, 25 bp, Rattus norvegicus
aagagcgggagctcttcctaataga

SEQ ID NO: 35915 - DNA, 25 bp, Rattus norvegicus
aagagcggtggccattcctctgaaa

SEQ ID NO: 35916 - DNA, 25 bp, Rattus norvegicus
aagagcggtggcgattcctctgaaa

SEQ ID NO: 35917 - DNA, 25 bp, Rattus norvegicus
aagagcgtacggatgccgatgtcct

SEQ ID NO: 35918 - DNA, 25 bp, Rattus norvegicus
aagagcgtacggttgccgatgtcct

SEQ ID NO: 35919 - DNA, 25 bp, Rattus norvegicus
aagagcgtacgtattactcctgatt

SEQ ID NO: 35920 - DNA, 25 bp, Rattus norvegicus
aagagcgtacgttttactcctgatt

SEQ ID NO: 35921 - DNA, 25 bp, Rattus norvegicus
aagagcgtcgtgcttgctagcgaaa

SEQ ID NO: 35922 - DNA, 25 bp, Rattus norvegicus
aagagcgtcgtggttgctagcgaaa

SEQ ID NO: 35923 - DNA, 25 bp, Rattus norvegicus
aagagcgtgactccaaagctccttc

SEQ ID NO: 35924 - DNA, 25 bp, Rattus norvegicus
aagagcgtgactgcaaagctccttc

SEQ ID NO: 35925 - DNA, 25 bp, Rattus norvegicus
aagagcgtgcccctgtaagcaaagg

SEQ ID NO: 35926 - DNA, 25 bp, Rattus norvegicus
aagagcgtgcccgtgtaagcaaagg

SEQ ID NO: 35927 - DNA, 25 bp, Rattus norvegicus
aagagcgtgctcaacttggccatca

SEQ ID NO: 35928 - DNA, 25 bp, Rattus norvegicus
aagagcgtgctctacttggccatca

SEQ ID NO: 35929 - DNA, 25 bp, Rattus norvegicus
aagagcgtggatctcctcaatgcca

SEQ ID NO: 35930 - DNA, 25 bp, Rattus norvegicus
aagagcgtggatgtcctcaatgcca

SEQ ID NO: 35931 - DNA, 25 bp, Rattus norvegicus
aagagcgttcgcatgctatcgggct

SEQ ID NO: 35932 - DNA, 25 bp, Rattus norvegicus
aagagcgttcgcttgctatcgggct

SEQ ID NO: 35933 - DNA, 25 bp, Rattus norvegicus
aagagcgttctcctgtgtcgagcct

SEQ ID NO: 35934 - DNA, 25 bp, Rattus norvegicus
aagagcgttctcgtgtgtcgagcct

SEQ ID NO: 35935 - DNA, 25 bp, Rattus norvegicus
aagagcgtttacacagagccacctt

SEQ ID NO: 35936 - DNA, 25 bp, Rattus norvegicus
aagagcgtttactcagagccacctt

SEQ ID NO: 35937 - DNA, 25 bp, Rattus norvegicus
aagagctaaacgcaacctggacata

SEQ ID NO: 35938 - DNA, 25 bp, Rattus norvegicus
aagagctaaacggaacctggacata

SEQ ID NO: 35939 - DNA, 25 bp, Rattus norvegicus
aagagctaaaggaggaggcagtctc

SEQ ID NO: 35940 - DNA, 25 bp, Rattus norvegicus
aagagctaaaggtggaggcagtctc

SEQ ID NO: 35941 - DNA, 25 bp, Rattus norvegicus
aagagctaacttcctcatcgtcatc

SEQ ID NO: 35942 - DNA, 25 bp, Rattus norvegicus
aagagctaacttgctcatcgtcatc

SEQ ID NO: 35943 - DNA, 25 bp, Rattus norvegicus
aagagctaagctaggaccctgctgg

SEQ ID NO: 35944 - DNA, 25 bp, Rattus norvegicus
aagagctaagcttggaccctgctgg

SEQ ID NO: 35945 - DNA, 25 bp, Rattus norvegicus
aagagctaataacaccactgaggca

SEQ ID NO: 35946 - DNA, 25 bp, Rattus norvegicus
aagagctaataagaccactgaggca

SEQ ID NO: 35947 - DNA, 25 bp, Rattus norvegicus
aagagctaccagattgcggtggctt

SEQ ID NO: 35948 - DNA, 25 bp, Rattus norvegicus
aagagctaccagtttgcggtggctt

SEQ ID NO: 35949 - DNA, 25 bp, Rattus norvegicus
aagagctacgagatgcctgatgggc

SEQ ID NO: 35950 - DNA, 25 bp, Rattus norvegicus
aagagctacgagttgcctgatgggc

SEQ ID NO: 35951 - DNA, 25 bp, Rattus norvegicus
aagagctactgtatatgtgccagac

SEQ ID NO: 35952 - DNA, 25 bp, Rattus norvegicus
aagagctactgtttatgtgccagac

SEQ ID NO: 35953 - DNA, 25 bp, Rattus norvegicus
aagagctacttcagtgatgtgatga

SEQ ID NO: 35954 - DNA, 25 bp, Rattus norvegicus
aagagctacttctgtgatgtgatga

SEQ ID NO: 35955 - DNA, 25 bp, Rattus norvegicus
aagagctagaaaccctcccactggt

SEQ ID NO: 35956 - DNA, 25 bp, Rattus norvegicus
aagagctagaaagcctcccactggt

SEQ ID NO: 35957 - DNA, 25 bp, Rattus norvegicus
aagagctagccccaacaacagattt

SEQ ID NO: 35958 - DNA, 25 bp, Rattus norvegicus
aagagctagcccgaacaacagattt

SEQ ID NO: 35959 - DNA, 25 bp, Rattus norvegicus
aagagctaggcccatggctgccctg

SEQ ID NO: 35960 - DNA, 25 bp, Rattus norvegicus
aagagctaggccgatggctgccctg

SEQ ID NO: 35961 - DNA, 25 bp, Rattus norvegicus
aagagctatggtcaggactgccctc

SEQ ID NO: 35962 - DNA, 25 bp, Rattus norvegicus
aagagctatggtgaggactgccctc

SEQ ID NO: 35963 - DNA, 25 bp, Rattus norvegicus
aagagctcaacaagagtgcccctct

SEQ ID NO: 35964 - DNA, 25 bp, Rattus norvegicus
aagagctcaacatgagtgcccctct

SEQ ID NO: 35965 - DNA, 25 bp, Rattus norvegicus
aagagctcactgatgaatcaccaga

SEQ ID NO: 35966 - DNA, 25 bp, Rattus norvegicus
aagagctcactgttgaatcaccaga

SEQ ID NO: 35967 - DNA, 25 bp, Rattus norvegicus
aagagctcagacacccttggttaag

SEQ ID NO: 35968 - DNA, 25 bp, Rattus norvegicus
aagagctcagactcccttggttaag

SEQ ID NO: 35969 - DNA, 25 bp, Rattus norvegicus
aagagctcattgcattgtccggcta

SEQ ID NO: 35970 - DNA, 25 bp, Rattus norvegicus
aagagctcattggattgtccggcta

SEQ ID NO: 35971 - DNA, 25 bp, Rattus norvegicus
aagagctccacgatgaccactgttg

SEQ ID NO: 35972 - DNA, 25 bp, Rattus norvegicus
aagagctccacgttgaccactgttg

SEQ ID NO: 35973 - DNA, 25 bp, Rattus norvegicus
aagagctccatgattacctggcagt

SEQ ID NO: 35974 - DNA, 25 bp, Rattus norvegicus
aagagctccatgtttacctggcagt

SEQ ID NO: 35975 - DNA, 25 bp, Rattus norvegicus
aagagctcccggatgatgtcagtgc

SEQ ID NO: 35976 - DNA, 25 bp, Rattus norvegicus
aagagctcccggttgatgtcagtgc

SEQ ID NO: 35977 - DNA, 25 bp, Rattus norvegicus
aagagctcctaaaggccgagttcct

SEQ ID NO: 35978 - DNA, 25 bp, Rattus norvegicus
aagagctcctaatggccgagttcct

SEQ ID NO: 35979 - DNA, 25 bp, Rattus norvegicus
aagagctcctatattgtactcctgg

SEQ ID NO: 35980 - DNA, 25 bp, Rattus norvegicus
aagagctcctatcctgattctgaga

SEQ ID NO: 35981 - DNA, 25 bp, Rattus norvegicus
aagagctcctatgctgattctgaga

SEQ ID NO: 35982 - DNA, 25 bp, Rattus norvegicus
aagagctcctattttgtactcctgg

SEQ ID NO: 35983 - DNA, 25 bp, Rattus norvegicus
aagagctcctcgcagaacagcgtcc

SEQ ID NO: 35984 - DNA, 25 bp, Rattus norvegicus
aagagctcctcggagaacagcgtcc

SEQ ID NO: 35985 - DNA, 25 bp, Rattus norvegicus
aagagctcctgtaaccacagcgtta

SEQ ID NO: 35986 - DNA, 25 bp, Rattus norvegicus
aagagctcctgttaccacagcgtta

SEQ ID NO: 35987 - DNA, 25 bp, Rattus norvegicus
aagagctcgaggcttcttaccatat

SEQ ID NO: 35988 - DNA, 25 bp, Rattus norvegicus
aagagctcgagggttcttaccatat

SEQ ID NO: 35989 - DNA, 25 bp, Rattus norvegicus
aagagctctcccatggtaccggcat

SEQ ID NO: 35990 - DNA, 25 bp, Rattus norvegicus
aagagctctcccttggtaccggcat

SEQ ID NO: 35991 - DNA, 25 bp, Rattus norvegicus
aagagctctcggattctgactggga

SEQ ID NO: 35992 - DNA, 25 bp, Rattus norvegicus
aagagctctcggtttctgactggga

SEQ ID NO: 35993 - DNA, 25 bp, Rattus norvegicus
aagagctctctgctgtggcaagtcc

SEQ ID NO: 35994 - DNA, 25 bp, Rattus norvegicus
aagagctctctggtgtggcaagtcc

SEQ ID NO: 35995 - DNA, 25 bp, Rattus norvegicus
aagagctctcttcgaagtggacgca

SEQ ID NO: 35996 - DNA, 25 bp, Rattus norvegicus
aagagctctcttggaagtggacgca

SEQ ID NO: 35997 - DNA, 25 bp, Rattus norvegicus
aagagctctgaccaggcctgaagac

SEQ ID NO: 35998 - DNA, 25 bp, Rattus norvegicus
aagagctctgacgaggcctgaagac

SEQ ID NO: 35999 - DNA, 25 bp, Rattus norvegicus
aagagctctggcctagggttcatcc

SEQ ID NO: 36000 - DNA, 25 bp, Rattus norvegicus
aagagctctggcgtagggttcatcc

SEQ ID NO: 36001 - DNA, 25 bp, Rattus norvegicus
aagagctgaccgcaaggccatacaa

SEQ ID NO: 36002 - DNA, 25 bp, Rattus norvegicus
aagagctgaccggaaggccatacaa

SEQ ID NO: 36003 - DNA, 25 bp, Rattus norvegicus
aagagctgactgattgtattcccgc

SEQ ID NO: 36004 - DNA, 25 bp, Rattus norvegicus
aagagctgactgtttgtattcccgc

SEQ ID NO: 36005 - DNA, 25 bp, Rattus norvegicus
aagagctgagcaagcatcacgctgt

SEQ ID NO: 36006 - DNA, 25 bp, Rattus norvegicus
aagagctgagcatgcatcacgctgt

SEQ ID NO: 36007 - DNA, 25 bp, Rattus norvegicus
aagagctgagccatgactccactgc

SEQ ID NO: 36008 - DNA, 25 bp, Rattus norvegicus
aagagctgagccttgactccactgc

SEQ ID NO: 36009 - DNA, 25 bp, Rattus norvegicus
aagagctgagcgaaggcttcaggaa

SEQ ID NO: 36010 - DNA, 25 bp, Rattus norvegicus
aagagctgagcgtaggcttcaggaa

SEQ ID NO: 36011 - DNA, 25 bp, Rattus norvegicus
aagagctgaggccttaaagcagaga

SEQ ID NO: 36012 - DNA, 25 bp, Rattus norvegicus
aagagctgaggcgttaaagcagaga

SEQ ID NO: 36013 - DNA, 25 bp, Rattus norvegicus
aagagctgagttcttgtccaccatc

SEQ ID NO: 36014 - DNA, 25 bp, Rattus norvegicus
aagagctgagttgttgtccaccatc

SEQ ID NO: 36015 - DNA, 25 bp, Rattus norvegicus
aagagctgatccctaacactatgca

SEQ ID NO: 36016 - DNA, 25 bp, Rattus norvegicus
aagagctgatccgtaacactatgca

SEQ ID NO: 36017 - DNA, 25 bp, Rattus norvegicus
aagagctgatgtcatccagggcctg

SEQ ID NO: 36018 - DNA, 25 bp, Rattus norvegicus
aagagctgatgtgatccagggcctg

SEQ ID NO: 36019 - DNA, 25 bp, Rattus norvegicus
aagagctgcacgctttccattaact

SEQ ID NO: 36020 - DNA, 25 bp, Rattus norvegicus
aagagctgcacggtttccattaact

SEQ ID NO: 36021 - DNA, 25 bp, Rattus norvegicus
aagagctgcagcctgtgccgagacc

SEQ ID NO: 36022 - DNA, 25 bp, Rattus norvegicus
aagagctgcagcgtgtgccgagacc

SEQ ID NO: 36023 - DNA, 25 bp, Rattus norvegicus
aagagctgcagtataaggccgtcct

SEQ ID NO: 36024 - DNA, 25 bp, Rattus norvegicus
aagagctgcagtttaaggccgtcct

SEQ ID NO: 36025 - DNA, 25 bp, Rattus norvegicus
aagagctgcatgacagcccacagga

SEQ ID NO: 36026 - DNA, 25 bp, Rattus norvegicus
aagagctgcatgtcagcccacagga

SEQ ID NO: 36027 - DNA, 25 bp, Rattus norvegicus
aagagctgcctgacaagagtgtcca

SEQ ID NO: 36028 - DNA, 25 bp, Rattus norvegicus
aagagctgcctgattagaactgaac

SEQ ID NO: 36029 - DNA, 25 bp, Rattus norvegicus
aagagctgcctgtcaagagtgtcca

SEQ ID NO: 36030 - DNA, 25 bp, Rattus norvegicus
aagagctgcctgtttagaactgaac

SEQ ID NO: 36031 - DNA, 25 bp, Rattus norvegicus
aagagctgcgctaccttagagggaa

SEQ ID NO: 36032 - DNA, 25 bp, Rattus norvegicus
aagagctgcgcttccttagagggaa

SEQ ID NO: 36033 - DNA, 25 bp, Rattus norvegicus
aagagctgcggaatcttcaggcttc

SEQ ID NO: 36034 - DNA, 25 bp, Rattus norvegicus
aagagctgcggacccttgaacttgt

SEQ ID NO: 36035 - DNA, 25 bp, Rattus norvegicus
aagagctgcggagccttgaacttgt

SEQ ID NO: 36036 - DNA, 25 bp, Rattus norvegicus
aagagctgcggattcttcaggcttc

SEQ ID NO: 36037 - DNA, 25 bp, Rattus norvegicus
aagagctgcggcactgagagctgta

SEQ ID NO: 36038 - DNA, 25 bp, Rattus norvegicus
aagagctgcggctctgagagctgta

SEQ ID NO: 36039 - DNA, 25 bp, Rattus norvegicus
aagagctgctaaccctttggctctc

SEQ ID NO: 36040 - DNA, 25 bp, Rattus norvegicus
aagagctgctaagcctttggctctc

SEQ ID NO: 36041 - DNA, 25 bp, Rattus norvegicus
aagagctgctcccttggctggattt

SEQ ID NO: 36042 - DNA, 25 bp, Rattus norvegicus
aagagctgctccctttaagtccatt

SEQ ID NO: 36043 - DNA, 25 bp, Rattus norvegicus
aagagctgctccgttggctggattt

SEQ ID NO: 36044 - DNA, 25 bp, Rattus norvegicus
aagagctgctccgtttaagtccatt

SEQ ID NO: 36045 - DNA, 25 bp, Rattus norvegicus
aagagctgctctatcagaccagtga

SEQ ID NO: 36046 - DNA, 25 bp, Rattus norvegicus
aagagctgctctttcagaccagtga

SEQ ID NO: 36047 - DNA, 25 bp, Rattus norvegicus
aagagctgctgaatatgccagcccg

SEQ ID NO: 36048 - DNA, 25 bp, Rattus norvegicus
aagagctgctgattatgccagcccg

SEQ ID NO: 36049 - DNA, 25 bp, Rattus norvegicus
aagagctgctggaaggttgctcgtc

SEQ ID NO: 36050 - DNA, 25 bp, Rattus norvegicus
aagagctgctggtaggttgctcgtc

SEQ ID NO: 36051 - DNA, 25 bp, Rattus norvegicus
aagagctgcttcagcttatgcggtt

SEQ ID NO: 36052 - DNA, 25 bp, Rattus norvegicus
aagagctgcttctgcttatgcggtt

SEQ ID NO: 36053 - DNA, 25 bp, Rattus norvegicus
aagagctggagaactttccgctgcc

SEQ ID NO: 36054 - DNA, 25 bp, Rattus norvegicus
aagagctggagatctttccgctgcc

SEQ ID NO: 36055 - DNA, 25 bp, Rattus norvegicus
aagagctggataaactatacccgag

SEQ ID NO: 36056 - DNA, 25 bp, Rattus norvegicus
aagagctggatatactatacccgag

SEQ ID NO: 36057 - DNA, 25 bp, Rattus norvegicus
aagagctggattactcgctgtttcc

SEQ ID NO: 36058 - DNA, 25 bp, Rattus norvegicus
aagagctggatttctcgctgtttcc

SEQ ID NO: 36059 - DNA, 25 bp, Rattus norvegicus
aagagctggcagatcgtctagaaaa

SEQ ID NO: 36060 - DNA, 25 bp, Rattus norvegicus
aagagctggcagttcgtctagaaaa

SEQ ID NO: 36061 - DNA, 25 bp, Rattus norvegicus
aagagctggctgaacacactggacc

SEQ ID NO: 36062 - DNA, 25 bp, Rattus norvegicus
aagagctggctgtacacactggacc

SEQ ID NO: 36063 - DNA, 25 bp, Rattus norvegicus
aagagctggcttccagtgcacagga

SEQ ID NO: 36064 - DNA, 25 bp, Rattus norvegicus
aagagctggcttgcagtgcacagga

SEQ ID NO: 36065 - DNA, 25 bp, Rattus norvegicus
aagagctgggccataatgctcctgg

SEQ ID NO: 36066 - DNA, 25 bp, Rattus norvegicus
aagagctgggccttaatgctcctgg

SEQ ID NO: 36067 - DNA, 25 bp, Rattus norvegicus
aagagctggtctatttcccatggcc

SEQ ID NO: 36068 - DNA, 25 bp, Rattus norvegicus
aagagctggtctttttcccatggcc

SEQ ID NO: 36069 - DNA, 25 bp, Rattus norvegicus
aagagctgtagcatgcacggtctgt

SEQ ID NO: 36070 - DNA, 25 bp, Rattus norvegicus
aagagctgtagcttgcacggtctgt

SEQ ID NO: 36071 - DNA, 25 bp, Rattus norvegicus
aagagctgtatactcccatttcacg

SEQ ID NO: 36072 - DNA, 25 bp, Rattus norvegicus
aagagctgtatagtcccatttcacg

SEQ ID NO: 36073 - DNA, 25 bp, Rattus norvegicus
aagagctgtgggatcgactgtgcca

SEQ ID NO: 36074 - DNA, 25 bp, Rattus norvegicus
aagagctgtgggttcgactgtgcca

SEQ ID NO: 36075 - DNA, 25 bp, Rattus norvegicus
aagagctgtgtacgactggctagaa

SEQ ID NO: 36076 - DNA, 25 bp, Rattus norvegicus
aagagctgtgtaggactggctagaa

SEQ ID NO: 36077 - DNA, 25 bp, Rattus norvegicus
aagagctgtgtcatcacctacctgg

SEQ ID NO: 36078 - DNA, 25 bp, Rattus norvegicus
aagagctgtgtcttcacctacctgg

SEQ ID NO: 36079 - DNA, 25 bp, Rattus norvegicus
aagagctgtgtgagcgctggaccca

SEQ ID NO: 36080 - DNA, 25 bp, Rattus norvegicus
aagagctgtgtgtgcgctggaccca

SEQ ID NO: 36081 - DNA, 25 bp, Rattus norvegicus
aagagctgttctacgacaacactga

SEQ ID NO: 36082 - DNA, 25 bp, Rattus norvegicus
aagagctgttcttcgacaacactga

SEQ ID NO: 36083 - DNA, 25 bp, Rattus norvegicus
aagagctgtttgcttccggtacaca

SEQ ID NO: 36084 - DNA, 25 bp, Rattus norvegicus
aagagctgtttggttccggtacaca

SEQ ID NO: 36085 - DNA, 25 bp, Rattus norvegicus
aagagcttaaaaacagcccgcccca

SEQ ID NO: 36086 - DNA, 25 bp, Rattus norvegicus
aagagcttaaaatcagcccgcccca

SEQ ID NO: 36087 - DNA, 25 bp, Rattus norvegicus
aagagcttacaacccattgtggtgt

SEQ ID NO: 36088 - DNA, 25 bp, Rattus norvegicus
aagagcttacaagccattgtggtgt

SEQ ID NO: 36089 - DNA, 25 bp, Rattus norvegicus
aagagcttcaacagccactctggcc

SEQ ID NO: 36090 - DNA, 25 bp, Rattus norvegicus
aagagcttcaactgccactctggcc

SEQ ID NO: 36091 - DNA, 25 bp, Rattus norvegicus
aagagcttcagaagtgcagtccaac

SEQ ID NO: 36092 - DNA, 25 bp, Rattus norvegicus
aagagcttcagatgtgcagtccaac

SEQ ID NO: 36093 - DNA, 25 bp, Rattus norvegicus
aagagcttcagcaacaggaacctag

SEQ ID NO: 36094 - DNA, 25 bp, Rattus norvegicus
aagagcttcagcaggaacgccaacc

SEQ ID NO: 36095 - DNA, 25 bp, Rattus norvegicus
aagagcttcagctacaggaacctag

SEQ ID NO: 36096 - DNA, 25 bp, Rattus norvegicus
aagagcttcagctggaacgccaacc

SEQ ID NO: 36097 - DNA, 25 bp, Rattus norvegicus
aagagcttcaggacctatgccggca

SEQ ID NO: 36098 - DNA, 25 bp, Rattus norvegicus
aagagcttcaggtcctatgccggca

SEQ ID NO: 36099 - DNA, 25 bp, Rattus norvegicus
aagagcttcataaaattttgccttc

SEQ ID NO: 36100 - DNA, 25 bp, Rattus norvegicus
aagagcttcatataattttgccttc

SEQ ID NO: 36101 - DNA, 25 bp, Rattus norvegicus
aagagcttcctcagccacggagagt

SEQ ID NO: 36102 - DNA, 25 bp, Rattus norvegicus
aagagcttcctctgccacggagagt

SEQ ID NO: 36103 - DNA, 25 bp, Rattus norvegicus
aagagcttcctgatactctaagccg

SEQ ID NO: 36104 - DNA, 25 bp, Rattus norvegicus
aagagcttcctgttactctaagccg

SEQ ID NO: 36105 - DNA, 25 bp, Rattus norvegicus
aagagcttccttctggacagtacac

SEQ ID NO: 36106 - DNA, 25 bp, Rattus norvegicus
aagagcttccttgtggacagtacac

SEQ ID NO: 36107 - DNA, 25 bp, Rattus norvegicus
aagagcttcggtaggcggtcaaatc

SEQ ID NO: 36108 - DNA, 25 bp, Rattus norvegicus
aagagcttcggttggcggtcaaatc

SEQ ID NO: 36109 - DNA, 25 bp, Rattus norvegicus
aagagcttgaaaatactgtcctaga

SEQ ID NO: 36110 - DNA, 25 bp, Rattus norvegicus
aagagcttgaaattactgtcctaga

SEQ ID NO: 36111 - DNA, 25 bp, Rattus norvegicus
aagagcttgagaaaattcgccagaa

SEQ ID NO: 36112 - DNA, 25 bp, Rattus norvegicus
aagagcttgagataattcgccagaa

SEQ ID NO: 36113 - DNA, 25 bp, Rattus norvegicus
aagagcttgccccatatgatgagaa

SEQ ID NO: 36114 - DNA, 25 bp, Rattus norvegicus
aagagcttgcccgatatgatgagaa

SEQ ID NO: 36115 - DNA, 25 bp, Rattus norvegicus
aagagcttgcgtctctgttggttag

SEQ ID NO: 36116 - DNA, 25 bp, Rattus norvegicus
aagagcttgcgtgtctgttggttag

SEQ ID NO: 36117 - DNA, 25 bp, Rattus norvegicus
aagagcttgctcaggaaaccccggc

SEQ ID NO: 36118 - DNA, 25 bp, Rattus norvegicus
aagagcttgctctggaaaccccggc

SEQ ID NO: 36119 - DNA, 25 bp, Rattus norvegicus
aagagcttggacatcctatcgatca

SEQ ID NO: 36120 - DNA, 25 bp, Rattus norvegicus
aagagcttggacttcctatcgatca

SEQ ID NO: 36121 - DNA, 25 bp, Rattus norvegicus
aagagcttgtggcatgctcagcccc

SEQ ID NO: 36122 - DNA, 25 bp, Rattus norvegicus
aagagcttgtgggatgctcagcccc

SEQ ID NO: 36123 - DNA, 25 bp, Rattus norvegicus
aagagcttgtttatatgtgcattca

SEQ ID NO: 36124 - DNA, 25 bp, Rattus norvegicus
aagagcttgtttttatgtgcattca

SEQ ID NO: 36125 - DNA, 25 bp, Rattus norvegicus
aagagctttactaatcaaccacagt

SEQ ID NO: 36126 - DNA, 25 bp, Rattus norvegicus
aagagctttacttatcaaccacagt

SEQ ID NO: 36127 - DNA, 25 bp, Rattus norvegicus
aagagctttagtacgctttgaccga

SEQ ID NO: 36128 - DNA, 25 bp, Rattus norvegicus
aagagctttagttcgctttgaccga

SEQ ID NO: 36129 - DNA, 25 bp, Rattus norvegicus
aagagctttcagaccagcagtaaaa

SEQ ID NO: 36130 - DNA, 25 bp, Rattus norvegicus
aagagctttcagtccagcagtaaaa

SEQ ID NO: 36131 - DNA, 25 bp, Rattus norvegicus
aagagctttgctatagtcggcgatg

SEQ ID NO: 36132 - DNA, 25 bp, Rattus norvegicus
aagagctttgctttagtcggcgatg

SEQ ID NO: 36133 - DNA, 25 bp, Rattus norvegicus
aagagcttttcaagtcaaggccctg

SEQ ID NO: 36134 - DNA, 25 bp, Rattus norvegicus
aagagcttttcatgtcaaggccctg

SEQ ID NO: 36135 - DNA, 25 bp, Rattus norvegicus
aagagcttttgtactagcccggtat

SEQ ID NO: 36136 - DNA, 25 bp, Rattus norvegicus
aagagcttttgttctagcccggtat

SEQ ID NO: 36137 - DNA, 25 bp, Rattus norvegicus
aagaggaaaccgctggcttgctttc

SEQ ID NO: 36138 - DNA, 25 bp, Rattus norvegicus
aagaggaaaccggtggcttgctttc

SEQ ID NO: 36139 - DNA, 25 bp, Rattus norvegicus
aagaggaaactgacgtccgccgtgt

SEQ ID NO: 36140 - DNA, 25 bp, Rattus norvegicus
aagaggaaactgtcgtccgccgtgt

SEQ ID NO: 36141 - DNA, 25 bp, Rattus norvegicus
aagaggaaaggacgccttgccctca

SEQ ID NO: 36142 - DNA, 25 bp, Rattus norvegicus
aagaggaaaggaggccttgccctca

SEQ ID NO: 36143 - DNA, 25 bp, Rattus norvegicus
aagaggaacaacacgcttcaaacag

SEQ ID NO: 36144 - DNA, 25 bp, Rattus norvegicus
aagaggaacaactcgcttcaaacag

SEQ ID NO: 36145 - DNA, 25 bp, Rattus norvegicus
aagaggaacagccaaccagacactc

SEQ ID NO: 36146 - DNA, 25 bp, Rattus norvegicus
aagaggaacagcgaaccagacactc

SEQ ID NO: 36147 - DNA, 25 bp, Rattus norvegicus
aagaggaaccagagcttctgcccaa

SEQ ID NO: 36148 - DNA, 25 bp, Rattus norvegicus
aagaggaaccagtgcttctgcccaa

SEQ ID NO: 36149 - DNA, 25 bp, Rattus norvegicus
aagaggaaccccatcgatgtggacc

SEQ ID NO: 36150 - DNA, 25 bp, Rattus norvegicus
aagaggaaccccttcgatgtggacc

SEQ ID NO: 36151 - DNA, 25 bp, Rattus norvegicus
aagaggaaccgcaatcactgacaag

SEQ ID NO: 36152 - DNA, 25 bp, Rattus norvegicus
aagaggaaccgctatcactgacaag

SEQ ID NO: 36153 - DNA, 25 bp, Rattus norvegicus
aagaggaacgcgaggccatcagact

SEQ ID NO: 36154 - DNA, 25 bp, Rattus norvegicus
aagaggaacgcgtggccatcagact

SEQ ID NO: 36155 - DNA, 25 bp, Rattus norvegicus
aagaggaactgcaggccacgtgtgc

SEQ ID NO: 36156 - DNA, 25 bp, Rattus norvegicus
aagaggaactgctggccacgtgtgc

SEQ ID NO: 36157 - DNA, 25 bp, Rattus norvegicus
aagaggaagagaagccccccgatgg

SEQ ID NO: 36158 - DNA, 25 bp, Rattus norvegicus
aagaggaagagatgccccccgatgg

SEQ ID NO: 36159 - DNA, 25 bp, Rattus norvegicus
aagaggaagcacagagcaggtagca

SEQ ID NO: 36160 - DNA, 25 bp, Rattus norvegicus
aagaggaagcactgagcaggtagca

SEQ ID NO: 36161 - DNA, 25 bp, Rattus norvegicus
aagaggaagcctctgtctctggcct

SEQ ID NO: 36162 - DNA, 25 bp, Rattus norvegicus
aagaggaagcctgtgtctctggcct

SEQ ID NO: 36163 - DNA, 25 bp, Rattus norvegicus
aagaggaagcttcgtgcgtgttctc

SEQ ID NO: 36164 - DNA, 25 bp, Rattus norvegicus
aagaggaagcttggtgcgtgttctc

SEQ ID NO: 36165 - DNA, 25 bp, Rattus norvegicus
aagaggaaggctccccggctcaagt

SEQ ID NO: 36166 - DNA, 25 bp, Rattus norvegicus
aagaggaaggctgcccggctcaagt

SEQ ID NO: 36167 - DNA, 25 bp, Rattus norvegicus
aagaggaatgccatgctgctcattt

SEQ ID NO: 36168 - DNA, 25 bp, Rattus norvegicus
aagaggaatgccttgctgctcattt

SEQ ID NO: 36169 - DNA, 25 bp, Rattus norvegicus
aagaggacacataagcagccccaaa

SEQ ID NO: 36170 - DNA, 25 bp, Rattus norvegicus
aagaggacacattagcagccccaaa

SEQ ID NO: 36171 - DNA, 25 bp, Rattus norvegicus
aagaggacacgcagacacgcgaact

SEQ ID NO: 36172 - DNA, 25 bp, Rattus norvegicus
aagaggacacgctgacacgcgaact

SEQ ID NO: 36173 - DNA, 25 bp, Rattus norvegicus
aagaggacagacagcctggcgtccc

SEQ ID NO: 36174 - DNA, 25 bp, Rattus norvegicus
aagaggacagactgcctggcgtccc

SEQ ID NO: 36175 - DNA, 25 bp, Rattus norvegicus
aagaggacagccaggtgcccagcat

SEQ ID NO: 36176 - DNA, 25 bp, Rattus norvegicus
aagaggacagcctggtgcccagcat

SEQ ID NO: 36177 - DNA, 25 bp, Rattus norvegicus
aagaggacaggacgagactgcccta

SEQ ID NO: 36178 - DNA, 25 bp, Rattus norvegicus
aagaggacaggaggagactgcccta

SEQ ID NO: 36179 - DNA, 25 bp, Rattus norvegicus
aagaggacaggcctcttgctttagc

SEQ ID NO: 36180 - DNA, 25 bp, Rattus norvegicus
aagaggacaggcgtcttgctttagc

SEQ ID NO: 36181 - DNA, 25 bp, Rattus norvegicus
aagaggacatccaatctcctggacc

SEQ ID NO: 36182 - DNA, 25 bp, Rattus norvegicus
aagaggacatccagtgtgacaacac

SEQ ID NO: 36183 - DNA, 25 bp, Rattus norvegicus
aagaggacatcctatctcctggacc

SEQ ID NO: 36184 - DNA, 25 bp, Rattus norvegicus
aagaggacatcctgtgtgacaacac

SEQ ID NO: 36185 - DNA, 25 bp, Rattus norvegicus
aagaggaccaaacccttccacacag

SEQ ID NO: 36186 - DNA, 25 bp, Rattus norvegicus
aagaggaccaaagccttccacacag

SEQ ID NO: 36187 - DNA, 25 bp, Rattus norvegicus
aagaggacccttcggatatgacccg

SEQ ID NO: 36188 - DNA, 25 bp, Rattus norvegicus
aagaggacccttgggatatgacccg

SEQ ID NO: 36189 - DNA, 25 bp, Rattus norvegicus
aagaggaccgcgctgacttgcctgt

SEQ ID NO: 36190 - DNA, 25 bp, Rattus norvegicus
aagaggaccgcggtgacttgcctgt

SEQ ID NO: 36191 - DNA, 25 bp, Rattus norvegicus
aagaggacggtgatgagccctgctt

SEQ ID NO: 36192 - DNA, 25 bp, Rattus norvegicus
aagaggacggtgttgagccctgctt

SEQ ID NO: 36193 - DNA, 25 bp, Rattus norvegicus
aagaggacgtgcatagacagaccca

SEQ ID NO: 36194 - DNA, 25 bp, Rattus norvegicus
aagaggacgtgcttagacagaccca

SEQ ID NO: 36195 - DNA, 25 bp, Rattus norvegicus
aagaggactccaagctcttaactgc

SEQ ID NO: 36196 - DNA, 25 bp, Rattus norvegicus
aagaggactccatgctcttaactgc

SEQ ID NO: 36197 - DNA, 25 bp, Rattus norvegicus
aagaggactccgacacagcgggcag

SEQ ID NO: 36198 - DNA, 25 bp, Rattus norvegicus
aagaggactccgtcacagcgggcag

SEQ ID NO: 36199 - DNA, 25 bp, Rattus norvegicus
aagaggactctgactttcccggaat

SEQ ID NO: 36200 - DNA, 25 bp, Rattus norvegicus
aagaggactctgtctttcccggaat

SEQ ID NO: 36201 - DNA, 25 bp, Rattus norvegicus
aagaggactggcagtgaccctatct

SEQ ID NO: 36202 - DNA, 25 bp, Rattus norvegicus
aagaggactggctgtgaccctatct

SEQ ID NO: 36203 - DNA, 25 bp, Rattus norvegicus
aagaggactgtcagccatcggacct

SEQ ID NO: 36204 - DNA, 25 bp, Rattus norvegicus
aagaggactgtctgccatcggacct

SEQ ID NO: 36205 - DNA, 25 bp, Rattus norvegicus
aagaggacttgtcggcttagctctc

SEQ ID NO: 36206 - DNA, 25 bp, Rattus norvegicus
aagaggacttgtgggcttagctctc

SEQ ID NO: 36207 - DNA, 25 bp, Rattus norvegicus
aagaggagaagtcccgcatcagcct

SEQ ID NO: 36208 - DNA, 25 bp, Rattus norvegicus
aagaggagaagtgccgcatcagcct

SEQ ID NO: 36209 - DNA, 25 bp, Rattus norvegicus
aagaggagaccaccgatgaccctga

SEQ ID NO: 36210 - DNA, 25 bp, Rattus norvegicus
aagaggagaccagcgatgaccctga

SEQ ID NO: 36211 - DNA, 25 bp, Rattus norvegicus
aagaggagacctccatcaacgtgtg

SEQ ID NO: 36212 - DNA, 25 bp, Rattus norvegicus
aagaggagacctgcatcaacgtgtg

SEQ ID NO: 36213 - DNA, 25 bp, Rattus norvegicus
aagaggagcaccaacacaacagcca

SEQ ID NO: 36214 - DNA, 25 bp, Rattus norvegicus
aagaggagcaccaccggcaaaacgt

SEQ ID NO: 36215 - DNA, 25 bp, Rattus norvegicus
aagaggagcaccagtcttccagaaa

SEQ ID NO: 36216 - DNA, 25 bp, Rattus norvegicus
aagaggagcacctacacaacagcca

SEQ ID NO: 36217 - DNA, 25 bp, Rattus norvegicus
aagaggagcacctccggcaaaacgt

SEQ ID NO: 36218 - DNA, 25 bp, Rattus norvegicus
aagaggagcacctgtcttccagaaa

SEQ ID NO: 36219 - DNA, 25 bp, Rattus norvegicus
aagaggagcagcaagcactcggcca

SEQ ID NO: 36220 - DNA, 25 bp, Rattus norvegicus
aagaggagcagctagcactcggcca

SEQ ID NO: 36221 - DNA, 25 bp, Rattus norvegicus
aagaggagcccaagctggtggccca

SEQ ID NO: 36222 - DNA, 25 bp, Rattus norvegicus
aagaggagcccacgtccaggtcgtt

SEQ ID NO: 36223 - DNA, 25 bp, Rattus norvegicus
aagaggagcccaggtccaggtcgtt

SEQ ID NO: 36224 - DNA, 25 bp, Rattus norvegicus
aagaggagcccatgctggtggccca

SEQ ID NO: 36225 - DNA, 25 bp, Rattus norvegicus
aagaggagcgaacccactatcagca

SEQ ID NO: 36226 - DNA, 25 bp, Rattus norvegicus
aagaggagcgaagccactatcagca

SEQ ID NO: 36227 - DNA, 25 bp, Rattus norvegicus
aagaggagcgcgactctgaactgcg

SEQ ID NO: 36228 - DNA, 25 bp, Rattus norvegicus
aagaggagcgcgtctctgaactgcg

SEQ ID NO: 36229 - DNA, 25 bp, Rattus norvegicus
aagaggagcgctcttcccgtgtaga

SEQ ID NO: 36230 - DNA, 25 bp, Rattus norvegicus
aagaggagcgctgttcccgtgtaga

SEQ ID NO: 36231 - DNA, 25 bp, Rattus norvegicus
aagaggaggacccacgggcctctca

SEQ ID NO: 36232 - DNA, 25 bp, Rattus norvegicus
aagaggaggaccgacgggcctctca

SEQ ID NO: 36233 - DNA, 25 bp, Rattus norvegicus
aagaggaggagcacaccaagccctt

SEQ ID NO: 36234 - DNA, 25 bp, Rattus norvegicus
aagaggaggagctcaccaagccctt

SEQ ID NO: 36235 - DNA, 25 bp, Rattus norvegicus
aagaggaggatgaagcggatcccaa

SEQ ID NO: 36236 - DNA, 25 bp, Rattus norvegicus
aagaggaggatgtagcggatcccaa

SEQ ID NO: 36237 - DNA, 25 bp, Rattus norvegicus
aagaggaggccaaggctggtctcta

SEQ ID NO: 36238 - DNA, 25 bp, Rattus norvegicus
aagaggaggccatggctggtctcta

SEQ ID NO: 36239 - DNA, 25 bp, Rattus norvegicus
aagaggaggctgactcgcaagctca

SEQ ID NO: 36240 - DNA, 25 bp, Rattus norvegicus
aagaggaggctgtctcgcaagctca

SEQ ID NO: 36241 - DNA, 25 bp, Rattus norvegicus
aagaggaggtagaccagcagtgcat

SEQ ID NO: 36242 - DNA, 25 bp, Rattus norvegicus
aagaggaggtagtccagcagtgcat

SEQ ID NO: 36243 - DNA, 25 bp, Rattus norvegicus
aagaggagtcctacctgaggcaggc

SEQ ID NO: 36244 - DNA, 25 bp, Rattus norvegicus
aagaggagtccttcctgaggcaggc

SEQ ID NO: 36245 - DNA, 25 bp, Rattus norvegicus
aagaggagtcgcactagaccttctt

SEQ ID NO: 36246 - DNA, 25 bp, Rattus norvegicus
aagaggagtcgctctagaccttctt

SEQ ID NO: 36247 - DNA, 25 bp, Rattus norvegicus
aagaggagttcaccgtttctgtctg

SEQ ID NO: 36248 - DNA, 25 bp, Rattus norvegicus
aagaggagttcagcgtttctgtctg

SEQ ID NO: 36249 - DNA, 25 bp, Rattus norvegicus
aagaggagtttaactgcaggggaaa

SEQ ID NO: 36250 - DNA, 25 bp, Rattus norvegicus
aagaggagtttatctgcaggggaaa

SEQ ID NO: 36251 - DNA, 25 bp, Rattus norvegicus
aagaggagttttagccactgacccg

SEQ ID NO: 36252 - DNA, 25 bp, Rattus norvegicus
aagaggagtttttgccactgacccg

SEQ ID NO: 36253 - DNA, 25 bp, Rattus norvegicus
aagaggatagaacccgcagacgcgc

SEQ ID NO: 36254 - DNA, 25 bp, Rattus norvegicus
aagaggatagaagccgcagacgcgc

SEQ ID NO: 36255 - DNA, 25 bp, Rattus norvegicus
aagaggatatgcagccaccaggttg

SEQ ID NO: 36256 - DNA, 25 bp, Rattus norvegicus
aagaggatatgctgccaccaggttg

SEQ ID NO: 36257 - DNA, 25 bp, Rattus norvegicus
aagaggatcaccacgttgtctttcg

SEQ ID NO: 36258 - DNA, 25 bp, Rattus norvegicus
aagaggatcacctcgttgtctttcg

SEQ ID NO: 36259 - DNA, 25 bp, Rattus norvegicus
aagaggatccacactcttggctttc

SEQ ID NO: 36260 - DNA, 25 bp, Rattus norvegicus
aagaggatccactctcttggctttc

SEQ ID NO: 36261 - DNA, 25 bp, Rattus norvegicus
aagaggatccctaaggtggcttcac

SEQ ID NO: 36262 - DNA, 25 bp, Rattus norvegicus
aagaggatccctcagagtaccctga

SEQ ID NO: 36263 - DNA, 25 bp, Rattus norvegicus
aagaggatccctgagagtaccctga

SEQ ID NO: 36264 - DNA, 25 bp, Rattus norvegicus
aagaggatcccttaggtggcttcac

SEQ ID NO: 36265 - DNA, 25 bp, Rattus norvegicus
aagaggatccggctactgcagtttg

SEQ ID NO: 36266 - DNA, 25 bp, Rattus norvegicus
aagaggatccgggtactgcagtttg

SEQ ID NO: 36267 - DNA, 25 bp, Rattus norvegicus
aagaggatcgggacatcctgcctat

SEQ ID NO: 36268 - DNA, 25 bp, Rattus norvegicus
aagaggatcgggtcatcctgcctat

SEQ ID NO: 36269 - DNA, 25 bp, Rattus norvegicus
aagaggatctctccagcccgagaaa

SEQ ID NO: 36270 - DNA, 25 bp, Rattus norvegicus
aagaggatctctcccgttacgtttc

SEQ ID NO: 36271 - DNA, 25 bp, Rattus norvegicus
aagaggatctctgcagcccgagaaa

SEQ ID NO: 36272 - DNA, 25 bp, Rattus norvegicus
aagaggatctctgccgttacgtttc

SEQ ID NO: 36273 - DNA, 25 bp, Rattus norvegicus
aagaggatgagaccccagcacaggt

SEQ ID NO: 36274 - DNA, 25 bp, Rattus norvegicus
aagaggatgagagcccagcacaggt

SEQ ID NO: 36275 - DNA, 25 bp, Rattus norvegicus
aagaggatgcctctcgaggtcctgt

SEQ ID NO: 36276 - DNA, 25 bp, Rattus norvegicus
aagaggatgcctgtcgaggtcctgt

SEQ ID NO: 36277 - DNA, 25 bp, Rattus norvegicus
aagaggatgtatacccatgggccta

SEQ ID NO: 36278 - DNA, 25 bp, Rattus norvegicus
aagaggatgtatctgcctgtccaaa

SEQ ID NO: 36279 - DNA, 25 bp, Rattus norvegicus
aagaggatgtatgtgcctgtccaaa

SEQ ID NO: 36280 - DNA, 25 bp, Rattus norvegicus
aagaggatgtattcccatgggccta

SEQ ID NO: 36281 - DNA, 25 bp, Rattus norvegicus
aagaggattaccagctttgcttccg

SEQ ID NO: 36282 - DNA, 25 bp, Rattus norvegicus
aagaggattacctgctttgcttccg

SEQ ID NO: 36283 - DNA, 25 bp, Rattus norvegicus
aagaggatttgcatcccaaacacca

SEQ ID NO: 36284 - DNA, 25 bp, Rattus norvegicus
aagaggatttgcttcccaaacacca

SEQ ID NO: 36285 - DNA, 25 bp, Rattus norvegicus
aagaggattttcaccgaagcaaatt

SEQ ID NO: 36286 - DNA, 25 bp, Rattus norvegicus
aagaggattttctccgaagcaaatt

SEQ ID NO: 36287 - DNA, 25 bp, Rattus norvegicus
aagaggcaacatcctcatgagttag

SEQ ID NO: 36288 - DNA, 25 bp, Rattus norvegicus
aagaggcaacatgctcatgagttag

SEQ ID NO: 36289 - DNA, 25 bp, Rattus norvegicus
aagaggcaagttacacacacgcaaa

SEQ ID NO: 36290 - DNA, 25 bp, Rattus norvegicus
aagaggcaagtttcacacacgcaaa

SEQ ID NO: 36291 - DNA, 25 bp, Rattus norvegicus
aagaggcaccaacacccttgtcagc

SEQ ID NO: 36292 - DNA, 25 bp, Rattus norvegicus
aagaggcaccaagacccttgtcagc

SEQ ID NO: 36293 - DNA, 25 bp, Rattus norvegicus
aagaggcaccaccaccttgaaaaag

SEQ ID NO: 36294 - DNA, 25 bp, Rattus norvegicus
aagaggcaccacgaccttgaaaaag

SEQ ID NO: 36295 - DNA, 25 bp, Rattus norvegicus
aagaggcacctgactgcggatcttg

SEQ ID NO: 36296 - DNA, 25 bp, Rattus norvegicus
aagaggcacctgtctgcggatcttg

SEQ ID NO: 36297 - DNA, 25 bp, Rattus norvegicus
aagaggcacgccagctcacagaact

SEQ ID NO: 36298 - DNA, 25 bp, Rattus norvegicus
aagaggcacgcctgctcacagaact

SEQ ID NO: 36299 - DNA, 25 bp, Rattus norvegicus
aagaggcagaaaactcccgcatcag

SEQ ID NO: 36300 - DNA, 25 bp, Rattus norvegicus
aagaggcagaaatctcccgcatcag

SEQ ID NO: 36301 - DNA, 25 bp, Rattus norvegicus
aagaggcagaagaacccagtctacc

SEQ ID NO: 36302 - DNA, 25 bp, Rattus norvegicus
aagaggcagaagtacccagtctacc

SEQ ID NO: 36303 - DNA, 25 bp, Rattus norvegicus
aagaggcagccaatcctgagggcag

SEQ ID NO: 36304 - DNA, 25 bp, Rattus norvegicus
aagaggcagccattcctgagggcag

SEQ ID NO: 36305 - DNA, 25 bp, Rattus norvegicus
aagaggcagcggaccaccaggacaa

SEQ ID NO: 36306 - DNA, 25 bp, Rattus norvegicus
aagaggcagcggtccaccaggacaa

SEQ ID NO: 36307 - DNA, 25 bp, Rattus norvegicus
aagaggcagctcagtaacaccggtg

SEQ ID NO: 36308 - DNA, 25 bp, Rattus norvegicus
aagaggcagctctgtaacaccggtg

SEQ ID NO: 36309 - DNA, 25 bp, Rattus norvegicus
aagaggcagcttaccaactttgcac

SEQ ID NO: 36310 - DNA, 25 bp, Rattus norvegicus
aagaggcagctttccaactttgcac

SEQ ID NO: 36311 - DNA, 25 bp, Rattus norvegicus
aagaggcaggcgacagagtccagca

SEQ ID NO: 36312 - DNA, 25 bp, Rattus norvegicus
aagaggcaggcgtcagagtccagca

SEQ ID NO: 36313 - DNA, 25 bp, Rattus norvegicus
aagaggcagggcatcagcatcgcaa

SEQ ID NO: 36314 - DNA, 25 bp, Rattus norvegicus
aagaggcagggcttcagcatcgcaa

SEQ ID NO: 36315 - DNA, 25 bp, Rattus norvegicus
aagaggcatctgatctgtgctgtca

SEQ ID NO: 36316 - DNA, 25 bp, Rattus norvegicus
aagaggcatctgttctgtgctgtca

SEQ ID NO: 36317 - DNA, 25 bp, Rattus norvegicus
aagaggccaccaaatgcttccaatt

SEQ ID NO: 36318 - DNA, 25 bp, Rattus norvegicus
aagaggccaccatatgcttccaatt

SEQ ID NO: 36319 - DNA, 25 bp, Rattus norvegicus
aagaggccagcaccatgtcttacat

SEQ ID NO: 36320 - DNA, 25 bp, Rattus norvegicus
aagaggccagcagcatgtcttacat

SEQ ID NO: 36321 - DNA, 25 bp, Rattus norvegicus
aagaggccaggtcttcacgctgaat

SEQ ID NO: 36322 - DNA, 25 bp, Rattus norvegicus
aagaggccaggtgttcacgctgaat

SEQ ID NO: 36323 - DNA, 25 bp, Rattus norvegicus
aagaggccagtccaatcactatttc

SEQ ID NO: 36324 - DNA, 25 bp, Rattus norvegicus
aagaggccagtcgaatcactatttc

SEQ ID NO: 36325 - DNA, 25 bp, Rattus norvegicus
aagaggccattgagcctttgtaaag

SEQ ID NO: 36326 - DNA, 25 bp, Rattus norvegicus
aagaggccattgtgcctttgtaaag

SEQ ID NO: 36327 - DNA, 25 bp, Rattus norvegicus
aagaggccccaacccgtgaagagtg

SEQ ID NO: 36328 - DNA, 25 bp, Rattus norvegicus
aagaggccccaagccgtgaagagtg

SEQ ID NO: 36329 - DNA, 25 bp, Rattus norvegicus
aagaggccctgaaaggcagcctggc

SEQ ID NO: 36330 - DNA, 25 bp, Rattus norvegicus
aagaggccctgataggcagcctggc

SEQ ID NO: 36331 - DNA, 25 bp, Rattus norvegicus
aagaggccgtgtcgatccatctcaa

SEQ ID NO: 36332 - DNA, 25 bp, Rattus norvegicus
aagaggccgtgtggatccatctcaa

SEQ ID NO: 36333 - DNA, 25 bp, Rattus norvegicus
aagaggcctacacaatgacccggaa

SEQ ID NO: 36334 - DNA, 25 bp, Rattus norvegicus
aagaggcctacagaatgacccggaa

SEQ ID NO: 36335 - DNA, 25 bp, Rattus norvegicus
aagaggcctcagcttagtcacttta

SEQ ID NO: 36336 - DNA, 25 bp, Rattus norvegicus
aagaggcctcaggttagtcacttta

SEQ ID NO: 36337 - DNA, 25 bp, Rattus norvegicus
aagaggcctctgatgtggacatgct

SEQ ID NO: 36338 - DNA, 25 bp, Rattus norvegicus
aagaggcctctgttgtggacatgct

SEQ ID NO: 36339 - DNA, 25 bp, Rattus norvegicus
aagaggcctgtgatcatgtaaccaa

SEQ ID NO: 36340 - DNA, 25 bp, Rattus norvegicus
aagaggcctgtgttcatgtaaccaa

SEQ ID NO: 36341 - DNA, 25 bp, Rattus norvegicus
aagaggccttaccaggccactggag

SEQ ID NO: 36342 - DNA, 25 bp, Rattus norvegicus
aagaggccttacgaggccactggag

SEQ ID NO: 36343 - DNA, 25 bp, Rattus norvegicus
aagaggcgaaacactaccgggactg

SEQ ID NO: 36344 - DNA, 25 bp, Rattus norvegicus
aagaggcgaaactctaccgggactg

SEQ ID NO: 36345 - DNA, 25 bp, Rattus norvegicus
aagaggcgctcaaattctacaccaa

SEQ ID NO: 36346 - DNA, 25 bp, Rattus norvegicus
aagaggcgctcatattctacaccaa

SEQ ID NO: 36347 - DNA, 25 bp, Rattus norvegicus
aagaggcgctgaactccaaggcctg

SEQ ID NO: 36348 - DNA, 25 bp, Rattus norvegicus
aagaggcgctgatctccaaggcctg

SEQ ID NO: 36349 - DNA, 25 bp, Rattus norvegicus
aagaggcgctgtagtctgtgctcac

SEQ ID NO: 36350 - DNA, 25 bp, Rattus norvegicus
aagaggcgctgttgtctgtgctcac

SEQ ID NO: 36351 - DNA, 25 bp, Rattus norvegicus
aagaggcggtcacatctggaacaga

SEQ ID NO: 36352 - DNA, 25 bp, Rattus norvegicus
aagaggcggtcagatctggaacaga

SEQ ID NO: 36353 - DNA, 25 bp, Rattus norvegicus
aagaggcgtacccacgcaacagcag

SEQ ID NO: 36354 - DNA, 25 bp, Rattus norvegicus
aagaggcgtaccgacgcaacagcag

SEQ ID NO: 36355 - DNA, 25 bp, Rattus norvegicus
aagaggctaaacagatcatccagga

SEQ ID NO: 36356 - DNA, 25 bp, Rattus norvegicus
aagaggctaaactgatcatccagga

SEQ ID NO: 36357 - DNA, 25 bp, Rattus norvegicus
aagaggctaagcacagccccgagta

SEQ ID NO: 36358 - DNA, 25 bp, Rattus norvegicus
aagaggctaagctcagccccgagta

SEQ ID NO: 36359 - DNA, 25 bp, Rattus norvegicus
aagaggctacaactggctgcttcac

SEQ ID NO: 36360 - DNA, 25 bp, Rattus norvegicus
aagaggctacaagtggctgcttcac

SEQ ID NO: 36361 - DNA, 25 bp, Rattus norvegicus
aagaggctactcagtctggccagtg

SEQ ID NO: 36362 - DNA, 25 bp, Rattus norvegicus
aagaggctactctgtctggccagtg

SEQ ID NO: 36363 - DNA, 25 bp, Rattus norvegicus
aagaggctaggccacttgtgccgac

SEQ ID NO: 36364 - DNA, 25 bp, Rattus norvegicus
aagaggctaggcgacttgtgccgac

SEQ ID NO: 36365 - DNA, 25 bp, Rattus norvegicus
aagaggctatgcagttcaatgttgc

SEQ ID NO: 36366 - DNA, 25 bp, Rattus norvegicus
aagaggctatgctgttcaatgttgc

SEQ ID NO: 36367 - DNA, 25 bp, Rattus norvegicus
aagaggctcaaaccttcgtgttcac

SEQ ID NO: 36368 - DNA, 25 bp, Rattus norvegicus
aagaggctcaaagcttcgtgttcac

SEQ ID NO: 36369 - DNA, 25 bp, Rattus norvegicus
aagaggctcatcaactgtggcgtct

SEQ ID NO: 36370 - DNA, 25 bp, Rattus norvegicus
aagaggctcatctactgtggcgtct

SEQ ID NO: 36371 - DNA, 25 bp, Rattus norvegicus
aagaggctcatgaacctggcctagt

SEQ ID NO: 36372 - DNA, 25 bp, Rattus norvegicus
aagaggctcatgtacctggcctagt

SEQ ID NO: 36373 - DNA, 25 bp, Rattus norvegicus
aagaggctccacatctgatgtgaaa

SEQ ID NO: 36374 - DNA, 25 bp, Rattus norvegicus
aagaggctccacttctgatgtgaaa

SEQ ID NO: 36375 - DNA, 25 bp, Rattus norvegicus
aagaggctcctgcatctgaggtccc

SEQ ID NO: 36376 - DNA, 25 bp, Rattus norvegicus
aagaggctcctggatctgaggtccc

SEQ ID NO: 36377 - DNA, 25 bp, Rattus norvegicus
aagaggctcggaactcagtctgcat

SEQ ID NO: 36378 - DNA, 25 bp, Rattus norvegicus
aagaggctcggaactgtctatacca

SEQ ID NO: 36379 - DNA, 25 bp, Rattus norvegicus
aagaggctcggatctcagtctgcat

SEQ ID NO: 36380 - DNA, 25 bp, Rattus norvegicus
aagaggctcggatctgtctatacca

SEQ ID NO: 36381 - DNA, 25 bp, Rattus norvegicus
aagaggctctacctcagcgactgga

SEQ ID NO: 36382 - DNA, 25 bp, Rattus norvegicus
aagaggctctacgtcagcgactgga

SEQ ID NO: 36383 - DNA, 25 bp, Rattus norvegicus
aagaggctctcacctgagcgcaggc

SEQ ID NO: 36384 - DNA, 25 bp, Rattus norvegicus
aagaggctctcagctgagcgcaggc

SEQ ID NO: 36385 - DNA, 25 bp, Rattus norvegicus
aagaggctctccaataacaaatgaa

SEQ ID NO: 36386 - DNA, 25 bp, Rattus norvegicus
aagaggctctcctataacaaatgaa

SEQ ID NO: 36387 - DNA, 25 bp, Rattus norvegicus
aagaggctcttacttcatctccaaa

SEQ ID NO: 36388 - DNA, 25 bp, Rattus norvegicus
aagaggctcttagttcatctccaaa

SEQ ID NO: 36389 - DNA, 25 bp, Rattus norvegicus
aagaggctcttgcatcagggatgca

SEQ ID NO: 36390 - DNA, 25 bp, Rattus norvegicus
aagaggctcttggatcagggatgca

SEQ ID NO: 36391 - DNA, 25 bp, Rattus norvegicus
aagaggctctttctagccccaagat

SEQ ID NO: 36392 - DNA, 25 bp, Rattus norvegicus
aagaggctctttgtagccccaagat

SEQ ID NO: 36393 - DNA, 25 bp, Rattus norvegicus
aagaggctgaaacaccacacgagga

SEQ ID NO: 36394 - DNA, 25 bp, Rattus norvegicus
aagaggctgaaagaccacacgagga

SEQ ID NO: 36395 - DNA, 25 bp, Rattus norvegicus
aagaggctgaacaaagtaactgtgt

SEQ ID NO: 36396 - DNA, 25 bp, Rattus norvegicus
aagaggctgaactaagtaactgtgt

SEQ ID NO: 36397 - DNA, 25 bp, Rattus norvegicus
aagaggctgagcagactctacccag

SEQ ID NO: 36398 - DNA, 25 bp, Rattus norvegicus
aagaggctgagctgactctacccag

SEQ ID NO: 36399 - DNA, 25 bp, Rattus norvegicus
aagaggctgatcattgctggtccct

SEQ ID NO: 36400 - DNA, 25 bp, Rattus norvegicus
aagaggctgatctttgctggtccct

SEQ ID NO: 36401 - DNA, 25 bp, Rattus norvegicus
aagaggctgattccatcccacttta

SEQ ID NO: 36402 - DNA, 25 bp, Rattus norvegicus
aagaggctgattgcatcccacttta

SEQ ID NO: 36403 - DNA, 25 bp, Rattus norvegicus
aagaggctgcagctgacattcctgt

SEQ ID NO: 36404 - DNA, 25 bp, Rattus norvegicus
aagaggctgcaggtgacattcctgt

SEQ ID NO: 36405 - DNA, 25 bp, Rattus norvegicus
aagaggctgccaacaaggccatcga

SEQ ID NO: 36406 - DNA, 25 bp, Rattus norvegicus
aagaggctgccatcaaggccatcga

SEQ ID NO: 36407 - DNA, 25 bp, Rattus norvegicus
aagaggctgctaacttgttcatcat

SEQ ID NO: 36408 - DNA, 25 bp, Rattus norvegicus
aagaggctgctatcttgttcatcat

SEQ ID NO: 36409 - DNA, 25 bp, Rattus norvegicus
aagaggctgctgctcacaatggtga

SEQ ID NO: 36410 - DNA, 25 bp, Rattus norvegicus
aagaggctgctggtcacaatggtga

SEQ ID NO: 36411 - DNA, 25 bp, Rattus norvegicus
aagaggctgcttatctgacttggat

SEQ ID NO: 36412 - DNA, 25 bp, Rattus norvegicus
aagaggctgcttttctgacttggat

SEQ ID NO: 36413 - DNA, 25 bp, Rattus norvegicus
aagaggctggccacaatgtcaccac

SEQ ID NO: 36414 - DNA, 25 bp, Rattus norvegicus
aagaggctggcctcaatgtcaccac

SEQ ID NO: 36415 - DNA, 25 bp, Rattus norvegicus
aagaggctgggcactcggtatctct

SEQ ID NO: 36416 - DNA, 25 bp, Rattus norvegicus
aagaggctgggctctcggtatctct

SEQ ID NO: 36417 - DNA, 25 bp, Rattus norvegicus
aagaggctgtagctccagagaccaa

SEQ ID NO: 36418 - DNA, 25 bp, Rattus norvegicus
aagaggctgtaggtccagagaccaa

SEQ ID NO: 36419 - DNA, 25 bp, Rattus norvegicus
aagaggctgtccctgcagctgagcc

SEQ ID NO: 36420 - DNA, 25 bp, Rattus norvegicus
aagaggctgtccgtgcagctgagcc

SEQ ID NO: 36421 - DNA, 25 bp, Rattus norvegicus
aagaggctgtgaagcacctggacca

SEQ ID NO: 36422 - DNA, 25 bp, Rattus norvegicus
aagaggctgtgatgcacctggacca

SEQ ID NO: 36423 - DNA, 25 bp, Rattus norvegicus
aagaggctgttaatgcccgagatcg

SEQ ID NO: 36424 - DNA, 25 bp, Rattus norvegicus
aagaggctgttattgcccgagatcg

SEQ ID NO: 36425 - DNA, 25 bp, Rattus norvegicus
aagaggcttcctatctgatcttcaa

SEQ ID NO: 36426 - DNA, 25 bp, Rattus norvegicus
aagaggcttcctttctgatcttcaa

SEQ ID NO: 36427 - DNA, 25 bp, Rattus norvegicus
aagaggcttcggacaagtgcagctg

SEQ ID NO: 36428 - DNA, 25 bp, Rattus norvegicus
aagaggcttcggtcaagtgcagctg

SEQ ID NO: 36429 - DNA, 25 bp, Rattus norvegicus
aagaggcttctgctggtcagacact

SEQ ID NO: 36430 - DNA, 25 bp, Rattus norvegicus
aagaggcttctggtggtcagacact

SEQ ID NO: 36431 - DNA, 25 bp, Rattus norvegicus
aagaggcttggacacttcctgctga

SEQ ID NO: 36432 - DNA, 25 bp, Rattus norvegicus
aagaggcttggagacttcctgctga

SEQ ID NO: 36433 - DNA, 25 bp, Rattus norvegicus
aagaggcttggcatacggctggcaa

SEQ ID NO: 36434 - DNA, 25 bp, Rattus norvegicus
aagaggcttggcttacggctggcaa

SEQ ID NO: 36435 - DNA, 25 bp, Rattus norvegicus
aagaggcttgttcgcattttacata

SEQ ID NO: 36436 - DNA, 25 bp, Rattus norvegicus
aagaggcttgttggcattttacata

SEQ ID NO: 36437 - DNA, 25 bp, Rattus norvegicus
aagaggctttgacttagtctttcat

SEQ ID NO: 36438 - DNA, 25 bp, Rattus norvegicus
aagaggctttgagttagtctttcat

SEQ ID NO: 36439 - DNA, 25 bp, Rattus norvegicus
aagaggcttttcaaagtctccgctt

SEQ ID NO: 36440 - DNA, 25 bp, Rattus norvegicus
aagaggcttttctaagtctccgctt

SEQ ID NO: 36441 - DNA, 25 bp, Rattus norvegicus
aagagggaagcaccccggttgtctt

SEQ ID NO: 36442 - DNA, 25 bp, Rattus norvegicus
aagagggaagcagcccggttgtctt

SEQ ID NO: 36443 - DNA, 25 bp, Rattus norvegicus
aagagggaagtgaccccttggcatc

SEQ ID NO: 36444 - DNA, 25 bp, Rattus norvegicus
aagagggaagtgtccccttggcatc

SEQ ID NO: 36445 - DNA, 25 bp, Rattus norvegicus
aagagggacaacctcgactccttgt

SEQ ID NO: 36446 - DNA, 25 bp, Rattus norvegicus
aagagggacaacgtcgactccttgt

SEQ ID NO: 36447 - DNA, 25 bp, Rattus norvegicus
aagagggactttagttagattatca

SEQ ID NO: 36448 - DNA, 25 bp, Rattus norvegicus
aagagggacttttgttagattatca

SEQ ID NO: 36449 - DNA, 25 bp, Rattus norvegicus
aagagggagatgaagggagcggcta

SEQ ID NO: 36450 - DNA, 25 bp, Rattus norvegicus
aagagggagatgtagggagcggcta

SEQ ID NO: 36451 - DNA, 25 bp, Rattus norvegicus
aagagggagcggactcgcagcccaa

SEQ ID NO: 36452 - DNA, 25 bp, Rattus norvegicus
aagagggagcggtctcgcagcccaa

SEQ ID NO: 36453 - DNA, 25 bp, Rattus norvegicus
aagagggagctcagtcctctgcaac

SEQ ID NO: 36454 - DNA, 25 bp, Rattus norvegicus
aagagggagctctgtcctctgcaac

SEQ ID NO: 36455 - DNA, 25 bp, Rattus norvegicus
aagagggaggtgaccacagccccag

SEQ ID NO: 36456 - DNA, 25 bp, Rattus norvegicus
aagagggaggtgtccacagccccag

SEQ ID NO: 36457 - DNA, 25 bp, Rattus norvegicus
aagagggaggttctccattccacac

SEQ ID NO: 36458 - DNA, 25 bp, Rattus norvegicus
aagagggaggttgtccattccacac

SEQ ID NO: 36459 - DNA, 25 bp, Rattus norvegicus
aagagggagtctaccacacgggaca

SEQ ID NO: 36460 - DNA, 25 bp, Rattus norvegicus
aagagggagtctagccttcttgggc

SEQ ID NO: 36461 - DNA, 25 bp, Rattus norvegicus
aagagggagtcttccacacgggaca

SEQ ID NO: 36462 - DNA, 25 bp, Rattus norvegicus
aagagggagtcttgccttcttgggc

SEQ ID NO: 36463 - DNA, 25 bp, Rattus norvegicus
aagagggatggacacctgctcccca

SEQ ID NO: 36464 - DNA, 25 bp, Rattus norvegicus
aagagggatggagacctgctcccca

SEQ ID NO: 36465 - DNA, 25 bp, Rattus norvegicus
aagagggcacggattcagcattcca

SEQ ID NO: 36466 - DNA, 25 bp, Rattus norvegicus
aagagggcacggtttcagcattcca

SEQ ID NO: 36467 - DNA, 25 bp, Rattus norvegicus
aagagggcagcaacttgtccaacca

SEQ ID NO: 36468 - DNA, 25 bp, Rattus norvegicus
aagagggcagcatcttgtccaacca

SEQ ID NO: 36469 - DNA, 25 bp, Rattus norvegicus
aagagggcatcactgctctcctgga

SEQ ID NO: 36470 - DNA, 25 bp, Rattus norvegicus
aagagggcatcagtgctctcctgga

SEQ ID NO: 36471 - DNA, 25 bp, Rattus norvegicus
aagagggcatccatgagcctctgca

SEQ ID NO: 36472 - DNA, 25 bp, Rattus norvegicus
aagagggcatccttgagcctctgca

SEQ ID NO: 36473 - DNA, 25 bp, Rattus norvegicus
aagagggcattgattccctgggacc

SEQ ID NO: 36474 - DNA, 25 bp, Rattus norvegicus
aagagggcattgtttccctgggacc

SEQ ID NO: 36475 - DNA, 25 bp, Rattus norvegicus
aagagggccctcagtccagatggtg

SEQ ID NO: 36476 - DNA, 25 bp, Rattus norvegicus
aagagggccctctgtccagatggtg

SEQ ID NO: 36477 - DNA, 25 bp, Rattus norvegicus
aagagggcctagatttctggagtga

SEQ ID NO: 36478 - DNA, 25 bp, Rattus norvegicus
aagagggcctagttttctggagtga

SEQ ID NO: 36479 - DNA, 25 bp, Rattus norvegicus
aagagggcctgtagcattggccttt

SEQ ID NO: 36480 - DNA, 25 bp, Rattus norvegicus
aagagggcctgttgcattggccttt

SEQ ID NO: 36481 - DNA, 25 bp, Rattus norvegicus
aagagggctccaacttggtaaccaa

SEQ ID NO: 36482 - DNA, 25 bp, Rattus norvegicus
aagagggctccatcttggtaaccaa

SEQ ID NO: 36483 - DNA, 25 bp, Rattus norvegicus
aagagggctctaccaggctgtttca

SEQ ID NO: 36484 - DNA, 25 bp, Rattus norvegicus
aagagggctctagcaggctgtttca

SEQ ID NO: 36485 - DNA, 25 bp, Rattus norvegicus
aagagggctctcaaggctgattttc

SEQ ID NO: 36486 - DNA, 25 bp, Rattus norvegicus
aagagggctctctaggctgattttc

SEQ ID NO: 36487 - DNA, 25 bp, Rattus norvegicus
aagagggctctgacccaggaaactc

SEQ ID NO: 36488 - DNA, 25 bp, Rattus norvegicus
aagagggctctgatctgtggagtta

SEQ ID NO: 36489 - DNA, 25 bp, Rattus norvegicus
aagagggctctgtcccaggaaactc

SEQ ID NO: 36490 - DNA, 25 bp, Rattus norvegicus
aagagggctctgttctgtggagtta

SEQ ID NO: 36491 - DNA, 25 bp, Rattus norvegicus
aagagggctcttcaaccagccgttt

SEQ ID NO: 36492 - DNA, 25 bp, Rattus norvegicus
aagagggctcttgaaccagccgttt

SEQ ID NO: 36493 - DNA, 25 bp, Rattus norvegicus
aagagggctgagaatggctcccaac

SEQ ID NO: 36494 - DNA, 25 bp, Rattus norvegicus
aagagggctgagtatggctcccaac

SEQ ID NO: 36495 - DNA, 25 bp, Rattus norvegicus
aagagggcttttctacactggtatg

SEQ ID NO: 36496 - DNA, 25 bp, Rattus norvegicus
aagagggcttttgtacactggtatg

SEQ ID NO: 36497 - DNA, 25 bp, Rattus norvegicus
aagagggtataaactgagccatgaa

SEQ ID NO: 36498 - DNA, 25 bp, Rattus norvegicus
aagagggtataatctgagccatgaa

SEQ ID NO: 36499 - DNA, 25 bp, Rattus norvegicus
aagagggtatttcctcagtgctaac

SEQ ID NO: 36500 - DNA, 25 bp, Rattus norvegicus
aagagggtatttgctcagtgctaac

SEQ ID NO: 36501 - DNA, 25 bp, Rattus norvegicus
aagagggtccagctgtcatgctgac

SEQ ID NO: 36502 - DNA, 25 bp, Rattus norvegicus
aagagggtccaggtgtcatgctgac

SEQ ID NO: 36503 - DNA, 25 bp, Rattus norvegicus
aagagggtcccgaggcctatgaatt

SEQ ID NO: 36504 - DNA, 25 bp, Rattus norvegicus
aagagggtcccgtggcctatgaatt

SEQ ID NO: 36505 - DNA, 25 bp, Rattus norvegicus
aagagggtcctactctgcagcagca

SEQ ID NO: 36506 - DNA, 25 bp, Rattus norvegicus
aagagggtcctacttggcaggctct

SEQ ID NO: 36507 - DNA, 25 bp, Rattus norvegicus
aagagggtcctagtctgcagcagca

SEQ ID NO: 36508 - DNA, 25 bp, Rattus norvegicus
aagagggtcctagttggcaggctct

SEQ ID NO: 36509 - DNA, 25 bp, Rattus norvegicus
aagagggtcctcatttactgtcact

SEQ ID NO: 36510 - DNA, 25 bp, Rattus norvegicus
aagagggtcctcttttactgtcact

SEQ ID NO: 36511 - DNA, 25 bp, Rattus norvegicus
aagagggtcctgagaggctctcgca

SEQ ID NO: 36512 - DNA, 25 bp, Rattus norvegicus
aagagggtcctgtgaggctctcgca

SEQ ID NO: 36513 - DNA, 25 bp, Rattus norvegicus
aagagggtgactagtgtgacacatc

SEQ ID NO: 36514 - DNA, 25 bp, Rattus norvegicus
aagagggtgacttgtgtgacacatc

SEQ ID NO: 36515 - DNA, 25 bp, Rattus norvegicus
aagagggtgcaacctttcttttcct

SEQ ID NO: 36516 - DNA, 25 bp, Rattus norvegicus
aagagggtgcaagctttcttttcct

SEQ ID NO: 36517 - DNA, 25 bp, Rattus norvegicus
aagagggtgcctcggcctcaccgta

SEQ ID NO: 36518 - DNA, 25 bp, Rattus norvegicus
aagagggtgcctgggcctcaccgta

SEQ ID NO: 36519 - DNA, 25 bp, Rattus norvegicus
aagagggtggtgcaaactgacatcc

SEQ ID NO: 36520 - DNA, 25 bp, Rattus norvegicus
aagagggtggtggaaactgacatcc

SEQ ID NO: 36521 - DNA, 25 bp, Rattus norvegicus
aagagggttcctcagctactactga

SEQ ID NO: 36522 - DNA, 25 bp, Rattus norvegicus
aagagggttcctgagctactactga

SEQ ID NO: 36523 - DNA, 25 bp, Rattus norvegicus
aagagggttgttatggctcatagaa

SEQ ID NO: 36524 - DNA, 25 bp, Rattus norvegicus
aagagggttgttttggctcatagaa

SEQ ID NO: 36525 - DNA, 25 bp, Rattus norvegicus
aagaggtaccatctgccctggcgag

SEQ ID NO: 36526 - DNA, 25 bp, Rattus norvegicus
aagaggtaccatgtgccctggcgag

SEQ ID NO: 36527 - DNA, 25 bp, Rattus norvegicus
aagaggtacttgctgttctctgtcg

SEQ ID NO: 36528 - DNA, 25 bp, Rattus norvegicus
aagaggtacttggtgttctctgtcg

SEQ ID NO: 36529 - DNA, 25 bp, Rattus norvegicus
aagaggtatggcatcactgcctttg

SEQ ID NO: 36530 - DNA, 25 bp, Rattus norvegicus
aagaggtatggcttcactgcctttg

SEQ ID NO: 36531 - DNA, 25 bp, Rattus norvegicus
aagaggtcaacccagtgagccagcc

SEQ ID NO: 36532 - DNA, 25 bp, Rattus norvegicus
aagaggtcaaccgagtgagccagcc

SEQ ID NO: 36533 - DNA, 25 bp, Rattus norvegicus
aagaggtcaaggctgtccttggtta

SEQ ID NO: 36534 - DNA, 25 bp, Rattus norvegicus
aagaggtcaagggtgtccttggtta

SEQ ID NO: 36535 - DNA, 25 bp, Rattus norvegicus
aagaggtcatctactcctgtgaaat

SEQ ID NO: 36536 - DNA, 25 bp, Rattus norvegicus
aagaggtcatcttctcctgtgaaat

SEQ ID NO: 36537 - DNA, 25 bp, Rattus norvegicus
aagaggtccatgatgtgaaccaaga

SEQ ID NO: 36538 - DNA, 25 bp, Rattus norvegicus
aagaggtccatgttgtgaaccaaga

SEQ ID NO: 36539 - DNA, 25 bp, Rattus norvegicus
aagaggtccccgcaagagagcgact

SEQ ID NO: 36540 - DNA, 25 bp, Rattus norvegicus
aagaggtccccggaagagagcgact

SEQ ID NO: 36541 - DNA, 25 bp, Rattus norvegicus
aagaggtccctcagacagaagccat

SEQ ID NO: 36542 - DNA, 25 bp, Rattus norvegicus
aagaggtccctctgacagaagccat

SEQ ID NO: 36543 - DNA, 25 bp, Rattus norvegicus
aagaggtcctgtatgcggtctcata

SEQ ID NO: 36544 - DNA, 25 bp, Rattus norvegicus
aagaggtcctgtttgcggtctcata

SEQ ID NO: 36545 - DNA, 25 bp, Rattus norvegicus
aagaggtcgtggctcttctgagccc

SEQ ID NO: 36546 - DNA, 25 bp, Rattus norvegicus
aagaggtcgtgggtcttctgagccc

SEQ ID NO: 36547 - DNA, 25 bp, Rattus norvegicus
aagaggtctaggctgttcctccaac

SEQ ID NO: 36548 - DNA, 25 bp, Rattus norvegicus
aagaggtctagggtgttcctccaac

SEQ ID NO: 36549 - DNA, 25 bp, Rattus norvegicus
aagaggtctgtacccagtgggaaca

SEQ ID NO: 36550 - DNA, 25 bp, Rattus norvegicus
aagaggtctgtagccagtgggaaca

SEQ ID NO: 36551 - DNA, 25 bp, Rattus norvegicus
aagaggtgacagattatccccatca

SEQ ID NO: 36552 - DNA, 25 bp, Rattus norvegicus
aagaggtgacagtttatccccatca

SEQ ID NO: 36553 - DNA, 25 bp, Rattus norvegicus
aagaggtgagcaccagtctccactc

SEQ ID NO: 36554 - DNA, 25 bp, Rattus norvegicus
aagaggtgagcagcagtctccactc

SEQ ID NO: 36555 - DNA, 25 bp, Rattus norvegicus
aagaggtgagggagcacgtcttccc

SEQ ID NO: 36556 - DNA, 25 bp, Rattus norvegicus
aagaggtgagggtgcacgtcttccc

SEQ ID NO: 36557 - DNA, 25 bp, Rattus norvegicus
aagaggtgattcattccatccctat

SEQ ID NO: 36558 - DNA, 25 bp, Rattus norvegicus
aagaggtgattctttccatccctat

SEQ ID NO: 36559 - DNA, 25 bp, Rattus norvegicus
aagaggtgcccaaattcctgctgga

SEQ ID NO: 36560 - DNA, 25 bp, Rattus norvegicus
aagaggtgcccatattcctgctgga

SEQ ID NO: 36561 - DNA, 25 bp, Rattus norvegicus
aagaggtgcgaaattctcctaggaa

SEQ ID NO: 36562 - DNA, 25 bp, Rattus norvegicus
aagaggtgcgaatttctcctaggaa

SEQ ID NO: 36563 - DNA, 25 bp, Rattus norvegicus
aagaggtgctacaggtttttctcaa

SEQ ID NO: 36564 - DNA, 25 bp, Rattus norvegicus
aagaggtgctactggtttttctcaa

SEQ ID NO: 36565 - DNA, 25 bp, Rattus norvegicus
aagaggtgctgtaaggtgctgctaa

SEQ ID NO: 36566 - DNA, 25 bp, Rattus norvegicus
aagaggtgctgttaggtgctgctaa

SEQ ID NO: 36567 - DNA, 25 bp, Rattus norvegicus
aagaggtggattaaagcctcctgga

SEQ ID NO: 36568 - DNA, 25 bp, Rattus norvegicus
aagaggtggatttaagcctcctgga

SEQ ID NO: 36569 - DNA, 25 bp, Rattus norvegicus
aagaggtggcccctaagctggtcat

SEQ ID NO: 36570 - DNA, 25 bp, Rattus norvegicus
aagaggtggcccgtaagctggtcat

SEQ ID NO: 36571 - DNA, 25 bp, Rattus norvegicus
aagaggtggcctcaggttcatccct

SEQ ID NO: 36572 - DNA, 25 bp, Rattus norvegicus
aagaggtggcctgaggttcatccct

SEQ ID NO: 36573 - DNA, 25 bp, Rattus norvegicus
aagaggtgggcacctgacacaagac

SEQ ID NO: 36574 - DNA, 25 bp, Rattus norvegicus
aagaggtgggcagctgacacaagac

SEQ ID NO: 36575 - DNA, 25 bp, Rattus norvegicus
aagaggtggtctcctctagtctgac

SEQ ID NO: 36576 - DNA, 25 bp, Rattus norvegicus
aagaggtggtctgctctagtctgac

SEQ ID NO: 36577 - DNA, 25 bp, Rattus norvegicus
aagaggtgtacaacttcaatgccat

SEQ ID NO: 36578 - DNA, 25 bp, Rattus norvegicus
aagaggtgtacatcttcaatgccat

SEQ ID NO: 36579 - DNA, 25 bp, Rattus norvegicus
aagaggttcaccagtgagcaggcct

SEQ ID NO: 36580 - DNA, 25 bp, Rattus norvegicus
aagaggttcacctgtgagcaggcct

SEQ ID NO: 36581 - DNA, 25 bp, Rattus norvegicus
aagaggttctcaatctgtaacctag

SEQ ID NO: 36582 - DNA, 25 bp, Rattus norvegicus
aagaggttctcattctgtaacctag

SEQ ID NO: 36583 - DNA, 25 bp, Rattus norvegicus
aagaggttctcccagatggttcaga

SEQ ID NO: 36584 - DNA, 25 bp, Rattus norvegicus
aagaggttctccgagatggttcaga

SEQ ID NO: 36585 - DNA, 25 bp, Rattus norvegicus
aagaggttctgactcctgatggaag

SEQ ID NO: 36586 - DNA, 25 bp, Rattus norvegicus
aagaggttctgagtcctgatggaag

SEQ ID NO: 36587 - DNA, 25 bp, Rattus norvegicus
aagaggttgagccttccacgtagca

SEQ ID NO: 36588 - DNA, 25 bp, Rattus norvegicus
aagaggttgagcgttccacgtagca

SEQ ID NO: 36589 - DNA, 25 bp, Rattus norvegicus
aagaggttgctgcttccattaccag

SEQ ID NO: 36590 - DNA, 25 bp, Rattus norvegicus
aagaggttgctggttccattaccag

SEQ ID NO: 36591 - DNA, 25 bp, Rattus norvegicus
aagaggttgcttctggtcctttaag

SEQ ID NO: 36592 - DNA, 25 bp, Rattus norvegicus
aagaggttgcttgtggtcctttaag

SEQ ID NO: 36593 - DNA, 25 bp, Rattus norvegicus
aagaggttggatcttccagctctgg

SEQ ID NO: 36594 - DNA, 25 bp, Rattus norvegicus
aagaggttggatgttccagctctgg

SEQ ID NO: 36595 - DNA, 25 bp, Rattus norvegicus
aagaggtttatgaccactgtttgtc

SEQ ID NO: 36596 - DNA, 25 bp, Rattus norvegicus
aagaggtttatgtccactgtttgtc

SEQ ID NO: 36597 - DNA, 25 bp, Rattus norvegicus
aagaggtttcagcattcccaattat

SEQ ID NO: 36598 - DNA, 25 bp, Rattus norvegicus
aagaggtttcaggattcccaattat

SEQ ID NO: 36599 - DNA, 25 bp, Rattus norvegicus
aagaggtttcatcagcctctaccaa

SEQ ID NO: 36600 - DNA, 25 bp, Rattus norvegicus
aagaggtttcatgagcctctaccaa

SEQ ID NO: 36601 - DNA, 25 bp, Rattus norvegicus
aagaggtttcctagtgccaaataag

SEQ ID NO: 36602 - DNA, 25 bp, Rattus norvegicus
aagaggtttccttgtgccaaataag

SEQ ID NO: 36603 - DNA, 25 bp, Rattus norvegicus
aagaggtttctgctcaacttggtat

SEQ ID NO: 36604 - DNA, 25 bp, Rattus norvegicus
aagaggtttctggtcaacttggtat

SEQ ID NO: 36605 - DNA, 25 bp, Rattus norvegicus
aagaggttttctcctgatgttcaga

SEQ ID NO: 36606 - DNA, 25 bp, Rattus norvegicus
aagaggttttctgctgatgttcaga

SEQ ID NO: 36607 - DNA, 25 bp, Rattus norvegicus
aagaggttttgcagcctctggacaa

SEQ ID NO: 36608 - DNA, 25 bp, Rattus norvegicus
aagaggttttgctgcctctggacaa

SEQ ID NO: 36609 - DNA, 25 bp, Rattus norvegicus
aagagtaaccggcacagcctagcca

SEQ ID NO: 36610 - DNA, 25 bp, Rattus norvegicus
aagagtaaccgggacagcctagcca

SEQ ID NO: 36611 - DNA, 25 bp, Rattus norvegicus
aagagtaagcccctgcagccaaaac

SEQ ID NO: 36612 - DNA, 25 bp, Rattus norvegicus
aagagtaagcccgtgcagccaaaac

SEQ ID NO: 36613 - DNA, 25 bp, Rattus norvegicus
aagagtaaggatccctttgccctga

SEQ ID NO: 36614 - DNA, 25 bp, Rattus norvegicus
aagagtaaggatgcctttgccctga

SEQ ID NO: 36615 - DNA, 25 bp, Rattus norvegicus
aagagtaagtggacctcatctccgc

SEQ ID NO: 36616 - DNA, 25 bp, Rattus norvegicus
aagagtaagtggtcctcatctccgc

SEQ ID NO: 36617 - DNA, 25 bp, Rattus norvegicus
aagagtaatcttccctgtatccttc

SEQ ID NO: 36618 - DNA, 25 bp, Rattus norvegicus
aagagtaatcttgcctgtatccttc

SEQ ID NO: 36619 - DNA, 25 bp, Rattus norvegicus
aagagtaatggcacctcttccaggg

SEQ ID NO: 36620 - DNA, 25 bp, Rattus norvegicus
aagagtaatggctcctcttccaggg

SEQ ID NO: 36621 - DNA, 25 bp, Rattus norvegicus
aagagtacagctccgactaccaggg

SEQ ID NO: 36622 - DNA, 25 bp, Rattus norvegicus
aagagtacagctgcgactaccaggg

SEQ ID NO: 36623 - DNA, 25 bp, Rattus norvegicus
aagagtacattcacatatgaccaaa

SEQ ID NO: 36624 - DNA, 25 bp, Rattus norvegicus
aagagtacattctcatatgaccaaa

SEQ ID NO: 36625 - DNA, 25 bp, Rattus norvegicus
aagagtacccacatcccttgtggag

SEQ ID NO: 36626 - DNA, 25 bp, Rattus norvegicus
aagagtacccacttcccttgtggag

SEQ ID NO: 36627 - DNA, 25 bp, Rattus norvegicus
aagagtacccttattctgcacagta

SEQ ID NO: 36628 - DNA, 25 bp, Rattus norvegicus
aagagtaccctttttctgcacagta

SEQ ID NO: 36629 - DNA, 25 bp, Rattus norvegicus
aagagtactgtgaccttccttttgc

SEQ ID NO: 36630 - DNA, 25 bp, Rattus norvegicus
aagagtactgtgattatttcttctc

SEQ ID NO: 36631 - DNA, 25 bp, Rattus norvegicus
aagagtactgtgtccttccttttgc

SEQ ID NO: 36632 - DNA, 25 bp, Rattus norvegicus
aagagtactgtgtttatttcttctc

SEQ ID NO: 36633 - DNA, 25 bp, Rattus norvegicus
aagagtagacttctctcctcagact

SEQ ID NO: 36634 - DNA, 25 bp, Rattus norvegicus
aagagtagacttgtctcctcagact

SEQ ID NO: 36635 - DNA, 25 bp, Rattus norvegicus
aagagtagagtgaccccttctgtta

SEQ ID NO: 36636 - DNA, 25 bp, Rattus norvegicus
aagagtagagtgtccccttctgtta

SEQ ID NO: 36637 - DNA, 25 bp, Rattus norvegicus
aagagtagcactctgggcctatgct

SEQ ID NO: 36638 - DNA, 25 bp, Rattus norvegicus
aagagtagcactgtgggcctatgct

SEQ ID NO: 36639 - DNA, 25 bp, Rattus norvegicus
aagagtagcgagatccccgagtcag

SEQ ID NO: 36640 - DNA, 25 bp, Rattus norvegicus
aagagtagcgagttccccgagtcag

SEQ ID NO: 36641 - DNA, 25 bp, Rattus norvegicus
aagagtagggtgaggtctcccagct

SEQ ID NO: 36642 - DNA, 25 bp, Rattus norvegicus
aagagtagggtgtggtctcccagct

SEQ ID NO: 36643 - DNA, 25 bp, Rattus norvegicus
aagagtagtaaacccctgcaatcga

SEQ ID NO: 36644 - DNA, 25 bp, Rattus norvegicus
aagagtagtaaagccctgcaatcga

SEQ ID NO: 36645 - DNA, 25 bp, Rattus norvegicus
aagagtagtgatcgcttcttcctca

SEQ ID NO: 36646 - DNA, 25 bp, Rattus norvegicus
aagagtagtgatctgggtcctccca

SEQ ID NO: 36647 - DNA, 25 bp, Rattus norvegicus
aagagtagtgatggcttcttcctca

SEQ ID NO: 36648 - DNA, 25 bp, Rattus norvegicus
aagagtagtgatgtgggtcctccca

SEQ ID NO: 36649 - DNA, 25 bp, Rattus norvegicus
aagagtatagccactctcagtctac

SEQ ID NO: 36650 - DNA, 25 bp, Rattus norvegicus
aagagtatagcctctctcagtctac

SEQ ID NO: 36651 - DNA, 25 bp, Rattus norvegicus
aagagtataggcacagcttcccctg

SEQ ID NO: 36652 - DNA, 25 bp, Rattus norvegicus
aagagtataggctcagcttcccctg

SEQ ID NO: 36653 - DNA, 25 bp, Rattus norvegicus
aagagtatagttacctgacagtgtc

SEQ ID NO: 36654 - DNA, 25 bp, Rattus norvegicus
aagagtatagtttcctgacagtgtc

SEQ ID NO: 36655 - DNA, 25 bp, Rattus norvegicus
aagagtatcactcaggctcccgaag

SEQ ID NO: 36656 - DNA, 25 bp, Rattus norvegicus
aagagtatcactgaggctcccgaag

SEQ ID NO: 36657 - DNA, 25 bp, Rattus norvegicus
aagagtatcagccatttaaccccac

SEQ ID NO: 36658 - DNA, 25 bp, Rattus norvegicus
aagagtatcagcgatttaaccccac

SEQ ID NO: 36659 - DNA, 25 bp, Rattus norvegicus
aagagtatcaggagcattccccgga

SEQ ID NO: 36660 - DNA, 25 bp, Rattus norvegicus
aagagtatcaggtgcattccccgga

SEQ ID NO: 36661 - DNA, 25 bp, Rattus norvegicus
aagagtatctgcaatttattcttta

SEQ ID NO: 36662 - DNA, 25 bp, Rattus norvegicus
aagagtatctgctatttattcttta

SEQ ID NO: 36663 - DNA, 25 bp, Rattus norvegicus
aagagtatcttgagagcctcatcaa

SEQ ID NO: 36664 - DNA, 25 bp, Rattus norvegicus
aagagtatcttgtgagcctcatcaa

SEQ ID NO: 36665 - DNA, 25 bp, Rattus norvegicus
aagagtatgctaattcaaagggaac

SEQ ID NO: 36666 - DNA, 25 bp, Rattus norvegicus
aagagtatgctatttcaaagggaac

SEQ ID NO: 36667 - DNA, 25 bp, Rattus norvegicus
aagagtatgttcactcagcaggcct

SEQ ID NO: 36668 - DNA, 25 bp, Rattus norvegicus
aagagtatgttctctcagcaggcct

SEQ ID NO: 36669 - DNA, 25 bp, Rattus norvegicus
aagagtattataccgtccacaacaa

SEQ ID NO: 36670 - DNA, 25 bp, Rattus norvegicus
aagagtattatagcgtccacaacaa

SEQ ID NO: 36671 - DNA, 25 bp, Rattus norvegicus
aagagtattctcagctggcttctgt

SEQ ID NO: 36672 - DNA, 25 bp, Rattus norvegicus
aagagtattctctgctggcttctgt

SEQ ID NO: 36673 - DNA, 25 bp, Rattus norvegicus
aagagtattggaaacagcctgtaat

SEQ ID NO: 36674 - DNA, 25 bp, Rattus norvegicus
aagagtattggatacagcctgtaat

SEQ ID NO: 36675 - DNA, 25 bp, Rattus norvegicus
aagagtattttgagagtgtgagttc

SEQ ID NO: 36676 - DNA, 25 bp, Rattus norvegicus
aagagtattttgtgagtgtgagttc

SEQ ID NO: 36677 - DNA, 25 bp, Rattus norvegicus
aagagtcaaacccagttctgtccga

SEQ ID NO: 36678 - DNA, 25 bp, Rattus norvegicus
aagagtcaaaccgagttctgtccga

SEQ ID NO: 36679 - DNA, 25 bp, Rattus norvegicus
aagagtcaacctaccagtcacgtgg

SEQ ID NO: 36680 - DNA, 25 bp, Rattus norvegicus
aagagtcaaccttccagtcacgtgg

SEQ ID NO: 36681 - DNA, 25 bp, Rattus norvegicus
aagagtcaaggtaggctcctatgta

SEQ ID NO: 36682 - DNA, 25 bp, Rattus norvegicus
aagagtcaaggttggctcctatgta

SEQ ID NO: 36683 - DNA, 25 bp, Rattus norvegicus
aagagtcacccaagatcctcaatct

SEQ ID NO: 36684 - DNA, 25 bp, Rattus norvegicus
aagagtcacccatgatcctcaatct

SEQ ID NO: 36685 - DNA, 25 bp, Rattus norvegicus
aagagtcaccgacgcaatccagaga

SEQ ID NO: 36686 - DNA, 25 bp, Rattus norvegicus
aagagtcaccgaggcaatccagaga

SEQ ID NO: 36687 - DNA, 25 bp, Rattus norvegicus
aagagtcactgtccggagcctttca

SEQ ID NO: 36688 - DNA, 25 bp, Rattus norvegicus
aagagtcactgtgcggagcctttca

SEQ ID NO: 36689 - DNA, 25 bp, Rattus norvegicus
aagagtcacttaatctcagcaccct

SEQ ID NO: 36690 - DNA, 25 bp, Rattus norvegicus
aagagtcacttattctcagcaccct

SEQ ID NO: 36691 - DNA, 25 bp, Rattus norvegicus
aagagtcagacacgaccccaaagtc

SEQ ID NO: 36692 - DNA, 25 bp, Rattus norvegicus
aagagtcagacaggaccccaaagtc

SEQ ID NO: 36693 - DNA, 25 bp, Rattus norvegicus
aagagtcagggtacttttcctgcag

SEQ ID NO: 36694 - DNA, 25 bp, Rattus norvegicus
aagagtcagggttcttttcctgcag

SEQ ID NO: 36695 - DNA, 25 bp, Rattus norvegicus
aagagtcaggttcgtcaccatccat

SEQ ID NO: 36696 - DNA, 25 bp, Rattus norvegicus
aagagtcaggttggtcaccatccat

SEQ ID NO: 36697 - DNA, 25 bp, Rattus norvegicus
aagagtcagtgacgacgtccctggc

SEQ ID NO: 36698 - DNA, 25 bp, Rattus norvegicus
aagagtcagtgaggacgtccctggc

SEQ ID NO: 36699 - DNA, 25 bp, Rattus norvegicus
aagagtcatctcatcctttgacgta

SEQ ID NO: 36700 - DNA, 25 bp, Rattus norvegicus
aagagtcatctcttcctttgacgta

SEQ ID NO: 36701 - DNA, 25 bp, Rattus norvegicus
aagagtcatctgctcagtctgtggt

SEQ ID NO: 36702 - DNA, 25 bp, Rattus norvegicus
aagagtcatctggtcagtctgtggt

SEQ ID NO: 36703 - DNA, 25 bp, Rattus norvegicus
aagagtcattctcgagtgttctcgt

SEQ ID NO: 36704 - DNA, 25 bp, Rattus norvegicus
aagagtcattctggagtgttctcgt

SEQ ID NO: 36705 - DNA, 25 bp, Rattus norvegicus
aagagtcattgtaacttcgccatgt

SEQ ID NO: 36706 - DNA, 25 bp, Rattus norvegicus
aagagtcattgttacttcgccatgt

SEQ ID NO: 36707 - DNA, 25 bp, Rattus norvegicus
aagagtcattttaccctcaggcaga

SEQ ID NO: 36708 - DNA, 25 bp, Rattus norvegicus
aagagtcatttttccctcaggcaga

SEQ ID NO: 36709 - DNA, 25 bp, Rattus norvegicus
aagagtccaaggcaccatccaaagg

SEQ ID NO: 36710 - DNA, 25 bp, Rattus norvegicus
aagagtccaagggaccatccaaagg

SEQ ID NO: 36711 - DNA, 25 bp, Rattus norvegicus
aagagtccagataatgtttcacaag

SEQ ID NO: 36712 - DNA, 25 bp, Rattus norvegicus
aagagtccagattatgtttcacaag

SEQ ID NO: 36713 - DNA, 25 bp, Rattus norvegicus
aagagtccagcaataggctccacat

SEQ ID NO: 36714 - DNA, 25 bp, Rattus norvegicus
aagagtccagcattaggctccacat

SEQ ID NO: 36715 - DNA, 25 bp, Rattus norvegicus
aagagtcccactcgcagaggctagt

SEQ ID NO: 36716 - DNA, 25 bp, Rattus norvegicus
aagagtcccactggcagaggctagt

SEQ ID NO: 36717 - DNA, 25 bp, Rattus norvegicus
aagagtcccctgagcggcaagctga

SEQ ID NO: 36718 - DNA, 25 bp, Rattus norvegicus
aagagtcccctgtgcggcaagctga

SEQ ID NO: 36719 - DNA, 25 bp, Rattus norvegicus
aagagtccccttcagctgtttatgt

SEQ ID NO: 36720 - DNA, 25 bp, Rattus norvegicus
aagagtccccttgagctgtttatgt

SEQ ID NO: 36721 - DNA, 25 bp, Rattus norvegicus
aagagtcccgggagtctaggctaga

SEQ ID NO: 36722 - DNA, 25 bp, Rattus norvegicus
aagagtcccgggtgtctaggctaga

SEQ ID NO: 36723 - DNA, 25 bp, Rattus norvegicus
aagagtcccggtacttcatgctgta

SEQ ID NO: 36724 - DNA, 25 bp, Rattus norvegicus
aagagtcccggttcttcatgctgta

SEQ ID NO: 36725 - DNA, 25 bp, Rattus norvegicus
aagagtccgactcgcatttgtggca

SEQ ID NO: 36726 - DNA, 25 bp, Rattus norvegicus
aagagtccgactggcatttgtggca

SEQ ID NO: 36727 - DNA, 25 bp, Rattus norvegicus
aagagtccgtggattctgccaagcc

SEQ ID NO: 36728 - DNA, 25 bp, Rattus norvegicus
aagagtccgtggtttctgccaagcc

SEQ ID NO: 36729 - DNA, 25 bp, Rattus norvegicus
aagagtcctaagaaagctgtgtcaa

SEQ ID NO: 36730 - DNA, 25 bp, Rattus norvegicus
aagagtcctaagtaagctgtgtcaa

SEQ ID NO: 36731 - DNA, 25 bp, Rattus norvegicus
aagagtcctaatcgcaagctccggc

SEQ ID NO: 36732 - DNA, 25 bp, Rattus norvegicus
aagagtcctaatggcaagctccggc

SEQ ID NO: 36733 - DNA, 25 bp, Rattus norvegicus
aagagtcctatgcagctggcacaga

SEQ ID NO: 36734 - DNA, 25 bp, Rattus norvegicus
aagagtcctatggagctggcacaga

SEQ ID NO: 36735 - DNA, 25 bp, Rattus norvegicus
aagagtcctcttcttgagctttcag

SEQ ID NO: 36736 - DNA, 25 bp, Rattus norvegicus
aagagtcctcttgttgagctttcag

SEQ ID NO: 36737 - DNA, 25 bp, Rattus norvegicus
aagagtcctgagcaaccctttcctg

SEQ ID NO: 36738 - DNA, 25 bp, Rattus norvegicus
aagagtcctgaggaaccctttcctg

SEQ ID NO: 36739 - DNA, 25 bp, Rattus norvegicus
aagagtcctggacttgttctccaga

SEQ ID NO: 36740 - DNA, 25 bp, Rattus norvegicus
aagagtcctggagttgttctccaga

SEQ ID NO: 36741 - DNA, 25 bp, Rattus norvegicus
aagagtcctggcaagccttcggtaa

SEQ ID NO: 36742 - DNA, 25 bp, Rattus norvegicus
aagagtcctggctagccttcggtaa

SEQ ID NO: 36743 - DNA, 25 bp, Rattus norvegicus
aagagtcctgtcctttgaggattaa

SEQ ID NO: 36744 - DNA, 25 bp, Rattus norvegicus
aagagtcctgtcgtttgaggattaa

SEQ ID NO: 36745 - DNA, 25 bp, Rattus norvegicus
aagagtccttatctcgccatatgct

SEQ ID NO: 36746 - DNA, 25 bp, Rattus norvegicus
aagagtccttatgtcgccatatgct

SEQ ID NO: 36747 - DNA, 25 bp, Rattus norvegicus
aagagtccttcaattctcaaaccct

SEQ ID NO: 36748 - DNA, 25 bp, Rattus norvegicus
aagagtccttcaccttgttggagtg

SEQ ID NO: 36749 - DNA, 25 bp, Rattus norvegicus
aagagtccttcagcttgttggagtg

SEQ ID NO: 36750 - DNA, 25 bp, Rattus norvegicus
aagagtccttcatttctcaaaccct

SEQ ID NO: 36751 - DNA, 25 bp, Rattus norvegicus
aagagtccttccacagacaactcag

SEQ ID NO: 36752 - DNA, 25 bp, Rattus norvegicus
aagagtccttcctcagacaactcag

SEQ ID NO: 36753 - DNA, 25 bp, Rattus norvegicus
aagagtcgataacacacccttccgg

SEQ ID NO: 36754 - DNA, 25 bp, Rattus norvegicus
aagagtcgataagacacccttccgg

SEQ ID NO: 36755 - DNA, 25 bp, Rattus norvegicus
aagagtcgccctccaggctgaaaag

SEQ ID NO: 36756 - DNA, 25 bp, Rattus norvegicus
aagagtcgccctgcaggctgaaaag

SEQ ID NO: 36757 - DNA, 25 bp, Rattus norvegicus
aagagtcgtctaccttgtctaagaa

SEQ ID NO: 36758 - DNA, 25 bp, Rattus norvegicus
aagagtcgtctagcttgtctaagaa

SEQ ID NO: 36759 - DNA, 25 bp, Rattus norvegicus
aagagtctaaccagtgttcagcagt

SEQ ID NO: 36760 - DNA, 25 bp, Rattus norvegicus
aagagtctaacctgtgttcagcagt

SEQ ID NO: 36761 - DNA, 25 bp, Rattus norvegicus
aagagtctaagcatttcaggctagc

SEQ ID NO: 36762 - DNA, 25 bp, Rattus norvegicus
aagagtctaagccagccactgcaaa

SEQ ID NO: 36763 - DNA, 25 bp, Rattus norvegicus
aagagtctaagcgagccactgcaaa

SEQ ID NO: 36764 - DNA, 25 bp, Rattus norvegicus
aagagtctaagcttttcaggctagc

SEQ ID NO: 36765 - DNA, 25 bp, Rattus norvegicus
aagagtctcaccctgttgccaaggc

SEQ ID NO: 36766 - DNA, 25 bp, Rattus norvegicus
aagagtctcaccgtgttgccaaggc

SEQ ID NO: 36767 - DNA, 25 bp, Rattus norvegicus
aagagtctcaggatgtcagttgtct

SEQ ID NO: 36768 - DNA, 25 bp, Rattus norvegicus
aagagtctcaggttgtcagttgtct

SEQ ID NO: 36769 - DNA, 25 bp, Rattus norvegicus
aagagtctcatacagcagtgctcgc

SEQ ID NO: 36770 - DNA, 25 bp, Rattus norvegicus
aagagtctcatagagcagtgctcgc

SEQ ID NO: 36771 - DNA, 25 bp, Rattus norvegicus
aagagtctgaagctcactggatttc

SEQ ID NO: 36772 - DNA, 25 bp, Rattus norvegicus
aagagtctgaaggtcactggatttc

SEQ ID NO: 36773 - DNA, 25 bp, Rattus norvegicus
aagagtctgatgaaatccccgttca

SEQ ID NO: 36774 - DNA, 25 bp, Rattus norvegicus
aagagtctgatgtaatccccgttca

SEQ ID NO: 36775 - DNA, 25 bp, Rattus norvegicus
aagagtctgcaaaggcttggccaag

SEQ ID NO: 36776 - DNA, 25 bp, Rattus norvegicus
aagagtctgcaatggcttggccaag

SEQ ID NO: 36777 - DNA, 25 bp, Rattus norvegicus
aagagtctgcggattgaaagcctgc

SEQ ID NO: 36778 - DNA, 25 bp, Rattus norvegicus
aagagtctgcggtttgaaagcctgc

SEQ ID NO: 36779 - DNA, 25 bp, Rattus norvegicus
aagagtctggttctgcaatcgacgc

SEQ ID NO: 36780 - DNA, 25 bp, Rattus norvegicus
aagagtctggttgtgcaatcgacgc

SEQ ID NO: 36781 - DNA, 25 bp, Rattus norvegicus
aagagtctgtgtacttcctgtgtca

SEQ ID NO: 36782 - DNA, 25 bp, Rattus norvegicus
aagagtctgtgtcggcttagcctgc

SEQ ID NO: 36783 - DNA, 25 bp, Rattus norvegicus
aagagtctgtgtgggcttagcctgc

SEQ ID NO: 36784 - DNA, 25 bp, Rattus norvegicus
aagagtctgtgttcttcctgtgtca

SEQ ID NO: 36785 - DNA, 25 bp, Rattus norvegicus
aagagtctgttccactacaggcagt

SEQ ID NO: 36786 - DNA, 25 bp, Rattus norvegicus
aagagtctgttcgactacaggcagt

SEQ ID NO: 36787 - DNA, 25 bp, Rattus norvegicus
aagagtcttagcagcctgtttgtgt

SEQ ID NO: 36788 - DNA, 25 bp, Rattus norvegicus
aagagtcttagctgcctgtttgtgt

SEQ ID NO: 36789 - DNA, 25 bp, Rattus norvegicus
aagagtcttatgctttgtgtgcggc

SEQ ID NO: 36790 - DNA, 25 bp, Rattus norvegicus
aagagtcttatggtttgtgtgcggc

SEQ ID NO: 36791 - DNA, 25 bp, Rattus norvegicus
aagagtcttccaaggagcgcaatcc

SEQ ID NO: 36792 - DNA, 25 bp, Rattus norvegicus
aagagtcttccatggagcgcaatcc

SEQ ID NO: 36793 - DNA, 25 bp, Rattus norvegicus
aagagtcttccccagaggtgaaccg

SEQ ID NO: 36794 - DNA, 25 bp, Rattus norvegicus
aagagtcttcccgagaggtgaaccg

SEQ ID NO: 36795 - DNA, 25 bp, Rattus norvegicus
aagagtcttgcaacatcctatctgg

SEQ ID NO: 36796 - DNA, 25 bp, Rattus norvegicus
aagagtcttgcatcatcctatctgg

SEQ ID NO: 36797 - DNA, 25 bp, Rattus norvegicus
aagagtcttgtcacttcggcattgc

SEQ ID NO: 36798 - DNA, 25 bp, Rattus norvegicus
aagagtcttgtctcttcggcattgc

SEQ ID NO: 36799 - DNA, 25 bp, Rattus norvegicus
aagagtctttatatgcatggttgta

SEQ ID NO: 36800 - DNA, 25 bp, Rattus norvegicus
aagagtctttatttgcatggttgta

SEQ ID NO: 36801 - DNA, 25 bp, Rattus norvegicus
aagagtctttctcatgtgagtcgga

SEQ ID NO: 36802 - DNA, 25 bp, Rattus norvegicus
aagagtctttctgatgtgagtcgga

SEQ ID NO: 36803 - DNA, 25 bp, Rattus norvegicus
aagagtgaaaagctgctatttcggt

SEQ ID NO: 36804 - DNA, 25 bp, Rattus norvegicus
aagagtgaaaaggtgctatttcggt

SEQ ID NO: 36805 - DNA, 25 bp, Rattus norvegicus
aagagtgaaatcaccagcttatgga

SEQ ID NO: 36806 - DNA, 25 bp, Rattus norvegicus
aagagtgaaatctccagcttatgga

SEQ ID NO: 36807 - DNA, 25 bp, Rattus norvegicus
aagagtgaaattcttgcagcatcca

SEQ ID NO: 36808 - DNA, 25 bp, Rattus norvegicus
aagagtgaaattgttgcagcatcca

SEQ ID NO: 36809 - DNA, 25 bp, Rattus norvegicus
aagagtgaaccaaggccgtgcatgt

SEQ ID NO: 36810 - DNA, 25 bp, Rattus norvegicus
aagagtgaaccatggccgtgcatgt

SEQ ID NO: 36811 - DNA, 25 bp, Rattus norvegicus
aagagtgaaccgagaggtaagccag

SEQ ID NO: 36812 - DNA, 25 bp, Rattus norvegicus
aagagtgaaccgtgaggtaagccag

SEQ ID NO: 36813 - DNA, 25 bp, Rattus norvegicus
aagagtgaagcccttgttccctgga

SEQ ID NO: 36814 - DNA, 25 bp, Rattus norvegicus
aagagtgaagccgttgttccctgga

SEQ ID NO: 36815 - DNA, 25 bp, Rattus norvegicus
aagagtgaaggactgtatgctgaca

SEQ ID NO: 36816 - DNA, 25 bp, Rattus norvegicus
aagagtgaaggagtgtatgctgaca

SEQ ID NO: 36817 - DNA, 25 bp, Rattus norvegicus
aagagtgacaagaaccgggcagacc

SEQ ID NO: 36818 - DNA, 25 bp, Rattus norvegicus
aagagtgacaagaccagctgagctg

SEQ ID NO: 36819 - DNA, 25 bp, Rattus norvegicus
aagagtgacaagtaccgggcagacc

SEQ ID NO: 36820 - DNA, 25 bp, Rattus norvegicus
aagagtgacaagtccagctgagctg

SEQ ID NO: 36821 - DNA, 25 bp, Rattus norvegicus
aagagtgacccgagggctctctgaa

SEQ ID NO: 36822 - DNA, 25 bp, Rattus norvegicus
aagagtgacccgtgggctctctgaa

SEQ ID NO: 36823 - DNA, 25 bp, Rattus norvegicus
aagagtgaccttcctgcttcttaag

SEQ ID NO: 36824 - DNA, 25 bp, Rattus norvegicus
aagagtgaccttgctgcttcttaag

SEQ ID NO: 36825 - DNA, 25 bp, Rattus norvegicus
aagagtgagcaacaggcctccacat

SEQ ID NO: 36826 - DNA, 25 bp, Rattus norvegicus
aagagtgagcaagaggcctccacat

SEQ ID NO: 36827 - DNA, 25 bp, Rattus norvegicus
aagagtgagccacatccctgggact

SEQ ID NO: 36828 - DNA, 25 bp, Rattus norvegicus
aagagtgagccagatccctgggact

SEQ ID NO: 36829 - DNA, 25 bp, Rattus norvegicus
aagagtgagctccaggcctacattg

SEQ ID NO: 36830 - DNA, 25 bp, Rattus norvegicus
aagagtgagctcgaggcctacattg

SEQ ID NO: 36831 - DNA, 25 bp, Rattus norvegicus
aagagtgatagtcctgccatacagc

SEQ ID NO: 36832 - DNA, 25 bp, Rattus norvegicus
aagagtgatagtgctgccatacagc

SEQ ID NO: 36833 - DNA, 25 bp, Rattus norvegicus
aagagtgatatccactccaccagta

SEQ ID NO: 36834 - DNA, 25 bp, Rattus norvegicus
aagagtgatatcgactccaccagta

SEQ ID NO: 36835 - DNA, 25 bp, Rattus norvegicus
aagagtgatcagaatgcattgtatg

SEQ ID NO: 36836 - DNA, 25 bp, Rattus norvegicus
aagagtgatcagtatgcattgtatg

SEQ ID NO: 36837 - DNA, 25 bp, Rattus norvegicus
aagagtgatctcctccagggagcac

SEQ ID NO: 36838 - DNA, 25 bp, Rattus norvegicus
aagagtgatctcgtccagggagcac

SEQ ID NO: 36839 - DNA, 25 bp, Rattus norvegicus
aagagtgatctgaccccttgggcag

SEQ ID NO: 36840 - DNA, 25 bp, Rattus norvegicus
aagagtgatctgtccccttgggcag

SEQ ID NO: 36841 - DNA, 25 bp, Rattus norvegicus
aagagtgatggaccgagatgcccaa

SEQ ID NO: 36842 - DNA, 25 bp, Rattus norvegicus
aagagtgatggagcgagatgcccaa

SEQ ID NO: 36843 - DNA, 25 bp, Rattus norvegicus
aagagtgattccatgcccacctcta

SEQ ID NO: 36844 - DNA, 25 bp, Rattus norvegicus
aagagtgattccttgcccacctcta

SEQ ID NO: 36845 - DNA, 25 bp, Rattus norvegicus
aagagtgatttgatcccaggatggc

SEQ ID NO: 36846 - DNA, 25 bp, Rattus norvegicus
aagagtgatttgttcccaggatggc

SEQ ID NO: 36847 - DNA, 25 bp, Rattus norvegicus
aagagtgcatcacacctttggccag

SEQ ID NO: 36848 - DNA, 25 bp, Rattus norvegicus
aagagtgcatcagacctttggccag

SEQ ID NO: 36849 - DNA, 25 bp, Rattus norvegicus
aagagtgcatccatcaaagcgcccg

SEQ ID NO: 36850 - DNA, 25 bp, Rattus norvegicus
aagagtgcatccttcaaagcgcccg

SEQ ID NO: 36851 - DNA, 25 bp, Rattus norvegicus
aagagtgccagtaacaagtttgttg

SEQ ID NO: 36852 - DNA, 25 bp, Rattus norvegicus
aagagtgccagtctctcgcatggga

SEQ ID NO: 36853 - DNA, 25 bp, Rattus norvegicus
aagagtgccagtgtctcgcatggga

SEQ ID NO: 36854 - DNA, 25 bp, Rattus norvegicus
aagagtgccagttacaagtttgttg

SEQ ID NO: 36855 - DNA, 25 bp, Rattus norvegicus
aagagtgcggacaccctgtgggata

SEQ ID NO: 36856 - DNA, 25 bp, Rattus norvegicus
aagagtgcggactccctgtgggata

SEQ ID NO: 36857 - DNA, 25 bp, Rattus norvegicus
aagagtgcgtgtagacctggtacca

SEQ ID NO: 36858 - DNA, 25 bp, Rattus norvegicus
aagagtgcgtgttgacctggtacca

SEQ ID NO: 36859 - DNA, 25 bp, Rattus norvegicus
aagagtgctcataagcttcctgctg

SEQ ID NO: 36860 - DNA, 25 bp, Rattus norvegicus
aagagtgctcattagcttcctgctg

SEQ ID NO: 36861 - DNA, 25 bp, Rattus norvegicus
aagagtgctgtcatgcaggaggtat

SEQ ID NO: 36862 - DNA, 25 bp, Rattus norvegicus
aagagtgctgtcttgcaggaggtat

SEQ ID NO: 36863 - DNA, 25 bp, Rattus norvegicus
aagagtgcttacagcctgtgctggt

SEQ ID NO: 36864 - DNA, 25 bp, Rattus norvegicus
aagagtgcttactgcctgtgctggt

SEQ ID NO: 36865 - DNA, 25 bp, Rattus norvegicus
aagagtgcttgcatttgccgccatg

SEQ ID NO: 36866 - DNA, 25 bp, Rattus norvegicus
aagagtgcttgcttttgccgccatg

SEQ ID NO: 36867 - DNA, 25 bp, Rattus norvegicus
aagagtgcttggcatctgacgaaga

SEQ ID NO: 36868 - DNA, 25 bp, Rattus norvegicus
aagagtgcttgggatctgacgaaga

SEQ ID NO: 36869 - DNA, 25 bp, Rattus norvegicus
aagagtggacacacaactgcctggg

SEQ ID NO: 36870 - DNA, 25 bp, Rattus norvegicus
aagagtggacactcaactgcctggg

SEQ ID NO: 36871 - DNA, 25 bp, Rattus norvegicus
aagagtggacagaaggccgcagcct

SEQ ID NO: 36872 - DNA, 25 bp, Rattus norvegicus
aagagtggacagtaggccgcagcct

SEQ ID NO: 36873 - DNA, 25 bp, Rattus norvegicus
aagagtggacgcagagcccctggct

SEQ ID NO: 36874 - DNA, 25 bp, Rattus norvegicus
aagagtggacgctgagcccctggct

SEQ ID NO: 36875 - DNA, 25 bp, Rattus norvegicus
aagagtggaggtcaccttctccgat

SEQ ID NO: 36876 - DNA, 25 bp, Rattus norvegicus
aagagtggaggtgaccttctccgat

SEQ ID NO: 36877 - DNA, 25 bp, Rattus norvegicus
aagagtggatcgctcattccgagaa

SEQ ID NO: 36878 - DNA, 25 bp, Rattus norvegicus
aagagtggatcggtcattccgagaa

SEQ ID NO: 36879 - DNA, 25 bp, Rattus norvegicus
aagagtggcaacatatggtcctagt

SEQ ID NO: 36880 - DNA, 25 bp, Rattus norvegicus
aagagtggcaacttatggtcctagt

SEQ ID NO: 36881 - DNA, 25 bp, Rattus norvegicus
aagagtggccggacctaccatgagg

SEQ ID NO: 36882 - DNA, 25 bp, Rattus norvegicus
aagagtggccggtcctaccatgagg

SEQ ID NO: 36883 - DNA, 25 bp, Rattus norvegicus
aagagtggcgaaatcaaccctgtaa

SEQ ID NO: 36884 - DNA, 25 bp, Rattus norvegicus
aagagtggcgaattcaaccctgtaa

SEQ ID NO: 36885 - DNA, 25 bp, Rattus norvegicus
aagagtggcttgcagcctaactgat

SEQ ID NO: 36886 - DNA, 25 bp, Rattus norvegicus
aagagtggcttggagcctaactgat

SEQ ID NO: 36887 - DNA, 25 bp, Rattus norvegicus
aagagtgggcagaccttcaggtctc

SEQ ID NO: 36888 - DNA, 25 bp, Rattus norvegicus
aagagtgggcagtccttcaggtctc

SEQ ID NO: 36889 - DNA, 25 bp, Rattus norvegicus
aagagtgggctgatccaccgtggca

SEQ ID NO: 36890 - DNA, 25 bp, Rattus norvegicus
aagagtgggctgttccaccgtggca

SEQ ID NO: 36891 - DNA, 25 bp, Rattus norvegicus
aagagtgggtcacatgccctggaac

SEQ ID NO: 36892 - DNA, 25 bp, Rattus norvegicus
aagagtgggtcagatgccctggaac

SEQ ID NO: 36893 - DNA, 25 bp, Rattus norvegicus
aagagtggtcctccttttgtggact

SEQ ID NO: 36894 - DNA, 25 bp, Rattus norvegicus
aagagtggtcctgcttttgtggact

SEQ ID NO: 36895 - DNA, 25 bp, Rattus norvegicus
aagagtggtcttcatctgcttctca

SEQ ID NO: 36896 - DNA, 25 bp, Rattus norvegicus
aagagtggtcttgatctgcttctca

SEQ ID NO: 36897 - DNA, 25 bp, Rattus norvegicus
aagagtggtggcatgcattgttcct

SEQ ID NO: 36898 - DNA, 25 bp, Rattus norvegicus
aagagtggtggcttgcattgttcct

SEQ ID NO: 36899 - DNA, 25 bp, Rattus norvegicus
aagagtggtttgaactttggagaat

SEQ ID NO: 36900 - DNA, 25 bp, Rattus norvegicus
aagagtggtttgtactttggagaat

SEQ ID NO: 36901 - DNA, 25 bp, Rattus norvegicus
aagagtgtacctccaaatatttttg

SEQ ID NO: 36902 - DNA, 25 bp, Rattus norvegicus
aagagtgtacctgcaaatatttttg

SEQ ID NO: 36903 - DNA, 25 bp, Rattus norvegicus
aagagtgtatctagccttcaggtct

SEQ ID NO: 36904 - DNA, 25 bp, Rattus norvegicus
aagagtgtatcttgccttcaggtct

SEQ ID NO: 36905 - DNA, 25 bp, Rattus norvegicus
aagagtgtcactagtacccacggcg

SEQ ID NO: 36906 - DNA, 25 bp, Rattus norvegicus
aagagtgtcacttgtacccacggcg

SEQ ID NO: 36907 - DNA, 25 bp, Rattus norvegicus
aagagtgtcagtcccaagaacttgg

SEQ ID NO: 36908 - DNA, 25 bp, Rattus norvegicus
aagagtgtcagtgccaagaacttgg

SEQ ID NO: 36909 - DNA, 25 bp, Rattus norvegicus
aagagtgtcccaatcttgagcctca

SEQ ID NO: 36910 - DNA, 25 bp, Rattus norvegicus
aagagtgtcccattcttgagcctca

SEQ ID NO: 36911 - DNA, 25 bp, Rattus norvegicus
aagagtgtctacagcctggtttgcc

SEQ ID NO: 36912 - DNA, 25 bp, Rattus norvegicus
aagagtgtctactgcctggtttgcc

SEQ ID NO: 36913 - DNA, 25 bp, Rattus norvegicus
aagagtgtgctgaccactcagcata

SEQ ID NO: 36914 - DNA, 25 bp, Rattus norvegicus
aagagtgtgctgtccactcagcata

SEQ ID NO: 36915 - DNA, 25 bp, Rattus norvegicus
aagagtgtggctctgtttgcacaac

SEQ ID NO: 36916 - DNA, 25 bp, Rattus norvegicus
aagagtgtggctgtgtttgcacaac

SEQ ID NO: 36917 - DNA, 25 bp, Rattus norvegicus
aagagtgtgtcaatggaaacagaat

SEQ ID NO: 36918 - DNA, 25 bp, Rattus norvegicus
aagagtgtgtcattggaaacagaat

SEQ ID NO: 36919 - DNA, 25 bp, Rattus norvegicus
aagagttacctcaagtgcgtacata

SEQ ID NO: 36920 - DNA, 25 bp, Rattus norvegicus
aagagttacctctagtgcgtacata

SEQ ID NO: 36921 - DNA, 25 bp, Rattus norvegicus
aagagttacgtgaagctgccctccg

SEQ ID NO: 36922 - DNA, 25 bp, Rattus norvegicus
aagagttacgtgtagctgccctccg

SEQ ID NO: 36923 - DNA, 25 bp, Rattus norvegicus
aagagttagcgcagctcctgggttc

SEQ ID NO: 36924 - DNA, 25 bp, Rattus norvegicus
aagagttagcgctgctcctgggttc

SEQ ID NO: 36925 - DNA, 25 bp, Rattus norvegicus
aagagttaggatagccattaccaaa

SEQ ID NO: 36926 - DNA, 25 bp, Rattus norvegicus
aagagttaggattgccattaccaaa

SEQ ID NO: 36927 - DNA, 25 bp, Rattus norvegicus
aagagttaggcacctttcccctgat

SEQ ID NO: 36928 - DNA, 25 bp, Rattus norvegicus
aagagttaggcagctttcccctgat

SEQ ID NO: 36929 - DNA, 25 bp, Rattus norvegicus
aagagttatcagacctttgacaagg

SEQ ID NO: 36930 - DNA, 25 bp, Rattus norvegicus
aagagttatcagtcctttgacaagg

SEQ ID NO: 36931 - DNA, 25 bp, Rattus norvegicus
aagagttcacccatcaatatggagt

SEQ ID NO: 36932 - DNA, 25 bp, Rattus norvegicus
aagagttcacccttcaatatggagt

SEQ ID NO: 36933 - DNA, 25 bp, Rattus norvegicus
aagagttcagacacttccctttggg

SEQ ID NO: 36934 - DNA, 25 bp, Rattus norvegicus
aagagttcagactcttccctttggg

SEQ ID NO: 36935 - DNA, 25 bp, Rattus norvegicus
aagagttcagctaacaccacagcca

SEQ ID NO: 36936 - DNA, 25 bp, Rattus norvegicus
aagagttcagcttacaccacagcca

SEQ ID NO: 36937 - DNA, 25 bp, Rattus norvegicus
aagagttcagtcacggatcctgcac

SEQ ID NO: 36938 - DNA, 25 bp, Rattus norvegicus
aagagttcagtctcggatcctgcac

SEQ ID NO: 36939 - DNA, 25 bp, Rattus norvegicus
aagagttccactattgtggtcctgg

SEQ ID NO: 36940 - DNA, 25 bp, Rattus norvegicus
aagagttccacttttgtggtcctgg

SEQ ID NO: 36941 - DNA, 25 bp, Rattus norvegicus
aagagttcccacatatctcatgcag

SEQ ID NO: 36942 - DNA, 25 bp, Rattus norvegicus
aagagttcccacttatctcatgcag

SEQ ID NO: 36943 - DNA, 25 bp, Rattus norvegicus
aagagttcccttagaccaggcatgg

SEQ ID NO: 36944 - DNA, 25 bp, Rattus norvegicus
aagagttcccttcagaccatggagt

SEQ ID NO: 36945 - DNA, 25 bp, Rattus norvegicus
aagagttcccttgagaccatggagt

SEQ ID NO: 36946 - DNA, 25 bp, Rattus norvegicus
aagagttccctttgaccaggcatgg

SEQ ID NO: 36947 - DNA, 25 bp, Rattus norvegicus
aagagttcctatatcaggctcggac

SEQ ID NO: 36948 - DNA, 25 bp, Rattus norvegicus
aagagttcctatttcaggctcggac

SEQ ID NO: 36949 - DNA, 25 bp, Rattus norvegicus
aagagttcctgaagccagacctgaa

SEQ ID NO: 36950 - DNA, 25 bp, Rattus norvegicus
aagagttcctgatgccagacctgaa

SEQ ID NO: 36951 - DNA, 25 bp, Rattus norvegicus
aagagttccttgacacctctgtggt

SEQ ID NO: 36952 - DNA, 25 bp, Rattus norvegicus
aagagttccttgtcacctctgtggt

SEQ ID NO: 36953 - DNA, 25 bp, Rattus norvegicus
aagagttcgctcagctactggcgca

SEQ ID NO: 36954 - DNA, 25 bp, Rattus norvegicus
aagagttcgctctgctactggcgca

SEQ ID NO: 36955 - DNA, 25 bp, Rattus norvegicus
aagagttcggctacctatcgagggt

SEQ ID NO: 36956 - DNA, 25 bp, Rattus norvegicus
aagagttcggcttcctatcgagggt

SEQ ID NO: 36957 - DNA, 25 bp, Rattus norvegicus
aagagttctcgacccactcaacatt

SEQ ID NO: 36958 - DNA, 25 bp, Rattus norvegicus
aagagttctcgagccactcaacatt

SEQ ID NO: 36959 - DNA, 25 bp, Rattus norvegicus
aagagttctgggactcaactcccaa

SEQ ID NO: 36960 - DNA, 25 bp, Rattus norvegicus
aagagttctgggtctcaactcccaa

SEQ ID NO: 36961 - DNA, 25 bp, Rattus norvegicus
aagagttctgtgcatctccagtgat

SEQ ID NO: 36962 - DNA, 25 bp, Rattus norvegicus
aagagttctgtggatctccagtgat

SEQ ID NO: 36963 - DNA, 25 bp, Rattus norvegicus
aagagttcttgcaggaatcccagcc

SEQ ID NO: 36964 - DNA, 25 bp, Rattus norvegicus
aagagttcttgctggaatcccagcc

SEQ ID NO: 36965 - DNA, 25 bp, Rattus norvegicus
aagagttcttggagctccagcggca

SEQ ID NO: 36966 - DNA, 25 bp, Rattus norvegicus
aagagttcttggtgctccagcggca

SEQ ID NO: 36967 - DNA, 25 bp, Rattus norvegicus
aagagttctttgaggacttccgtga

SEQ ID NO: 36968 - DNA, 25 bp, Rattus norvegicus
aagagttctttgaggcaggattctg

SEQ ID NO: 36969 - DNA, 25 bp, Rattus norvegicus
aagagttctttgtggacttccgtga

SEQ ID NO: 36970 - DNA, 25 bp, Rattus norvegicus
aagagttctttgtggcaggattctg

SEQ ID NO: 36971 - DNA, 25 bp, Rattus norvegicus
aagagttgacaaatgggacctcata

SEQ ID NO: 36972 - DNA, 25 bp, Rattus norvegicus
aagagttgacaattgggacctcata

SEQ ID NO: 36973 - DNA, 25 bp, Rattus norvegicus
aagagttgacagaggctgccaaggc

SEQ ID NO: 36974 - DNA, 25 bp, Rattus norvegicus
aagagttgacagtggctgccaaggc

SEQ ID NO: 36975 - DNA, 25 bp, Rattus norvegicus
aagagttgcctgctctggtgacaga

SEQ ID NO: 36976 - DNA, 25 bp, Rattus norvegicus
aagagttgcctggtctggtgacaga

SEQ ID NO: 36977 - DNA, 25 bp, Rattus norvegicus
aagagttgctgacattgcctgctga

SEQ ID NO: 36978 - DNA, 25 bp, Rattus norvegicus
aagagttgctgagattgcctgctga

SEQ ID NO: 36979 - DNA, 25 bp, Rattus norvegicus
aagagttggagtcccttgttctgct

SEQ ID NO: 36980 - DNA, 25 bp, Rattus norvegicus
aagagttggagtgccttgttctgct

SEQ ID NO: 36981 - DNA, 25 bp, Rattus norvegicus
aagagttggcaacataacgggaccg

SEQ ID NO: 36982 - DNA, 25 bp, Rattus norvegicus
aagagttggcaacttttgaccaggt

SEQ ID NO: 36983 - DNA, 25 bp, Rattus norvegicus
aagagttggcaagataacgggaccg

SEQ ID NO: 36984 - DNA, 25 bp, Rattus norvegicus
aagagttggcaagttttgaccaggt

SEQ ID NO: 36985 - DNA, 25 bp, Rattus norvegicus
aagagttggctccaaactgcccgca

SEQ ID NO: 36986 - DNA, 25 bp, Rattus norvegicus
aagagttggctcgaaactgcccgca

SEQ ID NO: 36987 - DNA, 25 bp, Rattus norvegicus
aagagttgggttcctgcactctctg

SEQ ID NO: 36988 - DNA, 25 bp, Rattus norvegicus
aagagttgggttgctgcactctctg

SEQ ID NO: 36989 - DNA, 25 bp, Rattus norvegicus
aagagttggtatctcttccttctcg

SEQ ID NO: 36990 - DNA, 25 bp, Rattus norvegicus
aagagttggtatgtcttccttctcg

SEQ ID NO: 36991 - DNA, 25 bp, Rattus norvegicus
aagagttgtcctcagggaaggcctc

SEQ ID NO: 36992 - DNA, 25 bp, Rattus norvegicus
aagagttgtcctgagggaaggcctc

SEQ ID NO: 36993 - DNA, 25 bp, Rattus norvegicus
aagagttgtgcgagctctcagttgc

SEQ ID NO: 36994 - DNA, 25 bp, Rattus norvegicus
aagagttgtgcgtgctctcagttgc

SEQ ID NO: 36995 - DNA, 25 bp, Rattus norvegicus
aagagtttagccacctctgcagaag

SEQ ID NO: 36996 - DNA, 25 bp, Rattus norvegicus
aagagtttagcctcctctgcagaag

SEQ ID NO: 36997 - DNA, 25 bp, Rattus norvegicus
aagagtttatgcctcgtgctgtgtg

SEQ ID NO: 36998 - DNA, 25 bp, Rattus norvegicus
aagagtttatgcgtcgtgctgtgtg

SEQ ID NO: 36999 - DNA, 25 bp, Rattus norvegicus
aagagtttcctcagttgtgcataga

SEQ ID NO: 37000 - DNA, 25 bp, Rattus norvegicus
aagagtttcctctgttgtgcataga

SEQ ID NO: 37001 - DNA, 25 bp, Rattus norvegicus
aagagtttcgtccaggttcttccat

SEQ ID NO: 37002 - DNA, 25 bp, Rattus norvegicus
aagagtttcgtcgaggttcttccat

SEQ ID NO: 37003 - DNA, 25 bp, Rattus norvegicus
aagagtttctccagcatgtatatag

SEQ ID NO: 37004 - DNA, 25 bp, Rattus norvegicus
aagagtttctcctgcatgtatatag

SEQ ID NO: 37005 - DNA, 25 bp, Rattus norvegicus
aagagtttcttcaggagatagcagt

SEQ ID NO: 37006 - DNA, 25 bp, Rattus norvegicus
aagagtttcttctggagatagcagt

SEQ ID NO: 37007 - DNA, 25 bp, Rattus norvegicus
aagagtttgagcaccagccatgcac

SEQ ID NO: 37008 - DNA, 25 bp, Rattus norvegicus
aagagtttgagcctcacacttgtcc

SEQ ID NO: 37009 - DNA, 25 bp, Rattus norvegicus
aagagtttgagcgtcacacttgtcc

SEQ ID NO: 37010 - DNA, 25 bp, Rattus norvegicus
aagagtttgagctccagccatgcac

SEQ ID NO: 37011 - DNA, 25 bp, Rattus norvegicus
aagagtttgattccaggcccaggta

SEQ ID NO: 37012 - DNA, 25 bp, Rattus norvegicus
aagagtttgattgcaggcccaggta

SEQ ID NO: 37013 - DNA, 25 bp, Rattus norvegicus
aagagtttgcagcttacagagacac

SEQ ID NO: 37014 - DNA, 25 bp, Rattus norvegicus
aagagtttgcaggttacagagacac

SEQ ID NO: 37015 - DNA, 25 bp, Rattus norvegicus
aagagtttgcttagagatccacaga

SEQ ID NO: 37016 - DNA, 25 bp, Rattus norvegicus
aagagtttgctttgagatccacaga

SEQ ID NO: 37017 - DNA, 25 bp, Rattus norvegicus
aagagtttgtatcttcgtgctcgat

SEQ ID NO: 37018 - DNA, 25 bp, Rattus norvegicus
aagagtttgtatgttcgtgctcgat

SEQ ID NO: 37019 - DNA, 25 bp, Rattus norvegicus
aagagttttcctcgcccagctgggc

SEQ ID NO: 37020 - DNA, 25 bp, Rattus norvegicus
aagagttttcctggcccagctgggc

SEQ ID NO: 37021 - DNA, 25 bp, Rattus norvegicus
aagagttttctcagggcgggtcagt

SEQ ID NO: 37022 - DNA, 25 bp, Rattus norvegicus
aagagttttctctgggcgggtcagt

SEQ ID NO: 37023 - DNA, 25 bp, Rattus norvegicus
aagagtttttttaatgctgacataa

SEQ ID NO: 37024 - DNA, 25 bp, Rattus norvegicus
aagagttttttttatgctgacataa

SEQ ID NO: 37025 - DNA, 25 bp, Rattus norvegicus
aagataaaagttctgactcaagaag

SEQ ID NO: 37026 - DNA, 25 bp, Rattus norvegicus
aagataaaagttgtgactcaagaag

SEQ ID NO: 37027 - DNA, 25 bp, Rattus norvegicus
aagataaaccatccccagagcccag

SEQ ID NO: 37028 - DNA, 25 bp, Rattus norvegicus
aagataaaccatgcccagagcccag

SEQ ID NO: 37029 - DNA, 25 bp, Rattus norvegicus
aagataaaccccatggacctcactg

SEQ ID NO: 37030 - DNA, 25 bp, Rattus norvegicus
aagataaaccccttggacctcactg

SEQ ID NO: 37031 - DNA, 25 bp, Rattus norvegicus
aagataaccccacattctacattgc

SEQ ID NO: 37032 - DNA, 25 bp, Rattus norvegicus
aagataaccccagattctacattgc

SEQ ID NO: 37033 - DNA, 25 bp, Rattus norvegicus
aagataacctcgcaccatggctttt

SEQ ID NO: 37034 - DNA, 25 bp, Rattus norvegicus
aagataacctcggaccatggctttt

SEQ ID NO: 37035 - DNA, 25 bp, Rattus norvegicus
aagataacctgtatatctgaaacaa

SEQ ID NO: 37036 - DNA, 25 bp, Rattus norvegicus
aagataacctgtttatctgaaacaa

SEQ ID NO: 37037 - DNA, 25 bp, Rattus norvegicus
aagataacttgactgtccctctcca

SEQ ID NO: 37038 - DNA, 25 bp, Rattus norvegicus
aagataacttgagtgtccctctcca

SEQ ID NO: 37039 - DNA, 25 bp, Rattus norvegicus
aagataagctctacctccatagtac

SEQ ID NO: 37040 - DNA, 25 bp, Rattus norvegicus
aagataagctcttcctccatagtac

SEQ ID NO: 37041 - DNA, 25 bp, Rattus norvegicus
aagataaggactccctgacagccac

SEQ ID NO: 37042 - DNA, 25 bp, Rattus norvegicus
aagataaggactgcctgacagccac

SEQ ID NO: 37043 - DNA, 25 bp, Rattus norvegicus
aagataatccatacaagcacattta

SEQ ID NO: 37044 - DNA, 25 bp, Rattus norvegicus
aagataatccattcaagcacattta

SEQ ID NO: 37045 - DNA, 25 bp, Rattus norvegicus
aagataatcttgatgcgtttcccca

SEQ ID NO: 37046 - DNA, 25 bp, Rattus norvegicus
aagataatcttgttgcgtttcccca

SEQ ID NO: 37047 - DNA, 25 bp, Rattus norvegicus
aagataatggagacttcctcacccc

SEQ ID NO: 37048 - DNA, 25 bp, Rattus norvegicus
aagataatggagtcttcctcacccc

SEQ ID NO: 37049 - DNA, 25 bp, Rattus norvegicus
aagataattctgatctgtcatgatt

SEQ ID NO: 37050 - DNA, 25 bp, Rattus norvegicus
aagataattctgttctgtcatgatt

SEQ ID NO: 37051 - DNA, 25 bp, Rattus norvegicus
aagatacacatgctgaccccagaca

SEQ ID NO: 37052 - DNA, 25 bp, Rattus norvegicus
aagatacacatggtgaccccagaca

SEQ ID NO: 37053 - DNA, 25 bp, Rattus norvegicus
aagatacacgcacgaaccccgagtt

SEQ ID NO: 37054 - DNA, 25 bp, Rattus norvegicus
aagatacacgcaggaaccccgagtt

SEQ ID NO: 37055 - DNA, 25 bp, Rattus norvegicus
aagatacagcttatctggttacaga

SEQ ID NO: 37056 - DNA, 25 bp, Rattus norvegicus
aagatacagcttttctggttacaga

SEQ ID NO: 37057 - DNA, 25 bp, Rattus norvegicus
aagatacattcaattctcccggaat

SEQ ID NO: 37058 - DNA, 25 bp, Rattus norvegicus
aagatacattcatttctcccggaat

SEQ ID NO: 37059 - DNA, 25 bp, Rattus norvegicus
aagatacattccacttctgttctgc

SEQ ID NO: 37060 - DNA, 25 bp, Rattus norvegicus
aagatacattcccagcttcagtctc

SEQ ID NO: 37061 - DNA, 25 bp, Rattus norvegicus
aagatacattccgagcttcagtctc

SEQ ID NO: 37062 - DNA, 25 bp, Rattus norvegicus
aagatacattcctcttctgttctgc

SEQ ID NO: 37063 - DNA, 25 bp, Rattus norvegicus
aagataccagcacgctgcacagctt

SEQ ID NO: 37064 - DNA, 25 bp, Rattus norvegicus
aagataccagcaggctgcacagctt

SEQ ID NO: 37065 - DNA, 25 bp, Rattus norvegicus
aagatacccaaaccacatcttcagt

SEQ ID NO: 37066 - DNA, 25 bp, Rattus norvegicus
aagatacccaaagcacatcttcagt

SEQ ID NO: 37067 - DNA, 25 bp, Rattus norvegicus
aagatacccaatccattgttgcaga

SEQ ID NO: 37068 - DNA, 25 bp, Rattus norvegicus
aagatacccaatgcattgttgcaga

SEQ ID NO: 37069 - DNA, 25 bp, Rattus norvegicus
aagatacccacgagaggtccagctg

SEQ ID NO: 37070 - DNA, 25 bp, Rattus norvegicus
aagatacccacgtgaggtccagctg

SEQ ID NO: 37071 - DNA, 25 bp, Rattus norvegicus
aagataccggtaatcaagctgttga

SEQ ID NO: 37072 - DNA, 25 bp, Rattus norvegicus
aagataccggtattcaagctgttga

SEQ ID NO: 37073 - DNA, 25 bp, Rattus norvegicus
aagatacctccaattgtaacggcga

SEQ ID NO: 37074 - DNA, 25 bp, Rattus norvegicus
aagatacctccatttgtaacggcga

SEQ ID NO: 37075 - DNA, 25 bp, Rattus norvegicus
aagataccttgaaacattttccatt

SEQ ID NO: 37076 - DNA, 25 bp, Rattus norvegicus
aagataccttgaaggctcagcttct

SEQ ID NO: 37077 - DNA, 25 bp, Rattus norvegicus
aagataccttgatacattttccatt

SEQ ID NO: 37078 - DNA, 25 bp, Rattus norvegicus
aagataccttgatggctcagcttct

SEQ ID NO: 37079 - DNA, 25 bp, Rattus norvegicus
aagataccttgtacaagcccggctt

SEQ ID NO: 37080 - DNA, 25 bp, Rattus norvegicus
aagataccttgttcaagcccggctt

SEQ ID NO: 37081 - DNA, 25 bp, Rattus norvegicus
aagatacgtactccaggcccagatt

SEQ ID NO: 37082 - DNA, 25 bp, Rattus norvegicus
aagatacgtactgcaggcccagatt

SEQ ID NO: 37083 - DNA, 25 bp, Rattus norvegicus
aagatacgttctcggcttccataga

SEQ ID NO: 37084 - DNA, 25 bp, Rattus norvegicus
aagatacgttctgggcttccataga

SEQ ID NO: 37085 - DNA, 25 bp, Rattus norvegicus
aagatactcacaagtggtccacacc

SEQ ID NO: 37086 - DNA, 25 bp, Rattus norvegicus
aagatactcacatgtggtccacacc

SEQ ID NO: 37087 - DNA, 25 bp, Rattus norvegicus
aagatactccacaagttggcctagg

SEQ ID NO: 37088 - DNA, 25 bp, Rattus norvegicus
aagatactccactagttggcctagg

SEQ ID NO: 37089 - DNA, 25 bp, Rattus norvegicus
aagatactccggctaccaacgtttg

SEQ ID NO: 37090 - DNA, 25 bp, Rattus norvegicus
aagatactccgggtaccaacgtttg

SEQ ID NO: 37091 - DNA, 25 bp, Rattus norvegicus
aagatactcggtctctgtttccaga

SEQ ID NO: 37092 - DNA, 25 bp, Rattus norvegicus
aagatactcggtgtctgtttccaga

SEQ ID NO: 37093 - DNA, 25 bp, Rattus norvegicus
aagatacttcttccttctctagagg

SEQ ID NO: 37094 - DNA, 25 bp, Rattus norvegicus
aagatacttcttgcttctctagagg

SEQ ID NO: 37095 - DNA, 25 bp, Rattus norvegicus
aagatactttatatgcagcaggacc

SEQ ID NO: 37096 - DNA, 25 bp, Rattus norvegicus
aagatactttatttgcagcaggacc

SEQ ID NO: 37097 - DNA, 25 bp, Rattus norvegicus
aagatagagcggacccagcgggaca

SEQ ID NO: 37098 - DNA, 25 bp, Rattus norvegicus
aagatagagcggtcccagcgggaca

SEQ ID NO: 37099 - DNA, 25 bp, Rattus norvegicus
aagatagcatctcacggtaccttcc

SEQ ID NO: 37100 - DNA, 25 bp, Rattus norvegicus
aagatagcatctgacggtaccttcc

SEQ ID NO: 37101 - DNA, 25 bp, Rattus norvegicus
aagatagcatggcagcccctgccta

SEQ ID NO: 37102 - DNA, 25 bp, Rattus norvegicus
aagatagcatgggagcccctgccta

SEQ ID NO: 37103 - DNA, 25 bp, Rattus norvegicus
aagatagcccatcccgtgtagaaaa

SEQ ID NO: 37104 - DNA, 25 bp, Rattus norvegicus
aagatagcccatgccgtgtagaaaa

SEQ ID NO: 37105 - DNA, 25 bp, Rattus norvegicus
aagatagccgctacccaaagatcct

SEQ ID NO: 37106 - DNA, 25 bp, Rattus norvegicus
aagatagccgcttcccaaagatcct

SEQ ID NO: 37107 - DNA, 25 bp, Rattus norvegicus
aagatagcgcttatagtgaacacag

SEQ ID NO: 37108 - DNA, 25 bp, Rattus norvegicus
aagatagcgcttttagtgaacacag

SEQ ID NO: 37109 - DNA, 25 bp, Rattus norvegicus
aagatagctctacacaattgggatc

SEQ ID NO: 37110 - DNA, 25 bp, Rattus norvegicus
aagatagctctagacaattgggatc

SEQ ID NO: 37111 - DNA, 25 bp, Rattus norvegicus
aagatagctttcaatgtttcagcat

SEQ ID NO: 37112 - DNA, 25 bp, Rattus norvegicus
aagatagctttctatgtttcagcat

SEQ ID NO: 37113 - DNA, 25 bp, Rattus norvegicus
aagatagggccaaggccaagcccca

SEQ ID NO: 37114 - DNA, 25 bp, Rattus norvegicus
aagatagggccatggccaagcccca

SEQ ID NO: 37115 - DNA, 25 bp, Rattus norvegicus
aagataggtactcccttagagataa

SEQ ID NO: 37116 - DNA, 25 bp, Rattus norvegicus
aagataggtactgccttagagataa

SEQ ID NO: 37117 - DNA, 25 bp, Rattus norvegicus
aagatagtaactacagagcttagct

SEQ ID NO: 37118 - DNA, 25 bp, Rattus norvegicus
aagatagtaacttcagagcttagct

SEQ ID NO: 37119 - DNA, 25 bp, Rattus norvegicus
aagatagtcagcatcctcagaacct

SEQ ID NO: 37120 - DNA, 25 bp, Rattus norvegicus
aagatagtcagcttcctcagaacct

SEQ ID NO: 37121 - DNA, 25 bp, Rattus norvegicus
aagatagtgtttcccggccatgagc

SEQ ID NO: 37122 - DNA, 25 bp, Rattus norvegicus
aagatagtgtttgccggccatgagc

SEQ ID NO: 37123 - DNA, 25 bp, Rattus norvegicus
aagatagttcacacgcatggtccct

SEQ ID NO: 37124 - DNA, 25 bp, Rattus norvegicus
aagatagttcactcgcatggtccct

SEQ ID NO: 37125 - DNA, 25 bp, Rattus norvegicus
aagatataatcaatctattggagag

SEQ ID NO: 37126 - DNA, 25 bp, Rattus norvegicus
aagatataatcattctattggagag

SEQ ID NO: 37127 - DNA, 25 bp, Rattus norvegicus
aagatatactacaagctgcaaaaca

SEQ ID NO: 37128 - DNA, 25 bp, Rattus norvegicus
aagatatactactagctgcaaaaca

SEQ ID NO: 37129 - DNA, 25 bp, Rattus norvegicus
aagatatattctaggctccatgatt

SEQ ID NO: 37130 - DNA, 25 bp, Rattus norvegicus
aagatatattcttggctccatgatt

SEQ ID NO: 37131 - DNA, 25 bp, Rattus norvegicus
aagatatcctcaattgctccactgc

SEQ ID NO: 37132 - DNA, 25 bp, Rattus norvegicus
aagatatcctcatttgctccactgc

SEQ ID NO: 37133 - DNA, 25 bp, Rattus norvegicus
aagatatctcacctactgacggtgg

SEQ ID NO: 37134 - DNA, 25 bp, Rattus norvegicus
aagatatctcacgtactgacggtgg

SEQ ID NO: 37135 - DNA, 25 bp, Rattus norvegicus
aagatatctctaagttccccttcaa

SEQ ID NO: 37136 - DNA, 25 bp, Rattus norvegicus
aagatatctctatgttccccttcaa

SEQ ID NO: 37137 - DNA, 25 bp, Rattus norvegicus
aagatatcttcacctgtgggctgat

SEQ ID NO: 37138 - DNA, 25 bp, Rattus norvegicus
aagatatcttcagctgtgggctgat

SEQ ID NO: 37139 - DNA, 25 bp, Rattus norvegicus
aagatatcttctccctctttatgcc

SEQ ID NO: 37140 - DNA, 25 bp, Rattus norvegicus
aagatatcttctgcctctttatgcc

SEQ ID NO: 37141 - DNA, 25 bp, Rattus norvegicus
aagatatgcattcgccagctcactg

SEQ ID NO: 37142 - DNA, 25 bp, Rattus norvegicus
aagatatgcattggccagctcactg

SEQ ID NO: 37143 - DNA, 25 bp, Rattus norvegicus
aagatatggaggacagacactggat

SEQ ID NO: 37144 - DNA, 25 bp, Rattus norvegicus
aagatatggaggtcagacactggat

SEQ ID NO: 37145 - DNA, 25 bp, Rattus norvegicus
aagatatgtgtcactctatagacca

SEQ ID NO: 37146 - DNA, 25 bp, Rattus norvegicus
aagatatgtgtctctctatagacca

SEQ ID NO: 37147 - DNA, 25 bp, Rattus norvegicus
aagatattcaacctgtaccctcgca

SEQ ID NO: 37148 - DNA, 25 bp, Rattus norvegicus
aagatattcaacgtgtaccctcgca

(The sequence listing continues in the following parts.)

What is claimed is:

1. An array comprising a plurality of nucleic acid probes, wherein the plurality comprises each of the sequences listed in SEQ ID Nos. 1-699,466, and wherein each probe in the plurality of nucleic acid probes consists of one of the sequences listed in SEQ ID Nos. 1-699,466.

2. The array of claim 1 wherein said plurality of nucleic acid probes is attached to a solid support.

3. The array of claim 1 wherein the array comprises a plurality of beads wherein the probes are attached to the beads and the probes on a bead consist of one of the sequences listed in SEQ ID Nos. 1-699,466.

4. The array of claim 1 wherein the array consists of a single contiguous solid support.

5. A method of monitoring gene expression levels in a biological sample from a rat comprising:
   isolating nucleic acid derived from the sample;
   labeling the nucleic acid;
   hybridizing the labeled nucleic acid to the array of claim 1; and,
   detecting the hybridization pattern, wherein the intensity of signal resulting from hybridization to probes on the array is used to monitor gene expression levels.

6. The method of claim 5 wherein said monitoring gene expression levels comprises comparing gene expression levels of nucleic acids derived from two or more different samples and further comprises the step of:
   comparing said hybridization patterns between said nucleic acid derived from said two or more different samples.

7. The method of claim 5 wherein the labeled nucleic acid hybridized to the array consists essentially of DNA.

8. The method of claim 5 wherein the labeled nucleic acid hybridized to the array consists essentially of RNA that is complementary to target mRNA.

9. The method of claim 5 wherein the labeled nucleic acid hybridized to the array consists essentially of RNA that is in the sense orientation relative to target mRNA.

10. The method of claim 5 wherein the labeled nucleic acid is hybridized to the array in a single reaction.

* * * * *